United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 27

SEQ ID NO: 1118521 - DNA, 13 bp, Homo sapiens
gtagtgagccgag

SEQ ID NO: 1118522 - DNA, 17 bp, Homo sapiens
gtagtgaggatcttgat

SEQ ID NO: 1118523 - DNA, 21 bp, Homo sapiens
gtagtgaggatcttgatttgg

SEQ ID NO: 1118524 - DNA, 14 bp, Homo sapiens
gtagtgcaaaatgg

SEQ ID NO: 1118525 - DNA, 18 bp, Homo sapiens
gtagtgcatttttaaact

SEQ ID NO: 1118526 - DNA, 13 bp, Homo sapiens
gtagtggaagagc

SEQ ID NO: 1118527 - DNA, 14 bp, Homo sapiens
gtagtggaagagca

SEQ ID NO: 1118528 - DNA, 16 bp, Homo sapiens
gtagtggaagagcagc

SEQ ID NO: 1118529 - DNA, 18 bp, Homo sapiens
gtagtggaagagcagcct

SEQ ID NO: 1118530 - DNA, 20 bp, Homo sapiens
gtagtggaagagcagcctga

SEQ ID NO: 1118531 - DNA, 21 bp, Homo sapiens
gtagtggaagagcagcctgat

SEQ ID NO: 1118532 - DNA, 14 bp, Homo sapiens
gtagtgttatcagg

SEQ ID NO: 1118533 - DNA, 21 bp, Homo sapiens
gtagtgttattgccaggaaag

SEQ ID NO: 1118534 - DNA, 15 bp, Homo sapiens
gtagttaaataactg

SEQ ID NO: 1118535 - DNA, 11 bp, Homo sapiens
gtagttaggaa

SEQ ID NO: 1118536 - DNA, 13 bp, Homo sapiens
gtagttaggaaat

SEQ ID NO: 1118537 - DNA, 14 bp, Homo sapiens
gtagttaggaaata

SEQ ID NO: 1118538 - DNA, 17 bp, Homo sapiens
gtagttatataattgtt

SEQ ID NO: 1118539 - DNA, 23 bp, Homo sapiens
gtagttccctgaaaacccagaga

SEQ ID NO: 1118540 - DNA, 15 bp, Homo sapiens
gtagttctctcattt

SEQ ID NO: 1118541 - DNA, 16 bp, Homo sapiens
gtagttctgtgcctcc

SEQ ID NO: 1118542 - DNA, 19 bp, Homo sapiens
gtagttgggtagaaaaatt

SEQ ID NO: 1118543 - DNA, 16 bp, Homo sapiens
gtagttgtctttcctg

SEQ ID NO: 1118544 - DNA, 17 bp, Homo sapiens
gtagtttagttctgttg

SEQ ID NO: 1118545 - DNA, 20 bp, Homo sapiens
gtatggctctgcacccctct

SEQ ID NO: 1118546 - DNA, 20 bp, Homo sapiens
gtatgggaaaaaaactgaag

SEQ ID NO: 1118547 - DNA, 19 bp, Homo sapiens
gtatgggtagggtaaatca

SEQ ID NO: 1118548 - DNA, 22 bp, Homo sapiens
gtatggtattacaaaacaaaca

SEQ ID NO: 1118549 - DNA, 11 bp, Homo sapiens
gtatgtaaaaa

SEQ ID NO: 1118550 - DNA, 16 bp, Homo sapiens
gtatgtaaataggttt

SEQ ID NO: 1118551 - DNA, 14 bp, Homo sapiens
gtatgtaaatgtgc

SEQ ID NO: 1118552 - DNA, 16 bp, Homo sapiens
gtatgtaacaattgtt

SEQ ID NO: 1118553 - DNA, 12 bp, Homo sapiens
gtatgtaacatg

SEQ ID NO: 1118554 - DNA, 22 bp, Homo sapiens
gtatgtaatgtgtggtggcctc

SEQ ID NO: 1118555 - DNA, 23 bp, Homo sapiens
gtatgtaatgtgtggtggcctca

SEQ ID NO: 1118556 - DNA, 16 bp, Homo sapiens
gtatgtaatttatgca

SEQ ID NO: 1118557 - DNA, 18 bp, Homo sapiens
gtatgtacaatacaatgt

SEQ ID NO: 1118558 - DNA, 19 bp, Homo sapiens
gtatgtacaatacaatgta

SEQ ID NO: 1118559 - DNA, 14 bp, Homo sapiens
gtatgtatacacac

SEQ ID NO: 1118560 - DNA, 15 bp, Homo sapiens
gtatgtatacacaca

SEQ ID NO: 1118561 - DNA, 15 bp, Homo sapiens
gtatgtatataatca

SEQ ID NO: 1118562 - DNA, 16 bp, Homo sapiens
gtatgtccttcagctg

SEQ ID NO: 1118563 - DNA, 11 bp, Homo sapiens
gtatgtctgcc

SEQ ID NO: 1118564 - DNA, 13 bp, Homo sapiens
gtatgtctgtttt

SEQ ID NO: 1118565 - DNA, 21 bp, Homo sapiens
gtatgtctgtttttgtatctt

SEQ ID NO: 1118566 - DNA, 13 bp, Homo sapiens
gtatgtgactttt

SEQ ID NO: 1118567 - DNA, 13 bp, Homo sapiens
gtatgtgagctgt

SEQ ID NO: 1118568 - DNA, 16 bp, Homo sapiens
gtatgtgcactgtcac

SEQ ID NO: 1118569 - DNA, 18 bp, Homo sapiens
gtatgtgccaggcttgcc

SEQ ID NO: 1118570 - DNA, 22 bp, Homo sapiens
gtatgtgtgcaggagcctccct

SEQ ID NO: 1118571 - DNA, 16 bp, Homo sapiens
gtatgtgtgtaggtta

SEQ ID NO: 1118572 - DNA, 14 bp, Homo sapiens
gtatgtgtgtgagt

SEQ ID NO: 1118573 - DNA, 19 bp, Homo sapiens
gtatgtgtgtgtgggtgtg

SEQ ID NO: 1118574 - DNA, 14 bp, Homo sapiens
gtatgttaatatgt

SEQ ID NO: 1118575 - DNA, 13 bp, Homo sapiens
gtatgttatagaa

SEQ ID NO: 1118576 - DNA, 22 bp, Homo sapiens
gtatgttatgatattgtttaaa

SEQ ID NO: 1118577 - DNA, 16 bp, Homo sapiens
gtatgttattcctggt

SEQ ID NO: 1118578 - DNA, 13 bp, Homo sapiens
gtatgttcctaag

SEQ ID NO: 1118579 - DNA, 19 bp, Homo sapiens
gtatgttctaacctttaca

SEQ ID NO: 1118580 - DNA, 14 bp, Homo sapiens
gtatgttgtcataa

SEQ ID NO: 1118581 - DNA, 11 bp, Homo sapiens
gtatgttgtcc

SEQ ID NO: 1118582 - DNA, 18 bp, Homo sapiens
gtatgttgtccaattgtt

SEQ ID NO: 1118583 - DNA, 14 bp, Homo sapiens
gtatgttttagcat

SEQ ID NO: 1118584 - DNA, 14 bp, Homo sapiens
gtatgtttttacat

SEQ ID NO: 1118585 - DNA, 22 bp, Homo sapiens
gtatgtttttacattatgcaaa

SEQ ID NO: 1118586 - DNA, 23 bp, Homo sapiens
gtatgtttttacattatgcaaat

SEQ ID NO: 1118587 - DNA, 19 bp, Homo sapiens
gtattaaaaaaaaatactc

SEQ ID NO: 1118588 - DNA, 19 bp, Homo sapiens
gtattaaaaaaaacaaaaa

SEQ ID NO: 1118589 - DNA, 22 bp, Homo sapiens
gtattaaaaaaaacaaaaagaa

SEQ ID NO: 1118590 - DNA, 13 bp, Homo sapiens
gtattaaagacag

SEQ ID NO: 1118591 - DNA, 14 bp, Homo sapiens
gtattaaagggggg

SEQ ID NO: 1118592 - DNA, 13 bp, Homo sapiens
gtattaaatggtt

SEQ ID NO: 1118593 - DNA, 14 bp, Homo sapiens
gtattaaatggttt

SEQ ID NO: 1118594 - DNA, 22 bp, Homo sapiens
gtattaactttatacacttgga

SEQ ID NO: 1118595 - DNA, 18 bp, Homo sapiens
gtattaagccaaacatga

SEQ ID NO: 1118596 - DNA, 13 bp, Homo sapiens
gtattaagggtag

SEQ ID NO: 1118597 - DNA, 13 bp, Homo sapiens
gtattaagtgact

SEQ ID NO: 1118598 - DNA, 12 bp, Homo sapiens
gtattaataaaa

SEQ ID NO: 1118599 - DNA, 13 bp, Homo sapiens
gtattaataaaaa

SEQ ID NO: 1118600 - DNA, 14 bp, Homo sapiens
gtattaataaaaag

SEQ ID NO: 1118601 - DNA, 18 bp, Homo sapiens
gtattaataaaaagacaa

SEQ ID NO: 1118602 - DNA, 13 bp, Homo sapiens
gtattaataaagc

SEQ ID NO: 1118603 - DNA, 14 bp, Homo sapiens
gtattaataaagca

SEQ ID NO: 1118604 - DNA, 16 bp, Homo sapiens
gtattaataaagcatt

SEQ ID NO: 1118605 - DNA, 17 bp, Homo sapiens
gtattaataaagcattc

SEQ ID NO: 1118606 - DNA, 14 bp, Homo sapiens
gtattaatatatag

SEQ ID NO: 1118607 - DNA, 20 bp, Homo sapiens
gtattaatccccatcattac

SEQ ID NO: 1118608 - DNA, 23 bp, Homo sapiens
gtattaatctgtttgtgcaaaca

SEQ ID NO: 1118609 - DNA, 23 bp, Homo sapiens
gtattacacaagaccagtgctta

SEQ ID NO: 1118610 - DNA, 18 bp, Homo sapiens
gtattacactctgtaatt

SEQ ID NO: 1118611 - DNA, 15 bp, Homo sapiens
gtattacataaataa

SEQ ID NO: 1118612 - DNA, 14 bp, Homo sapiens
gtattaccattact

SEQ ID NO: 1118613 - DNA, 19 bp, Homo sapiens
gtattactgctgctgtgct

SEQ ID NO: 1118614 - DNA, 14 bp, Homo sapiens
gtattactttctgc

SEQ ID NO: 1118615 - DNA, 15 bp, Homo sapiens
gtattagctcactga

SEQ ID NO: 1118616 - DNA, 21 bp, Homo sapiens
gtattagctcactgaatcttc

SEQ ID NO: 1118617 - DNA, 14 bp, Homo sapiens
gtattagcttaccc

SEQ ID NO: 1118618 - DNA, 23 bp, Homo sapiens
gtattataaaagctcagatgaca

SEQ ID NO: 1118619 - DNA, 22 bp, Homo sapiens
gtattatcacatcaagcatgca

SEQ ID NO: 1118620 - DNA, 13 bp, Homo sapiens
gtattatgagcca

SEQ ID NO: 1118621 - DNA, 13 bp, Homo sapiens
gtattatgcaaca

SEQ ID NO: 1118622 - DNA, 17 bp, Homo sapiens
gtattatgcatatataa

SEQ ID NO: 1118623 - DNA, 23 bp, Homo sapiens
gtattatgtcctgtgagatgtgt

SEQ ID NO: 1118624 - DNA, 18 bp, Homo sapiens
gtattattttttaataaa

SEQ ID NO: 1118625 - DNA, 21 bp, Homo sapiens
gtattcaataccgctcagtat

SEQ ID NO: 1118626 - DNA, 20 bp, Homo sapiens
gtattcacatagtcctcagg

SEQ ID NO: 1118627 - DNA, 16 bp, Homo sapiens
gtattcaccccacacc

SEQ ID NO: 1118628 - DNA, 18 bp, Homo sapiens
gtattcaccctgggcagt

SEQ ID NO: 1118629 - DNA, 14 bp, Homo sapiens
gtattcagaaatta

SEQ ID NO: 1118630 - DNA, 20 bp, Homo sapiens
gtattcagaaattaaaatat

SEQ ID NO: 1118631 - DNA, 15 bp, Homo sapiens
gtattccaccttaaa

SEQ ID NO: 1118632 - DNA, 21 bp, Homo sapiens
gtattcccaaaaattactttg

SEQ ID NO: 1118633 - DNA, 15 bp, Homo sapiens
gtattcccactcacc

SEQ ID NO: 1118634 - DNA, 15 bp, Homo sapiens
gtattctagtggctg

SEQ ID NO: 1118635 - DNA, 13 bp, Homo sapiens
gtattctcagagc

SEQ ID NO: 1118636 - DNA, 22 bp, Homo sapiens
gtattctcagagcatgtgtcag

SEQ ID NO: 1118637 - DNA, 14 bp, Homo sapiens
gtattctctctatg

SEQ ID NO: 1118638 - DNA, 11 bp, Homo sapiens
gtattctctga

SEQ ID NO: 1118639 - DNA, 13 bp, Homo sapiens
gtattctctgagc

SEQ ID NO: 1118640 - DNA, 16 bp, Homo sapiens
gtattctctttacctt

SEQ ID NO: 1118641 - DNA, 21 bp, Homo sapiens
gtattctctttaccttctaaa

SEQ ID NO: 1118642 - DNA, 22 bp, Homo sapiens
gtattctctttaccttctaaaa

SEQ ID NO: 1118643 - DNA, 15 bp, Homo sapiens
gtattctgacatgta

SEQ ID NO: 1118644 - DNA, 12 bp, Homo sapiens
gtattctgtcat

SEQ ID NO: 1118645 - DNA, 13 bp, Homo sapiens
gtattctgtcatt

SEQ ID NO: 1118646 - DNA, 14 bp, Homo sapiens
gtattctgtggccg

SEQ ID NO: 1118647 - DNA, 17 bp, Homo sapiens
gtattctgttctggagg

SEQ ID NO: 1118648 - DNA, 15 bp, Homo sapiens
gtattcttgtttgaa

SEQ ID NO: 1118649 - DNA, 16 bp, Homo sapiens
gtattctttctgcctt

SEQ ID NO: 1118650 - DNA, 20 bp, Homo sapiens
gtattcttttccaagctcct

SEQ ID NO: 1118651 - DNA, 15 bp, Homo sapiens
gtattgaaaacactt

SEQ ID NO: 1118652 - DNA, 15 bp, Homo sapiens
gtattgaaaacttca

SEQ ID NO: 1118653 - DNA, 19 bp, Homo sapiens
gtattgaaaacttcaaagc

SEQ ID NO: 1118654 - DNA, 14 bp, Homo sapiens
gtattgaaagccaa

SEQ ID NO: 1118655 - DNA, 15 bp, Homo sapiens
gtattgactgtacca

SEQ ID NO: 1118656 - DNA, 18 bp, Homo sapiens
gtattgactttatgttgt

SEQ ID NO: 1118657 - DNA, 18 bp, Homo sapiens
gtattgagggccagtgat

SEQ ID NO: 1118658 - DNA, 13 bp, Homo sapiens
gtattgattacaa

SEQ ID NO: 1118659 - DNA, 23 bp, Homo sapiens
gtattgcatctgtataagtaaga

SEQ ID NO: 1118660 - DNA, 13 bp, Homo sapiens
gtattgccacctc

SEQ ID NO: 1118661 - DNA, 22 bp, Homo sapiens
gtattggacggtttctagcctc

SEQ ID NO: 1118662 - DNA, 22 bp, Homo sapiens
gtattggagcacatgttactgc

SEQ ID NO: 1118663 - DNA, 14 bp, Homo sapiens
gtattggcctggag

SEQ ID NO: 1118664 - DNA, 15 bp, Homo sapiens
gtattggcctggagg

SEQ ID NO: 1118665 - DNA, 13 bp, Homo sapiens
gtattggcctgtt

SEQ ID NO: 1118666 - DNA, 20 bp, Homo sapiens
gtattgggattacagacatg

SEQ ID NO: 1118667 - DNA, 18 bp, Homo sapiens
gtattgtaaaacattcac

SEQ ID NO: 1118668 - DNA, 17 bp, Homo sapiens
gtcatgtacttcctgtg

SEQ ID NO: 1118669 - DNA, 14 bp, Homo sapiens
gtcatgtatgcaag

SEQ ID NO: 1118670 - DNA, 15 bp, Homo sapiens
gtcatgtatgcaagt

SEQ ID NO: 1118671 - DNA, 14 bp, Homo sapiens
gtcatgtatgtttc

SEQ ID NO: 1118672 - DNA, 15 bp, Homo sapiens
gtcatgtattttatg

SEQ ID NO: 1118673 - DNA, 17 bp, Homo sapiens
gtcatgtgggtcttcca

SEQ ID NO: 1118674 - DNA, 20 bp, Homo sapiens
gtcatgtgtgcatgtgagca

SEQ ID NO: 1118675 - DNA, 16 bp, Homo sapiens
gtcatgtttgcagggg

SEQ ID NO: 1118676 - DNA, 17 bp, Homo sapiens
gtcattaaattactata

SEQ ID NO: 1118677 - DNA, 24 bp, Homo sapiens
gtcattaaattactatagcaaagt

SEQ ID NO: 1118678 - DNA, 14 bp, Homo sapiens
gtcattcagaaaaa

SEQ ID NO: 1118679 - DNA, 16 bp, Homo sapiens
gtcattcatatttgtc

SEQ ID NO: 1118680 - DNA, 16 bp, Homo sapiens
gtcattcgttctgtgg

SEQ ID NO: 1118681 - DNA, 14 bp, Homo sapiens
gtcattgctgctgc

SEQ ID NO: 1118682 - DNA, 15 bp, Homo sapiens
gtcattgtatgttat

SEQ ID NO: 1118683 - DNA, 12 bp, Homo sapiens
gtcattgtccag

SEQ ID NO: 1118684 - DNA, 15 bp, Homo sapiens
gtcattgtccagctg

SEQ ID NO: 1118685 - DNA, 13 bp, Homo sapiens
gtcattgtctact

SEQ ID NO: 1118686 - DNA, 14 bp, Homo sapiens
gtcatttcattcca

SEQ ID NO: 1118687 - DNA, 15 bp, Homo sapiens
gtcattttaaaatct

SEQ ID NO: 1118688 - DNA, 16 bp, Homo sapiens
gtcattttaaaatctg

SEQ ID NO: 1118689 - DNA, 21 bp, Homo sapiens
gtcattttaaaatctgattta

SEQ ID NO: 1118690 - DNA, 20 bp, Homo sapiens
gtcattttatgaatatcatt

SEQ ID NO: 1118691 - DNA, 18 bp, Homo sapiens
gtcattttggtactttgg

SEQ ID NO: 1118692 - DNA, 20 bp, Homo sapiens
gtcattttggtactttggtg

SEQ ID NO: 1118693 - DNA, 21 bp, Homo sapiens
gtcatttttaacagcatgctg

SEQ ID NO: 1118694 - DNA, 18 bp, Homo sapiens
gtcatttttaatgtatct

SEQ ID NO: 1118695 - DNA, 19 bp, Homo sapiens
gtcattttttttatattgc

SEQ ID NO: 1118696 - DNA, 19 bp, Homo sapiens
gtccaaaaaaaggaaaaat

SEQ ID NO: 1118697 - DNA, 21 bp, Homo sapiens
gtccaaaaaaaggaaaaataa

SEQ ID NO: 1118698 - DNA, 18 bp, Homo sapiens
gtccaaaagattgctgaa

SEQ ID NO: 1118699 - DNA, 15 bp, Homo sapiens
gtccaaacatttcat

SEQ ID NO: 1118700 - DNA, 20 bp, Homo sapiens
gtccaaacatttcatccgtg

SEQ ID NO: 1118701 - DNA, 16 bp, Homo sapiens
gtccaaagaggctgcc

SEQ ID NO: 1118702 - DNA, 14 bp, Homo sapiens
gtccaaaggaggct

SEQ ID NO: 1118703 - DNA, 15 bp, Homo sapiens
gtccaaaggccagcg

SEQ ID NO: 1118704 - DNA, 17 bp, Homo sapiens
gtccaaaggccagcggt

SEQ ID NO: 1118705 - DNA, 22 bp, Homo sapiens
gtccaacaagaatgcattccct

SEQ ID NO: 1118706 - DNA, 20 bp, Homo sapiens
gtccaacctaacccctttcc

SEQ ID NO: 1118707 - DNA, 19 bp, Homo sapiens
gtccaactcacttccagtg

SEQ ID NO: 1118708 - DNA, 14 bp, Homo sapiens
gtccaagcagagtg

SEQ ID NO: 1118709 - DNA, 12 bp, Homo sapiens
gtccaatcctat

SEQ ID NO: 1118710 - DNA, 15 bp, Homo sapiens
gtccaatttttactc

SEQ ID NO: 1118711 - DNA, 20 bp, Homo sapiens
gtccacaaaataaccaatcc

SEQ ID NO: 1118712 - DNA, 15 bp, Homo sapiens
gtccacaacacacag

SEQ ID NO: 1118713 - DNA, 13 bp, Homo sapiens
gtccacaggggca

SEQ ID NO: 1118714 - DNA, 19 bp, Homo sapiens
gtccacaggggcaggcctg

SEQ ID NO: 1118715 - DNA, 22 bp, Homo sapiens
gtccacaggggcaggcctggga

SEQ ID NO: 1118716 - DNA, 15 bp, Homo sapiens
gtccacaggggccac

SEQ ID NO: 1118717 - DNA, 19 bp, Homo sapiens
gtccacaggggccaccacc

SEQ ID NO: 1118718 - DNA, 14 bp, Homo sapiens
gtccacatccccag

SEQ ID NO: 1118719 - DNA, 15 bp, Homo sapiens
gtccacatccccaga

SEQ ID NO: 1118720 - DNA, 17 bp, Homo sapiens
gtccacatccccagagc

SEQ ID NO: 1118721 - DNA, 18 bp, Homo sapiens
gtccacatccccagagcc

SEQ ID NO: 1118722 - DNA, 16 bp, Homo sapiens
gtccacatctgcctcc

SEQ ID NO: 1118723 - DNA, 17 bp, Homo sapiens
gtccacatctgcctcct

SEQ ID NO: 1118724 - DNA, 19 bp, Homo sapiens
gtccacattcgtcacagat

SEQ ID NO: 1118725 - DNA, 12 bp, Homo sapiens
gtccacattcta

SEQ ID NO: 1118726 - DNA, 14 bp, Homo sapiens
gtccaccagaccca

SEQ ID NO: 1118727 - DNA, 13 bp, Homo sapiens
gtccacccaggct

SEQ ID NO: 1118728 - DNA, 21 bp, Homo sapiens
gtccacccaggctgcactgca

SEQ ID NO: 1118729 - DNA, 17 bp, Homo sapiens
gtccacccttccatcag

SEQ ID NO: 1118730 - DNA, 18 bp, Homo sapiens
gtccacccttccatcagc

SEQ ID NO: 1118731 - DNA, 23 bp, Homo sapiens
gtccaccctttcatagagaggcc

SEQ ID NO: 1118732 - DNA, 19 bp, Homo sapiens
gtccaccggcccctggcag

SEQ ID NO: 1118733 - DNA, 13 bp, Homo sapiens
gtccactccctgc

SEQ ID NO: 1118734 - DNA, 20 bp, Homo sapiens
gtccactccctgctccacga

SEQ ID NO: 1118735 - DNA, 12 bp, Homo sapiens
gtccactgtcct

SEQ ID NO: 1118736 - DNA, 11 bp, Homo sapiens
gtccactgtgt

SEQ ID NO: 1118737 - DNA, 23 bp, Homo sapiens
gtccactgtgtatagaagtagat

SEQ ID NO: 1118738 - DNA, 21 bp, Homo sapiens
gtccagaaactcctgtttctc

SEQ ID NO: 1118739 - DNA, 17 bp, Homo sapiens
gtccagaagaatattca

SEQ ID NO: 1118740 - DNA, 19 bp, Homo sapiens
gtccagaagaatattcagg

SEQ ID NO: 1118741 - DNA, 15 bp, Homo sapiens
gtccagacccaagtc

SEQ ID NO: 1118742 - DNA, 18 bp, Homo sapiens
gtccagactcagagggct

SEQ ID NO: 1118743 - DNA, 23 bp, Homo sapiens
gtccagagagagaagtgcccctg

SEQ ID NO: 1118744 - DNA, 18 bp, Homo sapiens
gtccagagagcctccctg

SEQ ID NO: 1118745 - DNA, 21 bp, Homo sapiens
gtccagagcggaggctgtgtg

SEQ ID NO: 1118746 - DNA, 15 bp, Homo sapiens
gtccagagcttttca

SEQ ID NO: 1118747 - DNA, 12 bp, Homo sapiens
gtccagcagctg

SEQ ID NO: 1118748 - DNA, 18 bp, Homo sapiens
gtccagccacccccaggc

SEQ ID NO: 1118749 - DNA, 11 bp, Homo sapiens
gtccagccccc

SEQ ID NO: 1118750 - DNA, 11 bp, Homo sapiens
gtccagccctc

SEQ ID NO: 1118751 - DNA, 12 bp, Homo sapiens
gtccagccctcc

SEQ ID NO: 1118752 - DNA, 12 bp, Homo sapiens
gtccagctcagc

SEQ ID NO: 1118753 - DNA, 13 bp, Homo sapiens
gtccagctcagcc

SEQ ID NO: 1118754 - DNA, 17 bp, Homo sapiens
gtccagctcagccctgg

SEQ ID NO: 1118755 - DNA, 23 bp, Homo sapiens
gtccagctcccgctgtggccgca

SEQ ID NO: 1118756 - DNA, 11 bp, Homo sapiens
gtccagctctg

SEQ ID NO: 1118757 - DNA, 18 bp, Homo sapiens
gtccagctctgacatccc

SEQ ID NO: 1118758 - DNA, 19 bp, Homo sapiens
gtccagctctgacatccct

SEQ ID NO: 1118759 - DNA, 22 bp, Homo sapiens
gtccagctctgacatcccttcc

SEQ ID NO: 1118760 - DNA, 16 bp, Homo sapiens
gtccagctctggaggg

SEQ ID NO: 1118761 - DNA, 21 bp, Homo sapiens
gtccagctctggaggggaggg

SEQ ID NO: 1118762 - DNA, 18 bp, Homo sapiens
gtccagctggcctggaca

SEQ ID NO: 1118763 - DNA, 19 bp, Homo sapiens
gtccagctgggaagccctt

SEQ ID NO: 1118764 - DNA, 19 bp, Homo sapiens
gtccagctggggccagagg

SEQ ID NO: 1118765 - DNA, 20 bp, Homo sapiens
gtccagctggggccagaggc

SEQ ID NO: 1118766 - DNA, 14 bp, Homo sapiens
gtccagcttccaaa

SEQ ID NO: 1118767 - DNA, 18 bp, Homo sapiens
gtccaggaacaagctaat

SEQ ID NO: 1118768 - DNA, 14 bp, Homo sapiens
gtccaggaaggcag

SEQ ID NO: 1118769 - DNA, 16 bp, Homo sapiens
gtccaggaaggcagct

SEQ ID NO: 1118770 - DNA, 18 bp, Homo sapiens
gtccaggaaggcagctgc

SEQ ID NO: 1118771 - DNA, 20 bp, Homo sapiens
gtccaggaaggcagctgctc

SEQ ID NO: 1118772 - DNA, 21 bp, Homo sapiens
gtccaggaaggcagctgctct

SEQ ID NO: 1118773 - DNA, 16 bp, Homo sapiens
gtccaggagagcctgg

SEQ ID NO: 1118774 - DNA, 13 bp, Homo sapiens
gtccaggagcctg

SEQ ID NO: 1118775 - DNA, 17 bp, Homo sapiens
gtccaggagctaatctg

SEQ ID NO: 1118776 - DNA, 13 bp, Homo sapiens
gtccaggagctca

SEQ ID NO: 1118777 - DNA, 15 bp, Homo sapiens
gtccaggagctcagg

SEQ ID NO: 1118778 - DNA, 15 bp, Homo sapiens
gtccaggcactgaga

SEQ ID NO: 1118779 - DNA, 15 bp, Homo sapiens
gtccaggcagctccc

SEQ ID NO: 1118780 - DNA, 13 bp, Homo sapiens
gtccaggccactg

SEQ ID NO: 1118781 - DNA, 15 bp, Homo sapiens
gtccaggccactgtg

SEQ ID NO: 1118782 - DNA, 17 bp, Homo sapiens
gtccaggccagtgggcc

SEQ ID NO: 1118783 - DNA, 13 bp, Homo sapiens
gtccaggccctta

SEQ ID NO: 1118784 - DNA, 19 bp, Homo sapiens
gtccaggcctctctctgct

SEQ ID NO: 1118785 - DNA, 15 bp, Homo sapiens
gtccaggcgggcaag

SEQ ID NO: 1118786 - DNA, 15 bp, Homo sapiens
gtccaggctctgggc

SEQ ID NO: 1118787 - DNA, 17 bp, Homo sapiens
gtccaggctctgggcac

SEQ ID NO: 1118788 - DNA, 13 bp, Homo sapiens
gtccagggaagag

SEQ ID NO: 1118789 - DNA, 15 bp, Homo sapiens
gtccagggaagctgg

SEQ ID NO: 1118790 - DNA, 13 bp, Homo sapiens
gtccagggcccca

SEQ ID NO: 1118791 - DNA, 17 bp, Homo sapiens
gtccctgggccagggtc

SEQ ID NO: 1118792 - DNA, 19 bp, Homo sapiens
gtccctgggccagggtctg

SEQ ID NO: 1118793 - DNA, 19 bp, Homo sapiens
gtccctgggggaagccctg

SEQ ID NO: 1118794 - DNA, 21 bp, Homo sapiens
gtccctgggggaagccctgga

SEQ ID NO: 1118795 - DNA, 19 bp, Homo sapiens
gtccctgggggtgcagatg

SEQ ID NO: 1118796 - DNA, 12 bp, Homo sapiens
gtccctggtccc

SEQ ID NO: 1118797 - DNA, 16 bp, Homo sapiens
gtccctgtcaggacac

SEQ ID NO: 1118798 - DNA, 14 bp, Homo sapiens
gtccctgtccccag

SEQ ID NO: 1118799 - DNA, 16 bp, Homo sapiens
gtccctgtccctctag

SEQ ID NO: 1118800 - DNA, 17 bp, Homo sapiens
gtccctgtccctgcccc

SEQ ID NO: 1118801 - DNA, 19 bp, Homo sapiens
gtccctgtccctgccccgc

SEQ ID NO: 1118802 - DNA, 21 bp, Homo sapiens
gtccctgtgttgtcccatctg

SEQ ID NO: 1118803 - DNA, 19 bp, Homo sapiens
gtccctgttttctgagccc

SEQ ID NO: 1118804 - DNA, 20 bp, Homo sapiens
gtccctgttttctgagcccg

SEQ ID NO: 1118805 - DNA, 23 bp, Homo sapiens
gtcccttaatattgaggctgcag

SEQ ID NO: 1118806 - DNA, 20 bp, Homo sapiens
gtcccttcccctccctggct

SEQ ID NO: 1118807 - DNA, 22 bp, Homo sapiens
gtcccttcccctccctggctcc

SEQ ID NO: 1118808 - DNA, 13 bp, Homo sapiens
gtcccttcccctt

SEQ ID NO: 1118809 - DNA, 14 bp, Homo sapiens
gtcccttccccttc

SEQ ID NO: 1118810 - DNA, 15 bp, Homo sapiens
gtcccttccccttca

SEQ ID NO: 1118811 - DNA, 22 bp, Homo sapiens
gtcccttcctattctcctgcca

SEQ ID NO: 1118812 - DNA, 23 bp, Homo sapiens
gtcccttcctattctcctgccat

SEQ ID NO: 1118813 - DNA, 12 bp, Homo sapiens
gtcccttcctgc

SEQ ID NO: 1118814 - DNA, 17 bp, Homo sapiens
gtcccttcctgcttcct

SEQ ID NO: 1118815 - DNA, 17 bp, Homo sapiens
gtcccttgagacctcag

SEQ ID NO: 1118816 - DNA, 18 bp, Homo sapiens
gtcccttgagacctcagc

SEQ ID NO: 1118817 - DNA, 19 bp, Homo sapiens
gtcccttgagacctcagcc

SEQ ID NO: 1118818 - DNA, 13 bp, Homo sapiens
gtcccttgcctca

SEQ ID NO: 1118819 - DNA, 16 bp, Homo sapiens
gtcccttgctgtatgc

SEQ ID NO: 1118820 - DNA, 16 bp, Homo sapiens
gtcccttggcacactt

SEQ ID NO: 1118821 - DNA, 17 bp, Homo sapiens
gtcccttgtttccagct

SEQ ID NO: 1118822 - DNA, 20 bp, Homo sapiens
gtcccttgtttccagctaga

SEQ ID NO: 1118823 - DNA, 16 bp, Homo sapiens
gtccctttccctacct

SEQ ID NO: 1118824 - DNA, 14 bp, Homo sapiens
gtccgcaccagctg

SEQ ID NO: 1118825 - DNA, 23 bp, Homo sapiens
gtccgcaccagctgctctgcccc

SEQ ID NO: 1118826 - DNA, 16 bp, Homo sapiens
gtccgccatccagggt

SEQ ID NO: 1118827 - DNA, 20 bp, Homo sapiens
gtccgccctgctcctccctg

SEQ ID NO: 1118828 - DNA, 18 bp, Homo sapiens
gtccgcctgcgcctccat

SEQ ID NO: 1118829 - DNA, 14 bp, Homo sapiens
gtccgccttaatct

SEQ ID NO: 1118830 - DNA, 14 bp, Homo sapiens
gtccgcggcctgca

SEQ ID NO: 1118831 - DNA, 17 bp, Homo sapiens
gtccgctaaatatttac

SEQ ID NO: 1118832 - DNA, 21 bp, Homo sapiens
gtccggatttctaacagtcct

SEQ ID NO: 1118833 - DNA, 14 bp, Homo sapiens
gtccggcccagtgc

SEQ ID NO: 1118834 - DNA, 18 bp, Homo sapiens
gtccggcccagtgccagc

SEQ ID NO: 1118835 - DNA, 12 bp, Homo sapiens
gtccggcgcccc

SEQ ID NO: 1118836 - DNA, 24 bp, Homo sapiens
gtccggtgtccttttcactacacc

SEQ ID NO: 1118837 - DNA, 18 bp, Homo sapiens
gtccgtccacccttccat

SEQ ID NO: 1118838 - DNA, 20 bp, Homo sapiens
gtccgtccacccttccatca

SEQ ID NO: 1118839 - DNA, 14 bp, Homo sapiens
gtccgtccagagcc

SEQ ID NO: 1118840 - DNA, 20 bp, Homo sapiens
gtccgtgctgacagctgctc

SEQ ID NO: 1118841 - DNA, 16 bp, Homo sapiens
gtccgttgctgaaaat

SEQ ID NO: 1118842 - DNA, 14 bp, Homo sapiens
gtccgtttactcca

SEQ ID NO: 1118843 - DNA, 16 bp, Homo sapiens
gtcctaaaaatggcta

SEQ ID NO: 1118844 - DNA, 23 bp, Homo sapiens
gtcctaaaacttggatggacttg

SEQ ID NO: 1118845 - DNA, 22 bp, Homo sapiens
gtcctaagaaagaggagtgctt

SEQ ID NO: 1118846 - DNA, 19 bp, Homo sapiens
gtcctaagagatttatctt

SEQ ID NO: 1118847 - DNA, 18 bp, Homo sapiens
gtcctacagtgactccct

SEQ ID NO: 1118848 - DNA, 16 bp, Homo sapiens
gtcctacccgcccgcg

SEQ ID NO: 1118849 - DNA, 16 bp, Homo sapiens
gtcctacgtccaaggt

SEQ ID NO: 1118850 - DNA, 20 bp, Homo sapiens
gtcctactatcactgaacaa

SEQ ID NO: 1118851 - DNA, 20 bp, Homo sapiens
gtcctacttctgactttact

SEQ ID NO: 1118852 - DNA, 19 bp, Homo sapiens
gtcctagcccttccctgag

SEQ ID NO: 1118853 - DNA, 22 bp, Homo sapiens
gtcctaggccacaccatctcct

SEQ ID NO: 1118854 - DNA, 16 bp, Homo sapiens
gtcctagtcgggcagg

SEQ ID NO: 1118855 - DNA, 16 bp, Homo sapiens
gtcctagttgttcagc

SEQ ID NO: 1118856 - DNA, 20 bp, Homo sapiens
gtcctatctccagcggccct

SEQ ID NO: 1118857 - DNA, 19 bp, Homo sapiens
gtcctatggacaacttatt

SEQ ID NO: 1118858 - DNA, 19 bp, Homo sapiens
gtcctatgtacagagcttt

SEQ ID NO: 1118859 - DNA, 12 bp, Homo sapiens
gtcctcaccctg

SEQ ID NO: 1118860 - DNA, 17 bp, Homo sapiens
gtcctcaccctgtggga

SEQ ID NO: 1118861 - DNA, 20 bp, Homo sapiens
gtcctcacgccccctgtgac

SEQ ID NO: 1118862 - DNA, 16 bp, Homo sapiens
gtcctcactgtcctgt

SEQ ID NO: 1118863 - DNA, 16 bp, Homo sapiens
gtcctcacttggggga

SEQ ID NO: 1118864 - DNA, 21 bp, Homo sapiens
gtcctcacttgggggaaaaaa

SEQ ID NO: 1118865 - DNA, 20 bp, Homo sapiens
gtcctcagagaatttctacc

SEQ ID NO: 1118866 - DNA, 12 bp, Homo sapiens
gtcctcagagca

SEQ ID NO: 1118867 - DNA, 19 bp, Homo sapiens
gtcctcagcagtccacaaa

SEQ ID NO: 1118868 - DNA, 13 bp, Homo sapiens
gtcctcagccagt

SEQ ID NO: 1118869 - DNA, 17 bp, Homo sapiens
gtcctcagctgctccca

SEQ ID NO: 1118870 - DNA, 23 bp, Homo sapiens
gtcctcagggctcagtcttttga

SEQ ID NO: 1118871 - DNA, 13 bp, Homo sapiens
gtcctcaggtaca

SEQ ID NO: 1118872 - DNA, 19 bp, Homo sapiens
gtcctcaggtacagcgggc

SEQ ID NO: 1118873 - DNA, 21 bp, Homo sapiens
gtcctccaacaccaagcacag

SEQ ID NO: 1118874 - DNA, 14 bp, Homo sapiens
gtcctccaagccag

SEQ ID NO: 1118875 - DNA, 22 bp, Homo sapiens
gtcctccagaagcctctggcta

SEQ ID NO: 1118876 - DNA, 17 bp, Homo sapiens
gtcctccagaccaccag

SEQ ID NO: 1118877 - DNA, 14 bp, Homo sapiens
gtcctccatccacg

SEQ ID NO: 1118878 - DNA, 16 bp, Homo sapiens
gtcctcccacagacct

SEQ ID NO: 1118879 - DNA, 18 bp, Homo sapiens
gtcctcccacagacctgc

SEQ ID NO: 1118880 - DNA, 21 bp, Homo sapiens
gtcctcccacagacctgcagt

SEQ ID NO: 1118881 - DNA, 23 bp, Homo sapiens
gtcctcccacagacctgcagtga

SEQ ID NO: 1118882 - DNA, 14 bp, Homo sapiens
gtcctcccatcccc

SEQ ID NO: 1118883 - DNA, 16 bp, Homo sapiens
gtcctcccatcccctc

SEQ ID NO: 1118884 - DNA, 19 bp, Homo sapiens
gtcctcccatcccctggac

SEQ ID NO: 1118885 - DNA, 16 bp, Homo sapiens
gtcctccccctgccag

SEQ ID NO: 1118886 - DNA, 16 bp, Homo sapiens
gtcctcccgagctcct

SEQ ID NO: 1118887 - DNA, 16 bp, Homo sapiens
gtcctcccgggccctc

SEQ ID NO: 1118888 - DNA, 21 bp, Homo sapiens
gtcctcccgggccctcccttg

SEQ ID NO: 1118889 - DNA, 11 bp, Homo sapiens
gtcctccctca

SEQ ID NO: 1118890 - DNA, 13 bp, Homo sapiens
gtcctccctcagc

SEQ ID NO: 1118891 - DNA, 18 bp, Homo sapiens
gtcctccctcagcctccc

SEQ ID NO: 1118892 - DNA, 23 bp, Homo sapiens
gtcctccctcagcctccccttct

SEQ ID NO: 1118893 - DNA, 12 bp, Homo sapiens
gtcctccctgac

SEQ ID NO: 1118894 - DNA, 19 bp, Homo sapiens
gtcctcctaagtcccttcc

SEQ ID NO: 1118895 - DNA, 13 bp, Homo sapiens
gtcctcctcacct

SEQ ID NO: 1118896 - DNA, 21 bp, Homo sapiens
gtcctcctcgctcctccttcc

SEQ ID NO: 1118897 - DNA, 21 bp, Homo sapiens
gtcctcctcggatcaccgaga

SEQ ID NO: 1118898 - DNA, 12 bp, Homo sapiens
gtcctcctctgt

SEQ ID NO: 1118899 - DNA, 23 bp, Homo sapiens
gtcctcctgttccgtgtgggctt

SEQ ID NO: 1118900 - DNA, 10 bp, Homo sapiens
gtcctccttc

SEQ ID NO: 1118901 - DNA, 12 bp, Homo sapiens
gtcctcggagct

SEQ ID NO: 1118902 - DNA, 19 bp, Homo sapiens
gtcctctcagttctctccc

SEQ ID NO: 1118903 - DNA, 20 bp, Homo sapiens
gtcctctcagttctctccct

SEQ ID NO: 1118904 - DNA, 15 bp, Homo sapiens
gtcctctccagagag

SEQ ID NO: 1118905 - DNA, 17 bp, Homo sapiens
gtcctctcccccttcag

SEQ ID NO: 1118906 - DNA, 21 bp, Homo sapiens
gtcctctcccccttcagctcc

SEQ ID NO: 1118907 - DNA, 13 bp, Homo sapiens
gtcctctcgagcc

SEQ ID NO: 1118908 - DNA, 12 bp, Homo sapiens
gtcctctctctg

SEQ ID NO: 1118909 - DNA, 21 bp, Homo sapiens
gtcctctctctgtggggctga

SEQ ID NO: 1118910 - DNA, 13 bp, Homo sapiens
gtcctctgaggca

SEQ ID NO: 1118911 - DNA, 19 bp, Homo sapiens
gtcctctgatacccagagc

SEQ ID NO: 1118912 - DNA, 16 bp, Homo sapiens
gtcctctgcctgggct

SEQ ID NO: 1118913 - DNA, 23 bp, Homo sapiens
gtctatttaaaaaaaaagtcaga

SEQ ID NO: 1118914 - DNA, 20 bp, Homo sapiens
gtctatttccactgaacaaa

SEQ ID NO: 1118915 - DNA, 22 bp, Homo sapiens
gtctatttccactgaacaaaac

SEQ ID NO: 1118916 - DNA, 11 bp, Homo sapiens
gtctattttaa

SEQ ID NO: 1118917 - DNA, 16 bp, Homo sapiens
gtctattttctgcaga

SEQ ID NO: 1118918 - DNA, 20 bp, Homo sapiens
gtctattttgtatatttgta

SEQ ID NO: 1118919 - DNA, 17 bp, Homo sapiens
gtctcaaaaaaagaaaa

SEQ ID NO: 1118920 - DNA, 15 bp, Homo sapiens
gtctcaaactcctga

SEQ ID NO: 1118921 - DNA, 16 bp, Homo sapiens
gtctcaaactcctgac

SEQ ID NO: 1118922 - DNA, 20 bp, Homo sapiens
gtctcaaactcctgggctca

SEQ ID NO: 1118923 - DNA, 17 bp, Homo sapiens
gtctcaacatgtgtttc

SEQ ID NO: 1118924 - DNA, 20 bp, Homo sapiens
gtctcaacatgtgtttctga

SEQ ID NO: 1118925 - DNA, 23 bp, Homo sapiens
gtctcacagtgttgcccaggctg

SEQ ID NO: 1118926 - DNA, 23 bp, Homo sapiens
gtctcacgggcatgggcactccc

SEQ ID NO: 1118927 - DNA, 13 bp, Homo sapiens
gtctcactcctga

SEQ ID NO: 1118928 - DNA, 17 bp, Homo sapiens
gtctcactcctgagtgg

SEQ ID NO: 1118929 - DNA, 22 bp, Homo sapiens
gtctcactctgtcgctcaggct

SEQ ID NO: 1118930 - DNA, 16 bp, Homo sapiens
gtctcactctgttgcc

SEQ ID NO: 1118931 - DNA, 21 bp, Homo sapiens
gtctcactgaaacatttaaat

SEQ ID NO: 1118932 - DNA, 15 bp, Homo sapiens
gtctcactgtgtgtc

SEQ ID NO: 1118933 - DNA, 13 bp, Homo sapiens
gtctcactgttct

SEQ ID NO: 1118934 - DNA, 15 bp, Homo sapiens
gtctcactgttctgc

SEQ ID NO: 1118935 - DNA, 16 bp, Homo sapiens
gtctcacttataccaa

SEQ ID NO: 1118936 - DNA, 14 bp, Homo sapiens
gtctcagagaccag

SEQ ID NO: 1118937 - DNA, 15 bp, Homo sapiens
gtctcagagaccagc

SEQ ID NO: 1118938 - DNA, 16 bp, Homo sapiens
gtctcagagaccagca

SEQ ID NO: 1118939 - DNA, 16 bp, Homo sapiens
gtctcagcctctgcca

SEQ ID NO: 1118940 - DNA, 12 bp, Homo sapiens
gtctcaggagca

SEQ ID NO: 1118941 - DNA, 16 bp, Homo sapiens
gtctcaggagcatggg

SEQ ID NO: 1118942 - DNA, 14 bp, Homo sapiens
gtctcaggaggagg

SEQ ID NO: 1118943 - DNA, 16 bp, Homo sapiens
gtctcaggagtctctg

SEQ ID NO: 1118944 - DNA, 12 bp, Homo sapiens
gtctcaggcagc

SEQ ID NO: 1118945 - DNA, 12 bp, Homo sapiens
gtctcagggccg

SEQ ID NO: 1118946 - DNA, 21 bp, Homo sapiens
gtctcagtttgtgtgtcttaa

SEQ ID NO: 1118947 - DNA, 11 bp, Homo sapiens
gtctcatccca

SEQ ID NO: 1118948 - DNA, 15 bp, Homo sapiens
gtctcatccccaggg

SEQ ID NO: 1118949 - DNA, 16 bp, Homo sapiens
gtctcatccccagggg

SEQ ID NO: 1118950 - DNA, 14 bp, Homo sapiens
gtctcatcctcctg

SEQ ID NO: 1118951 - DNA, 16 bp, Homo sapiens
gtctcatctcctgacc

SEQ ID NO: 1118952 - DNA, 15 bp, Homo sapiens
gtctcatctcttcag

SEQ ID NO: 1118953 - DNA, 14 bp, Homo sapiens
gtctcatcttctct

SEQ ID NO: 1118954 - DNA, 19 bp, Homo sapiens
gtctcatgctccttaatgg

SEQ ID NO: 1118955 - DNA, 16 bp, Homo sapiens
gtctcatgctgttgct

SEQ ID NO: 1118956 - DNA, 14 bp, Homo sapiens
gtctcatgggaagc

SEQ ID NO: 1118957 - DNA, 18 bp, Homo sapiens
gtctcattcgcctttgtc

SEQ ID NO: 1118958 - DNA, 23 bp, Homo sapiens
gtctcattcgcctttgtcttgta

SEQ ID NO: 1118959 - DNA, 18 bp, Homo sapiens
gtctcattgcttctgact

SEQ ID NO: 1118960 - DNA, 14 bp, Homo sapiens
gtctccaagggagg

SEQ ID NO: 1118961 - DNA, 20 bp, Homo sapiens
gtctccacctacacccctgt

SEQ ID NO: 1118962 - DNA, 23 bp, Homo sapiens
gtctccacctacacccctgtgct

SEQ ID NO: 1118963 - DNA, 19 bp, Homo sapiens
gtctccactgtgcctttgc

SEQ ID NO: 1118964 - DNA, 14 bp, Homo sapiens
gtctccacttgtat

SEQ ID NO: 1118965 - DNA, 22 bp, Homo sapiens
gtctccagccccttctcagaat

SEQ ID NO: 1118966 - DNA, 20 bp, Homo sapiens
gtctccagctgcctgggccc

SEQ ID NO: 1118967 - DNA, 23 bp, Homo sapiens
gtctccagctgcctgggcccgga

SEQ ID NO: 1118968 - DNA, 23 bp, Homo sapiens
gtctccagggacccttgcctgcc

SEQ ID NO: 1118969 - DNA, 21 bp, Homo sapiens
gtctccagtatccactttgca

SEQ ID NO: 1118970 - DNA, 20 bp, Homo sapiens
gtctccagtggttgctgttg

SEQ ID NO: 1118971 - DNA, 18 bp, Homo sapiens
gtctccatgaagagcttg

SEQ ID NO: 1118972 - DNA, 22 bp, Homo sapiens
gtctccatgaggtactggtccc

SEQ ID NO: 1118973 - DNA, 21 bp, Homo sapiens
gtctccatgctggatactgga

SEQ ID NO: 1118974 - DNA, 17 bp, Homo sapiens
gtctccattgtgtgatc

SEQ ID NO: 1118975 - DNA, 16 bp, Homo sapiens
gtctcccaaagtgctg

SEQ ID NO: 1118976 - DNA, 18 bp, Homo sapiens
gtctcccaaagtgctggg

SEQ ID NO: 1118977 - DNA, 11 bp, Homo sapiens
gtctcccaaca

SEQ ID NO: 1118978 - DNA, 17 bp, Homo sapiens
gtctcccacacccaccc

SEQ ID NO: 1118979 - DNA, 17 bp, Homo sapiens
gtctcccaggccccctg

SEQ ID NO: 1118980 - DNA, 16 bp, Homo sapiens
gtctcccaggctgctg

SEQ ID NO: 1118981 - DNA, 12 bp, Homo sapiens
gtctcccatcct

SEQ ID NO: 1118982 - DNA, 16 bp, Homo sapiens
gtctccccactccacc

SEQ ID NO: 1118983 - DNA, 13 bp, Homo sapiens
gtctcccccagag

SEQ ID NO: 1118984 - DNA, 19 bp, Homo sapiens
gtctcccccagagtgctgt

SEQ ID NO: 1118985 - DNA, 16 bp, Homo sapiens
gtctcccctcctgcac

SEQ ID NO: 1118986 - DNA, 19 bp, Homo sapiens
gtctcccgccccccacact

SEQ ID NO: 1118987 - DNA, 22 bp, Homo sapiens
gtctccctcccctctcagaaca

SEQ ID NO: 1118988 - DNA, 16 bp, Homo sapiens
gtctccctcccttggg

SEQ ID NO: 1118989 - DNA, 19 bp, Homo sapiens
gtctccctccgactccaga

SEQ ID NO: 1118990 - DNA, 17 bp, Homo sapiens
gtctccctctcctgcct

SEQ ID NO: 1118991 - DNA, 18 bp, Homo sapiens
gtctccctctcctgccta

SEQ ID NO: 1118992 - DNA, 11 bp, Homo sapiens
gtctccctggc

SEQ ID NO: 1118993 - DNA, 17 bp, Homo sapiens
gtctccctggttgcctc

SEQ ID NO: 1118994 - DNA, 18 bp, Homo sapiens
gtctccctggttgcctct

SEQ ID NO: 1118995 - DNA, 21 bp, Homo sapiens
gtctccctggttgcctctctt

SEQ ID NO: 1118996 - DNA, 22 bp, Homo sapiens
gtctccctggttgcctctcttg

SEQ ID NO: 1118997 - DNA, 13 bp, Homo sapiens
gtctccctgtgtt

SEQ ID NO: 1118998 - DNA, 20 bp, Homo sapiens
gtctccctgtgttacccagg

SEQ ID NO: 1118999 - DNA, 19 bp, Homo sapiens
gtctccctttccatggcaa

SEQ ID NO: 1119000 - DNA, 13 bp, Homo sapiens
gtctccgagagag

SEQ ID NO: 1119001 - DNA, 17 bp, Homo sapiens
gtctcctacctgctgct

SEQ ID NO: 1119002 - DNA, 22 bp, Homo sapiens
gtctcctatatatttctattat

SEQ ID NO: 1119003 - DNA, 14 bp, Homo sapiens
gtctcctccccttc

SEQ ID NO: 1119004 - DNA, 12 bp, Homo sapiens
gtctcctccctc

SEQ ID NO: 1119005 - DNA, 14 bp, Homo sapiens
gtctcctccctggg

SEQ ID NO: 1119006 - DNA, 23 bp, Homo sapiens
gtctcctggaccttgacagagca

SEQ ID NO: 1119007 - DNA, 19 bp, Homo sapiens
gtctccttactctgagccc

SEQ ID NO: 1119008 - DNA, 14 bp, Homo sapiens
gtctcgcagcctga

SEQ ID NO: 1119009 - DNA, 15 bp, Homo sapiens
gtctcgcagcctgaa

SEQ ID NO: 1119010 - DNA, 18 bp, Homo sapiens
gtctcgcagcctgaagcc

SEQ ID NO: 1119011 - DNA, 16 bp, Homo sapiens
gtctcgctttgttgcc

SEQ ID NO: 1119012 - DNA, 14 bp, Homo sapiens
gtctcggcccctct

SEQ ID NO: 1119013 - DNA, 22 bp, Homo sapiens
gtctcggggcttgccccactct

SEQ ID NO: 1119014 - DNA, 23 bp, Homo sapiens
gtctcgggtggctagtcagagag

SEQ ID NO: 1119015 - DNA, 21 bp, Homo sapiens
gtctcgtcttccgtctccccc

SEQ ID NO: 1119016 - DNA, 13 bp, Homo sapiens
gtctcgtggtagg

SEQ ID NO: 1119017 - DNA, 19 bp, Homo sapiens
gtctcgtggtaggactgta

SEQ ID NO: 1119018 - DNA, 23 bp, Homo sapiens
gtctcgtgtacagctcccttccc

SEQ ID NO: 1119019 - DNA, 16 bp, Homo sapiens
gtctcgtgtcagtaat

SEQ ID NO: 1119020 - DNA, 17 bp, Homo sapiens
gtctcgtgtcagtaatt

SEQ ID NO: 1119021 - DNA, 23 bp, Homo sapiens
gtctcgttttgttgccaaagctg

SEQ ID NO: 1119022 - DNA, 21 bp, Homo sapiens
gtctctatattatgtcttctt

SEQ ID NO: 1119023 - DNA, 22 bp, Homo sapiens
gtctctatattatgtcttcttt

SEQ ID NO: 1119024 - DNA, 15 bp, Homo sapiens
gtctctattagctgg

SEQ ID NO: 1119025 - DNA, 18 bp, Homo sapiens
gtctctattagctgggtt

SEQ ID NO: 1119026 - DNA, 16 bp, Homo sapiens
gtctctcacagatgtg

SEQ ID NO: 1119027 - DNA, 12 bp, Homo sapiens
gtctctcagaat

SEQ ID NO: 1119028 - DNA, 16 bp, Homo sapiens
gtctctcccaccccgg

SEQ ID NO: 1119029 - DNA, 20 bp, Homo sapiens
gtctctcccaccccggcctc

SEQ ID NO: 1119030 - DNA, 22 bp, Homo sapiens
gtctctcccaccccggcctcca

SEQ ID NO: 1119031 - DNA, 14 bp, Homo sapiens
gtctctccctcagg

SEQ ID NO: 1119032 - DNA, 15 bp, Homo sapiens
gtctctccctcaggt

SEQ ID NO: 1119033 - DNA, 21 bp, Homo sapiens
gtctctcctagcccctctctc

SEQ ID NO: 1119034 - DNA, 16 bp, Homo sapiens
gtctctctccctctgt

SEQ ID NO: 1119035 - DNA, 16 bp, Homo sapiens
gtcttaactgtatttc

SEQ ID NO: 1119036 - DNA, 19 bp, Homo sapiens
gtcttaactgtatttcagt

SEQ ID NO: 1119037 - DNA, 17 bp, Homo sapiens
gtcttaatcgatctggt

SEQ ID NO: 1119038 - DNA, 16 bp, Homo sapiens
gtcttaatttatttct

SEQ ID NO: 1119039 - DNA, 20 bp, Homo sapiens
gtcttacaatcaaatctcct

SEQ ID NO: 1119040 - DNA, 18 bp, Homo sapiens
gtcttacataaaccattt

SEQ ID NO: 1119041 - DNA, 14 bp, Homo sapiens
gtcttactctgtct

SEQ ID NO: 1119042 - DNA, 15 bp, Homo sapiens
gtcttagctctttct

SEQ ID NO: 1119043 - DNA, 16 bp, Homo sapiens
gtcttagctctttctc

SEQ ID NO: 1119044 - DNA, 20 bp, Homo sapiens
gtcttatcccccccagcctg

SEQ ID NO: 1119045 - DNA, 22 bp, Homo sapiens
gtcttatcccccccagcctggc

SEQ ID NO: 1119046 - DNA, 19 bp, Homo sapiens
gtcttatggtccagaaact

SEQ ID NO: 1119047 - DNA, 18 bp, Homo sapiens
gtcttatggtcttgatcc

SEQ ID NO: 1119048 - DNA, 14 bp, Homo sapiens
gtcttatttcctca

SEQ ID NO: 1119049 - DNA, 13 bp, Homo sapiens
gtcttcaaggact

SEQ ID NO: 1119050 - DNA, 21 bp, Homo sapiens
gtcttcaatttgtataaaatg

SEQ ID NO: 1119051 - DNA, 17 bp, Homo sapiens
gtcttcactttcctcag

SEQ ID NO: 1119052 - DNA, 18 bp, Homo sapiens
gtcttcactttcctcagt

SEQ ID NO: 1119053 - DNA, 14 bp, Homo sapiens
gtcttcagacccag

SEQ ID NO: 1119054 - DNA, 23 bp, Homo sapiens
gtcttcagcctagccgacctcag

SEQ ID NO: 1119055 - DNA, 19 bp, Homo sapiens
gtcttcatcacttcttcca

SEQ ID NO: 1119056 - DNA, 17 bp, Homo sapiens
gtcttcatctccctgcc

SEQ ID NO: 1119057 - DNA, 18 bp, Homo sapiens
gtcttcatctccctgcca

SEQ ID NO: 1119058 - DNA, 14 bp, Homo sapiens
gtcttccacaaaga

SEQ ID NO: 1119059 - DNA, 17 bp, Homo sapiens
gtcttccacaaagaaaa

SEQ ID NO: 1119060 - DNA, 14 bp, Homo sapiens
gtcttcccccctct

SEQ ID NO: 1119061 - DNA, 16 bp, Homo sapiens
gtcttcccccctctcc

SEQ ID NO: 1119062 - DNA, 13 bp, Homo sapiens
gtcttcccctgag

SEQ ID NO: 1119063 - DNA, 19 bp, Homo sapiens
gtcttcccgcaaggcctct

SEQ ID NO: 1119064 - DNA, 18 bp, Homo sapiens
gtcttccctgggctgcca

SEQ ID NO: 1119065 - DNA, 17 bp, Homo sapiens
gtcttcccttacctcaa

SEQ ID NO: 1119066 - DNA, 22 bp, Homo sapiens
gtcttccgatcaacatttatga

SEQ ID NO: 1119067 - DNA, 17 bp, Homo sapiens
gtcttccgcccctgcct

SEQ ID NO: 1119068 - DNA, 17 bp, Homo sapiens
gtcttcgccctctgaaa

SEQ ID NO: 1119069 - DNA, 13 bp, Homo sapiens
gtcttctaatttc

SEQ ID NO: 1119070 - DNA, 23 bp, Homo sapiens
gtcttctcatagcattaactaat

SEQ ID NO: 1119071 - DNA, 23 bp, Homo sapiens
gtcttctccaccagcccctcaca

SEQ ID NO: 1119072 - DNA, 19 bp, Homo sapiens
gtcttctctatcctctctc

SEQ ID NO: 1119073 - DNA, 14 bp, Homo sapiens
gtcttctgcctgtt

SEQ ID NO: 1119074 - DNA, 17 bp, Homo sapiens
gtcttctgcctgttata

SEQ ID NO: 1119075 - DNA, 12 bp, Homo sapiens
gtcttctgctgt

SEQ ID NO: 1119076 - DNA, 20 bp, Homo sapiens
gtcttctgctgttcttcact

SEQ ID NO: 1119077 - DNA, 21 bp, Homo sapiens
gtcttctgctgttcttcactt

SEQ ID NO: 1119078 - DNA, 16 bp, Homo sapiens
gtcttctgttcccaag

SEQ ID NO: 1119079 - DNA, 19 bp, Homo sapiens
gtcttcttgtgtcctgatg

SEQ ID NO: 1119080 - DNA, 13 bp, Homo sapiens
gtcttcttttgtg

SEQ ID NO: 1119081 - DNA, 21 bp, Homo sapiens
gtcttgaatagattttctctg

SEQ ID NO: 1119082 - DNA, 23 bp, Homo sapiens
gtcttgaatagattttctctgga

SEQ ID NO: 1119083 - DNA, 19 bp, Homo sapiens
gtcttgaatgtcttttgaa

SEQ ID NO: 1119084 - DNA, 12 bp, Homo sapiens
gtcttgactcat

SEQ ID NO: 1119085 - DNA, 22 bp, Homo sapiens
gtcttgactcatggcagctgtt

SEQ ID NO: 1119086 - DNA, 22 bp, Homo sapiens
gtcttgagccagtaatctttat

SEQ ID NO: 1119087 - DNA, 13 bp, Homo sapiens
gtcttgatttttc

SEQ ID NO: 1119088 - DNA, 20 bp, Homo sapiens
gtcttgcaaagcgacagatt

SEQ ID NO: 1119089 - DNA, 21 bp, Homo sapiens
gtcttgcccagcagctcaaga

SEQ ID NO: 1119090 - DNA, 13 bp, Homo sapiens
gtcttgccccagt

SEQ ID NO: 1119091 - DNA, 22 bp, Homo sapiens
gtcttgccccagtttggggtgc

SEQ ID NO: 1119092 - DNA, 13 bp, Homo sapiens
gtcttgccccatc

SEQ ID NO: 1119093 - DNA, 16 bp, Homo sapiens
gtcttgccccatcact

SEQ ID NO: 1119094 - DNA, 22 bp, Homo sapiens
gtcttgccccatcactgcgcca

SEQ ID NO: 1119095 - DNA, 14 bp, Homo sapiens
gtcttgctatgttg

SEQ ID NO: 1119096 - DNA, 20 bp, Homo sapiens
gtcttgctatgttgcccaag

SEQ ID NO: 1119097 - DNA, 19 bp, Homo sapiens
gtcttgctatttgagcatg

SEQ ID NO: 1119098 - DNA, 23 bp, Homo sapiens
gtcttgctctgtctcccaggctg

SEQ ID NO: 1119099 - DNA, 21 bp, Homo sapiens
gtcttggaagctgtttggaaa

SEQ ID NO: 1119100 - DNA, 18 bp, Homo sapiens
gtcttggagctgagcctc

SEQ ID NO: 1119101 - DNA, 23 bp, Homo sapiens
gtcttggagctgagcctctcacc

SEQ ID NO: 1119102 - DNA, 21 bp, Homo sapiens
gtcttgggaaatatgaatgcc

SEQ ID NO: 1119103 - DNA, 22 bp, Homo sapiens
gtcttgggcagagctggctctg

SEQ ID NO: 1119104 - DNA, 18 bp, Homo sapiens
gtcttgggctactggcag

SEQ ID NO: 1119105 - DNA, 19 bp, Homo sapiens
gtcttgggctactggcagc

SEQ ID NO: 1119106 - DNA, 15 bp, Homo sapiens
gtcttggggccactt

SEQ ID NO: 1119107 - DNA, 15 bp, Homo sapiens
gtcttggtattctta

SEQ ID NO: 1119108 - DNA, 15 bp, Homo sapiens
gtcttggtgcctttt

SEQ ID NO: 1119109 - DNA, 17 bp, Homo sapiens
gtcttggtgccttttgt

SEQ ID NO: 1119110 - DNA, 14 bp, Homo sapiens
gtcttggtgctatc

SEQ ID NO: 1119111 - DNA, 16 bp, Homo sapiens
gtcttggtggttctat

SEQ ID NO: 1119112 - DNA, 15 bp, Homo sapiens
gtcttggtgtaattt

SEQ ID NO: 1119113 - DNA, 17 bp, Homo sapiens
gtcttggttctaaaggt

SEQ ID NO: 1119114 - DNA, 22 bp, Homo sapiens
gtcttgtagctagaacttctct

SEQ ID NO: 1119115 - DNA, 23 bp, Homo sapiens
gtcttgtagctagaacttctcta

SEQ ID NO: 1119116 - DNA, 15 bp, Homo sapiens
gtcttgtgtttgctg

SEQ ID NO: 1119117 - DNA, 16 bp, Homo sapiens
gtcttgtgtttgctgc

SEQ ID NO: 1119118 - DNA, 17 bp, Homo sapiens
gtcttgttagaaaacaa

SEQ ID NO: 1119119 - DNA, 21 bp, Homo sapiens
gtcttgttatgtacaaactag

SEQ ID NO: 1119120 - DNA, 20 bp, Homo sapiens
gtcttgttgcggatggatgg

SEQ ID NO: 1119121 - DNA, 15 bp, Homo sapiens
gtctttaaaagagag

SEQ ID NO: 1119122 - DNA, 19 bp, Homo sapiens
gtctttaaaggcccagccc

SEQ ID NO: 1119123 - DNA, 22 bp, Homo sapiens
gtctttaaaggcccagccccta

SEQ ID NO: 1119124 - DNA, 16 bp, Homo sapiens
gtctttaaatagatac

SEQ ID NO: 1119125 - DNA, 16 bp, Homo sapiens
gtctttaatcattggt

SEQ ID NO: 1119126 - DNA, 17 bp, Homo sapiens
gtctttagagctcagct

SEQ ID NO: 1119127 - DNA, 20 bp, Homo sapiens
gtctttcagatgatttgaaa

SEQ ID NO: 1119128 - DNA, 21 bp, Homo sapiens
gtctttcaggaccttttgaag

SEQ ID NO: 1119129 - DNA, 22 bp, Homo sapiens
gtctttcagtacttttttaaat

SEQ ID NO: 1119130 - DNA, 18 bp, Homo sapiens
gtctttcattcggtgtga

SEQ ID NO: 1119131 - DNA, 19 bp, Homo sapiens
gtctttcattcggtgtgaa

SEQ ID NO: 1119132 - DNA, 21 bp, Homo sapiens
gtctttcattcggtgtgaact

SEQ ID NO: 1119133 - DNA, 13 bp, Homo sapiens
gtctttccactct

SEQ ID NO: 1119134 - DNA, 19 bp, Homo sapiens
gtctttcccatggggaggg

SEQ ID NO: 1119135 - DNA, 19 bp, Homo sapiens
gtctttcctcctacctttt

SEQ ID NO: 1119136 - DNA, 19 bp, Homo sapiens
gtctttcctgctacaagtg

SEQ ID NO: 1119137 - DNA, 20 bp, Homo sapiens
gtctttcctgctacaagtgt

SEQ ID NO: 1119138 - DNA, 18 bp, Homo sapiens
gtctttctaatgtagcta

SEQ ID NO: 1119139 - DNA, 21 bp, Homo sapiens
gtctttctaatgtagctattt

SEQ ID NO: 1119140 - DNA, 18 bp, Homo sapiens
gtctttctctaaatatga

SEQ ID NO: 1119141 - DNA, 19 bp, Homo sapiens
gtctttctctaaatatgat

SEQ ID NO: 1119142 - DNA, 13 bp, Homo sapiens
gtctttctggaga

SEQ ID NO: 1119143 - DNA, 12 bp, Homo sapiens
gtctttcttctt

SEQ ID NO: 1119144 - DNA, 13 bp, Homo sapiens
gtctttgataaag

SEQ ID NO: 1119145 - DNA, 13 bp, Homo sapiens
gtctttgcacatg

SEQ ID NO: 1119146 - DNA, 21 bp, Homo sapiens
gtctttgcaccaaagatgtcc

SEQ ID NO: 1119147 - DNA, 13 bp, Homo sapiens
gtctttgccttct

SEQ ID NO: 1119148 - DNA, 18 bp, Homo sapiens
gtctttgctgctgctctc

SEQ ID NO: 1119149 - DNA, 15 bp, Homo sapiens
gtctttggttcagct

SEQ ID NO: 1119150 - DNA, 19 bp, Homo sapiens
gtctttgtaatgtcaccac

SEQ ID NO: 1119151 - DNA, 22 bp, Homo sapiens
gtctttgtcaccacgtggggct

SEQ ID NO: 1119152 - DNA, 19 bp, Homo sapiens
gtctttgtgtgttatattc

SEQ ID NO: 1119153 - DNA, 15 bp, Homo sapiens
gtcttttaaacatta

SEQ ID NO: 1119154 - DNA, 15 bp, Homo sapiens
gtcttttaccctgtg

SEQ ID NO: 1119155 - DNA, 16 bp, Homo sapiens
gtcttttaccctgtgt

SEQ ID NO: 1119156 - DNA, 19 bp, Homo sapiens
gtgactgaatttgggcctc

SEQ ID NO: 1119157 - DNA, 23 bp, Homo sapiens
gtgactgagcaagaccctgtctc

SEQ ID NO: 1119158 - DNA, 22 bp, Homo sapiens
gtgactgcaagcatttttccat

SEQ ID NO: 1119159 - DNA, 16 bp, Homo sapiens
gtgactgccccaactc

SEQ ID NO: 1119160 - DNA, 23 bp, Homo sapiens
gtgactgccccaactcctggaag

SEQ ID NO: 1119161 - DNA, 21 bp, Homo sapiens
gtgactggaagttgtggatat

SEQ ID NO: 1119162 - DNA, 15 bp, Homo sapiens
gtgactggcaggtgc

SEQ ID NO: 1119163 - DNA, 21 bp, Homo sapiens
gtgactggcaggtgcagatgg

SEQ ID NO: 1119164 - DNA, 19 bp, Homo sapiens
gtgactgtatctgtgtaga

SEQ ID NO: 1119165 - DNA, 12 bp, Homo sapiens
gtgactgtccca

SEQ ID NO: 1119166 - DNA, 13 bp, Homo sapiens
gtgactgtcccac

SEQ ID NO: 1119167 - DNA, 21 bp, Homo sapiens
gtgactgtcccaccgggagcc

SEQ ID NO: 1119168 - DNA, 22 bp, Homo sapiens
gtgactgtcccaccgggagcct

SEQ ID NO: 1119169 - DNA, 15 bp, Homo sapiens
gtgacttcactgtat

SEQ ID NO: 1119170 - DNA, 16 bp, Homo sapiens
gtgacttcagctctgt

SEQ ID NO: 1119171 - DNA, 17 bp, Homo sapiens
gtgacttctagcagaga

SEQ ID NO: 1119172 - DNA, 13 bp, Homo sapiens
gtgacttctgaga

SEQ ID NO: 1119173 - DNA, 14 bp, Homo sapiens
gtgacttgttctga

SEQ ID NO: 1119174 - DNA, 13 bp, Homo sapiens
gtgactttaaaag

SEQ ID NO: 1119175 - DNA, 16 bp, Homo sapiens
gtgactttacaggagg

SEQ ID NO: 1119176 - DNA, 15 bp, Homo sapiens
gtgactttggggaca

SEQ ID NO: 1119177 - DNA, 17 bp, Homo sapiens
gtgactttggggacagg

SEQ ID NO: 1119178 - DNA, 14 bp, Homo sapiens
gtgacttttctgat

SEQ ID NO: 1119179 - DNA, 19 bp, Homo sapiens
gtgagaactcagaagagaa

SEQ ID NO: 1119180 - DNA, 18 bp, Homo sapiens
gtgagaagctagatgccc

SEQ ID NO: 1119181 - DNA, 14 bp, Homo sapiens
gtgagaagctgagg

SEQ ID NO: 1119182 - DNA, 20 bp, Homo sapiens
gtgagaatcctgcctctccc

SEQ ID NO: 1119183 - DNA, 12 bp, Homo sapiens
gtgagacagact

SEQ ID NO: 1119184 - DNA, 19 bp, Homo sapiens
gtgagacagtctggaaagt

SEQ ID NO: 1119185 - DNA, 16 bp, Homo sapiens
gtgagacccccacacc

SEQ ID NO: 1119186 - DNA, 16 bp, Homo sapiens
gtgagaccctgtctct

SEQ ID NO: 1119187 - DNA, 18 bp, Homo sapiens
gtgagactgcaggtgggc

SEQ ID NO: 1119188 - DNA, 13 bp, Homo sapiens
gtgagagaatgta

SEQ ID NO: 1119189 - DNA, 16 bp, Homo sapiens
gtgagagaatttatca

SEQ ID NO: 1119190 - DNA, 19 bp, Homo sapiens
gtgagagacattaactcat

SEQ ID NO: 1119191 - DNA, 18 bp, Homo sapiens
gtgagagaggaggcctgg

SEQ ID NO: 1119192 - DNA, 15 bp, Homo sapiens
gtgagagcacccact

SEQ ID NO: 1119193 - DNA, 13 bp, Homo sapiens
gtgagaggcagct

SEQ ID NO: 1119194 - DNA, 12 bp, Homo sapiens
gtgagaggcagg

SEQ ID NO: 1119195 - DNA, 17 bp, Homo sapiens
gtgagagggctgttaac

SEQ ID NO: 1119196 - DNA, 17 bp, Homo sapiens
gtgagaggggagggagg

SEQ ID NO: 1119197 - DNA, 23 bp, Homo sapiens
gtgagaggggagggctcctgggg

SEQ ID NO: 1119198 - DNA, 13 bp, Homo sapiens
gtgagagtgagct

SEQ ID NO: 1119199 - DNA, 15 bp, Homo sapiens
gtgagagttgtctct

SEQ ID NO: 1119200 - DNA, 16 bp, Homo sapiens
gtgagatgcagctgga

SEQ ID NO: 1119201 - DNA, 21 bp, Homo sapiens
gtgagcaaaatatgccccttc

SEQ ID NO: 1119202 - DNA, 13 bp, Homo sapiens
gtgagcaaccagc

SEQ ID NO: 1119203 - DNA, 14 bp, Homo sapiens
gtgagcagaacagg

SEQ ID NO: 1119204 - DNA, 19 bp, Homo sapiens
gtgagcagagatgtactgc

SEQ ID NO: 1119205 - DNA, 23 bp, Homo sapiens
gtgagcagctactgtaacttttt

SEQ ID NO: 1119206 - DNA, 20 bp, Homo sapiens
gtgagcagggtcaagcctct

SEQ ID NO: 1119207 - DNA, 22 bp, Homo sapiens
gtgagcagggtggggtctggga

SEQ ID NO: 1119208 - DNA, 16 bp, Homo sapiens
gtgagccaagaaacac

SEQ ID NO: 1119209 - DNA, 20 bp, Homo sapiens
gtgagccaccgctgccagca

SEQ ID NO: 1119210 - DNA, 22 bp, Homo sapiens
gtgagccaccgtgcctggccag

SEQ ID NO: 1119211 - DNA, 14 bp, Homo sapiens
gtgagcccctggtc

SEQ ID NO: 1119212 - DNA, 13 bp, Homo sapiens
gtgagccctctag

SEQ ID NO: 1119213 - DNA, 17 bp, Homo sapiens
gtgagccgccaggaacc

SEQ ID NO: 1119214 - DNA, 21 bp, Homo sapiens
gtgagcctgactgccaggacc

SEQ ID NO: 1119215 - DNA, 19 bp, Homo sapiens
gtgagcgatcatttatttc

SEQ ID NO: 1119216 - DNA, 14 bp, Homo sapiens
gtgagcgcttgggc

SEQ ID NO: 1119217 - DNA, 23 bp, Homo sapiens
gtgagctctggttatttttctct

SEQ ID NO: 1119218 - DNA, 20 bp, Homo sapiens
gtgagctggatagacttggg

SEQ ID NO: 1119219 - DNA, 12 bp, Homo sapiens
gtgagctgggga

SEQ ID NO: 1119220 - DNA, 14 bp, Homo sapiens
gtgagctgtgatca

SEQ ID NO: 1119221 - DNA, 16 bp, Homo sapiens
gtgagctttgctgcta

SEQ ID NO: 1119222 - DNA, 18 bp, Homo sapiens
gtgaggaaccctgatctc

SEQ ID NO: 1119223 - DNA, 19 bp, Homo sapiens
gtgaggaaccctgatctct

SEQ ID NO: 1119224 - DNA, 17 bp, Homo sapiens
gtgaggaatgctctgtg

SEQ ID NO: 1119225 - DNA, 12 bp, Homo sapiens
gtgaggagggtg

SEQ ID NO: 1119226 - DNA, 20 bp, Homo sapiens
gtgaggattccaaaaacatt

SEQ ID NO: 1119227 - DNA, 12 bp, Homo sapiens
gtgaggcagggg

SEQ ID NO: 1119228 - DNA, 22 bp, Homo sapiens
gtgaggcatggcaattctggaa

SEQ ID NO: 1119229 - DNA, 15 bp, Homo sapiens
gtgaggccagggcag

SEQ ID NO: 1119230 - DNA, 16 bp, Homo sapiens
gtgaggcccaaggagc

SEQ ID NO: 1119231 - DNA, 17 bp, Homo sapiens
gtgaggcccaaggagct

SEQ ID NO: 1119232 - DNA, 23 bp, Homo sapiens
gtgaggcccagcctgtcctggta

SEQ ID NO: 1119233 - DNA, 13 bp, Homo sapiens
gtgaggcccctgg

SEQ ID NO: 1119234 - DNA, 16 bp, Homo sapiens
gtgaggctgtcctgta

SEQ ID NO: 1119235 - DNA, 15 bp, Homo sapiens
gtgaggctgtgtctc

SEQ ID NO: 1119236 - DNA, 17 bp, Homo sapiens
gtgaggcttccaggctc

SEQ ID NO: 1119237 - DNA, 18 bp, Homo sapiens
gtgaggcttccaggctct

SEQ ID NO: 1119238 - DNA, 17 bp, Homo sapiens
gtgagggagggctgtca

SEQ ID NO: 1119239 - DNA, 12 bp, Homo sapiens
gtgagggagtgc

SEQ ID NO: 1119240 - DNA, 12 bp, Homo sapiens
gtgagggcagca

SEQ ID NO: 1119241 - DNA, 14 bp, Homo sapiens
gtgagggcctcaga

SEQ ID NO: 1119242 - DNA, 15 bp, Homo sapiens
gtgagggcctcagag

SEQ ID NO: 1119243 - DNA, 16 bp, Homo sapiens
gtgagggcctcagagc

SEQ ID NO: 1119244 - DNA, 19 bp, Homo sapiens
gtgaggggaacagggtgca

SEQ ID NO: 1119245 - DNA, 14 bp, Homo sapiens
gtgaggggaaggcc

SEQ ID NO: 1119246 - DNA, 15 bp, Homo sapiens
gtgaggggaggggcc

SEQ ID NO: 1119247 - DNA, 16 bp, Homo sapiens
gtgagggtcccatgtg

SEQ ID NO: 1119248 - DNA, 14 bp, Homo sapiens
gtgagggtcctgca

SEQ ID NO: 1119249 - DNA, 23 bp, Homo sapiens
gtgagggtgccccgcctgagtca

SEQ ID NO: 1119250 - DNA, 13 bp, Homo sapiens
gtgaggtggccca

SEQ ID NO: 1119251 - DNA, 15 bp, Homo sapiens
gtgaggtggcccagg

SEQ ID NO: 1119252 - DNA, 14 bp, Homo sapiens
gtgagtaagagctg

SEQ ID NO: 1119253 - DNA, 15 bp, Homo sapiens
gtgagtaagagctgg

SEQ ID NO: 1119254 - DNA, 18 bp, Homo sapiens
gtgagtaatcaatacaga

SEQ ID NO: 1119255 - DNA, 19 bp, Homo sapiens
gtgagtcacctgctccaga

SEQ ID NO: 1119256 - DNA, 20 bp, Homo sapiens
gtgagtcacctgctccagaa

SEQ ID NO: 1119257 - DNA, 16 bp, Homo sapiens
gtgagtcagtgatgag

SEQ ID NO: 1119258 - DNA, 14 bp, Homo sapiens
gtgagtcatttaaa

SEQ ID NO: 1119259 - DNA, 16 bp, Homo sapiens
gtgagtcccctactcc

SEQ ID NO: 1119260 - DNA, 13 bp, Homo sapiens
gtgagtcctgttg

SEQ ID NO: 1119261 - DNA, 21 bp, Homo sapiens
gtgagtcctgttgaagacttc

SEQ ID NO: 1119262 - DNA, 22 bp, Homo sapiens
gtgagtctccccttgcagcctg

SEQ ID NO: 1119263 - DNA, 20 bp, Homo sapiens
gtgagtctggtggaggagct

SEQ ID NO: 1119264 - DNA, 22 bp, Homo sapiens
gtgagtcttggcggcagcagcc

SEQ ID NO: 1119265 - DNA, 11 bp, Homo sapiens
gtgagtgaatc

SEQ ID NO: 1119266 - DNA, 14 bp, Homo sapiens
gtgagtgcgcctca

SEQ ID NO: 1119267 - DNA, 17 bp, Homo sapiens
gtgagtggagttgaggt

SEQ ID NO: 1119268 - DNA, 15 bp, Homo sapiens
gtgagtggcagccat

SEQ ID NO: 1119269 - DNA, 17 bp, Homo sapiens
gtgagtggcagccatgc

SEQ ID NO: 1119270 - DNA, 12 bp, Homo sapiens
gtgagtgtaaat

SEQ ID NO: 1119271 - DNA, 18 bp, Homo sapiens
gtgagtgtatgtgtgtgt

SEQ ID NO: 1119272 - DNA, 16 bp, Homo sapiens
gtgagtgtggctcccc

SEQ ID NO: 1119273 - DNA, 22 bp, Homo sapiens
gtgagtgtgtgagcgcttctgc

SEQ ID NO: 1119274 - DNA, 13 bp, Homo sapiens
gtgagttctccct

SEQ ID NO: 1119275 - DNA, 22 bp, Homo sapiens
gtgagttctccctgtacagtgt

SEQ ID NO: 1119276 - DNA, 17 bp, Homo sapiens
gtgagttgggattggac

SEQ ID NO: 1119277 - DNA, 16 bp, Homo sapiens
gtgagtttggtctgga

SEQ ID NO: 1119278 - DNA, 17 bp, Homo sapiens
gtgataaaactgggttg

SEQ ID NO: 1119279 - DNA, 19 bp, Homo sapiens
gtgcctcctcaaacccagt

SEQ ID NO: 1119280 - DNA, 20 bp, Homo sapiens
gtgcctcctcagaggacagt

SEQ ID NO: 1119281 - DNA, 13 bp, Homo sapiens
gtgcctcctggcc

SEQ ID NO: 1119282 - DNA, 18 bp, Homo sapiens
gtgcctccttccacctcc

SEQ ID NO: 1119283 - DNA, 21 bp, Homo sapiens
gtgcctccttccacctccctc

SEQ ID NO: 1119284 - DNA, 14 bp, Homo sapiens
gtgcctcgaggcac

SEQ ID NO: 1119285 - DNA, 16 bp, Homo sapiens
gtgcctcgaggcaccg

SEQ ID NO: 1119286 - DNA, 21 bp, Homo sapiens
gtgcctcgcatcctatgctta

SEQ ID NO: 1119287 - DNA, 13 bp, Homo sapiens
gtgcctctgggac

SEQ ID NO: 1119288 - DNA, 15 bp, Homo sapiens
gtgcctctgggactg

SEQ ID NO: 1119289 - DNA, 15 bp, Homo sapiens
gtgcctcttccagtg

SEQ ID NO: 1119290 - DNA, 21 bp, Homo sapiens
gtgcctgacacactaaccaag

SEQ ID NO: 1119291 - DNA, 16 bp, Homo sapiens
gtgcctgagaggcagg

SEQ ID NO: 1119292 - DNA, 15 bp, Homo sapiens
gtgcctgcagcgcct

SEQ ID NO: 1119293 - DNA, 15 bp, Homo sapiens
gtgcctgccactctc

SEQ ID NO: 1119294 - DNA, 14 bp, Homo sapiens
gtgcctgccctgga

SEQ ID NO: 1119295 - DNA, 18 bp, Homo sapiens
gtgcctgccctggaggga

SEQ ID NO: 1119296 - DNA, 19 bp, Homo sapiens
gtgcctgctcagcagccag

SEQ ID NO: 1119297 - DNA, 18 bp, Homo sapiens
gtgcctgctcaggtgcta

SEQ ID NO: 1119298 - DNA, 21 bp, Homo sapiens
gtgcctggcccattcttgagt

SEQ ID NO: 1119299 - DNA, 14 bp, Homo sapiens
gtgcctggccccag

SEQ ID NO: 1119300 - DNA, 20 bp, Homo sapiens
gtgcctggccccagcctggg

SEQ ID NO: 1119301 - DNA, 18 bp, Homo sapiens
gtgcctgggaagcccacc

SEQ ID NO: 1119302 - DNA, 16 bp, Homo sapiens
gtgcctgggaatgtat

SEQ ID NO: 1119303 - DNA, 11 bp, Homo sapiens
gtgcctgggcc

SEQ ID NO: 1119304 - DNA, 16 bp, Homo sapiens
gtgcctgggcccctcc

SEQ ID NO: 1119305 - DNA, 17 bp, Homo sapiens
gtgcctgggtggccatc

SEQ ID NO: 1119306 - DNA, 19 bp, Homo sapiens
gtgcctgggtggccatcct

SEQ ID NO: 1119307 - DNA, 18 bp, Homo sapiens
gtgcctgggtggggctgc

SEQ ID NO: 1119308 - DNA, 20 bp, Homo sapiens
gtgcctgggtggggctgctc

SEQ ID NO: 1119309 - DNA, 22 bp, Homo sapiens
gtgcctgggtggggctgctcct

SEQ ID NO: 1119310 - DNA, 12 bp, Homo sapiens
gtgcctgtggca

SEQ ID NO: 1119311 - DNA, 22 bp, Homo sapiens
gtgcctgtgtccatgcgctcag

SEQ ID NO: 1119312 - DNA, 15 bp, Homo sapiens
gtgccttacctcctg

SEQ ID NO: 1119313 - DNA, 21 bp, Homo sapiens
gtgccttacctcctgcccagg

SEQ ID NO: 1119314 - DNA, 15 bp, Homo sapiens
gtgccttccataatt

SEQ ID NO: 1119315 - DNA, 16 bp, Homo sapiens
gtgccttcctccccgc

SEQ ID NO: 1119316 - DNA, 22 bp, Homo sapiens
gtgccttcctctctctaccagt

SEQ ID NO: 1119317 - DNA, 11 bp, Homo sapiens
gtgccttctct

SEQ ID NO: 1119318 - DNA, 12 bp, Homo sapiens
gtgccttctggg

SEQ ID NO: 1119319 - DNA, 15 bp, Homo sapiens
gtgccttctgggctt

SEQ ID NO: 1119320 - DNA, 15 bp, Homo sapiens
gtgccttgcccacag

SEQ ID NO: 1119321 - DNA, 21 bp, Homo sapiens
gtgccttggggaatttcctct

SEQ ID NO: 1119322 - DNA, 13 bp, Homo sapiens
gtgccttgttttt

SEQ ID NO: 1119323 - DNA, 16 bp, Homo sapiens
gtgcctttatctcagc

SEQ ID NO: 1119324 - DNA, 12 bp, Homo sapiens
gtgcctttcaaa

SEQ ID NO: 1119325 - DNA, 14 bp, Homo sapiens
gtgcctttcctatc

SEQ ID NO: 1119326 - DNA, 14 bp, Homo sapiens
gtgccttttctgaa

SEQ ID NO: 1119327 - DNA, 15 bp, Homo sapiens
gtgccttttgcaccc

SEQ ID NO: 1119328 - DNA, 21 bp, Homo sapiens
gtgccttttgcacccctccca

SEQ ID NO: 1119329 - DNA, 21 bp, Homo sapiens
gtgccttttgcagaagagggt

SEQ ID NO: 1119330 - DNA, 21 bp, Homo sapiens
gtgccttttgtaggctgttcc

SEQ ID NO: 1119331 - DNA, 14 bp, Homo sapiens
gtgcctttttcctt

SEQ ID NO: 1119332 - DNA, 22 bp, Homo sapiens
gtgccttttttcacggaagttt

SEQ ID NO: 1119333 - DNA, 12 bp, Homo sapiens
gtgcgagcacac

SEQ ID NO: 1119334 - DNA, 23 bp, Homo sapiens
gtgcgagtgtgtgcatgtgtgtg

SEQ ID NO: 1119335 - DNA, 19 bp, Homo sapiens
gtgcgcagatctgtgcctg

SEQ ID NO: 1119336 - DNA, 14 bp, Homo sapiens
gtgcgcccagggct

SEQ ID NO: 1119337 - DNA, 13 bp, Homo sapiens
gtgcgcctcacca

SEQ ID NO: 1119338 - DNA, 19 bp, Homo sapiens
gtgcgcgtggcgtggcccg

SEQ ID NO: 1119339 - DNA, 22 bp, Homo sapiens
gtgcgctgacaaccaccgctcc

SEQ ID NO: 1119340 - DNA, 15 bp, Homo sapiens
gtgcggaggcaggag

SEQ ID NO: 1119341 - DNA, 23 bp, Homo sapiens
gtgcggcctcaccaggcccacga

SEQ ID NO: 1119342 - DNA, 13 bp, Homo sapiens
gtgcggcctgggg

SEQ ID NO: 1119343 - DNA, 22 bp, Homo sapiens
gtgcggcggtcccagctccctg

SEQ ID NO: 1119344 - DNA, 13 bp, Homo sapiens
gtgcggttcctca

SEQ ID NO: 1119345 - DNA, 19 bp, Homo sapiens
gtgcgtatgcagtgtagat

SEQ ID NO: 1119346 - DNA, 13 bp, Homo sapiens
gtgcgtctccagt

SEQ ID NO: 1119347 - DNA, 16 bp, Homo sapiens
gtgcgtctccagtcat

SEQ ID NO: 1119348 - DNA, 16 bp, Homo sapiens
gtgcgtgcgtgtgtgt

SEQ ID NO: 1119349 - DNA, 13 bp, Homo sapiens
gtgcgtggctgtg

SEQ ID NO: 1119350 - DNA, 15 bp, Homo sapiens
gtgcgtggctgtggc

SEQ ID NO: 1119351 - DNA, 13 bp, Homo sapiens
gtgcgtgtgtgtg

SEQ ID NO: 1119352 - DNA, 17 bp, Homo sapiens
gtgcgtgttagtgtgtg

SEQ ID NO: 1119353 - DNA, 22 bp, Homo sapiens
gtgcgtgttagtgtgtgtgcat

SEQ ID NO: 1119354 - DNA, 23 bp, Homo sapiens
gtgcgtgttagtgtgtgtgcatg

SEQ ID NO: 1119355 - DNA, 13 bp, Homo sapiens
gtgcgttctccca

SEQ ID NO: 1119356 - DNA, 17 bp, Homo sapiens
gtgctaaagccaaccag

SEQ ID NO: 1119357 - DNA, 16 bp, Homo sapiens
gtgctaaattttcagt

SEQ ID NO: 1119358 - DNA, 19 bp, Homo sapiens
gtgctacagggaatttgta

SEQ ID NO: 1119359 - DNA, 16 bp, Homo sapiens
gtgctactgattgttt

SEQ ID NO: 1119360 - DNA, 17 bp, Homo sapiens
gtgctacttgcttgaag

SEQ ID NO: 1119361 - DNA, 21 bp, Homo sapiens
gtgctagaaaatttagccctt

SEQ ID NO: 1119362 - DNA, 21 bp, Homo sapiens
gtgctagaggattagtaagat

SEQ ID NO: 1119363 - DNA, 19 bp, Homo sapiens
gtgctaggaagaggagtgg

SEQ ID NO: 1119364 - DNA, 16 bp, Homo sapiens
gtgctaggggatgagg

SEQ ID NO: 1119365 - DNA, 22 bp, Homo sapiens
gtgctataatctgtttttacgt

SEQ ID NO: 1119366 - DNA, 17 bp, Homo sapiens
gtgctatacacacacac

SEQ ID NO: 1119367 - DNA, 16 bp, Homo sapiens
gtgctataggctggag

SEQ ID NO: 1119368 - DNA, 15 bp, Homo sapiens
gtgctatataaatat

SEQ ID NO: 1119369 - DNA, 13 bp, Homo sapiens
gtgctatcacatg

SEQ ID NO: 1119370 - DNA, 13 bp, Homo sapiens
gtgctattctgtg

SEQ ID NO: 1119371 - DNA, 16 bp, Homo sapiens
gtgctatttgtcatct

SEQ ID NO: 1119372 - DNA, 18 bp, Homo sapiens
gtgctcacgactcttcct

SEQ ID NO: 1119373 - DNA, 12 bp, Homo sapiens
gtgctcagccaa

SEQ ID NO: 1119374 - DNA, 22 bp, Homo sapiens
gtgctccatatttgatttctaa

SEQ ID NO: 1119375 - DNA, 23 bp, Homo sapiens
gtgctccatatttgatttctaat

SEQ ID NO: 1119376 - DNA, 17 bp, Homo sapiens
gtgctcccctgccacac

SEQ ID NO: 1119377 - DNA, 20 bp, Homo sapiens
gtgctcccctgccacactga

SEQ ID NO: 1119378 - DNA, 22 bp, Homo sapiens
gtgctccgtgcctccaccacca

SEQ ID NO: 1119379 - DNA, 22 bp, Homo sapiens
gtgctcctctcgcacaatgcat

SEQ ID NO: 1119380 - DNA, 18 bp, Homo sapiens
gtgctcctgcccagccac

SEQ ID NO: 1119381 - DNA, 19 bp, Homo sapiens
gtgctcctgcccagccacc

SEQ ID NO: 1119382 - DNA, 14 bp, Homo sapiens
gtgctcgccccagc

SEQ ID NO: 1119383 - DNA, 21 bp, Homo sapiens
gtgctcggagaagagcgcagt

SEQ ID NO: 1119384 - DNA, 14 bp, Homo sapiens
gtgctcgggaaggg

SEQ ID NO: 1119385 - DNA, 22 bp, Homo sapiens
gtgctcgggaagggaggggaag

SEQ ID NO: 1119386 - DNA, 16 bp, Homo sapiens
gtgctctgaggtcaat

SEQ ID NO: 1119387 - DNA, 23 bp, Homo sapiens
gtgctctgaggtcaataaagcag

SEQ ID NO: 1119388 - DNA, 22 bp, Homo sapiens
gtgctctggcggcttcctgtcc

SEQ ID NO: 1119389 - DNA, 23 bp, Homo sapiens
gtgctctggcggcttcctgtcca

SEQ ID NO: 1119390 - DNA, 12 bp, Homo sapiens
gtgctctggtct

SEQ ID NO: 1119391 - DNA, 13 bp, Homo sapiens
gtgctctgtgttc

SEQ ID NO: 1119392 - DNA, 13 bp, Homo sapiens
gtgctcttggctg

SEQ ID NO: 1119393 - DNA, 19 bp, Homo sapiens
gtgctctttttttaaaagg

SEQ ID NO: 1119394 - DNA, 21 bp, Homo sapiens
gtgctgaacagtggaggaaga

SEQ ID NO: 1119395 - DNA, 23 bp, Homo sapiens
gtgctgaatggttttcaaaataa

SEQ ID NO: 1119396 - DNA, 19 bp, Homo sapiens
gtgctgaatgttgggactg

SEQ ID NO: 1119397 - DNA, 17 bp, Homo sapiens
gtgctgacaacttagct

SEQ ID NO: 1119398 - DNA, 22 bp, Homo sapiens
gtgctgacaacttagctcaggt

SEQ ID NO: 1119399 - DNA, 16 bp, Homo sapiens
gtgctgacagctgctc

SEQ ID NO: 1119400 - DNA, 18 bp, Homo sapiens
gtgctgagcttagccttg

SEQ ID NO: 1119401 - DNA, 18 bp, Homo sapiens
gtggcatgtggcctgtgg

SEQ ID NO: 1119402 - DNA, 15 bp, Homo sapiens
gtggcattgaaatga

SEQ ID NO: 1119403 - DNA, 23 bp, Homo sapiens
gtggcatttcaattcctggccct

SEQ ID NO: 1119404 - DNA, 14 bp, Homo sapiens
gtggcatttccaaa

SEQ ID NO: 1119405 - DNA, 15 bp, Homo sapiens
gtggcatttccaaac

SEQ ID NO: 1119406 - DNA, 21 bp, Homo sapiens
gtggccaaataggagggagac

SEQ ID NO: 1119407 - DNA, 15 bp, Homo sapiens
gtggccaaccaggac

SEQ ID NO: 1119408 - DNA, 23 bp, Homo sapiens
gtggccaactgcaaaaaaagcct

SEQ ID NO: 1119409 - DNA, 22 bp, Homo sapiens
gtggccaagaagcagtggcctt

SEQ ID NO: 1119410 - DNA, 16 bp, Homo sapiens
gtggccaagcctgctg

SEQ ID NO: 1119411 - DNA, 23 bp, Homo sapiens
gtggccaagcctgctgtgtcctt

SEQ ID NO: 1119412 - DNA, 17 bp, Homo sapiens
gtggccaaggagctgct

SEQ ID NO: 1119413 - DNA, 22 bp, Homo sapiens
gtggccacaatccacgcttctc

SEQ ID NO: 1119414 - DNA, 16 bp, Homo sapiens
gtggccacaccacagc

SEQ ID NO: 1119415 - DNA, 15 bp, Homo sapiens
gtggccacagactga

SEQ ID NO: 1119416 - DNA, 19 bp, Homo sapiens
gtggccacagcaagtacag

SEQ ID NO: 1119417 - DNA, 15 bp, Homo sapiens
gtggccacagccccc

SEQ ID NO: 1119418 - DNA, 20 bp, Homo sapiens
gtggccacgttcagggaggg

SEQ ID NO: 1119419 - DNA, 17 bp, Homo sapiens
gtggccacttcattcca

SEQ ID NO: 1119420 - DNA, 19 bp, Homo sapiens
gtggccacttcattccagc

SEQ ID NO: 1119421 - DNA, 22 bp, Homo sapiens
gtggccacttcattccagcagc

SEQ ID NO: 1119422 - DNA, 12 bp, Homo sapiens
gtggccagagct

SEQ ID NO: 1119423 - DNA, 22 bp, Homo sapiens
gtggccagagctggaaggcagg

SEQ ID NO: 1119424 - DNA, 23 bp, Homo sapiens
gtggccagagctgggaggcatgg

SEQ ID NO: 1119425 - DNA, 17 bp, Homo sapiens
gtggccagccagtgcca

SEQ ID NO: 1119426 - DNA, 15 bp, Homo sapiens
gtggccagcccggct

SEQ ID NO: 1119427 - DNA, 16 bp, Homo sapiens
gtggccagcccggctg

SEQ ID NO: 1119428 - DNA, 14 bp, Homo sapiens
gtggccagcctgga

SEQ ID NO: 1119429 - DNA, 15 bp, Homo sapiens
gtggccagcgccagg

SEQ ID NO: 1119430 - DNA, 19 bp, Homo sapiens
gtggccagcgccagggccc

SEQ ID NO: 1119431 - DNA, 13 bp, Homo sapiens
gtggccagggctt

SEQ ID NO: 1119432 - DNA, 14 bp, Homo sapiens
gtggccagggcttc

SEQ ID NO: 1119433 - DNA, 19 bp, Homo sapiens
gtggccagggcttccccat

SEQ ID NO: 1119434 - DNA, 16 bp, Homo sapiens
gtggccatcactcagc

SEQ ID NO: 1119435 - DNA, 18 bp, Homo sapiens
gtggccatcactcagccc

SEQ ID NO: 1119436 - DNA, 14 bp, Homo sapiens
gtggccatccctgg

SEQ ID NO: 1119437 - DNA, 17 bp, Homo sapiens
gtggccatccctgggcc

SEQ ID NO: 1119438 - DNA, 18 bp, Homo sapiens
gtggccatccctgggccc

SEQ ID NO: 1119439 - DNA, 21 bp, Homo sapiens
gtggccatccctgggcccctc

SEQ ID NO: 1119440 - DNA, 19 bp, Homo sapiens
gtggccatcctacccagcg

SEQ ID NO: 1119441 - DNA, 13 bp, Homo sapiens
gtggcccagagcc

SEQ ID NO: 1119442 - DNA, 13 bp, Homo sapiens
gtggcccaggccc

SEQ ID NO: 1119443 - DNA, 15 bp, Homo sapiens
gtggccccaccctgg

SEQ ID NO: 1119444 - DNA, 20 bp, Homo sapiens
gtggccccaccctgggccct

SEQ ID NO: 1119445 - DNA, 18 bp, Homo sapiens
gtggcccccgggcctgca

SEQ ID NO: 1119446 - DNA, 13 bp, Homo sapiens
gtggccccctgtc

SEQ ID NO: 1119447 - DNA, 21 bp, Homo sapiens
gtggccccctgtccccaagac

SEQ ID NO: 1119448 - DNA, 23 bp, Homo sapiens
gtggccccgtttctggtggtctg

SEQ ID NO: 1119449 - DNA, 15 bp, Homo sapiens
gtggcccgtggcctg

SEQ ID NO: 1119450 - DNA, 16 bp, Homo sapiens
gtggcccgtggcctgg

SEQ ID NO: 1119451 - DNA, 16 bp, Homo sapiens
gtggccctccctcagc

SEQ ID NO: 1119452 - DNA, 22 bp, Homo sapiens
gtggccctgccatcttcccagc

SEQ ID NO: 1119453 - DNA, 17 bp, Homo sapiens
gtggccctggcctgctg

SEQ ID NO: 1119454 - DNA, 18 bp, Homo sapiens
gtggccctggcctgctgg

SEQ ID NO: 1119455 - DNA, 20 bp, Homo sapiens
gtggccctgtgcctgggccc

SEQ ID NO: 1119456 - DNA, 22 bp, Homo sapiens
gtggcccttctgtccaccagac

SEQ ID NO: 1119457 - DNA, 20 bp, Homo sapiens
gtggcccttgtttacagtga

SEQ ID NO: 1119458 - DNA, 23 bp, Homo sapiens
gtggcccttgtttacagtgagga

SEQ ID NO: 1119459 - DNA, 22 bp, Homo sapiens
gtggccgccatctgcgcagggt

SEQ ID NO: 1119460 - DNA, 15 bp, Homo sapiens
gtggccgcccctgag

SEQ ID NO: 1119461 - DNA, 13 bp, Homo sapiens
gtggccgtctcct

SEQ ID NO: 1119462 - DNA, 11 bp, Homo sapiens
gtggcctcaga

SEQ ID NO: 1119463 - DNA, 12 bp, Homo sapiens
gtggcctcagaa

SEQ ID NO: 1119464 - DNA, 11 bp, Homo sapiens
gtggcctcagc

SEQ ID NO: 1119465 - DNA, 14 bp, Homo sapiens
gtggcctcagccct

SEQ ID NO: 1119466 - DNA, 17 bp, Homo sapiens
gtggcctcagccctcag

SEQ ID NO: 1119467 - DNA, 21 bp, Homo sapiens
gtggcctccctggctcctccg

SEQ ID NO: 1119468 - DNA, 15 bp, Homo sapiens
gtggcctctgcctgg

SEQ ID NO: 1119469 - DNA, 13 bp, Homo sapiens
gtggcctctgtgg

SEQ ID NO: 1119470 - DNA, 14 bp, Homo sapiens
gtggcctgcccagc

SEQ ID NO: 1119471 - DNA, 15 bp, Homo sapiens
gtggcctgcccagcc

SEQ ID NO: 1119472 - DNA, 19 bp, Homo sapiens
gtggcctgcccagcctcaa

SEQ ID NO: 1119473 - DNA, 16 bp, Homo sapiens
gtggcctggccaggag

SEQ ID NO: 1119474 - DNA, 18 bp, Homo sapiens
gtggcctggccaggagct

SEQ ID NO: 1119475 - DNA, 14 bp, Homo sapiens
gtggcctggtccct

SEQ ID NO: 1119476 - DNA, 15 bp, Homo sapiens
gtggcctggtccctg

SEQ ID NO: 1119477 - DNA, 13 bp, Homo sapiens
gtggcctggtggg

SEQ ID NO: 1119478 - DNA, 16 bp, Homo sapiens
gtggcctgtggcctgt

SEQ ID NO: 1119479 - DNA, 15 bp, Homo sapiens
gtggcctgtgtccag

SEQ ID NO: 1119480 - DNA, 16 bp, Homo sapiens
gtggcctgtgtccagc

SEQ ID NO: 1119481 - DNA, 22 bp, Homo sapiens
gtggcctgtgtccagcagctgc

SEQ ID NO: 1119482 - DNA, 17 bp, Homo sapiens
gtggcctgtgtcccatg

SEQ ID NO: 1119483 - DNA, 21 bp, Homo sapiens
gtggccttccccttttgcctg

SEQ ID NO: 1119484 - DNA, 24 bp, Homo sapiens
gtggccttccccttttgcctggct

SEQ ID NO: 1119485 - DNA, 12 bp, Homo sapiens
gtggccttgccc

SEQ ID NO: 1119486 - DNA, 13 bp, Homo sapiens
gtggccttgggag

SEQ ID NO: 1119487 - DNA, 16 bp, Homo sapiens
gtggccttgggaggac

SEQ ID NO: 1119488 - DNA, 14 bp, Homo sapiens
gtggccttgggcct

SEQ ID NO: 1119489 - DNA, 14 bp, Homo sapiens
gtggcctttcagtg

SEQ ID NO: 1119490 - DNA, 14 bp, Homo sapiens
gtggcctttgtgct

SEQ ID NO: 1119491 - DNA, 23 bp, Homo sapiens
gtggcctttttctgagatgctca

SEQ ID NO: 1119492 - DNA, 16 bp, Homo sapiens
gtggcgactctgcaga

SEQ ID NO: 1119493 - DNA, 17 bp, Homo sapiens
gtggcgactctgcagag

SEQ ID NO: 1119494 - DNA, 20 bp, Homo sapiens
gtggcgcgatctcggctcag

SEQ ID NO: 1119495 - DNA, 19 bp, Homo sapiens
gtggcgctggtgcattctg

SEQ ID NO: 1119496 - DNA, 14 bp, Homo sapiens
gtggcgctttctcc

SEQ ID NO: 1119497 - DNA, 14 bp, Homo sapiens
gtggcggccttccg

SEQ ID NO: 1119498 - DNA, 14 bp, Homo sapiens
gtggcgggcacctg

SEQ ID NO: 1119499 - DNA, 21 bp, Homo sapiens
gtggcggggtggggtgggggt

SEQ ID NO: 1119500 - DNA, 23 bp, Homo sapiens
gtggcgggtgatggccagcccct

SEQ ID NO: 1119501 - DNA, 14 bp, Homo sapiens
gtggcggtgcctgg

SEQ ID NO: 1119502 - DNA, 17 bp, Homo sapiens
gtggcggtgcctgggtg

SEQ ID NO: 1119503 - DNA, 14 bp, Homo sapiens
gtggcgtggcccgt

SEQ ID NO: 1119504 - DNA, 22 bp, Homo sapiens
gtggcgtgtgcatagcgtcctg

SEQ ID NO: 1119505 - DNA, 22 bp, Homo sapiens
gtggctagtcaagctcctcctc

SEQ ID NO: 1119506 - DNA, 23 bp, Homo sapiens
gtggctagtcaagctcctcctcc

SEQ ID NO: 1119507 - DNA, 19 bp, Homo sapiens
gtggctagtcagagagagt

SEQ ID NO: 1119508 - DNA, 15 bp, Homo sapiens
gtggctatcctgatt

SEQ ID NO: 1119509 - DNA, 15 bp, Homo sapiens
gtggctcagccagca

SEQ ID NO: 1119510 - DNA, 16 bp, Homo sapiens
gtggctcatgcctgtg

SEQ ID NO: 1119511 - DNA, 12 bp, Homo sapiens
gtggctccccac

SEQ ID NO: 1119512 - DNA, 14 bp, Homo sapiens
gtggctccccacct

SEQ ID NO: 1119513 - DNA, 15 bp, Homo sapiens
gtggctccccacctg

SEQ ID NO: 1119514 - DNA, 16 bp, Homo sapiens
gtggctccccacctgg

SEQ ID NO: 1119515 - DNA, 22 bp, Homo sapiens
gtggctccccacctggacacac

SEQ ID NO: 1119516 - DNA, 18 bp, Homo sapiens
gtggctccccctctgctt

SEQ ID NO: 1119517 - DNA, 20 bp, Homo sapiens
gtggctcctatctgtgtttt

SEQ ID NO: 1119518 - DNA, 18 bp, Homo sapiens
gtggctctcagagcagca

SEQ ID NO: 1119519 - DNA, 20 bp, Homo sapiens
gtggctctcagagcagcaga

SEQ ID NO: 1119520 - DNA, 13 bp, Homo sapiens
gtggctctccagt

SEQ ID NO: 1119521 - DNA, 23 bp, Homo sapiens
gtggctctgggaatgggagaggg

SEQ ID NO: 1119522 - DNA, 21 bp, Homo sapiens
gtggctctgggagagccagct

SEQ ID NO: 1119523 - DNA, 23 bp, Homo sapiens
gtggtctgaatgttctgacatta

SEQ ID NO: 1119524 - DNA, 14 bp, Homo sapiens
gtggtctgtgtcac

SEQ ID NO: 1119525 - DNA, 15 bp, Homo sapiens
gtggtcttctccacc

SEQ ID NO: 1119526 - DNA, 23 bp, Homo sapiens
gtggtgaaatcccatctctacaa

SEQ ID NO: 1119527 - DNA, 17 bp, Homo sapiens
gtggtgacaggacgctg

SEQ ID NO: 1119528 - DNA, 23 bp, Homo sapiens
gtggtgagcagaagtggagctgg

SEQ ID NO: 1119529 - DNA, 14 bp, Homo sapiens
gtggtgaggggctt

SEQ ID NO: 1119530 - DNA, 19 bp, Homo sapiens
gtggtgaggggctttctct

SEQ ID NO: 1119531 - DNA, 22 bp, Homo sapiens
gtggtgaggggctttctcttcc

SEQ ID NO: 1119532 - DNA, 19 bp, Homo sapiens
gtggtgagtggaagggagg

SEQ ID NO: 1119533 - DNA, 19 bp, Homo sapiens
gtggtgatcaattaaatgt

SEQ ID NO: 1119534 - DNA, 14 bp, Homo sapiens
gtggtgcagacaga

SEQ ID NO: 1119535 - DNA, 17 bp, Homo sapiens
gtggtgcagccttcccc

SEQ ID NO: 1119536 - DNA, 14 bp, Homo sapiens
gtggtgctgggact

SEQ ID NO: 1119537 - DNA, 15 bp, Homo sapiens
gtggtggaagggtag

SEQ ID NO: 1119538 - DNA, 15 bp, Homo sapiens
gtggtggagccaggg

SEQ ID NO: 1119539 - DNA, 23 bp, Homo sapiens
gtggtggcaggcacctgtagtcc

SEQ ID NO: 1119540 - DNA, 18 bp, Homo sapiens
gtggtggcccacgcctgt

SEQ ID NO: 1119541 - DNA, 13 bp, Homo sapiens
gtggtggcctggt

SEQ ID NO: 1119542 - DNA, 12 bp, Homo sapiens
gtggtgggactc

SEQ ID NO: 1119543 - DNA, 14 bp, Homo sapiens
gtggtgggcgctgg

SEQ ID NO: 1119544 - DNA, 16 bp, Homo sapiens
gtggtgggcgctgggg

SEQ ID NO: 1119545 - DNA, 22 bp, Homo sapiens
gtggtggggaggggcgctggcc

SEQ ID NO: 1119546 - DNA, 12 bp, Homo sapiens
gtggtggggctg

SEQ ID NO: 1119547 - DNA, 20 bp, Homo sapiens
gtggtggtaaccctggtggt

SEQ ID NO: 1119548 - DNA, 16 bp, Homo sapiens
gtggtggtattctgtc

SEQ ID NO: 1119549 - DNA, 22 bp, Homo sapiens
gtggtggttaaaagggaacaca

SEQ ID NO: 1119550 - DNA, 14 bp, Homo sapiens
gtggtggttttctg

SEQ ID NO: 1119551 - DNA, 20 bp, Homo sapiens
gtggtggttttctgttcttt

SEQ ID NO: 1119552 - DNA, 15 bp, Homo sapiens
gtggtgtatttgaga

SEQ ID NO: 1119553 - DNA, 15 bp, Homo sapiens
gtggtgtcagaccct

SEQ ID NO: 1119554 - DNA, 14 bp, Homo sapiens
gtggtgtgatctta

SEQ ID NO: 1119555 - DNA, 17 bp, Homo sapiens
gtggtgtttgtaggctg

SEQ ID NO: 1119556 - DNA, 20 bp, Homo sapiens
gtggtgtttgtaggctgtgg

SEQ ID NO: 1119557 - DNA, 21 bp, Homo sapiens
gtggttaccgagtatctgtaa

SEQ ID NO: 1119558 - DNA, 18 bp, Homo sapiens
gtggttatggagagggtg

SEQ ID NO: 1119559 - DNA, 18 bp, Homo sapiens
gtggttattagcaaggct

SEQ ID NO: 1119560 - DNA, 21 bp, Homo sapiens
gtggttccatgcagccttggg

SEQ ID NO: 1119561 - DNA, 13 bp, Homo sapiens
gtggttccgggct

SEQ ID NO: 1119562 - DNA, 13 bp, Homo sapiens
gtggttcctctgc

SEQ ID NO: 1119563 - DNA, 16 bp, Homo sapiens
gtggttctataataag

SEQ ID NO: 1119564 - DNA, 16 bp, Homo sapiens
gtggttctattttact

SEQ ID NO: 1119565 - DNA, 23 bp, Homo sapiens
gtggttctccttcctcagcctcc

SEQ ID NO: 1119566 - DNA, 24 bp, Homo sapiens
gtggttcttaaatgtttatactgt

SEQ ID NO: 1119567 - DNA, 12 bp, Homo sapiens
gtggttcttttt

SEQ ID NO: 1119568 - DNA, 21 bp, Homo sapiens
gtggttgaggctaagttggga

SEQ ID NO: 1119569 - DNA, 18 bp, Homo sapiens
gtggtttaggctatttgt

SEQ ID NO: 1119570 - DNA, 15 bp, Homo sapiens
gtggtttatgattaa

SEQ ID NO: 1119571 - DNA, 18 bp, Homo sapiens
gtggtttcagatgtgcaa

SEQ ID NO: 1119572 - DNA, 17 bp, Homo sapiens
gtggtttccctgcccct

SEQ ID NO: 1119573 - DNA, 14 bp, Homo sapiens
gtggtttgccatgt

SEQ ID NO: 1119574 - DNA, 18 bp, Homo sapiens
gtggtttgccatgtcgct

SEQ ID NO: 1119575 - DNA, 14 bp, Homo sapiens
gtggtttgtactca

SEQ ID NO: 1119576 - DNA, 22 bp, Homo sapiens
gtggttttattacaaatgcaaa

SEQ ID NO: 1119577 - DNA, 16 bp, Homo sapiens
gtggttttcccctccc

SEQ ID NO: 1119578 - DNA, 20 bp, Homo sapiens
gtggttttcccctccctggg

SEQ ID NO: 1119579 - DNA, 21 bp, Homo sapiens
gtggttttcccctccctgggt

SEQ ID NO: 1119580 - DNA, 23 bp, Homo sapiens
gtggttttgggttttttctgttt

SEQ ID NO: 1119581 - DNA, 17 bp, Homo sapiens
gtgtaaaatattttgaa

SEQ ID NO: 1119582 - DNA, 13 bp, Homo sapiens
gtgtaaaatgtat

SEQ ID NO: 1119583 - DNA, 15 bp, Homo sapiens
gtgtaaacacatcta

SEQ ID NO: 1119584 - DNA, 13 bp, Homo sapiens
gtgtaaataattt

SEQ ID NO: 1119585 - DNA, 19 bp, Homo sapiens
gtgtaaatatatgtctgat

SEQ ID NO: 1119586 - DNA, 13 bp, Homo sapiens
gtgtaaattatgt

SEQ ID NO: 1119587 - DNA, 22 bp, Homo sapiens
gtgtaaattatgtaatgcaaaa

SEQ ID NO: 1119588 - DNA, 13 bp, Homo sapiens
gtgtaaatttgta

SEQ ID NO: 1119589 - DNA, 19 bp, Homo sapiens
gtgtaacaggtctcctctt

SEQ ID NO: 1119590 - DNA, 22 bp, Homo sapiens
gtgtaaccgtaacccaccccca

SEQ ID NO: 1119591 - DNA, 13 bp, Homo sapiens
gtgtaacctcagt

SEQ ID NO: 1119592 - DNA, 21 bp, Homo sapiens
gtgtaagaacaatgccagggc

SEQ ID NO: 1119593 - DNA, 21 bp, Homo sapiens
gtgtaagaactgtacattgtg

SEQ ID NO: 1119594 - DNA, 21 bp, Homo sapiens
gtgtaagtattcttatttaat

SEQ ID NO: 1119595 - DNA, 19 bp, Homo sapiens
gtgtaatcatttcttgggc

SEQ ID NO: 1119596 - DNA, 21 bp, Homo sapiens
gtgtaatcatttcttgggccc

SEQ ID NO: 1119597 - DNA, 19 bp, Homo sapiens
gtgtaatccaggggtgtag

SEQ ID NO: 1119598 - DNA, 19 bp, Homo sapiens
gtgtaatctaagtatatgt

SEQ ID NO: 1119599 - DNA, 13 bp, Homo sapiens
gtgtacaaagaaa

SEQ ID NO: 1119600 - DNA, 20 bp, Homo sapiens
gtgtacaatgtacacactgg

SEQ ID NO: 1119601 - DNA, 13 bp, Homo sapiens
gtgtacagtgaat

SEQ ID NO: 1119602 - DNA, 21 bp, Homo sapiens
gtgtacagtgaattgtctttt

SEQ ID NO: 1119603 - DNA, 12 bp, Homo sapiens
gtgtacagtgtg

SEQ ID NO: 1119604 - DNA, 17 bp, Homo sapiens
gtgtacatcatgttatt

SEQ ID NO: 1119605 - DNA, 17 bp, Homo sapiens
gtgtacatggaataaca

SEQ ID NO: 1119606 - DNA, 17 bp, Homo sapiens
gtgtacattaccatata

SEQ ID NO: 1119607 - DNA, 18 bp, Homo sapiens
gtgtacatttatgttcct

SEQ ID NO: 1119608 - DNA, 18 bp, Homo sapiens
gtgtaccacttctgtggg

SEQ ID NO: 1119609 - DNA, 19 bp, Homo sapiens
gtgtaccacttctgtgggc

SEQ ID NO: 1119610 - DNA, 20 bp, Homo sapiens
gtgtacctgtgtacataact

SEQ ID NO: 1119611 - DNA, 22 bp, Homo sapiens
gtgtactgtgcctggtttgatt

SEQ ID NO: 1119612 - DNA, 16 bp, Homo sapiens
gtgtactttttttgga

SEQ ID NO: 1119613 - DNA, 13 bp, Homo sapiens
gtgtagaaactgg

SEQ ID NO: 1119614 - DNA, 14 bp, Homo sapiens
gtgtagaacactaa

SEQ ID NO: 1119615 - DNA, 15 bp, Homo sapiens
gtgtagaacactaat

SEQ ID NO: 1119616 - DNA, 19 bp, Homo sapiens
gtgtagaacactaattcat

SEQ ID NO: 1119617 - DNA, 16 bp, Homo sapiens
gtgtagacctgagctg

SEQ ID NO: 1119618 - DNA, 23 bp, Homo sapiens
gtgtagatagttaaaagactgca

SEQ ID NO: 1119619 - DNA, 16 bp, Homo sapiens
gtgtagcaactacagt

SEQ ID NO: 1119620 - DNA, 21 bp, Homo sapiens
gtgtagccaggtatggctctg

SEQ ID NO: 1119621 - DNA, 23 bp, Homo sapiens
gtgtagccaggtatggctctgca

SEQ ID NO: 1119622 - DNA, 20 bp, Homo sapiens
gtgtagcctaaagggcaggg

SEQ ID NO: 1119623 - DNA, 21 bp, Homo sapiens
gtgtagcctaaagggcagggc

SEQ ID NO: 1119624 - DNA, 11 bp, Homo sapiens
gtgtagccttt

SEQ ID NO: 1119625 - DNA, 18 bp, Homo sapiens
gtgtagcgggaggaagcc

SEQ ID NO: 1119626 - DNA, 14 bp, Homo sapiens
gtgtagctgagctg

SEQ ID NO: 1119627 - DNA, 15 bp, Homo sapiens
gtgtagctgagctgt

SEQ ID NO: 1119628 - DNA, 12 bp, Homo sapiens
gtgtagctgtaa

SEQ ID NO: 1119629 - DNA, 19 bp, Homo sapiens
gtgtagctgtaagggcagt

SEQ ID NO: 1119630 - DNA, 15 bp, Homo sapiens
gtgtagctgtgtggc

SEQ ID NO: 1119631 - DNA, 14 bp, Homo sapiens
gtgtagctttgctc

SEQ ID NO: 1119632 - DNA, 15 bp, Homo sapiens
gtgtaggcagacaca

SEQ ID NO: 1119633 - DNA, 14 bp, Homo sapiens
gtgtaggttatctt

SEQ ID NO: 1119634 - DNA, 23 bp, Homo sapiens
gtgtaggttccgtatctccctgg

SEQ ID NO: 1119635 - DNA, 12 bp, Homo sapiens
gtgtataaatgt

SEQ ID NO: 1119636 - DNA, 16 bp, Homo sapiens
gtgtataccacctgta

SEQ ID NO: 1119637 - DNA, 14 bp, Homo sapiens
gtgtatagtgttca

SEQ ID NO: 1119638 - DNA, 23 bp, Homo sapiens
gtgtatagtgttcacaaactgtg

SEQ ID NO: 1119639 - DNA, 15 bp, Homo sapiens
gtgtatataattttt

SEQ ID NO: 1119640 - DNA, 21 bp, Homo sapiens
gtgtatataattttttaaaaa

SEQ ID NO: 1119641 - DNA, 21 bp, Homo sapiens
gtgtatatattataaaaatta

SEQ ID NO: 1119642 - DNA, 17 bp, Homo sapiens
gtgtatatcatgaagcc

SEQ ID NO: 1119643 - DNA, 18 bp, Homo sapiens
gtgtatatcatgaagcct

SEQ ID NO: 1119644 - DNA, 21 bp, Homo sapiens
gtgtatatcatgaagccttgc

SEQ ID NO: 1119645 - DNA, 20 bp, Homo sapiens
gtgtttgaggccaaaacaga

SEQ ID NO: 1119646 - DNA, 20 bp, Homo sapiens
gtgtttgctgccttgctcct

SEQ ID NO: 1119647 - DNA, 22 bp, Homo sapiens
gtgtttgcttaaaatatgtgaa

SEQ ID NO: 1119648 - DNA, 18 bp, Homo sapiens
gtgtttgcttaaacaaag

SEQ ID NO: 1119649 - DNA, 19 bp, Homo sapiens
gtgtttgcttaaacaaagt

SEQ ID NO: 1119650 - DNA, 16 bp, Homo sapiens
gtgtttggcaatgcta

SEQ ID NO: 1119651 - DNA, 21 bp, Homo sapiens
gtgtttgggtcacccctccag

SEQ ID NO: 1119652 - DNA, 15 bp, Homo sapiens
gtgtttgtcctgggt

SEQ ID NO: 1119653 - DNA, 12 bp, Homo sapiens
gtgtttgttcct

SEQ ID NO: 1119654 - DNA, 19 bp, Homo sapiens
gtgttttaaaaaaactgaa

SEQ ID NO: 1119655 - DNA, 20 bp, Homo sapiens
gtgttttaaaaaaactgaag

SEQ ID NO: 1119656 - DNA, 20 bp, Homo sapiens
gtgttttaagactgaatgtt

SEQ ID NO: 1119657 - DNA, 13 bp, Homo sapiens
gtgttttaattta

SEQ ID NO: 1119658 - DNA, 14 bp, Homo sapiens
gtgttttactcttt

SEQ ID NO: 1119659 - DNA, 18 bp, Homo sapiens
gtgttttagatgttacta

SEQ ID NO: 1119660 - DNA, 15 bp, Homo sapiens
gtgttttatttccta

SEQ ID NO: 1119661 - DNA, 21 bp, Homo sapiens
gtgttttcaaggaagaaaacg

SEQ ID NO: 1119662 - DNA, 16 bp, Homo sapiens
gtgttttcataataaa

SEQ ID NO: 1119663 - DNA, 13 bp, Homo sapiens
gtgttttctgaat

SEQ ID NO: 1119664 - DNA, 13 bp, Homo sapiens
gtgttttctgtag

SEQ ID NO: 1119665 - DNA, 15 bp, Homo sapiens
gtgttttgaaagaat

SEQ ID NO: 1119666 - DNA, 16 bp, Homo sapiens
gtgttttgcaagtgct

SEQ ID NO: 1119667 - DNA, 16 bp, Homo sapiens
gtgttttgtttattaa

SEQ ID NO: 1119668 - DNA, 19 bp, Homo sapiens
gtgtttttctcatatttga

SEQ ID NO: 1119669 - DNA, 14 bp, Homo sapiens
gtgtttttctgctt

SEQ ID NO: 1119670 - DNA, 15 bp, Homo sapiens
gtgttttttaagata

SEQ ID NO: 1119671 - DNA, 13 bp, Homo sapiens
gttaaaaaaataa

SEQ ID NO: 1119672 - DNA, 20 bp, Homo sapiens
gttaaaaacagatttggaaa

SEQ ID NO: 1119673 - DNA, 22 bp, Homo sapiens
gttaaaaagaaaagtttataaa

SEQ ID NO: 1119674 - DNA, 22 bp, Homo sapiens
gttaaaaaggccaaagataaaa

SEQ ID NO: 1119675 - DNA, 23 bp, Homo sapiens
gttaaaaataaaaactaatttca

SEQ ID NO: 1119676 - DNA, 21 bp, Homo sapiens
gttaaaataactagtgttgct

SEQ ID NO: 1119677 - DNA, 22 bp, Homo sapiens
gttaaaataccagccagtaaat

SEQ ID NO: 1119678 - DNA, 15 bp, Homo sapiens
gttaaaatcacattt

SEQ ID NO: 1119679 - DNA, 15 bp, Homo sapiens
gttaaaatgtacact

SEQ ID NO: 1119680 - DNA, 17 bp, Homo sapiens
gttaaacaaaatgaaaa

SEQ ID NO: 1119681 - DNA, 12 bp, Homo sapiens
gttaaacagtag

SEQ ID NO: 1119682 - DNA, 23 bp, Homo sapiens
gttaaacagtagttgtattcttc

SEQ ID NO: 1119683 - DNA, 19 bp, Homo sapiens
gttaaacggtgcccatcct

SEQ ID NO: 1119684 - DNA, 19 bp, Homo sapiens
gttaaactattagagtatt

SEQ ID NO: 1119685 - DNA, 12 bp, Homo sapiens
gttaaactgtta

SEQ ID NO: 1119686 - DNA, 21 bp, Homo sapiens
gttaaactgttagcactgttg

SEQ ID NO: 1119687 - DNA, 15 bp, Homo sapiens
gttaaagaagctgca

SEQ ID NO: 1119688 - DNA, 16 bp, Homo sapiens
gttaaagaagctgcat

SEQ ID NO: 1119689 - DNA, 11 bp, Homo sapiens
gttaaagccac

SEQ ID NO: 1119690 - DNA, 15 bp, Homo sapiens
gttaaagctgccggc

SEQ ID NO: 1119691 - DNA, 12 bp, Homo sapiens
gttaaagctgta

SEQ ID NO: 1119692 - DNA, 20 bp, Homo sapiens
gttaaagcttatttttatgt

SEQ ID NO: 1119693 - DNA, 18 bp, Homo sapiens
gttaaaggcaatggtttg

SEQ ID NO: 1119694 - DNA, 12 bp, Homo sapiens
gttaaaggcagt

SEQ ID NO: 1119695 - DNA, 16 bp, Homo sapiens
gttaaaggcagtccag

SEQ ID NO: 1119696 - DNA, 19 bp, Homo sapiens
gttaaaggcagtccagagc

SEQ ID NO: 1119697 - DNA, 20 bp, Homo sapiens
gttaaagtcagtgggaacgt

SEQ ID NO: 1119698 - DNA, 18 bp, Homo sapiens
gttaaataaatagaaaga

SEQ ID NO: 1119699 - DNA, 17 bp, Homo sapiens
gttaaatactgtgcaga

SEQ ID NO: 1119700 - DNA, 19 bp, Homo sapiens
gttaaatactgtgcagaat

SEQ ID NO: 1119701 - DNA, 20 bp, Homo sapiens
gttaaatactgtgcagaata

SEQ ID NO: 1119702 - DNA, 21 bp, Homo sapiens
gttaaatactgtgcagaataa

SEQ ID NO: 1119703 - DNA, 19 bp, Homo sapiens
gttaaatagagtatatgca

SEQ ID NO: 1119704 - DNA, 20 bp, Homo sapiens
gttaaatagagtatatgcac

SEQ ID NO: 1119705 - DNA, 16 bp, Homo sapiens
gttaaattacattttt

SEQ ID NO: 1119706 - DNA, 15 bp, Homo sapiens
gttaaattcatttta

SEQ ID NO: 1119707 - DNA, 19 bp, Homo sapiens
gttaacaggatattagaca

SEQ ID NO: 1119708 - DNA, 18 bp, Homo sapiens
gttaacatcatgaattta

SEQ ID NO: 1119709 - DNA, 20 bp, Homo sapiens
gttaacatcatgaatttatt

SEQ ID NO: 1119710 - DNA, 23 bp, Homo sapiens
gttaacattgaccaagaactgca

SEQ ID NO: 1119711 - DNA, 17 bp, Homo sapiens
gttaacccattccagta

SEQ ID NO: 1119712 - DNA, 17 bp, Homo sapiens
gttaacctcagtgtcat

SEQ ID NO: 1119713 - DNA, 15 bp, Homo sapiens
gttaacctttttgta

SEQ ID NO: 1119714 - DNA, 14 bp, Homo sapiens
gttaactacatatt

SEQ ID NO: 1119715 - DNA, 15 bp, Homo sapiens
gttaactctcccagg

SEQ ID NO: 1119716 - DNA, 16 bp, Homo sapiens
gttaactgaataccac

SEQ ID NO: 1119717 - DNA, 19 bp, Homo sapiens
gttaagaaaaactacagca

SEQ ID NO: 1119718 - DNA, 22 bp, Homo sapiens
gttaagaaaggatataaaagga

SEQ ID NO: 1119719 - DNA, 15 bp, Homo sapiens
gttaagaatgtcgat

SEQ ID NO: 1119720 - DNA, 22 bp, Homo sapiens
gttaagacatgatttccttgaa

SEQ ID NO: 1119721 - DNA, 16 bp, Homo sapiens
gttaagacttgacagt

SEQ ID NO: 1119722 - DNA, 17 bp, Homo sapiens
gttaagacttgacagtg

SEQ ID NO: 1119723 - DNA, 19 bp, Homo sapiens
gttaagacttgacagtgga

SEQ ID NO: 1119724 - DNA, 22 bp, Homo sapiens
gttaagagtgggggagagcagg

SEQ ID NO: 1119725 - DNA, 14 bp, Homo sapiens
gttaaggaaagaaa

SEQ ID NO: 1119726 - DNA, 14 bp, Homo sapiens
gttaaggaatataa

SEQ ID NO: 1119727 - DNA, 19 bp, Homo sapiens
gttaaggacttctgcagct

SEQ ID NO: 1119728 - DNA, 14 bp, Homo sapiens
gttaaggccagggc

SEQ ID NO: 1119729 - DNA, 14 bp, Homo sapiens
gttaagggaaggaa

SEQ ID NO: 1119730 - DNA, 22 bp, Homo sapiens
gttaagggaaggaactctggct

SEQ ID NO: 1119731 - DNA, 17 bp, Homo sapiens
gttaagggcatttttat

SEQ ID NO: 1119732 - DNA, 16 bp, Homo sapiens
gttaagtacccgaggc

SEQ ID NO: 1119733 - DNA, 18 bp, Homo sapiens
gttaagtctatctggtat

SEQ ID NO: 1119734 - DNA, 16 bp, Homo sapiens
gttaagtctcctgtct

SEQ ID NO: 1119735 - DNA, 21 bp, Homo sapiens
gttaagtgccattactactgt

SEQ ID NO: 1119736 - DNA, 19 bp, Homo sapiens
gttaatacacagtacttta

SEQ ID NO: 1119737 - DNA, 13 bp, Homo sapiens
gttaataccagct

SEQ ID NO: 1119738 - DNA, 18 bp, Homo sapiens
gttaatagattatttcat

SEQ ID NO: 1119739 - DNA, 15 bp, Homo sapiens
gttaatatttaagac

SEQ ID NO: 1119740 - DNA, 18 bp, Homo sapiens
gttaatcattaggtgtga

SEQ ID NO: 1119741 - DNA, 23 bp, Homo sapiens
gttaatccacatctttactcagg

SEQ ID NO: 1119742 - DNA, 19 bp, Homo sapiens
gttaatctcccagcccacc

SEQ ID NO: 1119743 - DNA, 17 bp, Homo sapiens
gttaatcttaatgtata

SEQ ID NO: 1119744 - DNA, 19 bp, Homo sapiens
gttaatcttaatgtatatc

SEQ ID NO: 1119745 - DNA, 16 bp, Homo sapiens
gttaatgaaaatgtca

SEQ ID NO: 1119746 - DNA, 13 bp, Homo sapiens
gttaatgagccat

SEQ ID NO: 1119747 - DNA, 22 bp, Homo sapiens
gttaatgatggttgatgggttc

SEQ ID NO: 1119748 - DNA, 19 bp, Homo sapiens
gttaatggctagtactgta

SEQ ID NO: 1119749 - DNA, 22 bp, Homo sapiens
gttaatggctagtactgtattg

SEQ ID NO: 1119750 - DNA, 17 bp, Homo sapiens
gttaatgtcattgctaa

SEQ ID NO: 1119751 - DNA, 16 bp, Homo sapiens
gttaattcctatgaag

SEQ ID NO: 1119752 - DNA, 23 bp, Homo sapiens
gttaattgtaattgcatgacaaa

SEQ ID NO: 1119753 - DNA, 12 bp, Homo sapiens
gttaatttaaag

SEQ ID NO: 1119754 - DNA, 17 bp, Homo sapiens
gttaatttataatgtat

SEQ ID NO: 1119755 - DNA, 18 bp, Homo sapiens
gttaatttataatgtatt

SEQ ID NO: 1119756 - DNA, 19 bp, Homo sapiens
gttaatttataatgtattt

SEQ ID NO: 1119757 - DNA, 20 bp, Homo sapiens
gttaatttataatgtatttg

SEQ ID NO: 1119758 - DNA, 16 bp, Homo sapiens
gttaatttattttgct

SEQ ID NO: 1119759 - DNA, 20 bp, Homo sapiens
gttaatttattttgctccct

SEQ ID NO: 1119760 - DNA, 21 bp, Homo sapiens
gttaatttattttgctccctc

SEQ ID NO: 1119761 - DNA, 18 bp, Homo sapiens
gttaattttattcaagaa

SEQ ID NO: 1119762 - DNA, 20 bp, Homo sapiens
gttaatttttccaactacta

SEQ ID NO: 1119763 - DNA, 16 bp, Homo sapiens
gttaatttttcctgca

SEQ ID NO: 1119764 - DNA, 23 bp, Homo sapiens
gttaatttttcctgcatgttctg

SEQ ID NO: 1119765 - DNA, 9 bp, Homo sapiens
gttacaaac

SEQ ID NO: 1119766 - DNA, 16 bp, Homo sapiens
gttacaaactgcaata

SEQ ID NO: 1119767 - DNA, 12 bp, Homo sapiens
gttcccttctcc

SEQ ID NO: 1119768 - DNA, 16 bp, Homo sapiens
gttcccttctccccct

SEQ ID NO: 1119769 - DNA, 19 bp, Homo sapiens
gttcccttggcctcagaat

SEQ ID NO: 1119770 - DNA, 15 bp, Homo sapiens
gttccctttgcctta

SEQ ID NO: 1119771 - DNA, 18 bp, Homo sapiens
gttccctttgccttaaac

SEQ ID NO: 1119772 - DNA, 20 bp, Homo sapiens
gttccgaaaccaaagaagaa

SEQ ID NO: 1119773 - DNA, 14 bp, Homo sapiens
gttccggcctgggc

SEQ ID NO: 1119774 - DNA, 15 bp, Homo sapiens
gttccgggaggcaga

SEQ ID NO: 1119775 - DNA, 22 bp, Homo sapiens
gttccgggcaaatgccagggcc

SEQ ID NO: 1119776 - DNA, 13 bp, Homo sapiens
gttccgtgtgggc

SEQ ID NO: 1119777 - DNA, 15 bp, Homo sapiens
gttcctaagggaaag

SEQ ID NO: 1119778 - DNA, 15 bp, Homo sapiens
gttcctatggaaaca

SEQ ID NO: 1119779 - DNA, 18 bp, Homo sapiens
gttcctatggaaacattt

SEQ ID NO: 1119780 - DNA, 18 bp, Homo sapiens
gttcctcatgttgctgaa

SEQ ID NO: 1119781 - DNA, 16 bp, Homo sapiens
gttcctccattttctt

SEQ ID NO: 1119782 - DNA, 16 bp, Homo sapiens
gttcctcgccctgggt

SEQ ID NO: 1119783 - DNA, 17 bp, Homo sapiens
gttcctcggtgggccag

SEQ ID NO: 1119784 - DNA, 20 bp, Homo sapiens
gttcctcggtgggccagagc

SEQ ID NO: 1119785 - DNA, 21 bp, Homo sapiens
gttcctcggtgggccagagct

SEQ ID NO: 1119786 - DNA, 12 bp, Homo sapiens
gttcctctgcct

SEQ ID NO: 1119787 - DNA, 15 bp, Homo sapiens
gttcctctgcctgcc

SEQ ID NO: 1119788 - DNA, 23 bp, Homo sapiens
gttcctctgctcaccgcccatca

SEQ ID NO: 1119789 - DNA, 18 bp, Homo sapiens
gttcctctgggtttctaa

SEQ ID NO: 1119790 - DNA, 16 bp, Homo sapiens
gttcctgaagctgctg

SEQ ID NO: 1119791 - DNA, 21 bp, Homo sapiens
gttcctgagtgcgtggatctg

SEQ ID NO: 1119792 - DNA, 22 bp, Homo sapiens
gttcctgcagccccagaagaaa

SEQ ID NO: 1119793 - DNA, 23 bp, Homo sapiens
gttcctgctccatgactggctgt

SEQ ID NO: 1119794 - DNA, 18 bp, Homo sapiens
gttcctgctctctgctca

SEQ ID NO: 1119795 - DNA, 21 bp, Homo sapiens
gttcctgctctctgctcatgg

SEQ ID NO: 1119796 - DNA, 14 bp, Homo sapiens
gttcctggaagcag

SEQ ID NO: 1119797 - DNA, 23 bp, Homo sapiens
gttcctggaagcaggtgctacaa

SEQ ID NO: 1119798 - DNA, 13 bp, Homo sapiens
gttcctggcaata

SEQ ID NO: 1119799 - DNA, 14 bp, Homo sapiens
gttcctggcagttt

SEQ ID NO: 1119800 - DNA, 23 bp, Homo sapiens
gttcctggcatttgctgatttct

SEQ ID NO: 1119801 - DNA, 21 bp, Homo sapiens
gttcctggctgatgatccaga

SEQ ID NO: 1119802 - DNA, 13 bp, Homo sapiens
gttcctggggccg

SEQ ID NO: 1119803 - DNA, 23 bp, Homo sapiens
gttcctggggccgcctgccctgc

SEQ ID NO: 1119804 - DNA, 14 bp, Homo sapiens
gttcctgtggagac

SEQ ID NO: 1119805 - DNA, 15 bp, Homo sapiens
gttcctgtggagaca

SEQ ID NO: 1119806 - DNA, 16 bp, Homo sapiens
gttcctgtggagacac

SEQ ID NO: 1119807 - DNA, 14 bp, Homo sapiens
gttcctgtttgaaa

SEQ ID NO: 1119808 - DNA, 14 bp, Homo sapiens
gttccttactgcag

SEQ ID NO: 1119809 - DNA, 15 bp, Homo sapiens
gttccttatttctct

SEQ ID NO: 1119810 - DNA, 19 bp, Homo sapiens
gttccttatttctctctcc

SEQ ID NO: 1119811 - DNA, 15 bp, Homo sapiens
gttccttccctggga

SEQ ID NO: 1119812 - DNA, 17 bp, Homo sapiens
gttccttccctgggaag

SEQ ID NO: 1119813 - DNA, 20 bp, Homo sapiens
gttccttcctccactgcgct

SEQ ID NO: 1119814 - DNA, 19 bp, Homo sapiens
gttccttcctctgagcctt

SEQ ID NO: 1119815 - DNA, 15 bp, Homo sapiens
gttccttctctgggt

SEQ ID NO: 1119816 - DNA, 23 bp, Homo sapiens
gttccttgatctgtatatacaat

SEQ ID NO: 1119817 - DNA, 12 bp, Homo sapiens
gttccttgcctt

SEQ ID NO: 1119818 - DNA, 15 bp, Homo sapiens
gttccttgccttaat

SEQ ID NO: 1119819 - DNA, 23 bp, Homo sapiens
gttccttgccttaataaatatgt

SEQ ID NO: 1119820 - DNA, 22 bp, Homo sapiens
gttcctttcatctctctacctc

SEQ ID NO: 1119821 - DNA, 23 bp, Homo sapiens
gttcctttccttttctttaaaga

SEQ ID NO: 1119822 - DNA, 13 bp, Homo sapiens
gttcctttctttt

SEQ ID NO: 1119823 - DNA, 19 bp, Homo sapiens
gttcctttgtgtgtactca

SEQ ID NO: 1119824 - DNA, 19 bp, Homo sapiens
gttcctttgttaaatttag

SEQ ID NO: 1119825 - DNA, 19 bp, Homo sapiens
gttccttttctctcctgtg

SEQ ID NO: 1119826 - DNA, 18 bp, Homo sapiens
gttcctttttaaatgtga

SEQ ID NO: 1119827 - DNA, 20 bp, Homo sapiens
gttcctttttaaatgtgaat

SEQ ID NO: 1119828 - DNA, 22 bp, Homo sapiens
gttccttttttcaatatgcaag

SEQ ID NO: 1119829 - DNA, 22 bp, Homo sapiens
gttcgaaatagatatcctctcc

SEQ ID NO: 1119830 - DNA, 16 bp, Homo sapiens
gttcgagaccagcctg

SEQ ID NO: 1119831 - DNA, 19 bp, Homo sapiens
gttcgcaccattctcctgc

SEQ ID NO: 1119832 - DNA, 13 bp, Homo sapiens
gttcgcagagctt

SEQ ID NO: 1119833 - DNA, 17 bp, Homo sapiens
gttcgtaccgcttcctt

SEQ ID NO: 1119834 - DNA, 13 bp, Homo sapiens
gttcgtagctttc

SEQ ID NO: 1119835 - DNA, 17 bp, Homo sapiens
gttcgttggggacatga

SEQ ID NO: 1119836 - DNA, 19 bp, Homo sapiens
gttcgttggtagagccctc

SEQ ID NO: 1119837 - DNA, 19 bp, Homo sapiens
gttctaaaaattgtgatca

SEQ ID NO: 1119838 - DNA, 23 bp, Homo sapiens
gttctaaagatggaaaaaccacc

SEQ ID NO: 1119839 - DNA, 20 bp, Homo sapiens
gttctaacagatcagaacat

SEQ ID NO: 1119840 - DNA, 14 bp, Homo sapiens
gttctaagaaaccc

SEQ ID NO: 1119841 - DNA, 14 bp, Homo sapiens
gttctaaggggacc

SEQ ID NO: 1119842 - DNA, 20 bp, Homo sapiens
gttctacagtcgtaaaagag

SEQ ID NO: 1119843 - DNA, 16 bp, Homo sapiens
gttctactcaggctgg

SEQ ID NO: 1119844 - DNA, 20 bp, Homo sapiens
gttctagacgcccctcccaa

SEQ ID NO: 1119845 - DNA, 23 bp, Homo sapiens
gttctagagaagaggctggtgct

SEQ ID NO: 1119846 - DNA, 17 bp, Homo sapiens
gttctagcgcagttttt

SEQ ID NO: 1119847 - DNA, 13 bp, Homo sapiens
gttctaggccccc

SEQ ID NO: 1119848 - DNA, 22 bp, Homo sapiens
gttctaggggagaagagccctg

SEQ ID NO: 1119849 - DNA, 23 bp, Homo sapiens
gttctaggggagaagagccctgg

SEQ ID NO: 1119850 - DNA, 14 bp, Homo sapiens
gttctagtctcctt

SEQ ID NO: 1119851 - DNA, 14 bp, Homo sapiens
gttctagttttcag

SEQ ID NO: 1119852 - DNA, 21 bp, Homo sapiens
gttctataagaataaggcttt

SEQ ID NO: 1119853 - DNA, 21 bp, Homo sapiens
gttctatcccacccaacagct

SEQ ID NO: 1119854 - DNA, 20 bp, Homo sapiens
gttctatccttttgcctgca

SEQ ID NO: 1119855 - DNA, 15 bp, Homo sapiens
gttctatgcctttag

SEQ ID NO: 1119856 - DNA, 17 bp, Homo sapiens
gttctatttttcaatca

SEQ ID NO: 1119857 - DNA, 17 bp, Homo sapiens
gttctcaagaatctaga

SEQ ID NO: 1119858 - DNA, 14 bp, Homo sapiens
gttctcaatgaaaa

SEQ ID NO: 1119859 - DNA, 18 bp, Homo sapiens
gttctcacaccaacagtg

SEQ ID NO: 1119860 - DNA, 17 bp, Homo sapiens
gttctcacacccaccgt

SEQ ID NO: 1119861 - DNA, 15 bp, Homo sapiens
gttctcactgggaag

SEQ ID NO: 1119862 - DNA, 23 bp, Homo sapiens
gttctcagaatcccttaacagtt

SEQ ID NO: 1119863 - DNA, 16 bp, Homo sapiens
gttctcagagccaagt

SEQ ID NO: 1119864 - DNA, 23 bp, Homo sapiens
gttctcatttggtctgccagaat

SEQ ID NO: 1119865 - DNA, 17 bp, Homo sapiens
gttctccagaatgtaag

SEQ ID NO: 1119866 - DNA, 13 bp, Homo sapiens
gttctcccagcac

SEQ ID NO: 1119867 - DNA, 12 bp, Homo sapiens
gttctcccaggg

SEQ ID NO: 1119868 - DNA, 14 bp, Homo sapiens
gttctcccagggag

SEQ ID NO: 1119869 - DNA, 17 bp, Homo sapiens
gttctcccagggagtga

SEQ ID NO: 1119870 - DNA, 19 bp, Homo sapiens
gttctcccagggagtgagc

SEQ ID NO: 1119871 - DNA, 22 bp, Homo sapiens
gttctcccagggagtgagcagc

SEQ ID NO: 1119872 - DNA, 20 bp, Homo sapiens
gttctccctgtacagtgtta

SEQ ID NO: 1119873 - DNA, 19 bp, Homo sapiens
gttctccctttctctctcc

SEQ ID NO: 1119874 - DNA, 20 bp, Homo sapiens
gttctccctttctctctcct

SEQ ID NO: 1119875 - DNA, 15 bp, Homo sapiens
gttctcctgcttgta

SEQ ID NO: 1119876 - DNA, 20 bp, Homo sapiens
gttctccttcctcagcctcc

SEQ ID NO: 1119877 - DNA, 22 bp, Homo sapiens
gttctccttttcctctctcccg

SEQ ID NO: 1119878 - DNA, 17 bp, Homo sapiens
gttctctcccctcacat

SEQ ID NO: 1119879 - DNA, 23 bp, Homo sapiens
gttctctcccctcacatcctcct

SEQ ID NO: 1119880 - DNA, 17 bp, Homo sapiens
gttctctgatgcagaaa

SEQ ID NO: 1119881 - DNA, 18 bp, Homo sapiens
gttctctgatgcagaaat

SEQ ID NO: 1119882 - DNA, 19 bp, Homo sapiens
gttctctgggagaaaatca

SEQ ID NO: 1119883 - DNA, 21 bp, Homo sapiens
gttctctgggagaaaatcatc

SEQ ID NO: 1119884 - DNA, 19 bp, Homo sapiens
gttctctggtttcaccagc

SEQ ID NO: 1119885 - DNA, 15 bp, Homo sapiens
gttctcttaaatatt

SEQ ID NO: 1119886 - DNA, 15 bp, Homo sapiens
gttctcttcccaggc

SEQ ID NO: 1119887 - DNA, 22 bp, Homo sapiens
gttctcttcccaggcctttgga

SEQ ID NO: 1119888 - DNA, 18 bp, Homo sapiens
gttggaaggatctgctga

SEQ ID NO: 1119889 - DNA, 17 bp, Homo sapiens
gttggaatggatttttc

SEQ ID NO: 1119890 - DNA, 22 bp, Homo sapiens
gttggaatggatttttctttaa

SEQ ID NO: 1119891 - DNA, 15 bp, Homo sapiens
gttggacagacactg

SEQ ID NO: 1119892 - DNA, 16 bp, Homo sapiens
gttggacccgctctgg

SEQ ID NO: 1119893 - DNA, 23 bp, Homo sapiens
gttggacttttcgttaacattga

SEQ ID NO: 1119894 - DNA, 13 bp, Homo sapiens
gttggagccactc

SEQ ID NO: 1119895 - DNA, 16 bp, Homo sapiens
gttggagctcattctg

SEQ ID NO: 1119896 - DNA, 18 bp, Homo sapiens
gttggagtactatattta

SEQ ID NO: 1119897 - DNA, 15 bp, Homo sapiens
gttggatgggagtgg

SEQ ID NO: 1119898 - DNA, 14 bp, Homo sapiens
gttggatgtagcat

SEQ ID NO: 1119899 - DNA, 18 bp, Homo sapiens
gttggatttataaatgct

SEQ ID NO: 1119900 - DNA, 20 bp, Homo sapiens
gttggatttgctcattgctg

SEQ ID NO: 1119901 - DNA, 20 bp, Homo sapiens
gttggatttttgtcttgtgt

SEQ ID NO: 1119902 - DNA, 17 bp, Homo sapiens
gttggcacatttcatga

SEQ ID NO: 1119903 - DNA, 15 bp, Homo sapiens
gttggcaccccagct

SEQ ID NO: 1119904 - DNA, 15 bp, Homo sapiens
gttggcactcacaga

SEQ ID NO: 1119905 - DNA, 12 bp, Homo sapiens
gttggcacttat

SEQ ID NO: 1119906 - DNA, 13 bp, Homo sapiens
gttggcagagaag

SEQ ID NO: 1119907 - DNA, 14 bp, Homo sapiens
gttggcagagaagg

SEQ ID NO: 1119908 - DNA, 20 bp, Homo sapiens
gttggcagagaaggcctctt

SEQ ID NO: 1119909 - DNA, 17 bp, Homo sapiens
gttggcaggctggccag

SEQ ID NO: 1119910 - DNA, 15 bp, Homo sapiens
gttggccaccttgct

SEQ ID NO: 1119911 - DNA, 20 bp, Homo sapiens
gttggccagattgtggggtg

SEQ ID NO: 1119912 - DNA, 22 bp, Homo sapiens
gttggcccttccagtgggatta

SEQ ID NO: 1119913 - DNA, 20 bp, Homo sapiens
gttggcccttgtcttttcaa

SEQ ID NO: 1119914 - DNA, 13 bp, Homo sapiens
gttggcctccggc

SEQ ID NO: 1119915 - DNA, 13 bp, Homo sapiens
gttggcgggggca

SEQ ID NO: 1119916 - DNA, 14 bp, Homo sapiens
gttggctggatgaa

SEQ ID NO: 1119917 - DNA, 13 bp, Homo sapiens
gttggctgggccc

SEQ ID NO: 1119918 - DNA, 14 bp, Homo sapiens
gttggctgggccca

SEQ ID NO: 1119919 - DNA, 21 bp, Homo sapiens
gttggctgtgttcgggggagc

SEQ ID NO: 1119920 - DNA, 18 bp, Homo sapiens
gttgggaagttttggaaa

SEQ ID NO: 1119921 - DNA, 22 bp, Homo sapiens
gttgggagccctttggagaacg

SEQ ID NO: 1119922 - DNA, 18 bp, Homo sapiens
gttgggattcctgaccca

SEQ ID NO: 1119923 - DNA, 22 bp, Homo sapiens
gttgggattgggggctggtgcc

SEQ ID NO: 1119924 - DNA, 13 bp, Homo sapiens
gttgggcccagat

SEQ ID NO: 1119925 - DNA, 15 bp, Homo sapiens
gttgggcccagatct

SEQ ID NO: 1119926 - DNA, 21 bp, Homo sapiens
gttgggctatagcacacagtt

SEQ ID NO: 1119927 - DNA, 17 bp, Homo sapiens
gttgggctcgcactgcc

SEQ ID NO: 1119928 - DNA, 19 bp, Homo sapiens
gttgggctcgcactgccca

SEQ ID NO: 1119929 - DNA, 18 bp, Homo sapiens
gttggggaagggcctgcc

SEQ ID NO: 1119930 - DNA, 13 bp, Homo sapiens
gttggggccctct

SEQ ID NO: 1119931 - DNA, 22 bp, Homo sapiens
gttggggccctcttgccagcct

SEQ ID NO: 1119932 - DNA, 23 bp, Homo sapiens
gttggggccctcttgccagcctc

SEQ ID NO: 1119933 - DNA, 16 bp, Homo sapiens
gttggggcttcacagc

SEQ ID NO: 1119934 - DNA, 14 bp, Homo sapiens
gttgggggaatgca

SEQ ID NO: 1119935 - DNA, 13 bp, Homo sapiens
gttggggtgacag

SEQ ID NO: 1119936 - DNA, 21 bp, Homo sapiens
gttgggtcaccagacggggct

SEQ ID NO: 1119937 - DNA, 15 bp, Homo sapiens
gttgggtgggtgggc

SEQ ID NO: 1119938 - DNA, 17 bp, Homo sapiens
gttgggtttgctcatgt

SEQ ID NO: 1119939 - DNA, 16 bp, Homo sapiens
gttgggtttttgctgt

SEQ ID NO: 1119940 - DNA, 14 bp, Homo sapiens
gttggtaaacagtt

SEQ ID NO: 1119941 - DNA, 21 bp, Homo sapiens
gttggtacctttctagcctta

SEQ ID NO: 1119942 - DNA, 22 bp, Homo sapiens
gttggtacctttctagccttag

SEQ ID NO: 1119943 - DNA, 18 bp, Homo sapiens
gttggtcaggctggtctc

SEQ ID NO: 1119944 - DNA, 14 bp, Homo sapiens
gttggtccactgtg

SEQ ID NO: 1119945 - DNA, 14 bp, Homo sapiens
gttggtccagagcg

SEQ ID NO: 1119946 - DNA, 16 bp, Homo sapiens
gttggtcctctctctg

SEQ ID NO: 1119947 - DNA, 14 bp, Homo sapiens
gttggttggataag

SEQ ID NO: 1119948 - DNA, 23 bp, Homo sapiens
gttggtttcactgagagctgcct

SEQ ID NO: 1119949 - DNA, 19 bp, Homo sapiens
gttgtaaactgttgttttg

SEQ ID NO: 1119950 - DNA, 21 bp, Homo sapiens
gttgtaaagtatgtattattt

SEQ ID NO: 1119951 - DNA, 18 bp, Homo sapiens
gttgtaaatatataaata

SEQ ID NO: 1119952 - DNA, 14 bp, Homo sapiens
gttgtaaatattta

SEQ ID NO: 1119953 - DNA, 16 bp, Homo sapiens
gttgtaaattggcatg

SEQ ID NO: 1119954 - DNA, 20 bp, Homo sapiens
gttgtaacaaatacagatga

SEQ ID NO: 1119955 - DNA, 22 bp, Homo sapiens
gttgtaacttatattgaagaca

SEQ ID NO: 1119956 - DNA, 14 bp, Homo sapiens
gttgtacacagtct

SEQ ID NO: 1119957 - DNA, 23 bp, Homo sapiens
gttgtactttatatcttgtttac

SEQ ID NO: 1119958 - DNA, 18 bp, Homo sapiens
gttgtagcatttaaaatg

SEQ ID NO: 1119959 - DNA, 17 bp, Homo sapiens
gttgtataaatttattt

SEQ ID NO: 1119960 - DNA, 12 bp, Homo sapiens
gttgtattcatt

SEQ ID NO: 1119961 - DNA, 14 bp, Homo sapiens
gttgtattcttctg

SEQ ID NO: 1119962 - DNA, 16 bp, Homo sapiens
gttgtatttaacagaa

SEQ ID NO: 1119963 - DNA, 15 bp, Homo sapiens
gttgtcaaggaagaa

SEQ ID NO: 1119964 - DNA, 22 bp, Homo sapiens
gttgtcaagtctctgctggccc

SEQ ID NO: 1119965 - DNA, 19 bp, Homo sapiens
gttgtcaatattaaataca

SEQ ID NO: 1119966 - DNA, 21 bp, Homo sapiens
gttgtcaatattaaatacaga

SEQ ID NO: 1119967 - DNA, 22 bp, Homo sapiens
gttgtcagaatggaatccatct

SEQ ID NO: 1119968 - DNA, 23 bp, Homo sapiens
gttgtcagaatggaatccatctg

SEQ ID NO: 1119969 - DNA, 17 bp, Homo sapiens
gttgtcagcaggcaggc

SEQ ID NO: 1119970 - DNA, 13 bp, Homo sapiens
gttgtcattgtcc

SEQ ID NO: 1119971 - DNA, 17 bp, Homo sapiens
gttgtcccatctgccct

SEQ ID NO: 1119972 - DNA, 17 bp, Homo sapiens
gttgtccccgctggctc

SEQ ID NO: 1119973 - DNA, 23 bp, Homo sapiens
gttgtcctatggacaacttattt

SEQ ID NO: 1119974 - DNA, 19 bp, Homo sapiens
gttgtccttgccccactcc

SEQ ID NO: 1119975 - DNA, 20 bp, Homo sapiens
gttgtccttgccccactcct

SEQ ID NO: 1119976 - DNA, 14 bp, Homo sapiens
gttgtccttttcat

SEQ ID NO: 1119977 - DNA, 15 bp, Homo sapiens
gttgtccttttcata

SEQ ID NO: 1119978 - DNA, 18 bp, Homo sapiens
gttgtctattctgagcct

SEQ ID NO: 1119979 - DNA, 13 bp, Homo sapiens
gttgtctccttcc

SEQ ID NO: 1119980 - DNA, 23 bp, Homo sapiens
gttgtctccttccattcagatgt

SEQ ID NO: 1119981 - DNA, 18 bp, Homo sapiens
gttgtctctagagcaggg

SEQ ID NO: 1119982 - DNA, 15 bp, Homo sapiens
gttgtctctgatgca

SEQ ID NO: 1119983 - DNA, 22 bp, Homo sapiens
gttgtctctgttggtccactgt

SEQ ID NO: 1119984 - DNA, 22 bp, Homo sapiens
gttgtctgaagtcactgcacag

SEQ ID NO: 1119985 - DNA, 14 bp, Homo sapiens
gttgtctggcaagg

SEQ ID NO: 1119986 - DNA, 16 bp, Homo sapiens
gttgtcttatgtgaaa

SEQ ID NO: 1119987 - DNA, 22 bp, Homo sapiens
gttgtcttatgtgaaaaattaa

SEQ ID NO: 1119988 - DNA, 23 bp, Homo sapiens
gttgtcttatgtgaaaaattaac

SEQ ID NO: 1119989 - DNA, 14 bp, Homo sapiens
gttgtgaggcctgg

SEQ ID NO: 1119990 - DNA, 22 bp, Homo sapiens
gttgtgaggcctggccaggcac

SEQ ID NO: 1119991 - DNA, 20 bp, Homo sapiens
gttgtgagtttaccttgtat

SEQ ID NO: 1119992 - DNA, 13 bp, Homo sapiens
gttgtgcagggtg

SEQ ID NO: 1119993 - DNA, 21 bp, Homo sapiens
gttgtggaaagataataaatt

SEQ ID NO: 1119994 - DNA, 17 bp, Homo sapiens
gttgtggatatcagggt

SEQ ID NO: 1119995 - DNA, 14 bp, Homo sapiens
gttgtggatgctcc

SEQ ID NO: 1119996 - DNA, 20 bp, Homo sapiens
gttgtggcccccgccccctc

SEQ ID NO: 1119997 - DNA, 21 bp, Homo sapiens
gttgtggcccccgccccctcc

SEQ ID NO: 1119998 - DNA, 22 bp, Homo sapiens
gttgtggcccccgccccctccc

SEQ ID NO: 1119999 - DNA, 15 bp, Homo sapiens
gttgtgggcttcctg

SEQ ID NO: 1120000 - DNA, 21 bp, Homo sapiens
gttgtgtgagcgtggccttgg

SEQ ID NO: 1120001 - DNA, 19 bp, Homo sapiens
gttgtgtgtatatgtattt

SEQ ID NO: 1120002 - DNA, 14 bp, Homo sapiens
gttgtgttgtcacc

SEQ ID NO: 1120003 - DNA, 15 bp, Homo sapiens
gttgttaataaaagt

SEQ ID NO: 1120004 - DNA, 16 bp, Homo sapiens
gttgttaatgaaaatg

SEQ ID NO: 1120005 - DNA, 17 bp, Homo sapiens
gttgttaatgaaaatgt

SEQ ID NO: 1120006 - DNA, 14 bp, Homo sapiens
gttgttacattttt

SEQ ID NO: 1120007 - DNA, 19 bp, Homo sapiens
gttgttactaactaaactc

SEQ ID NO: 1120008 - DNA, 18 bp, Homo sapiens
gttgttccattttatgca

SEQ ID NO: 1120009 - DNA, 19 bp, Homo sapiens
gttgttccattttatgcag

SEQ ID NO: 1120010 - DNA, 14 bp, Homo sapiens
gtttctctgtgctc

SEQ ID NO: 1120011 - DNA, 19 bp, Homo sapiens
gtttctctttgattatttg

SEQ ID NO: 1120012 - DNA, 19 bp, Homo sapiens
gtttctgaaaattccagaa

SEQ ID NO: 1120013 - DNA, 19 bp, Homo sapiens
gtttctgaagtacttaaac

SEQ ID NO: 1120014 - DNA, 18 bp, Homo sapiens
gtttctgacacaagatcc

SEQ ID NO: 1120015 - DNA, 15 bp, Homo sapiens
gtttctgcagccctt

SEQ ID NO: 1120016 - DNA, 22 bp, Homo sapiens
gtttctgcagtagtctctgtgc

SEQ ID NO: 1120017 - DNA, 22 bp, Homo sapiens
gtttctggataaaccaccctct

SEQ ID NO: 1120018 - DNA, 22 bp, Homo sapiens
gtttctggggaaaaaaaagaga

SEQ ID NO: 1120019 - DNA, 19 bp, Homo sapiens
gtttctgggtccctgctcc

SEQ ID NO: 1120020 - DNA, 22 bp, Homo sapiens
gtttctgggtccctgctcccct

SEQ ID NO: 1120021 - DNA, 21 bp, Homo sapiens
gtttctggtggtctgttggca

SEQ ID NO: 1120022 - DNA, 16 bp, Homo sapiens
gtttctgtaacaaatt

SEQ ID NO: 1120023 - DNA, 23 bp, Homo sapiens
gtttctgtagaaaagaaaacatt

SEQ ID NO: 1120024 - DNA, 23 bp, Homo sapiens
gtttctgtatatgattctctgtg

SEQ ID NO: 1120025 - DNA, 15 bp, Homo sapiens
gtttctgtcctgtaa

SEQ ID NO: 1120026 - DNA, 22 bp, Homo sapiens
gtttctgtcgttaaaaacagat

SEQ ID NO: 1120027 - DNA, 14 bp, Homo sapiens
gtttctgttattaa

SEQ ID NO: 1120028 - DNA, 19 bp, Homo sapiens
gtttctgtttcaaagcaca

SEQ ID NO: 1120029 - DNA, 21 bp, Homo sapiens
gtttcttaaataagaaacttt

SEQ ID NO: 1120030 - DNA, 22 bp, Homo sapiens
gtttcttaaataagaaactttt

SEQ ID NO: 1120031 - DNA, 19 bp, Homo sapiens
gtttcttaagggcacacac

SEQ ID NO: 1120032 - DNA, 11 bp, Homo sapiens
gtttcttccaa

SEQ ID NO: 1120033 - DNA, 14 bp, Homo sapiens
gtttcttctggctt

SEQ ID NO: 1120034 - DNA, 11 bp, Homo sapiens
gtttcttcttc

SEQ ID NO: 1120035 - DNA, 13 bp, Homo sapiens
gtttcttcttgtg

SEQ ID NO: 1120036 - DNA, 16 bp, Homo sapiens
gtttcttcttttcctt

SEQ ID NO: 1120037 - DNA, 16 bp, Homo sapiens
gtttcttgcactgaat

SEQ ID NO: 1120038 - DNA, 18 bp, Homo sapiens
gtttcttgctctctctcc

SEQ ID NO: 1120039 - DNA, 23 bp, Homo sapiens
gtttcttgcttggaagccaggta

SEQ ID NO: 1120040 - DNA, 19 bp, Homo sapiens
gtttctttctctgaggaca

SEQ ID NO: 1120041 - DNA, 19 bp, Homo sapiens
gtttctttctgtctgcttt

SEQ ID NO: 1120042 - DNA, 14 bp, Homo sapiens
gtttctttgtgttg

SEQ ID NO: 1120043 - DNA, 17 bp, Homo sapiens
gtttcttttgtaaagag

SEQ ID NO: 1120044 - DNA, 20 bp, Homo sapiens
gtttcttttgtatgtaaatg

SEQ ID NO: 1120045 - DNA, 18 bp, Homo sapiens
gtttctttttacagcatt

SEQ ID NO: 1120046 - DNA, 24 bp, Homo sapiens
gtttctttttacagcattgtcttt

SEQ ID NO: 1120047 - DNA, 21 bp, Homo sapiens
gtttgaaaacttcagaagcaa

SEQ ID NO: 1120048 - DNA, 18 bp, Homo sapiens
gtttgaaaatgctcttaa

SEQ ID NO: 1120049 - DNA, 16 bp, Homo sapiens
gtttgaaacaaagaag

SEQ ID NO: 1120050 - DNA, 17 bp, Homo sapiens
gtttgaaagattatgat

SEQ ID NO: 1120051 - DNA, 21 bp, Homo sapiens
gtttgaaatgtcgatcaagag

SEQ ID NO: 1120052 - DNA, 22 bp, Homo sapiens
gtttgaacctttttttttgaaa

SEQ ID NO: 1120053 - DNA, 18 bp, Homo sapiens
gtttgaagacacagcctc

SEQ ID NO: 1120054 - DNA, 16 bp, Homo sapiens
gtttgaaggaaacagt

SEQ ID NO: 1120055 - DNA, 18 bp, Homo sapiens
gtttgaagtcaaatgtca

SEQ ID NO: 1120056 - DNA, 14 bp, Homo sapiens
gtttgaattaggct

SEQ ID NO: 1120057 - DNA, 16 bp, Homo sapiens
gtttgactttttggaa

SEQ ID NO: 1120058 - DNA, 18 bp, Homo sapiens
gtttgagacactggttta

SEQ ID NO: 1120059 - DNA, 23 bp, Homo sapiens
gtttgaggatatattttcacttt

SEQ ID NO: 1120060 - DNA, 19 bp, Homo sapiens
gtttgaggcaaattaactg

SEQ ID NO: 1120061 - DNA, 15 bp, Homo sapiens
gtttgatcagacagc

SEQ ID NO: 1120062 - DNA, 15 bp, Homo sapiens
gtttgatcatttctg

SEQ ID NO: 1120063 - DNA, 14 bp, Homo sapiens
gtttgattattatg

SEQ ID NO: 1120064 - DNA, 15 bp, Homo sapiens
gtttgattattatgt

SEQ ID NO: 1120065 - DNA, 13 bp, Homo sapiens
gtttgatttagta

SEQ ID NO: 1120066 - DNA, 14 bp, Homo sapiens
gtttgatttttgtt

SEQ ID NO: 1120067 - DNA, 18 bp, Homo sapiens
gtttgcaaaaaatgtttt

SEQ ID NO: 1120068 - DNA, 18 bp, Homo sapiens
gtttgcaacatatttaag

SEQ ID NO: 1120069 - DNA, 15 bp, Homo sapiens
gtttgcaccgcctgc

SEQ ID NO: 1120070 - DNA, 17 bp, Homo sapiens
gtttgcacctttctagt

SEQ ID NO: 1120071 - DNA, 19 bp, Homo sapiens
gtttgcactgtatgctgga

SEQ ID NO: 1120072 - DNA, 15 bp, Homo sapiens
gtttgcacttcctct

SEQ ID NO: 1120073 - DNA, 16 bp, Homo sapiens
gtttgcaggggtgacg

SEQ ID NO: 1120074 - DNA, 17 bp, Homo sapiens
gtttgccacttgatggg

SEQ ID NO: 1120075 - DNA, 15 bp, Homo sapiens
gtttgccatactttg

SEQ ID NO: 1120076 - DNA, 23 bp, Homo sapiens
gtttgcccaaaatttattttata

SEQ ID NO: 1120077 - DNA, 19 bp, Homo sapiens
gtttgcccagtcctgggtt

SEQ ID NO: 1120078 - DNA, 23 bp, Homo sapiens
gtttgccccgggatattatagaa

SEQ ID NO: 1120079 - DNA, 20 bp, Homo sapiens
gtttgcctgcagtttcttgt

SEQ ID NO: 1120080 - DNA, 15 bp, Homo sapiens
gtttgcctgctgtat

SEQ ID NO: 1120081 - DNA, 18 bp, Homo sapiens
gtttgccttcctttctcc

SEQ ID NO: 1120082 - DNA, 18 bp, Homo sapiens
gtttgctaaaagaagaga

SEQ ID NO: 1120083 - DNA, 13 bp, Homo sapiens
gtttgctaatgtt

SEQ ID NO: 1120084 - DNA, 20 bp, Homo sapiens
gtttgctcttttaagcagtc

SEQ ID NO: 1120085 - DNA, 16 bp, Homo sapiens
gtttgctgttgggttt

SEQ ID NO: 1120086 - DNA, 16 bp, Homo sapiens
gtttgcttaaacaaag

SEQ ID NO: 1120087 - DNA, 17 bp, Homo sapiens
gtttgcttaaacaaagt

SEQ ID NO: 1120088 - DNA, 14 bp, Homo sapiens
gtttgcttattgtt

SEQ ID NO: 1120089 - DNA, 16 bp, Homo sapiens
gtttgcttattgttcc

SEQ ID NO: 1120090 - DNA, 18 bp, Homo sapiens
gtttgcttattgttccaa

SEQ ID NO: 1120091 - DNA, 16 bp, Homo sapiens
gtttgcttcataaatg

SEQ ID NO: 1120092 - DNA, 16 bp, Homo sapiens
gtttggaaggagcaga

SEQ ID NO: 1120093 - DNA, 17 bp, Homo sapiens
gtttggaccccagctgg

SEQ ID NO: 1120094 - DNA, 19 bp, Homo sapiens
gtttggaccccagctggga

SEQ ID NO: 1120095 - DNA, 21 bp, Homo sapiens
gtttggactgcagaagcaagg

SEQ ID NO: 1120096 - DNA, 18 bp, Homo sapiens
gtttggatacatctgctg

SEQ ID NO: 1120097 - DNA, 20 bp, Homo sapiens
gtttggatacatctgctgtg

SEQ ID NO: 1120098 - DNA, 21 bp, Homo sapiens
gtttggatacatctgctgtgt

SEQ ID NO: 1120099 - DNA, 20 bp, Homo sapiens
gtttggatgggagtgagaca

SEQ ID NO: 1120100 - DNA, 20 bp, Homo sapiens
gtttggattcttatgtagca

SEQ ID NO: 1120101 - DNA, 19 bp, Homo sapiens
gtttggcaatagtttgcat

SEQ ID NO: 1120102 - DNA, 21 bp, Homo sapiens
gtttggcacttgtatttaatt

SEQ ID NO: 1120103 - DNA, 11 bp, Homo sapiens
gtttggccagg

SEQ ID NO: 1120104 - DNA, 11 bp, Homo sapiens
gtttggccctg

SEQ ID NO: 1120105 - DNA, 12 bp, Homo sapiens
gtttggccctgg

SEQ ID NO: 1120106 - DNA, 16 bp, Homo sapiens
gtttggccctggagcc

SEQ ID NO: 1120107 - DNA, 17 bp, Homo sapiens
gtttggccctggagcca

SEQ ID NO: 1120108 - DNA, 16 bp, Homo sapiens
gtttggcgggccaagg

SEQ ID NO: 1120109 - DNA, 23 bp, Homo sapiens
gtttggctgtgtctaaactgcat

SEQ ID NO: 1120110 - DNA, 16 bp, Homo sapiens
gtttggcttataaaca

SEQ ID NO: 1120111 - DNA, 15 bp, Homo sapiens
gtttgggagtcaggc

SEQ ID NO: 1120112 - DNA, 18 bp, Homo sapiens
gtttgggcccctcagagc

SEQ ID NO: 1120113 - DNA, 16 bp, Homo sapiens
gtttgggcccctctcc

SEQ ID NO: 1120114 - DNA, 15 bp, Homo sapiens
gtttggggagcagag

SEQ ID NO: 1120115 - DNA, 19 bp, Homo sapiens
gtttggggcagaaaggact

SEQ ID NO: 1120116 - DNA, 12 bp, Homo sapiens
gtttgggggaaa

SEQ ID NO: 1120117 - DNA, 18 bp, Homo sapiens
gtttgggggaaaaaaaag

SEQ ID NO: 1120118 - DNA, 19 bp, Homo sapiens
gtttggggtgccaagatgg

SEQ ID NO: 1120119 - DNA, 20 bp, Homo sapiens
gtttgggtaaaatactttta

SEQ ID NO: 1120120 - DNA, 16 bp, Homo sapiens
gtttggtagttagcca

SEQ ID NO: 1120121 - DNA, 15 bp, Homo sapiens
gtttggtctggactg

SEQ ID NO: 1120122 - DNA, 22 bp, Homo sapiens
gtttggttcacttacagatagt

SEQ ID NO: 1120123 - DNA, 13 bp, Homo sapiens
gtttgtaaaacta

SEQ ID NO: 1120124 - DNA, 22 bp, Homo sapiens
gtttgtaaaattgttcctgaat

SEQ ID NO: 1120125 - DNA, 15 bp, Homo sapiens
gtttgtaaataagag

SEQ ID NO: 1120126 - DNA, 17 bp, Homo sapiens
gtttgtaaataagagat

SEQ ID NO: 1120127 - DNA, 18 bp, Homo sapiens
gtttgtaaataagagatt

SEQ ID NO: 1120128 - DNA, 20 bp, Homo sapiens
gtttgtaaattaacttttat

SEQ ID NO: 1120129 - DNA, 16 bp, Homo sapiens
gtttgtaatactttac

SEQ ID NO: 1120130 - DNA, 19 bp, Homo sapiens
gtttgtacagtaatatgtt

SEQ ID NO: 1120131 - DNA, 20 bp, Homo sapiens
taaaacaaaaccaagccttg

SEQ ID NO: 1120132 - DNA, 17 bp, Homo sapiens
taaaacaaaatttgact

SEQ ID NO: 1120133 - DNA, 17 bp, Homo sapiens
taaaacaaaatttgttt

SEQ ID NO: 1120134 - DNA, 21 bp, Homo sapiens
taaaacaagaggacacaatgg

SEQ ID NO: 1120135 - DNA, 11 bp, Homo sapiens
taaaacaagcc

SEQ ID NO: 1120136 - DNA, 14 bp, Homo sapiens
taaaacaatattgt

SEQ ID NO: 1120137 - DNA, 22 bp, Homo sapiens
taaaacaattttttttttcctc

SEQ ID NO: 1120138 - DNA, 14 bp, Homo sapiens
taaaacacacaggt

SEQ ID NO: 1120139 - DNA, 15 bp, Homo sapiens
taaaacacctttcct

SEQ ID NO: 1120140 - DNA, 19 bp, Homo sapiens
taaaacacttattccctca

SEQ ID NO: 1120141 - DNA, 13 bp, Homo sapiens
taaaacagaaaaa

SEQ ID NO: 1120142 - DNA, 14 bp, Homo sapiens
taaaacagaagcct

SEQ ID NO: 1120143 - DNA, 19 bp, Homo sapiens
taaaacagaatcttctggg

SEQ ID NO: 1120144 - DNA, 13 bp, Homo sapiens
taaaacagacact

SEQ ID NO: 1120145 - DNA, 15 bp, Homo sapiens
taaaacagacactgg

SEQ ID NO: 1120146 - DNA, 17 bp, Homo sapiens
taaaacagacactggca

SEQ ID NO: 1120147 - DNA, 18 bp, Homo sapiens
taaaacagacactggcat

SEQ ID NO: 1120148 - DNA, 22 bp, Homo sapiens
taaaacaggtagaattatctaa

SEQ ID NO: 1120149 - DNA, 14 bp, Homo sapiens
taaaacatatttca

SEQ ID NO: 1120150 - DNA, 16 bp, Homo sapiens
taaaacatatttcatt

SEQ ID NO: 1120151 - DNA, 18 bp, Homo sapiens
taaaacatatttcatttt

SEQ ID NO: 1120152 - DNA, 20 bp, Homo sapiens
taaaacatatttcattttaa

SEQ ID NO: 1120153 - DNA, 13 bp, Homo sapiens
taaaacattaaga

SEQ ID NO: 1120154 - DNA, 14 bp, Homo sapiens
taaaacattaagaa

SEQ ID NO: 1120155 - DNA, 13 bp, Homo sapiens
taaaacattatat

SEQ ID NO: 1120156 - DNA, 13 bp, Homo sapiens
taaaaccacagct

SEQ ID NO: 1120157 - DNA, 23 bp, Homo sapiens
taaaaccatcagatatttcttat

SEQ ID NO: 1120158 - DNA, 19 bp, Homo sapiens
taaaaccatcctgtttgaa

SEQ ID NO: 1120159 - DNA, 21 bp, Homo sapiens
taaaaccatgtagaaaatttg

SEQ ID NO: 1120160 - DNA, 19 bp, Homo sapiens
taaaacccaatacttttgt

SEQ ID NO: 1120161 - DNA, 21 bp, Homo sapiens
taaaaccccagccaactcatt

SEQ ID NO: 1120162 - DNA, 19 bp, Homo sapiens
taaaaccccatctctacta

SEQ ID NO: 1120163 - DNA, 15 bp, Homo sapiens
taaaacctgtcaatg

SEQ ID NO: 1120164 - DNA, 16 bp, Homo sapiens
taaaacctgtcaatga

SEQ ID NO: 1120165 - DNA, 15 bp, Homo sapiens
taaaaccttgaaggt

SEQ ID NO: 1120166 - DNA, 17 bp, Homo sapiens
taaaaccttgttctatt

SEQ ID NO: 1120167 - DNA, 20 bp, Homo sapiens
taaaaccttgttctattttt

SEQ ID NO: 1120168 - DNA, 20 bp, Homo sapiens
taaaacctttcaaatttcac

SEQ ID NO: 1120169 - DNA, 21 bp, Homo sapiens
taaaacgtcttagagcctttt

SEQ ID NO: 1120170 - DNA, 21 bp, Homo sapiens
taaaactaaggcttttatttc

SEQ ID NO: 1120171 - DNA, 21 bp, Homo sapiens
taaaactatggttcccaataa

SEQ ID NO: 1120172 - DNA, 23 bp, Homo sapiens
taaaactatggttcccaataaaa

SEQ ID NO: 1120173 - DNA, 13 bp, Homo sapiens
taaaactatgtgt

SEQ ID NO: 1120174 - DNA, 20 bp, Homo sapiens
taaaactatttattgtgctg

SEQ ID NO: 1120175 - DNA, 17 bp, Homo sapiens
taaaactcagaatataa

SEQ ID NO: 1120176 - DNA, 19 bp, Homo sapiens
taaaactcagaatataaca

SEQ ID NO: 1120177 - DNA, 14 bp, Homo sapiens
taaaactcataatt

SEQ ID NO: 1120178 - DNA, 20 bp, Homo sapiens
taaaactcataattattttg

SEQ ID NO: 1120179 - DNA, 23 bp, Homo sapiens
taaaactctccttttccttacca

SEQ ID NO: 1120180 - DNA, 18 bp, Homo sapiens
taaaactgagtccatgaa

SEQ ID NO: 1120181 - DNA, 12 bp, Homo sapiens
taaaactgcttt

SEQ ID NO: 1120182 - DNA, 19 bp, Homo sapiens
taaaactggcatctgacac

SEQ ID NO: 1120183 - DNA, 16 bp, Homo sapiens
taaaactggcctgact

SEQ ID NO: 1120184 - DNA, 14 bp, Homo sapiens
taaaactgtattta

SEQ ID NO: 1120185 - DNA, 12 bp, Homo sapiens
taaaactttaaa

SEQ ID NO: 1120186 - DNA, 13 bp, Homo sapiens
taaaactttaaaa

SEQ ID NO: 1120187 - DNA, 16 bp, Homo sapiens
taaaactttatgtact

SEQ ID NO: 1120188 - DNA, 17 bp, Homo sapiens
taaaactttatgtactg

SEQ ID NO: 1120189 - DNA, 18 bp, Homo sapiens
taaaactttatgtactgc

SEQ ID NO: 1120190 - DNA, 13 bp, Homo sapiens
taaaactttcctc

SEQ ID NO: 1120191 - DNA, 15 bp, Homo sapiens
taaaactttcctcgc

SEQ ID NO: 1120192 - DNA, 14 bp, Homo sapiens
taaaactttgaagt

SEQ ID NO: 1120193 - DNA, 21 bp, Homo sapiens
taaaactttgaagttagcttt

SEQ ID NO: 1120194 - DNA, 15 bp, Homo sapiens
taaaactttgctgcc

SEQ ID NO: 1120195 - DNA, 17 bp, Homo sapiens
taaaagaaaaaatgaca

SEQ ID NO: 1120196 - DNA, 22 bp, Homo sapiens
taaaagaaaataaaaaaaagaa

SEQ ID NO: 1120197 - DNA, 13 bp, Homo sapiens
taaaagaaacttt

SEQ ID NO: 1120198 - DNA, 14 bp, Homo sapiens
taaaagaaatcttg

SEQ ID NO: 1120199 - DNA, 18 bp, Homo sapiens
taaaagaacagtaaacat

SEQ ID NO: 1120200 - DNA, 17 bp, Homo sapiens
taaaagaatatttagaa

SEQ ID NO: 1120201 - DNA, 20 bp, Homo sapiens
taaaagaatttttttgtctt

SEQ ID NO: 1120202 - DNA, 16 bp, Homo sapiens
taaaagactgcagctg

SEQ ID NO: 1120203 - DNA, 18 bp, Homo sapiens
taaaagactgcagctgct

SEQ ID NO: 1120204 - DNA, 15 bp, Homo sapiens
taaaagagatctggg

SEQ ID NO: 1120205 - DNA, 17 bp, Homo sapiens
taaaagagatctgggca

SEQ ID NO: 1120206 - DNA, 19 bp, Homo sapiens
taaaagagatctgggcatt

SEQ ID NO: 1120207 - DNA, 16 bp, Homo sapiens
taaaagagctgtctga

SEQ ID NO: 1120208 - DNA, 17 bp, Homo sapiens
taaaagagctgtctgac

SEQ ID NO: 1120209 - DNA, 11 bp, Homo sapiens
taaaagagctt

SEQ ID NO: 1120210 - DNA, 20 bp, Homo sapiens
taaaagataaatttgttgaa

SEQ ID NO: 1120211 - DNA, 22 bp, Homo sapiens
taaaagataaatttgttgaata

SEQ ID NO: 1120212 - DNA, 23 bp, Homo sapiens
taaaagataacaagatctttcag

SEQ ID NO: 1120213 - DNA, 14 bp, Homo sapiens
taaaagatacagtt

SEQ ID NO: 1120214 - DNA, 13 bp, Homo sapiens
taaaagatcgcag

SEQ ID NO: 1120215 - DNA, 22 bp, Homo sapiens
taaaagatgaaggctgtatcta

SEQ ID NO: 1120216 - DNA, 16 bp, Homo sapiens
taaaagcaaaaaagaa

SEQ ID NO: 1120217 - DNA, 18 bp, Homo sapiens
taaaagcaaaaaagaaaa

SEQ ID NO: 1120218 - DNA, 20 bp, Homo sapiens
taaaagcaaatcatttgttt

SEQ ID NO: 1120219 - DNA, 21 bp, Homo sapiens
taaaagcaaatcatttgttta

SEQ ID NO: 1120220 - DNA, 14 bp, Homo sapiens
taaaagcacaatca

SEQ ID NO: 1120221 - DNA, 19 bp, Homo sapiens
taaaagcacaatcactaaa

SEQ ID NO: 1120222 - DNA, 11 bp, Homo sapiens
taaaagcagca

SEQ ID NO: 1120223 - DNA, 21 bp, Homo sapiens
taaaagcagcatctgctaata

SEQ ID NO: 1120224 - DNA, 13 bp, Homo sapiens
taaaagcatgaaa

SEQ ID NO: 1120225 - DNA, 16 bp, Homo sapiens
taaaagcatgaaacat

SEQ ID NO: 1120226 - DNA, 11 bp, Homo sapiens
taaaagcattg

SEQ ID NO: 1120227 - DNA, 16 bp, Homo sapiens
taaaagcattgtctct

SEQ ID NO: 1120228 - DNA, 16 bp, Homo sapiens
taaaagcattttgtaa

SEQ ID NO: 1120229 - DNA, 17 bp, Homo sapiens
taaaagcattttgtaat

SEQ ID NO: 1120230 - DNA, 18 bp, Homo sapiens
taaaagctagatactgga

SEQ ID NO: 1120231 - DNA, 19 bp, Homo sapiens
taaaagctagatactggaa

SEQ ID NO: 1120232 - DNA, 20 bp, Homo sapiens
taaaagctagatactggaaa

SEQ ID NO: 1120233 - DNA, 16 bp, Homo sapiens
taaaagctataaagta

SEQ ID NO: 1120234 - DNA, 12 bp, Homo sapiens
taaaagctatga

SEQ ID NO: 1120235 - DNA, 18 bp, Homo sapiens
taaaagctcagatgacat

SEQ ID NO: 1120236 - DNA, 22 bp, Homo sapiens
taaaagctcctacttttgccac

SEQ ID NO: 1120237 - DNA, 16 bp, Homo sapiens
taaaagctttcatgtc

SEQ ID NO: 1120238 - DNA, 21 bp, Homo sapiens
taaaaggaaatctcaccccat

SEQ ID NO: 1120239 - DNA, 15 bp, Homo sapiens
taaaaggatgtataa

SEQ ID NO: 1120240 - DNA, 19 bp, Homo sapiens
taaaaggatgttacaagtt

SEQ ID NO: 1120241 - DNA, 15 bp, Homo sapiens
taaaaggcaactcaa

SEQ ID NO: 1120242 - DNA, 16 bp, Homo sapiens
taaaaggccctgtggt

SEQ ID NO: 1120243 - DNA, 17 bp, Homo sapiens
taaaaggccctgtggtc

SEQ ID NO: 1120244 - DNA, 13 bp, Homo sapiens
taaaaggggccca

SEQ ID NO: 1120245 - DNA, 19 bp, Homo sapiens
taaaaggtagagtcttaca

SEQ ID NO: 1120246 - DNA, 21 bp, Homo sapiens
taaaaggtatgcaatcaaatc

SEQ ID NO: 1120247 - DNA, 18 bp, Homo sapiens
taaaagtaaaatgtcttt

SEQ ID NO: 1120248 - DNA, 15 bp, Homo sapiens
taaaagtataatttt

SEQ ID NO: 1120249 - DNA, 15 bp, Homo sapiens
taaaagtattcatac

SEQ ID NO: 1120250 - DNA, 19 bp, Homo sapiens
taaaagtattcttgttaga

SEQ ID NO: 1120251 - DNA, 15 bp, Homo sapiens
taaaagtgatcaata

SEQ ID NO: 1120252 - DNA, 18 bp, Homo sapiens
taaaagtgcatttaagga

SEQ ID NO: 1120253 - DNA, 19 bp, Homo sapiens
taaaatgttgaaaagtcaa

SEQ ID NO: 1120254 - DNA, 23 bp, Homo sapiens
taaaatgtttcattatgcacttt

SEQ ID NO: 1120255 - DNA, 14 bp, Homo sapiens
taaaattaaagcta

SEQ ID NO: 1120256 - DNA, 12 bp, Homo sapiens
taaaattaaatg

SEQ ID NO: 1120257 - DNA, 13 bp, Homo sapiens
taaaattaaatgc

SEQ ID NO: 1120258 - DNA, 13 bp, Homo sapiens
taaaattaactct

SEQ ID NO: 1120259 - DNA, 15 bp, Homo sapiens
taaaattaagtagaa

SEQ ID NO: 1120260 - DNA, 14 bp, Homo sapiens
taaaattaagttga

SEQ ID NO: 1120261 - DNA, 16 bp, Homo sapiens
taaaattaagttgaaa

SEQ ID NO: 1120262 - DNA, 17 bp, Homo sapiens
taaaattaagttgaaaa

SEQ ID NO: 1120263 - DNA, 15 bp, Homo sapiens
taaaattactattct

SEQ ID NO: 1120264 - DNA, 16 bp, Homo sapiens
taaaattactattctt

SEQ ID NO: 1120265 - DNA, 16 bp, Homo sapiens
taaaattatactgtgt

SEQ ID NO: 1120266 - DNA, 22 bp, Homo sapiens
taaaattatcaatatctaatat

SEQ ID NO: 1120267 - DNA, 16 bp, Homo sapiens
taaaattatggaaaca

SEQ ID NO: 1120268 - DNA, 15 bp, Homo sapiens
taaaattcaaacata

SEQ ID NO: 1120269 - DNA, 23 bp, Homo sapiens
taaaattcaagaaaataaaacta

SEQ ID NO: 1120270 - DNA, 21 bp, Homo sapiens
taaaattcagtttttgtatct

SEQ ID NO: 1120271 - DNA, 13 bp, Homo sapiens
taaaattgaaagg

SEQ ID NO: 1120272 - DNA, 14 bp, Homo sapiens
taaaattgcacttt

SEQ ID NO: 1120273 - DNA, 21 bp, Homo sapiens
taaaattgcagtttcatgtat

SEQ ID NO: 1120274 - DNA, 23 bp, Homo sapiens
taaaattgcagtttcatgtatgt

SEQ ID NO: 1120275 - DNA, 13 bp, Homo sapiens
taaaattggcacc

SEQ ID NO: 1120276 - DNA, 17 bp, Homo sapiens
taaaattggcaccatgt

SEQ ID NO: 1120277 - DNA, 22 bp, Homo sapiens
taaaattgtaacctgcattttt

SEQ ID NO: 1120278 - DNA, 23 bp, Homo sapiens
taaaatttaaatggcttttgcca

SEQ ID NO: 1120279 - DNA, 17 bp, Homo sapiens
taaaatttaagtatctt

SEQ ID NO: 1120280 - DNA, 15 bp, Homo sapiens
taaaatttaatttca

SEQ ID NO: 1120281 - DNA, 21 bp, Homo sapiens
taaaatttacagtcaatctat

SEQ ID NO: 1120282 - DNA, 22 bp, Homo sapiens
taaaatttcataattctgaaac

SEQ ID NO: 1120283 - DNA, 21 bp, Homo sapiens
taaaatttgtgtaaatttgta

SEQ ID NO: 1120284 - DNA, 14 bp, Homo sapiens
taaaatttgttgca

SEQ ID NO: 1120285 - DNA, 21 bp, Homo sapiens
taaaattttgcttttaattaa

SEQ ID NO: 1120286 - DNA, 22 bp, Homo sapiens
taaaattttttaaaagttttga

SEQ ID NO: 1120287 - DNA, 22 bp, Homo sapiens
taaacaaaatagaaagttgcaa

SEQ ID NO: 1120288 - DNA, 18 bp, Homo sapiens
taaacaaaatagaagctg

SEQ ID NO: 1120289 - DNA, 23 bp, Homo sapiens
taaacaaaatagaagctgtagta

SEQ ID NO: 1120290 - DNA, 18 bp, Homo sapiens
taaacaaagcagtatata

SEQ ID NO: 1120291 - DNA, 15 bp, Homo sapiens
taaacaaagttacta

SEQ ID NO: 1120292 - DNA, 16 bp, Homo sapiens
taaacaaatatgaaaa

SEQ ID NO: 1120293 - DNA, 21 bp, Homo sapiens
taaacaaatatgaaaaatgta

SEQ ID NO: 1120294 - DNA, 21 bp, Homo sapiens
taaacaaattcatattctgtc

SEQ ID NO: 1120295 - DNA, 22 bp, Homo sapiens
taaacaaattcatattctgtct

SEQ ID NO: 1120296 - DNA, 15 bp, Homo sapiens
taaacaacagctgaa

SEQ ID NO: 1120297 - DNA, 16 bp, Homo sapiens
taaacaagaaatctga

SEQ ID NO: 1120298 - DNA, 22 bp, Homo sapiens
taaacaagaccacgtttctaaa

SEQ ID NO: 1120299 - DNA, 21 bp, Homo sapiens
taaacaagattttaaagacat

SEQ ID NO: 1120300 - DNA, 19 bp, Homo sapiens
taaacaagtaagaaaaata

SEQ ID NO: 1120301 - DNA, 13 bp, Homo sapiens
taaacaagtattt

SEQ ID NO: 1120302 - DNA, 22 bp, Homo sapiens
taaacaagtatttgttaattta

SEQ ID NO: 1120303 - DNA, 16 bp, Homo sapiens
taaacaatctttcatg

SEQ ID NO: 1120304 - DNA, 20 bp, Homo sapiens
taaacaatctttcatgtctt

SEQ ID NO: 1120305 - DNA, 17 bp, Homo sapiens
taaacaatgtataaaga

SEQ ID NO: 1120306 - DNA, 23 bp, Homo sapiens
taaacacaaaatccattccaggt

SEQ ID NO: 1120307 - DNA, 14 bp, Homo sapiens
taaacacactagtt

SEQ ID NO: 1120308 - DNA, 16 bp, Homo sapiens
taaacacagtcaaaat

SEQ ID NO: 1120309 - DNA, 21 bp, Homo sapiens
taaacacagtcaaaataattc

SEQ ID NO: 1120310 - DNA, 16 bp, Homo sapiens
taaacacatagattca

SEQ ID NO: 1120311 - DNA, 17 bp, Homo sapiens
taaacaccaacccagga

SEQ ID NO: 1120312 - DNA, 18 bp, Homo sapiens
taaacaccaacccaggaa

SEQ ID NO: 1120313 - DNA, 22 bp, Homo sapiens
taaacacccatgaatcaaagac

SEQ ID NO: 1120314 - DNA, 16 bp, Homo sapiens
taaacacgtgtctata

SEQ ID NO: 1120315 - DNA, 14 bp, Homo sapiens
taaacactgtaatc

SEQ ID NO: 1120316 - DNA, 20 bp, Homo sapiens
taaacagaaaactcccaata

SEQ ID NO: 1120317 - DNA, 21 bp, Homo sapiens
taaacagacaggaatttagaa

SEQ ID NO: 1120318 - DNA, 16 bp, Homo sapiens
taaacagatataaatg

SEQ ID NO: 1120319 - DNA, 21 bp, Homo sapiens
taaacagatataaatggctgg

SEQ ID NO: 1120320 - DNA, 18 bp, Homo sapiens
taaacagatttttacaaa

SEQ ID NO: 1120321 - DNA, 17 bp, Homo sapiens
taaacaggaattttatt

SEQ ID NO: 1120322 - DNA, 23 bp, Homo sapiens
taaacaggcccagcattgctggt

SEQ ID NO: 1120323 - DNA, 22 bp, Homo sapiens
taaacaggtatttttttaaatc

SEQ ID NO: 1120324 - DNA, 21 bp, Homo sapiens
taaacagtagttgtattcttc

SEQ ID NO: 1120325 - DNA, 16 bp, Homo sapiens
taaacagtatattctt

SEQ ID NO: 1120326 - DNA, 21 bp, Homo sapiens
taaacagtatattctttggtt

SEQ ID NO: 1120327 - DNA, 15 bp, Homo sapiens
taaacagtatttcat

SEQ ID NO: 1120328 - DNA, 18 bp, Homo sapiens
taaacagtgagcatatct

SEQ ID NO: 1120329 - DNA, 19 bp, Homo sapiens
taaacagtgagcatatctg

SEQ ID NO: 1120330 - DNA, 23 bp, Homo sapiens
taaacagtgagcctgaattttgt

SEQ ID NO: 1120331 - DNA, 17 bp, Homo sapiens
taaacataattgtggat

SEQ ID NO: 1120332 - DNA, 19 bp, Homo sapiens
taaacatatccaagtttga

SEQ ID NO: 1120333 - DNA, 20 bp, Homo sapiens
taaacatatccaagtttgaa

SEQ ID NO: 1120334 - DNA, 16 bp, Homo sapiens
taaacatcacacacac

SEQ ID NO: 1120335 - DNA, 19 bp, Homo sapiens
taaacatctagcagtaaat

SEQ ID NO: 1120336 - DNA, 17 bp, Homo sapiens
taaacatgaccctgggc

SEQ ID NO: 1120337 - DNA, 13 bp, Homo sapiens
taaacatgtgttt

SEQ ID NO: 1120338 - DNA, 18 bp, Homo sapiens
taaacatgtttaaagtgt

SEQ ID NO: 1120339 - DNA, 19 bp, Homo sapiens
taaacattaaacactgtaa

SEQ ID NO: 1120340 - DNA, 17 bp, Homo sapiens
taaacattaagtaaatg

SEQ ID NO: 1120341 - DNA, 20 bp, Homo sapiens
taaacattaattttgtgcat

SEQ ID NO: 1120342 - DNA, 18 bp, Homo sapiens
taaacattgaagtaatga

SEQ ID NO: 1120343 - DNA, 22 bp, Homo sapiens
taaacatttcaatgtcagcctt

SEQ ID NO: 1120344 - DNA, 21 bp, Homo sapiens
taaaccaaaacaccccaactt

SEQ ID NO: 1120345 - DNA, 16 bp, Homo sapiens
taaaccaaacccagcc

SEQ ID NO: 1120346 - DNA, 17 bp, Homo sapiens
taaaccaaacccagcca

SEQ ID NO: 1120347 - DNA, 19 bp, Homo sapiens
taaaccaaacccagccact

SEQ ID NO: 1120348 - DNA, 20 bp, Homo sapiens
taaaccaaacccagccactg

SEQ ID NO: 1120349 - DNA, 15 bp, Homo sapiens
taaaccaaggactga

SEQ ID NO: 1120350 - DNA, 21 bp, Homo sapiens
taaaccacaaggctgttgcat

SEQ ID NO: 1120351 - DNA, 15 bp, Homo sapiens
taaaccacataattt

SEQ ID NO: 1120352 - DNA, 20 bp, Homo sapiens
taaaccacataatttttgta

SEQ ID NO: 1120353 - DNA, 17 bp, Homo sapiens
taaaccacatcatggac

SEQ ID NO: 1120354 - DNA, 23 bp, Homo sapiens
taaaccacatcatggaccaaatg

SEQ ID NO: 1120355 - DNA, 13 bp, Homo sapiens
taaaccactgaaa

SEQ ID NO: 1120356 - DNA, 14 bp, Homo sapiens
taaaccactgtgcg

SEQ ID NO: 1120357 - DNA, 20 bp, Homo sapiens
taaaccacttctctgctgcc

SEQ ID NO: 1120358 - DNA, 15 bp, Homo sapiens
taaaccattgtaact

SEQ ID NO: 1120359 - DNA, 19 bp, Homo sapiens
taaaccatttttgttactc

SEQ ID NO: 1120360 - DNA, 17 bp, Homo sapiens
taaacccagatggtttc

SEQ ID NO: 1120361 - DNA, 14 bp, Homo sapiens
taaacccatacaat

SEQ ID NO: 1120362 - DNA, 14 bp, Homo sapiens
taaaccctttagtg

SEQ ID NO: 1120363 - DNA, 17 bp, Homo sapiens
taaaccgtttttaacac

SEQ ID NO: 1120364 - DNA, 19 bp, Homo sapiens
taaaccgtttttaacacat

SEQ ID NO: 1120365 - DNA, 14 bp, Homo sapiens
taaacctgcactga

SEQ ID NO: 1120366 - DNA, 16 bp, Homo sapiens
taaacctgcactgaaa

SEQ ID NO: 1120367 - DNA, 14 bp, Homo sapiens
taaacctttaatga

SEQ ID NO: 1120368 - DNA, 16 bp, Homo sapiens
taaacctttttcttga

SEQ ID NO: 1120369 - DNA, 20 bp, Homo sapiens
taaacctttttcttgatctt

SEQ ID NO: 1120370 - DNA, 21 bp, Homo sapiens
taaacctttttcttgatctta

SEQ ID NO: 1120371 - DNA, 23 bp, Homo sapiens
taaacctttttcttgatcttaaa

SEQ ID NO: 1120372 - DNA, 13 bp, Homo sapiens
taaacgaggaaaa

SEQ ID NO: 1120373 - DNA, 15 bp, Homo sapiens
taaacggattccaaa

SEQ ID NO: 1120374 - DNA, 15 bp, Homo sapiens
taaataggatcctgg

SEQ ID NO: 1120375 - DNA, 18 bp, Homo sapiens
taaatagtgtcatataaa

SEQ ID NO: 1120376 - DNA, 21 bp, Homo sapiens
taaatagtgtcatataaactc

SEQ ID NO: 1120377 - DNA, 13 bp, Homo sapiens
taaatagttctat

SEQ ID NO: 1120378 - DNA, 16 bp, Homo sapiens
taaatataattctgta

SEQ ID NO: 1120379 - DNA, 19 bp, Homo sapiens
taaatataattctgtaaat

SEQ ID NO: 1120380 - DNA, 21 bp, Homo sapiens
taaatataccactctttacct

SEQ ID NO: 1120381 - DNA, 19 bp, Homo sapiens
taaatatactcaagtttca

SEQ ID NO: 1120382 - DNA, 14 bp, Homo sapiens
taaatatataaaaa

SEQ ID NO: 1120383 - DNA, 11 bp, Homo sapiens
taaatatatat

SEQ ID NO: 1120384 - DNA, 17 bp, Homo sapiens
taaatatatataaacct

SEQ ID NO: 1120385 - DNA, 21 bp, Homo sapiens
taaatatatatatatataaaa

SEQ ID NO: 1120386 - DNA, 19 bp, Homo sapiens
taaatatatatttttcaaa

SEQ ID NO: 1120387 - DNA, 12 bp, Homo sapiens
taaatatatcta

SEQ ID NO: 1120388 - DNA, 11 bp, Homo sapiens
taaatatatgt

SEQ ID NO: 1120389 - DNA, 17 bp, Homo sapiens
taaatatatgtctgata

SEQ ID NO: 1120390 - DNA, 19 bp, Homo sapiens
taaatatatgtctgataat

SEQ ID NO: 1120391 - DNA, 11 bp, Homo sapiens
taaatatatta

SEQ ID NO: 1120392 - DNA, 13 bp, Homo sapiens
taaatatcaccta

SEQ ID NO: 1120393 - DNA, 13 bp, Homo sapiens
taaatatccaaag

SEQ ID NO: 1120394 - DNA, 17 bp, Homo sapiens
taaatatcttctgattt

SEQ ID NO: 1120395 - DNA, 19 bp, Homo sapiens
taaatatggactgctcagg

SEQ ID NO: 1120396 - DNA, 13 bp, Homo sapiens
taaatatgtaata

SEQ ID NO: 1120397 - DNA, 17 bp, Homo sapiens
taaatatgtaatataaa

SEQ ID NO: 1120398 - DNA, 13 bp, Homo sapiens
taaatatgtgaag

SEQ ID NO: 1120399 - DNA, 21 bp, Homo sapiens
taaatatgtgaagaaaaagac

SEQ ID NO: 1120400 - DNA, 11 bp, Homo sapiens
taaatattcat

SEQ ID NO: 1120401 - DNA, 12 bp, Homo sapiens
taaatattcata

SEQ ID NO: 1120402 - DNA, 13 bp, Homo sapiens
taaatattctata

SEQ ID NO: 1120403 - DNA, 19 bp, Homo sapiens
taaatattctatatgaatt

SEQ ID NO: 1120404 - DNA, 22 bp, Homo sapiens
taaatattcttgtccacattct

SEQ ID NO: 1120405 - DNA, 23 bp, Homo sapiens
taaatattgggattggggggaaa

SEQ ID NO: 1120406 - DNA, 10 bp, Homo sapiens
taaatattta

SEQ ID NO: 1120407 - DNA, 18 bp, Homo sapiens
taaatatttaccttgaaa

SEQ ID NO: 1120408 - DNA, 19 bp, Homo sapiens
taaatatttactctttgca

SEQ ID NO: 1120409 - DNA, 20 bp, Homo sapiens
taaatatttactctttgcaa

SEQ ID NO: 1120410 - DNA, 16 bp, Homo sapiens
taaatatttatgtaga

SEQ ID NO: 1120411 - DNA, 12 bp, Homo sapiens
taaatatttcct

SEQ ID NO: 1120412 - DNA, 14 bp, Homo sapiens
taaatatttcctta

SEQ ID NO: 1120413 - DNA, 18 bp, Homo sapiens
taaatatttgacttgcat

SEQ ID NO: 1120414 - DNA, 14 bp, Homo sapiens
taaatatttgagac

SEQ ID NO: 1120415 - DNA, 17 bp, Homo sapiens
taaatattttaaagaat

SEQ ID NO: 1120416 - DNA, 18 bp, Homo sapiens
taaatattttaaagaatt

SEQ ID NO: 1120417 - DNA, 14 bp, Homo sapiens
taaatcaatgtcac

SEQ ID NO: 1120418 - DNA, 23 bp, Homo sapiens
taaatcacagaaaatttaactta

SEQ ID NO: 1120419 - DNA, 14 bp, Homo sapiens
taaatcagaaagta

SEQ ID NO: 1120420 - DNA, 18 bp, Homo sapiens
taaatcagtaagaggtgt

SEQ ID NO: 1120421 - DNA, 11 bp, Homo sapiens
taaatcagtgg

SEQ ID NO: 1120422 - DNA, 15 bp, Homo sapiens
taaatcataaagtca

SEQ ID NO: 1120423 - DNA, 16 bp, Homo sapiens
taaatcataaagtcag

SEQ ID NO: 1120424 - DNA, 16 bp, Homo sapiens
taaatcatcctcatgt

SEQ ID NO: 1120425 - DNA, 13 bp, Homo sapiens
taaatcatgttgt

SEQ ID NO: 1120426 - DNA, 14 bp, Homo sapiens
taaatcattaatac

SEQ ID NO: 1120427 - DNA, 17 bp, Homo sapiens
taaatcattcttactaa

SEQ ID NO: 1120428 - DNA, 15 bp, Homo sapiens
taaatcatttcagta

SEQ ID NO: 1120429 - DNA, 16 bp, Homo sapiens
taaatcatttcagtat

SEQ ID NO: 1120430 - DNA, 21 bp, Homo sapiens
taaatcatttggttaaatcat

SEQ ID NO: 1120431 - DNA, 23 bp, Homo sapiens
taaatccgacttgaatattcctg

SEQ ID NO: 1120432 - DNA, 22 bp, Homo sapiens
taaatcctagacttgaaagttt

SEQ ID NO: 1120433 - DNA, 16 bp, Homo sapiens
taaatcctgaagagca

SEQ ID NO: 1120434 - DNA, 19 bp, Homo sapiens
taaatccttgggagtcatt

SEQ ID NO: 1120435 - DNA, 16 bp, Homo sapiens
taaatctaaacaaaaa

SEQ ID NO: 1120436 - DNA, 14 bp, Homo sapiens
taaatctaaatcta

SEQ ID NO: 1120437 - DNA, 15 bp, Homo sapiens
taaatctaaatctat

SEQ ID NO: 1120438 - DNA, 13 bp, Homo sapiens
taaatctaacatt

SEQ ID NO: 1120439 - DNA, 20 bp, Homo sapiens
taaatctatttattaatatt

SEQ ID NO: 1120440 - DNA, 14 bp, Homo sapiens
taaatctccaaaat

SEQ ID NO: 1120441 - DNA, 21 bp, Homo sapiens
taaatctccaagacctggtgt

SEQ ID NO: 1120442 - DNA, 14 bp, Homo sapiens
taaatctctaatat

SEQ ID NO: 1120443 - DNA, 15 bp, Homo sapiens
taaatctctttaaga

SEQ ID NO: 1120444 - DNA, 12 bp, Homo sapiens
taaatctgccac

SEQ ID NO: 1120445 - DNA, 15 bp, Homo sapiens
taaatctggggaaga

SEQ ID NO: 1120446 - DNA, 14 bp, Homo sapiens
taaatcttaaacaa

SEQ ID NO: 1120447 - DNA, 18 bp, Homo sapiens
taaatcttaaacaatgta

SEQ ID NO: 1120448 - DNA, 19 bp, Homo sapiens
taaatcttaaacaatgtat

SEQ ID NO: 1120449 - DNA, 20 bp, Homo sapiens
taaatcttaaacaatgtata

SEQ ID NO: 1120450 - DNA, 19 bp, Homo sapiens
taaatcttaatgttcctca

SEQ ID NO: 1120451 - DNA, 14 bp, Homo sapiens
taaatgaaacaagt

SEQ ID NO: 1120452 - DNA, 15 bp, Homo sapiens
taaatgaaattgtaa

SEQ ID NO: 1120453 - DNA, 16 bp, Homo sapiens
taaatgaagcagcttt

SEQ ID NO: 1120454 - DNA, 22 bp, Homo sapiens
taaatgaagtacagtagtttcc

SEQ ID NO: 1120455 - DNA, 12 bp, Homo sapiens
taaatgaatgtt

SEQ ID NO: 1120456 - DNA, 13 bp, Homo sapiens
taaatgaatgttt

SEQ ID NO: 1120457 - DNA, 16 bp, Homo sapiens
taaatgacaaagtgtt

SEQ ID NO: 1120458 - DNA, 17 bp, Homo sapiens
taaatgacaaagtgttg

SEQ ID NO: 1120459 - DNA, 13 bp, Homo sapiens
taaatgacttttc

SEQ ID NO: 1120460 - DNA, 19 bp, Homo sapiens
taaatgagaagtacttggt

SEQ ID NO: 1120461 - DNA, 11 bp, Homo sapiens
taaatgatatt

SEQ ID NO: 1120462 - DNA, 13 bp, Homo sapiens
taaatgatattta

SEQ ID NO: 1120463 - DNA, 17 bp, Homo sapiens
taaatgatatttaggtt

SEQ ID NO: 1120464 - DNA, 19 bp, Homo sapiens
taaatgatatttaggtttt

SEQ ID NO: 1120465 - DNA, 21 bp, Homo sapiens
taaatgatatttaggtttttg

SEQ ID NO: 1120466 - DNA, 14 bp, Homo sapiens
taaatgatctgcct

SEQ ID NO: 1120467 - DNA, 15 bp, Homo sapiens
taaatgatggtgctt

SEQ ID NO: 1120468 - DNA, 16 bp, Homo sapiens
taaatgattatattca

SEQ ID NO: 1120469 - DNA, 14 bp, Homo sapiens
taaatgattccaaa

SEQ ID NO: 1120470 - DNA, 20 bp, Homo sapiens
taaatgatttaaatttaagt

SEQ ID NO: 1120471 - DNA, 20 bp, Homo sapiens
taaatgattttaattttata

SEQ ID NO: 1120472 - DNA, 20 bp, Homo sapiens
taaatgcaatttaaaattat

SEQ ID NO: 1120473 - DNA, 15 bp, Homo sapiens
taaatgcacatttca

SEQ ID NO: 1120474 - DNA, 19 bp, Homo sapiens
taaatgcaccaagaaagct

SEQ ID NO: 1120475 - DNA, 22 bp, Homo sapiens
taaatgcagacaacaccttcct

SEQ ID NO: 1120476 - DNA, 17 bp, Homo sapiens
taaatgcagttttaaga

SEQ ID NO: 1120477 - DNA, 21 bp, Homo sapiens
taaatgcatatcctgagccat

SEQ ID NO: 1120478 - DNA, 15 bp, Homo sapiens
taaatgcatgtctta

SEQ ID NO: 1120479 - DNA, 22 bp, Homo sapiens
taaatgccctcttctcgtgcct

SEQ ID NO: 1120480 - DNA, 16 bp, Homo sapiens
taaatgccttgtataa

SEQ ID NO: 1120481 - DNA, 16 bp, Homo sapiens
taaatgctcataaaga

SEQ ID NO: 1120482 - DNA, 23 bp, Homo sapiens
taaatgctcataaagatgttaaa

SEQ ID NO: 1120483 - DNA, 16 bp, Homo sapiens
taaatgctcatacaca

SEQ ID NO: 1120484 - DNA, 17 bp, Homo sapiens
taaatgctcattttctg

SEQ ID NO: 1120485 - DNA, 18 bp, Homo sapiens
taaatgctcattttcttt

SEQ ID NO: 1120486 - DNA, 23 bp, Homo sapiens
taaatgctgattatttagagcca

SEQ ID NO: 1120487 - DNA, 20 bp, Homo sapiens
taaatgctgtagaagtgagt

SEQ ID NO: 1120488 - DNA, 17 bp, Homo sapiens
taaatgctttatgcaaa

SEQ ID NO: 1120489 - DNA, 21 bp, Homo sapiens
taaatgctttgtgtgattgaa

SEQ ID NO: 1120490 - DNA, 22 bp, Homo sapiens
taaatgcttttaaatgctctct

SEQ ID NO: 1120491 - DNA, 22 bp, Homo sapiens
taaatggaattcgtgttatgaa

SEQ ID NO: 1120492 - DNA, 13 bp, Homo sapiens
taaatggccagtg

SEQ ID NO: 1120493 - DNA, 12 bp, Homo sapiens
taaatggcctca

SEQ ID NO: 1120494 - DNA, 16 bp, Homo sapiens
taaatggcctcatgtg

SEQ ID NO: 1120495 - DNA, 23 bp, Homo sapiens
taaatggcctcatgtggctggaa

SEQ ID NO: 1120496 - DNA, 17 bp, Homo sapiens
taaatggggctcacaaa

SEQ ID NO: 1120497 - DNA, 13 bp, Homo sapiens
taacatttaaatt

SEQ ID NO: 1120498 - DNA, 18 bp, Homo sapiens
taacatttaaattccaca

SEQ ID NO: 1120499 - DNA, 19 bp, Homo sapiens
taacatttatagaagaaat

SEQ ID NO: 1120500 - DNA, 16 bp, Homo sapiens
taacatttgctgtttt

SEQ ID NO: 1120501 - DNA, 17 bp, Homo sapiens
taacatttgctgtttta

SEQ ID NO: 1120502 - DNA, 22 bp, Homo sapiens
taacatttgctgttttaaacat

SEQ ID NO: 1120503 - DNA, 15 bp, Homo sapiens
taacatttttcaata

SEQ ID NO: 1120504 - DNA, 18 bp, Homo sapiens
taacatttttgaggaagt

SEQ ID NO: 1120505 - DNA, 21 bp, Homo sapiens
taaccaaatattaaagattct

SEQ ID NO: 1120506 - DNA, 15 bp, Homo sapiens
taaccaagaggctgg

SEQ ID NO: 1120507 - DNA, 16 bp, Homo sapiens
taaccaagctgagttt

SEQ ID NO: 1120508 - DNA, 18 bp, Homo sapiens
taaccaagtgtgctcttt

SEQ ID NO: 1120509 - DNA, 22 bp, Homo sapiens
taaccaatgacgtttgcataga

SEQ ID NO: 1120510 - DNA, 17 bp, Homo sapiens
taaccaatgccttttta

SEQ ID NO: 1120511 - DNA, 23 bp, Homo sapiens
taaccacaaagcacagtttgaac

SEQ ID NO: 1120512 - DNA, 22 bp, Homo sapiens
taaccacaaggtccactccctg

SEQ ID NO: 1120513 - DNA, 23 bp, Homo sapiens
taaccaccgcatatgcatgccag

SEQ ID NO: 1120514 - DNA, 15 bp, Homo sapiens
taaccacggaaaaga

SEQ ID NO: 1120515 - DNA, 20 bp, Homo sapiens
taaccacttaaaaaatgtcc

SEQ ID NO: 1120516 - DNA, 16 bp, Homo sapiens
taaccagcagaaatgc

SEQ ID NO: 1120517 - DNA, 16 bp, Homo sapiens
taaccaggccccagcc

SEQ ID NO: 1120518 - DNA, 23 bp, Homo sapiens
taaccaggccccagcctccaggc

SEQ ID NO: 1120519 - DNA, 15 bp, Homo sapiens
taaccataaatcaat

SEQ ID NO: 1120520 - DNA, 15 bp, Homo sapiens
taaccatccccaact

SEQ ID NO: 1120521 - DNA, 16 bp, Homo sapiens
taaccatccccaactc

SEQ ID NO: 1120522 - DNA, 22 bp, Homo sapiens
taaccatgtgaaaaggcaaaaa

SEQ ID NO: 1120523 - DNA, 17 bp, Homo sapiens
taaccattacatgttta

SEQ ID NO: 1120524 - DNA, 19 bp, Homo sapiens
taaccatttcagtgtattg

SEQ ID NO: 1120525 - DNA, 15 bp, Homo sapiens
taaccattttccttt

SEQ ID NO: 1120526 - DNA, 13 bp, Homo sapiens
taacccagatttt

SEQ ID NO: 1120527 - DNA, 15 bp, Homo sapiens
taacccagttacttt

SEQ ID NO: 1120528 - DNA, 13 bp, Homo sapiens
taaccccagctcc

SEQ ID NO: 1120529 - DNA, 19 bp, Homo sapiens
taaccccagctccctagga

SEQ ID NO: 1120530 - DNA, 17 bp, Homo sapiens
taaccccaggcactgtt

SEQ ID NO: 1120531 - DNA, 20 bp, Homo sapiens
taaccccaggcactgtttgg

SEQ ID NO: 1120532 - DNA, 18 bp, Homo sapiens
taacccccagcccacaga

SEQ ID NO: 1120533 - DNA, 22 bp, Homo sapiens
taacccccagcccacagagcct

SEQ ID NO: 1120534 - DNA, 16 bp, Homo sapiens
taacccccctgtacac

SEQ ID NO: 1120535 - DNA, 12 bp, Homo sapiens
taacccctttcc

SEQ ID NO: 1120536 - DNA, 17 bp, Homo sapiens
taaccctaggaatttag

SEQ ID NO: 1120537 - DNA, 21 bp, Homo sapiens
taaccctcattgctgtcttgc

SEQ ID NO: 1120538 - DNA, 14 bp, Homo sapiens
taaccctctcttcc

SEQ ID NO: 1120539 - DNA, 15 bp, Homo sapiens
taaccctctcttccc

SEQ ID NO: 1120540 - DNA, 12 bp, Homo sapiens
taaccctgccag

SEQ ID NO: 1120541 - DNA, 13 bp, Homo sapiens
taaccctgccagt

SEQ ID NO: 1120542 - DNA, 17 bp, Homo sapiens
taaccctggcacttaag

SEQ ID NO: 1120543 - DNA, 17 bp, Homo sapiens
taaccctgggctgtcca

SEQ ID NO: 1120544 - DNA, 20 bp, Homo sapiens
taacccttcatcttcctgtg

SEQ ID NO: 1120545 - DNA, 21 bp, Homo sapiens
taacccttcatcttcctgtgt

SEQ ID NO: 1120546 - DNA, 16 bp, Homo sapiens
taacccttgaatttct

SEQ ID NO: 1120547 - DNA, 17 bp, Homo sapiens
taacccttgaatttcta

SEQ ID NO: 1120548 - DNA, 20 bp, Homo sapiens
taaccgagccagcagctgaa

SEQ ID NO: 1120549 - DNA, 22 bp, Homo sapiens
taacctaatcaccatgtaagca

SEQ ID NO: 1120550 - DNA, 17 bp, Homo sapiens
taacctagaagtatttt

SEQ ID NO: 1120551 - DNA, 20 bp, Homo sapiens
taacctagttaaagaaagga

SEQ ID NO: 1120552 - DNA, 16 bp, Homo sapiens
taacctatctatgaac

SEQ ID NO: 1120553 - DNA, 17 bp, Homo sapiens
taacctatctatgaaca

SEQ ID NO: 1120554 - DNA, 21 bp, Homo sapiens
taacctatctatgaacaacag

SEQ ID NO: 1120555 - DNA, 13 bp, Homo sapiens
taacctcagctct

SEQ ID NO: 1120556 - DNA, 15 bp, Homo sapiens
taacctcagctctgg

SEQ ID NO: 1120557 - DNA, 16 bp, Homo sapiens
taacctcagctctggg

SEQ ID NO: 1120558 - DNA, 19 bp, Homo sapiens
taacctcagctctgggaga

SEQ ID NO: 1120559 - DNA, 19 bp, Homo sapiens
taacctcagtatttatgta

SEQ ID NO: 1120560 - DNA, 20 bp, Homo sapiens
taacctcagtatttatgtaa

SEQ ID NO: 1120561 - DNA, 20 bp, Homo sapiens
taacctcagtgtcatttatg

SEQ ID NO: 1120562 - DNA, 18 bp, Homo sapiens
taacctcatcttcttcac

SEQ ID NO: 1120563 - DNA, 16 bp, Homo sapiens
taacctcgggcctgct

SEQ ID NO: 1120564 - DNA, 15 bp, Homo sapiens
taacctctgctttta

SEQ ID NO: 1120565 - DNA, 17 bp, Homo sapiens
taacctctgcttttatc

SEQ ID NO: 1120566 - DNA, 15 bp, Homo sapiens
taacctctggccctt

SEQ ID NO: 1120567 - DNA, 17 bp, Homo sapiens
taacctctggcccttgg

SEQ ID NO: 1120568 - DNA, 17 bp, Homo sapiens
taacctcttcagaggcc

SEQ ID NO: 1120569 - DNA, 16 bp, Homo sapiens
taacctgccagtccca

SEQ ID NO: 1120570 - DNA, 16 bp, Homo sapiens
taacctggacctggaa

SEQ ID NO: 1120571 - DNA, 19 bp, Homo sapiens
taacctggccactgtccct

SEQ ID NO: 1120572 - DNA, 19 bp, Homo sapiens
taacctggtgctggatatt

SEQ ID NO: 1120573 - DNA, 15 bp, Homo sapiens
taaccttaaatacac

SEQ ID NO: 1120574 - DNA, 16 bp, Homo sapiens
taaccttaatttatta

SEQ ID NO: 1120575 - DNA, 21 bp, Homo sapiens
taaccttcatgcttttttccc

SEQ ID NO: 1120576 - DNA, 22 bp, Homo sapiens
taaccttcatttttaagactgt

SEQ ID NO: 1120577 - DNA, 21 bp, Homo sapiens
taaccttccaagactgaagac

SEQ ID NO: 1120578 - DNA, 17 bp, Homo sapiens
taaccttgaatgctgcc

SEQ ID NO: 1120579 - DNA, 21 bp, Homo sapiens
taaccttgcctggtacagtat

SEQ ID NO: 1120580 - DNA, 12 bp, Homo sapiens
taacctttctgg

SEQ ID NO: 1120581 - DNA, 16 bp, Homo sapiens
taacctttttgtaaat

SEQ ID NO: 1120582 - DNA, 17 bp, Homo sapiens
taacctttttgtaaata

SEQ ID NO: 1120583 - DNA, 15 bp, Homo sapiens
taaccttttttgtct

SEQ ID NO: 1120584 - DNA, 14 bp, Homo sapiens
taacgcaaccaagt

SEQ ID NO: 1120585 - DNA, 17 bp, Homo sapiens
taacgcgtcttcctgag

SEQ ID NO: 1120586 - DNA, 13 bp, Homo sapiens
taacgctgaactg

SEQ ID NO: 1120587 - DNA, 14 bp, Homo sapiens
taacggaccaaagc

SEQ ID NO: 1120588 - DNA, 18 bp, Homo sapiens
taacggctccaggatttt

SEQ ID NO: 1120589 - DNA, 14 bp, Homo sapiens
taacggtgctaaaa

SEQ ID NO: 1120590 - DNA, 16 bp, Homo sapiens
taacgtgaaacttata

SEQ ID NO: 1120591 - DNA, 17 bp, Homo sapiens
taacgtgatgtgccact

SEQ ID NO: 1120592 - DNA, 19 bp, Homo sapiens
taacgtgcccccagagtgt

SEQ ID NO: 1120593 - DNA, 14 bp, Homo sapiens
taacgtgctgctca

SEQ ID NO: 1120594 - DNA, 16 bp, Homo sapiens
taacgttgagcccctg

SEQ ID NO: 1120595 - DNA, 15 bp, Homo sapiens
taactaaaaggtatg

SEQ ID NO: 1120596 - DNA, 16 bp, Homo sapiens
taactaaaatgtatct

SEQ ID NO: 1120597 - DNA, 17 bp, Homo sapiens
taactaaactctctttg

SEQ ID NO: 1120598 - DNA, 15 bp, Homo sapiens
taactaaatgctcat

SEQ ID NO: 1120599 - DNA, 10 bp, Homo sapiens
taactaactg

SEQ ID NO: 1120600 - DNA, 15 bp, Homo sapiens
taactaactgcttca

SEQ ID NO: 1120601 - DNA, 20 bp, Homo sapiens
taactaactgcttcatctcc

SEQ ID NO: 1120602 - DNA, 17 bp, Homo sapiens
taactaagactcccgcc

SEQ ID NO: 1120603 - DNA, 23 bp, Homo sapiens
taactaatctattgggttcatta

SEQ ID NO: 1120604 - DNA, 19 bp, Homo sapiens
taactaatgctaagaaatg

SEQ ID NO: 1120605 - DNA, 14 bp, Homo sapiens
taactaattttgtt

SEQ ID NO: 1120606 - DNA, 20 bp, Homo sapiens
taactaattttgttgaaaat

SEQ ID NO: 1120607 - DNA, 16 bp, Homo sapiens
taactacaaagctttg

SEQ ID NO: 1120608 - DNA, 18 bp, Homo sapiens
taactacaaagctttgct

SEQ ID NO: 1120609 - DNA, 20 bp, Homo sapiens
taactacaaagctttgctac

SEQ ID NO: 1120610 - DNA, 21 bp, Homo sapiens
taactacaaagctttgctaca

SEQ ID NO: 1120611 - DNA, 12 bp, Homo sapiens
taactacaatga

SEQ ID NO: 1120612 - DNA, 17 bp, Homo sapiens
taactacaatgatggta

SEQ ID NO: 1120613 - DNA, 15 bp, Homo sapiens
taactacatctgcct

SEQ ID NO: 1120614 - DNA, 12 bp, Homo sapiens
taactactgtgt

SEQ ID NO: 1120615 - DNA, 14 bp, Homo sapiens
taactactgtgttc

SEQ ID NO: 1120616 - DNA, 15 bp, Homo sapiens
taactactgtgttcc

SEQ ID NO: 1120617 - DNA, 15 bp, Homo sapiens
taactactttactaa

SEQ ID NO: 1120618 - DNA, 18 bp, Homo sapiens
taactactttactaaatt

SEQ ID NO: 1120619 - DNA, 16 bp, Homo sapiens
taagctgtttccatag

SEQ ID NO: 1120620 - DNA, 21 bp, Homo sapiens
taagcttggtgacaaaattca

SEQ ID NO: 1120621 - DNA, 12 bp, Homo sapiens
taagctttctca

SEQ ID NO: 1120622 - DNA, 22 bp, Homo sapiens
taagctttgccagctgctgctg

SEQ ID NO: 1120623 - DNA, 15 bp, Homo sapiens
taagcttttaaacaa

SEQ ID NO: 1120624 - DNA, 23 bp, Homo sapiens
taagcttttaagaaaaacaaagt

SEQ ID NO: 1120625 - DNA, 15 bp, Homo sapiens
taagctttttggaat

SEQ ID NO: 1120626 - DNA, 11 bp, Homo sapiens
taaggaaacaa

SEQ ID NO: 1120627 - DNA, 16 bp, Homo sapiens
taaggaaagcaataaa

SEQ ID NO: 1120628 - DNA, 21 bp, Homo sapiens
taaggaaagcaataaatgaat

SEQ ID NO: 1120629 - DNA, 13 bp, Homo sapiens
taaggaagacaat

SEQ ID NO: 1120630 - DNA, 17 bp, Homo sapiens
taaggaattttgtctca

SEQ ID NO: 1120631 - DNA, 20 bp, Homo sapiens
taaggaattttgtctcactt

SEQ ID NO: 1120632 - DNA, 20 bp, Homo sapiens
taaggacaaattagcatgca

SEQ ID NO: 1120633 - DNA, 14 bp, Homo sapiens
taaggacacactaa

SEQ ID NO: 1120634 - DNA, 15 bp, Homo sapiens
taaggactgtaaaca

SEQ ID NO: 1120635 - DNA, 20 bp, Homo sapiens
taaggagcatgattttaaga

SEQ ID NO: 1120636 - DNA, 19 bp, Homo sapiens
taaggagggacatgatggg

SEQ ID NO: 1120637 - DNA, 13 bp, Homo sapiens
taaggagggagaa

SEQ ID NO: 1120638 - DNA, 20 bp, Homo sapiens
taaggagggagaaaggagaa

SEQ ID NO: 1120639 - DNA, 19 bp, Homo sapiens
taaggagtaatctgtgtac

SEQ ID NO: 1120640 - DNA, 20 bp, Homo sapiens
taaggagtaatctgtgtaca

SEQ ID NO: 1120641 - DNA, 19 bp, Homo sapiens
taaggatcagaacagcaga

SEQ ID NO: 1120642 - DNA, 18 bp, Homo sapiens
taaggatgacttttttat

SEQ ID NO: 1120643 - DNA, 18 bp, Homo sapiens
taaggatgcttgtacata

SEQ ID NO: 1120644 - DNA, 22 bp, Homo sapiens
taaggatgcttgtacataatgc

SEQ ID NO: 1120645 - DNA, 17 bp, Homo sapiens
taaggatgtcacagggc

SEQ ID NO: 1120646 - DNA, 19 bp, Homo sapiens
taaggatgtcacagggcca

SEQ ID NO: 1120647 - DNA, 15 bp, Homo sapiens
taaggattgtgatat

SEQ ID NO: 1120648 - DNA, 15 bp, Homo sapiens
taaggcaacattcct

SEQ ID NO: 1120649 - DNA, 14 bp, Homo sapiens
taaggcaggcattg

SEQ ID NO: 1120650 - DNA, 15 bp, Homo sapiens
taaggcatgaaggat

SEQ ID NO: 1120651 - DNA, 12 bp, Homo sapiens
taaggcattcca

SEQ ID NO: 1120652 - DNA, 19 bp, Homo sapiens
taaggccagaaactccttt

SEQ ID NO: 1120653 - DNA, 19 bp, Homo sapiens
taaggccattattgtactt

SEQ ID NO: 1120654 - DNA, 16 bp, Homo sapiens
taaggccgtgtctctg

SEQ ID NO: 1120655 - DNA, 17 bp, Homo sapiens
taaggcctactatacat

SEQ ID NO: 1120656 - DNA, 15 bp, Homo sapiens
taaggcctctggact

SEQ ID NO: 1120657 - DNA, 18 bp, Homo sapiens
taaggctggatgggaaag

SEQ ID NO: 1120658 - DNA, 13 bp, Homo sapiens
taaggcttccccc

SEQ ID NO: 1120659 - DNA, 13 bp, Homo sapiens
taaggcttttatt

SEQ ID NO: 1120660 - DNA, 17 bp, Homo sapiens
taagggacgggggtggg

SEQ ID NO: 1120661 - DNA, 23 bp, Homo sapiens
taagggactaggaaattccaaat

SEQ ID NO: 1120662 - DNA, 12 bp, Homo sapiens
taagggactgtg

SEQ ID NO: 1120663 - DNA, 12 bp, Homo sapiens
taagggagagct

SEQ ID NO: 1120664 - DNA, 21 bp, Homo sapiens
taagggagagctgagccagtt

SEQ ID NO: 1120665 - DNA, 20 bp, Homo sapiens
taagggcagtgcccatgtgt

SEQ ID NO: 1120666 - DNA, 20 bp, Homo sapiens
taaggggccttgctctgagc

SEQ ID NO: 1120667 - DNA, 18 bp, Homo sapiens
taagggggaaaactgttc

SEQ ID NO: 1120668 - DNA, 19 bp, Homo sapiens
taagggggtagaagtagtt

SEQ ID NO: 1120669 - DNA, 23 bp, Homo sapiens
taaggggtgggtcagaacatgtt

SEQ ID NO: 1120670 - DNA, 18 bp, Homo sapiens
taagggtaggatgttgct

SEQ ID NO: 1120671 - DNA, 20 bp, Homo sapiens
taagggtctttggtgttttt

SEQ ID NO: 1120672 - DNA, 18 bp, Homo sapiens
taagggtgggtgctcaga

SEQ ID NO: 1120673 - DNA, 20 bp, Homo sapiens
taagggttagtttacaatca

SEQ ID NO: 1120674 - DNA, 23 bp, Homo sapiens
taaggtaacatttatagaagaaa

SEQ ID NO: 1120675 - DNA, 22 bp, Homo sapiens
taaggtaactactgctaatgtt

SEQ ID NO: 1120676 - DNA, 14 bp, Homo sapiens
taaggtacacactt

SEQ ID NO: 1120677 - DNA, 18 bp, Homo sapiens
taaggtatttcgaaactg

SEQ ID NO: 1120678 - DNA, 16 bp, Homo sapiens
taaggtcctgaaagta

SEQ ID NO: 1120679 - DNA, 12 bp, Homo sapiens
taaggtctttgt

SEQ ID NO: 1120680 - DNA, 23 bp, Homo sapiens
taaggtctttgtaaaatcttgca

SEQ ID NO: 1120681 - DNA, 23 bp, Homo sapiens
taaggtgcctcagttttccttct

SEQ ID NO: 1120682 - DNA, 14 bp, Homo sapiens
taaggttgtgcagg

SEQ ID NO: 1120683 - DNA, 19 bp, Homo sapiens
taaggtttcgtttctgtat

SEQ ID NO: 1120684 - DNA, 20 bp, Homo sapiens
taaggtttcgtttctgtata

SEQ ID NO: 1120685 - DNA, 14 bp, Homo sapiens
taaggttttgttgt

SEQ ID NO: 1120686 - DNA, 13 bp, Homo sapiens
taagtaaaagtct

SEQ ID NO: 1120687 - DNA, 19 bp, Homo sapiens
taagtaaacctagtaaaac

SEQ ID NO: 1120688 - DNA, 14 bp, Homo sapiens
taagtaaagtggtt

SEQ ID NO: 1120689 - DNA, 14 bp, Homo sapiens
taagtaaatacaat

SEQ ID NO: 1120690 - DNA, 18 bp, Homo sapiens
taagtaaatatattatat

SEQ ID NO: 1120691 - DNA, 19 bp, Homo sapiens
taagtaacttaaggacctt

SEQ ID NO: 1120692 - DNA, 14 bp, Homo sapiens
taagtaatcaataa

SEQ ID NO: 1120693 - DNA, 20 bp, Homo sapiens
taagtaatcaataaagaaaa

SEQ ID NO: 1120694 - DNA, 16 bp, Homo sapiens
taagtaattgcctaca

SEQ ID NO: 1120695 - DNA, 14 bp, Homo sapiens
taagtaatttagaa

SEQ ID NO: 1120696 - DNA, 16 bp, Homo sapiens
taagtaatttagaaga

SEQ ID NO: 1120697 - DNA, 13 bp, Homo sapiens
taagtacaaggtg

SEQ ID NO: 1120698 - DNA, 18 bp, Homo sapiens
taagtacacaataagcaa

SEQ ID NO: 1120699 - DNA, 21 bp, Homo sapiens
taagtaccaatgggaagcagg

SEQ ID NO: 1120700 - DNA, 21 bp, Homo sapiens
taagtactagatgcatcactg

SEQ ID NO: 1120701 - DNA, 14 bp, Homo sapiens
taagtactgtgtac

SEQ ID NO: 1120702 - DNA, 19 bp, Homo sapiens
taagtaggaaagtcaccca

SEQ ID NO: 1120703 - DNA, 16 bp, Homo sapiens
taagtagtaaatcaga

SEQ ID NO: 1120704 - DNA, 20 bp, Homo sapiens
taagtagtaaatcagaaagt

SEQ ID NO: 1120705 - DNA, 16 bp, Homo sapiens
taagtagttggtttgt

SEQ ID NO: 1120706 - DNA, 20 bp, Homo sapiens
taagtagttggtttgtatga

SEQ ID NO: 1120707 - DNA, 16 bp, Homo sapiens
taagtataaaatacaa

SEQ ID NO: 1120708 - DNA, 23 bp, Homo sapiens
taagtatatagtatatttatact

SEQ ID NO: 1120709 - DNA, 19 bp, Homo sapiens
taagtatcaggggaaaaaa

SEQ ID NO: 1120710 - DNA, 16 bp, Homo sapiens
taagtatcttgtgctt

SEQ ID NO: 1120711 - DNA, 17 bp, Homo sapiens
taagtatggaatattca

SEQ ID NO: 1120712 - DNA, 21 bp, Homo sapiens
taagtatgggatgatagttga

SEQ ID NO: 1120713 - DNA, 18 bp, Homo sapiens
taagtattgcatctgtat

SEQ ID NO: 1120714 - DNA, 19 bp, Homo sapiens
taagtattgcatctgtata

SEQ ID NO: 1120715 - DNA, 20 bp, Homo sapiens
taagtattgcatctgtataa

SEQ ID NO: 1120716 - DNA, 12 bp, Homo sapiens
taagtatttagg

SEQ ID NO: 1120717 - DNA, 18 bp, Homo sapiens
taagtatttatatattta

SEQ ID NO: 1120718 - DNA, 13 bp, Homo sapiens
taagtatttcaaa

SEQ ID NO: 1120719 - DNA, 14 bp, Homo sapiens
taagtatttcccag

SEQ ID NO: 1120720 - DNA, 17 bp, Homo sapiens
taagtcaacagtaaacc

SEQ ID NO: 1120721 - DNA, 17 bp, Homo sapiens
taagtcaagcacatgta

SEQ ID NO: 1120722 - DNA, 18 bp, Homo sapiens
taagtcaagcacatgtaa

SEQ ID NO: 1120723 - DNA, 18 bp, Homo sapiens
taagtcaggagtgtagtt

SEQ ID NO: 1120724 - DNA, 19 bp, Homo sapiens
taagtcagtatggtctaac

SEQ ID NO: 1120725 - DNA, 13 bp, Homo sapiens
taagtcatcatta

SEQ ID NO: 1120726 - DNA, 13 bp, Homo sapiens
taagtcatttaac

SEQ ID NO: 1120727 - DNA, 15 bp, Homo sapiens
taagtccattaactg

SEQ ID NO: 1120728 - DNA, 22 bp, Homo sapiens
taagtctatactaatgcttaca

SEQ ID NO: 1120729 - DNA, 21 bp, Homo sapiens
taagtctatctggtattaaat

SEQ ID NO: 1120730 - DNA, 22 bp, Homo sapiens
taagtctatctggtattaaatg

SEQ ID NO: 1120731 - DNA, 21 bp, Homo sapiens
taagtctcctgtcttatggtc

SEQ ID NO: 1120732 - DNA, 12 bp, Homo sapiens
taagtctctgtg

SEQ ID NO: 1120733 - DNA, 19 bp, Homo sapiens
taagtctgtcttgccttca

SEQ ID NO: 1120734 - DNA, 21 bp, Homo sapiens
taagtcttccttaaatgactt

SEQ ID NO: 1120735 - DNA, 23 bp, Homo sapiens
taagtcttccttagctaaatgca

SEQ ID NO: 1120736 - DNA, 12 bp, Homo sapiens
taagtctttccc

SEQ ID NO: 1120737 - DNA, 19 bp, Homo sapiens
taagtgaaagtgaggaaat

SEQ ID NO: 1120738 - DNA, 14 bp, Homo sapiens
taagtgaaggagaa

SEQ ID NO: 1120739 - DNA, 24 bp, Homo sapiens
taagtgagagagacaagaagcaaa

SEQ ID NO: 1120740 - DNA, 18 bp, Homo sapiens
taagtgatttaaaaaaat

SEQ ID NO: 1120741 - DNA, 13 bp, Homo sapiens
taatcatgaatat

SEQ ID NO: 1120742 - DNA, 18 bp, Homo sapiens
taatcatgctcatgtata

SEQ ID NO: 1120743 - DNA, 21 bp, Homo sapiens
taatcatgctcatgtatattt

SEQ ID NO: 1120744 - DNA, 14 bp, Homo sapiens
taatcattgcttat

SEQ ID NO: 1120745 - DNA, 16 bp, Homo sapiens
taatcatttccccata

SEQ ID NO: 1120746 - DNA, 12 bp, Homo sapiens
taatcattttaa

SEQ ID NO: 1120747 - DNA, 13 bp, Homo sapiens
taatcattttcat

SEQ ID NO: 1120748 - DNA, 17 bp, Homo sapiens
taatcattttcattcct

SEQ ID NO: 1120749 - DNA, 18 bp, Homo sapiens
taatcattttcattccta

SEQ ID NO: 1120750 - DNA, 22 bp, Homo sapiens
taatccacatctttactcaggc

SEQ ID NO: 1120751 - DNA, 13 bp, Homo sapiens
taatccaccccca

SEQ ID NO: 1120752 - DNA, 22 bp, Homo sapiens
taatccattccttgaggacaga

SEQ ID NO: 1120753 - DNA, 11 bp, Homo sapiens
taatcccctgc

SEQ ID NO: 1120754 - DNA, 14 bp, Homo sapiens
taatccctgctttt

SEQ ID NO: 1120755 - DNA, 21 bp, Homo sapiens
taatccctgctttttgtgttt

SEQ ID NO: 1120756 - DNA, 20 bp, Homo sapiens
taatccctgggcattgcttt

SEQ ID NO: 1120757 - DNA, 21 bp, Homo sapiens
taatccgaatctctttttgct

SEQ ID NO: 1120758 - DNA, 23 bp, Homo sapiens
taatcctttgttttctgactaat

SEQ ID NO: 1120759 - DNA, 16 bp, Homo sapiens
taatcgatgaatgtaa

SEQ ID NO: 1120760 - DNA, 16 bp, Homo sapiens
taatcggcccacagct

SEQ ID NO: 1120761 - DNA, 15 bp, Homo sapiens
taatctaaaatgatt

SEQ ID NO: 1120762 - DNA, 11 bp, Homo sapiens
taatctaaatg

SEQ ID NO: 1120763 - DNA, 12 bp, Homo sapiens
taatctaaatgg

SEQ ID NO: 1120764 - DNA, 20 bp, Homo sapiens
taatctaagtatatgtgaga

SEQ ID NO: 1120765 - DNA, 14 bp, Homo sapiens
taatctactttttg

SEQ ID NO: 1120766 - DNA, 20 bp, Homo sapiens
taatctactttttgtattta

SEQ ID NO: 1120767 - DNA, 22 bp, Homo sapiens
taatctagaacacaggcaaaat

SEQ ID NO: 1120768 - DNA, 18 bp, Homo sapiens
taatctaggtgtggctgt

SEQ ID NO: 1120769 - DNA, 17 bp, Homo sapiens
taatctagtttacagaa

SEQ ID NO: 1120770 - DNA, 18 bp, Homo sapiens
taatctagtttacagaaa

SEQ ID NO: 1120771 - DNA, 18 bp, Homo sapiens
taatctatattaaatgag

SEQ ID NO: 1120772 - DNA, 22 bp, Homo sapiens
taatctattcctgtaaataaga

SEQ ID NO: 1120773 - DNA, 16 bp, Homo sapiens
taatctattgggttca

SEQ ID NO: 1120774 - DNA, 17 bp, Homo sapiens
taatctatttctatgag

SEQ ID NO: 1120775 - DNA, 15 bp, Homo sapiens
taatctcaaaggaga

SEQ ID NO: 1120776 - DNA, 18 bp, Homo sapiens
taatctcaaaggagaaaa

SEQ ID NO: 1120777 - DNA, 14 bp, Homo sapiens
taatctcatccccc

SEQ ID NO: 1120778 - DNA, 16 bp, Homo sapiens
taatctcatcccccca

SEQ ID NO: 1120779 - DNA, 20 bp, Homo sapiens
taatctcatccccccacccg

SEQ ID NO: 1120780 - DNA, 12 bp, Homo sapiens
taatctcccagc

SEQ ID NO: 1120781 - DNA, 14 bp, Homo sapiens
taatctctgtgtgt

SEQ ID NO: 1120782 - DNA, 21 bp, Homo sapiens
taatctctgtgtgttttcttt

SEQ ID NO: 1120783 - DNA, 14 bp, Homo sapiens
taatctcttattct

SEQ ID NO: 1120784 - DNA, 15 bp, Homo sapiens
taatctcttcttata

SEQ ID NO: 1120785 - DNA, 21 bp, Homo sapiens
taatctctttggttcctgtat

SEQ ID NO: 1120786 - DNA, 23 bp, Homo sapiens
taatctgaataaagtgtaacaat

SEQ ID NO: 1120787 - DNA, 12 bp, Homo sapiens
taatctgcctgg

SEQ ID NO: 1120788 - DNA, 22 bp, Homo sapiens
taatctggactcctctgtccag

SEQ ID NO: 1120789 - DNA, 17 bp, Homo sapiens
taatctgggaagggaag

SEQ ID NO: 1120790 - DNA, 15 bp, Homo sapiens
taatctggtgacaaa

SEQ ID NO: 1120791 - DNA, 16 bp, Homo sapiens
taatctgtagggctgg

SEQ ID NO: 1120792 - DNA, 17 bp, Homo sapiens
taatctgtagggctgga

SEQ ID NO: 1120793 - DNA, 16 bp, Homo sapiens
taatctgtcaaaacac

SEQ ID NO: 1120794 - DNA, 21 bp, Homo sapiens
taatctgtcaaaacactgtgg

SEQ ID NO: 1120795 - DNA, 19 bp, Homo sapiens
taatctgtgtacaaagaaa

SEQ ID NO: 1120796 - DNA, 19 bp, Homo sapiens
taatcttaggggagagctt

SEQ ID NO: 1120797 - DNA, 14 bp, Homo sapiens
taatcttatacaac

SEQ ID NO: 1120798 - DNA, 21 bp, Homo sapiens
taatcttattagggagaaaat

SEQ ID NO: 1120799 - DNA, 14 bp, Homo sapiens
taatcttcaggtga

SEQ ID NO: 1120800 - DNA, 21 bp, Homo sapiens
taatcttcaggtgaacactta

SEQ ID NO: 1120801 - DNA, 16 bp, Homo sapiens
taatcttcagttttat

SEQ ID NO: 1120802 - DNA, 18 bp, Homo sapiens
taatcttgctttctttag

SEQ ID NO: 1120803 - DNA, 14 bp, Homo sapiens
taatcttggctcag

SEQ ID NO: 1120804 - DNA, 17 bp, Homo sapiens
taatcttgttgataaaa

SEQ ID NO: 1120805 - DNA, 15 bp, Homo sapiens
taatctttaaactgg

SEQ ID NO: 1120806 - DNA, 14 bp, Homo sapiens
taatctttatactg

SEQ ID NO: 1120807 - DNA, 19 bp, Homo sapiens
taatctttcaaaccagctt

SEQ ID NO: 1120808 - DNA, 22 bp, Homo sapiens
taatctttcacttgaaagattt

SEQ ID NO: 1120809 - DNA, 18 bp, Homo sapiens
taatctttctttacctga

SEQ ID NO: 1120810 - DNA, 12 bp, Homo sapiens
taatctttgggt

SEQ ID NO: 1120811 - DNA, 19 bp, Homo sapiens
taatcttttagtgtttact

SEQ ID NO: 1120812 - DNA, 17 bp, Homo sapiens
taatctttttacagttg

SEQ ID NO: 1120813 - DNA, 19 bp, Homo sapiens
taatgaaaaacaaaaagct

SEQ ID NO: 1120814 - DNA, 16 bp, Homo sapiens
taatgaaaataaaaca

SEQ ID NO: 1120815 - DNA, 18 bp, Homo sapiens
taatgaaaataaaacaca

SEQ ID NO: 1120816 - DNA, 16 bp, Homo sapiens
taatgaaacaaagagt

SEQ ID NO: 1120817 - DNA, 17 bp, Homo sapiens
taatgaaacaaagagtt

SEQ ID NO: 1120818 - DNA, 19 bp, Homo sapiens
taatgaaagggaaagtcag

SEQ ID NO: 1120819 - DNA, 20 bp, Homo sapiens
taatgaaagggtttgtaata

SEQ ID NO: 1120820 - DNA, 14 bp, Homo sapiens
taatgaaataatca

SEQ ID NO: 1120821 - DNA, 13 bp, Homo sapiens
taatgaaatggag

SEQ ID NO: 1120822 - DNA, 17 bp, Homo sapiens
taatgaacaaaattatt

SEQ ID NO: 1120823 - DNA, 14 bp, Homo sapiens
taatgaacaaatgg

SEQ ID NO: 1120824 - DNA, 18 bp, Homo sapiens
taatgaactaccatctga

SEQ ID NO: 1120825 - DNA, 19 bp, Homo sapiens
taatgaactaccatctgat

SEQ ID NO: 1120826 - DNA, 17 bp, Homo sapiens
taatgaagaaagtggaa

SEQ ID NO: 1120827 - DNA, 22 bp, Homo sapiens
taatgaagaaagtggaaaacaa

SEQ ID NO: 1120828 - DNA, 20 bp, Homo sapiens
taatgaaggttttcatttgc

SEQ ID NO: 1120829 - DNA, 16 bp, Homo sapiens
taatgaataaactgaa

SEQ ID NO: 1120830 - DNA, 14 bp, Homo sapiens
taatgaattataac

SEQ ID NO: 1120831 - DNA, 16 bp, Homo sapiens
taatgaatttttatga

SEQ ID NO: 1120832 - DNA, 21 bp, Homo sapiens
taatgaatttttatgatattc

SEQ ID NO: 1120833 - DNA, 22 bp, Homo sapiens
taatgacaacacttaatagcaa

SEQ ID NO: 1120834 - DNA, 14 bp, Homo sapiens
taatgacagatgca

SEQ ID NO: 1120835 - DNA, 14 bp, Homo sapiens
taatgaccatgaaa

SEQ ID NO: 1120836 - DNA, 17 bp, Homo sapiens
taatgacttagaaactg

SEQ ID NO: 1120837 - DNA, 17 bp, Homo sapiens
taatgagagtgcactgc

SEQ ID NO: 1120838 - DNA, 20 bp, Homo sapiens
taatgagatgttattactgt

SEQ ID NO: 1120839 - DNA, 11 bp, Homo sapiens
taatgagccat

SEQ ID NO: 1120840 - DNA, 12 bp, Homo sapiens
taatgagccatc

SEQ ID NO: 1120841 - DNA, 22 bp, Homo sapiens
taatgagccatcactagaagaa

SEQ ID NO: 1120842 - DNA, 18 bp, Homo sapiens
taatgagctagtgtctta

SEQ ID NO: 1120843 - DNA, 16 bp, Homo sapiens
taatgaggatgattat

SEQ ID NO: 1120844 - DNA, 21 bp, Homo sapiens
taatgaggtctttaaaccttt

SEQ ID NO: 1120845 - DNA, 15 bp, Homo sapiens
taatgagtatgaact

SEQ ID NO: 1120846 - DNA, 20 bp, Homo sapiens
taatgataaactcagatctg

SEQ ID NO: 1120847 - DNA, 17 bp, Homo sapiens
taatgatcaaaacatgc

SEQ ID NO: 1120848 - DNA, 18 bp, Homo sapiens
taatgatcgaaaaaataa

SEQ ID NO: 1120849 - DNA, 19 bp, Homo sapiens
taatgatcgaaaaaataat

SEQ ID NO: 1120850 - DNA, 20 bp, Homo sapiens
taatgatcgaaaaaataatt

SEQ ID NO: 1120851 - DNA, 19 bp, Homo sapiens
taatgatgaaatctttctt

SEQ ID NO: 1120852 - DNA, 22 bp, Homo sapiens
taatgatgacaaaaaatgtttt

SEQ ID NO: 1120853 - DNA, 17 bp, Homo sapiens
taatgatgttgataatt

SEQ ID NO: 1120854 - DNA, 21 bp, Homo sapiens
taatgatgttgataatttcag

SEQ ID NO: 1120855 - DNA, 11 bp, Homo sapiens
taatgatgttt

SEQ ID NO: 1120856 - DNA, 14 bp, Homo sapiens
taatgattcataag

SEQ ID NO: 1120857 - DNA, 16 bp, Homo sapiens
taatgatttgctcttt

SEQ ID NO: 1120858 - DNA, 22 bp, Homo sapiens
taatgcaaattaaaacatattt

SEQ ID NO: 1120859 - DNA, 17 bp, Homo sapiens
taatgcaagcaaagtat

SEQ ID NO: 1120860 - DNA, 15 bp, Homo sapiens
taatgcacagtgcat

SEQ ID NO: 1120861 - DNA, 10 bp, Homo sapiens
taatgcactg

SEQ ID NO: 1120862 - DNA, 16 bp, Homo sapiens
taatgcatgttaggaa

SEQ ID NO: 1120863 - DNA, 19 bp, Homo sapiens
tacaaactgaagagtaatc

SEQ ID NO: 1120864 - DNA, 17 bp, Homo sapiens
tacaaactgcaatagag

SEQ ID NO: 1120865 - DNA, 22 bp, Homo sapiens
tacaaactgcaatagagactgt

SEQ ID NO: 1120866 - DNA, 17 bp, Homo sapiens
tacaaagcccttttata

SEQ ID NO: 1120867 - DNA, 21 bp, Homo sapiens
tacaaagcgtttctttacttc

SEQ ID NO: 1120868 - DNA, 16 bp, Homo sapiens
tacaaagctttgctac

SEQ ID NO: 1120869 - DNA, 18 bp, Homo sapiens
tacaaagctttgctacaa

SEQ ID NO: 1120870 - DNA, 21 bp, Homo sapiens
tacaaagctttgctacaaatt

SEQ ID NO: 1120871 - DNA, 19 bp, Homo sapiens
tacaaagtactgtcctcaa

SEQ ID NO: 1120872 - DNA, 15 bp, Homo sapiens
tacaaagtggaaact

SEQ ID NO: 1120873 - DNA, 13 bp, Homo sapiens
tacaaagtgtgta

SEQ ID NO: 1120874 - DNA, 15 bp, Homo sapiens
tacaaagtgtgtatt

SEQ ID NO: 1120875 - DNA, 19 bp, Homo sapiens
tacaaagtgtgtattaaaa

SEQ ID NO: 1120876 - DNA, 14 bp, Homo sapiens
tacaaataaacagt

SEQ ID NO: 1120877 - DNA, 19 bp, Homo sapiens
tacaaataaacagttgtta

SEQ ID NO: 1120878 - DNA, 12 bp, Homo sapiens
tacaaataggta

SEQ ID NO: 1120879 - DNA, 15 bp, Homo sapiens
tacaaataggtagag

SEQ ID NO: 1120880 - DNA, 14 bp, Homo sapiens
tacaaatataagaa

SEQ ID NO: 1120881 - DNA, 16 bp, Homo sapiens
tacaaatataagaata

SEQ ID NO: 1120882 - DNA, 17 bp, Homo sapiens
tacaaatattgtcatct

SEQ ID NO: 1120883 - DNA, 16 bp, Homo sapiens
tacaaatcaagtattt

SEQ ID NO: 1120884 - DNA, 22 bp, Homo sapiens
tacaaatcagaagtcatcttgc

SEQ ID NO: 1120885 - DNA, 15 bp, Homo sapiens
tacaaatcagtaatt

SEQ ID NO: 1120886 - DNA, 14 bp, Homo sapiens
tacaaatgaagaaa

SEQ ID NO: 1120887 - DNA, 15 bp, Homo sapiens
tacaaatgaagaaag

SEQ ID NO: 1120888 - DNA, 17 bp, Homo sapiens
tacaaatgtttataact

SEQ ID NO: 1120889 - DNA, 18 bp, Homo sapiens
tacaaatttatgcatttc

SEQ ID NO: 1120890 - DNA, 19 bp, Homo sapiens
tacaaatttatgcatttca

SEQ ID NO: 1120891 - DNA, 22 bp, Homo sapiens
tacaaatttatgcatttcattc

SEQ ID NO: 1120892 - DNA, 16 bp, Homo sapiens
tacaaattttttaatt

SEQ ID NO: 1120893 - DNA, 19 bp, Homo sapiens
tacaacaagagtttatttc

SEQ ID NO: 1120894 - DNA, 15 bp, Homo sapiens
tacaacacaaagaga

SEQ ID NO: 1120895 - DNA, 17 bp, Homo sapiens
tacaacacaaagagaaa

SEQ ID NO: 1120896 - DNA, 16 bp, Homo sapiens
tacaacaggagagaga

SEQ ID NO: 1120897 - DNA, 23 bp, Homo sapiens
tacaacataatctagtttacaga

SEQ ID NO: 1120898 - DNA, 23 bp, Homo sapiens
tacaaccaagctctctgcatcta

SEQ ID NO: 1120899 - DNA, 14 bp, Homo sapiens
tacaaccatatatt

SEQ ID NO: 1120900 - DNA, 17 bp, Homo sapiens
tacaacccataatcatg

SEQ ID NO: 1120901 - DNA, 18 bp, Homo sapiens
tacaacccataatcatgt

SEQ ID NO: 1120902 - DNA, 15 bp, Homo sapiens
tacaaccttcattta

SEQ ID NO: 1120903 - DNA, 21 bp, Homo sapiens
tacaactaaaaataaattaat

SEQ ID NO: 1120904 - DNA, 15 bp, Homo sapiens
tacaactgtaaagca

SEQ ID NO: 1120905 - DNA, 17 bp, Homo sapiens
tacaacttaagttggtc

SEQ ID NO: 1120906 - DNA, 17 bp, Homo sapiens
tacaagaaaaaatgaat

SEQ ID NO: 1120907 - DNA, 15 bp, Homo sapiens
tacaagaaaatgtat

SEQ ID NO: 1120908 - DNA, 14 bp, Homo sapiens
tacaagaagcattt

SEQ ID NO: 1120909 - DNA, 15 bp, Homo sapiens
tacaagaagcatttt

SEQ ID NO: 1120910 - DNA, 15 bp, Homo sapiens
tacaagaagtttatt

SEQ ID NO: 1120911 - DNA, 16 bp, Homo sapiens
tacaagactgccatat

SEQ ID NO: 1120912 - DNA, 16 bp, Homo sapiens
tacaagagtccctttg

SEQ ID NO: 1120913 - DNA, 22 bp, Homo sapiens
tacaagatctttccaaataccc

SEQ ID NO: 1120914 - DNA, 12 bp, Homo sapiens
tacaagatttcc

SEQ ID NO: 1120915 - DNA, 18 bp, Homo sapiens
tacaagcatatttgagaa

SEQ ID NO: 1120916 - DNA, 18 bp, Homo sapiens
tacaagccagctggagaa

SEQ ID NO: 1120917 - DNA, 21 bp, Homo sapiens
tacaagccattctaaggaaat

SEQ ID NO: 1120918 - DNA, 20 bp, Homo sapiens
tacaagcttaaagcttgatt

SEQ ID NO: 1120919 - DNA, 21 bp, Homo sapiens
tacaaggacattcactgctga

SEQ ID NO: 1120920 - DNA, 15 bp, Homo sapiens
tacaaggatgaaaga

SEQ ID NO: 1120921 - DNA, 15 bp, Homo sapiens
tacaaggcaagcatt

SEQ ID NO: 1120922 - DNA, 22 bp, Homo sapiens
tacaaggccccaaggtttacat

SEQ ID NO: 1120923 - DNA, 18 bp, Homo sapiens
tacaagggcataaagtaa

SEQ ID NO: 1120924 - DNA, 18 bp, Homo sapiens
tacaagggtctagggaga

SEQ ID NO: 1120925 - DNA, 19 bp, Homo sapiens
tacaagtaacaaaaataaa

SEQ ID NO: 1120926 - DNA, 20 bp, Homo sapiens
tacaagtataacagttttga

SEQ ID NO: 1120927 - DNA, 18 bp, Homo sapiens
tacaagtcagctccagct

SEQ ID NO: 1120928 - DNA, 19 bp, Homo sapiens
tacaagtggctccccacct

SEQ ID NO: 1120929 - DNA, 20 bp, Homo sapiens
tacaagtggctccccacctg

SEQ ID NO: 1120930 - DNA, 13 bp, Homo sapiens
tacaagttagaaa

SEQ ID NO: 1120931 - DNA, 16 bp, Homo sapiens
tacaagtttcagacag

SEQ ID NO: 1120932 - DNA, 14 bp, Homo sapiens
tacaagtttgctaa

SEQ ID NO: 1120933 - DNA, 16 bp, Homo sapiens
tacaagtttgctaaaa

SEQ ID NO: 1120934 - DNA, 17 bp, Homo sapiens
tacaagtttgctaaaag

SEQ ID NO: 1120935 - DNA, 13 bp, Homo sapiens
tacaagttttgta

SEQ ID NO: 1120936 - DNA, 14 bp, Homo sapiens
tacaagttttgtat

SEQ ID NO: 1120937 - DNA, 20 bp, Homo sapiens
tacaataaaatcttgaaaat

SEQ ID NO: 1120938 - DNA, 18 bp, Homo sapiens
tacaataaatattctgca

SEQ ID NO: 1120939 - DNA, 16 bp, Homo sapiens
tacaataaattgctaa

SEQ ID NO: 1120940 - DNA, 18 bp, Homo sapiens
tacaataacccagttact

SEQ ID NO: 1120941 - DNA, 20 bp, Homo sapiens
tacaataacccagttacttt

SEQ ID NO: 1120942 - DNA, 23 bp, Homo sapiens
tacaatacatatatctacacata

SEQ ID NO: 1120943 - DNA, 17 bp, Homo sapiens
tacaataccgttaagat

SEQ ID NO: 1120944 - DNA, 15 bp, Homo sapiens
tacaatcaaatctcc

SEQ ID NO: 1120945 - DNA, 21 bp, Homo sapiens
tacaatcaaatctcctgctga

SEQ ID NO: 1120946 - DNA, 17 bp, Homo sapiens
tacaatcattgctgaaa

SEQ ID NO: 1120947 - DNA, 14 bp, Homo sapiens
tacaatcctgttta

SEQ ID NO: 1120948 - DNA, 14 bp, Homo sapiens
tacaatctgtatct

SEQ ID NO: 1120949 - DNA, 20 bp, Homo sapiens
tacaatctgtatctttgaca

SEQ ID NO: 1120950 - DNA, 14 bp, Homo sapiens
tacaatgaactgct

SEQ ID NO: 1120951 - DNA, 15 bp, Homo sapiens
tacaatgaactgctt

SEQ ID NO: 1120952 - DNA, 16 bp, Homo sapiens
tacaatgaccacatag

SEQ ID NO: 1120953 - DNA, 16 bp, Homo sapiens
tacaatgatggtaaag

SEQ ID NO: 1120954 - DNA, 23 bp, Homo sapiens
tacaatgatggtaaagccatgtt

SEQ ID NO: 1120955 - DNA, 20 bp, Homo sapiens
tacaatgatgtataattaat

SEQ ID NO: 1120956 - DNA, 16 bp, Homo sapiens
tacaatgctgtgccct

SEQ ID NO: 1120957 - DNA, 12 bp, Homo sapiens
tacaatgtacaa

SEQ ID NO: 1120958 - DNA, 14 bp, Homo sapiens
tacaatgtacaatt

SEQ ID NO: 1120959 - DNA, 15 bp, Homo sapiens
tacaatgtacaatta

SEQ ID NO: 1120960 - DNA, 22 bp, Homo sapiens
tacaatgtatctttattaaaac

SEQ ID NO: 1120961 - DNA, 17 bp, Homo sapiens
tacaatgtatgtacaat

SEQ ID NO: 1120962 - DNA, 18 bp, Homo sapiens
tacaatgtatgtacaata

SEQ ID NO: 1120963 - DNA, 15 bp, Homo sapiens
tacaatgtgaacttt

SEQ ID NO: 1120964 - DNA, 17 bp, Homo sapiens
tacaatgtgaactttat

SEQ ID NO: 1120965 - DNA, 23 bp, Homo sapiens
tacaatgttatcaaccaactgca

SEQ ID NO: 1120966 - DNA, 16 bp, Homo sapiens
tacaatgttcatccca

SEQ ID NO: 1120967 - DNA, 22 bp, Homo sapiens
tacaatgttcatcccatgatgt

SEQ ID NO: 1120968 - DNA, 18 bp, Homo sapiens
tacaattaaaaaaaaaga

SEQ ID NO: 1120969 - DNA, 22 bp, Homo sapiens
tacaattaaaaaaaaagatctg

SEQ ID NO: 1120970 - DNA, 22 bp, Homo sapiens
tacaattaaaggtcctgccctc

SEQ ID NO: 1120971 - DNA, 15 bp, Homo sapiens
tacaattatatcagt

SEQ ID NO: 1120972 - DNA, 15 bp, Homo sapiens
tacaattatgtctct

SEQ ID NO: 1120973 - DNA, 16 bp, Homo sapiens
tacaattcattgtgtt

SEQ ID NO: 1120974 - DNA, 18 bp, Homo sapiens
tacaattcctctgataat

SEQ ID NO: 1120975 - DNA, 14 bp, Homo sapiens
tacaattgcactgc

SEQ ID NO: 1120976 - DNA, 17 bp, Homo sapiens
tacaattgcactgctgt

SEQ ID NO: 1120977 - DNA, 18 bp, Homo sapiens
tacaattgcactgctgtt

SEQ ID NO: 1120978 - DNA, 16 bp, Homo sapiens
tacaatttacaaagtg

SEQ ID NO: 1120979 - DNA, 21 bp, Homo sapiens
tacaatttccatatagtctat

SEQ ID NO: 1120980 - DNA, 23 bp, Homo sapiens
tacaatttgttaattcctatgaa

SEQ ID NO: 1120981 - DNA, 16 bp, Homo sapiens
tacaattttaaagttc

SEQ ID NO: 1120982 - DNA, 19 bp, Homo sapiens
tacaattttaaagttctta

SEQ ID NO: 1120983 - DNA, 22 bp, Homo sapiens
tacaattttagtcactaagact

SEQ ID NO: 1120984 - DNA, 18 bp, Homo sapiens
tacaattttctcccagga

SEQ ID NO: 1120985 - DNA, 16 bp, Homo sapiens
tacatacagattttac

SEQ ID NO: 1120986 - DNA, 16 bp, Homo sapiens
tacatacataatgttt

SEQ ID NO: 1120987 - DNA, 14 bp, Homo sapiens
tacatacatacata

SEQ ID NO: 1120988 - DNA, 18 bp, Homo sapiens
tacatacatacatacata

SEQ ID NO: 1120989 - DNA, 17 bp, Homo sapiens
tacatacatacatatat

SEQ ID NO: 1120990 - DNA, 14 bp, Homo sapiens
tacatacattgtat

SEQ ID NO: 1120991 - DNA, 23 bp, Homo sapiens
tacatacgcaaaaacttccttta

SEQ ID NO: 1120992 - DNA, 17 bp, Homo sapiens
tacatacggtcaggttt

SEQ ID NO: 1120993 - DNA, 23 bp, Homo sapiens
tacatacggtcaggtttaacatt

SEQ ID NO: 1120994 - DNA, 14 bp, Homo sapiens
tacatacgtctgcc

SEQ ID NO: 1120995 - DNA, 12 bp, Homo sapiens
tacatactggcc

SEQ ID NO: 1120996 - DNA, 17 bp, Homo sapiens
tacatactggcctctgt

SEQ ID NO: 1120997 - DNA, 20 bp, Homo sapiens
tacatactgtatttttacta

SEQ ID NO: 1120998 - DNA, 22 bp, Homo sapiens
tacatagagatctattttttct

SEQ ID NO: 1120999 - DNA, 12 bp, Homo sapiens
tacatagatcag

SEQ ID NO: 1121000 - DNA, 17 bp, Homo sapiens
tacatagatgcttagtc

SEQ ID NO: 1121001 - DNA, 22 bp, Homo sapiens
tacatagatttatttttcagtt

SEQ ID NO: 1121002 - DNA, 16 bp, Homo sapiens
tacataggtctgtatg

SEQ ID NO: 1121003 - DNA, 18 bp, Homo sapiens
tacataggtctgtatggc

SEQ ID NO: 1121004 - DNA, 19 bp, Homo sapiens
tacatagtgctgctgtgtg

SEQ ID NO: 1121005 - DNA, 19 bp, Homo sapiens
tacatatatatatacacat

SEQ ID NO: 1121006 - DNA, 22 bp, Homo sapiens
tacatatatatatacacataca

SEQ ID NO: 1121007 - DNA, 14 bp, Homo sapiens
tacatatatatatt

SEQ ID NO: 1121008 - DNA, 17 bp, Homo sapiens
tacatatatatatttgt

SEQ ID NO: 1121009 - DNA, 20 bp, Homo sapiens
tacatatatatatttgtaac

SEQ ID NO: 1121010 - DNA, 14 bp, Homo sapiens
tacatatatatctg

SEQ ID NO: 1121011 - DNA, 18 bp, Homo sapiens
tacatatcacctcatggc

SEQ ID NO: 1121012 - DNA, 22 bp, Homo sapiens
tacatatcgctgacttcatgga

SEQ ID NO: 1121013 - DNA, 17 bp, Homo sapiens
tacatatgatctgtctg

SEQ ID NO: 1121014 - DNA, 15 bp, Homo sapiens
tacatatgtaaaata

SEQ ID NO: 1121015 - DNA, 16 bp, Homo sapiens
tacatatgtaaaataa

SEQ ID NO: 1121016 - DNA, 20 bp, Homo sapiens
tacatatgtaaaataaaatt

SEQ ID NO: 1121017 - DNA, 14 bp, Homo sapiens
tacatattactgtt

SEQ ID NO: 1121018 - DNA, 18 bp, Homo sapiens
tacatattaggaaaatat

SEQ ID NO: 1121019 - DNA, 19 bp, Homo sapiens
tacatattaggaaaatatg

SEQ ID NO: 1121020 - DNA, 20 bp, Homo sapiens
tacatatttgactctttcaa

SEQ ID NO: 1121021 - DNA, 21 bp, Homo sapiens
tacatatttgactctttcaaa

SEQ ID NO: 1121022 - DNA, 20 bp, Homo sapiens
tacatattttggttgaagac

SEQ ID NO: 1121023 - DNA, 19 bp, Homo sapiens
tacatcaaagcttcttcac

SEQ ID NO: 1121024 - DNA, 17 bp, Homo sapiens
tacatcaagtccatctg

SEQ ID NO: 1121025 - DNA, 22 bp, Homo sapiens
tacatcaagtccatctgacaaa

SEQ ID NO: 1121026 - DNA, 13 bp, Homo sapiens
tacatcaattaat

SEQ ID NO: 1121027 - DNA, 15 bp, Homo sapiens
tacatcactgcttga

SEQ ID NO: 1121028 - DNA, 22 bp, Homo sapiens
tacatcactgcttgatgaagca

SEQ ID NO: 1121029 - DNA, 16 bp, Homo sapiens
tacatcactttgtgaa

SEQ ID NO: 1121030 - DNA, 17 bp, Homo sapiens
tacatcagactctagaa

SEQ ID NO: 1121031 - DNA, 21 bp, Homo sapiens
tacatcagtatagtgttttat

SEQ ID NO: 1121032 - DNA, 17 bp, Homo sapiens
tacatccagctcctcta

SEQ ID NO: 1121033 - DNA, 13 bp, Homo sapiens
tacatcccagcct

SEQ ID NO: 1121034 - DNA, 18 bp, Homo sapiens
tacatctattttggattg

SEQ ID NO: 1121035 - DNA, 13 bp, Homo sapiens
tacatctgctgtg

SEQ ID NO: 1121036 - DNA, 19 bp, Homo sapiens
tacatctgctgtgtggaaa

SEQ ID NO: 1121037 - DNA, 15 bp, Homo sapiens
tacatctgtaaagaa

SEQ ID NO: 1121038 - DNA, 17 bp, Homo sapiens
tacatcttctgccttag

SEQ ID NO: 1121039 - DNA, 22 bp, Homo sapiens
tacatcttctgtgaaatataat

SEQ ID NO: 1121040 - DNA, 23 bp, Homo sapiens
tacatcttctgtgaaatataatt

SEQ ID NO: 1121041 - DNA, 16 bp, Homo sapiens
tacatcttgttggtac

SEQ ID NO: 1121042 - DNA, 21 bp, Homo sapiens
tacatcttgttggtacctttc

SEQ ID NO: 1121043 - DNA, 16 bp, Homo sapiens
tacatctttaaacagt

SEQ ID NO: 1121044 - DNA, 14 bp, Homo sapiens
tacatctttcacat

SEQ ID NO: 1121045 - DNA, 23 bp, Homo sapiens
tacatcttttctaatcacagtgt

SEQ ID NO: 1121046 - DNA, 18 bp, Homo sapiens
tacatgaaaacacatttt

SEQ ID NO: 1121047 - DNA, 23 bp, Homo sapiens
tacatgaaaacacatttttctta

SEQ ID NO: 1121048 - DNA, 12 bp, Homo sapiens
tacatgaaacag

SEQ ID NO: 1121049 - DNA, 21 bp, Homo sapiens
tacatgaaacagaaacaaaaa

SEQ ID NO: 1121050 - DNA, 15 bp, Homo sapiens
tacatgacatcaaaa

SEQ ID NO: 1121051 - DNA, 14 bp, Homo sapiens
tacatgagaaagat

SEQ ID NO: 1121052 - DNA, 13 bp, Homo sapiens
tacatgaggactc

SEQ ID NO: 1121053 - DNA, 14 bp, Homo sapiens
tacatgaggactct

SEQ ID NO: 1121054 - DNA, 21 bp, Homo sapiens
tacatgaggactctattcttt

SEQ ID NO: 1121055 - DNA, 22 bp, Homo sapiens
tacatgaggactctattcttta

SEQ ID NO: 1121056 - DNA, 17 bp, Homo sapiens
tacatgatacattttta

SEQ ID NO: 1121057 - DNA, 19 bp, Homo sapiens
tacatgcaatttattaaaa

SEQ ID NO: 1121058 - DNA, 20 bp, Homo sapiens
tacatgcaatttattaaaat

SEQ ID NO: 1121059 - DNA, 17 bp, Homo sapiens
tacatgcagcccatgcc

SEQ ID NO: 1121060 - DNA, 14 bp, Homo sapiens
tacatgcatttgag

SEQ ID NO: 1121061 - DNA, 14 bp, Homo sapiens
tacatgccagtgac

SEQ ID NO: 1121062 - DNA, 13 bp, Homo sapiens
tacatgctacttt

SEQ ID NO: 1121063 - DNA, 22 bp, Homo sapiens
tacatgctatgctgaagacatt

SEQ ID NO: 1121064 - DNA, 20 bp, Homo sapiens
tacatgctggttacctgttc

SEQ ID NO: 1121065 - DNA, 14 bp, Homo sapiens
tacatggaataaca

SEQ ID NO: 1121066 - DNA, 19 bp, Homo sapiens
tacatggcagagtttgtgt

SEQ ID NO: 1121067 - DNA, 15 bp, Homo sapiens
tacatggtgtttgtg

SEQ ID NO: 1121068 - DNA, 16 bp, Homo sapiens
tacatggttgtgacct

SEQ ID NO: 1121069 - DNA, 13 bp, Homo sapiens
tacatgtagtagt

SEQ ID NO: 1121070 - DNA, 15 bp, Homo sapiens
tacatgtattgcaca

SEQ ID NO: 1121071 - DNA, 16 bp, Homo sapiens
tacatgtgtgtatatg

SEQ ID NO: 1121072 - DNA, 15 bp, Homo sapiens
tacatgttcttgtca

SEQ ID NO: 1121073 - DNA, 14 bp, Homo sapiens
tacatgttgatact

SEQ ID NO: 1121074 - DNA, 15 bp, Homo sapiens
tacatgtttataaat

SEQ ID NO: 1121075 - DNA, 17 bp, Homo sapiens
tacatgtttataaatct

SEQ ID NO: 1121076 - DNA, 21 bp, Homo sapiens
tacatgtttccatcatttctg

SEQ ID NO: 1121077 - DNA, 20 bp, Homo sapiens
tacatgttttttcatttgta

SEQ ID NO: 1121078 - DNA, 14 bp, Homo sapiens
tacattaacggtgc

SEQ ID NO: 1121079 - DNA, 16 bp, Homo sapiens
tacattaacggtgcta

SEQ ID NO: 1121080 - DNA, 22 bp, Homo sapiens
tacattaatgtcctcttgctgt

SEQ ID NO: 1121081 - DNA, 20 bp, Homo sapiens
tacattaatgttaattcagc

SEQ ID NO: 1121082 - DNA, 13 bp, Homo sapiens
tacattatgcaaa

SEQ ID NO: 1121083 - DNA, 18 bp, Homo sapiens
tacattcaaatttgtctg

SEQ ID NO: 1121084 - DNA, 21 bp, Homo sapiens
tacattcaaatttgtctggtt

SEQ ID NO: 1121085 - DNA, 13 bp, Homo sapiens
tacattcatttag

SEQ ID NO: 1121086 - DNA, 15 bp, Homo sapiens
tacattcatttagct

SEQ ID NO: 1121087 - DNA, 22 bp, Homo sapiens
tacattccctctcctgcccaga

SEQ ID NO: 1121088 - DNA, 19 bp, Homo sapiens
tacattcctaactagaatt

SEQ ID NO: 1121089 - DNA, 19 bp, Homo sapiens
tacattcctcagctgccaa

SEQ ID NO: 1121090 - DNA, 21 bp, Homo sapiens
tacattcttccatcatcactg

SEQ ID NO: 1121091 - DNA, 23 bp, Homo sapiens
tacattcttccatcatcactgta

SEQ ID NO: 1121092 - DNA, 14 bp, Homo sapiens
tacattgagcattt

SEQ ID NO: 1121093 - DNA, 19 bp, Homo sapiens
tacattgatacaaagtaca

SEQ ID NO: 1121094 - DNA, 22 bp, Homo sapiens
tacattgccgtggcatcttaaa

SEQ ID NO: 1121095 - DNA, 21 bp, Homo sapiens
tacattgtataggccatctgt

SEQ ID NO: 1121096 - DNA, 23 bp, Homo sapiens
tacattgtataggccatctgtaa

SEQ ID NO: 1121097 - DNA, 15 bp, Homo sapiens
tacattgtatatatg

SEQ ID NO: 1121098 - DNA, 14 bp, Homo sapiens
tacattgtcctgta

SEQ ID NO: 1121099 - DNA, 16 bp, Homo sapiens
tacattgtcctgtagc

SEQ ID NO: 1121100 - DNA, 13 bp, Homo sapiens
tacattgttgagc

SEQ ID NO: 1121101 - DNA, 14 bp, Homo sapiens
tacatttaaatttt

SEQ ID NO: 1121102 - DNA, 11 bp, Homo sapiens
tacatttaata

SEQ ID NO: 1121103 - DNA, 15 bp, Homo sapiens
tacatttacaaactg

SEQ ID NO: 1121104 - DNA, 18 bp, Homo sapiens
tacatttacaaactgaag

SEQ ID NO: 1121105 - DNA, 19 bp, Homo sapiens
tacatttataatgtttgct

SEQ ID NO: 1121106 - DNA, 16 bp, Homo sapiens
tacatttatttattac

SEQ ID NO: 1121107 - DNA, 19 bp, Homo sapiens
tacgagagcagaggtctcc

SEQ ID NO: 1121108 - DNA, 22 bp, Homo sapiens
tacgagcacctccagcctgaac

SEQ ID NO: 1121109 - DNA, 19 bp, Homo sapiens
tacgatcaagttgttgact

SEQ ID NO: 1121110 - DNA, 16 bp, Homo sapiens
tacgatctgtttccaa

SEQ ID NO: 1121111 - DNA, 13 bp, Homo sapiens
tacgatttcacta

SEQ ID NO: 1121112 - DNA, 19 bp, Homo sapiens
tacgcaaaaacttccttta

SEQ ID NO: 1121113 - DNA, 14 bp, Homo sapiens
tacgcaaggaagga

SEQ ID NO: 1121114 - DNA, 23 bp, Homo sapiens
tacgcactacatgtggtttatag

SEQ ID NO: 1121115 - DNA, 22 bp, Homo sapiens
tacgcagcgtgctttaaaaaat

SEQ ID NO: 1121116 - DNA, 16 bp, Homo sapiens
tacgcatgactaattt

SEQ ID NO: 1121117 - DNA, 21 bp, Homo sapiens
tacgccaaagtgcagcccttc

SEQ ID NO: 1121118 - DNA, 22 bp, Homo sapiens
tacgccaggggaaaatcagcct

SEQ ID NO: 1121119 - DNA, 13 bp, Homo sapiens
tacgcctcttctg

SEQ ID NO: 1121120 - DNA, 14 bp, Homo sapiens
tacgctcatcacct

SEQ ID NO: 1121121 - DNA, 12 bp, Homo sapiens
tacgcttttctt

SEQ ID NO: 1121122 - DNA, 13 bp, Homo sapiens
tacggaagagcag

SEQ ID NO: 1121123 - DNA, 14 bp, Homo sapiens
tacggacaccccct

SEQ ID NO: 1121124 - DNA, 22 bp, Homo sapiens
tacggcaaccacatgtcccaga

SEQ ID NO: 1121125 - DNA, 18 bp, Homo sapiens
tacgggagtgacccagct

SEQ ID NO: 1121126 - DNA, 15 bp, Homo sapiens
tacgggggcacttgg

SEQ ID NO: 1121127 - DNA, 21 bp, Homo sapiens
tacgggggcacttggaggacc

SEQ ID NO: 1121128 - DNA, 20 bp, Homo sapiens
tacggtcaggtttaacattt

SEQ ID NO: 1121129 - DNA, 20 bp, Homo sapiens
tacggtttgcccctttataa

SEQ ID NO: 1121130 - DNA, 21 bp, Homo sapiens
tacggttttataaaagccttg

SEQ ID NO: 1121131 - DNA, 22 bp, Homo sapiens
tacgtagaagctcttggacaac

SEQ ID NO: 1121132 - DNA, 17 bp, Homo sapiens
tacgtataaatatcagt

SEQ ID NO: 1121133 - DNA, 18 bp, Homo sapiens
tacgtataatgctttctg

SEQ ID NO: 1121134 - DNA, 18 bp, Homo sapiens
tacgtcatgtattttatg

SEQ ID NO: 1121135 - DNA, 12 bp, Homo sapiens
tacgtcccagcg

SEQ ID NO: 1121136 - DNA, 15 bp, Homo sapiens
tacgtcccgctgctg

SEQ ID NO: 1121137 - DNA, 19 bp, Homo sapiens
tacgtcccgctgctgtgct

SEQ ID NO: 1121138 - DNA, 14 bp, Homo sapiens
tacgtgagccaggt

SEQ ID NO: 1121139 - DNA, 19 bp, Homo sapiens
tacgtgcaaacaacctgaa

SEQ ID NO: 1121140 - DNA, 23 bp, Homo sapiens
tacgtgcaaacaacctgaatctt

SEQ ID NO: 1121141 - DNA, 20 bp, Homo sapiens
tacgtgccagatataactgt

SEQ ID NO: 1121142 - DNA, 21 bp, Homo sapiens
tacgtgccagatataactgtc

SEQ ID NO: 1121143 - DNA, 23 bp, Homo sapiens
tacgtgccagatataactgtctt

SEQ ID NO: 1121144 - DNA, 16 bp, Homo sapiens
tacgtgcctcccgaga

SEQ ID NO: 1121145 - DNA, 18 bp, Homo sapiens
tacgtgctctgtgggtct

SEQ ID NO: 1121146 - DNA, 17 bp, Homo sapiens
tacgtgtatgtttcttc

SEQ ID NO: 1121147 - DNA, 18 bp, Homo sapiens
tacgtgtatgtttcttct

SEQ ID NO: 1121148 - DNA, 19 bp, Homo sapiens
tacgtgtatgtttcttctt

SEQ ID NO: 1121149 - DNA, 17 bp, Homo sapiens
tacgtgtcaatgtgtgc

SEQ ID NO: 1121150 - DNA, 16 bp, Homo sapiens
tacgtgttcattttat

SEQ ID NO: 1121151 - DNA, 15 bp, Homo sapiens
tacgttaaaagcaaa

SEQ ID NO: 1121152 - DNA, 16 bp, Homo sapiens
tacgttattgttgact

SEQ ID NO: 1121153 - DNA, 12 bp, Homo sapiens
tacgttctcttt

SEQ ID NO: 1121154 - DNA, 19 bp, Homo sapiens
tacgttctctttaaaagct

SEQ ID NO: 1121155 - DNA, 13 bp, Homo sapiens
tacgtttgtatgt

SEQ ID NO: 1121156 - DNA, 12 bp, Homo sapiens
tacgttttattg

SEQ ID NO: 1121157 - DNA, 16 bp, Homo sapiens
tactaaaaagtataaa

SEQ ID NO: 1121158 - DNA, 16 bp, Homo sapiens
tactaaaaatgcaaaa

SEQ ID NO: 1121159 - DNA, 20 bp, Homo sapiens
tactaaaagttcttctccaa

SEQ ID NO: 1121160 - DNA, 19 bp, Homo sapiens
tactaaacccgcaccccag

SEQ ID NO: 1121161 - DNA, 15 bp, Homo sapiens
tactaaagaaagatt

SEQ ID NO: 1121162 - DNA, 16 bp, Homo sapiens
tactaaagaaagatta

SEQ ID NO: 1121163 - DNA, 16 bp, Homo sapiens
tactaaagcaaattgt

SEQ ID NO: 1121164 - DNA, 18 bp, Homo sapiens
tactaaagtagtttaagt

SEQ ID NO: 1121165 - DNA, 13 bp, Homo sapiens
tactaaatctggg

SEQ ID NO: 1121166 - DNA, 18 bp, Homo sapiens
tactaaccagcagaaatg

SEQ ID NO: 1121167 - DNA, 23 bp, Homo sapiens
tactaagaataacaagaagccca

SEQ ID NO: 1121168 - DNA, 16 bp, Homo sapiens
tactaagatgaaattg

SEQ ID NO: 1121169 - DNA, 18 bp, Homo sapiens
tactaagatgaaattgcc

SEQ ID NO: 1121170 - DNA, 20 bp, Homo sapiens
tactaagatgaaattgccaa

SEQ ID NO: 1121171 - DNA, 14 bp, Homo sapiens
tactaagccaggag

SEQ ID NO: 1121172 - DNA, 19 bp, Homo sapiens
tactaaggaagattactca

SEQ ID NO: 1121173 - DNA, 14 bp, Homo sapiens
tactaaggaatctt

SEQ ID NO: 1121174 - DNA, 14 bp, Homo sapiens
tactaataaattga

SEQ ID NO: 1121175 - DNA, 20 bp, Homo sapiens
tactaatagaataaaggcag

SEQ ID NO: 1121176 - DNA, 17 bp, Homo sapiens
tactaatagacaattta

SEQ ID NO: 1121177 - DNA, 14 bp, Homo sapiens
tactaatctgagat

SEQ ID NO: 1121178 - DNA, 14 bp, Homo sapiens
tactaatgatgttt

SEQ ID NO: 1121179 - DNA, 16 bp, Homo sapiens
tactaattccacacct

SEQ ID NO: 1121180 - DNA, 16 bp, Homo sapiens
tactaattctatttct

SEQ ID NO: 1121181 - DNA, 19 bp, Homo sapiens
tactaattctatttctcta

SEQ ID NO: 1121182 - DNA, 20 bp, Homo sapiens
tactaattctatttctctat

SEQ ID NO: 1121183 - DNA, 16 bp, Homo sapiens
tactaattttctagat

SEQ ID NO: 1121184 - DNA, 13 bp, Homo sapiens
tactacaaaattt

SEQ ID NO: 1121185 - DNA, 13 bp, Homo sapiens
tactacactgagg

SEQ ID NO: 1121186 - DNA, 23 bp, Homo sapiens
tactacactggtgtgtccctctg

SEQ ID NO: 1121187 - DNA, 14 bp, Homo sapiens
tactacagtttgtt

SEQ ID NO: 1121188 - DNA, 20 bp, Homo sapiens
tactacagtttgttagtatg

SEQ ID NO: 1121189 - DNA, 17 bp, Homo sapiens
tactaccacaaggaaaa

SEQ ID NO: 1121190 - DNA, 18 bp, Homo sapiens
tactaccagaagggcttc

SEQ ID NO: 1121191 - DNA, 18 bp, Homo sapiens
tactaccatagtgagcca

SEQ ID NO: 1121192 - DNA, 14 bp, Homo sapiens
tactaccttgaaaa

SEQ ID NO: 1121193 - DNA, 16 bp, Homo sapiens
tactacggagaaactc

SEQ ID NO: 1121194 - DNA, 17 bp, Homo sapiens
tactacggagaaactca

SEQ ID NO: 1121195 - DNA, 17 bp, Homo sapiens
tactactagatgtcttt

SEQ ID NO: 1121196 - DNA, 16 bp, Homo sapiens
tactactcctgtaatt

SEQ ID NO: 1121197 - DNA, 20 bp, Homo sapiens
tactactgaaacagatttca

SEQ ID NO: 1121198 - DNA, 13 bp, Homo sapiens
tactactgtggaa

SEQ ID NO: 1121199 - DNA, 19 bp, Homo sapiens
tactactttgttaggattt

SEQ ID NO: 1121200 - DNA, 22 bp, Homo sapiens
tactactttgttaggattttca

SEQ ID NO: 1121201 - DNA, 23 bp, Homo sapiens
tactagagatattttgtaaaatg

SEQ ID NO: 1121202 - DNA, 19 bp, Homo sapiens
tactagagtctgaacagct

SEQ ID NO: 1121203 - DNA, 17 bp, Homo sapiens
tactagcaaaataaaac

SEQ ID NO: 1121204 - DNA, 18 bp, Homo sapiens
tactagcaaaataaaaca

SEQ ID NO: 1121205 - DNA, 23 bp, Homo sapiens
tactaggcttaatacctgggtga

SEQ ID NO: 1121206 - DNA, 20 bp, Homo sapiens
tactagggagccatttgaga

SEQ ID NO: 1121207 - DNA, 18 bp, Homo sapiens
tactaggtgacatgtcta

SEQ ID NO: 1121208 - DNA, 20 bp, Homo sapiens
tactaggttggacagccccc

SEQ ID NO: 1121209 - DNA, 20 bp, Homo sapiens
tactagtcaccagagacttt

SEQ ID NO: 1121210 - DNA, 14 bp, Homo sapiens
tactagtgttctgt

SEQ ID NO: 1121211 - DNA, 19 bp, Homo sapiens
tactagttttagttttctc

SEQ ID NO: 1121212 - DNA, 13 bp, Homo sapiens
tactataaagaga

SEQ ID NO: 1121213 - DNA, 14 bp, Homo sapiens
tactataaagagaa

SEQ ID NO: 1121214 - DNA, 13 bp, Homo sapiens
tactataattgta

SEQ ID NO: 1121215 - DNA, 15 bp, Homo sapiens
tactataattgtaaa

SEQ ID NO: 1121216 - DNA, 15 bp, Homo sapiens
tactatacagccata

SEQ ID NO: 1121217 - DNA, 20 bp, Homo sapiens
tactatagtggtgagatgga

SEQ ID NO: 1121218 - DNA, 18 bp, Homo sapiens
tactatatacatatatat

SEQ ID NO: 1121219 - DNA, 14 bp, Homo sapiens
tactatatttatgg

SEQ ID NO: 1121220 - DNA, 16 bp, Homo sapiens
tactatccatgtaata

SEQ ID NO: 1121221 - DNA, 17 bp, Homo sapiens
tactatctgttgaaaag

SEQ ID NO: 1121222 - DNA, 17 bp, Homo sapiens
tactatgcagtatctct

SEQ ID NO: 1121223 - DNA, 13 bp, Homo sapiens
tactatgtatcaa

SEQ ID NO: 1121224 - DNA, 14 bp, Homo sapiens
tactatgtatgttt

SEQ ID NO: 1121225 - DNA, 15 bp, Homo sapiens
tactattaaaatatt

SEQ ID NO: 1121226 - DNA, 17 bp, Homo sapiens
tactattaagcagtaaa

SEQ ID NO: 1121227 - DNA, 15 bp, Homo sapiens
tactattgaactgta

SEQ ID NO: 1121228 - DNA, 11 bp, Homo sapiens
tactatttaaa

SEQ ID NO: 1121229 - DNA, 15 bp, Homo sapiens
tacttaagagtggca

SEQ ID NO: 1121230 - DNA, 14 bp, Homo sapiens
tacttaataaattc

SEQ ID NO: 1121231 - DNA, 19 bp, Homo sapiens
tacttaataaattcagata

SEQ ID NO: 1121232 - DNA, 18 bp, Homo sapiens
tacttaatctaagaaaca

SEQ ID NO: 1121233 - DNA, 18 bp, Homo sapiens
tacttaatgtaattcagg

SEQ ID NO: 1121234 - DNA, 18 bp, Homo sapiens
tacttaattcctttctca

SEQ ID NO: 1121235 - DNA, 16 bp, Homo sapiens
tacttacctaaacaga

SEQ ID NO: 1121236 - DNA, 18 bp, Homo sapiens
tacttacctagtgaaact

SEQ ID NO: 1121237 - DNA, 17 bp, Homo sapiens
tacttagaatgccataa

SEQ ID NO: 1121238 - DNA, 21 bp, Homo sapiens
tacttagaatgccataaaatt

SEQ ID NO: 1121239 - DNA, 16 bp, Homo sapiens
tacttagaggaaataa

SEQ ID NO: 1121240 - DNA, 16 bp, Homo sapiens
tacttagagtttctgt

SEQ ID NO: 1121241 - DNA, 17 bp, Homo sapiens
tacttagattgtgttcc

SEQ ID NO: 1121242 - DNA, 18 bp, Homo sapiens
tacttagcaaagttttac

SEQ ID NO: 1121243 - DNA, 14 bp, Homo sapiens
tacttagctgtact

SEQ ID NO: 1121244 - DNA, 16 bp, Homo sapiens
tacttagctgtactat

SEQ ID NO: 1121245 - DNA, 21 bp, Homo sapiens
tacttagggaagaaaaagcaa

SEQ ID NO: 1121246 - DNA, 19 bp, Homo sapiens
tacttaggttattttgctt

SEQ ID NO: 1121247 - DNA, 21 bp, Homo sapiens
tacttaggttattttgctttg

SEQ ID NO: 1121248 - DNA, 15 bp, Homo sapiens
tacttagtggtatgt

SEQ ID NO: 1121249 - DNA, 16 bp, Homo sapiens
tacttagtggtatgtc

SEQ ID NO: 1121250 - DNA, 18 bp, Homo sapiens
tacttatcatttttgtat

SEQ ID NO: 1121251 - DNA, 22 bp, Homo sapiens
tacttatcatttttgtataaaa

SEQ ID NO: 1121252 - DNA, 21 bp, Homo sapiens
tacttatgatttaaaaacaac

SEQ ID NO: 1121253 - DNA, 14 bp, Homo sapiens
tacttattactgct

SEQ ID NO: 1121254 - DNA, 18 bp, Homo sapiens
tacttattttaggaaatt

SEQ ID NO: 1121255 - DNA, 21 bp, Homo sapiens
tacttattttattttttacca

SEQ ID NO: 1121256 - DNA, 19 bp, Homo sapiens
tacttatttttgacagtgt

SEQ ID NO: 1121257 - DNA, 17 bp, Homo sapiens
tacttcaaaagtttgtt

SEQ ID NO: 1121258 - DNA, 23 bp, Homo sapiens
tacttcaagttaaagtgaataac

SEQ ID NO: 1121259 - DNA, 14 bp, Homo sapiens
tacttcactgtcag

SEQ ID NO: 1121260 - DNA, 19 bp, Homo sapiens
tacttcactgtcaggaaga

SEQ ID NO: 1121261 - DNA, 15 bp, Homo sapiens
tacttcagctttgga

SEQ ID NO: 1121262 - DNA, 23 bp, Homo sapiens
tacttcaggtgcttttgatgtga

SEQ ID NO: 1121263 - DNA, 19 bp, Homo sapiens
tacttcattttctcaaagg

SEQ ID NO: 1121264 - DNA, 14 bp, Homo sapiens
tacttccaaactaa

SEQ ID NO: 1121265 - DNA, 23 bp, Homo sapiens
tacttccataggacatactgcat

SEQ ID NO: 1121266 - DNA, 23 bp, Homo sapiens
tacttcccattttggaagttttc

SEQ ID NO: 1121267 - DNA, 19 bp, Homo sapiens
tacttcccgggccagggct

SEQ ID NO: 1121268 - DNA, 20 bp, Homo sapiens
tacttcccgggccagggctg

SEQ ID NO: 1121269 - DNA, 14 bp, Homo sapiens
tacttcctggcctc

SEQ ID NO: 1121270 - DNA, 15 bp, Homo sapiens
tacttcctggcctct

SEQ ID NO: 1121271 - DNA, 14 bp, Homo sapiens
tacttcctgggtca

SEQ ID NO: 1121272 - DNA, 22 bp, Homo sapiens
tacttcgtcttcgccctctgaa

SEQ ID NO: 1121273 - DNA, 22 bp, Homo sapiens
tacttctctataaaaaatatgt

SEQ ID NO: 1121274 - DNA, 16 bp, Homo sapiens
tacttctgactttact

SEQ ID NO: 1121275 - DNA, 13 bp, Homo sapiens
tacttctgaggta

SEQ ID NO: 1121276 - DNA, 13 bp, Homo sapiens
tacttctgtgttc

SEQ ID NO: 1121277 - DNA, 15 bp, Homo sapiens
tacttctgtgttcat

SEQ ID NO: 1121278 - DNA, 12 bp, Homo sapiens
tacttcttctgt

SEQ ID NO: 1121279 - DNA, 22 bp, Homo sapiens
tacttcttttttcaaaagaaag

SEQ ID NO: 1121280 - DNA, 20 bp, Homo sapiens
tacttgaaatctaggattat

SEQ ID NO: 1121281 - DNA, 22 bp, Homo sapiens
tacttgaagtctaaaagcagaa

SEQ ID NO: 1121282 - DNA, 14 bp, Homo sapiens
tacttgacctccta

SEQ ID NO: 1121283 - DNA, 19 bp, Homo sapiens
tacttgataatattagtga

SEQ ID NO: 1121284 - DNA, 20 bp, Homo sapiens
tacttgataatattagtgat

SEQ ID NO: 1121285 - DNA, 22 bp, Homo sapiens
tacttgatttgatgtgactttt

SEQ ID NO: 1121286 - DNA, 21 bp, Homo sapiens
tacttgcaactaaggacaaat

SEQ ID NO: 1121287 - DNA, 14 bp, Homo sapiens
tacttgcctcattt

SEQ ID NO: 1121288 - DNA, 17 bp, Homo sapiens
tacttgcttcagtggac

SEQ ID NO: 1121289 - DNA, 20 bp, Homo sapiens
tacttgctttcaattgacaa

SEQ ID NO: 1121290 - DNA, 18 bp, Homo sapiens
tacttgggaaatttttaa

SEQ ID NO: 1121291 - DNA, 23 bp, Homo sapiens
tacttgggagacctgtaatcata

SEQ ID NO: 1121292 - DNA, 20 bp, Homo sapiens
tacttgggagcctgaggcag

SEQ ID NO: 1121293 - DNA, 22 bp, Homo sapiens
tacttgggagcctgaggcagga

SEQ ID NO: 1121294 - DNA, 12 bp, Homo sapiens
tacttgggaggc

SEQ ID NO: 1121295 - DNA, 14 bp, Homo sapiens
tacttgtattccct

SEQ ID NO: 1121296 - DNA, 15 bp, Homo sapiens
tacttgtcaaagaag

SEQ ID NO: 1121297 - DNA, 18 bp, Homo sapiens
tacttgtcaaagaaggtt

SEQ ID NO: 1121298 - DNA, 13 bp, Homo sapiens
tacttgtcaatat

SEQ ID NO: 1121299 - DNA, 14 bp, Homo sapiens
tacttgtcctcagc

SEQ ID NO: 1121300 - DNA, 14 bp, Homo sapiens
tacttgtctgaggc

SEQ ID NO: 1121301 - DNA, 18 bp, Homo sapiens
tacttgtctgtcaaatgt

SEQ ID NO: 1121302 - DNA, 15 bp, Homo sapiens
tacttgtgacaagaa

SEQ ID NO: 1121303 - DNA, 14 bp, Homo sapiens
tacttgtggtgtga

SEQ ID NO: 1121304 - DNA, 21 bp, Homo sapiens
tacttgtggttctctttttgt

SEQ ID NO: 1121305 - DNA, 15 bp, Homo sapiens
tacttgtgtttgctt

SEQ ID NO: 1121306 - DNA, 16 bp, Homo sapiens
tacttgtttctctgtt

SEQ ID NO: 1121307 - DNA, 16 bp, Homo sapiens
tacttgtttgaatatt

SEQ ID NO: 1121308 - DNA, 13 bp, Homo sapiens
tactttaaaaagg

SEQ ID NO: 1121309 - DNA, 17 bp, Homo sapiens
tactttaaaaaggaaat

SEQ ID NO: 1121310 - DNA, 15 bp, Homo sapiens
tactttaaaggaaaa

SEQ ID NO: 1121311 - DNA, 21 bp, Homo sapiens
tactttaaaggaaaaaatgtt

SEQ ID NO: 1121312 - DNA, 19 bp, Homo sapiens
tactttaaagtagtgatga

SEQ ID NO: 1121313 - DNA, 17 bp, Homo sapiens
tactttacatatgcttt

SEQ ID NO: 1121314 - DNA, 19 bp, Homo sapiens
tactttacctctctgtcat

SEQ ID NO: 1121315 - DNA, 16 bp, Homo sapiens
tactttactcattttt

SEQ ID NO: 1121316 - DNA, 15 bp, Homo sapiens
tactttactgcctga

SEQ ID NO: 1121317 - DNA, 21 bp, Homo sapiens
tactttagaagcctgcataat

SEQ ID NO: 1121318 - DNA, 19 bp, Homo sapiens
tactttagccatcataact

SEQ ID NO: 1121319 - DNA, 21 bp, Homo sapiens
tactttagccatcataactca

SEQ ID NO: 1121320 - DNA, 19 bp, Homo sapiens
tactttataactaacatgt

SEQ ID NO: 1121321 - DNA, 13 bp, Homo sapiens
tactttatatctt

SEQ ID NO: 1121322 - DNA, 15 bp, Homo sapiens
tactttatatcttgt

SEQ ID NO: 1121323 - DNA, 22 bp, Homo sapiens
tactttatcatgaatgctttta

SEQ ID NO: 1121324 - DNA, 12 bp, Homo sapiens
tactttattctt

SEQ ID NO: 1121325 - DNA, 15 bp, Homo sapiens
tactttattcttgct

SEQ ID NO: 1121326 - DNA, 17 bp, Homo sapiens
tactttatttttctgat

SEQ ID NO: 1121327 - DNA, 23 bp, Homo sapiens
tactttcttcaccaagtgcaata

SEQ ID NO: 1121328 - DNA, 17 bp, Homo sapiens
tactttcttcaggtaaa

SEQ ID NO: 1121329 - DNA, 12 bp, Homo sapiens
tactttgaaaac

SEQ ID NO: 1121330 - DNA, 21 bp, Homo sapiens
tactttgaaaacaattcagtg

SEQ ID NO: 1121331 - DNA, 15 bp, Homo sapiens
tactttgacaaggaa

SEQ ID NO: 1121332 - DNA, 21 bp, Homo sapiens
tactttgattctgataatgct

SEQ ID NO: 1121333 - DNA, 18 bp, Homo sapiens
tactttgcataaattaat

SEQ ID NO: 1121334 - DNA, 16 bp, Homo sapiens
tactttgcattgtctg

SEQ ID NO: 1121335 - DNA, 14 bp, Homo sapiens
tactttgccatttt

SEQ ID NO: 1121336 - DNA, 20 bp, Homo sapiens
tactttggggctaatttaac

SEQ ID NO: 1121337 - DNA, 18 bp, Homo sapiens
tactttggtttctgagca

SEQ ID NO: 1121338 - DNA, 13 bp, Homo sapiens
tactttgtaaata

SEQ ID NO: 1121339 - DNA, 12 bp, Homo sapiens
tactttgtactt

SEQ ID NO: 1121340 - DNA, 13 bp, Homo sapiens
tactttgtagact

SEQ ID NO: 1121341 - DNA, 16 bp, Homo sapiens
tactttgtagactgtt

SEQ ID NO: 1121342 - DNA, 11 bp, Homo sapiens
tactttgtcag

SEQ ID NO: 1121343 - DNA, 20 bp, Homo sapiens
tactttgtcctttttgttat

SEQ ID NO: 1121344 - DNA, 14 bp, Homo sapiens
tactttgtctgaaa

SEQ ID NO: 1121345 - DNA, 21 bp, Homo sapiens
tacttttaaacagtgagcctg

SEQ ID NO: 1121346 - DNA, 15 bp, Homo sapiens
tacttttaaactgtg

SEQ ID NO: 1121347 - DNA, 20 bp, Homo sapiens
tacttttacaagtaacaaaa

SEQ ID NO: 1121348 - DNA, 22 bp, Homo sapiens
tacttttagttgactcacaggc

SEQ ID NO: 1121349 - DNA, 19 bp, Homo sapiens
tacttttatgatgtatatt

SEQ ID NO: 1121350 - DNA, 21 bp, Homo sapiens
tacttttcacactgtcttccc

SEQ ID NO: 1121351 - DNA, 21 bp, Homo sapiens
tagaccttttttttttttcca

SEQ ID NO: 1121352 - DNA, 22 bp, Homo sapiens
tagaccttttttttttttccaa

SEQ ID NO: 1121353 - DNA, 13 bp, Homo sapiens
tagacggtgctca

SEQ ID NO: 1121354 - DNA, 13 bp, Homo sapiens
tagactaaatgaa

SEQ ID NO: 1121355 - DNA, 14 bp, Homo sapiens
tagactaaatgaaa

SEQ ID NO: 1121356 - DNA, 17 bp, Homo sapiens
tagactcatcttactgt

SEQ ID NO: 1121357 - DNA, 18 bp, Homo sapiens
tagactcatcttactgta

SEQ ID NO: 1121358 - DNA, 22 bp, Homo sapiens
tagactctgaagttggttgtga

SEQ ID NO: 1121359 - DNA, 17 bp, Homo sapiens
tagactcttcccctccc

SEQ ID NO: 1121360 - DNA, 12 bp, Homo sapiens
tagactgaggga

SEQ ID NO: 1121361 - DNA, 21 bp, Homo sapiens
tagactgaggtataaagacaa

SEQ ID NO: 1121362 - DNA, 19 bp, Homo sapiens
tagactggaacttgaactg

SEQ ID NO: 1121363 - DNA, 17 bp, Homo sapiens
tagactggagtgaggct

SEQ ID NO: 1121364 - DNA, 21 bp, Homo sapiens
tagactgtttcacattgcact

SEQ ID NO: 1121365 - DNA, 15 bp, Homo sapiens
tagacttcccaacag

SEQ ID NO: 1121366 - DNA, 22 bp, Homo sapiens
tagacttcccactgttctgaaa

SEQ ID NO: 1121367 - DNA, 18 bp, Homo sapiens
tagacttcgactcaggat

SEQ ID NO: 1121368 - DNA, 22 bp, Homo sapiens
tagacttggacatctctctggc

SEQ ID NO: 1121369 - DNA, 16 bp, Homo sapiens
tagacttggattcttt

SEQ ID NO: 1121370 - DNA, 18 bp, Homo sapiens
tagacttgtgctgatcgt

SEQ ID NO: 1121371 - DNA, 17 bp, Homo sapiens
tagactttagaaataaa

SEQ ID NO: 1121372 - DNA, 18 bp, Homo sapiens
tagactttagaaataaat

SEQ ID NO: 1121373 - DNA, 15 bp, Homo sapiens
tagactttctcagtg

SEQ ID NO: 1121374 - DNA, 22 bp, Homo sapiens
tagagaaggacccggaggggcc

SEQ ID NO: 1121375 - DNA, 19 bp, Homo sapiens
tagagaagtatacataagt

SEQ ID NO: 1121376 - DNA, 15 bp, Homo sapiens
tagagaatgagaaat

SEQ ID NO: 1121377 - DNA, 11 bp, Homo sapiens
tagagaatgtg

SEQ ID NO: 1121378 - DNA, 16 bp, Homo sapiens
tagagaatgtgtttca

SEQ ID NO: 1121379 - DNA, 18 bp, Homo sapiens
tagagaatgtgtttcaaa

SEQ ID NO: 1121380 - DNA, 11 bp, Homo sapiens
tagagacacat

SEQ ID NO: 1121381 - DNA, 12 bp, Homo sapiens
tagagacacatt

SEQ ID NO: 1121382 - DNA, 15 bp, Homo sapiens
tagagacagaagcag

SEQ ID NO: 1121383 - DNA, 11 bp, Homo sapiens
tagagaccccg

SEQ ID NO: 1121384 - DNA, 16 bp, Homo sapiens
tagagacggagatcct

SEQ ID NO: 1121385 - DNA, 19 bp, Homo sapiens
tagagacggggtttcacca

SEQ ID NO: 1121386 - DNA, 13 bp, Homo sapiens
tagagagaaagag

SEQ ID NO: 1121387 - DNA, 13 bp, Homo sapiens
tagagagaacagg

SEQ ID NO: 1121388 - DNA, 10 bp, Homo sapiens
tagagagaga

SEQ ID NO: 1121389 - DNA, 17 bp, Homo sapiens
tagagagagctgtatta

SEQ ID NO: 1121390 - DNA, 18 bp, Homo sapiens
tagagagagggagaaaca

SEQ ID NO: 1121391 - DNA, 21 bp, Homo sapiens
tagagaggacaatactggggt

SEQ ID NO: 1121392 - DNA, 17 bp, Homo sapiens
tagagaggggactgggg

SEQ ID NO: 1121393 - DNA, 13 bp, Homo sapiens
tagagagggggct

SEQ ID NO: 1121394 - DNA, 17 bp, Homo sapiens
tagagaggtagcgagct

SEQ ID NO: 1121395 - DNA, 19 bp, Homo sapiens
tagagaggtttttcttggg

SEQ ID NO: 1121396 - DNA, 20 bp, Homo sapiens
tagagataaaacagaatctt

SEQ ID NO: 1121397 - DNA, 21 bp, Homo sapiens
tagagatattttgtaaaatgt

SEQ ID NO: 1121398 - DNA, 15 bp, Homo sapiens
tagagatctattttt

SEQ ID NO: 1121399 - DNA, 19 bp, Homo sapiens
tagagatggggtttcacca

SEQ ID NO: 1121400 - DNA, 12 bp, Homo sapiens
tagagatgtttt

SEQ ID NO: 1121401 - DNA, 21 bp, Homo sapiens
tagagattacctcctgagaaa

SEQ ID NO: 1121402 - DNA, 20 bp, Homo sapiens
tagagattgccccagagccc

SEQ ID NO: 1121403 - DNA, 15 bp, Homo sapiens
tagagattgtacatt

SEQ ID NO: 1121404 - DNA, 23 bp, Homo sapiens
tagagcaacctctgtattagttt

SEQ ID NO: 1121405 - DNA, 16 bp, Homo sapiens
tagagcacactgtagc

SEQ ID NO: 1121406 - DNA, 17 bp, Homo sapiens
tagagcacactgtagca

SEQ ID NO: 1121407 - DNA, 13 bp, Homo sapiens
tagagcacagctt

SEQ ID NO: 1121408 - DNA, 15 bp, Homo sapiens
tagagcacagcttct

SEQ ID NO: 1121409 - DNA, 13 bp, Homo sapiens
tagagcagacagg

SEQ ID NO: 1121410 - DNA, 18 bp, Homo sapiens
tagagcagcctcgtggag

SEQ ID NO: 1121411 - DNA, 16 bp, Homo sapiens
tagagccaagctgcac

SEQ ID NO: 1121412 - DNA, 11 bp, Homo sapiens
tagagccctca

SEQ ID NO: 1121413 - DNA, 13 bp, Homo sapiens
tagagccctcaga

SEQ ID NO: 1121414 - DNA, 20 bp, Homo sapiens
tagagcgtttggttaaagta

SEQ ID NO: 1121415 - DNA, 17 bp, Homo sapiens
tagagctagctgccact

SEQ ID NO: 1121416 - DNA, 19 bp, Homo sapiens
tagagctgatccagagcac

SEQ ID NO: 1121417 - DNA, 12 bp, Homo sapiens
tagagctgccac

SEQ ID NO: 1121418 - DNA, 18 bp, Homo sapiens
tagagctgggtggcctgt

SEQ ID NO: 1121419 - DNA, 20 bp, Homo sapiens
tagagctgtattaagccact

SEQ ID NO: 1121420 - DNA, 22 bp, Homo sapiens
tagagcttccaaatgtgtcaga

SEQ ID NO: 1121421 - DNA, 13 bp, Homo sapiens
tagaggaaaagaa

SEQ ID NO: 1121422 - DNA, 13 bp, Homo sapiens
tagaggaagaaat

SEQ ID NO: 1121423 - DNA, 19 bp, Homo sapiens
tagaggcagggaggggact

SEQ ID NO: 1121424 - DNA, 15 bp, Homo sapiens
tagaggcattgttag

SEQ ID NO: 1121425 - DNA, 21 bp, Homo sapiens
tagaggccaaggtattctatt

SEQ ID NO: 1121426 - DNA, 12 bp, Homo sapiens
tagaggcccagg

SEQ ID NO: 1121427 - DNA, 14 bp, Homo sapiens
tagaggcccaggca

SEQ ID NO: 1121428 - DNA, 18 bp, Homo sapiens
tagaggcccaggcaccac

SEQ ID NO: 1121429 - DNA, 21 bp, Homo sapiens
tagaggctcagtggtgggaga

SEQ ID NO: 1121430 - DNA, 14 bp, Homo sapiens
tagaggcttctccg

SEQ ID NO: 1121431 - DNA, 19 bp, Homo sapiens
tagaggcttctccgccagc

SEQ ID NO: 1121432 - DNA, 21 bp, Homo sapiens
tagaggcttctccgccagcct

SEQ ID NO: 1121433 - DNA, 20 bp, Homo sapiens
tagagggacctctcccaggg

SEQ ID NO: 1121434 - DNA, 13 bp, Homo sapiens
tagagggaggggc

SEQ ID NO: 1121435 - DNA, 20 bp, Homo sapiens
tagagggaggtgtttaaaga

SEQ ID NO: 1121436 - DNA, 12 bp, Homo sapiens
tagagggcccat

SEQ ID NO: 1121437 - DNA, 15 bp, Homo sapiens
tagagggcccatcag

SEQ ID NO: 1121438 - DNA, 13 bp, Homo sapiens
tagagggttcctg

SEQ ID NO: 1121439 - DNA, 16 bp, Homo sapiens
tagagggttgctgcct

SEQ ID NO: 1121440 - DNA, 15 bp, Homo sapiens
tagaggtaaaagtac

SEQ ID NO: 1121441 - DNA, 14 bp, Homo sapiens
tagaggtgagaaaa

SEQ ID NO: 1121442 - DNA, 16 bp, Homo sapiens
tagaggtgggcagctg

SEQ ID NO: 1121443 - DNA, 19 bp, Homo sapiens
tagaggtgggcagctgggc

SEQ ID NO: 1121444 - DNA, 20 bp, Homo sapiens
tagaggtgggcagctgggcc

SEQ ID NO: 1121445 - DNA, 23 bp, Homo sapiens
tagaggtgttacagaggaccctt

SEQ ID NO: 1121446 - DNA, 15 bp, Homo sapiens
tagaggttcaaagat

SEQ ID NO: 1121447 - DNA, 16 bp, Homo sapiens
tagaggttcaaagata

SEQ ID NO: 1121448 - DNA, 22 bp, Homo sapiens
tagaggttctgggttttctgaa

SEQ ID NO: 1121449 - DNA, 18 bp, Homo sapiens
tagagtaaatacaggtag

SEQ ID NO: 1121450 - DNA, 17 bp, Homo sapiens
tagagtaatgaaatgga

SEQ ID NO: 1121451 - DNA, 14 bp, Homo sapiens
tagagtaatgatgt

SEQ ID NO: 1121452 - DNA, 21 bp, Homo sapiens
tagagtagaagatttgatgct

SEQ ID NO: 1121453 - DNA, 14 bp, Homo sapiens
tagagtatatgcac

SEQ ID NO: 1121454 - DNA, 14 bp, Homo sapiens
tagagtatttccct

SEQ ID NO: 1121455 - DNA, 16 bp, Homo sapiens
tagagtatttcccttc

SEQ ID NO: 1121456 - DNA, 20 bp, Homo sapiens
tagagtatttcccttccaaa

SEQ ID NO: 1121457 - DNA, 16 bp, Homo sapiens
tagagtcaatttgctg

SEQ ID NO: 1121458 - DNA, 18 bp, Homo sapiens
tagagtcaatttgctgaa

SEQ ID NO: 1121459 - DNA, 19 bp, Homo sapiens
tagagtcaatttgctgaaa

SEQ ID NO: 1121460 - DNA, 23 bp, Homo sapiens
tagagtcatctccatcagctgta

SEQ ID NO: 1121461 - DNA, 20 bp, Homo sapiens
tagagtcctcactcccagtc

SEQ ID NO: 1121462 - DNA, 12 bp, Homo sapiens
tagagtgcccag

SEQ ID NO: 1121463 - DNA, 17 bp, Homo sapiens
tagagtgtagactgtgg

SEQ ID NO: 1121464 - DNA, 13 bp, Homo sapiens
tagagtgtagcct

SEQ ID NO: 1121465 - DNA, 23 bp, Homo sapiens
tagagtgtagcctaaagggcagg

SEQ ID NO: 1121466 - DNA, 14 bp, Homo sapiens
tagagtgtagctgt

SEQ ID NO: 1121467 - DNA, 18 bp, Homo sapiens
tagagtgtagctgtaagg

SEQ ID NO: 1121468 - DNA, 22 bp, Homo sapiens
tagagtgtagctgtaagggcag

SEQ ID NO: 1121469 - DNA, 18 bp, Homo sapiens
tagagtgtgatgtatgtg

SEQ ID NO: 1121470 - DNA, 12 bp, Homo sapiens
tagagttcggtc

SEQ ID NO: 1121471 - DNA, 14 bp, Homo sapiens
tagagttgctgaga

SEQ ID NO: 1121472 - DNA, 21 bp, Homo sapiens
tagagtttagccctgaacatt

SEQ ID NO: 1121473 - DNA, 23 bp, Homo sapiens
tagagtttctgtttgattctttt

SEQ ID NO: 1121474 - DNA, 24 bp, Homo sapiens
tagccccgccccagccctcagtca

SEQ ID NO: 1121475 - DNA, 14 bp, Homo sapiens
tagcccctctctca

SEQ ID NO: 1121476 - DNA, 15 bp, Homo sapiens
tagcccctctctcac

SEQ ID NO: 1121477 - DNA, 21 bp, Homo sapiens
tagcccctctggattcccttt

SEQ ID NO: 1121478 - DNA, 12 bp, Homo sapiens
tagccctcagtc

SEQ ID NO: 1121479 - DNA, 15 bp, Homo sapiens
tagccctccccccag

SEQ ID NO: 1121480 - DNA, 20 bp, Homo sapiens
tagccctccccccagctccc

SEQ ID NO: 1121481 - DNA, 23 bp, Homo sapiens
tagccctccccccagctccctgc

SEQ ID NO: 1121482 - DNA, 20 bp, Homo sapiens
tagccctcctttttccaaca

SEQ ID NO: 1121483 - DNA, 14 bp, Homo sapiens
tagccctgaacatt

SEQ ID NO: 1121484 - DNA, 12 bp, Homo sapiens
tagccctgagcc

SEQ ID NO: 1121485 - DNA, 13 bp, Homo sapiens
tagccctgagccc

SEQ ID NO: 1121486 - DNA, 15 bp, Homo sapiens
tagcccttccagcct

SEQ ID NO: 1121487 - DNA, 18 bp, Homo sapiens
tagcccttccagcctggg

SEQ ID NO: 1121488 - DNA, 15 bp, Homo sapiens
tagcccttccctgag

SEQ ID NO: 1121489 - DNA, 13 bp, Homo sapiens
tagccctttctgt

SEQ ID NO: 1121490 - DNA, 13 bp, Homo sapiens
tagccgacctcag

SEQ ID NO: 1121491 - DNA, 14 bp, Homo sapiens
tagccgagagcctg

SEQ ID NO: 1121492 - DNA, 18 bp, Homo sapiens
tagccgagagcctgctcc

SEQ ID NO: 1121493 - DNA, 15 bp, Homo sapiens
tagccgatggaaaat

SEQ ID NO: 1121494 - DNA, 16 bp, Homo sapiens
tagccgattctctgcc

SEQ ID NO: 1121495 - DNA, 13 bp, Homo sapiens
tagccgcaccctg

SEQ ID NO: 1121496 - DNA, 14 bp, Homo sapiens
tagccgcaccctgc

SEQ ID NO: 1121497 - DNA, 19 bp, Homo sapiens
tagccgggcatggtggcgc

SEQ ID NO: 1121498 - DNA, 21 bp, Homo sapiens
tagcctaaagggcagggccca

SEQ ID NO: 1121499 - DNA, 20 bp, Homo sapiens
tagcctaacacactccaaga

SEQ ID NO: 1121500 - DNA, 23 bp, Homo sapiens
tagcctcacggggttggctgttc

SEQ ID NO: 1121501 - DNA, 20 bp, Homo sapiens
tagcctcagatgatttcccc

SEQ ID NO: 1121502 - DNA, 12 bp, Homo sapiens
tagcctccagct

SEQ ID NO: 1121503 - DNA, 20 bp, Homo sapiens
tagcctccgtttatgggcct

SEQ ID NO: 1121504 - DNA, 15 bp, Homo sapiens
tagcctctcccaccc

SEQ ID NO: 1121505 - DNA, 23 bp, Homo sapiens
tagcctctgagatgctaatttat

SEQ ID NO: 1121506 - DNA, 24 bp, Homo sapiens
tagcctcttggaaatcaggtagac

SEQ ID NO: 1121507 - DNA, 13 bp, Homo sapiens
tagcctgatgaga

SEQ ID NO: 1121508 - DNA, 22 bp, Homo sapiens
tagcctgcaccgccgccaccct

SEQ ID NO: 1121509 - DNA, 16 bp, Homo sapiens
tagcctgcctcaccca

SEQ ID NO: 1121510 - DNA, 16 bp, Homo sapiens
tagcctgcctgatccc

SEQ ID NO: 1121511 - DNA, 22 bp, Homo sapiens
tagcctggatattattcttgta

SEQ ID NO: 1121512 - DNA, 19 bp, Homo sapiens
tagcctggatggcccctcc

SEQ ID NO: 1121513 - DNA, 17 bp, Homo sapiens
tagcctgggccacaggg

SEQ ID NO: 1121514 - DNA, 20 bp, Homo sapiens
tagcctgggctcactgtgct

SEQ ID NO: 1121515 - DNA, 15 bp, Homo sapiens
tagccttaaattttt

SEQ ID NO: 1121516 - DNA, 16 bp, Homo sapiens
tagccttaaatttttg

SEQ ID NO: 1121517 - DNA, 23 bp, Homo sapiens
tagccttcctccacatcctttct

SEQ ID NO: 1121518 - DNA, 16 bp, Homo sapiens
tagccttcctgacctc

SEQ ID NO: 1121519 - DNA, 16 bp, Homo sapiens
tagccttgatttgttc

SEQ ID NO: 1121520 - DNA, 12 bp, Homo sapiens
tagccttgcttg

SEQ ID NO: 1121521 - DNA, 13 bp, Homo sapiens
tagccttgcttgt

SEQ ID NO: 1121522 - DNA, 14 bp, Homo sapiens
tagccttgcttgtt

SEQ ID NO: 1121523 - DNA, 14 bp, Homo sapiens
tagccttgtgccct

SEQ ID NO: 1121524 - DNA, 18 bp, Homo sapiens
tagccttgtgccctgccc

SEQ ID NO: 1121525 - DNA, 22 bp, Homo sapiens
tagccttgtgccctgcccccat

SEQ ID NO: 1121526 - DNA, 15 bp, Homo sapiens
tagcctttttgtata

SEQ ID NO: 1121527 - DNA, 22 bp, Homo sapiens
tagcctttttgtataaaataga

SEQ ID NO: 1121528 - DNA, 20 bp, Homo sapiens
tagcgaaaggcgagtccagg

SEQ ID NO: 1121529 - DNA, 17 bp, Homo sapiens
tagcgaccccagactgt

SEQ ID NO: 1121530 - DNA, 17 bp, Homo sapiens
tagcgagctgctctgct

SEQ ID NO: 1121531 - DNA, 19 bp, Homo sapiens
tagcgatctctcctggcct

SEQ ID NO: 1121532 - DNA, 22 bp, Homo sapiens
tagcgattgattgatgtacaga

SEQ ID NO: 1121533 - DNA, 19 bp, Homo sapiens
tagcgccgtgctgtaaata

SEQ ID NO: 1121534 - DNA, 19 bp, Homo sapiens
tagcgctatagttactgtc

SEQ ID NO: 1121535 - DNA, 21 bp, Homo sapiens
tagcgctgccgcaccccagag

SEQ ID NO: 1121536 - DNA, 22 bp, Homo sapiens
tagcgctgccgcaccccagagt

SEQ ID NO: 1121537 - DNA, 20 bp, Homo sapiens
tagcggaaaagttgtcttaa

SEQ ID NO: 1121538 - DNA, 21 bp, Homo sapiens
tagcggcaaacctttccccct

SEQ ID NO: 1121539 - DNA, 14 bp, Homo sapiens
tagcgggactcagt

SEQ ID NO: 1121540 - DNA, 16 bp, Homo sapiens
tagcgtcaagacattt

SEQ ID NO: 1121541 - DNA, 21 bp, Homo sapiens
tagcgtcaagacatttgctga

SEQ ID NO: 1121542 - DNA, 17 bp, Homo sapiens
tagcgtcctgaggaata

SEQ ID NO: 1121543 - DNA, 15 bp, Homo sapiens
tagcgtcctgccctg

SEQ ID NO: 1121544 - DNA, 16 bp, Homo sapiens
tagcgtcctgccctgc

SEQ ID NO: 1121545 - DNA, 17 bp, Homo sapiens
tagcgtcctgccctgcc

SEQ ID NO: 1121546 - DNA, 18 bp, Homo sapiens
tagcgtcctgccctgccc

SEQ ID NO: 1121547 - DNA, 16 bp, Homo sapiens
tagcgtgctcactgac

SEQ ID NO: 1121548 - DNA, 13 bp, Homo sapiens
tagcgttctggac

SEQ ID NO: 1121549 - DNA, 16 bp, Homo sapiens
tagcgttttttaaatg

SEQ ID NO: 1121550 - DNA, 22 bp, Homo sapiens
tagcgttttttaaatgtatact

SEQ ID NO: 1121551 - DNA, 20 bp, Homo sapiens
tagctaaacggattccaaag

SEQ ID NO: 1121552 - DNA, 20 bp, Homo sapiens
tagctaacattttaaataaa

SEQ ID NO: 1121553 - DNA, 23 bp, Homo sapiens
tagctaacattttaaataaaaga

SEQ ID NO: 1121554 - DNA, 15 bp, Homo sapiens
tagctaactgtaaat

SEQ ID NO: 1121555 - DNA, 17 bp, Homo sapiens
tagctaactgtaaatca

SEQ ID NO: 1121556 - DNA, 14 bp, Homo sapiens
tagctaagtacaca

SEQ ID NO: 1121557 - DNA, 20 bp, Homo sapiens
tagctaagtatcaggggaaa

SEQ ID NO: 1121558 - DNA, 16 bp, Homo sapiens
tagctacaatttgttt

SEQ ID NO: 1121559 - DNA, 15 bp, Homo sapiens
tagctacagtgcata

SEQ ID NO: 1121560 - DNA, 23 bp, Homo sapiens
tagctacatagcagactttccca

SEQ ID NO: 1121561 - DNA, 22 bp, Homo sapiens
tagctactaaatatatattatg

SEQ ID NO: 1121562 - DNA, 20 bp, Homo sapiens
tagctagcgtgtgccaggca

SEQ ID NO: 1121563 - DNA, 17 bp, Homo sapiens
tagctaggtgacatata

SEQ ID NO: 1121564 - DNA, 23 bp, Homo sapiens
tagctataattgggtcatagaaa

SEQ ID NO: 1121565 - DNA, 16 bp, Homo sapiens
tagctatatccatgta

SEQ ID NO: 1121566 - DNA, 14 bp, Homo sapiens
tagctatcagaaga

SEQ ID NO: 1121567 - DNA, 16 bp, Homo sapiens
tagctatcagaagacc

SEQ ID NO: 1121568 - DNA, 21 bp, Homo sapiens
tagctatcagaagaccacaaa

SEQ ID NO: 1121569 - DNA, 16 bp, Homo sapiens
tagctatgctgtatct

SEQ ID NO: 1121570 - DNA, 16 bp, Homo sapiens
tagctattttccttgc

SEQ ID NO: 1121571 - DNA, 21 bp, Homo sapiens
tagctattttccttgcttttc

SEQ ID NO: 1121572 - DNA, 15 bp, Homo sapiens
tagctcaagtttaaa

SEQ ID NO: 1121573 - DNA, 15 bp, Homo sapiens
tagctcaattagtgt

SEQ ID NO: 1121574 - DNA, 17 bp, Homo sapiens
tagctcactgaatcttc

SEQ ID NO: 1121575 - DNA, 19 bp, Homo sapiens
tagctcagtcatcaaagca

SEQ ID NO: 1121576 - DNA, 14 bp, Homo sapiens
tagctcctgtggcc

SEQ ID NO: 1121577 - DNA, 20 bp, Homo sapiens
tagctcctgtggccccaccc

SEQ ID NO: 1121578 - DNA, 17 bp, Homo sapiens
tagctctaataagtttg

SEQ ID NO: 1121579 - DNA, 21 bp, Homo sapiens
tagctctaggagggctggcaa

SEQ ID NO: 1121580 - DNA, 16 bp, Homo sapiens
tagctctgaagcaaga

SEQ ID NO: 1121581 - DNA, 17 bp, Homo sapiens
tagctctgcctccctct

SEQ ID NO: 1121582 - DNA, 22 bp, Homo sapiens
tagctctggaggtgctgctcta

SEQ ID NO: 1121583 - DNA, 20 bp, Homo sapiens
tagctcttaattgttcattt

SEQ ID NO: 1121584 - DNA, 17 bp, Homo sapiens
tagctcttagtctcttt

SEQ ID NO: 1121585 - DNA, 21 bp, Homo sapiens
tagctctttgggcctctcctg

SEQ ID NO: 1121586 - DNA, 22 bp, Homo sapiens
tagctcttttttgtttgtttct

SEQ ID NO: 1121587 - DNA, 15 bp, Homo sapiens
tagctgaaaactaat

SEQ ID NO: 1121588 - DNA, 22 bp, Homo sapiens
tagctgaccccgagaagtgctc

SEQ ID NO: 1121589 - DNA, 20 bp, Homo sapiens
tagctgacgccaataataaa

SEQ ID NO: 1121590 - DNA, 21 bp, Homo sapiens
tagctgacgccaataataaaa

SEQ ID NO: 1121591 - DNA, 17 bp, Homo sapiens
tagctgagcgtggtggc

SEQ ID NO: 1121592 - DNA, 16 bp, Homo sapiens
tagctgagctgtgaca

SEQ ID NO: 1121593 - DNA, 20 bp, Homo sapiens
tagctgagctttaaatcatt

SEQ ID NO: 1121594 - DNA, 14 bp, Homo sapiens
tagctgatcagttt

SEQ ID NO: 1121595 - DNA, 23 bp, Homo sapiens
tagggtaagaagattcaagagga

SEQ ID NO: 1121596 - DNA, 18 bp, Homo sapiens
tagggtataatgtgtctg

SEQ ID NO: 1121597 - DNA, 20 bp, Homo sapiens
tagggtctgcagcctgctgg

SEQ ID NO: 1121598 - DNA, 17 bp, Homo sapiens
tagggtctttcttggga

SEQ ID NO: 1121599 - DNA, 15 bp, Homo sapiens
tagggtggcagaagt

SEQ ID NO: 1121600 - DNA, 19 bp, Homo sapiens
tagggtggctttaattgta

SEQ ID NO: 1121601 - DNA, 15 bp, Homo sapiens
tagggttaaatggta

SEQ ID NO: 1121602 - DNA, 14 bp, Homo sapiens
tagggttctgcctc

SEQ ID NO: 1121603 - DNA, 17 bp, Homo sapiens
tagggttttttttaatg

SEQ ID NO: 1121604 - DNA, 14 bp, Homo sapiens
taggtacacagctc

SEQ ID NO: 1121605 - DNA, 18 bp, Homo sapiens
taggtagagtcattcata

SEQ ID NO: 1121606 - DNA, 22 bp, Homo sapiens
taggtagagtcattcatatttg

SEQ ID NO: 1121607 - DNA, 13 bp, Homo sapiens
taggtagatccag

SEQ ID NO: 1121608 - DNA, 21 bp, Homo sapiens
taggtaggcaccacagagaag

SEQ ID NO: 1121609 - DNA, 16 bp, Homo sapiens
taggtattgtctactc

SEQ ID NO: 1121610 - DNA, 18 bp, Homo sapiens
taggtatttaagactgat

SEQ ID NO: 1121611 - DNA, 22 bp, Homo sapiens
taggtatttaagactgataatt

SEQ ID NO: 1121612 - DNA, 17 bp, Homo sapiens
taggtcacgttggccct

SEQ ID NO: 1121613 - DNA, 15 bp, Homo sapiens
taggtcagtctaaca

SEQ ID NO: 1121614 - DNA, 16 bp, Homo sapiens
taggtcatcatgaaag

SEQ ID NO: 1121615 - DNA, 22 bp, Homo sapiens
taggtccaagccccccacacct

SEQ ID NO: 1121616 - DNA, 14 bp, Homo sapiens
taggtccctgacat

SEQ ID NO: 1121617 - DNA, 19 bp, Homo sapiens
taggtcctcacttggggga

SEQ ID NO: 1121618 - DNA, 17 bp, Homo sapiens
taggtcgcgctcttgca

SEQ ID NO: 1121619 - DNA, 17 bp, Homo sapiens
taggtcgttttccaaag

SEQ ID NO: 1121620 - DNA, 17 bp, Homo sapiens
taggtctcttctcccag

SEQ ID NO: 1121621 - DNA, 20 bp, Homo sapiens
taggtctcttctcccagaat

SEQ ID NO: 1121622 - DNA, 19 bp, Homo sapiens
taggtctgaaatttttctt

SEQ ID NO: 1121623 - DNA, 14 bp, Homo sapiens
taggtctttctctc

SEQ ID NO: 1121624 - DNA, 18 bp, Homo sapiens
taggtgaagggatggggg

SEQ ID NO: 1121625 - DNA, 19 bp, Homo sapiens
taggtgaagggatggggga

SEQ ID NO: 1121626 - DNA, 16 bp, Homo sapiens
taggtgagcctgggca

SEQ ID NO: 1121627 - DNA, 16 bp, Homo sapiens
taggtgataaaatttt

SEQ ID NO: 1121628 - DNA, 17 bp, Homo sapiens
taggtgcagctcctcag

SEQ ID NO: 1121629 - DNA, 19 bp, Homo sapiens
taggtggaggttgtgcatg

SEQ ID NO: 1121630 - DNA, 16 bp, Homo sapiens
taggtggatcacctga

SEQ ID NO: 1121631 - DNA, 20 bp, Homo sapiens
taggtggccgctcctccctg

SEQ ID NO: 1121632 - DNA, 20 bp, Homo sapiens
taggtggctctgggaatggg

SEQ ID NO: 1121633 - DNA, 16 bp, Homo sapiens
taggtgggccagcccc

SEQ ID NO: 1121634 - DNA, 13 bp, Homo sapiens
taggtgtccccaa

SEQ ID NO: 1121635 - DNA, 19 bp, Homo sapiens
taggtgtgactgaatttct

SEQ ID NO: 1121636 - DNA, 20 bp, Homo sapiens
taggttaaaaaaaaaagtca

SEQ ID NO: 1121637 - DNA, 19 bp, Homo sapiens
taggttaaagctaaactga

SEQ ID NO: 1121638 - DNA, 13 bp, Homo sapiens
taggttatacaat

SEQ ID NO: 1121639 - DNA, 14 bp, Homo sapiens
taggttatacaata

SEQ ID NO: 1121640 - DNA, 18 bp, Homo sapiens
taggttatacaataaccc

SEQ ID NO: 1121641 - DNA, 19 bp, Homo sapiens
taggttatctttttaaaaa

SEQ ID NO: 1121642 - DNA, 22 bp, Homo sapiens
taggttattttgatgtaaagat

SEQ ID NO: 1121643 - DNA, 17 bp, Homo sapiens
taggttattttgctttg

SEQ ID NO: 1121644 - DNA, 16 bp, Homo sapiens
taggttggacagcccc

SEQ ID NO: 1121645 - DNA, 12 bp, Homo sapiens
taggttgttacc

SEQ ID NO: 1121646 - DNA, 18 bp, Homo sapiens
taggtttctaaaaagtca

SEQ ID NO: 1121647 - DNA, 19 bp, Homo sapiens
taggtttgttttttcatgc

SEQ ID NO: 1121648 - DNA, 21 bp, Homo sapiens
tagtaaaaaatcaattaacca

SEQ ID NO: 1121649 - DNA, 23 bp, Homo sapiens
tagtaaaaccttgttctattttt

SEQ ID NO: 1121650 - DNA, 19 bp, Homo sapiens
tagtaaaagtggtctctgc

SEQ ID NO: 1121651 - DNA, 21 bp, Homo sapiens
tagtaaaagtggtctctgctg

SEQ ID NO: 1121652 - DNA, 22 bp, Homo sapiens
tagtaaaagtggtctctgctgg

SEQ ID NO: 1121653 - DNA, 16 bp, Homo sapiens
tagtaaaatgcttaca

SEQ ID NO: 1121654 - DNA, 23 bp, Homo sapiens
tagtaaacattaagtaaatgctg

SEQ ID NO: 1121655 - DNA, 16 bp, Homo sapiens
tagtaaatatgtgaag

SEQ ID NO: 1121656 - DNA, 19 bp, Homo sapiens
tagtaaatatgtgaagaaa

SEQ ID NO: 1121657 - DNA, 18 bp, Homo sapiens
tagtaaatcacgcttttt

SEQ ID NO: 1121658 - DNA, 11 bp, Homo sapiens
tagtaaatgtt

SEQ ID NO: 1121659 - DNA, 15 bp, Homo sapiens
tagtaaccattttcc

SEQ ID NO: 1121660 - DNA, 21 bp, Homo sapiens
tagtaactactttttatactc

SEQ ID NO: 1121661 - DNA, 19 bp, Homo sapiens
tagtaacttcttatggaat

SEQ ID NO: 1121662 - DNA, 13 bp, Homo sapiens
tagtaagagcttt

SEQ ID NO: 1121663 - DNA, 14 bp, Homo sapiens
tagtaagatctctt

SEQ ID NO: 1121664 - DNA, 22 bp, Homo sapiens
tagtaagcccctgtgaccctct

SEQ ID NO: 1121665 - DNA, 18 bp, Homo sapiens
tagtaatagtccaatatt

SEQ ID NO: 1121666 - DNA, 15 bp, Homo sapiens
tagtaatcacagttg

SEQ ID NO: 1121667 - DNA, 22 bp, Homo sapiens
tagtaattgcctagaaatatct

SEQ ID NO: 1121668 - DNA, 15 bp, Homo sapiens
tagtaatttcctaga

SEQ ID NO: 1121669 - DNA, 12 bp, Homo sapiens
tagtacataatt

SEQ ID NO: 1121670 - DNA, 23 bp, Homo sapiens
tagtaccaatcattttaattatt

SEQ ID NO: 1121671 - DNA, 19 bp, Homo sapiens
tagtaccctatagagaggg

SEQ ID NO: 1121672 - DNA, 22 bp, Homo sapiens
tagtaccctatagagagggggc

SEQ ID NO: 1121673 - DNA, 15 bp, Homo sapiens
tagtactagaaactg

SEQ ID NO: 1121674 - DNA, 19 bp, Homo sapiens
tagtactcctgcaaaattt

SEQ ID NO: 1121675 - DNA, 13 bp, Homo sapiens
tagtactgctctt

SEQ ID NO: 1121676 - DNA, 14 bp, Homo sapiens
tagtactggcacaa

SEQ ID NO: 1121677 - DNA, 17 bp, Homo sapiens
tagtacttcttctgtaa

SEQ ID NO: 1121678 - DNA, 19 bp, Homo sapiens
tagtacttcttctgtaata

SEQ ID NO: 1121679 - DNA, 21 bp, Homo sapiens
tagtacttttataatgaaaag

SEQ ID NO: 1121680 - DNA, 15 bp, Homo sapiens
tagtagaaattttac

SEQ ID NO: 1121681 - DNA, 20 bp, Homo sapiens
tagtagatttttaacaaaaa

SEQ ID NO: 1121682 - DNA, 17 bp, Homo sapiens
tagtagccctttctgtg

SEQ ID NO: 1121683 - DNA, 21 bp, Homo sapiens
tagtagcgttttttaaatgta

SEQ ID NO: 1121684 - DNA, 23 bp, Homo sapiens
tagtagcgttttttaaatgtata

SEQ ID NO: 1121685 - DNA, 18 bp, Homo sapiens
tagtagtatgatgataca

SEQ ID NO: 1121686 - DNA, 15 bp, Homo sapiens
tagtagtgtggcctg

SEQ ID NO: 1121687 - DNA, 16 bp, Homo sapiens
tagtagttaaataact

SEQ ID NO: 1121688 - DNA, 16 bp, Homo sapiens
tagtatagtagaaaga

SEQ ID NO: 1121689 - DNA, 13 bp, Homo sapiens
tagtatatttata

SEQ ID NO: 1121690 - DNA, 17 bp, Homo sapiens
tagtatatttatactct

SEQ ID NO: 1121691 - DNA, 18 bp, Homo sapiens
tagtatcatcagatagca

SEQ ID NO: 1121692 - DNA, 13 bp, Homo sapiens
tagtatcatttta

SEQ ID NO: 1121693 - DNA, 22 bp, Homo sapiens
tagtatccacaggatattaaac

SEQ ID NO: 1121694 - DNA, 16 bp, Homo sapiens
tagtatctagcaatca

SEQ ID NO: 1121695 - DNA, 13 bp, Homo sapiens
tagtatcttcaaa

SEQ ID NO: 1121696 - DNA, 20 bp, Homo sapiens
tagtatcttcaaactttcac

SEQ ID NO: 1121697 - DNA, 15 bp, Homo sapiens
tagtatgaggcattt

SEQ ID NO: 1121698 - DNA, 24 bp, Homo sapiens
tagtatgctggcttgtacatagta

SEQ ID NO: 1121699 - DNA, 19 bp, Homo sapiens
tagtatggttcaagattgt

SEQ ID NO: 1121700 - DNA, 11 bp, Homo sapiens
tagtatgtctg

SEQ ID NO: 1121701 - DNA, 23 bp, Homo sapiens
tagtatgtctgtttttgtatctt

SEQ ID NO: 1121702 - DNA, 13 bp, Homo sapiens
tagtatgtgactt

SEQ ID NO: 1121703 - DNA, 15 bp, Homo sapiens
tagtatgtgactttt

SEQ ID NO: 1121704 - DNA, 23 bp, Homo sapiens
tagtatgtgacttttctgattaa

SEQ ID NO: 1121705 - DNA, 21 bp, Homo sapiens
tagtattaccaccctttcaca

SEQ ID NO: 1121706 - DNA, 22 bp, Homo sapiens
tagtattaccaccctttcacaa

SEQ ID NO: 1121707 - DNA, 17 bp, Homo sapiens
tagtattcattctgcat

SEQ ID NO: 1121708 - DNA, 19 bp, Homo sapiens
tagtattctcttgtgcatt

SEQ ID NO: 1121709 - DNA, 22 bp, Homo sapiens
tagtattggagcacatgttact

SEQ ID NO: 1121710 - DNA, 16 bp, Homo sapiens
tagtatttatttaatg

SEQ ID NO: 1121711 - DNA, 17 bp, Homo sapiens
tagtatttctcaggaag

SEQ ID NO: 1121712 - DNA, 17 bp, Homo sapiens
tagtattttaaaaaata

SEQ ID NO: 1121713 - DNA, 22 bp, Homo sapiens
tagtatttttttcttaccaaaa

SEQ ID NO: 1121714 - DNA, 16 bp, Homo sapiens
tagtcaaattatgtat

SEQ ID NO: 1121715 - DNA, 23 bp, Homo sapiens
tagtcaagttggacttgttttaa

SEQ ID NO: 1121716 - DNA, 15 bp, Homo sapiens
tataaagattgtact

SEQ ID NO: 1121717 - DNA, 12 bp, Homo sapiens
tataaagcagta

SEQ ID NO: 1121718 - DNA, 18 bp, Homo sapiens
tataaaggaccctgtttc

SEQ ID NO: 1121719 - DNA, 16 bp, Homo sapiens
tataaaggttatgaaa

SEQ ID NO: 1121720 - DNA, 20 bp, Homo sapiens
tataaaggttatgaaacata

SEQ ID NO: 1121721 - DNA, 24 bp, Homo sapiens
tataaaggttatgaaacatatcat

SEQ ID NO: 1121722 - DNA, 15 bp, Homo sapiens
tataaagtaaagcta

SEQ ID NO: 1121723 - DNA, 16 bp, Homo sapiens
tataaagtaaagctaa

SEQ ID NO: 1121724 - DNA, 16 bp, Homo sapiens
tataaagtagtcctgt

SEQ ID NO: 1121725 - DNA, 18 bp, Homo sapiens
tataaagtattctttttc

SEQ ID NO: 1121726 - DNA, 20 bp, Homo sapiens
tataaataaaaacttatttt

SEQ ID NO: 1121727 - DNA, 14 bp, Homo sapiens
tataaataaatatt

SEQ ID NO: 1121728 - DNA, 22 bp, Homo sapiens
tataaataaccctgggctgtcc

SEQ ID NO: 1121729 - DNA, 13 bp, Homo sapiens
tataaataagagc

SEQ ID NO: 1121730 - DNA, 22 bp, Homo sapiens
tataaatacacttcctgcttaa

SEQ ID NO: 1121731 - DNA, 19 bp, Homo sapiens
tataaatatatatttttca

SEQ ID NO: 1121732 - DNA, 21 bp, Homo sapiens
tataaatatatatttttcaaa

SEQ ID NO: 1121733 - DNA, 15 bp, Homo sapiens
tataaatatcagtat

SEQ ID NO: 1121734 - DNA, 16 bp, Homo sapiens
tataaatatcagtatt

SEQ ID NO: 1121735 - DNA, 18 bp, Homo sapiens
tataaatatcagtattct

SEQ ID NO: 1121736 - DNA, 20 bp, Homo sapiens
tataaatccaatatcatgtc

SEQ ID NO: 1121737 - DNA, 18 bp, Homo sapiens
tataaatgacaaagtgtt

SEQ ID NO: 1121738 - DNA, 16 bp, Homo sapiens
tataaatggacctttt

SEQ ID NO: 1121739 - DNA, 19 bp, Homo sapiens
tataaatggaccttttata

SEQ ID NO: 1121740 - DNA, 16 bp, Homo sapiens
tataaatgtaaaaatg

SEQ ID NO: 1121741 - DNA, 19 bp, Homo sapiens
tataaatgtaaaaatgaag

SEQ ID NO: 1121742 - DNA, 13 bp, Homo sapiens
tataaatgtacat

SEQ ID NO: 1121743 - DNA, 12 bp, Homo sapiens
tataaatgtgtg

SEQ ID NO: 1121744 - DNA, 17 bp, Homo sapiens
tataaatgtttggaaag

SEQ ID NO: 1121745 - DNA, 12 bp, Homo sapiens
tataaattaaat

SEQ ID NO: 1121746 - DNA, 17 bp, Homo sapiens
tataaattaaataaact

SEQ ID NO: 1121747 - DNA, 22 bp, Homo sapiens
tataaattaaataaactgtttt

SEQ ID NO: 1121748 - DNA, 14 bp, Homo sapiens
tataaattaaatat

SEQ ID NO: 1121749 - DNA, 16 bp, Homo sapiens
tataaattaagaagag

SEQ ID NO: 1121750 - DNA, 15 bp, Homo sapiens
tataaattactatct

SEQ ID NO: 1121751 - DNA, 18 bp, Homo sapiens
tataaattactatctgtt

SEQ ID NO: 1121752 - DNA, 15 bp, Homo sapiens
tataaattattcaga

SEQ ID NO: 1121753 - DNA, 14 bp, Homo sapiens
tataaattcagaac

SEQ ID NO: 1121754 - DNA, 14 bp, Homo sapiens
tataaattcctctt

SEQ ID NO: 1121755 - DNA, 14 bp, Homo sapiens
tataaattgtacat

SEQ ID NO: 1121756 - DNA, 17 bp, Homo sapiens
tataaattgtacatttt

SEQ ID NO: 1121757 - DNA, 21 bp, Homo sapiens
tataaattgtacattttgtaa

SEQ ID NO: 1121758 - DNA, 14 bp, Homo sapiens
tataaattgtcttt

SEQ ID NO: 1121759 - DNA, 18 bp, Homo sapiens
tataaatttaagaaaaca

SEQ ID NO: 1121760 - DNA, 17 bp, Homo sapiens
tataaatttaagcaaac

SEQ ID NO: 1121761 - DNA, 14 bp, Homo sapiens
tataaatttattta

SEQ ID NO: 1121762 - DNA, 20 bp, Homo sapiens
tataaatttcgcttcttaga

SEQ ID NO: 1121763 - DNA, 13 bp, Homo sapiens
tataaattttatt

SEQ ID NO: 1121764 - DNA, 16 bp, Homo sapiens
tataacagatacattt

SEQ ID NO: 1121765 - DNA, 23 bp, Homo sapiens
tataacagcaaatgaaagactct

SEQ ID NO: 1121766 - DNA, 16 bp, Homo sapiens
tataacagttatattt

SEQ ID NO: 1121767 - DNA, 23 bp, Homo sapiens
tataacagttttgagtaattcaa

SEQ ID NO: 1121768 - DNA, 20 bp, Homo sapiens
tataaccacaaagcacagtt

SEQ ID NO: 1121769 - DNA, 22 bp, Homo sapiens
tataaccagtgttgtggattta

SEQ ID NO: 1121770 - DNA, 20 bp, Homo sapiens
tataaccctaggaatttaga

SEQ ID NO: 1121771 - DNA, 22 bp, Homo sapiens
tataacctagttaaagaaagga

SEQ ID NO: 1121772 - DNA, 15 bp, Homo sapiens
tataacctggcaaaa

SEQ ID NO: 1121773 - DNA, 16 bp, Homo sapiens
tataacctggcaaaat

SEQ ID NO: 1121774 - DNA, 15 bp, Homo sapiens
tataaccttaattta

SEQ ID NO: 1121775 - DNA, 22 bp, Homo sapiens
tataactcaaggataccttctt

SEQ ID NO: 1121776 - DNA, 16 bp, Homo sapiens
tataactcatcataaa

SEQ ID NO: 1121777 - DNA, 19 bp, Homo sapiens
tataactcatcataaaata

SEQ ID NO: 1121778 - DNA, 20 bp, Homo sapiens
tataactcatcataaaataa

SEQ ID NO: 1121779 - DNA, 13 bp, Homo sapiens
tataactctttga

SEQ ID NO: 1121780 - DNA, 16 bp, Homo sapiens
tataactgaaggagaa

SEQ ID NO: 1121781 - DNA, 13 bp, Homo sapiens
tataactgtattt

SEQ ID NO: 1121782 - DNA, 19 bp, Homo sapiens
tataactgtcttgtttcag

SEQ ID NO: 1121783 - DNA, 20 bp, Homo sapiens
tataactgtcttgtttcagt

SEQ ID NO: 1121784 - DNA, 20 bp, Homo sapiens
tataacttaaaaatgtaaat

SEQ ID NO: 1121785 - DNA, 22 bp, Homo sapiens
tataacttatattgtaagaaat

SEQ ID NO: 1121786 - DNA, 11 bp, Homo sapiens
tataagaaaaa

SEQ ID NO: 1121787 - DNA, 22 bp, Homo sapiens
tataagaaaaaattctttcact

SEQ ID NO: 1121788 - DNA, 13 bp, Homo sapiens
tataagaagcctt

SEQ ID NO: 1121789 - DNA, 19 bp, Homo sapiens
tataagaagtcctatctca

SEQ ID NO: 1121790 - DNA, 15 bp, Homo sapiens
tataagacatttgtt

SEQ ID NO: 1121791 - DNA, 16 bp, Homo sapiens
tataagagaagtctca

SEQ ID NO: 1121792 - DNA, 20 bp, Homo sapiens
tataagagggctttttaaat

SEQ ID NO: 1121793 - DNA, 22 bp, Homo sapiens
tataagattccaaaaagcacat

SEQ ID NO: 1121794 - DNA, 19 bp, Homo sapiens
tataagcaaattgcttttt

SEQ ID NO: 1121795 - DNA, 19 bp, Homo sapiens
tataagcagattgctttaa

SEQ ID NO: 1121796 - DNA, 20 bp, Homo sapiens
tataagccctgcataatgtt

SEQ ID NO: 1121797 - DNA, 14 bp, Homo sapiens
tataagcgtattta

SEQ ID NO: 1121798 - DNA, 17 bp, Homo sapiens
tataagcgtatttagac

SEQ ID NO: 1121799 - DNA, 14 bp, Homo sapiens
tataagctgaataa

SEQ ID NO: 1121800 - DNA, 15 bp, Homo sapiens
tataagcttaaatag

SEQ ID NO: 1121801 - DNA, 23 bp, Homo sapiens
tataaggactttttgatggaatt

SEQ ID NO: 1121802 - DNA, 17 bp, Homo sapiens
tataagggagagctgag

SEQ ID NO: 1121803 - DNA, 22 bp, Homo sapiens
tataaggtgctctctttctgtc

SEQ ID NO: 1121804 - DNA, 15 bp, Homo sapiens
tataagtaagaaaat

SEQ ID NO: 1121805 - DNA, 20 bp, Homo sapiens
tataagtagtaaatcagaaa

SEQ ID NO: 1121806 - DNA, 18 bp, Homo sapiens
tataagtgaagtgatact

SEQ ID NO: 1121807 - DNA, 22 bp, Homo sapiens
tataagtgagatggtatgaaat

SEQ ID NO: 1121808 - DNA, 18 bp, Homo sapiens
tataagtggaggcacttt

SEQ ID NO: 1121809 - DNA, 19 bp, Homo sapiens
tataagtggaggcacttta

SEQ ID NO: 1121810 - DNA, 14 bp, Homo sapiens
tataagttgctgta

SEQ ID NO: 1121811 - DNA, 13 bp, Homo sapiens
tataagtttgaag

SEQ ID NO: 1121812 - DNA, 13 bp, Homo sapiens
tataagttttaga

SEQ ID NO: 1121813 - DNA, 12 bp, Homo sapiens
tataataaaaat

SEQ ID NO: 1121814 - DNA, 13 bp, Homo sapiens
tataataaaagga

SEQ ID NO: 1121815 - DNA, 21 bp, Homo sapiens
tataataaaaggaaaagcaaa

SEQ ID NO: 1121816 - DNA, 14 bp, Homo sapiens
tataataaaggact

SEQ ID NO: 1121817 - DNA, 13 bp, Homo sapiens
tataataaagtat

SEQ ID NO: 1121818 - DNA, 18 bp, Homo sapiens
tataataactgaactgtt

SEQ ID NO: 1121819 - DNA, 20 bp, Homo sapiens
tataataactgaactgtttg

SEQ ID NO: 1121820 - DNA, 21 bp, Homo sapiens
tataataactgaactgtttgg

SEQ ID NO: 1121821 - DNA, 21 bp, Homo sapiens
tataataactttattgcatat

SEQ ID NO: 1121822 - DNA, 18 bp, Homo sapiens
tataataagttttgatat

SEQ ID NO: 1121823 - DNA, 16 bp, Homo sapiens
tataatactaaaactc

SEQ ID NO: 1121824 - DNA, 15 bp, Homo sapiens
tataatacttgcaac

SEQ ID NO: 1121825 - DNA, 14 bp, Homo sapiens
tataatactttgta

SEQ ID NO: 1121826 - DNA, 20 bp, Homo sapiens
tataatactttgtatacaag

SEQ ID NO: 1121827 - DNA, 22 bp, Homo sapiens
tataatactttgtatacaagta

SEQ ID NO: 1121828 - DNA, 16 bp, Homo sapiens
tataatatatttgtgt

SEQ ID NO: 1121829 - DNA, 20 bp, Homo sapiens
tataatatctaaagttatat

SEQ ID NO: 1121830 - DNA, 22 bp, Homo sapiens
tataatattcagccagcttaaa

SEQ ID NO: 1121831 - DNA, 19 bp, Homo sapiens
tataatattgaaaattgaa

SEQ ID NO: 1121832 - DNA, 13 bp, Homo sapiens
tataatatttcct

SEQ ID NO: 1121833 - DNA, 21 bp, Homo sapiens
tataatatttcttaatttgga

SEQ ID NO: 1121834 - DNA, 17 bp, Homo sapiens
tataatcaaagctcata

SEQ ID NO: 1121835 - DNA, 14 bp, Homo sapiens
tataatcagaatgg

SEQ ID NO: 1121836 - DNA, 21 bp, Homo sapiens
tataatcattagttttagagg

SEQ ID NO: 1121837 - DNA, 21 bp, Homo sapiens
tataatctcttcttatacaga

SEQ ID NO: 1121838 - DNA, 18 bp, Homo sapiens
tatattatataactcttt

SEQ ID NO: 1121839 - DNA, 13 bp, Homo sapiens
tatattatatatg

SEQ ID NO: 1121840 - DNA, 17 bp, Homo sapiens
tatattatcatatctct

SEQ ID NO: 1121841 - DNA, 14 bp, Homo sapiens
tatattatcatgca

SEQ ID NO: 1121842 - DNA, 13 bp, Homo sapiens
tatattatgtctt

SEQ ID NO: 1121843 - DNA, 15 bp, Homo sapiens
tatattattccaaag

SEQ ID NO: 1121844 - DNA, 15 bp, Homo sapiens
tatattattgattca

SEQ ID NO: 1121845 - DNA, 22 bp, Homo sapiens
tatattcaggacttgaaagaaa

SEQ ID NO: 1121846 - DNA, 14 bp, Homo sapiens
tatattcatatatt

SEQ ID NO: 1121847 - DNA, 19 bp, Homo sapiens
tatattcatcagaatgtta

SEQ ID NO: 1121848 - DNA, 16 bp, Homo sapiens
tatattccaaggaaaa

SEQ ID NO: 1121849 - DNA, 15 bp, Homo sapiens
tatattctggaaaaa

SEQ ID NO: 1121850 - DNA, 22 bp, Homo sapiens
tatattcttattggaaatgtac

SEQ ID NO: 1121851 - DNA, 17 bp, Homo sapiens
tatattgaaagttgctt

SEQ ID NO: 1121852 - DNA, 23 bp, Homo sapiens
tatattgaaagttgcttttattg

SEQ ID NO: 1121853 - DNA, 22 bp, Homo sapiens
tatattgaacttttgtactgaa

SEQ ID NO: 1121854 - DNA, 20 bp, Homo sapiens
tatattgaagacaatttgat

SEQ ID NO: 1121855 - DNA, 13 bp, Homo sapiens
tatattgaataaa

SEQ ID NO: 1121856 - DNA, 13 bp, Homo sapiens
tatattgaatata

SEQ ID NO: 1121857 - DNA, 15 bp, Homo sapiens
tatattgaatatatc

SEQ ID NO: 1121858 - DNA, 22 bp, Homo sapiens
tatattgagaatcccttaaaat

SEQ ID NO: 1121859 - DNA, 20 bp, Homo sapiens
tatattgcccaggctggtct

SEQ ID NO: 1121860 - DNA, 15 bp, Homo sapiens
tatattgtaaagaag

SEQ ID NO: 1121861 - DNA, 16 bp, Homo sapiens
tatattgtaaagaagg

SEQ ID NO: 1121862 - DNA, 22 bp, Homo sapiens
tatattgtacaaatgtaagcaa

SEQ ID NO: 1121863 - DNA, 15 bp, Homo sapiens
tatattgtatattct

SEQ ID NO: 1121864 - DNA, 18 bp, Homo sapiens
tatattgtatattctgga

SEQ ID NO: 1121865 - DNA, 15 bp, Homo sapiens
tatattgtccaggct

SEQ ID NO: 1121866 - DNA, 12 bp, Homo sapiens
tatattgtggaa

SEQ ID NO: 1121867 - DNA, 13 bp, Homo sapiens
tatattgtggaat

SEQ ID NO: 1121868 - DNA, 17 bp, Homo sapiens
tatattgtggaataaat

SEQ ID NO: 1121869 - DNA, 15 bp, Homo sapiens
tatatttaaaaattg

SEQ ID NO: 1121870 - DNA, 17 bp, Homo sapiens
tatatttaaaaattgtt

SEQ ID NO: 1121871 - DNA, 22 bp, Homo sapiens
tatatttaaaaattgtttcttg

SEQ ID NO: 1121872 - DNA, 16 bp, Homo sapiens
tatatttaatatgtca

SEQ ID NO: 1121873 - DNA, 21 bp, Homo sapiens
tatatttagattgttaaaata

SEQ ID NO: 1121874 - DNA, 14 bp, Homo sapiens
tatatttataactc

SEQ ID NO: 1121875 - DNA, 15 bp, Homo sapiens
tatatttataactca

SEQ ID NO: 1121876 - DNA, 16 bp, Homo sapiens
tatatttataactcat

SEQ ID NO: 1121877 - DNA, 24 bp, Homo sapiens
tatatttataactcatcataaaat

SEQ ID NO: 1121878 - DNA, 15 bp, Homo sapiens
tatatttataaggaa

SEQ ID NO: 1121879 - DNA, 16 bp, Homo sapiens
tatatttatactgtat

SEQ ID NO: 1121880 - DNA, 23 bp, Homo sapiens
tatatttcaaacattttgtatca

SEQ ID NO: 1121881 - DNA, 21 bp, Homo sapiens
tatatttcacttttgttctgc

SEQ ID NO: 1121882 - DNA, 18 bp, Homo sapiens
tatatttcctgtattgct

SEQ ID NO: 1121883 - DNA, 13 bp, Homo sapiens
tatatttctatta

SEQ ID NO: 1121884 - DNA, 13 bp, Homo sapiens
tatatttctgtgt

SEQ ID NO: 1121885 - DNA, 19 bp, Homo sapiens
tatatttcttcttctaaga

SEQ ID NO: 1121886 - DNA, 12 bp, Homo sapiens
tatatttgcaaa

SEQ ID NO: 1121887 - DNA, 21 bp, Homo sapiens
tatatttgcaaaccctttgta

SEQ ID NO: 1121888 - DNA, 21 bp, Homo sapiens
tatatttgcatattgaaaagc

SEQ ID NO: 1121889 - DNA, 20 bp, Homo sapiens
tatatttgcattatgtattt

SEQ ID NO: 1121890 - DNA, 15 bp, Homo sapiens
tatatttgctgcaaa

SEQ ID NO: 1121891 - DNA, 17 bp, Homo sapiens
tatatttggaaagagac

SEQ ID NO: 1121892 - DNA, 22 bp, Homo sapiens
tatatttgtaacattgtaaagt

SEQ ID NO: 1121893 - DNA, 15 bp, Homo sapiens
tatatttgtcttccg

SEQ ID NO: 1121894 - DNA, 22 bp, Homo sapiens
tatatttgtgatagcactttct

SEQ ID NO: 1121895 - DNA, 23 bp, Homo sapiens
tatatttgtgatagcactttcta

SEQ ID NO: 1121896 - DNA, 16 bp, Homo sapiens
tatatttgtgctatag

SEQ ID NO: 1121897 - DNA, 21 bp, Homo sapiens
tatatttgtgctatagtattt

SEQ ID NO: 1121898 - DNA, 13 bp, Homo sapiens
tatattttaagaa

SEQ ID NO: 1121899 - DNA, 23 bp, Homo sapiens
tatattttaagccttcatttgca

SEQ ID NO: 1121900 - DNA, 16 bp, Homo sapiens
tatattttaatagaat

SEQ ID NO: 1121901 - DNA, 17 bp, Homo sapiens
tatattttagcatttta

SEQ ID NO: 1121902 - DNA, 19 bp, Homo sapiens
tatattttatatgttcata

SEQ ID NO: 1121903 - DNA, 18 bp, Homo sapiens
tatattttcagcaaagaa

SEQ ID NO: 1121904 - DNA, 14 bp, Homo sapiens
tatattttcttttt

SEQ ID NO: 1121905 - DNA, 13 bp, Homo sapiens
tatattttgggaa

SEQ ID NO: 1121906 - DNA, 15 bp, Homo sapiens
tatatttttaaagaa

SEQ ID NO: 1121907 - DNA, 18 bp, Homo sapiens
tatatttttaaagaatgt

SEQ ID NO: 1121908 - DNA, 13 bp, Homo sapiens
tatatttttatat

SEQ ID NO: 1121909 - DNA, 14 bp, Homo sapiens
tatatttttcaaat

SEQ ID NO: 1121910 - DNA, 16 bp, Homo sapiens
tatatttttcaaatag

SEQ ID NO: 1121911 - DNA, 17 bp, Homo sapiens
tatatttttctgagatt

SEQ ID NO: 1121912 - DNA, 16 bp, Homo sapiens
tatatttttgatacct

SEQ ID NO: 1121913 - DNA, 18 bp, Homo sapiens
tatatttttggttgtcaa

SEQ ID NO: 1121914 - DNA, 12 bp, Homo sapiens
tatatttttgta

SEQ ID NO: 1121915 - DNA, 16 bp, Homo sapiens
tatatttttgtacata

SEQ ID NO: 1121916 - DNA, 17 bp, Homo sapiens
tatatttttgtacatat

SEQ ID NO: 1121917 - DNA, 19 bp, Homo sapiens
tatattttttaatgtattc

SEQ ID NO: 1121918 - DNA, 19 bp, Homo sapiens
tatattttttaatttgatg

SEQ ID NO: 1121919 - DNA, 22 bp, Homo sapiens
tatattttttaatttgatgaaa

SEQ ID NO: 1121920 - DNA, 20 bp, Homo sapiens
tatcaaaaagctaatgtgca

SEQ ID NO: 1121921 - DNA, 12 bp, Homo sapiens
tatcaaaacaag

SEQ ID NO: 1121922 - DNA, 18 bp, Homo sapiens
tatcaaaacgagggctga

SEQ ID NO: 1121923 - DNA, 19 bp, Homo sapiens
tatcaaaactttcttttct

SEQ ID NO: 1121924 - DNA, 23 bp, Homo sapiens
tatcaaacaccaacataaaaatg

SEQ ID NO: 1121925 - DNA, 18 bp, Homo sapiens
tatcaaaccctagccttg

SEQ ID NO: 1121926 - DNA, 20 bp, Homo sapiens
tatcaaaccctagccttgct

SEQ ID NO: 1121927 - DNA, 16 bp, Homo sapiens
tatcaaactgaagcca

SEQ ID NO: 1121928 - DNA, 21 bp, Homo sapiens
tatcaaacttcagctgtactt

SEQ ID NO: 1121929 - DNA, 19 bp, Homo sapiens
tatcaaagagaagatgcct

SEQ ID NO: 1121930 - DNA, 20 bp, Homo sapiens
tatcaaagtcattaaagaca

SEQ ID NO: 1121931 - DNA, 18 bp, Homo sapiens
tatcaaataaaatatcat

SEQ ID NO: 1121932 - DNA, 14 bp, Homo sapiens
tatcaaataaaatt

SEQ ID NO: 1121933 - DNA, 17 bp, Homo sapiens
tatcaaataataaagta

SEQ ID NO: 1121934 - DNA, 15 bp, Homo sapiens
tatcaaatctaccac

SEQ ID NO: 1121935 - DNA, 15 bp, Homo sapiens
tatcaaatgaaactc

SEQ ID NO: 1121936 - DNA, 11 bp, Homo sapiens
tatcaaatgtt

SEQ ID NO: 1121937 - DNA, 17 bp, Homo sapiens
tatcaaatgttacagtt

SEQ ID NO: 1121938 - DNA, 16 bp, Homo sapiens
tatcaacttatttttc

SEQ ID NO: 1121939 - DNA, 12 bp, Homo sapiens
tatcaactttag

SEQ ID NO: 1121940 - DNA, 21 bp, Homo sapiens
tatcaagagagtaaacagaca

SEQ ID NO: 1121941 - DNA, 16 bp, Homo sapiens
tatcaaggaaacgttt

SEQ ID NO: 1121942 - DNA, 18 bp, Homo sapiens
tatcaaggggatgatttg

SEQ ID NO: 1121943 - DNA, 15 bp, Homo sapiens
tatcaagtatagaaa

SEQ ID NO: 1121944 - DNA, 16 bp, Homo sapiens
tatcaagtatagaaaa

SEQ ID NO: 1121945 - DNA, 15 bp, Homo sapiens
tatcaagtggcatgt

SEQ ID NO: 1121946 - DNA, 18 bp, Homo sapiens
tatcaatgtgtctttcta

SEQ ID NO: 1121947 - DNA, 18 bp, Homo sapiens
tatcaatttttcccagta

SEQ ID NO: 1121948 - DNA, 20 bp, Homo sapiens
tatcaatttttcccagtatt

SEQ ID NO: 1121949 - DNA, 17 bp, Homo sapiens
tatcacacttctgtgag

SEQ ID NO: 1121950 - DNA, 11 bp, Homo sapiens
tatcacagtgt

SEQ ID NO: 1121951 - DNA, 19 bp, Homo sapiens
tatcacataagagagatga

SEQ ID NO: 1121952 - DNA, 21 bp, Homo sapiens
tatcacataagagagatgaga

SEQ ID NO: 1121953 - DNA, 16 bp, Homo sapiens
tatcacataattccag

SEQ ID NO: 1121954 - DNA, 18 bp, Homo sapiens
tatcacatcaagcatgca

SEQ ID NO: 1121955 - DNA, 22 bp, Homo sapiens
tatcacatcaagcatgcaataa

SEQ ID NO: 1121956 - DNA, 17 bp, Homo sapiens
tatcacatgattataga

SEQ ID NO: 1121957 - DNA, 18 bp, Homo sapiens
tatcacattaatctcaaa

SEQ ID NO: 1121958 - DNA, 22 bp, Homo sapiens
tatcacattaatctcaaagaga

SEQ ID NO: 1121959 - DNA, 13 bp, Homo sapiens
tatcacattattt

SEQ ID NO: 1121960 - DNA, 21 bp, Homo sapiens
tatctgcactctaaactgcaa

SEQ ID NO: 1121961 - DNA, 11 bp, Homo sapiens
tatctgcagaa

SEQ ID NO: 1121962 - DNA, 12 bp, Homo sapiens
tatctgcagaac

SEQ ID NO: 1121963 - DNA, 19 bp, Homo sapiens
tatctgcaggcagacacgg

SEQ ID NO: 1121964 - DNA, 12 bp, Homo sapiens
tatctgcatgtg

SEQ ID NO: 1121965 - DNA, 22 bp, Homo sapiens
tatctgcatgtgtcatgaagaa

SEQ ID NO: 1121966 - DNA, 15 bp, Homo sapiens
tatctgcattatcta

SEQ ID NO: 1121967 - DNA, 21 bp, Homo sapiens
tatctgccaaattgagataat

SEQ ID NO: 1121968 - DNA, 15 bp, Homo sapiens
tatctgcctggcctg

SEQ ID NO: 1121969 - DNA, 16 bp, Homo sapiens
tatctgcctggcctgg

SEQ ID NO: 1121970 - DNA, 19 bp, Homo sapiens
tatctgcctggcctggctc

SEQ ID NO: 1121971 - DNA, 22 bp, Homo sapiens
tatctggaacaacttgtagcag

SEQ ID NO: 1121972 - DNA, 22 bp, Homo sapiens
tatctggaatattgtgattctg

SEQ ID NO: 1121973 - DNA, 18 bp, Homo sapiens
tatctggacaagccaact

SEQ ID NO: 1121974 - DNA, 16 bp, Homo sapiens
tatctggattcaaatt

SEQ ID NO: 1121975 - DNA, 12 bp, Homo sapiens
tatctggcactg

SEQ ID NO: 1121976 - DNA, 23 bp, Homo sapiens
tatctggccctcgacactcacca

SEQ ID NO: 1121977 - DNA, 15 bp, Homo sapiens
tatctggcgttcttt

SEQ ID NO: 1121978 - DNA, 19 bp, Homo sapiens
tatctgggattctacttta

SEQ ID NO: 1121979 - DNA, 20 bp, Homo sapiens
tatctgggttaagtgtttat

SEQ ID NO: 1121980 - DNA, 18 bp, Homo sapiens
tatctggtatatgtcatt

SEQ ID NO: 1121981 - DNA, 22 bp, Homo sapiens
tatctggtatatgtcattattt

SEQ ID NO: 1121982 - DNA, 22 bp, Homo sapiens
tatctggtcaacctcctggaca

SEQ ID NO: 1121983 - DNA, 14 bp, Homo sapiens
tatctggtgcctcc

SEQ ID NO: 1121984 - DNA, 13 bp, Homo sapiens
tatctgtaatggt

SEQ ID NO: 1121985 - DNA, 22 bp, Homo sapiens
tatctgtaatggtactgacttt

SEQ ID NO: 1121986 - DNA, 23 bp, Homo sapiens
tatctgtagtgagatagcattgt

SEQ ID NO: 1121987 - DNA, 15 bp, Homo sapiens
tatctgtcatctctc

SEQ ID NO: 1121988 - DNA, 14 bp, Homo sapiens
tatctgtctttcca

SEQ ID NO: 1121989 - DNA, 19 bp, Homo sapiens
tatctgtgaaatgctggca

SEQ ID NO: 1121990 - DNA, 17 bp, Homo sapiens
tatctgtgcgtgaaaca

SEQ ID NO: 1121991 - DNA, 16 bp, Homo sapiens
tatctgtgcttctaat

SEQ ID NO: 1121992 - DNA, 12 bp, Homo sapiens
tatctgttcttg

SEQ ID NO: 1121993 - DNA, 21 bp, Homo sapiens
tatctgttgccttatttctca

SEQ ID NO: 1121994 - DNA, 13 bp, Homo sapiens
tatctgtttgtat

SEQ ID NO: 1121995 - DNA, 20 bp, Homo sapiens
tatctgtttgtatatttgca

SEQ ID NO: 1121996 - DNA, 13 bp, Homo sapiens
tatcttaaaacct

SEQ ID NO: 1121997 - DNA, 20 bp, Homo sapiens
tatcttaaagaaacagcttt

SEQ ID NO: 1121998 - DNA, 17 bp, Homo sapiens
tatcttaattctttgtt

SEQ ID NO: 1121999 - DNA, 13 bp, Homo sapiens
tatcttacgaaaa

SEQ ID NO: 1122000 - DNA, 17 bp, Homo sapiens
tatcttactatttcaca

SEQ ID NO: 1122001 - DNA, 14 bp, Homo sapiens
tatcttactttcct

SEQ ID NO: 1122002 - DNA, 20 bp, Homo sapiens
tatcttagagtttacagttt

SEQ ID NO: 1122003 - DNA, 22 bp, Homo sapiens
tatcttagagtttacagtttgt

SEQ ID NO: 1122004 - DNA, 19 bp, Homo sapiens
tatcttagatgtttcacac

SEQ ID NO: 1122005 - DNA, 18 bp, Homo sapiens
tatcttataactgtttta

SEQ ID NO: 1122006 - DNA, 17 bp, Homo sapiens
tatcttattaaagtatt

SEQ ID NO: 1122007 - DNA, 17 bp, Homo sapiens
tatcttcaaactttcac

SEQ ID NO: 1122008 - DNA, 21 bp, Homo sapiens
tatcttcaaactttcactttg

SEQ ID NO: 1122009 - DNA, 14 bp, Homo sapiens
tatcttcacattgt

SEQ ID NO: 1122010 - DNA, 16 bp, Homo sapiens
tatcttcacattgtgt

SEQ ID NO: 1122011 - DNA, 19 bp, Homo sapiens
tatcttcacattgtgtgaa

SEQ ID NO: 1122012 - DNA, 19 bp, Homo sapiens
tatcttcaccctcatcctt

SEQ ID NO: 1122013 - DNA, 22 bp, Homo sapiens
tatcttcaccctcatcctttac

SEQ ID NO: 1122014 - DNA, 13 bp, Homo sapiens
tatcttcagccca

SEQ ID NO: 1122015 - DNA, 18 bp, Homo sapiens
tatcttcagcccaggctt

SEQ ID NO: 1122016 - DNA, 20 bp, Homo sapiens
tatcttcatatgtcaccttt

SEQ ID NO: 1122017 - DNA, 18 bp, Homo sapiens
tatcttcatgtaaattga

SEQ ID NO: 1122018 - DNA, 19 bp, Homo sapiens
tatcttcccatttaacatt

SEQ ID NO: 1122019 - DNA, 23 bp, Homo sapiens
tatcttcccatttaacattgttt

SEQ ID NO: 1122020 - DNA, 13 bp, Homo sapiens
tatcttcctttct

SEQ ID NO: 1122021 - DNA, 15 bp, Homo sapiens
tatcttctggactat

SEQ ID NO: 1122022 - DNA, 18 bp, Homo sapiens
tatcttctttattattcc

SEQ ID NO: 1122023 - DNA, 17 bp, Homo sapiens
tatcttgatacattcaa

SEQ ID NO: 1122024 - DNA, 19 bp, Homo sapiens
tatcttgatacattcaaat

SEQ ID NO: 1122025 - DNA, 17 bp, Homo sapiens
tatcttgatgtttagaa

SEQ ID NO: 1122026 - DNA, 20 bp, Homo sapiens
tatcttgatgtttagaaaag

SEQ ID NO: 1122027 - DNA, 16 bp, Homo sapiens
tatcttgctccattgt

SEQ ID NO: 1122028 - DNA, 19 bp, Homo sapiens
tatcttggacaaatcacat

SEQ ID NO: 1122029 - DNA, 20 bp, Homo sapiens
tatcttgggtgtattctctg

SEQ ID NO: 1122030 - DNA, 22 bp, Homo sapiens
tatcttgttagagagcttttca

SEQ ID NO: 1122031 - DNA, 15 bp, Homo sapiens
tatcttgttattaat

SEQ ID NO: 1122032 - DNA, 17 bp, Homo sapiens
tatcttgttcaggaaaa

SEQ ID NO: 1122033 - DNA, 15 bp, Homo sapiens
tatcttgtttacaat

SEQ ID NO: 1122034 - DNA, 18 bp, Homo sapiens
tatcttgtttttccacta

SEQ ID NO: 1122035 - DNA, 14 bp, Homo sapiens
tatctttaaacatt

SEQ ID NO: 1122036 - DNA, 18 bp, Homo sapiens
tatctttaacaattgtct

SEQ ID NO: 1122037 - DNA, 23 bp, Homo sapiens
tatctttatacagattttctaga

SEQ ID NO: 1122038 - DNA, 16 bp, Homo sapiens
tatctttattaaaaca

SEQ ID NO: 1122039 - DNA, 20 bp, Homo sapiens
tatctttccatgggagccag

SEQ ID NO: 1122040 - DNA, 13 bp, Homo sapiens
tatctttcctccc

SEQ ID NO: 1122041 - DNA, 14 bp, Homo sapiens
tatctttctcttac

SEQ ID NO: 1122042 - DNA, 21 bp, Homo sapiens
tatctttctcttacctgttat

SEQ ID NO: 1122043 - DNA, 15 bp, Homo sapiens
tatctttctttccat

SEQ ID NO: 1122044 - DNA, 17 bp, Homo sapiens
tatctttctttccattt

SEQ ID NO: 1122045 - DNA, 18 bp, Homo sapiens
tatctttgacaattctgg

SEQ ID NO: 1122046 - DNA, 22 bp, Homo sapiens
tatctttgacaattctgggtgc

SEQ ID NO: 1122047 - DNA, 22 bp, Homo sapiens
tatctttttaaaaactcttcag

SEQ ID NO: 1122048 - DNA, 20 bp, Homo sapiens
tatgaaaaaatatgaaccta

SEQ ID NO: 1122049 - DNA, 18 bp, Homo sapiens
tatgaaaaacaaaaataa

SEQ ID NO: 1122050 - DNA, 13 bp, Homo sapiens
tatgaaaaacatc

SEQ ID NO: 1122051 - DNA, 21 bp, Homo sapiens
tatgaaaaacatcccaaactt

SEQ ID NO: 1122052 - DNA, 17 bp, Homo sapiens
tatgaaaaccaaatttt

SEQ ID NO: 1122053 - DNA, 13 bp, Homo sapiens
tatgaaaacttat

SEQ ID NO: 1122054 - DNA, 15 bp, Homo sapiens
tatgaaaacttatga

SEQ ID NO: 1122055 - DNA, 14 bp, Homo sapiens
tatgaaaagctaga

SEQ ID NO: 1122056 - DNA, 22 bp, Homo sapiens
tatgaaaatatagacattctca

SEQ ID NO: 1122057 - DNA, 13 bp, Homo sapiens
tatgaaataaaga

SEQ ID NO: 1122058 - DNA, 21 bp, Homo sapiens
tatgaacaacagtagtttctc

SEQ ID NO: 1122059 - DNA, 13 bp, Homo sapiens
tatgaacactgtc

SEQ ID NO: 1122060 - DNA, 13 bp, Homo sapiens
tatgaacagctgt

SEQ ID NO: 1122061 - DNA, 15 bp, Homo sapiens
tatgaacagctgtgt

SEQ ID NO: 1122062 - DNA, 16 bp, Homo sapiens
tatgaacagctgtgtc

SEQ ID NO: 1122063 - DNA, 22 bp, Homo sapiens
tatgaacagggcccaggcctgg

SEQ ID NO: 1122064 - DNA, 17 bp, Homo sapiens
tatgaacatattgttga

SEQ ID NO: 1122065 - DNA, 10 bp, Homo sapiens
tatgaacatc

SEQ ID NO: 1122066 - DNA, 14 bp, Homo sapiens
tatgaacattgtac

SEQ ID NO: 1122067 - DNA, 14 bp, Homo sapiens
tatgaacctatttt

SEQ ID NO: 1122068 - DNA, 23 bp, Homo sapiens
tatgaactacaggtgtttgactt

SEQ ID NO: 1122069 - DNA, 21 bp, Homo sapiens
tatgaagaaaaagtacaatga

SEQ ID NO: 1122070 - DNA, 13 bp, Homo sapiens
tatgaaggaattt

SEQ ID NO: 1122071 - DNA, 22 bp, Homo sapiens
tatgaaggaatttgattgcttt

SEQ ID NO: 1122072 - DNA, 14 bp, Homo sapiens
tatgaagtataaat

SEQ ID NO: 1122073 - DNA, 17 bp, Homo sapiens
tatgaagtataaatctg

SEQ ID NO: 1122074 - DNA, 19 bp, Homo sapiens
tatgaagtgcgtgaatgta

SEQ ID NO: 1122075 - DNA, 20 bp, Homo sapiens
tatgaagttgctgtttattt

SEQ ID NO: 1122076 - DNA, 17 bp, Homo sapiens
tatgaagttggcacatt

SEQ ID NO: 1122077 - DNA, 17 bp, Homo sapiens
tatgaataaagaatgcc

SEQ ID NO: 1122078 - DNA, 13 bp, Homo sapiens
tatgaatactttg

SEQ ID NO: 1122079 - DNA, 15 bp, Homo sapiens
tatgaatactttgca

SEQ ID NO: 1122080 - DNA, 15 bp, Homo sapiens
tatgaatatcattga

SEQ ID NO: 1122081 - DNA, 18 bp, Homo sapiens
tatgaatatcattgattt

SEQ ID NO: 1122082 - DNA, 20 bp, Homo sapiens
tatggttcccaataaaagtg

SEQ ID NO: 1122083 - DNA, 21 bp, Homo sapiens
tatggttcccaataaaagtga

SEQ ID NO: 1122084 - DNA, 23 bp, Homo sapiens
tatggttctcagatcttgacagt

SEQ ID NO: 1122085 - DNA, 20 bp, Homo sapiens
tatggttctccaagaaactg

SEQ ID NO: 1122086 - DNA, 20 bp, Homo sapiens
tatggttgatagtttacctg

SEQ ID NO: 1122087 - DNA, 22 bp, Homo sapiens
tatggttgatagtttacctgaa

SEQ ID NO: 1122088 - DNA, 14 bp, Homo sapiens
tatggttgccaccc

SEQ ID NO: 1122089 - DNA, 17 bp, Homo sapiens
tatggttggagagccct

SEQ ID NO: 1122090 - DNA, 21 bp, Homo sapiens
tatgtaaaaggattattacta

SEQ ID NO: 1122091 - DNA, 19 bp, Homo sapiens
tatgtaaaataaaattatg

SEQ ID NO: 1122092 - DNA, 14 bp, Homo sapiens
tatgtaaacataat

SEQ ID NO: 1122093 - DNA, 18 bp, Homo sapiens
tatgtaaacataattctt

SEQ ID NO: 1122094 - DNA, 18 bp, Homo sapiens
tatgtaaagtatgtaaac

SEQ ID NO: 1122095 - DNA, 15 bp, Homo sapiens
tatgtaaagtatgtt

SEQ ID NO: 1122096 - DNA, 20 bp, Homo sapiens
tatgtaaataggtttctaaa

SEQ ID NO: 1122097 - DNA, 20 bp, Homo sapiens
tatgtaaattattgtaaact

SEQ ID NO: 1122098 - DNA, 13 bp, Homo sapiens
tatgtaacttgca

SEQ ID NO: 1122099 - DNA, 16 bp, Homo sapiens
tatgtaagagcacctt

SEQ ID NO: 1122100 - DNA, 14 bp, Homo sapiens
tatgtaatacttaa

SEQ ID NO: 1122101 - DNA, 13 bp, Homo sapiens
tatgtaatataaa

SEQ ID NO: 1122102 - DNA, 19 bp, Homo sapiens
tatgtaatatattgtacaa

SEQ ID NO: 1122103 - DNA, 17 bp, Homo sapiens
tatgtaatgcaaaattt

SEQ ID NO: 1122104 - DNA, 15 bp, Homo sapiens
tatgtaatttatgca

SEQ ID NO: 1122105 - DNA, 15 bp, Homo sapiens
tatgtaatttcaaaa

SEQ ID NO: 1122106 - DNA, 19 bp, Homo sapiens
tatgtaatttcaaaataca

SEQ ID NO: 1122107 - DNA, 21 bp, Homo sapiens
tatgtaatttgtacaggggcc

SEQ ID NO: 1122108 - DNA, 22 bp, Homo sapiens
tatgtaatttgtacaggggcca

SEQ ID NO: 1122109 - DNA, 16 bp, Homo sapiens
tatgtacaaccctgac

SEQ ID NO: 1122110 - DNA, 11 bp, Homo sapiens
tatgtacaata

SEQ ID NO: 1122111 - DNA, 20 bp, Homo sapiens
tatgtacaatacaatgtaca

SEQ ID NO: 1122112 - DNA, 16 bp, Homo sapiens
tatgtacagagctttc

SEQ ID NO: 1122113 - DNA, 14 bp, Homo sapiens
tatgtacatatata

SEQ ID NO: 1122114 - DNA, 16 bp, Homo sapiens
tatgtacgtttgtatg

SEQ ID NO: 1122115 - DNA, 21 bp, Homo sapiens
tatgtactcctctttacactg

SEQ ID NO: 1122116 - DNA, 19 bp, Homo sapiens
tatgtacttagctgtacta

SEQ ID NO: 1122117 - DNA, 16 bp, Homo sapiens
tatgtacttgtcaaag

SEQ ID NO: 1122118 - DNA, 12 bp, Homo sapiens
tatgtagatgtg

SEQ ID NO: 1122119 - DNA, 17 bp, Homo sapiens
tatgtagatgtgcattt

SEQ ID NO: 1122120 - DNA, 15 bp, Homo sapiens
tatgtagcaaaatac

SEQ ID NO: 1122121 - DNA, 19 bp, Homo sapiens
tatgtagccttcacacaga

SEQ ID NO: 1122122 - DNA, 17 bp, Homo sapiens
tatgtagctttatcctt

SEQ ID NO: 1122123 - DNA, 17 bp, Homo sapiens
tatgtagtaattgacat

SEQ ID NO: 1122124 - DNA, 18 bp, Homo sapiens
tatgtagtatctatatga

SEQ ID NO: 1122125 - DNA, 23 bp, Homo sapiens
tatgtatacttatcttgctccat

SEQ ID NO: 1122126 - DNA, 18 bp, Homo sapiens
tatgtatataatcatgct

SEQ ID NO: 1122127 - DNA, 14 bp, Homo sapiens
tatgtatatatata

SEQ ID NO: 1122128 - DNA, 19 bp, Homo sapiens
tatgtatatttttttaatt

SEQ ID NO: 1122129 - DNA, 23 bp, Homo sapiens
tatgtatatttttttaatttaac

SEQ ID NO: 1122130 - DNA, 14 bp, Homo sapiens
tatgtatcagctct

SEQ ID NO: 1122131 - DNA, 15 bp, Homo sapiens
tatgtatcagctctc

SEQ ID NO: 1122132 - DNA, 16 bp, Homo sapiens
tatgtatcagctctct

SEQ ID NO: 1122133 - DNA, 12 bp, Homo sapiens
tatgtatgaagg

SEQ ID NO: 1122134 - DNA, 14 bp, Homo sapiens
tatgtatgtaaaaa

SEQ ID NO: 1122135 - DNA, 13 bp, Homo sapiens
tatgtatgtttac

SEQ ID NO: 1122136 - DNA, 17 bp, Homo sapiens
tatgtattcccttgtat

SEQ ID NO: 1122137 - DNA, 18 bp, Homo sapiens
tatgtattcccttgtatt

SEQ ID NO: 1122138 - DNA, 20 bp, Homo sapiens
tatgtattcccttgtatttt

SEQ ID NO: 1122139 - DNA, 22 bp, Homo sapiens
tatgtattgtaaacatgtgttt

SEQ ID NO: 1122140 - DNA, 14 bp, Homo sapiens
tatgtatttaaaaa

SEQ ID NO: 1122141 - DNA, 13 bp, Homo sapiens
tatgtatttaaga

SEQ ID NO: 1122142 - DNA, 21 bp, Homo sapiens
tatgtatttaagatgtacatt

SEQ ID NO: 1122143 - DNA, 14 bp, Homo sapiens
tatgtcaaagcagg

SEQ ID NO: 1122144 - DNA, 19 bp, Homo sapiens
tatgtcaatatttagtaaa

SEQ ID NO: 1122145 - DNA, 20 bp, Homo sapiens
tatgtcaatttgtatatcat

SEQ ID NO: 1122146 - DNA, 19 bp, Homo sapiens
tatgtcagaaaaaatatgt

SEQ ID NO: 1122147 - DNA, 21 bp, Homo sapiens
tatgtcagaggaacagtcctg

SEQ ID NO: 1122148 - DNA, 16 bp, Homo sapiens
tatgtcagtcactaaa

SEQ ID NO: 1122149 - DNA, 18 bp, Homo sapiens
tatgtcatcagtaaagta

SEQ ID NO: 1122150 - DNA, 15 bp, Homo sapiens
tatgtcattatttat

SEQ ID NO: 1122151 - DNA, 20 bp, Homo sapiens
tatgtcatttttaatgtatc

SEQ ID NO: 1122152 - DNA, 18 bp, Homo sapiens
tatgtcgagagctggcca

SEQ ID NO: 1122153 - DNA, 14 bp, Homo sapiens
tatgtctaattgag

SEQ ID NO: 1122154 - DNA, 21 bp, Homo sapiens
tatgtctcgtggtaggactgt

SEQ ID NO: 1122155 - DNA, 17 bp, Homo sapiens
tatgtctgaacatagaa

SEQ ID NO: 1122156 - DNA, 21 bp, Homo sapiens
tatgtctgaacatagaaactc

SEQ ID NO: 1122157 - DNA, 14 bp, Homo sapiens
tatgtctgccatgt

SEQ ID NO: 1122158 - DNA, 12 bp, Homo sapiens
tatgtctgcctt

SEQ ID NO: 1122159 - DNA, 15 bp, Homo sapiens
tatgtcttcttttgt

SEQ ID NO: 1122160 - DNA, 14 bp, Homo sapiens
tatgtgaaaaatta

SEQ ID NO: 1122161 - DNA, 21 bp, Homo sapiens
tatgtgaaaaattaacttttt

SEQ ID NO: 1122162 - DNA, 21 bp, Homo sapiens
tatgtgaatcctcttctttat

SEQ ID NO: 1122163 - DNA, 14 bp, Homo sapiens
tatgtgacattaac

SEQ ID NO: 1122164 - DNA, 14 bp, Homo sapiens
tatgtgacatttta

SEQ ID NO: 1122165 - DNA, 18 bp, Homo sapiens
tatgtgacttgcaataaa

SEQ ID NO: 1122166 - DNA, 14 bp, Homo sapiens
tatgtgagatttcc

SEQ ID NO: 1122167 - DNA, 20 bp, Homo sapiens
tatgtgagatttccttatca

SEQ ID NO: 1122168 - DNA, 18 bp, Homo sapiens
tatgtgagctgtaaaaat

SEQ ID NO: 1122169 - DNA, 21 bp, Homo sapiens
tatgtgagtagtcttatgtaa

SEQ ID NO: 1122170 - DNA, 22 bp, Homo sapiens
tatgtgcactgtcactttgctc

SEQ ID NO: 1122171 - DNA, 16 bp, Homo sapiens
tatgtgccaaagcttt

SEQ ID NO: 1122172 - DNA, 20 bp, Homo sapiens
tatgtgccacattttcttaa

SEQ ID NO: 1122173 - DNA, 16 bp, Homo sapiens
tatgtgcgtctctctt

SEQ ID NO: 1122174 - DNA, 12 bp, Homo sapiens
tatgtggaagta

SEQ ID NO: 1122175 - DNA, 14 bp, Homo sapiens
tatgtggaagtata

SEQ ID NO: 1122176 - DNA, 16 bp, Homo sapiens
tatgtggaagtatacc

SEQ ID NO: 1122177 - DNA, 21 bp, Homo sapiens
tatgtggaagtatacctggct

SEQ ID NO: 1122178 - DNA, 20 bp, Homo sapiens
tatgtgtatgcacagtaaaa

SEQ ID NO: 1122179 - DNA, 18 bp, Homo sapiens
tatgtgtctgctaatgta

SEQ ID NO: 1122180 - DNA, 15 bp, Homo sapiens
tatgtgtgaggagct

SEQ ID NO: 1122181 - DNA, 16 bp, Homo sapiens
tatgtgtgaggagctg

SEQ ID NO: 1122182 - DNA, 19 bp, Homo sapiens
tatgtgtggctgtgggtgt

SEQ ID NO: 1122183 - DNA, 19 bp, Homo sapiens
tatgtgtgtgtatgtttgc

SEQ ID NO: 1122184 - DNA, 16 bp, Homo sapiens
tatgtgtgtttctgtc

SEQ ID NO: 1122185 - DNA, 16 bp, Homo sapiens
tatgtgttacattatt

SEQ ID NO: 1122186 - DNA, 17 bp, Homo sapiens
tatgtgttatgaacatc

SEQ ID NO: 1122187 - DNA, 22 bp, Homo sapiens
tatgtgtttggatacatctgct

SEQ ID NO: 1122188 - DNA, 16 bp, Homo sapiens
tatgtgtttttcacat

SEQ ID NO: 1122189 - DNA, 17 bp, Homo sapiens
tatgtgtttttcacatt

SEQ ID NO: 1122190 - DNA, 14 bp, Homo sapiens
tatgtgtttttctc

SEQ ID NO: 1122191 - DNA, 21 bp, Homo sapiens
tatgtgtttttctcatatttg

SEQ ID NO: 1122192 - DNA, 15 bp, Homo sapiens
tatgttaaaaagaaa

SEQ ID NO: 1122193 - DNA, 13 bp, Homo sapiens
tatgttaaactct

SEQ ID NO: 1122194 - DNA, 12 bp, Homo sapiens
tatgttaaatac

SEQ ID NO: 1122195 - DNA, 16 bp, Homo sapiens
tatgttaaatactgtg

SEQ ID NO: 1122196 - DNA, 18 bp, Homo sapiens
tatgttaaatactgtgca

SEQ ID NO: 1122197 - DNA, 14 bp, Homo sapiens
tatgttaagctctt

SEQ ID NO: 1122198 - DNA, 13 bp, Homo sapiens
tatgttagagagg

SEQ ID NO: 1122199 - DNA, 16 bp, Homo sapiens
tatgttatacaaggca

SEQ ID NO: 1122200 - DNA, 21 bp, Homo sapiens
tatgttatagaacttcatgga

SEQ ID NO: 1122201 - DNA, 20 bp, Homo sapiens
tatgttatgatattgtttaa

SEQ ID NO: 1122202 - DNA, 21 bp, Homo sapiens
tatgttcctaacaaaatgaga

SEQ ID NO: 1122203 - DNA, 22 bp, Homo sapiens
tatgttcctttatttaggaaac

SEQ ID NO: 1122204 - DNA, 14 bp, Homo sapiens
tattgacactgaac

SEQ ID NO: 1122205 - DNA, 16 bp, Homo sapiens
tattgacactgaactt

SEQ ID NO: 1122206 - DNA, 14 bp, Homo sapiens
tattgacttgtata

SEQ ID NO: 1122207 - DNA, 15 bp, Homo sapiens
tattgacttgtatat

SEQ ID NO: 1122208 - DNA, 17 bp, Homo sapiens
tattgacttgtatattt

SEQ ID NO: 1122209 - DNA, 18 bp, Homo sapiens
tattgactttcttaaaaa

SEQ ID NO: 1122210 - DNA, 18 bp, Homo sapiens
tattgagaatcccttaaa

SEQ ID NO: 1122211 - DNA, 18 bp, Homo sapiens
tattgagaattttaaatt

SEQ ID NO: 1122212 - DNA, 18 bp, Homo sapiens
tattgagatttcttaaat

SEQ ID NO: 1122213 - DNA, 19 bp, Homo sapiens
tattgagcaatatgtcagt

SEQ ID NO: 1122214 - DNA, 18 bp, Homo sapiens
tattgagccttgcatgta

SEQ ID NO: 1122215 - DNA, 23 bp, Homo sapiens
tattgagccttgcatgtacttga

SEQ ID NO: 1122216 - DNA, 22 bp, Homo sapiens
tattgaggccaagaatattgca

SEQ ID NO: 1122217 - DNA, 23 bp, Homo sapiens
tattgaggccaagaatattgcaa

SEQ ID NO: 1122218 - DNA, 17 bp, Homo sapiens
tattgagggccagtgat

SEQ ID NO: 1122219 - DNA, 20 bp, Homo sapiens
tattgagggccagtgatgat

SEQ ID NO: 1122220 - DNA, 20 bp, Homo sapiens
tattgatatgcttatacact

SEQ ID NO: 1122221 - DNA, 19 bp, Homo sapiens
tattgatcccacatttcca

SEQ ID NO: 1122222 - DNA, 18 bp, Homo sapiens
tattgatcccttctcctg

SEQ ID NO: 1122223 - DNA, 14 bp, Homo sapiens
tattgatgcaatat

SEQ ID NO: 1122224 - DNA, 15 bp, Homo sapiens
tattgatgttaacaa

SEQ ID NO: 1122225 - DNA, 23 bp, Homo sapiens
tattgatgttaacaagaggggaa

SEQ ID NO: 1122226 - DNA, 17 bp, Homo sapiens
tattgattaaaaatgtg

SEQ ID NO: 1122227 - DNA, 16 bp, Homo sapiens
tattgatttaaaattg

SEQ ID NO: 1122228 - DNA, 19 bp, Homo sapiens
tattgcaaaatacatgaag

SEQ ID NO: 1122229 - DNA, 21 bp, Homo sapiens
tattgcaaaggttccaactgt

SEQ ID NO: 1122230 - DNA, 15 bp, Homo sapiens
tattgcaactctttt

SEQ ID NO: 1122231 - DNA, 17 bp, Homo sapiens
tattgcacattgtaaaa

SEQ ID NO: 1122232 - DNA, 15 bp, Homo sapiens
tattgcagttataga

SEQ ID NO: 1122233 - DNA, 15 bp, Homo sapiens
tattgcattaatttt

SEQ ID NO: 1122234 - DNA, 14 bp, Homo sapiens
tattgccacctctg

SEQ ID NO: 1122235 - DNA, 14 bp, Homo sapiens
tattgcccccatgg

SEQ ID NO: 1122236 - DNA, 11 bp, Homo sapiens
tattgccttat

SEQ ID NO: 1122237 - DNA, 17 bp, Homo sapiens
tattgccttatttgtct

SEQ ID NO: 1122238 - DNA, 19 bp, Homo sapiens
tattgccttatttgtctgt

SEQ ID NO: 1122239 - DNA, 19 bp, Homo sapiens
tattgcgaatgtgcagaaa

SEQ ID NO: 1122240 - DNA, 14 bp, Homo sapiens
tattgcgctgctac

SEQ ID NO: 1122241 - DNA, 13 bp, Homo sapiens
tattgctcctccc

SEQ ID NO: 1122242 - DNA, 20 bp, Homo sapiens
tattgctgaagaatctactt

SEQ ID NO: 1122243 - DNA, 16 bp, Homo sapiens
tattgctgattttaaa

SEQ ID NO: 1122244 - DNA, 17 bp, Homo sapiens
tattgctgccaaaacca

SEQ ID NO: 1122245 - DNA, 16 bp, Homo sapiens
tattgctgtctggtga

SEQ ID NO: 1122246 - DNA, 22 bp, Homo sapiens
tattgcttattttattatgagc

SEQ ID NO: 1122247 - DNA, 19 bp, Homo sapiens
tattggaaatgtacttttg

SEQ ID NO: 1122248 - DNA, 14 bp, Homo sapiens
tattggaaatgtga

SEQ ID NO: 1122249 - DNA, 22 bp, Homo sapiens
tattggaaatgtgaataagtaa

SEQ ID NO: 1122250 - DNA, 22 bp, Homo sapiens
tattggaaatttgttataatga

SEQ ID NO: 1122251 - DNA, 23 bp, Homo sapiens
tattggaattaacctggtgctgg

SEQ ID NO: 1122252 - DNA, 23 bp, Homo sapiens
tattggattgcgcctttgtatta

SEQ ID NO: 1122253 - DNA, 21 bp, Homo sapiens
tattggcagccaaggaatgtg

SEQ ID NO: 1122254 - DNA, 14 bp, Homo sapiens
tattggccactggg

SEQ ID NO: 1122255 - DNA, 20 bp, Homo sapiens
tattgggaaggaaatatatt

SEQ ID NO: 1122256 - DNA, 16 bp, Homo sapiens
tattgggacagcatga

SEQ ID NO: 1122257 - DNA, 20 bp, Homo sapiens
tattgggagtcttaataaaa

SEQ ID NO: 1122258 - DNA, 18 bp, Homo sapiens
tattgggattacagacat

SEQ ID NO: 1122259 - DNA, 20 bp, Homo sapiens
tattggggaattaaatagtg

SEQ ID NO: 1122260 - DNA, 21 bp, Homo sapiens
tattggggaattaaatagtgt

SEQ ID NO: 1122261 - DNA, 16 bp, Homo sapiens
tattggggtctgaccc

SEQ ID NO: 1122262 - DNA, 17 bp, Homo sapiens
tattggggtctgacccc

SEQ ID NO: 1122263 - DNA, 23 bp, Homo sapiens
tattgggtagatattttttctga

SEQ ID NO: 1122264 - DNA, 14 bp, Homo sapiens
tattgggttcatta

SEQ ID NO: 1122265 - DNA, 16 bp, Homo sapiens
tattgggttcattatt

SEQ ID NO: 1122266 - DNA, 18 bp, Homo sapiens
tattgggttcattattgg

SEQ ID NO: 1122267 - DNA, 17 bp, Homo sapiens
tattgggtttttattgt

SEQ ID NO: 1122268 - DNA, 14 bp, Homo sapiens
tattggtaaattct

SEQ ID NO: 1122269 - DNA, 20 bp, Homo sapiens
tattggtaaattctggtata

SEQ ID NO: 1122270 - DNA, 15 bp, Homo sapiens
tattggtaattaaaa

SEQ ID NO: 1122271 - DNA, 22 bp, Homo sapiens
tattggtaattaaaagactcca

SEQ ID NO: 1122272 - DNA, 19 bp, Homo sapiens
tattggtgcgtttttacag

SEQ ID NO: 1122273 - DNA, 14 bp, Homo sapiens
tattggtgcttgac

SEQ ID NO: 1122274 - DNA, 15 bp, Homo sapiens
tattgtaaaacaggt

SEQ ID NO: 1122275 - DNA, 14 bp, Homo sapiens
tattgtaaaacatt

SEQ ID NO: 1122276 - DNA, 15 bp, Homo sapiens
tattgtaaaacattc

SEQ ID NO: 1122277 - DNA, 16 bp, Homo sapiens
tattgtaaaacattca

SEQ ID NO: 1122278 - DNA, 16 bp, Homo sapiens
tattgtaaacatgtgt

SEQ ID NO: 1122279 - DNA, 18 bp, Homo sapiens
tattgtaaacatgtgttt

SEQ ID NO: 1122280 - DNA, 16 bp, Homo sapiens
tattgtaaactttttc

SEQ ID NO: 1122281 - DNA, 20 bp, Homo sapiens
tattgtaaactttttcaatg

SEQ ID NO: 1122282 - DNA, 14 bp, Homo sapiens
tattgtaaatatgt

SEQ ID NO: 1122283 - DNA, 13 bp, Homo sapiens
tattgtaaattat

SEQ ID NO: 1122284 - DNA, 18 bp, Homo sapiens
tattgtaaggtctttgta

SEQ ID NO: 1122285 - DNA, 18 bp, Homo sapiens
tattgtaatgagtgaatt

SEQ ID NO: 1122286 - DNA, 15 bp, Homo sapiens
tattgtacaaatgta

SEQ ID NO: 1122287 - DNA, 17 bp, Homo sapiens
tattgtacagactgttt

SEQ ID NO: 1122288 - DNA, 18 bp, Homo sapiens
tattgtacagactgtttt

SEQ ID NO: 1122289 - DNA, 17 bp, Homo sapiens
tattgtacagtttttat

SEQ ID NO: 1122290 - DNA, 14 bp, Homo sapiens
tattgtacataaaa

SEQ ID NO: 1122291 - DNA, 17 bp, Homo sapiens
tattgtagcatttcttg

SEQ ID NO: 1122292 - DNA, 16 bp, Homo sapiens
tattgtataaactatc

SEQ ID NO: 1122293 - DNA, 19 bp, Homo sapiens
tattgtatattacaatgat

SEQ ID NO: 1122294 - DNA, 20 bp, Homo sapiens
tattgtatattctggaaaaa

SEQ ID NO: 1122295 - DNA, 20 bp, Homo sapiens
tattgtatctgaattcctgt

SEQ ID NO: 1122296 - DNA, 14 bp, Homo sapiens
tattgtatgtaagt

SEQ ID NO: 1122297 - DNA, 17 bp, Homo sapiens
tattgtattaggaaaat

SEQ ID NO: 1122298 - DNA, 16 bp, Homo sapiens
tattgtattgttagat

SEQ ID NO: 1122299 - DNA, 15 bp, Homo sapiens
tattgtatttatgtg

SEQ ID NO: 1122300 - DNA, 22 bp, Homo sapiens
tattgtcagtatctgtatctct

SEQ ID NO: 1122301 - DNA, 17 bp, Homo sapiens
tattgtccttcagagct

SEQ ID NO: 1122302 - DNA, 23 bp, Homo sapiens
tattgtctgaacttgcattgtga

SEQ ID NO: 1122303 - DNA, 15 bp, Homo sapiens
tattgtgaagtacat

SEQ ID NO: 1122304 - DNA, 15 bp, Homo sapiens
tattgtgacttcact

SEQ ID NO: 1122305 - DNA, 15 bp, Homo sapiens
tattgtgattctgtt

SEQ ID NO: 1122306 - DNA, 17 bp, Homo sapiens
tattgtgcaatgtaaat

SEQ ID NO: 1122307 - DNA, 18 bp, Homo sapiens
tattgtgtaattgattta

SEQ ID NO: 1122308 - DNA, 22 bp, Homo sapiens
tattgtgttttgctttggaaac

SEQ ID NO: 1122309 - DNA, 17 bp, Homo sapiens
tattgttaactcttgtc

SEQ ID NO: 1122310 - DNA, 21 bp, Homo sapiens
tattgttaactcttgtctatt

SEQ ID NO: 1122311 - DNA, 22 bp, Homo sapiens
tattgttacgtagcctaaggct

SEQ ID NO: 1122312 - DNA, 13 bp, Homo sapiens
tattgttccaaga

SEQ ID NO: 1122313 - DNA, 18 bp, Homo sapiens
tattgttccaagacattg

SEQ ID NO: 1122314 - DNA, 19 bp, Homo sapiens
tattgttccaagacattgt

SEQ ID NO: 1122315 - DNA, 21 bp, Homo sapiens
tattgttccaagacattgtca

SEQ ID NO: 1122316 - DNA, 23 bp, Homo sapiens
tattgttgacaactgtgactgta

SEQ ID NO: 1122317 - DNA, 13 bp, Homo sapiens
tattgttggtaat

SEQ ID NO: 1122318 - DNA, 16 bp, Homo sapiens
tattgttgtccttttc

SEQ ID NO: 1122319 - DNA, 15 bp, Homo sapiens
tattgtttaaaattc

SEQ ID NO: 1122320 - DNA, 24 bp, Homo sapiens
tattgtttattctttttaaagtat

SEQ ID NO: 1122321 - DNA, 11 bp, Homo sapiens
tattgtttcta

SEQ ID NO: 1122322 - DNA, 20 bp, Homo sapiens
tattgtttctttaagaaagt

SEQ ID NO: 1122323 - DNA, 15 bp, Homo sapiens
tattgttttacaata

SEQ ID NO: 1122324 - DNA, 12 bp, Homo sapiens
tattgttttcag

SEQ ID NO: 1122325 - DNA, 18 bp, Homo sapiens
tattgttttcagtgtaca

SEQ ID NO: 1122326 - DNA, 12 bp, Homo sapiens
tatttttaagaa

SEQ ID NO: 1122327 - DNA, 15 bp, Homo sapiens
tatttttaatttaaa

SEQ ID NO: 1122328 - DNA, 9 bp, Homo sapiens
tatttttac

SEQ ID NO: 1122329 - DNA, 20 bp, Homo sapiens
tatttttagaataagaattt

SEQ ID NO: 1122330 - DNA, 19 bp, Homo sapiens
tatttttagactcatcaat

SEQ ID NO: 1122331 - DNA, 21 bp, Homo sapiens
tatttttatactcttcctatt

SEQ ID NO: 1122332 - DNA, 18 bp, Homo sapiens
tatttttatataatatct

SEQ ID NO: 1122333 - DNA, 19 bp, Homo sapiens
tatttttatataatatcta

SEQ ID NO: 1122334 - DNA, 20 bp, Homo sapiens
tatttttatatcatgcaaaa

SEQ ID NO: 1122335 - DNA, 21 bp, Homo sapiens
tatttttatatttcctttatg

SEQ ID NO: 1122336 - DNA, 18 bp, Homo sapiens
tatttttatcatgaattc

SEQ ID NO: 1122337 - DNA, 18 bp, Homo sapiens
tatttttatctatataaa

SEQ ID NO: 1122338 - DNA, 16 bp, Homo sapiens
tatttttatgtgcagc

SEQ ID NO: 1122339 - DNA, 15 bp, Homo sapiens
tatttttattacttt

SEQ ID NO: 1122340 - DNA, 15 bp, Homo sapiens
tatttttcaaggcat

SEQ ID NO: 1122341 - DNA, 12 bp, Homo sapiens
tatttttcaatc

SEQ ID NO: 1122342 - DNA, 15 bp, Homo sapiens
tatttttcacagttt

SEQ ID NO: 1122343 - DNA, 12 bp, Homo sapiens
tatttttcactc

SEQ ID NO: 1122344 - DNA, 14 bp, Homo sapiens
tatttttcatattg

SEQ ID NO: 1122345 - DNA, 21 bp, Homo sapiens
tatttttccatttatttatga

SEQ ID NO: 1122346 - DNA, 14 bp, Homo sapiens
tatttttccttttt

SEQ ID NO: 1122347 - DNA, 15 bp, Homo sapiens
tatttttctaaagaa

SEQ ID NO: 1122348 - DNA, 19 bp, Homo sapiens
tatttttctaaagaaatat

SEQ ID NO: 1122349 - DNA, 15 bp, Homo sapiens
tatttttctaagtgt

SEQ ID NO: 1122350 - DNA, 13 bp, Homo sapiens
tatttttctcttg

SEQ ID NO: 1122351 - DNA, 19 bp, Homo sapiens
tatttttctcttgtaccat

SEQ ID NO: 1122352 - DNA, 15 bp, Homo sapiens
tatttttctctttct

SEQ ID NO: 1122353 - DNA, 15 bp, Homo sapiens
tatttttctgttacc

SEQ ID NO: 1122354 - DNA, 19 bp, Homo sapiens
tatttttcttgctgttcag

SEQ ID NO: 1122355 - DNA, 22 bp, Homo sapiens
tatttttcttgttgcatctttt

SEQ ID NO: 1122356 - DNA, 13 bp, Homo sapiens
tatttttgcaaaa

SEQ ID NO: 1122357 - DNA, 13 bp, Homo sapiens
tatttttgccctg

SEQ ID NO: 1122358 - DNA, 11 bp, Homo sapiens
tatttttgccg

SEQ ID NO: 1122359 - DNA, 18 bp, Homo sapiens
tatttttggactggcaga

SEQ ID NO: 1122360 - DNA, 20 bp, Homo sapiens
tatttttgggtttggccagg

SEQ ID NO: 1122361 - DNA, 13 bp, Homo sapiens
tatttttgtacat

SEQ ID NO: 1122362 - DNA, 13 bp, Homo sapiens
tatttttgtactt

SEQ ID NO: 1122363 - DNA, 22 bp, Homo sapiens
tatttttgtgttttcttgtaaa

SEQ ID NO: 1122364 - DNA, 14 bp, Homo sapiens
tattttttaaaata

SEQ ID NO: 1122365 - DNA, 13 bp, Homo sapiens
tattttttaagta

SEQ ID NO: 1122366 - DNA, 15 bp, Homo sapiens
tattttttctacaca

SEQ ID NO: 1122367 - DNA, 15 bp, Homo sapiens
tattttttcttttgt

SEQ ID NO: 1122368 - DNA, 13 bp, Homo sapiens
tattttttgaaaa

SEQ ID NO: 1122369 - DNA, 15 bp, Homo sapiens
tattttttgggccat

SEQ ID NO: 1122370 - DNA, 16 bp, Homo sapiens
tattttttgggccatt

SEQ ID NO: 1122371 - DNA, 19 bp, Homo sapiens
tattttttgggccattacc

SEQ ID NO: 1122372 - DNA, 18 bp, Homo sapiens
tatttttttaaacaaaat

SEQ ID NO: 1122373 - DNA, 22 bp, Homo sapiens
tatttttttaaacaaaatttca

SEQ ID NO: 1122374 - DNA, 20 bp, Homo sapiens
tatttttttaaatcaaggaa

SEQ ID NO: 1122375 - DNA, 15 bp, Homo sapiens
tatttttttaacttt

SEQ ID NO: 1122376 - DNA, 20 bp, Homo sapiens
tatttttttaactttaccat

SEQ ID NO: 1122377 - DNA, 21 bp, Homo sapiens
tatttttttaactttaccatg

SEQ ID NO: 1122378 - DNA, 18 bp, Homo sapiens
tatttttttaatttaaca

SEQ ID NO: 1122379 - DNA, 16 bp, Homo sapiens
tatttttttgcaagtg

SEQ ID NO: 1122380 - DNA, 19 bp, Homo sapiens
tatttttttgtacagatgg

SEQ ID NO: 1122381 - DNA, 15 bp, Homo sapiens
tattttttttaaaga

SEQ ID NO: 1122382 - DNA, 17 bp, Homo sapiens
tattttttttaaagaaa

SEQ ID NO: 1122383 - DNA, 23 bp, Homo sapiens
tcaaaaaaaaaaaaaaagactgt

SEQ ID NO: 1122384 - DNA, 18 bp, Homo sapiens
tcaaaaaaaagaaaatgt

SEQ ID NO: 1122385 - DNA, 14 bp, Homo sapiens
tcaaaaaaacacta

SEQ ID NO: 1122386 - DNA, 15 bp, Homo sapiens
tcaaaaaaagaaaaa

SEQ ID NO: 1122387 - DNA, 19 bp, Homo sapiens
tcaaaaaaagactcagcca

SEQ ID NO: 1122388 - DNA, 18 bp, Homo sapiens
tcaaaaaacctttacagt

SEQ ID NO: 1122389 - DNA, 11 bp, Homo sapiens
tcaaaaaatta

SEQ ID NO: 1122390 - DNA, 15 bp, Homo sapiens
tcaaaaaccagccag

SEQ ID NO: 1122391 - DNA, 16 bp, Homo sapiens
tcaaaaaccagccagg

SEQ ID NO: 1122392 - DNA, 17 bp, Homo sapiens
tcaaaaactttggagtc

SEQ ID NO: 1122393 - DNA, 22 bp, Homo sapiens
tcaaaaactttggagtcccctc

SEQ ID NO: 1122394 - DNA, 17 bp, Homo sapiens
tcaaaaagaaatcaata

SEQ ID NO: 1122395 - DNA, 13 bp, Homo sapiens
tcaaaaagcagag

SEQ ID NO: 1122396 - DNA, 19 bp, Homo sapiens
tcaaaaagctaatgtgcag

SEQ ID NO: 1122397 - DNA, 12 bp, Homo sapiens
tcaaaaagtatt

SEQ ID NO: 1122398 - DNA, 19 bp, Homo sapiens
tcaaaaagtgtttattttt

SEQ ID NO: 1122399 - DNA, 18 bp, Homo sapiens
tcaaaaataaattagaaa

SEQ ID NO: 1122400 - DNA, 18 bp, Homo sapiens
tcaaaaatcaatatgcag

SEQ ID NO: 1122401 - DNA, 16 bp, Homo sapiens
tcaaaacactgtggaa

SEQ ID NO: 1122402 - DNA, 17 bp, Homo sapiens
tcaaaacactgtggaac

SEQ ID NO: 1122403 - DNA, 15 bp, Homo sapiens
tcaaaacagagatgt

SEQ ID NO: 1122404 - DNA, 16 bp, Homo sapiens
tcaaaacagagggctg

SEQ ID NO: 1122405 - DNA, 15 bp, Homo sapiens
tcaaaacctgcagtt

SEQ ID NO: 1122406 - DNA, 14 bp, Homo sapiens
tcaaaacctggaga

SEQ ID NO: 1122407 - DNA, 17 bp, Homo sapiens
tcaaaacctgtgccagg

SEQ ID NO: 1122408 - DNA, 15 bp, Homo sapiens
tcaaaaccttttgaa

SEQ ID NO: 1122409 - DNA, 16 bp, Homo sapiens
tcaaaacgggtcagta

SEQ ID NO: 1122410 - DNA, 21 bp, Homo sapiens
tcaaaacgtgatgttttgaat

SEQ ID NO: 1122411 - DNA, 24 bp, Homo sapiens
tcaaaactggagtcccaaatgtca

SEQ ID NO: 1122412 - DNA, 20 bp, Homo sapiens
tcaaaacttggacccttgga

SEQ ID NO: 1122413 - DNA, 23 bp, Homo sapiens
tcaaaacttggacccttggaaaa

SEQ ID NO: 1122414 - DNA, 18 bp, Homo sapiens
tcaaaagaaaaggcaaaa

SEQ ID NO: 1122415 - DNA, 21 bp, Homo sapiens
tcaaaagaatctattagattt

SEQ ID NO: 1122416 - DNA, 23 bp, Homo sapiens
tcaaaagagccctggctctgccc

SEQ ID NO: 1122417 - DNA, 18 bp, Homo sapiens
tcaaaagcaaatgagatc

SEQ ID NO: 1122418 - DNA, 18 bp, Homo sapiens
tcaaaagccataacttga

SEQ ID NO: 1122419 - DNA, 22 bp, Homo sapiens
tcaaaagctatttaaagcatct

SEQ ID NO: 1122420 - DNA, 21 bp, Homo sapiens
tcaaaaggaaccaggaggttt

SEQ ID NO: 1122421 - DNA, 14 bp, Homo sapiens
tcaaaagtattgaa

SEQ ID NO: 1122422 - DNA, 14 bp, Homo sapiens
tcaaaagtttgttt

SEQ ID NO: 1122423 - DNA, 13 bp, Homo sapiens
tcaaaatactact

SEQ ID NO: 1122424 - DNA, 13 bp, Homo sapiens
tcaaaatatgtca

SEQ ID NO: 1122425 - DNA, 19 bp, Homo sapiens
tcaaaatatgtcaacttaa

SEQ ID NO: 1122426 - DNA, 20 bp, Homo sapiens
tcaaaatattgagcagaatt

SEQ ID NO: 1122427 - DNA, 19 bp, Homo sapiens
tcaaaatatttaaaaatgt

SEQ ID NO: 1122428 - DNA, 16 bp, Homo sapiens
tcaaaatatttgtaca

SEQ ID NO: 1122429 - DNA, 17 bp, Homo sapiens
tcaaaatatttgtacat

SEQ ID NO: 1122430 - DNA, 17 bp, Homo sapiens
tcaaaatcagtttttca

SEQ ID NO: 1122431 - DNA, 12 bp, Homo sapiens
tcaaaatctttc

SEQ ID NO: 1122432 - DNA, 17 bp, Homo sapiens
tcaaaatctttgtataa

SEQ ID NO: 1122433 - DNA, 23 bp, Homo sapiens
tcaaaatgctctaatgagcattt

SEQ ID NO: 1122434 - DNA, 14 bp, Homo sapiens
tcaaaatgtctgta

SEQ ID NO: 1122435 - DNA, 16 bp, Homo sapiens
tcaaaatgttctattt

SEQ ID NO: 1122436 - DNA, 16 bp, Homo sapiens
tcaaaattaatagctt

SEQ ID NO: 1122437 - DNA, 17 bp, Homo sapiens
tcaaaattccaaatttt

SEQ ID NO: 1122438 - DNA, 12 bp, Homo sapiens
tcaaaatttaaa

SEQ ID NO: 1122439 - DNA, 20 bp, Homo sapiens
tcaaaattttaaaaatacca

SEQ ID NO: 1122440 - DNA, 11 bp, Homo sapiens
tcaaacacagt

SEQ ID NO: 1122441 - DNA, 22 bp, Homo sapiens
tcaaacagccccagtcttcctt

SEQ ID NO: 1122442 - DNA, 22 bp, Homo sapiens
tcaaacattcgtgagctgggga

SEQ ID NO: 1122443 - DNA, 15 bp, Homo sapiens
tcaaacattttctgg

SEQ ID NO: 1122444 - DNA, 12 bp, Homo sapiens
tcaaacattttg

SEQ ID NO: 1122445 - DNA, 13 bp, Homo sapiens
tcaaacattttgt

SEQ ID NO: 1122446 - DNA, 21 bp, Homo sapiens
tcaaacattttgtatcaagga

SEQ ID NO: 1122447 - DNA, 19 bp, Homo sapiens
tcaaaccaatttcttcctt

SEQ ID NO: 1122448 - DNA, 13 bp, Homo sapiens
tcaaaccaggatt

SEQ ID NO: 1122449 - DNA, 19 bp, Homo sapiens
tcaagcaatcctcctgcct

SEQ ID NO: 1122450 - DNA, 19 bp, Homo sapiens
tcaagcaatcgagatttgg

SEQ ID NO: 1122451 - DNA, 16 bp, Homo sapiens
tcaagcacatgtaata

SEQ ID NO: 1122452 - DNA, 19 bp, Homo sapiens
tcaagcaccaggaagtgtt

SEQ ID NO: 1122453 - DNA, 23 bp, Homo sapiens
tcaagcagcgaccgccccctcct

SEQ ID NO: 1122454 - DNA, 17 bp, Homo sapiens
tcaagcaggaattatgt

SEQ ID NO: 1122455 - DNA, 17 bp, Homo sapiens
tcaagcagtcgtgcctg

SEQ ID NO: 1122456 - DNA, 19 bp, Homo sapiens
tcaagcagtcgtgcctgtg

SEQ ID NO: 1122457 - DNA, 23 bp, Homo sapiens
tcaagcagtcgtgcctgtgtcca

SEQ ID NO: 1122458 - DNA, 17 bp, Homo sapiens
tcaagcatattggaaag

SEQ ID NO: 1122459 - DNA, 14 bp, Homo sapiens
tcaagcatgaagat

SEQ ID NO: 1122460 - DNA, 23 bp, Homo sapiens
tcaagccagccccctccagctca

SEQ ID NO: 1122461 - DNA, 13 bp, Homo sapiens
tcaagccagcctg

SEQ ID NO: 1122462 - DNA, 21 bp, Homo sapiens
tcaagccatgtgctttagcat

SEQ ID NO: 1122463 - DNA, 18 bp, Homo sapiens
tcaagccccatttcctca

SEQ ID NO: 1122464 - DNA, 16 bp, Homo sapiens
tcaagcccgcggggac

SEQ ID NO: 1122465 - DNA, 17 bp, Homo sapiens
tcaagcctctaaacaga

SEQ ID NO: 1122466 - DNA, 18 bp, Homo sapiens
tcaagcctgtgcaaaaaa

SEQ ID NO: 1122467 - DNA, 19 bp, Homo sapiens
tcaagcctttatggctgct

SEQ ID NO: 1122468 - DNA, 15 bp, Homo sapiens
tcaagcgctccaggg

SEQ ID NO: 1122469 - DNA, 17 bp, Homo sapiens
tcaagcgctccagggcc

SEQ ID NO: 1122470 - DNA, 19 bp, Homo sapiens
tcaagctaagtaaaaatat

SEQ ID NO: 1122471 - DNA, 20 bp, Homo sapiens
tcaagctaagtaaaaatatg

SEQ ID NO: 1122472 - DNA, 16 bp, Homo sapiens
tcaagctagccagagg

SEQ ID NO: 1122473 - DNA, 14 bp, Homo sapiens
tcaagctagtgttt

SEQ ID NO: 1122474 - DNA, 20 bp, Homo sapiens
tcaagctcctcctccctgca

SEQ ID NO: 1122475 - DNA, 15 bp, Homo sapiens
tcaagctgagaaaag

SEQ ID NO: 1122476 - DNA, 21 bp, Homo sapiens
tcaagctgtgagacagtggga

SEQ ID NO: 1122477 - DNA, 16 bp, Homo sapiens
tcaagcttaatatgtg

SEQ ID NO: 1122478 - DNA, 22 bp, Homo sapiens
tcaagcttttgcttgatccaga

SEQ ID NO: 1122479 - DNA, 14 bp, Homo sapiens
tcaaggaaacgttt

SEQ ID NO: 1122480 - DNA, 21 bp, Homo sapiens
tcaaggaaaggctcatttaaa

SEQ ID NO: 1122481 - DNA, 19 bp, Homo sapiens
tcaaggaaagggggtccca

SEQ ID NO: 1122482 - DNA, 21 bp, Homo sapiens
tcaaggaaagggggtcccagt

SEQ ID NO: 1122483 - DNA, 19 bp, Homo sapiens
tcaaggaagggacaagaca

SEQ ID NO: 1122484 - DNA, 15 bp, Homo sapiens
tcaaggacaggagcc

SEQ ID NO: 1122485 - DNA, 16 bp, Homo sapiens
tcaaggacaggagcct

SEQ ID NO: 1122486 - DNA, 15 bp, Homo sapiens
tcaaggacagggctg

SEQ ID NO: 1122487 - DNA, 13 bp, Homo sapiens
tcaaggaccaaga

SEQ ID NO: 1122488 - DNA, 18 bp, Homo sapiens
tcaaggacttgaaagcat

SEQ ID NO: 1122489 - DNA, 16 bp, Homo sapiens
tcaaggatgtttttct

SEQ ID NO: 1122490 - DNA, 20 bp, Homo sapiens
tcaaggattttcatgttgat

SEQ ID NO: 1122491 - DNA, 17 bp, Homo sapiens
tcaaggcaaaaggaatt

SEQ ID NO: 1122492 - DNA, 23 bp, Homo sapiens
tcaaggcagggaaggggccatga

SEQ ID NO: 1122493 - DNA, 14 bp, Homo sapiens
tcaaggccaataat

SEQ ID NO: 1122494 - DNA, 21 bp, Homo sapiens
tcaaggccaataataaagaca

SEQ ID NO: 1122495 - DNA, 19 bp, Homo sapiens
tcaaggccacaaaaacaat

SEQ ID NO: 1122496 - DNA, 21 bp, Homo sapiens
tcaaggccgagggccaggcag

SEQ ID NO: 1122497 - DNA, 17 bp, Homo sapiens
tcaaggctgcttagaat

SEQ ID NO: 1122498 - DNA, 15 bp, Homo sapiens
tcaaggctggggcat

SEQ ID NO: 1122499 - DNA, 16 bp, Homo sapiens
tcaaggctggggcatg

SEQ ID NO: 1122500 - DNA, 20 bp, Homo sapiens
tcaagggaaaaccccgtctc

SEQ ID NO: 1122501 - DNA, 14 bp, Homo sapiens
tcaagggctgtagg

SEQ ID NO: 1122502 - DNA, 13 bp, Homo sapiens
tcaaggggcaggg

SEQ ID NO: 1122503 - DNA, 14 bp, Homo sapiens
tcaagggggtgaca

SEQ ID NO: 1122504 - DNA, 16 bp, Homo sapiens
tcaagggtggcaggtc

SEQ ID NO: 1122505 - DNA, 13 bp, Homo sapiens
tcaagggttcttt

SEQ ID NO: 1122506 - DNA, 16 bp, Homo sapiens
tcaagggttgcttctg

SEQ ID NO: 1122507 - DNA, 15 bp, Homo sapiens
tcaaggtcactgttt

SEQ ID NO: 1122508 - DNA, 18 bp, Homo sapiens
tcaaggtcactgtttcct

SEQ ID NO: 1122509 - DNA, 22 bp, Homo sapiens
tcaaggtgatatataatttcct

SEQ ID NO: 1122510 - DNA, 15 bp, Homo sapiens
tcaaggttttaaaac

SEQ ID NO: 1122511 - DNA, 16 bp, Homo sapiens
tcaagtaattgtgaaa

SEQ ID NO: 1122512 - DNA, 14 bp, Homo sapiens
tcaagtaattttca

SEQ ID NO: 1122513 - DNA, 20 bp, Homo sapiens
tcaagtaattttcatattaa

SEQ ID NO: 1122514 - DNA, 15 bp, Homo sapiens
tcaagtatagaaaat

SEQ ID NO: 1122515 - DNA, 12 bp, Homo sapiens
tcaagtattact

SEQ ID NO: 1122516 - DNA, 11 bp, Homo sapiens
tcaagtattat

SEQ ID NO: 1122517 - DNA, 16 bp, Homo sapiens
tcaagtattatacctt

SEQ ID NO: 1122518 - DNA, 22 bp, Homo sapiens
tcaagtatttattattgaagat

SEQ ID NO: 1122519 - DNA, 12 bp, Homo sapiens
tcaagtatttgg

SEQ ID NO: 1122520 - DNA, 18 bp, Homo sapiens
tcaagtcccttgttttgt

SEQ ID NO: 1122521 - DNA, 22 bp, Homo sapiens
tcaagtccttacctcttccgga

SEQ ID NO: 1122522 - DNA, 14 bp, Homo sapiens
tcaagtctctgctg

SEQ ID NO: 1122523 - DNA, 17 bp, Homo sapiens
tcaagtctctgctggcc

SEQ ID NO: 1122524 - DNA, 17 bp, Homo sapiens
tcaagtgataggataaa

SEQ ID NO: 1122525 - DNA, 19 bp, Homo sapiens
tcaagtgattctcctgcct

SEQ ID NO: 1122526 - DNA, 22 bp, Homo sapiens
tcaagtgattctcctgcctcag

SEQ ID NO: 1122527 - DNA, 17 bp, Homo sapiens
tcaagtgcctcttgttg

SEQ ID NO: 1122528 - DNA, 19 bp, Homo sapiens
tcaagtgcctcttgttgca

SEQ ID NO: 1122529 - DNA, 12 bp, Homo sapiens
tcaagtgcctta

SEQ ID NO: 1122530 - DNA, 16 bp, Homo sapiens
tcaagtgcttaaaaat

SEQ ID NO: 1122531 - DNA, 22 bp, Homo sapiens
tcaagttccatgcttgagcaat

SEQ ID NO: 1122532 - DNA, 16 bp, Homo sapiens
tcaagttcccaactga

SEQ ID NO: 1122533 - DNA, 17 bp, Homo sapiens
tcaagttgagattttta

SEQ ID NO: 1122534 - DNA, 16 bp, Homo sapiens
tcaagttgattagaaa

SEQ ID NO: 1122535 - DNA, 16 bp, Homo sapiens
tcaagttgtaaaaatg

SEQ ID NO: 1122536 - DNA, 22 bp, Homo sapiens
tcaagttgtgcttgtttacagc

SEQ ID NO: 1122537 - DNA, 23 bp, Homo sapiens
tcaagttgttgactgtgattaga

SEQ ID NO: 1122538 - DNA, 17 bp, Homo sapiens
tcaagtttaaaagccat

SEQ ID NO: 1122539 - DNA, 12 bp, Homo sapiens
tcaagtttacac

SEQ ID NO: 1122540 - DNA, 17 bp, Homo sapiens
tcaagtttacacttcat

SEQ ID NO: 1122541 - DNA, 18 bp, Homo sapiens
tcaagtttgaccagtgca

SEQ ID NO: 1122542 - DNA, 16 bp, Homo sapiens
tcaataaaaaaaagaa

SEQ ID NO: 1122543 - DNA, 22 bp, Homo sapiens
tcaataaaaaaaagaaatgaaa

SEQ ID NO: 1122544 - DNA, 16 bp, Homo sapiens
tcaataaaagagctgt

SEQ ID NO: 1122545 - DNA, 22 bp, Homo sapiens
tcaataaaagagctgtctgact

SEQ ID NO: 1122546 - DNA, 16 bp, Homo sapiens
tcaataaaatgtgatt

SEQ ID NO: 1122547 - DNA, 19 bp, Homo sapiens
tcaataaaatgtgattttt

SEQ ID NO: 1122548 - DNA, 22 bp, Homo sapiens
tcaataaaatgtgatttttctg

SEQ ID NO: 1122549 - DNA, 14 bp, Homo sapiens
tcaataaacagctt

SEQ ID NO: 1122550 - DNA, 21 bp, Homo sapiens
tcaataaacttagaggaaaat

SEQ ID NO: 1122551 - DNA, 21 bp, Homo sapiens
tcaataaagaaaacttccata

SEQ ID NO: 1122552 - DNA, 18 bp, Homo sapiens
tcaataaagcactgagca

SEQ ID NO: 1122553 - DNA, 13 bp, Homo sapiens
tcaataaagcaga

SEQ ID NO: 1122554 - DNA, 19 bp, Homo sapiens
tcaataaagcagagccaag

SEQ ID NO: 1122555 - DNA, 15 bp, Homo sapiens
tcaataaagtaccct

SEQ ID NO: 1122556 - DNA, 18 bp, Homo sapiens
tcaataaatcgtgctggg

SEQ ID NO: 1122557 - DNA, 12 bp, Homo sapiens
tcaataaatctt

SEQ ID NO: 1122558 - DNA, 13 bp, Homo sapiens
tcaataaatgaca

SEQ ID NO: 1122559 - DNA, 12 bp, Homo sapiens
tcaataataaaa

SEQ ID NO: 1122560 - DNA, 20 bp, Homo sapiens
tcaataatatattttctgtt

SEQ ID NO: 1122561 - DNA, 14 bp, Homo sapiens
tcaatacactagtt

SEQ ID NO: 1122562 - DNA, 20 bp, Homo sapiens
tcaatacagacaaggttctg

SEQ ID NO: 1122563 - DNA, 14 bp, Homo sapiens
tcaatacagcttca

SEQ ID NO: 1122564 - DNA, 19 bp, Homo sapiens
tcaatacagtgaaggtctt

SEQ ID NO: 1122565 - DNA, 21 bp, Homo sapiens
tcaatactgtatgccttctgt

SEQ ID NO: 1122566 - DNA, 17 bp, Homo sapiens
tcaatagcgtgtgtaga

SEQ ID NO: 1122567 - DNA, 12 bp, Homo sapiens
tcaatagttgaa

SEQ ID NO: 1122568 - DNA, 15 bp, Homo sapiens
tcaatagttgaatta

SEQ ID NO: 1122569 - DNA, 15 bp, Homo sapiens
tcaatataagaagca

SEQ ID NO: 1122570 - DNA, 22 bp, Homo sapiens
tcaatataatgtttttaatatt

SEQ ID NO: 1122571 - DNA, 21 bp, Homo sapiens
tcacagtctctttaatcttca

SEQ ID NO: 1122572 - DNA, 16 bp, Homo sapiens
tcacagtgaacactca

SEQ ID NO: 1122573 - DNA, 13 bp, Homo sapiens
tcacagtgtgttt

SEQ ID NO: 1122574 - DNA, 14 bp, Homo sapiens
tcacagtgttgcat

SEQ ID NO: 1122575 - DNA, 11 bp, Homo sapiens
tcacagtgttt

SEQ ID NO: 1122576 - DNA, 14 bp, Homo sapiens
tcacagtgtttgca

SEQ ID NO: 1122577 - DNA, 23 bp, Homo sapiens
tcacagttcaaaattctaaatgt

SEQ ID NO: 1122578 - DNA, 14 bp, Homo sapiens
tcacagttcctcgc

SEQ ID NO: 1122579 - DNA, 19 bp, Homo sapiens
tcacagttcctcgccctgg

SEQ ID NO: 1122580 - DNA, 22 bp, Homo sapiens
tcacagttcctcgccctgggtc

SEQ ID NO: 1122581 - DNA, 13 bp, Homo sapiens
tcacagttgacaa

SEQ ID NO: 1122582 - DNA, 17 bp, Homo sapiens
tcacataagctcagaat

SEQ ID NO: 1122583 - DNA, 20 bp, Homo sapiens
tcacataattccagtcacag

SEQ ID NO: 1122584 - DNA, 14 bp, Homo sapiens
tcacataccctccc

SEQ ID NO: 1122585 - DNA, 20 bp, Homo sapiens
tcacatactgacttcagtgg

SEQ ID NO: 1122586 - DNA, 17 bp, Homo sapiens
tcacatagagtgatctt

SEQ ID NO: 1122587 - DNA, 14 bp, Homo sapiens
tcacatagcccact

SEQ ID NO: 1122588 - DNA, 20 bp, Homo sapiens
tcacataggaagggatctga

SEQ ID NO: 1122589 - DNA, 21 bp, Homo sapiens
tcacataggaagggatctgag

SEQ ID NO: 1122590 - DNA, 14 bp, Homo sapiens
tcacatattttaaa

SEQ ID NO: 1122591 - DNA, 17 bp, Homo sapiens
tcacatccatctacttt

SEQ ID NO: 1122592 - DNA, 19 bp, Homo sapiens
tcacatcctcctgcccagc

SEQ ID NO: 1122593 - DNA, 19 bp, Homo sapiens
tcacatcctggcctggcac

SEQ ID NO: 1122594 - DNA, 23 bp, Homo sapiens
tcacatcctggcctggcacatca

SEQ ID NO: 1122595 - DNA, 14 bp, Homo sapiens
tcacatctctgcct

SEQ ID NO: 1122596 - DNA, 21 bp, Homo sapiens
tcacatcttaaattcatttct

SEQ ID NO: 1122597 - DNA, 17 bp, Homo sapiens
tcacatgaattattaca

SEQ ID NO: 1122598 - DNA, 21 bp, Homo sapiens
tcacatgaattattacagtgt

SEQ ID NO: 1122599 - DNA, 21 bp, Homo sapiens
tcacatgatgcacttcaaatt

SEQ ID NO: 1122600 - DNA, 23 bp, Homo sapiens
tcacatgattatagaaggctgtc

SEQ ID NO: 1122601 - DNA, 23 bp, Homo sapiens
tcacatgcacatttcaaaacaag

SEQ ID NO: 1122602 - DNA, 15 bp, Homo sapiens
tcacatgggacaaag

SEQ ID NO: 1122603 - DNA, 18 bp, Homo sapiens
tcacatggtgcccctagc

SEQ ID NO: 1122604 - DNA, 19 bp, Homo sapiens
tcacatgtggcaaaatatg

SEQ ID NO: 1122605 - DNA, 22 bp, Homo sapiens
tcacattaaaaaatgaaatatt

SEQ ID NO: 1122606 - DNA, 13 bp, Homo sapiens
tcacattagaatt

SEQ ID NO: 1122607 - DNA, 20 bp, Homo sapiens
tcacattaggggaaccattg

SEQ ID NO: 1122608 - DNA, 18 bp, Homo sapiens
tcacattatttattaaaa

SEQ ID NO: 1122609 - DNA, 19 bp, Homo sapiens
tcacattatttattaaaaa

SEQ ID NO: 1122610 - DNA, 20 bp, Homo sapiens
tcacattatttattaaaaat

SEQ ID NO: 1122611 - DNA, 21 bp, Homo sapiens
tcacattatttattaaaaatg

SEQ ID NO: 1122612 - DNA, 16 bp, Homo sapiens
tcacattccagtctga

SEQ ID NO: 1122613 - DNA, 12 bp, Homo sapiens
tcacattctgct

SEQ ID NO: 1122614 - DNA, 14 bp, Homo sapiens
tcacattctgctta

SEQ ID NO: 1122615 - DNA, 13 bp, Homo sapiens
tcacattgatcat

SEQ ID NO: 1122616 - DNA, 23 bp, Homo sapiens
tcacattgtaactgaacttcagg

SEQ ID NO: 1122617 - DNA, 18 bp, Homo sapiens
tcacattgttaagaaaaa

SEQ ID NO: 1122618 - DNA, 15 bp, Homo sapiens
tcacatttgaattct

SEQ ID NO: 1122619 - DNA, 17 bp, Homo sapiens
tcacatttgatgtacat

SEQ ID NO: 1122620 - DNA, 22 bp, Homo sapiens
tcacatttgatgtacatgtgta

SEQ ID NO: 1122621 - DNA, 22 bp, Homo sapiens
tcacattttaagtgcttcacat

SEQ ID NO: 1122622 - DNA, 18 bp, Homo sapiens
tcacattttccttttcaa

SEQ ID NO: 1122623 - DNA, 17 bp, Homo sapiens
tcacattttgttaagaa

SEQ ID NO: 1122624 - DNA, 21 bp, Homo sapiens
tcacatttttaaaagaacaat

SEQ ID NO: 1122625 - DNA, 17 bp, Homo sapiens
tcacatttttttctacc

SEQ ID NO: 1122626 - DNA, 14 bp, Homo sapiens
tcaccaaagtatta

SEQ ID NO: 1122627 - DNA, 17 bp, Homo sapiens
tcaccaaagtatttttt

SEQ ID NO: 1122628 - DNA, 20 bp, Homo sapiens
tcaccaaatcagctgctact

SEQ ID NO: 1122629 - DNA, 21 bp, Homo sapiens
tcaccaaatcagctgctacta

SEQ ID NO: 1122630 - DNA, 15 bp, Homo sapiens
tcaccaacacagttg

SEQ ID NO: 1122631 - DNA, 22 bp, Homo sapiens
tcaccaacacagttgggaccca

SEQ ID NO: 1122632 - DNA, 16 bp, Homo sapiens
tcaccaacttgccaca

SEQ ID NO: 1122633 - DNA, 20 bp, Homo sapiens
tcaccaagctcacagttcct

SEQ ID NO: 1122634 - DNA, 17 bp, Homo sapiens
tcaccaaggcagtgcat

SEQ ID NO: 1122635 - DNA, 20 bp, Homo sapiens
tcaccaaggcagtgcatgca

SEQ ID NO: 1122636 - DNA, 15 bp, Homo sapiens
tcaccaatgagcctt

SEQ ID NO: 1122637 - DNA, 12 bp, Homo sapiens
tcaccaccaccc

SEQ ID NO: 1122638 - DNA, 19 bp, Homo sapiens
tcaccacccagcccttcct

SEQ ID NO: 1122639 - DNA, 15 bp, Homo sapiens
tcaccacccccactg

SEQ ID NO: 1122640 - DNA, 17 bp, Homo sapiens
tcaccaccccctgtccc

SEQ ID NO: 1122641 - DNA, 22 bp, Homo sapiens
tcaccaccccctgtcccattct

SEQ ID NO: 1122642 - DNA, 13 bp, Homo sapiens
tcaccaccgcctc

SEQ ID NO: 1122643 - DNA, 15 bp, Homo sapiens
tcaccaccgcctctg

SEQ ID NO: 1122644 - DNA, 20 bp, Homo sapiens
tcaccaccgcctctggccgc

SEQ ID NO: 1122645 - DNA, 13 bp, Homo sapiens
tcaccacctctcc

SEQ ID NO: 1122646 - DNA, 16 bp, Homo sapiens
tcaccaccttcccagc

SEQ ID NO: 1122647 - DNA, 21 bp, Homo sapiens
tcaccacgtggggctcacttt

SEQ ID NO: 1122648 - DNA, 18 bp, Homo sapiens
tcaccactaccagccagc

SEQ ID NO: 1122649 - DNA, 19 bp, Homo sapiens
tcaccactaccagccagcc

SEQ ID NO: 1122650 - DNA, 16 bp, Homo sapiens
tcaccactgccccctg

SEQ ID NO: 1122651 - DNA, 23 bp, Homo sapiens
tcaccagccccactgccagcagc

SEQ ID NO: 1122652 - DNA, 18 bp, Homo sapiens
tcaccagccctgcagccc

SEQ ID NO: 1122653 - DNA, 19 bp, Homo sapiens
tcaccagctatctgtcatc

SEQ ID NO: 1122654 - DNA, 14 bp, Homo sapiens
tcaccagctgcctc

SEQ ID NO: 1122655 - DNA, 17 bp, Homo sapiens
tcaccagctgcctcttc

SEQ ID NO: 1122656 - DNA, 12 bp, Homo sapiens
tcaccagctgct

SEQ ID NO: 1122657 - DNA, 13 bp, Homo sapiens
tcaccagctgctg

SEQ ID NO: 1122658 - DNA, 12 bp, Homo sapiens
tcaccagctggg

SEQ ID NO: 1122659 - DNA, 22 bp, Homo sapiens
tcaccaggaatgttaaagtcag

SEQ ID NO: 1122660 - DNA, 23 bp, Homo sapiens
tcaccagggtccgcaccagctgc

SEQ ID NO: 1122661 - DNA, 21 bp, Homo sapiens
tcaccaggtgcatctgcaggc

SEQ ID NO: 1122662 - DNA, 13 bp, Homo sapiens
tcaccagtggcct

SEQ ID NO: 1122663 - DNA, 21 bp, Homo sapiens
tcaccagtgttcctgaagctg

SEQ ID NO: 1122664 - DNA, 17 bp, Homo sapiens
tcaccatctacctgctt

SEQ ID NO: 1122665 - DNA, 14 bp, Homo sapiens
tcaccatctcaggc

SEQ ID NO: 1122666 - DNA, 15 bp, Homo sapiens
tcaccatctcaggcc

SEQ ID NO: 1122667 - DNA, 16 bp, Homo sapiens
tcaccatgatcactta

SEQ ID NO: 1122668 - DNA, 14 bp, Homo sapiens
tcaccatgttagcc

SEQ ID NO: 1122669 - DNA, 20 bp, Homo sapiens
tcaccatgttggtcaggctg

SEQ ID NO: 1122670 - DNA, 21 bp, Homo sapiens
tcaccatgttggtcaggctgg

SEQ ID NO: 1122671 - DNA, 13 bp, Homo sapiens
tcaccattcccag

SEQ ID NO: 1122672 - DNA, 20 bp, Homo sapiens
tcaccattggacagtctccc

SEQ ID NO: 1122673 - DNA, 23 bp, Homo sapiens
tcaccattggacagtctccctga

SEQ ID NO: 1122674 - DNA, 14 bp, Homo sapiens
tcaccatttcttgg

SEQ ID NO: 1122675 - DNA, 23 bp, Homo sapiens
tcaccatttggcaatgccatcat

SEQ ID NO: 1122676 - DNA, 19 bp, Homo sapiens
tcacccaaacacttctgct

SEQ ID NO: 1122677 - DNA, 23 bp, Homo sapiens
tcacccaaacacttctgctttca

SEQ ID NO: 1122678 - DNA, 19 bp, Homo sapiens
tcacccaagagattgttgt

SEQ ID NO: 1122679 - DNA, 19 bp, Homo sapiens
tcacccaagcaaggccaaa

SEQ ID NO: 1122680 - DNA, 11 bp, Homo sapiens
tcacccacagg

SEQ ID NO: 1122681 - DNA, 12 bp, Homo sapiens
tcacccacaggg

SEQ ID NO: 1122682 - DNA, 15 bp, Homo sapiens
tcacccacagggcta

SEQ ID NO: 1122683 - DNA, 22 bp, Homo sapiens
tcacccacagggctaagagcta

SEQ ID NO: 1122684 - DNA, 12 bp, Homo sapiens
tcacccaccagc

SEQ ID NO: 1122685 - DNA, 14 bp, Homo sapiens
tcacccaccatgga

SEQ ID NO: 1122686 - DNA, 14 bp, Homo sapiens
tcacccacccctgc

SEQ ID NO: 1122687 - DNA, 13 bp, Homo sapiens
tcacccactccta

SEQ ID NO: 1122688 - DNA, 18 bp, Homo sapiens
tcacccagatcaggaacc

SEQ ID NO: 1122689 - DNA, 23 bp, Homo sapiens
tcacccagatcaggaaccagggc

SEQ ID NO: 1122690 - DNA, 12 bp, Homo sapiens
tcacccaggctc

SEQ ID NO: 1122691 - DNA, 21 bp, Homo sapiens
tcacccagttggtgactggga

SEQ ID NO: 1122692 - DNA, 17 bp, Homo sapiens
tcacccatgaagacagg

SEQ ID NO: 1122693 - DNA, 18 bp, Homo sapiens
tcactgaaaacatctgga

SEQ ID NO: 1122694 - DNA, 20 bp, Homo sapiens
tcactgaaaacatctggaag

SEQ ID NO: 1122695 - DNA, 15 bp, Homo sapiens
tcactgaacatgcct

SEQ ID NO: 1122696 - DNA, 14 bp, Homo sapiens
tcactgaaccactg

SEQ ID NO: 1122697 - DNA, 16 bp, Homo sapiens
tcactgaaccactgct

SEQ ID NO: 1122698 - DNA, 19 bp, Homo sapiens
tcactgaaccactgcttct

SEQ ID NO: 1122699 - DNA, 14 bp, Homo sapiens
tcactgaagcctgc

SEQ ID NO: 1122700 - DNA, 14 bp, Homo sapiens
tcactgaatttata

SEQ ID NO: 1122701 - DNA, 18 bp, Homo sapiens
tcactgagaccaaggctt

SEQ ID NO: 1122702 - DNA, 12 bp, Homo sapiens
tcactgagagct

SEQ ID NO: 1122703 - DNA, 17 bp, Homo sapiens
tcactgagagtcaggag

SEQ ID NO: 1122704 - DNA, 19 bp, Homo sapiens
tcactgagcacagtcaggg

SEQ ID NO: 1122705 - DNA, 22 bp, Homo sapiens
tcactgagcacagtcaggggct

SEQ ID NO: 1122706 - DNA, 17 bp, Homo sapiens
tcactgagccatcattt

SEQ ID NO: 1122707 - DNA, 11 bp, Homo sapiens
tcactgagcct

SEQ ID NO: 1122708 - DNA, 12 bp, Homo sapiens
tcactgagcctc

SEQ ID NO: 1122709 - DNA, 16 bp, Homo sapiens
tcactgagctccccag

SEQ ID NO: 1122710 - DNA, 13 bp, Homo sapiens
tcactgaggccat

SEQ ID NO: 1122711 - DNA, 22 bp, Homo sapiens
tcactgaggccatcagggccct

SEQ ID NO: 1122712 - DNA, 21 bp, Homo sapiens
tcactgatgtacaattaaaaa

SEQ ID NO: 1122713 - DNA, 18 bp, Homo sapiens
tcactgcaacctctgcct

SEQ ID NO: 1122714 - DNA, 21 bp, Homo sapiens
tcactgcaacctctgcctccc

SEQ ID NO: 1122715 - DNA, 20 bp, Homo sapiens
tcactgcaaccttcacctcc

SEQ ID NO: 1122716 - DNA, 20 bp, Homo sapiens
tcactgcacagtgcatctca

SEQ ID NO: 1122717 - DNA, 20 bp, Homo sapiens
tcactgcagcctcaacctcc

SEQ ID NO: 1122718 - DNA, 18 bp, Homo sapiens
tcactgcagccttgtcct

SEQ ID NO: 1122719 - DNA, 19 bp, Homo sapiens
tcactgcagcgcgctcctg

SEQ ID NO: 1122720 - DNA, 17 bp, Homo sapiens
tcactgcagtcttattt

SEQ ID NO: 1122721 - DNA, 16 bp, Homo sapiens
tcactgcattttgttt

SEQ ID NO: 1122722 - DNA, 20 bp, Homo sapiens
tcactgccacactctccatc

SEQ ID NO: 1122723 - DNA, 11 bp, Homo sapiens
tcactgccagg

SEQ ID NO: 1122724 - DNA, 19 bp, Homo sapiens
tcactgccaggccagcctc

SEQ ID NO: 1122725 - DNA, 16 bp, Homo sapiens
tcactgccatgatagc

SEQ ID NO: 1122726 - DNA, 17 bp, Homo sapiens
tcactgcccaccaaagg

SEQ ID NO: 1122727 - DNA, 18 bp, Homo sapiens
tcactgcccaccaaaggt

SEQ ID NO: 1122728 - DNA, 16 bp, Homo sapiens
tcactgccccacttct

SEQ ID NO: 1122729 - DNA, 23 bp, Homo sapiens
tcactgccccacttctggcatgg

SEQ ID NO: 1122730 - DNA, 17 bp, Homo sapiens
tcactgccctccctcgg

SEQ ID NO: 1122731 - DNA, 16 bp, Homo sapiens
tcactgccgacatccc

SEQ ID NO: 1122732 - DNA, 15 bp, Homo sapiens
tcactgcctggtaaa

SEQ ID NO: 1122733 - DNA, 16 bp, Homo sapiens
tcactgcctggtaaaa

SEQ ID NO: 1122734 - DNA, 20 bp, Homo sapiens
tcactgcctggtaaaattaa

SEQ ID NO: 1122735 - DNA, 14 bp, Homo sapiens
tcactgcctgtaga

SEQ ID NO: 1122736 - DNA, 17 bp, Homo sapiens
tcactgctcccccgtgt

SEQ ID NO: 1122737 - DNA, 19 bp, Homo sapiens
tcactgctgagtttctgtt

SEQ ID NO: 1122738 - DNA, 14 bp, Homo sapiens
tcactgctgcaagg

SEQ ID NO: 1122739 - DNA, 13 bp, Homo sapiens
tcactgctgctac

SEQ ID NO: 1122740 - DNA, 16 bp, Homo sapiens
tcactgctgctactgc

SEQ ID NO: 1122741 - DNA, 22 bp, Homo sapiens
tcactgctgctactgcccctct

SEQ ID NO: 1122742 - DNA, 18 bp, Homo sapiens
tcactgctggggagtccc

SEQ ID NO: 1122743 - DNA, 22 bp, Homo sapiens
tcactgctgtgagtgcgcctca

SEQ ID NO: 1122744 - DNA, 15 bp, Homo sapiens
tcactgcttaacttc

SEQ ID NO: 1122745 - DNA, 18 bp, Homo sapiens
tcactgcttaacttcaca

SEQ ID NO: 1122746 - DNA, 19 bp, Homo sapiens
tcactgcttgaactaggct

SEQ ID NO: 1122747 - DNA, 22 bp, Homo sapiens
tcactggagcaccaggcacgaa

SEQ ID NO: 1122748 - DNA, 11 bp, Homo sapiens
tcactggagcc

SEQ ID NO: 1122749 - DNA, 15 bp, Homo sapiens
tcactggagcccagg

SEQ ID NO: 1122750 - DNA, 17 bp, Homo sapiens
tcactggagcccaggag

SEQ ID NO: 1122751 - DNA, 19 bp, Homo sapiens
tcactggagttacattaat

SEQ ID NO: 1122752 - DNA, 21 bp, Homo sapiens
tcactggagttacattaatgt

SEQ ID NO: 1122753 - DNA, 22 bp, Homo sapiens
tcactggagttacattaatgtt

SEQ ID NO: 1122754 - DNA, 14 bp, Homo sapiens
tcactggatgaaga

SEQ ID NO: 1122755 - DNA, 16 bp, Homo sapiens
tcactggcagagcaca

SEQ ID NO: 1122756 - DNA, 14 bp, Homo sapiens
tcactggctctcca

SEQ ID NO: 1122757 - DNA, 15 bp, Homo sapiens
tcactggctgggagt

SEQ ID NO: 1122758 - DNA, 19 bp, Homo sapiens
tcactggctggggcagagg

SEQ ID NO: 1122759 - DNA, 22 bp, Homo sapiens
tcactgggaagaagcaagggca

SEQ ID NO: 1122760 - DNA, 23 bp, Homo sapiens
tcactgggaagctcccaccccac

SEQ ID NO: 1122761 - DNA, 20 bp, Homo sapiens
tcactggggtcctggggcct

SEQ ID NO: 1122762 - DNA, 14 bp, Homo sapiens
tcactgggtgttga

SEQ ID NO: 1122763 - DNA, 22 bp, Homo sapiens
tcactgggtgttgatcttacaa

SEQ ID NO: 1122764 - DNA, 20 bp, Homo sapiens
tcactggtagaccaaaataa

SEQ ID NO: 1122765 - DNA, 14 bp, Homo sapiens
tcactggtcagggc

SEQ ID NO: 1122766 - DNA, 21 bp, Homo sapiens
tcactggtcagggcagtggcc

SEQ ID NO: 1122767 - DNA, 18 bp, Homo sapiens
tcactggtgtacatcgtt

SEQ ID NO: 1122768 - DNA, 15 bp, Homo sapiens
tcactgtaaagacaa

SEQ ID NO: 1122769 - DNA, 13 bp, Homo sapiens
tcactgtactgca

SEQ ID NO: 1122770 - DNA, 21 bp, Homo sapiens
tcactgtagttttgagtgtat

SEQ ID NO: 1122771 - DNA, 23 bp, Homo sapiens
tcactgtagttttgagtgtatac

SEQ ID NO: 1122772 - DNA, 15 bp, Homo sapiens
tcactgtatagacat

SEQ ID NO: 1122773 - DNA, 12 bp, Homo sapiens
tcactgtatata

SEQ ID NO: 1122774 - DNA, 14 bp, Homo sapiens
tcactgtatataaa

SEQ ID NO: 1122775 - DNA, 15 bp, Homo sapiens
tcactgtatataaac

SEQ ID NO: 1122776 - DNA, 16 bp, Homo sapiens
tcactgtcactgccga

SEQ ID NO: 1122777 - DNA, 18 bp, Homo sapiens
tcactgtcaggaagaaat

SEQ ID NO: 1122778 - DNA, 18 bp, Homo sapiens
tcactgtccctcaaatga

SEQ ID NO: 1122779 - DNA, 16 bp, Homo sapiens
tcactgtcctccaagc

SEQ ID NO: 1122780 - DNA, 14 bp, Homo sapiens
tcactgtctaggct

SEQ ID NO: 1122781 - DNA, 20 bp, Homo sapiens
tcactgtctaggctacaaca

SEQ ID NO: 1122782 - DNA, 16 bp, Homo sapiens
tcactgtgaaatttca

SEQ ID NO: 1122783 - DNA, 17 bp, Homo sapiens
tcactgtggccacagcc

SEQ ID NO: 1122784 - DNA, 16 bp, Homo sapiens
tcactgtggtgtctgt

SEQ ID NO: 1122785 - DNA, 16 bp, Homo sapiens
tcactgtgttactgct

SEQ ID NO: 1122786 - DNA, 18 bp, Homo sapiens
tcactgtgttactgcttt

SEQ ID NO: 1122787 - DNA, 16 bp, Homo sapiens
tcactgttccctctgc

SEQ ID NO: 1122788 - DNA, 13 bp, Homo sapiens
tcactgttctgca

SEQ ID NO: 1122789 - DNA, 14 bp, Homo sapiens
tcactgttctgcaa

SEQ ID NO: 1122790 - DNA, 19 bp, Homo sapiens
tcactgttgaaaattattt

SEQ ID NO: 1122791 - DNA, 20 bp, Homo sapiens
tcactgttgaaaattatttt

SEQ ID NO: 1122792 - DNA, 16 bp, Homo sapiens
tcactgttgtacacag

SEQ ID NO: 1122793 - DNA, 17 bp, Homo sapiens
tcactgtttagaacaca

SEQ ID NO: 1122794 - DNA, 22 bp, Homo sapiens
tcactgtttcacttgctcttgg

SEQ ID NO: 1122795 - DNA, 14 bp, Homo sapiens
tcactgtttctctg

SEQ ID NO: 1122796 - DNA, 17 bp, Homo sapiens
tcactgtttctctgctg

SEQ ID NO: 1122797 - DNA, 13 bp, Homo sapiens
tcacttaatgttt

SEQ ID NO: 1122798 - DNA, 13 bp, Homo sapiens
tcacttacaagaa

SEQ ID NO: 1122799 - DNA, 17 bp, Homo sapiens
tcacttacctagattta

SEQ ID NO: 1122800 - DNA, 13 bp, Homo sapiens
tcacttagccatg

SEQ ID NO: 1122801 - DNA, 20 bp, Homo sapiens
tcacttattattaataatga

SEQ ID NO: 1122802 - DNA, 15 bp, Homo sapiens
tcacttcaaagctaa

SEQ ID NO: 1122803 - DNA, 20 bp, Homo sapiens
tcacttcaaagctaaaaaat

SEQ ID NO: 1122804 - DNA, 15 bp, Homo sapiens
tcacttcaccctgga

SEQ ID NO: 1122805 - DNA, 19 bp, Homo sapiens
tcacttcagatctctaatt

SEQ ID NO: 1122806 - DNA, 17 bp, Homo sapiens
tcacttccagatatcca

SEQ ID NO: 1122807 - DNA, 23 bp, Homo sapiens
tcacttccagatatccacataaa

SEQ ID NO: 1122808 - DNA, 15 bp, Homo sapiens
tcacttccagtgttg

SEQ ID NO: 1122809 - DNA, 20 bp, Homo sapiens
tcacttccagtgttggctgt

SEQ ID NO: 1122810 - DNA, 13 bp, Homo sapiens
tcacttctaaatt

SEQ ID NO: 1122811 - DNA, 13 bp, Homo sapiens
tcacttctccccg

SEQ ID NO: 1122812 - DNA, 15 bp, Homo sapiens
tcacttcttccactg

SEQ ID NO: 1122813 - DNA, 19 bp, Homo sapiens
tcacttctttgcagagcct

SEQ ID NO: 1122814 - DNA, 13 bp, Homo sapiens
tcacttgaatgtg

SEQ ID NO: 1122815 - DNA, 18 bp, Homo sapiens
tcagatcctgttacttgc

SEQ ID NO: 1122816 - DNA, 22 bp, Homo sapiens
tcagatcctgttacttgcttca

SEQ ID NO: 1122817 - DNA, 15 bp, Homo sapiens
tcagatcgttcattg

SEQ ID NO: 1122818 - DNA, 20 bp, Homo sapiens
tcagatctgaacacagttta

SEQ ID NO: 1122819 - DNA, 14 bp, Homo sapiens
tcagatctgaggtt

SEQ ID NO: 1122820 - DNA, 20 bp, Homo sapiens
tcagatcttaatataaattc

SEQ ID NO: 1122821 - DNA, 24 bp, Homo sapiens
tcagatcttaatataaattcactt

SEQ ID NO: 1122822 - DNA, 15 bp, Homo sapiens
tcagatcttgacagt

SEQ ID NO: 1122823 - DNA, 21 bp, Homo sapiens
tcagatgaactcttagaaatg

SEQ ID NO: 1122824 - DNA, 15 bp, Homo sapiens
tcagatgagaacaaa

SEQ ID NO: 1122825 - DNA, 18 bp, Homo sapiens
tcagatgaggcaaacagc

SEQ ID NO: 1122826 - DNA, 17 bp, Homo sapiens
tcagatgatctctccac

SEQ ID NO: 1122827 - DNA, 19 bp, Homo sapiens
tcagatgatggccatttct

SEQ ID NO: 1122828 - DNA, 21 bp, Homo sapiens
tcagatgatggccatttctaa

SEQ ID NO: 1122829 - DNA, 22 bp, Homo sapiens
tcagatgatggccatttctaaa

SEQ ID NO: 1122830 - DNA, 21 bp, Homo sapiens
tcagatgatttcccccctccg

SEQ ID NO: 1122831 - DNA, 14 bp, Homo sapiens
tcagatgcccagag

SEQ ID NO: 1122832 - DNA, 15 bp, Homo sapiens
tcagatgcctgcttg

SEQ ID NO: 1122833 - DNA, 14 bp, Homo sapiens
tcagatgctcttgg

SEQ ID NO: 1122834 - DNA, 15 bp, Homo sapiens
tcagatgctgaattg

SEQ ID NO: 1122835 - DNA, 18 bp, Homo sapiens
tcagatgcttctgggaga

SEQ ID NO: 1122836 - DNA, 20 bp, Homo sapiens
tcagatggaaaattcatttt

SEQ ID NO: 1122837 - DNA, 15 bp, Homo sapiens
tcagatgggaagaca

SEQ ID NO: 1122838 - DNA, 23 bp, Homo sapiens
tcagatgggtctgatattaatca

SEQ ID NO: 1122839 - DNA, 21 bp, Homo sapiens
tcagatggtagacgagctgtc

SEQ ID NO: 1122840 - DNA, 15 bp, Homo sapiens
tcagatgtaatgttt

SEQ ID NO: 1122841 - DNA, 16 bp, Homo sapiens
tcagatgtaatgtttt

SEQ ID NO: 1122842 - DNA, 13 bp, Homo sapiens
tcagatgtccctt

SEQ ID NO: 1122843 - DNA, 15 bp, Homo sapiens
tcagatgtcttctgc

SEQ ID NO: 1122844 - DNA, 22 bp, Homo sapiens
tcagatgtcttctgcctgttat

SEQ ID NO: 1122845 - DNA, 15 bp, Homo sapiens
tcagatgtgcaataa

SEQ ID NO: 1122846 - DNA, 21 bp, Homo sapiens
tcagatgttttacgcaaggaa

SEQ ID NO: 1122847 - DNA, 22 bp, Homo sapiens
tcagatgttttacgcaaggaag

SEQ ID NO: 1122848 - DNA, 23 bp, Homo sapiens
tcagatgttttacgcaaggaagg

SEQ ID NO: 1122849 - DNA, 14 bp, Homo sapiens
tcagattcccagag

SEQ ID NO: 1122850 - DNA, 22 bp, Homo sapiens
tcagattcccagagcaaaataa

SEQ ID NO: 1122851 - DNA, 17 bp, Homo sapiens
tcagattgactaaataa

SEQ ID NO: 1122852 - DNA, 19 bp, Homo sapiens
tcagatttctggttgttat

SEQ ID NO: 1122853 - DNA, 18 bp, Homo sapiens
tcagattttttaaaattt

SEQ ID NO: 1122854 - DNA, 20 bp, Homo sapiens
tcagattttttaaaattttg

SEQ ID NO: 1122855 - DNA, 19 bp, Homo sapiens
tcagcaaaggtcttgaata

SEQ ID NO: 1122856 - DNA, 15 bp, Homo sapiens
tcagcaaatttaaga

SEQ ID NO: 1122857 - DNA, 14 bp, Homo sapiens
tcagcaacaagact

SEQ ID NO: 1122858 - DNA, 20 bp, Homo sapiens
tcagcaacaagactgccagg

SEQ ID NO: 1122859 - DNA, 16 bp, Homo sapiens
tcagcaactcgcttta

SEQ ID NO: 1122860 - DNA, 19 bp, Homo sapiens
tcagcaatactcatcagag

SEQ ID NO: 1122861 - DNA, 16 bp, Homo sapiens
tcagcaatattgcctg

SEQ ID NO: 1122862 - DNA, 21 bp, Homo sapiens
tcagcaatattgcctgtgctt

SEQ ID NO: 1122863 - DNA, 18 bp, Homo sapiens
tcagcaatttcagaacca

SEQ ID NO: 1122864 - DNA, 22 bp, Homo sapiens
tcagcacaggaattctcaagac

SEQ ID NO: 1122865 - DNA, 21 bp, Homo sapiens
tcagcacattcgggaccaata

SEQ ID NO: 1122866 - DNA, 17 bp, Homo sapiens
tcagcaccacattgcct

SEQ ID NO: 1122867 - DNA, 14 bp, Homo sapiens
tcagcaccacccta

SEQ ID NO: 1122868 - DNA, 15 bp, Homo sapiens
tcagcaccccttcca

SEQ ID NO: 1122869 - DNA, 23 bp, Homo sapiens
tcagcaccctgggtgccattccc

SEQ ID NO: 1122870 - DNA, 19 bp, Homo sapiens
tcagcaccttggcccagga

SEQ ID NO: 1122871 - DNA, 18 bp, Homo sapiens
tcagcacgatttctgttt

SEQ ID NO: 1122872 - DNA, 20 bp, Homo sapiens
tcagcacttaactatgagcc

SEQ ID NO: 1122873 - DNA, 20 bp, Homo sapiens
tcagcagaggcagtggccac

SEQ ID NO: 1122874 - DNA, 16 bp, Homo sapiens
tcagcagatgccagtg

SEQ ID NO: 1122875 - DNA, 19 bp, Homo sapiens
tcagcagatgccagtgaag

SEQ ID NO: 1122876 - DNA, 17 bp, Homo sapiens
tcagcagcagagagccc

SEQ ID NO: 1122877 - DNA, 12 bp, Homo sapiens
tcagcagccagt

SEQ ID NO: 1122878 - DNA, 14 bp, Homo sapiens
tcagcagccagtct

SEQ ID NO: 1122879 - DNA, 22 bp, Homo sapiens
tcagcagccagtctcagagacc

SEQ ID NO: 1122880 - DNA, 13 bp, Homo sapiens
tcagcagggacca

SEQ ID NO: 1122881 - DNA, 20 bp, Homo sapiens
tcagcagtacctataaagta

SEQ ID NO: 1122882 - DNA, 20 bp, Homo sapiens
tcagcatagaaggaagtgtg

SEQ ID NO: 1122883 - DNA, 14 bp, Homo sapiens
tcagcatagcctgc

SEQ ID NO: 1122884 - DNA, 16 bp, Homo sapiens
tcagcatagcctgcct

SEQ ID NO: 1122885 - DNA, 17 bp, Homo sapiens
tcagcatagcctgcctg

SEQ ID NO: 1122886 - DNA, 20 bp, Homo sapiens
tcagcatagcctgcctgatc

SEQ ID NO: 1122887 - DNA, 19 bp, Homo sapiens
tcagcatatgtgtaaagat

SEQ ID NO: 1122888 - DNA, 15 bp, Homo sapiens
tcagcatctggctgt

SEQ ID NO: 1122889 - DNA, 13 bp, Homo sapiens
tcagcatgacaaa

SEQ ID NO: 1122890 - DNA, 12 bp, Homo sapiens
tcagcatgtcta

SEQ ID NO: 1122891 - DNA, 20 bp, Homo sapiens
tcagcattctcactcctacc

SEQ ID NO: 1122892 - DNA, 14 bp, Homo sapiens
tcagcattgtttca

SEQ ID NO: 1122893 - DNA, 19 bp, Homo sapiens
tcagcatttccacaccaag

SEQ ID NO: 1122894 - DNA, 22 bp, Homo sapiens
tcagcatttcttttctggccaa

SEQ ID NO: 1122895 - DNA, 11 bp, Homo sapiens
tcagcatttga

SEQ ID NO: 1122896 - DNA, 12 bp, Homo sapiens
tcagcatttgac

SEQ ID NO: 1122897 - DNA, 13 bp, Homo sapiens
tcagcattttaga

SEQ ID NO: 1122898 - DNA, 15 bp, Homo sapiens
tcagccaaagtccta

SEQ ID NO: 1122899 - DNA, 16 bp, Homo sapiens
tcagccaaatgcaggg

SEQ ID NO: 1122900 - DNA, 14 bp, Homo sapiens
tcagccaaatgtaa

SEQ ID NO: 1122901 - DNA, 22 bp, Homo sapiens
tcagccaaatgtaattgaataa

SEQ ID NO: 1122902 - DNA, 21 bp, Homo sapiens
tcagccaacgagtaatttatt

SEQ ID NO: 1122903 - DNA, 23 bp, Homo sapiens
tcagccaagacaaggaggtagag

SEQ ID NO: 1122904 - DNA, 19 bp, Homo sapiens
tcagccaaggggctgcgct

SEQ ID NO: 1122905 - DNA, 20 bp, Homo sapiens
tcagccaaggggctgcgcta

SEQ ID NO: 1122906 - DNA, 22 bp, Homo sapiens
tcagccaaggttttataaggct

SEQ ID NO: 1122907 - DNA, 15 bp, Homo sapiens
tcagccacactgggc

SEQ ID NO: 1122908 - DNA, 22 bp, Homo sapiens
tcagccacactgggcctggagc

SEQ ID NO: 1122909 - DNA, 23 bp, Homo sapiens
tcagccaccatcctattgcaaag

SEQ ID NO: 1122910 - DNA, 15 bp, Homo sapiens
tcagccacctccctc

SEQ ID NO: 1122911 - DNA, 20 bp, Homo sapiens
tcagccacctccctctgcca

SEQ ID NO: 1122912 - DNA, 13 bp, Homo sapiens
tcagccacctggg

SEQ ID NO: 1122913 - DNA, 16 bp, Homo sapiens
tcagccactgtgtctt

SEQ ID NO: 1122914 - DNA, 12 bp, Homo sapiens
tcagccagcact

SEQ ID NO: 1122915 - DNA, 14 bp, Homo sapiens
tcagccagcacttg

SEQ ID NO: 1122916 - DNA, 17 bp, Homo sapiens
tcagccagccgccctgg

SEQ ID NO: 1122917 - DNA, 13 bp, Homo sapiens
tcagccagccttc

SEQ ID NO: 1122918 - DNA, 17 bp, Homo sapiens
tcagccagccttcccca

SEQ ID NO: 1122919 - DNA, 18 bp, Homo sapiens
tcagccagctaccccttg

SEQ ID NO: 1122920 - DNA, 13 bp, Homo sapiens
tcagccagctgtt

SEQ ID NO: 1122921 - DNA, 18 bp, Homo sapiens
tcagccagtgaatctgtt

SEQ ID NO: 1122922 - DNA, 20 bp, Homo sapiens
tcagccagtggcacaggaga

SEQ ID NO: 1122923 - DNA, 17 bp, Homo sapiens
tcagccatcgtcctggg

SEQ ID NO: 1122924 - DNA, 11 bp, Homo sapiens
tcagccatgtt

SEQ ID NO: 1122925 - DNA, 14 bp, Homo sapiens
tcagccatgtttgg

SEQ ID NO: 1122926 - DNA, 15 bp, Homo sapiens
tcagccattaaaata

SEQ ID NO: 1122927 - DNA, 19 bp, Homo sapiens
tcagccatttccccctcct

SEQ ID NO: 1122928 - DNA, 23 bp, Homo sapiens
tcagccatttccccctcctcaga

SEQ ID NO: 1122929 - DNA, 13 bp, Homo sapiens
tcagccattttta

SEQ ID NO: 1122930 - DNA, 18 bp, Homo sapiens
tcagcccacccccctcat

SEQ ID NO: 1122931 - DNA, 11 bp, Homo sapiens
tcagcccagct

SEQ ID NO: 1122932 - DNA, 13 bp, Homo sapiens
tcagccccaaggg

SEQ ID NO: 1122933 - DNA, 15 bp, Homo sapiens
tcagccccaagggct

SEQ ID NO: 1122934 - DNA, 18 bp, Homo sapiens
tcagccccaccctggcct

SEQ ID NO: 1122935 - DNA, 21 bp, Homo sapiens
tcagccccatcgccccaactc

SEQ ID NO: 1122936 - DNA, 14 bp, Homo sapiens
tcagcccccaccag

SEQ ID NO: 1122937 - DNA, 23 bp, Homo sapiens
tcaggtctgtaactgcccagccc

SEQ ID NO: 1122938 - DNA, 21 bp, Homo sapiens
tcaggtgaacacttagtgatc

SEQ ID NO: 1122939 - DNA, 15 bp, Homo sapiens
tcaggtgagaagcag

SEQ ID NO: 1122940 - DNA, 23 bp, Homo sapiens
tcaggtgagaagcagaggaagga

SEQ ID NO: 1122941 - DNA, 23 bp, Homo sapiens
tcaggtgattccaggatggtttg

SEQ ID NO: 1122942 - DNA, 11 bp, Homo sapiens
tcaggtgccac

SEQ ID NO: 1122943 - DNA, 19 bp, Homo sapiens
tcaggtgcttttgatgtga

SEQ ID NO: 1122944 - DNA, 21 bp, Homo sapiens
tcaggtgcttttgatgtgaaa

SEQ ID NO: 1122945 - DNA, 18 bp, Homo sapiens
tcaggtggactctgggat

SEQ ID NO: 1122946 - DNA, 20 bp, Homo sapiens
tcaggtgtagctgagctgtg

SEQ ID NO: 1122947 - DNA, 15 bp, Homo sapiens
tcaggtgtataaatg

SEQ ID NO: 1122948 - DNA, 13 bp, Homo sapiens
tcaggtgtgcctg

SEQ ID NO: 1122949 - DNA, 17 bp, Homo sapiens
tcaggtgttttaagact

SEQ ID NO: 1122950 - DNA, 15 bp, Homo sapiens
tcaggttatactcct

SEQ ID NO: 1122951 - DNA, 13 bp, Homo sapiens
tcaggttccagaa

SEQ ID NO: 1122952 - DNA, 14 bp, Homo sapiens
tcaggttcttgcct

SEQ ID NO: 1122953 - DNA, 17 bp, Homo sapiens
tcaggtttaacatttgc

SEQ ID NO: 1122954 - DNA, 21 bp, Homo sapiens
tcaggtttccattctgcagaa

SEQ ID NO: 1122955 - DNA, 23 bp, Homo sapiens
tcaggtttggtttttttgtacaa

SEQ ID NO: 1122956 - DNA, 23 bp, Homo sapiens
tcaggttttcttttaagaatcaa

SEQ ID NO: 1122957 - DNA, 14 bp, Homo sapiens
tcaggttttgtaaa

SEQ ID NO: 1122958 - DNA, 22 bp, Homo sapiens
tcaggtttttcctttttttgta

SEQ ID NO: 1122959 - DNA, 18 bp, Homo sapiens
tcagtaaaattatactgt

SEQ ID NO: 1122960 - DNA, 20 bp, Homo sapiens
tcagtaaaattatactgtgt

SEQ ID NO: 1122961 - DNA, 23 bp, Homo sapiens
tcagtaaaattatactgtgtgtg

SEQ ID NO: 1122962 - DNA, 21 bp, Homo sapiens
tcagtaaacgggaacatgccc

SEQ ID NO: 1122963 - DNA, 20 bp, Homo sapiens
tcagtaaatagtgtcatata

SEQ ID NO: 1122964 - DNA, 20 bp, Homo sapiens
tcagtaacataactgcttct

SEQ ID NO: 1122965 - DNA, 21 bp, Homo sapiens
tcagtaacataactgcttctt

SEQ ID NO: 1122966 - DNA, 19 bp, Homo sapiens
tcagtaataaactgtgttt

SEQ ID NO: 1122967 - DNA, 16 bp, Homo sapiens
tcagtaatataatttg

SEQ ID NO: 1122968 - DNA, 13 bp, Homo sapiens
tcagtaatgtctt

SEQ ID NO: 1122969 - DNA, 20 bp, Homo sapiens
tcagtaattgtgtcctctct

SEQ ID NO: 1122970 - DNA, 20 bp, Homo sapiens
tcagtaatttagaaatcatt

SEQ ID NO: 1122971 - DNA, 14 bp, Homo sapiens
tcagtaatttgagg

SEQ ID NO: 1122972 - DNA, 17 bp, Homo sapiens
tcagtaatttgaggaca

SEQ ID NO: 1122973 - DNA, 18 bp, Homo sapiens
tcagtaatttgaggacaa

SEQ ID NO: 1122974 - DNA, 22 bp, Homo sapiens
tcagtacacttggtgtactggg

SEQ ID NO: 1122975 - DNA, 19 bp, Homo sapiens
tcagtaccctctcagctcc

SEQ ID NO: 1122976 - DNA, 24 bp, Homo sapiens
tcagtacgatcaagttgttgactg

SEQ ID NO: 1122977 - DNA, 13 bp, Homo sapiens
tcagtagaattac

SEQ ID NO: 1122978 - DNA, 15 bp, Homo sapiens
tcagtagaattacca

SEQ ID NO: 1122979 - DNA, 14 bp, Homo sapiens
tcagtagaatttta

SEQ ID NO: 1122980 - DNA, 18 bp, Homo sapiens
tcagtagaattttagtcc

SEQ ID NO: 1122981 - DNA, 21 bp, Homo sapiens
tcagtaggaacaagctggctt

SEQ ID NO: 1122982 - DNA, 23 bp, Homo sapiens
tcagtaggtgcccagaataagtt

SEQ ID NO: 1122983 - DNA, 13 bp, Homo sapiens
tcagtatccaggc

SEQ ID NO: 1122984 - DNA, 20 bp, Homo sapiens
tcagtatctgtatctctctc

SEQ ID NO: 1122985 - DNA, 24 bp, Homo sapiens
tcagtatctgtatctctctctctt

SEQ ID NO: 1122986 - DNA, 19 bp, Homo sapiens
tcagtatcttagagtttac

SEQ ID NO: 1122987 - DNA, 21 bp, Homo sapiens
tcagtatcttagagtttacag

SEQ ID NO: 1122988 - DNA, 13 bp, Homo sapiens
tcagtatgaatta

SEQ ID NO: 1122989 - DNA, 17 bp, Homo sapiens
tcagtatgaattattca

SEQ ID NO: 1122990 - DNA, 20 bp, Homo sapiens
tcagtatgctttccctgagg

SEQ ID NO: 1122991 - DNA, 15 bp, Homo sapiens
tcagtatgttgtcaa

SEQ ID NO: 1122992 - DNA, 17 bp, Homo sapiens
tcagtatgttgtcaaag

SEQ ID NO: 1122993 - DNA, 20 bp, Homo sapiens
tcagtatgttgtcaaagaga

SEQ ID NO: 1122994 - DNA, 22 bp, Homo sapiens
tcagtattaaaggggggagggg

SEQ ID NO: 1122995 - DNA, 19 bp, Homo sapiens
tcagtattactttctgccg

SEQ ID NO: 1122996 - DNA, 14 bp, Homo sapiens
tcagtattctgaca

SEQ ID NO: 1122997 - DNA, 14 bp, Homo sapiens
tcagtatttatgta

SEQ ID NO: 1122998 - DNA, 15 bp, Homo sapiens
tcagtatttccttcc

SEQ ID NO: 1122999 - DNA, 17 bp, Homo sapiens
tcagtatttccttccac

SEQ ID NO: 1123000 - DNA, 22 bp, Homo sapiens
tcagtattttccagccttatgt

SEQ ID NO: 1123001 - DNA, 22 bp, Homo sapiens
tcagtattttggagaaattatt

SEQ ID NO: 1123002 - DNA, 14 bp, Homo sapiens
tcagtatttttcct

SEQ ID NO: 1123003 - DNA, 22 bp, Homo sapiens
tcagtattttttacttttcaca

SEQ ID NO: 1123004 - DNA, 16 bp, Homo sapiens
tcagtattttttttta

SEQ ID NO: 1123005 - DNA, 15 bp, Homo sapiens
tcagtcaaaacttta

SEQ ID NO: 1123006 - DNA, 16 bp, Homo sapiens
tcagtcacacacacat

SEQ ID NO: 1123007 - DNA, 15 bp, Homo sapiens
tcagtcacagccacc

SEQ ID NO: 1123008 - DNA, 13 bp, Homo sapiens
tcagtcagttccc

SEQ ID NO: 1123009 - DNA, 22 bp, Homo sapiens
tcagtcagttcccggagcacag

SEQ ID NO: 1123010 - DNA, 12 bp, Homo sapiens
tcagtcatattt

SEQ ID NO: 1123011 - DNA, 15 bp, Homo sapiens
tcagtcatcatgggt

SEQ ID NO: 1123012 - DNA, 15 bp, Homo sapiens
tcagtcattttgggt

SEQ ID NO: 1123013 - DNA, 22 bp, Homo sapiens
tcagtcccaaagcggccgatgg

SEQ ID NO: 1123014 - DNA, 21 bp, Homo sapiens
tcagtcccccaccacactgaa

SEQ ID NO: 1123015 - DNA, 14 bp, Homo sapiens
tcagtcccctctct

SEQ ID NO: 1123016 - DNA, 17 bp, Homo sapiens
tcagtcccctctctctg

SEQ ID NO: 1123017 - DNA, 18 bp, Homo sapiens
tcagtcccctctctctgg

SEQ ID NO: 1123018 - DNA, 13 bp, Homo sapiens
tcagtccctatgt

SEQ ID NO: 1123019 - DNA, 18 bp, Homo sapiens
tcagtcctcctctccttt

SEQ ID NO: 1123020 - DNA, 16 bp, Homo sapiens
tcagtcctgctccaga

SEQ ID NO: 1123021 - DNA, 19 bp, Homo sapiens
tcagtctaacagtttgcct

SEQ ID NO: 1123022 - DNA, 20 bp, Homo sapiens
tcagtctctcttctctccag

SEQ ID NO: 1123023 - DNA, 13 bp, Homo sapiens
tcagtctctgagc

SEQ ID NO: 1123024 - DNA, 15 bp, Homo sapiens
tcagtctctgagcag

SEQ ID NO: 1123025 - DNA, 17 bp, Homo sapiens
tcagtctctgagcagtg

SEQ ID NO: 1123026 - DNA, 17 bp, Homo sapiens
tcagtctgctccaccaa

SEQ ID NO: 1123027 - DNA, 14 bp, Homo sapiens
tcagtcttccttgt

SEQ ID NO: 1123028 - DNA, 22 bp, Homo sapiens
tcagtcttccttgtggaatgct

SEQ ID NO: 1123029 - DNA, 13 bp, Homo sapiens
tcagtctttgctc

SEQ ID NO: 1123030 - DNA, 14 bp, Homo sapiens
tcagtctttgctca

SEQ ID NO: 1123031 - DNA, 16 bp, Homo sapiens
tcagtctttgctcagt

SEQ ID NO: 1123032 - DNA, 20 bp, Homo sapiens
tcagtgaagtacacctgtgt

SEQ ID NO: 1123033 - DNA, 19 bp, Homo sapiens
tcagtgaagtctagaatca

SEQ ID NO: 1123034 - DNA, 16 bp, Homo sapiens
tcagtgaatttgtcca

SEQ ID NO: 1123035 - DNA, 21 bp, Homo sapiens
tcagtgaatttgtccattgta

SEQ ID NO: 1123036 - DNA, 20 bp, Homo sapiens
tcagtgacaaaatgggagga

SEQ ID NO: 1123037 - DNA, 15 bp, Homo sapiens
tcagtgacagagttc

SEQ ID NO: 1123038 - DNA, 21 bp, Homo sapiens
tcagtgactgttgtagcattt

SEQ ID NO: 1123039 - DNA, 20 bp, Homo sapiens
tcagtgagcccctccccagc

SEQ ID NO: 1123040 - DNA, 16 bp, Homo sapiens
tcagtgagcctcctgt

SEQ ID NO: 1123041 - DNA, 21 bp, Homo sapiens
tcagtgagcctcctgtgcctg

SEQ ID NO: 1123042 - DNA, 19 bp, Homo sapiens
tcagtgatacgtacagcca

SEQ ID NO: 1123043 - DNA, 17 bp, Homo sapiens
tcagtgatctatgtttg

SEQ ID NO: 1123044 - DNA, 19 bp, Homo sapiens
tcagtgatgtaccatgaaa

SEQ ID NO: 1123045 - DNA, 12 bp, Homo sapiens
tcagtgatttcc

SEQ ID NO: 1123046 - DNA, 18 bp, Homo sapiens
tcagtgcacctgcctcag

SEQ ID NO: 1123047 - DNA, 23 bp, Homo sapiens
tcagtgcacctgcctcagctacc

SEQ ID NO: 1123048 - DNA, 23 bp, Homo sapiens
tcagtgcatccccacgacccctg

SEQ ID NO: 1123049 - DNA, 14 bp, Homo sapiens
tcagtgccacttga

SEQ ID NO: 1123050 - DNA, 17 bp, Homo sapiens
tcagtgccacttgacat

SEQ ID NO: 1123051 - DNA, 22 bp, Homo sapiens
tcagtgccacttgacattcctt

SEQ ID NO: 1123052 - DNA, 22 bp, Homo sapiens
tcagtgcccaccaacatcccat

SEQ ID NO: 1123053 - DNA, 20 bp, Homo sapiens
tcagtgccggaggccttggg

SEQ ID NO: 1123054 - DNA, 14 bp, Homo sapiens
tcagtgcctccaca

SEQ ID NO: 1123055 - DNA, 16 bp, Homo sapiens
tcagtgcctcctggcc

SEQ ID NO: 1123056 - DNA, 21 bp, Homo sapiens
tcagtgcctggtgttctgaag

SEQ ID NO: 1123057 - DNA, 19 bp, Homo sapiens
tcagtgctccctcacatgt

SEQ ID NO: 1123058 - DNA, 20 bp, Homo sapiens
tcatccaggcccaactgtga

SEQ ID NO: 1123059 - DNA, 15 bp, Homo sapiens
tcatccataactgaa

SEQ ID NO: 1123060 - DNA, 17 bp, Homo sapiens
tcatccatcatcatgtg

SEQ ID NO: 1123061 - DNA, 18 bp, Homo sapiens
tcatccatgccctcccag

SEQ ID NO: 1123062 - DNA, 23 bp, Homo sapiens
tcatcccaacctctttttcctcc

SEQ ID NO: 1123063 - DNA, 18 bp, Homo sapiens
tcatcccacgcactccat

SEQ ID NO: 1123064 - DNA, 18 bp, Homo sapiens
tcatcccacttcctttcc

SEQ ID NO: 1123065 - DNA, 21 bp, Homo sapiens
tcatcccattaatcatttccc

SEQ ID NO: 1123066 - DNA, 20 bp, Homo sapiens
tcatccccaggggtcccagc

SEQ ID NO: 1123067 - DNA, 14 bp, Homo sapiens
tcatcccccctgct

SEQ ID NO: 1123068 - DNA, 15 bp, Homo sapiens
tcatcccccctgctg

SEQ ID NO: 1123069 - DNA, 15 bp, Homo sapiens
tcatcccctcgtcct

SEQ ID NO: 1123070 - DNA, 16 bp, Homo sapiens
tcatcccctctcagga

SEQ ID NO: 1123071 - DNA, 21 bp, Homo sapiens
tcatcccgagcacctccacat

SEQ ID NO: 1123072 - DNA, 19 bp, Homo sapiens
tcatcccgtatcacagtgt

SEQ ID NO: 1123073 - DNA, 21 bp, Homo sapiens
tcatccctatgggattcagtg

SEQ ID NO: 1123074 - DNA, 15 bp, Homo sapiens
tcatccgtctgtgtg

SEQ ID NO: 1123075 - DNA, 23 bp, Homo sapiens
tcatcctcaaagaaagtgtattg

SEQ ID NO: 1123076 - DNA, 20 bp, Homo sapiens
tcatcctcattgcctcctgt

SEQ ID NO: 1123077 - DNA, 13 bp, Homo sapiens
tcatcctccagta

SEQ ID NO: 1123078 - DNA, 19 bp, Homo sapiens
tcatcctcccttgccccag

SEQ ID NO: 1123079 - DNA, 23 bp, Homo sapiens
tcatcctcccttgccccaggcca

SEQ ID NO: 1123080 - DNA, 11 bp, Homo sapiens
tcatcctcctg

SEQ ID NO: 1123081 - DNA, 15 bp, Homo sapiens
tcatcctgagcccaa

SEQ ID NO: 1123082 - DNA, 20 bp, Homo sapiens
tcatcctgagcccaaccagg

SEQ ID NO: 1123083 - DNA, 12 bp, Homo sapiens
tcatcctggcct

SEQ ID NO: 1123084 - DNA, 13 bp, Homo sapiens
tcatcctggcctc

SEQ ID NO: 1123085 - DNA, 18 bp, Homo sapiens
tcatcctgtgtcccctga

SEQ ID NO: 1123086 - DNA, 15 bp, Homo sapiens
tcatccttggtgctc

SEQ ID NO: 1123087 - DNA, 22 bp, Homo sapiens
tcatccttggtgctcttgcttt

SEQ ID NO: 1123088 - DNA, 16 bp, Homo sapiens
tcatcctttgttctga

SEQ ID NO: 1123089 - DNA, 21 bp, Homo sapiens
tcatccttttttctcttctgt

SEQ ID NO: 1123090 - DNA, 23 bp, Homo sapiens
tcatcgaagggattgtgtatctg

SEQ ID NO: 1123091 - DNA, 14 bp, Homo sapiens
tcatcgccagaggt

SEQ ID NO: 1123092 - DNA, 21 bp, Homo sapiens
tcatcgccagaggtgcttcac

SEQ ID NO: 1123093 - DNA, 16 bp, Homo sapiens
tcatcggaggctgggc

SEQ ID NO: 1123094 - DNA, 22 bp, Homo sapiens
tcatcggagtcagccaggagct

SEQ ID NO: 1123095 - DNA, 22 bp, Homo sapiens
tcatctaactgatgagtaaact

SEQ ID NO: 1123096 - DNA, 13 bp, Homo sapiens
tcatctacttttt

SEQ ID NO: 1123097 - DNA, 13 bp, Homo sapiens
tcatctatgtcat

SEQ ID NO: 1123098 - DNA, 16 bp, Homo sapiens
tcatctatttctgaga

SEQ ID NO: 1123099 - DNA, 17 bp, Homo sapiens
tcatctatttctgagaa

SEQ ID NO: 1123100 - DNA, 16 bp, Homo sapiens
tcatctcaggtagaag

SEQ ID NO: 1123101 - DNA, 21 bp, Homo sapiens
tcatctccaaggatcctctcc

SEQ ID NO: 1123102 - DNA, 22 bp, Homo sapiens
tcatctccaaggatcctctcca

SEQ ID NO: 1123103 - DNA, 22 bp, Homo sapiens
tcatctccagggagtcccctcc

SEQ ID NO: 1123104 - DNA, 23 bp, Homo sapiens
tcatctccagggagtcccctccc

SEQ ID NO: 1123105 - DNA, 22 bp, Homo sapiens
tcatctcccacctagcagcacc

SEQ ID NO: 1123106 - DNA, 17 bp, Homo sapiens
tcatctcccctcctggc

SEQ ID NO: 1123107 - DNA, 13 bp, Homo sapiens
tcatctccctgcc

SEQ ID NO: 1123108 - DNA, 18 bp, Homo sapiens
tcatctccctgccatccc

SEQ ID NO: 1123109 - DNA, 20 bp, Homo sapiens
tcatctccctgccatccccc

SEQ ID NO: 1123110 - DNA, 15 bp, Homo sapiens
tcatctcctgaccct

SEQ ID NO: 1123111 - DNA, 17 bp, Homo sapiens
tcatctcctgagtatgt

SEQ ID NO: 1123112 - DNA, 18 bp, Homo sapiens
tcatctcctgagtatgta

SEQ ID NO: 1123113 - DNA, 15 bp, Homo sapiens
tcatctcctgccttc

SEQ ID NO: 1123114 - DNA, 21 bp, Homo sapiens
tcatctcctgccttcctcctg

SEQ ID NO: 1123115 - DNA, 11 bp, Homo sapiens
tcatctctcct

SEQ ID NO: 1123116 - DNA, 15 bp, Homo sapiens
tcatctctcctccaa

SEQ ID NO: 1123117 - DNA, 23 bp, Homo sapiens
tcatctctcctccaagacactgt

SEQ ID NO: 1123118 - DNA, 20 bp, Homo sapiens
tcatctctgaaaattctgga

SEQ ID NO: 1123119 - DNA, 21 bp, Homo sapiens
tcatctctgaaaattctggaa

SEQ ID NO: 1123120 - DNA, 20 bp, Homo sapiens
tcatctctggaaggggcagc

SEQ ID NO: 1123121 - DNA, 17 bp, Homo sapiens
tcatctctgtcgtgctt

SEQ ID NO: 1123122 - DNA, 16 bp, Homo sapiens
tcatctcttaaatttt

SEQ ID NO: 1123123 - DNA, 23 bp, Homo sapiens
tcatctcttaaattttgttttct

SEQ ID NO: 1123124 - DNA, 12 bp, Homo sapiens
tcatctcttcag

SEQ ID NO: 1123125 - DNA, 16 bp, Homo sapiens
tcatctcttcaggttc

SEQ ID NO: 1123126 - DNA, 22 bp, Homo sapiens
tcatctgaccttcaccttggat

SEQ ID NO: 1123127 - DNA, 12 bp, Homo sapiens
tcatctgaggag

SEQ ID NO: 1123128 - DNA, 22 bp, Homo sapiens
tcatctgatcacttcatgtttt

SEQ ID NO: 1123129 - DNA, 12 bp, Homo sapiens
tcatctgcaaaa

SEQ ID NO: 1123130 - DNA, 13 bp, Homo sapiens
tcatctgcaaagg

SEQ ID NO: 1123131 - DNA, 20 bp, Homo sapiens
tcatctgcacccttcttttc

SEQ ID NO: 1123132 - DNA, 17 bp, Homo sapiens
tcatctgccagaaaact

SEQ ID NO: 1123133 - DNA, 13 bp, Homo sapiens
tcatctgcctgcg

SEQ ID NO: 1123134 - DNA, 19 bp, Homo sapiens
tcatctgctggtccgtggg

SEQ ID NO: 1123135 - DNA, 16 bp, Homo sapiens
tcatctgggaaagaca

SEQ ID NO: 1123136 - DNA, 17 bp, Homo sapiens
tcatctggggacctggt

SEQ ID NO: 1123137 - DNA, 13 bp, Homo sapiens
tcatctgggtggt

SEQ ID NO: 1123138 - DNA, 23 bp, Homo sapiens
tcatctggttgaactctggtggc

SEQ ID NO: 1123139 - DNA, 13 bp, Homo sapiens
tcatctgtagata

SEQ ID NO: 1123140 - DNA, 17 bp, Homo sapiens
tcatctgtctttcactg

SEQ ID NO: 1123141 - DNA, 15 bp, Homo sapiens
tcatctgtggagctg

SEQ ID NO: 1123142 - DNA, 14 bp, Homo sapiens
tcatctgtgtgaaa

SEQ ID NO: 1123143 - DNA, 18 bp, Homo sapiens
tcatctgttatcctgcta

SEQ ID NO: 1123144 - DNA, 15 bp, Homo sapiens
tcatctgttgttctg

SEQ ID NO: 1123145 - DNA, 12 bp, Homo sapiens
tcatcttactgt

SEQ ID NO: 1123146 - DNA, 16 bp, Homo sapiens
tcatcttactgtacct

SEQ ID NO: 1123147 - DNA, 23 bp, Homo sapiens
tcatcttaggttggcaaaaaggc

SEQ ID NO: 1123148 - DNA, 18 bp, Homo sapiens
tcatcttcagttgtctct

SEQ ID NO: 1123149 - DNA, 12 bp, Homo sapiens
tcatcttcctgt

SEQ ID NO: 1123150 - DNA, 14 bp, Homo sapiens
tcatcttcctgtgt

SEQ ID NO: 1123151 - DNA, 14 bp, Homo sapiens
tcatcttctggaat

SEQ ID NO: 1123152 - DNA, 16 bp, Homo sapiens
tcatcttcttcaccat

SEQ ID NO: 1123153 - DNA, 23 bp, Homo sapiens
tcatcttgatgtctatgatagat

SEQ ID NO: 1123154 - DNA, 21 bp, Homo sapiens
tcatcttgctaccagtattta

SEQ ID NO: 1123155 - DNA, 22 bp, Homo sapiens
tcatcttgctaccagtatttag

SEQ ID NO: 1123156 - DNA, 14 bp, Homo sapiens
tcatcttttcaagg

SEQ ID NO: 1123157 - DNA, 21 bp, Homo sapiens
tcatctttttatatggggttg

SEQ ID NO: 1123158 - DNA, 14 bp, Homo sapiens
tcatctttttctag

SEQ ID NO: 1123159 - DNA, 22 bp, Homo sapiens
tcatgaaaactgtttttactaa

SEQ ID NO: 1123160 - DNA, 14 bp, Homo sapiens
tcatgaaaagagga

SEQ ID NO: 1123161 - DNA, 15 bp, Homo sapiens
tcatgaaaatgacat

SEQ ID NO: 1123162 - DNA, 14 bp, Homo sapiens
tcatgaaatatgca

SEQ ID NO: 1123163 - DNA, 15 bp, Homo sapiens
tcatgaaatgattgg

SEQ ID NO: 1123164 - DNA, 15 bp, Homo sapiens
tcatgaaatgtggaa

SEQ ID NO: 1123165 - DNA, 15 bp, Homo sapiens
tcatgaaattgttca

SEQ ID NO: 1123166 - DNA, 14 bp, Homo sapiens
tcatgaacagctct

SEQ ID NO: 1123167 - DNA, 16 bp, Homo sapiens
tcatgaacagctctga

SEQ ID NO: 1123168 - DNA, 18 bp, Homo sapiens
tcatgaagaatgtttctg

SEQ ID NO: 1123169 - DNA, 14 bp, Homo sapiens
tcatgaagccttgc

SEQ ID NO: 1123170 - DNA, 18 bp, Homo sapiens
tcatgaagccttgctgaa

SEQ ID NO: 1123171 - DNA, 13 bp, Homo sapiens
tcatgaagggctg

SEQ ID NO: 1123172 - DNA, 14 bp, Homo sapiens
tcatgaatctttca

SEQ ID NO: 1123173 - DNA, 14 bp, Homo sapiens
tcatgaatgaaaat

SEQ ID NO: 1123174 - DNA, 20 bp, Homo sapiens
tcatgaatgtgctggtgaac

SEQ ID NO: 1123175 - DNA, 22 bp, Homo sapiens
tcatgaatttattgcacattgt

SEQ ID NO: 1123176 - DNA, 15 bp, Homo sapiens
tcatgaattttaaag

SEQ ID NO: 1123177 - DNA, 19 bp, Homo sapiens
tcatgacaaagactgagta

SEQ ID NO: 1123178 - DNA, 17 bp, Homo sapiens
tcatgacagtgcttgca

SEQ ID NO: 1123179 - DNA, 14 bp, Homo sapiens
tcatgacatgttat

SEQ ID NO: 1123180 - DNA, 22 bp, Homo sapiens
tcattgtcttgttatgtacaaa

SEQ ID NO: 1123181 - DNA, 19 bp, Homo sapiens
tcattgtgccaagccttct

SEQ ID NO: 1123182 - DNA, 20 bp, Homo sapiens
tcattgttggagtgtaaacc

SEQ ID NO: 1123183 - DNA, 16 bp, Homo sapiens
tcatttaaaaagctca

SEQ ID NO: 1123184 - DNA, 15 bp, Homo sapiens
tcatttaaaacaggc

SEQ ID NO: 1123185 - DNA, 14 bp, Homo sapiens
tcatttaaaatgat

SEQ ID NO: 1123186 - DNA, 22 bp, Homo sapiens
tcatttaaacccaatcagatgc

SEQ ID NO: 1123187 - DNA, 16 bp, Homo sapiens
tcatttagaacttgca

SEQ ID NO: 1123188 - DNA, 22 bp, Homo sapiens
tcatttagaacttgcagctgat

SEQ ID NO: 1123189 - DNA, 19 bp, Homo sapiens
tcatttagataatttgaaa

SEQ ID NO: 1123190 - DNA, 21 bp, Homo sapiens
tcatttagataatttgaaaaa

SEQ ID NO: 1123191 - DNA, 23 bp, Homo sapiens
tcatttagcatgttgttgaaagg

SEQ ID NO: 1123192 - DNA, 19 bp, Homo sapiens
tcatttagtttgattattc

SEQ ID NO: 1123193 - DNA, 21 bp, Homo sapiens
tcatttataaaaccatcaaaa

SEQ ID NO: 1123194 - DNA, 18 bp, Homo sapiens
tcatttatctataattta

SEQ ID NO: 1123195 - DNA, 14 bp, Homo sapiens
tcatttatgaaaag

SEQ ID NO: 1123196 - DNA, 15 bp, Homo sapiens
tcatttatttcatga

SEQ ID NO: 1123197 - DNA, 15 bp, Homo sapiens
tcatttcaatcattg

SEQ ID NO: 1123198 - DNA, 17 bp, Homo sapiens
tcatttcaatcattgaa

SEQ ID NO: 1123199 - DNA, 13 bp, Homo sapiens
tcatttcagaagt

SEQ ID NO: 1123200 - DNA, 13 bp, Homo sapiens
tcatttcagccaa

SEQ ID NO: 1123201 - DNA, 17 bp, Homo sapiens
tcatttcagccaaagtc

SEQ ID NO: 1123202 - DNA, 17 bp, Homo sapiens
tcatttcatctcattta

SEQ ID NO: 1123203 - DNA, 15 bp, Homo sapiens
tcatttcatgaaaat

SEQ ID NO: 1123204 - DNA, 15 bp, Homo sapiens
tcatttcattccatt

SEQ ID NO: 1123205 - DNA, 18 bp, Homo sapiens
tcatttccaaacttgaaa

SEQ ID NO: 1123206 - DNA, 22 bp, Homo sapiens
tcatttccccataactcaatgg

SEQ ID NO: 1123207 - DNA, 19 bp, Homo sapiens
tcatttccgtcccccccca

SEQ ID NO: 1123208 - DNA, 22 bp, Homo sapiens
tcatttcctatgtaactgcatt

SEQ ID NO: 1123209 - DNA, 23 bp, Homo sapiens
tcatttcctgcccttcctcagtt

SEQ ID NO: 1123210 - DNA, 21 bp, Homo sapiens
tcatttctatttctcctccat

SEQ ID NO: 1123211 - DNA, 15 bp, Homo sapiens
tcatttctgccatga

SEQ ID NO: 1123212 - DNA, 17 bp, Homo sapiens
tcatttcttcctctgca

SEQ ID NO: 1123213 - DNA, 14 bp, Homo sapiens
tcatttctttgtct

SEQ ID NO: 1123214 - DNA, 16 bp, Homo sapiens
tcatttgaacaactag

SEQ ID NO: 1123215 - DNA, 14 bp, Homo sapiens
tcatttgaatgaga

SEQ ID NO: 1123216 - DNA, 18 bp, Homo sapiens
tcatttgactaagagtct

SEQ ID NO: 1123217 - DNA, 19 bp, Homo sapiens
tcatttgactgtctcactt

SEQ ID NO: 1123218 - DNA, 14 bp, Homo sapiens
tcatttgagataaa

SEQ ID NO: 1123219 - DNA, 15 bp, Homo sapiens
tcatttgaggaagct

SEQ ID NO: 1123220 - DNA, 15 bp, Homo sapiens
tcatttgagtctctt

SEQ ID NO: 1123221 - DNA, 16 bp, Homo sapiens
tcatttgcaagctgag

SEQ ID NO: 1123222 - DNA, 14 bp, Homo sapiens
tcatttgctttgga

SEQ ID NO: 1123223 - DNA, 15 bp, Homo sapiens
tcatttgctttggaa

SEQ ID NO: 1123224 - DNA, 19 bp, Homo sapiens
tcatttggcttgctgttta

SEQ ID NO: 1123225 - DNA, 21 bp, Homo sapiens
tcatttggcttgctgtttact

SEQ ID NO: 1123226 - DNA, 19 bp, Homo sapiens
tcatttggtgttcctggaa

SEQ ID NO: 1123227 - DNA, 17 bp, Homo sapiens
tcatttggttggcacta

SEQ ID NO: 1123228 - DNA, 15 bp, Homo sapiens
tcatttgtaaaaatg

SEQ ID NO: 1123229 - DNA, 23 bp, Homo sapiens
tcatttgtacaaggtaattgttt

SEQ ID NO: 1123230 - DNA, 17 bp, Homo sapiens
tcatttgtatgtcaaag

SEQ ID NO: 1123231 - DNA, 15 bp, Homo sapiens
tcatttgtgaagaat

SEQ ID NO: 1123232 - DNA, 13 bp, Homo sapiens
tcatttgtgccac

SEQ ID NO: 1123233 - DNA, 21 bp, Homo sapiens
tcatttgtggcagtcccttat

SEQ ID NO: 1123234 - DNA, 17 bp, Homo sapiens
tcatttgtggttagaat

SEQ ID NO: 1123235 - DNA, 15 bp, Homo sapiens
tcatttgtgtcaatg

SEQ ID NO: 1123236 - DNA, 15 bp, Homo sapiens
tcatttgtttaaaca

SEQ ID NO: 1123237 - DNA, 17 bp, Homo sapiens
tcatttgttttgctttt

SEQ ID NO: 1123238 - DNA, 18 bp, Homo sapiens
tcattttaaaaactttat

SEQ ID NO: 1123239 - DNA, 13 bp, Homo sapiens
tcattttaaaaag

SEQ ID NO: 1123240 - DNA, 15 bp, Homo sapiens
tcattttaaaatctg

SEQ ID NO: 1123241 - DNA, 21 bp, Homo sapiens
tcattttaaaatctgatttaa

SEQ ID NO: 1123242 - DNA, 20 bp, Homo sapiens
tcattttaagaagacatgac

SEQ ID NO: 1123243 - DNA, 13 bp, Homo sapiens
tcattttaattat

SEQ ID NO: 1123244 - DNA, 17 bp, Homo sapiens
tcattttactcttatga

SEQ ID NO: 1123245 - DNA, 17 bp, Homo sapiens
tcattttatatgtcaaa

SEQ ID NO: 1123246 - DNA, 15 bp, Homo sapiens
tcattttatgttaag

SEQ ID NO: 1123247 - DNA, 22 bp, Homo sapiens
tcattttattttcatgcttttt

SEQ ID NO: 1123248 - DNA, 21 bp, Homo sapiens
tcattttattttttccctcct

SEQ ID NO: 1123249 - DNA, 19 bp, Homo sapiens
tcattttccccccactctc

SEQ ID NO: 1123250 - DNA, 12 bp, Homo sapiens
tcattttcctgt

SEQ ID NO: 1123251 - DNA, 15 bp, Homo sapiens
tcattttctctaata

SEQ ID NO: 1123252 - DNA, 16 bp, Homo sapiens
tcattttctctaatat

SEQ ID NO: 1123253 - DNA, 21 bp, Homo sapiens
tcattttcttatcttctgcaa

SEQ ID NO: 1123254 - DNA, 17 bp, Homo sapiens
tcattttgaaaagtatt

SEQ ID NO: 1123255 - DNA, 15 bp, Homo sapiens
tcattttgagctgaa

SEQ ID NO: 1123256 - DNA, 23 bp, Homo sapiens
tcattttgcagaaggaaatgatg

SEQ ID NO: 1123257 - DNA, 16 bp, Homo sapiens
tcattttgcattcaaa

SEQ ID NO: 1123258 - DNA, 17 bp, Homo sapiens
tcattttgcattcaaat

SEQ ID NO: 1123259 - DNA, 13 bp, Homo sapiens
tcattttggagct

SEQ ID NO: 1123260 - DNA, 16 bp, Homo sapiens
tcattttggtctgttt

SEQ ID NO: 1123261 - DNA, 18 bp, Homo sapiens
tcattttggttttgtgtt

SEQ ID NO: 1123262 - DNA, 16 bp, Homo sapiens
tcattttgttctgaaa

SEQ ID NO: 1123263 - DNA, 19 bp, Homo sapiens
tcattttgttttgctctga

SEQ ID NO: 1123264 - DNA, 19 bp, Homo sapiens
tcatttttaaagcctggct

SEQ ID NO: 1123265 - DNA, 21 bp, Homo sapiens
tcatttttaaagcctggcttc

SEQ ID NO: 1123266 - DNA, 19 bp, Homo sapiens
tcatttttaacagcatgct

SEQ ID NO: 1123267 - DNA, 23 bp, Homo sapiens
tcatttttaagactgtaatgtgt

SEQ ID NO: 1123268 - DNA, 13 bp, Homo sapiens
tcatttttaatgt

SEQ ID NO: 1123269 - DNA, 15 bp, Homo sapiens
tcatttttaatgtat

SEQ ID NO: 1123270 - DNA, 17 bp, Homo sapiens
tcatttttaatgtatct

SEQ ID NO: 1123271 - DNA, 15 bp, Homo sapiens
tcatttttacactat

SEQ ID NO: 1123272 - DNA, 19 bp, Homo sapiens
tcatttttcaatagcacat

SEQ ID NO: 1123273 - DNA, 22 bp, Homo sapiens
tcatttttgaaactgcatttgt

SEQ ID NO: 1123274 - DNA, 12 bp, Homo sapiens
tcatttttgctg

SEQ ID NO: 1123275 - DNA, 15 bp, Homo sapiens
tcatttttgtataaa

SEQ ID NO: 1123276 - DNA, 19 bp, Homo sapiens
tcatttttgtataaaaagg

SEQ ID NO: 1123277 - DNA, 16 bp, Homo sapiens
tcattttttaaaaaag

SEQ ID NO: 1123278 - DNA, 17 bp, Homo sapiens
tcatttttttaatttat

SEQ ID NO: 1123279 - DNA, 17 bp, Homo sapiens
tcatttttttttcaatc

SEQ ID NO: 1123280 - DNA, 18 bp, Homo sapiens
tccaaaaaaaaaaaaaat

SEQ ID NO: 1123281 - DNA, 17 bp, Homo sapiens
tccaaaaaaaggaaaaa

SEQ ID NO: 1123282 - DNA, 18 bp, Homo sapiens
tccaaaaaaaggaaaaat

SEQ ID NO: 1123283 - DNA, 21 bp, Homo sapiens
tccaaaaaaagggaaggattt

SEQ ID NO: 1123284 - DNA, 19 bp, Homo sapiens
tccaaaaagctctgaaaac

SEQ ID NO: 1123285 - DNA, 17 bp, Homo sapiens
tccaaaacctgcttcct

SEQ ID NO: 1123286 - DNA, 12 bp, Homo sapiens
tccaaaactgcc

SEQ ID NO: 1123287 - DNA, 23 bp, Homo sapiens
tccaaaacttctcttgaaaagtt

SEQ ID NO: 1123288 - DNA, 13 bp, Homo sapiens
tccaaaagacaaa

SEQ ID NO: 1123289 - DNA, 22 bp, Homo sapiens
tccaaaagattgctgaaatttt

SEQ ID NO: 1123290 - DNA, 14 bp, Homo sapiens
tccaaaagcacatg

SEQ ID NO: 1123291 - DNA, 17 bp, Homo sapiens
tccaaaataaaactttt

SEQ ID NO: 1123292 - DNA, 20 bp, Homo sapiens
tccaaaataaaactttttaa

SEQ ID NO: 1123293 - DNA, 14 bp, Homo sapiens
tccaaacagtgtgt

SEQ ID NO: 1123294 - DNA, 17 bp, Homo sapiens
tccaaaccaaattttaa

SEQ ID NO: 1123295 - DNA, 16 bp, Homo sapiens
tccaaaccagtttatt

SEQ ID NO: 1123296 - DNA, 16 bp, Homo sapiens
tccaaacccttcaact

SEQ ID NO: 1123297 - DNA, 19 bp, Homo sapiens
tccaaacctccagcctccc

SEQ ID NO: 1123298 - DNA, 12 bp, Homo sapiens
tccaaacctgtc

SEQ ID NO: 1123299 - DNA, 14 bp, Homo sapiens
tccaaacctgtctt

SEQ ID NO: 1123300 - DNA, 20 bp, Homo sapiens
tccaaacctgtcttggggcc

SEQ ID NO: 1123301 - DNA, 18 bp, Homo sapiens
tccaaacttggatttttg

SEQ ID NO: 1123302 - DNA, 21 bp, Homo sapiens
tcccccctctcctcccagctg

SEQ ID NO: 1123303 - DNA, 14 bp, Homo sapiens
tcccccctgctgcc

SEQ ID NO: 1123304 - DNA, 15 bp, Homo sapiens
tcccccctgctgccc

SEQ ID NO: 1123305 - DNA, 17 bp, Homo sapiens
tccccccttgaagcaat

SEQ ID NO: 1123306 - DNA, 20 bp, Homo sapiens
tcccccgaccaatccccagc

SEQ ID NO: 1123307 - DNA, 23 bp, Homo sapiens
tcccccgaccaatccccagccta

SEQ ID NO: 1123308 - DNA, 21 bp, Homo sapiens
tcccccgaccaggttggggag

SEQ ID NO: 1123309 - DNA, 15 bp, Homo sapiens
tcccccgactgcctg

SEQ ID NO: 1123310 - DNA, 17 bp, Homo sapiens
tcccccgcagtccccag

SEQ ID NO: 1123311 - DNA, 15 bp, Homo sapiens
tcccccgccctgccc

SEQ ID NO: 1123312 - DNA, 15 bp, Homo sapiens
tcccccggctgggcc

SEQ ID NO: 1123313 - DNA, 19 bp, Homo sapiens
tcccccgtgttcccctctt

SEQ ID NO: 1123314 - DNA, 12 bp, Homo sapiens
tccccctaccca

SEQ ID NO: 1123315 - DNA, 13 bp, Homo sapiens
tccccctacccac

SEQ ID NO: 1123316 - DNA, 21 bp, Homo sapiens
tccccctacccatatccctcc

SEQ ID NO: 1123317 - DNA, 21 bp, Homo sapiens
tccccctatttattgactttg

SEQ ID NO: 1123318 - DNA, 17 bp, Homo sapiens
tccccctcccagggcca

SEQ ID NO: 1123319 - DNA, 18 bp, Homo sapiens
tccccctcccagggccag

SEQ ID NO: 1123320 - DNA, 19 bp, Homo sapiens
tccccctcccagggccagg

SEQ ID NO: 1123321 - DNA, 14 bp, Homo sapiens
tccccctccccagg

SEQ ID NO: 1123322 - DNA, 20 bp, Homo sapiens
tccccctcccccttctccca

SEQ ID NO: 1123323 - DNA, 12 bp, Homo sapiens
tccccctcctga

SEQ ID NO: 1123324 - DNA, 12 bp, Homo sapiens
tccccctctgct

SEQ ID NO: 1123325 - DNA, 13 bp, Homo sapiens
tccccctctgctt

SEQ ID NO: 1123326 - DNA, 18 bp, Homo sapiens
tccccctctgtcttctct

SEQ ID NO: 1123327 - DNA, 20 bp, Homo sapiens
tccccctgcaaaaagaaaaa

SEQ ID NO: 1123328 - DNA, 21 bp, Homo sapiens
tccccctgcaacttccgctga

SEQ ID NO: 1123329 - DNA, 16 bp, Homo sapiens
tccccctgccagtgcc

SEQ ID NO: 1123330 - DNA, 13 bp, Homo sapiens
tccccctgccctg

SEQ ID NO: 1123331 - DNA, 20 bp, Homo sapiens
tccccctggggcttctcctg

SEQ ID NO: 1123332 - DNA, 21 bp, Homo sapiens
tccccctgtttcagaggctca

SEQ ID NO: 1123333 - DNA, 20 bp, Homo sapiens
tcccccttcagctcctgagt

SEQ ID NO: 1123334 - DNA, 20 bp, Homo sapiens
tcccccttcccttggaggga

SEQ ID NO: 1123335 - DNA, 13 bp, Homo sapiens
tcccccttctccc

SEQ ID NO: 1123336 - DNA, 12 bp, Homo sapiens
tcccccttcttc

SEQ ID NO: 1123337 - DNA, 18 bp, Homo sapiens
tcccccttcttcctcccc

SEQ ID NO: 1123338 - DNA, 23 bp, Homo sapiens
tcccccttcttcctcccctcaac

SEQ ID NO: 1123339 - DNA, 18 bp, Homo sapiens
tcccccttgtcttccccc

SEQ ID NO: 1123340 - DNA, 15 bp, Homo sapiens
tccccctttggggta

SEQ ID NO: 1123341 - DNA, 23 bp, Homo sapiens
tccccctttggggtagaccttga

SEQ ID NO: 1123342 - DNA, 19 bp, Homo sapiens
tcccccttttctgcatttt

SEQ ID NO: 1123343 - DNA, 20 bp, Homo sapiens
tccccgaagagtcagccccg

SEQ ID NO: 1123344 - DNA, 19 bp, Homo sapiens
tccccgacccccctacccc

SEQ ID NO: 1123345 - DNA, 19 bp, Homo sapiens
tccccgaggagctgggccc

SEQ ID NO: 1123346 - DNA, 23 bp, Homo sapiens
tccccgaggagctgggcccctgc

SEQ ID NO: 1123347 - DNA, 21 bp, Homo sapiens
tccccgaggctgccccaggcc

SEQ ID NO: 1123348 - DNA, 21 bp, Homo sapiens
tccccgagggcgaaggccatt

SEQ ID NO: 1123349 - DNA, 19 bp, Homo sapiens
tccccgaggttgtggggag

SEQ ID NO: 1123350 - DNA, 22 bp, Homo sapiens
tccccgagtcagggcgacttcc

SEQ ID NO: 1123351 - DNA, 13 bp, Homo sapiens
tccccgagtcctc

SEQ ID NO: 1123352 - DNA, 17 bp, Homo sapiens
tccccgagtcctcaggt

SEQ ID NO: 1123353 - DNA, 14 bp, Homo sapiens
tccccgagtgccta

SEQ ID NO: 1123354 - DNA, 14 bp, Homo sapiens
tccccgcacccccc

SEQ ID NO: 1123355 - DNA, 18 bp, Homo sapiens
tccccgcagcccgcctgc

SEQ ID NO: 1123356 - DNA, 12 bp, Homo sapiens
tccccgcccctg

SEQ ID NO: 1123357 - DNA, 16 bp, Homo sapiens
tccccgccgggcagtg

SEQ ID NO: 1123358 - DNA, 17 bp, Homo sapiens
tccccgcctccactcta

SEQ ID NO: 1123359 - DNA, 22 bp, Homo sapiens
tccccgcctcctcccactggga

SEQ ID NO: 1123360 - DNA, 16 bp, Homo sapiens
tccccgcctggccagg

SEQ ID NO: 1123361 - DNA, 20 bp, Homo sapiens
tccccgcctggccaggagca

SEQ ID NO: 1123362 - DNA, 19 bp, Homo sapiens
tccccgcgcgttccttcgc

SEQ ID NO: 1123363 - DNA, 22 bp, Homo sapiens
tccccgcggttcatacgcatcc

SEQ ID NO: 1123364 - DNA, 19 bp, Homo sapiens
tccccgctccgtctctgtc

SEQ ID NO: 1123365 - DNA, 14 bp, Homo sapiens
tccccgctctggat

SEQ ID NO: 1123366 - DNA, 23 bp, Homo sapiens
tccccggcaggcctgagaatgag

SEQ ID NO: 1123367 - DNA, 21 bp, Homo sapiens
tccccggccctaccagcgccc

SEQ ID NO: 1123368 - DNA, 19 bp, Homo sapiens
tccccggcggtgccgcgct

SEQ ID NO: 1123369 - DNA, 17 bp, Homo sapiens
tccccgtcccctgcagc

SEQ ID NO: 1123370 - DNA, 21 bp, Homo sapiens
tccccgtcccctgcagcctgg

SEQ ID NO: 1123371 - DNA, 15 bp, Homo sapiens
tccccgtccctgtcc

SEQ ID NO: 1123372 - DNA, 20 bp, Homo sapiens
tccccgtccctgtcccccag

SEQ ID NO: 1123373 - DNA, 18 bp, Homo sapiens
tcccctaacccccagtcc

SEQ ID NO: 1123374 - DNA, 20 bp, Homo sapiens
tcccctaagcagaccactga

SEQ ID NO: 1123375 - DNA, 17 bp, Homo sapiens
tcccctaagtctttact

SEQ ID NO: 1123376 - DNA, 23 bp, Homo sapiens
tcccctaccccctcctctctgcc

SEQ ID NO: 1123377 - DNA, 15 bp, Homo sapiens
tcccctactccctct

SEQ ID NO: 1123378 - DNA, 17 bp, Homo sapiens
tcccctactccctcttc

SEQ ID NO: 1123379 - DNA, 18 bp, Homo sapiens
tcccctagacctccccct

SEQ ID NO: 1123380 - DNA, 20 bp, Homo sapiens
tcccctatccacccagccca

SEQ ID NO: 1123381 - DNA, 19 bp, Homo sapiens
tcccctatggggatggtcc

SEQ ID NO: 1123382 - DNA, 20 bp, Homo sapiens
tcccctcaacaccctgcttc

SEQ ID NO: 1123383 - DNA, 21 bp, Homo sapiens
tcccctcaacaccctgcttct

SEQ ID NO: 1123384 - DNA, 22 bp, Homo sapiens
tcccctcaacaccctgcttctc

SEQ ID NO: 1123385 - DNA, 15 bp, Homo sapiens
tcccctcacatcctc

SEQ ID NO: 1123386 - DNA, 21 bp, Homo sapiens
tcccctcacatcctcctgccc

SEQ ID NO: 1123387 - DNA, 17 bp, Homo sapiens
tcccctcacctcctcta

SEQ ID NO: 1123388 - DNA, 14 bp, Homo sapiens
tcccctcactctgt

SEQ ID NO: 1123389 - DNA, 13 bp, Homo sapiens
tcccctcagagcc

SEQ ID NO: 1123390 - DNA, 17 bp, Homo sapiens
tcccctcagagcccatg

SEQ ID NO: 1123391 - DNA, 13 bp, Homo sapiens
tcccctcagcctc

SEQ ID NO: 1123392 - DNA, 17 bp, Homo sapiens
tcccctcagcctcttct

SEQ ID NO: 1123393 - DNA, 19 bp, Homo sapiens
tcccctcagcctcttctct

SEQ ID NO: 1123394 - DNA, 16 bp, Homo sapiens
tcccctcagcctgccc

SEQ ID NO: 1123395 - DNA, 14 bp, Homo sapiens
tcccctcagcgcag

SEQ ID NO: 1123396 - DNA, 14 bp, Homo sapiens
tcccctccacagct

SEQ ID NO: 1123397 - DNA, 20 bp, Homo sapiens
tcccctccacatcccagcag

SEQ ID NO: 1123398 - DNA, 16 bp, Homo sapiens
tcccctccatccccat

SEQ ID NO: 1123399 - DNA, 15 bp, Homo sapiens
tcccctcccagggga

SEQ ID NO: 1123400 - DNA, 16 bp, Homo sapiens
tcccctcccaggggag

SEQ ID NO: 1123401 - DNA, 13 bp, Homo sapiens
tcccctcccagtc

SEQ ID NO: 1123402 - DNA, 15 bp, Homo sapiens
tcccctcccatctgg

SEQ ID NO: 1123403 - DNA, 17 bp, Homo sapiens
tcccctcccatctggga

SEQ ID NO: 1123404 - DNA, 13 bp, Homo sapiens
tcccctccccagc

SEQ ID NO: 1123405 - DNA, 13 bp, Homo sapiens
tcccctcccccaa

SEQ ID NO: 1123406 - DNA, 20 bp, Homo sapiens
tcccctcccccactcctcta

SEQ ID NO: 1123407 - DNA, 15 bp, Homo sapiens
tcccctcccccatcc

SEQ ID NO: 1123408 - DNA, 23 bp, Homo sapiens
tcccctcccgacagcccatcacc

SEQ ID NO: 1123409 - DNA, 12 bp, Homo sapiens
tcccctccctcg

SEQ ID NO: 1123410 - DNA, 16 bp, Homo sapiens
tcccctccctcgtggg

SEQ ID NO: 1123411 - DNA, 17 bp, Homo sapiens
tcccctccctcgtgggc

SEQ ID NO: 1123412 - DNA, 18 bp, Homo sapiens
tcccctccctcttccttc

SEQ ID NO: 1123413 - DNA, 15 bp, Homo sapiens
tcccctccctgcctg

SEQ ID NO: 1123414 - DNA, 12 bp, Homo sapiens
tcccctccctgg

SEQ ID NO: 1123415 - DNA, 16 bp, Homo sapiens
tcccctccctggctcc

SEQ ID NO: 1123416 - DNA, 13 bp, Homo sapiens
tcccctccctggg

SEQ ID NO: 1123417 - DNA, 14 bp, Homo sapiens
tcccctccctgggt

SEQ ID NO: 1123418 - DNA, 16 bp, Homo sapiens
tcccctcctcttccct

SEQ ID NO: 1123419 - DNA, 16 bp, Homo sapiens
tcccctcctcttccga

SEQ ID NO: 1123420 - DNA, 11 bp, Homo sapiens
tcccctcctgc

SEQ ID NO: 1123421 - DNA, 14 bp, Homo sapiens
tcccctcctgctgg

SEQ ID NO: 1123422 - DNA, 12 bp, Homo sapiens
tcccctccttgc

SEQ ID NO: 1123423 - DNA, 18 bp, Homo sapiens
tcccctccttgcctcctg

SEQ ID NO: 1123424 - DNA, 16 bp, Homo sapiens
tccctcctgacaaata

SEQ ID NO: 1123425 - DNA, 17 bp, Homo sapiens
tccctcctgacaaatat

SEQ ID NO: 1123426 - DNA, 18 bp, Homo sapiens
tccctcctgacaaatatt

SEQ ID NO: 1123427 - DNA, 16 bp, Homo sapiens
tccctcctgcacacag

SEQ ID NO: 1123428 - DNA, 14 bp, Homo sapiens
tccctcctgcccag

SEQ ID NO: 1123429 - DNA, 14 bp, Homo sapiens
tccctcctggagct

SEQ ID NO: 1123430 - DNA, 12 bp, Homo sapiens
tccctcctggtc

SEQ ID NO: 1123431 - DNA, 17 bp, Homo sapiens
tccctcctggtcctgga

SEQ ID NO: 1123432 - DNA, 19 bp, Homo sapiens
tccctcctggtcctggaca

SEQ ID NO: 1123433 - DNA, 18 bp, Homo sapiens
tccctcctgtgccccagc

SEQ ID NO: 1123434 - DNA, 22 bp, Homo sapiens
tccctcgatcatatttcccctt

SEQ ID NO: 1123435 - DNA, 20 bp, Homo sapiens
tccctcgtccacaggggcag

SEQ ID NO: 1123436 - DNA, 19 bp, Homo sapiens
tccctcgtgggcttgtgct

SEQ ID NO: 1123437 - DNA, 17 bp, Homo sapiens
tccctctaatgagactg

SEQ ID NO: 1123438 - DNA, 14 bp, Homo sapiens
tccctctaatttat

SEQ ID NO: 1123439 - DNA, 14 bp, Homo sapiens
tccctctcatctca

SEQ ID NO: 1123440 - DNA, 14 bp, Homo sapiens
tccctctccactct

SEQ ID NO: 1123441 - DNA, 13 bp, Homo sapiens
tccctctcccagt

SEQ ID NO: 1123442 - DNA, 12 bp, Homo sapiens
tccctctccctg

SEQ ID NO: 1123443 - DNA, 12 bp, Homo sapiens
tccctctcctgc

SEQ ID NO: 1123444 - DNA, 15 bp, Homo sapiens
tccctctctcatgag

SEQ ID NO: 1123445 - DNA, 20 bp, Homo sapiens
tccctctctcatgagaagcc

SEQ ID NO: 1123446 - DNA, 18 bp, Homo sapiens
tccctctctcttctgctc

SEQ ID NO: 1123447 - DNA, 23 bp, Homo sapiens
tccctctctcttctgctccaccc

SEQ ID NO: 1123448 - DNA, 17 bp, Homo sapiens
tccctctcttccgggag

SEQ ID NO: 1123449 - DNA, 13 bp, Homo sapiens
tccctctgacctg

SEQ ID NO: 1123450 - DNA, 16 bp, Homo sapiens
tccctctgcagaatcc

SEQ ID NO: 1123451 - DNA, 20 bp, Homo sapiens
tccctctgcagaatcccttt

SEQ ID NO: 1123452 - DNA, 19 bp, Homo sapiens
tccctctgccccaagcagc

SEQ ID NO: 1123453 - DNA, 16 bp, Homo sapiens
tccctctgcctgtccc

SEQ ID NO: 1123454 - DNA, 20 bp, Homo sapiens
tccctctgcctgtccctctc

SEQ ID NO: 1123455 - DNA, 15 bp, Homo sapiens
tccctctgccttcag

SEQ ID NO: 1123456 - DNA, 18 bp, Homo sapiens
tccctctgctcctggagc

SEQ ID NO: 1123457 - DNA, 19 bp, Homo sapiens
tccctctggccctgccttc

SEQ ID NO: 1123458 - DNA, 20 bp, Homo sapiens
tccctctggccctgccttct

SEQ ID NO: 1123459 - DNA, 18 bp, Homo sapiens
tccctctgggccaatgct

SEQ ID NO: 1123460 - DNA, 19 bp, Homo sapiens
tccctctgggttccagcag

SEQ ID NO: 1123461 - DNA, 17 bp, Homo sapiens
tccctctgtcttttctc

SEQ ID NO: 1123462 - DNA, 20 bp, Homo sapiens
tccctcttcactgtggccac

SEQ ID NO: 1123463 - DNA, 14 bp, Homo sapiens
tccctcttctctcc

SEQ ID NO: 1123464 - DNA, 19 bp, Homo sapiens
tccctctttcatctcctga

SEQ ID NO: 1123465 - DNA, 23 bp, Homo sapiens
tccctctttggctcccctgtacc

SEQ ID NO: 1123466 - DNA, 22 bp, Homo sapiens
tccctcttttcttactcctcct

SEQ ID NO: 1123467 - DNA, 13 bp, Homo sapiens
tccctgaaacacg

SEQ ID NO: 1123468 - DNA, 21 bp, Homo sapiens
tccctgaaacacgaaacttgt

SEQ ID NO: 1123469 - DNA, 16 bp, Homo sapiens
tccctgaaacactgct

SEQ ID NO: 1123470 - DNA, 18 bp, Homo sapiens
tccctgaaatttctcatt

SEQ ID NO: 1123471 - DNA, 15 bp, Homo sapiens
tccctgaaccatccc

SEQ ID NO: 1123472 - DNA, 18 bp, Homo sapiens
tccctgaacccctggcca

SEQ ID NO: 1123473 - DNA, 18 bp, Homo sapiens
tccctgaacgttttcttc

SEQ ID NO: 1123474 - DNA, 22 bp, Homo sapiens
tccctgaacgttttcttctttc

SEQ ID NO: 1123475 - DNA, 23 bp, Homo sapiens
tccctgaacgttttcttctttcc

SEQ ID NO: 1123476 - DNA, 17 bp, Homo sapiens
tccctgaccctgtatat

SEQ ID NO: 1123477 - DNA, 22 bp, Homo sapiens
tccctgaccctgtatatagccc

SEQ ID NO: 1123478 - DNA, 16 bp, Homo sapiens
tccctgacctccctct

SEQ ID NO: 1123479 - DNA, 22 bp, Homo sapiens
tccctgaccttagcgttctgga

SEQ ID NO: 1123480 - DNA, 14 bp, Homo sapiens
tccctgactcattc

SEQ ID NO: 1123481 - DNA, 16 bp, Homo sapiens
tccctgactccctgtg

SEQ ID NO: 1123482 - DNA, 14 bp, Homo sapiens
tccctgactgggag

SEQ ID NO: 1123483 - DNA, 15 bp, Homo sapiens
tccctgactgggagt

SEQ ID NO: 1123484 - DNA, 14 bp, Homo sapiens
tccctgacttctcc

SEQ ID NO: 1123485 - DNA, 12 bp, Homo sapiens
tccctgagcctg

SEQ ID NO: 1123486 - DNA, 15 bp, Homo sapiens
tccctgagcctgcat

SEQ ID NO: 1123487 - DNA, 18 bp, Homo sapiens
tccctgagcctgcattct

SEQ ID NO: 1123488 - DNA, 20 bp, Homo sapiens
tccctgagcctgcattctgc

SEQ ID NO: 1123489 - DNA, 14 bp, Homo sapiens
tccctgagctttgg

SEQ ID NO: 1123490 - DNA, 21 bp, Homo sapiens
tccctgaggactgatttcaga

SEQ ID NO: 1123491 - DNA, 17 bp, Homo sapiens
tccctgagtcaccagga

SEQ ID NO: 1123492 - DNA, 22 bp, Homo sapiens
tccctgagtctggacctccatc

SEQ ID NO: 1123493 - DNA, 15 bp, Homo sapiens
tccctgatcccaccc

SEQ ID NO: 1123494 - DNA, 15 bp, Homo sapiens
tccctgatggaccct

SEQ ID NO: 1123495 - DNA, 17 bp, Homo sapiens
tccctgattgacctgct

SEQ ID NO: 1123496 - DNA, 13 bp, Homo sapiens
tccctgatttaat

SEQ ID NO: 1123497 - DNA, 15 bp, Homo sapiens
tccctgcaaccaact

SEQ ID NO: 1123498 - DNA, 13 bp, Homo sapiens
tccctgcaccgcc

SEQ ID NO: 1123499 - DNA, 21 bp, Homo sapiens
tccctgcaccgccgcagaagc

SEQ ID NO: 1123500 - DNA, 19 bp, Homo sapiens
tccctgcactccctcctgg

SEQ ID NO: 1123501 - DNA, 13 bp, Homo sapiens
tccctgcactgtg

SEQ ID NO: 1123502 - DNA, 16 bp, Homo sapiens
tccctgcactgtgccc

SEQ ID NO: 1123503 - DNA, 17 bp, Homo sapiens
tccctgcactgtgcccc

SEQ ID NO: 1123504 - DNA, 19 bp, Homo sapiens
tccctgcagaagccagaag

SEQ ID NO: 1123505 - DNA, 21 bp, Homo sapiens
tccctgcagccaccagacttg

SEQ ID NO: 1123506 - DNA, 13 bp, Homo sapiens
tccctgcatcctg

SEQ ID NO: 1123507 - DNA, 16 bp, Homo sapiens
tccctgcatcctgagg

SEQ ID NO: 1123508 - DNA, 19 bp, Homo sapiens
tccctgcatcctgaggcca

SEQ ID NO: 1123509 - DNA, 16 bp, Homo sapiens
tccctgcatctgacca

SEQ ID NO: 1123510 - DNA, 19 bp, Homo sapiens
tccctgccaatgctccagc

SEQ ID NO: 1123511 - DNA, 23 bp, Homo sapiens
tccctgccacactcagtccccca

SEQ ID NO: 1123512 - DNA, 22 bp, Homo sapiens
tccctgccaccaggcactgcct

SEQ ID NO: 1123513 - DNA, 17 bp, Homo sapiens
tccctgccactgggctc

SEQ ID NO: 1123514 - DNA, 19 bp, Homo sapiens
tccctgccactgggctctg

SEQ ID NO: 1123515 - DNA, 17 bp, Homo sapiens
tccctgccatccccctc

SEQ ID NO: 1123516 - DNA, 19 bp, Homo sapiens
tccctgcccaaactcccct

SEQ ID NO: 1123517 - DNA, 15 bp, Homo sapiens
tccctgcccagcctg

SEQ ID NO: 1123518 - DNA, 17 bp, Homo sapiens
tccctgcccagcctgtg

SEQ ID NO: 1123519 - DNA, 17 bp, Homo sapiens
tccctgccccgcccccc

SEQ ID NO: 1123520 - DNA, 18 bp, Homo sapiens
tccctgccccgcccccca

SEQ ID NO: 1123521 - DNA, 22 bp, Homo sapiens
tccctgccccgccccccagagc

SEQ ID NO: 1123522 - DNA, 14 bp, Homo sapiens
tccctgccccttaa

SEQ ID NO: 1123523 - DNA, 14 bp, Homo sapiens
tccctgccgcctca

SEQ ID NO: 1123524 - DNA, 14 bp, Homo sapiens
tccctgcctgaggg

SEQ ID NO: 1123525 - DNA, 15 bp, Homo sapiens
tccctgcctgctcct

SEQ ID NO: 1123526 - DNA, 21 bp, Homo sapiens
tccctgcctgctccttggcac

SEQ ID NO: 1123527 - DNA, 23 bp, Homo sapiens
tccctgcctgctccttggcaccc

SEQ ID NO: 1123528 - DNA, 20 bp, Homo sapiens
tccctgccttaggcctacct

SEQ ID NO: 1123529 - DNA, 23 bp, Homo sapiens
tccctgcgagacgcacacagctg

SEQ ID NO: 1123530 - DNA, 21 bp, Homo sapiens
tccctgcgcccttgaggggcc

SEQ ID NO: 1123531 - DNA, 21 bp, Homo sapiens
tccctgcgcctgtgatgctgg

SEQ ID NO: 1123532 - DNA, 12 bp, Homo sapiens
tccctgctcagt

SEQ ID NO: 1123533 - DNA, 15 bp, Homo sapiens
tccctgctcagtgct

SEQ ID NO: 1123534 - DNA, 12 bp, Homo sapiens
tccctgctcccc

SEQ ID NO: 1123535 - DNA, 13 bp, Homo sapiens
tccctgctcccct

SEQ ID NO: 1123536 - DNA, 13 bp, Homo sapiens
tccctgctcctca

SEQ ID NO: 1123537 - DNA, 18 bp, Homo sapiens
tccctgctcctcatggga

SEQ ID NO: 1123538 - DNA, 16 bp, Homo sapiens
tccctgctctggtccc

SEQ ID NO: 1123539 - DNA, 20 bp, Homo sapiens
tccctgctctggtcccctct

SEQ ID NO: 1123540 - DNA, 12 bp, Homo sapiens
tccctgcttcca

SEQ ID NO: 1123541 - DNA, 19 bp, Homo sapiens
tccctgcttgcacacttcc

SEQ ID NO: 1123542 - DNA, 22 bp, Homo sapiens
tccctgcttgcacacttcccca

SEQ ID NO: 1123543 - DNA, 16 bp, Homo sapiens
tccctgcttgcccgct

SEQ ID NO: 1123544 - DNA, 18 bp, Homo sapiens
tccctgctttggtcttgc

SEQ ID NO: 1123545 - DNA, 19 bp, Homo sapiens
tccctgctttttgtgtttt

SEQ ID NO: 1123546 - DNA, 15 bp, Homo sapiens
tccgcggcctgcacc

SEQ ID NO: 1123547 - DNA, 20 bp, Homo sapiens
tccgcgggctgactgggcca

SEQ ID NO: 1123548 - DNA, 16 bp, Homo sapiens
tccgcggggaccctgc

SEQ ID NO: 1123549 - DNA, 19 bp, Homo sapiens
tccgcggggaccctgccga

SEQ ID NO: 1123550 - DNA, 20 bp, Homo sapiens
tccgctcccaccgcccccac

SEQ ID NO: 1123551 - DNA, 14 bp, Homo sapiens
tccgctccctggat

SEQ ID NO: 1123552 - DNA, 17 bp, Homo sapiens
tccgctctcttcctgcc

SEQ ID NO: 1123553 - DNA, 13 bp, Homo sapiens
tccgctctgaggc

SEQ ID NO: 1123554 - DNA, 13 bp, Homo sapiens
tccgctgccacca

SEQ ID NO: 1123555 - DNA, 19 bp, Homo sapiens
tccgctgccagccttgagc

SEQ ID NO: 1123556 - DNA, 12 bp, Homo sapiens
tccgctgctcct

SEQ ID NO: 1123557 - DNA, 18 bp, Homo sapiens
tccggaggactgagcccc

SEQ ID NO: 1123558 - DNA, 20 bp, Homo sapiens
tccggaggactgagccccca

SEQ ID NO: 1123559 - DNA, 14 bp, Homo sapiens
tccggaggagcagc

SEQ ID NO: 1123560 - DNA, 15 bp, Homo sapiens
tccggaggagcagcc

SEQ ID NO: 1123561 - DNA, 19 bp, Homo sapiens
tccggaggagcagcctcga

SEQ ID NO: 1123562 - DNA, 15 bp, Homo sapiens
tccggaggcagcaga

SEQ ID NO: 1123563 - DNA, 17 bp, Homo sapiens
tccggaggggacccagc

SEQ ID NO: 1123564 - DNA, 19 bp, Homo sapiens
tccggaggggacccagctc

SEQ ID NO: 1123565 - DNA, 22 bp, Homo sapiens
tccggaggggacccagctcctc

SEQ ID NO: 1123566 - DNA, 17 bp, Homo sapiens
tccggagggggtcctcc

SEQ ID NO: 1123567 - DNA, 15 bp, Homo sapiens
tccggcccagtgcca

SEQ ID NO: 1123568 - DNA, 17 bp, Homo sapiens
tccggcccagtgccagc

SEQ ID NO: 1123569 - DNA, 15 bp, Homo sapiens
tccggcctgtaatca

SEQ ID NO: 1123570 - DNA, 24 bp, Homo sapiens
tccggcctgtaatcagctctcctg

SEQ ID NO: 1123571 - DNA, 13 bp, Homo sapiens
tccggcgccccgc

SEQ ID NO: 1123572 - DNA, 14 bp, Homo sapiens
tccggcgccccgca

SEQ ID NO: 1123573 - DNA, 17 bp, Homo sapiens
tccggcgccccgcaccc

SEQ ID NO: 1123574 - DNA, 16 bp, Homo sapiens
tccggctgctcctcca

SEQ ID NO: 1123575 - DNA, 21 bp, Homo sapiens
tccggcttgacctgtttctct

SEQ ID NO: 1123576 - DNA, 16 bp, Homo sapiens
tccgggaaaacagcta

SEQ ID NO: 1123577 - DNA, 14 bp, Homo sapiens
tccgggagctggtg

SEQ ID NO: 1123578 - DNA, 12 bp, Homo sapiens
tccgggaggtca

SEQ ID NO: 1123579 - DNA, 21 bp, Homo sapiens
tccgggcaaatgccagggccc

SEQ ID NO: 1123580 - DNA, 12 bp, Homo sapiens
tccgggcagggg

SEQ ID NO: 1123581 - DNA, 14 bp, Homo sapiens
tccgggcaggggag

SEQ ID NO: 1123582 - DNA, 18 bp, Homo sapiens
tccgggcctttctctggc

SEQ ID NO: 1123583 - DNA, 18 bp, Homo sapiens
tccggggccccactggct

SEQ ID NO: 1123584 - DNA, 16 bp, Homo sapiens
tccggggtctgtgctg

SEQ ID NO: 1123585 - DNA, 21 bp, Homo sapiens
tccggggtctgtgctgtgcct

SEQ ID NO: 1123586 - DNA, 14 bp, Homo sapiens
tccgggtcactgct

SEQ ID NO: 1123587 - DNA, 16 bp, Homo sapiens
tccgggtctcgcagcc

SEQ ID NO: 1123588 - DNA, 17 bp, Homo sapiens
tccgggtgtggcctcag

SEQ ID NO: 1123589 - DNA, 19 bp, Homo sapiens
tccgggtgtggcctcagcc

SEQ ID NO: 1123590 - DNA, 21 bp, Homo sapiens
tccggtggcctattccaggaa

SEQ ID NO: 1123591 - DNA, 19 bp, Homo sapiens
tccggtgtgcctgcagccc

SEQ ID NO: 1123592 - DNA, 21 bp, Homo sapiens
tccggtttagtcatccaacaa

SEQ ID NO: 1123593 - DNA, 16 bp, Homo sapiens
tccggtttctttttgc

SEQ ID NO: 1123594 - DNA, 14 bp, Homo sapiens
tccggtttgccatg

SEQ ID NO: 1123595 - DNA, 19 bp, Homo sapiens
tccggtttgggctgtctta

SEQ ID NO: 1123596 - DNA, 17 bp, Homo sapiens
tccgtagggtctttctt

SEQ ID NO: 1123597 - DNA, 12 bp, Homo sapiens
tccgtagtttgt

SEQ ID NO: 1123598 - DNA, 17 bp, Homo sapiens
tccgtagtttgttttct

SEQ ID NO: 1123599 - DNA, 23 bp, Homo sapiens
tccgtatctccctggagaagcac

SEQ ID NO: 1123600 - DNA, 23 bp, Homo sapiens
tccgtcaaaacagattgtttgca

SEQ ID NO: 1123601 - DNA, 18 bp, Homo sapiens
tccgtcatccatgccctc

SEQ ID NO: 1123602 - DNA, 18 bp, Homo sapiens
tccgtcattgctgctgct

SEQ ID NO: 1123603 - DNA, 17 bp, Homo sapiens
tccgtccacccaggctg

SEQ ID NO: 1123604 - DNA, 20 bp, Homo sapiens
tccgtccacccttccatcag

SEQ ID NO: 1123605 - DNA, 23 bp, Homo sapiens
tccgtccagagccggcatccttg

SEQ ID NO: 1123606 - DNA, 15 bp, Homo sapiens
tccgtccatccccct

SEQ ID NO: 1123607 - DNA, 16 bp, Homo sapiens
tccgtccccccccagg

SEQ ID NO: 1123608 - DNA, 19 bp, Homo sapiens
tccgtccccccccaggccc

SEQ ID NO: 1123609 - DNA, 20 bp, Homo sapiens
tccgtccccccccaggccct

SEQ ID NO: 1123610 - DNA, 12 bp, Homo sapiens
tccgtctgtctc

SEQ ID NO: 1123611 - DNA, 18 bp, Homo sapiens
tccgtgaaaacggagctg

SEQ ID NO: 1123612 - DNA, 23 bp, Homo sapiens
tccgtgagttgggggagggaaga

SEQ ID NO: 1123613 - DNA, 18 bp, Homo sapiens
tccgtgatccatccatct

SEQ ID NO: 1123614 - DNA, 23 bp, Homo sapiens
tccgtgatccatccatctccagg

SEQ ID NO: 1123615 - DNA, 15 bp, Homo sapiens
tccgtgcatcccaga

SEQ ID NO: 1123616 - DNA, 14 bp, Homo sapiens
tccgtgcccaggcc

SEQ ID NO: 1123617 - DNA, 13 bp, Homo sapiens
tccgtgctgacag

SEQ ID NO: 1123618 - DNA, 17 bp, Homo sapiens
tccgtgctgacagctgc

SEQ ID NO: 1123619 - DNA, 18 bp, Homo sapiens
tccgtgctgacagctgct

SEQ ID NO: 1123620 - DNA, 19 bp, Homo sapiens
tccgtgctgacagctgctc

SEQ ID NO: 1123621 - DNA, 12 bp, Homo sapiens
tccgtggaggag

SEQ ID NO: 1123622 - DNA, 22 bp, Homo sapiens
tccgtggaggaggttgggaggg

SEQ ID NO: 1123623 - DNA, 16 bp, Homo sapiens
tccgtgggacggtgcc

SEQ ID NO: 1123624 - DNA, 13 bp, Homo sapiens
tccgtgtcctctc

SEQ ID NO: 1123625 - DNA, 18 bp, Homo sapiens
tccgtgtcctctccccca

SEQ ID NO: 1123626 - DNA, 22 bp, Homo sapiens
tccgtgtgccgttgctccggcc

SEQ ID NO: 1123627 - DNA, 14 bp, Homo sapiens
tccgtgtgtatgtg

SEQ ID NO: 1123628 - DNA, 22 bp, Homo sapiens
tccgtgttgcaggttcatggat

SEQ ID NO: 1123629 - DNA, 12 bp, Homo sapiens
tcctaaaacaac

SEQ ID NO: 1123630 - DNA, 18 bp, Homo sapiens
tcctaaagagttattcaa

SEQ ID NO: 1123631 - DNA, 22 bp, Homo sapiens
tcctaaagccaaagtttctgtt

SEQ ID NO: 1123632 - DNA, 15 bp, Homo sapiens
tcctaaatatccaaa

SEQ ID NO: 1123633 - DNA, 23 bp, Homo sapiens
tcctaaatatccaaagactgtac

SEQ ID NO: 1123634 - DNA, 15 bp, Homo sapiens
tcctaaatgcagtga

SEQ ID NO: 1123635 - DNA, 19 bp, Homo sapiens
tcctaaatgcagtgaattg

SEQ ID NO: 1123636 - DNA, 16 bp, Homo sapiens
tcctaacaggatgaaa

SEQ ID NO: 1123637 - DNA, 24 bp, Homo sapiens
tcctaactttggacctattatcag

SEQ ID NO: 1123638 - DNA, 13 bp, Homo sapiens
tcctaagaaagag

SEQ ID NO: 1123639 - DNA, 18 bp, Homo sapiens
tcctaagaatttttcatt

SEQ ID NO: 1123640 - DNA, 16 bp, Homo sapiens
tcctaagacacaaatg

SEQ ID NO: 1123641 - DNA, 19 bp, Homo sapiens
tcctaagacacaaatgcat

SEQ ID NO: 1123642 - DNA, 16 bp, Homo sapiens
tcctaaggacacacta

SEQ ID NO: 1123643 - DNA, 17 bp, Homo sapiens
tcctaaggacacactaa

SEQ ID NO: 1123644 - DNA, 19 bp, Homo sapiens
tcctaaggagttaaatctt

SEQ ID NO: 1123645 - DNA, 16 bp, Homo sapiens
tcctaaggctccccac

SEQ ID NO: 1123646 - DNA, 17 bp, Homo sapiens
tcctaaggctccccacc

SEQ ID NO: 1123647 - DNA, 18 bp, Homo sapiens
tcctaaggctccccaccc

SEQ ID NO: 1123648 - DNA, 20 bp, Homo sapiens
tcctaaggctccccaccccg

SEQ ID NO: 1123649 - DNA, 23 bp, Homo sapiens
tcctaaggtccaacaagaatgca

SEQ ID NO: 1123650 - DNA, 17 bp, Homo sapiens
tcctaagtcccttccta

SEQ ID NO: 1123651 - DNA, 22 bp, Homo sapiens
tcctaataatatcccactggga

SEQ ID NO: 1123652 - DNA, 15 bp, Homo sapiens
tcctaatactgtcat

SEQ ID NO: 1123653 - DNA, 23 bp, Homo sapiens
tcctaatgaaggttttcatttgc

SEQ ID NO: 1123654 - DNA, 18 bp, Homo sapiens
tcctaattaccagtcttt

SEQ ID NO: 1123655 - DNA, 15 bp, Homo sapiens
tcctaattccacagc

SEQ ID NO: 1123656 - DNA, 15 bp, Homo sapiens
tcctaatttctcctc

SEQ ID NO: 1123657 - DNA, 19 bp, Homo sapiens
tcctaatttctcctccctt

SEQ ID NO: 1123658 - DNA, 18 bp, Homo sapiens
tcctacaagagcagcctg

SEQ ID NO: 1123659 - DNA, 22 bp, Homo sapiens
tcctacaagagcagcctgtggc

SEQ ID NO: 1123660 - DNA, 17 bp, Homo sapiens
tcctacaagatttagaa

SEQ ID NO: 1123661 - DNA, 20 bp, Homo sapiens
tcctacagaaatactgctct

SEQ ID NO: 1123662 - DNA, 15 bp, Homo sapiens
tcctacagcactact

SEQ ID NO: 1123663 - DNA, 21 bp, Homo sapiens
tcctacagcactactgggtgt

SEQ ID NO: 1123664 - DNA, 14 bp, Homo sapiens
tcctacagtacaat

SEQ ID NO: 1123665 - DNA, 23 bp, Homo sapiens
tcctacagtgactccctgggagc

SEQ ID NO: 1123666 - DNA, 18 bp, Homo sapiens
tcctacatccagctcctc

SEQ ID NO: 1123667 - DNA, 21 bp, Homo sapiens
tcctacatccagctcctctag

SEQ ID NO: 1123668 - DNA, 11 bp, Homo sapiens
tcctctatttt

SEQ ID NO: 1123669 - DNA, 14 bp, Homo sapiens
tcctctattttgtg

SEQ ID NO: 1123670 - DNA, 18 bp, Homo sapiens
tcctctattttgtgatga

SEQ ID NO: 1123671 - DNA, 22 bp, Homo sapiens
tcctctcaagctagccagaggg

SEQ ID NO: 1123672 - DNA, 17 bp, Homo sapiens
tcctctccaccctcctc

SEQ ID NO: 1123673 - DNA, 22 bp, Homo sapiens
tcctctccaccctcctctagcc

SEQ ID NO: 1123674 - DNA, 23 bp, Homo sapiens
tcctctccaccctcctctagcca

SEQ ID NO: 1123675 - DNA, 14 bp, Homo sapiens
tcctctccactgct

SEQ ID NO: 1123676 - DNA, 12 bp, Homo sapiens
tcctctccagag

SEQ ID NO: 1123677 - DNA, 14 bp, Homo sapiens
tcctctccaggaag

SEQ ID NO: 1123678 - DNA, 14 bp, Homo sapiens
tcctctccaggcac

SEQ ID NO: 1123679 - DNA, 13 bp, Homo sapiens
tcctctccatacc

SEQ ID NO: 1123680 - DNA, 14 bp, Homo sapiens
tcctctccatttta

SEQ ID NO: 1123681 - DNA, 15 bp, Homo sapiens
tcctctccattttag

SEQ ID NO: 1123682 - DNA, 19 bp, Homo sapiens
tcctctccattttagccca

SEQ ID NO: 1123683 - DNA, 23 bp, Homo sapiens
tcctctcccacagagtgctggac

SEQ ID NO: 1123684 - DNA, 17 bp, Homo sapiens
tcctctcccatccccct

SEQ ID NO: 1123685 - DNA, 18 bp, Homo sapiens
tcctctcccatccccctg

SEQ ID NO: 1123686 - DNA, 20 bp, Homo sapiens
tcctctcccatccccctgcc

SEQ ID NO: 1123687 - DNA, 19 bp, Homo sapiens
tcctctcccattgtccctc

SEQ ID NO: 1123688 - DNA, 20 bp, Homo sapiens
tcctctcccattgtccctct

SEQ ID NO: 1123689 - DNA, 22 bp, Homo sapiens
tcctctcccattgtccctctgc

SEQ ID NO: 1123690 - DNA, 20 bp, Homo sapiens
tcctctccccctcctccagg

SEQ ID NO: 1123691 - DNA, 14 bp, Homo sapiens
tcctctcccccttc

SEQ ID NO: 1123692 - DNA, 16 bp, Homo sapiens
tcctctcccccttcag

SEQ ID NO: 1123693 - DNA, 21 bp, Homo sapiens
tcctctcccccttcagctcct

SEQ ID NO: 1123694 - DNA, 18 bp, Homo sapiens
tcctctcccttcccttcc

SEQ ID NO: 1123695 - DNA, 17 bp, Homo sapiens
tcctctccttcccacaa

SEQ ID NO: 1123696 - DNA, 16 bp, Homo sapiens
tcctctccttgggctc

SEQ ID NO: 1123697 - DNA, 15 bp, Homo sapiens
tcctctcgcggccct

SEQ ID NO: 1123698 - DNA, 14 bp, Homo sapiens
tcctctctaccccc

SEQ ID NO: 1123699 - DNA, 20 bp, Homo sapiens
tcctctctcccaccctaagg

SEQ ID NO: 1123700 - DNA, 11 bp, Homo sapiens
tcctctctctc

SEQ ID NO: 1123701 - DNA, 13 bp, Homo sapiens
tcctctctgggcc

SEQ ID NO: 1123702 - DNA, 13 bp, Homo sapiens
tcctctctgtctg

SEQ ID NO: 1123703 - DNA, 20 bp, Homo sapiens
tcctctcttaaatgcaagtg

SEQ ID NO: 1123704 - DNA, 21 bp, Homo sapiens
tcctctgaccctccttctatt

SEQ ID NO: 1123705 - DNA, 17 bp, Homo sapiens
tcctctgagccttggga

SEQ ID NO: 1123706 - DNA, 15 bp, Homo sapiens
tcctctgatacccag

SEQ ID NO: 1123707 - DNA, 17 bp, Homo sapiens
tcctctgatctccatgg

SEQ ID NO: 1123708 - DNA, 14 bp, Homo sapiens
tcctctgccacctc

SEQ ID NO: 1123709 - DNA, 14 bp, Homo sapiens
tcctctgcctacag

SEQ ID NO: 1123710 - DNA, 22 bp, Homo sapiens
tcctctgcctgccccgccccca

SEQ ID NO: 1123711 - DNA, 14 bp, Homo sapiens
tcctctgcctgggc

SEQ ID NO: 1123712 - DNA, 22 bp, Homo sapiens
tcctctgcctgggctctggaag

SEQ ID NO: 1123713 - DNA, 11 bp, Homo sapiens
tcctctgcctt

SEQ ID NO: 1123714 - DNA, 22 bp, Homo sapiens
tcctctgccttggacaccatcc

SEQ ID NO: 1123715 - DNA, 22 bp, Homo sapiens
tcctctgctatgcattttcttc

SEQ ID NO: 1123716 - DNA, 14 bp, Homo sapiens
tcctctgctccagc

SEQ ID NO: 1123717 - DNA, 13 bp, Homo sapiens
tcctctgctggga

SEQ ID NO: 1123718 - DNA, 13 bp, Homo sapiens
tcctctggacacg

SEQ ID NO: 1123719 - DNA, 17 bp, Homo sapiens
tcctctggatggcacca

SEQ ID NO: 1123720 - DNA, 9 bp, Homo sapiens
tcctctggc

SEQ ID NO: 1123721 - DNA, 18 bp, Homo sapiens
tcctctggcaggcttccc

SEQ ID NO: 1123722 - DNA, 13 bp, Homo sapiens
tcctctggccgca

SEQ ID NO: 1123723 - DNA, 12 bp, Homo sapiens
tcctctggcttt

SEQ ID NO: 1123724 - DNA, 19 bp, Homo sapiens
tcctctgggcagcgctatc

SEQ ID NO: 1123725 - DNA, 16 bp, Homo sapiens
tcctctgggcctgggg

SEQ ID NO: 1123726 - DNA, 14 bp, Homo sapiens
tcctctggttcctt

SEQ ID NO: 1123727 - DNA, 17 bp, Homo sapiens
tcctctggttcctttca

SEQ ID NO: 1123728 - DNA, 21 bp, Homo sapiens
tcctctgtgaccaatgtcttg

SEQ ID NO: 1123729 - DNA, 14 bp, Homo sapiens
tcctctgtgcccac

SEQ ID NO: 1123730 - DNA, 19 bp, Homo sapiens
tcctctgttcaaagctgcc

SEQ ID NO: 1123731 - DNA, 23 bp, Homo sapiens
tcctctgttcaaagctgcctgtc

SEQ ID NO: 1123732 - DNA, 12 bp, Homo sapiens
tcctctgttcac

SEQ ID NO: 1123733 - DNA, 20 bp, Homo sapiens
tcctcttagaagaatattgt

SEQ ID NO: 1123734 - DNA, 13 bp, Homo sapiens
tcctcttcagaac

SEQ ID NO: 1123735 - DNA, 15 bp, Homo sapiens
tcctcttccccttgc

SEQ ID NO: 1123736 - DNA, 18 bp, Homo sapiens
tcctcttccccttgccct

SEQ ID NO: 1123737 - DNA, 19 bp, Homo sapiens
tcctcttcccttagcctct

SEQ ID NO: 1123738 - DNA, 15 bp, Homo sapiens
tcctcttcctctgag

SEQ ID NO: 1123739 - DNA, 15 bp, Homo sapiens
tcctcttctgacgtg

SEQ ID NO: 1123740 - DNA, 17 bp, Homo sapiens
tcctcttctgggcctga

SEQ ID NO: 1123741 - DNA, 13 bp, Homo sapiens
tcctcttctttat

SEQ ID NO: 1123742 - DNA, 16 bp, Homo sapiens
tcctcttgaccctgca

SEQ ID NO: 1123743 - DNA, 22 bp, Homo sapiens
tcctcttggcaagatgtttctt

SEQ ID NO: 1123744 - DNA, 23 bp, Homo sapiens
tcctcttggcaagatgtttctta

SEQ ID NO: 1123745 - DNA, 21 bp, Homo sapiens
tcctcttggtgggtgtggcca

SEQ ID NO: 1123746 - DNA, 12 bp, Homo sapiens
tcctcttgtaaa

SEQ ID NO: 1123747 - DNA, 19 bp, Homo sapiens
tcctcttgtaaataaagcc

SEQ ID NO: 1123748 - DNA, 14 bp, Homo sapiens
tcctcttgtcctgg

SEQ ID NO: 1123749 - DNA, 18 bp, Homo sapiens
tcctcttgtcctggccct

SEQ ID NO: 1123750 - DNA, 20 bp, Homo sapiens
tcctcttgtcctggcccttc

SEQ ID NO: 1123751 - DNA, 21 bp, Homo sapiens
tcctcttgtcctggcccttca

SEQ ID NO: 1123752 - DNA, 23 bp, Homo sapiens
tcctcttgtcctggcccttcagt

SEQ ID NO: 1123753 - DNA, 20 bp, Homo sapiens
tcctcttgtgatttctttaa

SEQ ID NO: 1123754 - DNA, 18 bp, Homo sapiens
tcctctttactctgggca

SEQ ID NO: 1123755 - DNA, 13 bp, Homo sapiens
tcctctttctctc

SEQ ID NO: 1123756 - DNA, 17 bp, Homo sapiens
tcctctttctctcccca

SEQ ID NO: 1123757 - DNA, 12 bp, Homo sapiens
tcctctttctgc

SEQ ID NO: 1123758 - DNA, 16 bp, Homo sapiens
tcctctttctgctctg

SEQ ID NO: 1123759 - DNA, 16 bp, Homo sapiens
tcctctttgctttgct

SEQ ID NO: 1123760 - DNA, 20 bp, Homo sapiens
tcctctttgctttgctttct

SEQ ID NO: 1123761 - DNA, 21 bp, Homo sapiens
tcctcttttatcttggactga

SEQ ID NO: 1123762 - DNA, 15 bp, Homo sapiens
tcctcttttcctggc

SEQ ID NO: 1123763 - DNA, 18 bp, Homo sapiens
tcctcttttcctggcagc

SEQ ID NO: 1123764 - DNA, 20 bp, Homo sapiens
tcctcttttcctggcagctg

SEQ ID NO: 1123765 - DNA, 17 bp, Homo sapiens
tcctgaaacccaaagcc

SEQ ID NO: 1123766 - DNA, 16 bp, Homo sapiens
tcctgaaacgctcctt

SEQ ID NO: 1123767 - DNA, 22 bp, Homo sapiens
tcctgaaacgctcctttgtgtg

SEQ ID NO: 1123768 - DNA, 21 bp, Homo sapiens
tcctgaaagaaacagttaact

SEQ ID NO: 1123769 - DNA, 15 bp, Homo sapiens
tcctgaaagggcact

SEQ ID NO: 1123770 - DNA, 15 bp, Homo sapiens
tcctgaaataaatgt

SEQ ID NO: 1123771 - DNA, 14 bp, Homo sapiens
tcctgaaatataaa

SEQ ID NO: 1123772 - DNA, 12 bp, Homo sapiens
tcctgaaatcaa

SEQ ID NO: 1123773 - DNA, 22 bp, Homo sapiens
tcctgaaccgactgaccctgag

SEQ ID NO: 1123774 - DNA, 21 bp, Homo sapiens
tcctgaaccgcacagctcagg

SEQ ID NO: 1123775 - DNA, 15 bp, Homo sapiens
tcctgaactttctcc

SEQ ID NO: 1123776 - DNA, 18 bp, Homo sapiens
tcctgaactttctccctc

SEQ ID NO: 1123777 - DNA, 13 bp, Homo sapiens
tcctgaagaatta

SEQ ID NO: 1123778 - DNA, 17 bp, Homo sapiens
tcctgaagaggcgggcc

SEQ ID NO: 1123779 - DNA, 23 bp, Homo sapiens
tcctgaagaggcgggccagccag

SEQ ID NO: 1123780 - DNA, 13 bp, Homo sapiens
tcctgaagccaga

SEQ ID NO: 1123781 - DNA, 18 bp, Homo sapiens
tcctgaagccctctgtct

SEQ ID NO: 1123782 - DNA, 14 bp, Homo sapiens
tcctgaagcctctg

SEQ ID NO: 1123783 - DNA, 13 bp, Homo sapiens
tcctgaagctgag

SEQ ID NO: 1123784 - DNA, 18 bp, Homo sapiens
tcctgaagctgaggctca

SEQ ID NO: 1123785 - DNA, 14 bp, Homo sapiens
tcctgaagctgctg

SEQ ID NO: 1123786 - DNA, 18 bp, Homo sapiens
tcctgaagctgctgtgtc

SEQ ID NO: 1123787 - DNA, 15 bp, Homo sapiens
tcctgaataaaccag

SEQ ID NO: 1123788 - DNA, 17 bp, Homo sapiens
tcctgaataaaccagta

SEQ ID NO: 1123789 - DNA, 14 bp, Homo sapiens
tcctgaatgcatcc

SEQ ID NO: 1123790 - DNA, 14 bp, Homo sapiens
tcctgacagaaggt

SEQ ID NO: 1123791 - DNA, 14 bp, Homo sapiens
tcctgtctgccagc

SEQ ID NO: 1123792 - DNA, 23 bp, Homo sapiens
tcctgtctggctcggacccaccc

SEQ ID NO: 1123793 - DNA, 14 bp, Homo sapiens
tcctgtcttatcct

SEQ ID NO: 1123794 - DNA, 21 bp, Homo sapiens
tcctgtctttaaagcctgcct

SEQ ID NO: 1123795 - DNA, 17 bp, Homo sapiens
tcctgtctttaaggaaa

SEQ ID NO: 1123796 - DNA, 22 bp, Homo sapiens
tcctgtgaatgccactgccttc

SEQ ID NO: 1123797 - DNA, 20 bp, Homo sapiens
tcctgtgaatggaggcagag

SEQ ID NO: 1123798 - DNA, 18 bp, Homo sapiens
tcctgtgacatgtaacag

SEQ ID NO: 1123799 - DNA, 23 bp, Homo sapiens
tcctgtgacccgtgaatgtgcct

SEQ ID NO: 1123800 - DNA, 22 bp, Homo sapiens
tcctgtgagatgtgtatcagtg

SEQ ID NO: 1123801 - DNA, 14 bp, Homo sapiens
tcctgtgcagatgc

SEQ ID NO: 1123802 - DNA, 16 bp, Homo sapiens
tcctgtgcatgggtga

SEQ ID NO: 1123803 - DNA, 18 bp, Homo sapiens
tcctgtgcatgggtgaag

SEQ ID NO: 1123804 - DNA, 17 bp, Homo sapiens
tcctgtgcccacatccc

SEQ ID NO: 1123805 - DNA, 20 bp, Homo sapiens
tcctgtgccccagctgccag

SEQ ID NO: 1123806 - DNA, 14 bp, Homo sapiens
tcctgtgccctaga

SEQ ID NO: 1123807 - DNA, 22 bp, Homo sapiens
tcctgtgccctcaccccaatcc

SEQ ID NO: 1123808 - DNA, 14 bp, Homo sapiens
tcctgtgcctggcc

SEQ ID NO: 1123809 - DNA, 16 bp, Homo sapiens
tcctgtgcctggcccc

SEQ ID NO: 1123810 - DNA, 15 bp, Homo sapiens
tcctgtgcctttcct

SEQ ID NO: 1123811 - DNA, 21 bp, Homo sapiens
tcctgtgcctttcctatcacc

SEQ ID NO: 1123812 - DNA, 16 bp, Homo sapiens
tcctgtgctttctgca

SEQ ID NO: 1123813 - DNA, 22 bp, Homo sapiens
tcctgtggccccaccctgggcc

SEQ ID NO: 1123814 - DNA, 21 bp, Homo sapiens
tcctgtgggtgttctttcctg

SEQ ID NO: 1123815 - DNA, 14 bp, Homo sapiens
tcctgtgtaacact

SEQ ID NO: 1123816 - DNA, 23 bp, Homo sapiens
tcctgtgtcccctgacctgtcca

SEQ ID NO: 1123817 - DNA, 12 bp, Homo sapiens
tcctgtgtcctg

SEQ ID NO: 1123818 - DNA, 17 bp, Homo sapiens
tcctgtgttcaatattt

SEQ ID NO: 1123819 - DNA, 19 bp, Homo sapiens
tcctgtgtttctagggaaa

SEQ ID NO: 1123820 - DNA, 14 bp, Homo sapiens
tcctgttacctgtc

SEQ ID NO: 1123821 - DNA, 15 bp, Homo sapiens
tcctgttacctgtct

SEQ ID NO: 1123822 - DNA, 17 bp, Homo sapiens
tcctgttccctcctggt

SEQ ID NO: 1123823 - DNA, 22 bp, Homo sapiens
tcctgttccctcctggtcctgg

SEQ ID NO: 1123824 - DNA, 15 bp, Homo sapiens
tcctgttctgcccac

SEQ ID NO: 1123825 - DNA, 19 bp, Homo sapiens
tcctgttcttccttcctag

SEQ ID NO: 1123826 - DNA, 16 bp, Homo sapiens
tcctgttgaagacttc

SEQ ID NO: 1123827 - DNA, 22 bp, Homo sapiens
tcctgttgaagacttcctctct

SEQ ID NO: 1123828 - DNA, 19 bp, Homo sapiens
tcctgttgatgggaaaagc

SEQ ID NO: 1123829 - DNA, 19 bp, Homo sapiens
tcctgttgttgttaatgaa

SEQ ID NO: 1123830 - DNA, 21 bp, Homo sapiens
tcctgttgttgttaatgaaaa

SEQ ID NO: 1123831 - DNA, 17 bp, Homo sapiens
tcctgtttataatctga

SEQ ID NO: 1123832 - DNA, 13 bp, Homo sapiens
tcctgtttgtcta

SEQ ID NO: 1123833 - DNA, 15 bp, Homo sapiens
tcctgtttgttttgt

SEQ ID NO: 1123834 - DNA, 22 bp, Homo sapiens
tcctgttttcttaggcactgag

SEQ ID NO: 1123835 - DNA, 17 bp, Homo sapiens
tcctgttttgcacagcc

SEQ ID NO: 1123836 - DNA, 21 bp, Homo sapiens
tcctgttttgcacagccaaat

SEQ ID NO: 1123837 - DNA, 15 bp, Homo sapiens
tccttaaacatgaaa

SEQ ID NO: 1123838 - DNA, 19 bp, Homo sapiens
tccttaaatcttaatgttc

SEQ ID NO: 1123839 - DNA, 23 bp, Homo sapiens
tccttaaccaccgcatatgcatg

SEQ ID NO: 1123840 - DNA, 17 bp, Homo sapiens
tccttaacctttattaa

SEQ ID NO: 1123841 - DNA, 13 bp, Homo sapiens
tccttaagaacac

SEQ ID NO: 1123842 - DNA, 20 bp, Homo sapiens
tccttaagagctatttgtgg

SEQ ID NO: 1123843 - DNA, 21 bp, Homo sapiens
tccttacaagttagaaaacat

SEQ ID NO: 1123844 - DNA, 19 bp, Homo sapiens
tccttacctatttcctcag

SEQ ID NO: 1123845 - DNA, 20 bp, Homo sapiens
tccttacctatttcctcaga

SEQ ID NO: 1123846 - DNA, 15 bp, Homo sapiens
tccttacctcgggga

SEQ ID NO: 1123847 - DNA, 15 bp, Homo sapiens
tccttacctttttat

SEQ ID NO: 1123848 - DNA, 20 bp, Homo sapiens
tccttacctttttatttgca

SEQ ID NO: 1123849 - DNA, 20 bp, Homo sapiens
tccttactcccccaccactc

SEQ ID NO: 1123850 - DNA, 16 bp, Homo sapiens
tccttactctgagccc

SEQ ID NO: 1123851 - DNA, 19 bp, Homo sapiens
tccttactctgagcccagg

SEQ ID NO: 1123852 - DNA, 15 bp, Homo sapiens
tccttacttttaagg

SEQ ID NO: 1123853 - DNA, 15 bp, Homo sapiens
tccttagaacatttt

SEQ ID NO: 1123854 - DNA, 23 bp, Homo sapiens
tccttagacctgagggacccttc

SEQ ID NO: 1123855 - DNA, 18 bp, Homo sapiens
tccttagagaagtttgtg

SEQ ID NO: 1123856 - DNA, 15 bp, Homo sapiens
tccttagccctgtct

SEQ ID NO: 1123857 - DNA, 16 bp, Homo sapiens
tccttagctaaatgca

SEQ ID NO: 1123858 - DNA, 21 bp, Homo sapiens
tccttagctatttatcccttt

SEQ ID NO: 1123859 - DNA, 19 bp, Homo sapiens
tccttagcttagacctcag

SEQ ID NO: 1123860 - DNA, 20 bp, Homo sapiens
tccttaggaaaatgcttctg

SEQ ID NO: 1123861 - DNA, 18 bp, Homo sapiens
tccttagtcttctcatag

SEQ ID NO: 1123862 - DNA, 16 bp, Homo sapiens
tccttagtgccaggag

SEQ ID NO: 1123863 - DNA, 16 bp, Homo sapiens
tccttagttggctgga

SEQ ID NO: 1123864 - DNA, 14 bp, Homo sapiens
tccttatactgtat

SEQ ID NO: 1123865 - DNA, 21 bp, Homo sapiens
tccttataggtgtaaatgaga

SEQ ID NO: 1123866 - DNA, 15 bp, Homo sapiens
tccttatcaaaggac

SEQ ID NO: 1123867 - DNA, 14 bp, Homo sapiens
tccttatcagagct

SEQ ID NO: 1123868 - DNA, 15 bp, Homo sapiens
tccttatcagagcta

SEQ ID NO: 1123869 - DNA, 15 bp, Homo sapiens
tccttattatcccag

SEQ ID NO: 1123870 - DNA, 23 bp, Homo sapiens
tccttattatcccagcttgctga

SEQ ID NO: 1123871 - DNA, 13 bp, Homo sapiens
tccttattgttca

SEQ ID NO: 1123872 - DNA, 11 bp, Homo sapiens
tccttatttat

SEQ ID NO: 1123873 - DNA, 14 bp, Homo sapiens
tccttatttcaagg

SEQ ID NO: 1123874 - DNA, 21 bp, Homo sapiens
tccttatttctctctcctggt

SEQ ID NO: 1123875 - DNA, 20 bp, Homo sapiens
tccttatttggcgtgacccg

SEQ ID NO: 1123876 - DNA, 13 bp, Homo sapiens
tccttcaaataaa

SEQ ID NO: 1123877 - DNA, 18 bp, Homo sapiens
tccttcaacaattctaaa

SEQ ID NO: 1123878 - DNA, 23 bp, Homo sapiens
tccttcaagttagctcaggaggc

SEQ ID NO: 1123879 - DNA, 18 bp, Homo sapiens
tccttcaccctccgttga

SEQ ID NO: 1123880 - DNA, 22 bp, Homo sapiens
tccttcaccctccgttgacagt

SEQ ID NO: 1123881 - DNA, 18 bp, Homo sapiens
tccttcactcatccagcc

SEQ ID NO: 1123882 - DNA, 20 bp, Homo sapiens
tccttcactgccccacttct

SEQ ID NO: 1123883 - DNA, 16 bp, Homo sapiens
tccttcactgttccct

SEQ ID NO: 1123884 - DNA, 22 bp, Homo sapiens
tccttcactgttccctctggct

SEQ ID NO: 1123885 - DNA, 12 bp, Homo sapiens
tccttcagagct

SEQ ID NO: 1123886 - DNA, 14 bp, Homo sapiens
tccttcagatttgg

SEQ ID NO: 1123887 - DNA, 20 bp, Homo sapiens
tccttcagctgactccagta

SEQ ID NO: 1123888 - DNA, 18 bp, Homo sapiens
tccttcagggtttaatag

SEQ ID NO: 1123889 - DNA, 12 bp, Homo sapiens
tccttcaggttt

SEQ ID NO: 1123890 - DNA, 17 bp, Homo sapiens
tccttcagtgagcccct

SEQ ID NO: 1123891 - DNA, 14 bp, Homo sapiens
tccttcattaatga

SEQ ID NO: 1123892 - DNA, 17 bp, Homo sapiens
tccttccaaaaaattaa

SEQ ID NO: 1123893 - DNA, 14 bp, Homo sapiens
tccttccacatgta

SEQ ID NO: 1123894 - DNA, 12 bp, Homo sapiens
tccttccactgt

SEQ ID NO: 1123895 - DNA, 15 bp, Homo sapiens
tccttccactgtagc

SEQ ID NO: 1123896 - DNA, 16 bp, Homo sapiens
tccttccactgtagct

SEQ ID NO: 1123897 - DNA, 19 bp, Homo sapiens
tccttccatatccctgccc

SEQ ID NO: 1123898 - DNA, 16 bp, Homo sapiens
tccttccatccctacc

SEQ ID NO: 1123899 - DNA, 14 bp, Homo sapiens
tccttcccacaaaa

SEQ ID NO: 1123900 - DNA, 17 bp, Homo sapiens
tccttcccacaaaagac

SEQ ID NO: 1123901 - DNA, 17 bp, Homo sapiens
tccttcccagggaccag

SEQ ID NO: 1123902 - DNA, 16 bp, Homo sapiens
tccttcccatgcctgt

SEQ ID NO: 1123903 - DNA, 17 bp, Homo sapiens
tccttccccaacttccc

SEQ ID NO: 1123904 - DNA, 21 bp, Homo sapiens
tccttccccctcactgaagct

SEQ ID NO: 1123905 - DNA, 11 bp, Homo sapiens
tccttcccctg

SEQ ID NO: 1123906 - DNA, 19 bp, Homo sapiens
tccttcccctgcacctggc

SEQ ID NO: 1123907 - DNA, 23 bp, Homo sapiens
tccttccctaactcaactgttgc

SEQ ID NO: 1123908 - DNA, 17 bp, Homo sapiens
tccttccctctctgatg

SEQ ID NO: 1123909 - DNA, 19 bp, Homo sapiens
tccttccctctctgatgtc

SEQ ID NO: 1123910 - DNA, 14 bp, Homo sapiens
tccttccctgcaga

SEQ ID NO: 1123911 - DNA, 12 bp, Homo sapiens
tccttccctggc

SEQ ID NO: 1123912 - DNA, 16 bp, Homo sapiens
tccttcctatgcccag

SEQ ID NO: 1123913 - DNA, 16 bp, Homo sapiens
tcgcttcttgcctctg

SEQ ID NO: 1123914 - DNA, 19 bp, Homo sapiens
tcgcttcttgcctctgtgc

SEQ ID NO: 1123915 - DNA, 17 bp, Homo sapiens
tcgcttgaacctgggaa

SEQ ID NO: 1123916 - DNA, 13 bp, Homo sapiens
tcgcttgagccca

SEQ ID NO: 1123917 - DNA, 17 bp, Homo sapiens
tcgcttgagcccaggag

SEQ ID NO: 1123918 - DNA, 19 bp, Homo sapiens
tcggaaaaataatcaaaag

SEQ ID NO: 1123919 - DNA, 15 bp, Homo sapiens
tcggaaaacatgcta

SEQ ID NO: 1123920 - DNA, 17 bp, Homo sapiens
tcggaaccgctcaccta

SEQ ID NO: 1123921 - DNA, 13 bp, Homo sapiens
tcggaagcctgtc

SEQ ID NO: 1123922 - DNA, 19 bp, Homo sapiens
tcggaaggctggctgggca

SEQ ID NO: 1123923 - DNA, 18 bp, Homo sapiens
tcggacccaccccaactc

SEQ ID NO: 1123924 - DNA, 19 bp, Homo sapiens
tcggacccaccccaactct

SEQ ID NO: 1123925 - DNA, 22 bp, Homo sapiens
tcggacccaccccaactctccc

SEQ ID NO: 1123926 - DNA, 16 bp, Homo sapiens
tcggacggggcaggcg

SEQ ID NO: 1123927 - DNA, 11 bp, Homo sapiens
tcggactgcca

SEQ ID NO: 1123928 - DNA, 14 bp, Homo sapiens
tcggactgccaaat

SEQ ID NO: 1123929 - DNA, 19 bp, Homo sapiens
tcggactgcccccagaaag

SEQ ID NO: 1123930 - DNA, 20 bp, Homo sapiens
tcggactgcccccagaaagc

SEQ ID NO: 1123931 - DNA, 18 bp, Homo sapiens
tcggacttgaatgctgcc

SEQ ID NO: 1123932 - DNA, 21 bp, Homo sapiens
tcggagacagtgatctccata

SEQ ID NO: 1123933 - DNA, 17 bp, Homo sapiens
tcggagactatggcctc

SEQ ID NO: 1123934 - DNA, 22 bp, Homo sapiens
tcggagactatggcctcgcctc

SEQ ID NO: 1123935 - DNA, 13 bp, Homo sapiens
tcggagagcagca

SEQ ID NO: 1123936 - DNA, 21 bp, Homo sapiens
tcggagcatcccggaggaaat

SEQ ID NO: 1123937 - DNA, 22 bp, Homo sapiens
tcggagcctcatccgaggcagg

SEQ ID NO: 1123938 - DNA, 23 bp, Homo sapiens
tcggagcctcatccgaggcaggg

SEQ ID NO: 1123939 - DNA, 15 bp, Homo sapiens
tcggagctgcctgca

SEQ ID NO: 1123940 - DNA, 17 bp, Homo sapiens
tcggagctggctgtgcc

SEQ ID NO: 1123941 - DNA, 18 bp, Homo sapiens
tcggagctggctgtgcct

SEQ ID NO: 1123942 - DNA, 13 bp, Homo sapiens
tcggaggaagccc

SEQ ID NO: 1123943 - DNA, 15 bp, Homo sapiens
tcggaggctgggccc

SEQ ID NO: 1123944 - DNA, 21 bp, Homo sapiens
tcggaggctgggcccctggga

SEQ ID NO: 1123945 - DNA, 22 bp, Homo sapiens
tcggaggcttgtcagagctggg

SEQ ID NO: 1123946 - DNA, 21 bp, Homo sapiens
tcggagggatggagaaagaag

SEQ ID NO: 1123947 - DNA, 14 bp, Homo sapiens
tcggagggccgcag

SEQ ID NO: 1123948 - DNA, 20 bp, Homo sapiens
tcggagggccgcagggccca

SEQ ID NO: 1123949 - DNA, 13 bp, Homo sapiens
tcggatctcacag

SEQ ID NO: 1123950 - DNA, 16 bp, Homo sapiens
tcggatgacaccctgg

SEQ ID NO: 1123951 - DNA, 22 bp, Homo sapiens
tcggcacacactgtgccccaca

SEQ ID NO: 1123952 - DNA, 17 bp, Homo sapiens
tcggcagaactctctgt

SEQ ID NO: 1123953 - DNA, 13 bp, Homo sapiens
tcggcatgccagg

SEQ ID NO: 1123954 - DNA, 23 bp, Homo sapiens
tcggccaagatgtacttctctgt

SEQ ID NO: 1123955 - DNA, 15 bp, Homo sapiens
tcggccacaggcagg

SEQ ID NO: 1123956 - DNA, 13 bp, Homo sapiens
tcggccacagggc

SEQ ID NO: 1123957 - DNA, 22 bp, Homo sapiens
tcggccactgtgtctctgtttc

SEQ ID NO: 1123958 - DNA, 16 bp, Homo sapiens
tcggccccacatggga

SEQ ID NO: 1123959 - DNA, 19 bp, Homo sapiens
tcggccccacatgggaacc

SEQ ID NO: 1123960 - DNA, 21 bp, Homo sapiens
tcggccccatcgccccaccgc

SEQ ID NO: 1123961 - DNA, 18 bp, Homo sapiens
tcggccccctcaccccag

SEQ ID NO: 1123962 - DNA, 20 bp, Homo sapiens
tcggccccctcaccccagct

SEQ ID NO: 1123963 - DNA, 22 bp, Homo sapiens
tcggccccctcaccccagctcc

SEQ ID NO: 1123964 - DNA, 19 bp, Homo sapiens
tcggcccgctgcagcctct

SEQ ID NO: 1123965 - DNA, 14 bp, Homo sapiens
tcggccctgcccaa

SEQ ID NO: 1123966 - DNA, 14 bp, Homo sapiens
tcggccctgtcccc

SEQ ID NO: 1123967 - DNA, 14 bp, Homo sapiens
tcggccgtgggccg

SEQ ID NO: 1123968 - DNA, 19 bp, Homo sapiens
tcggcctccgaggctcccc

SEQ ID NO: 1123969 - DNA, 14 bp, Homo sapiens
tcggcctttgggtg

SEQ ID NO: 1123970 - DNA, 22 bp, Homo sapiens
tcggctacccctcgactcagca

SEQ ID NO: 1123971 - DNA, 21 bp, Homo sapiens
tcggctctgcagtcctactca

SEQ ID NO: 1123972 - DNA, 12 bp, Homo sapiens
tcggctctggag

SEQ ID NO: 1123973 - DNA, 15 bp, Homo sapiens
tcggctggaagaaca

SEQ ID NO: 1123974 - DNA, 17 bp, Homo sapiens
tcggctggaagaacatc

SEQ ID NO: 1123975 - DNA, 17 bp, Homo sapiens
tcggcttgatcacagct

SEQ ID NO: 1123976 - DNA, 18 bp, Homo sapiens
tcgggaaacacacaagca

SEQ ID NO: 1123977 - DNA, 15 bp, Homo sapiens
tcgggaacagtgttt

SEQ ID NO: 1123978 - DNA, 16 bp, Homo sapiens
tcgggaagggagggga

SEQ ID NO: 1123979 - DNA, 22 bp, Homo sapiens
tcgggacatggttgggggaatg

SEQ ID NO: 1123980 - DNA, 16 bp, Homo sapiens
tcgggaccaatatata

SEQ ID NO: 1123981 - DNA, 16 bp, Homo sapiens
tcgggagcacccagag

SEQ ID NO: 1123982 - DNA, 17 bp, Homo sapiens
tcgggagcacccagagc

SEQ ID NO: 1123983 - DNA, 14 bp, Homo sapiens
tcgggagcagtgtc

SEQ ID NO: 1123984 - DNA, 16 bp, Homo sapiens
tcgggagcagtgtctt

SEQ ID NO: 1123985 - DNA, 13 bp, Homo sapiens
tcgggagctgcac

SEQ ID NO: 1123986 - DNA, 21 bp, Homo sapiens
tcgggaggtcgaggcaggagg

SEQ ID NO: 1123987 - DNA, 15 bp, Homo sapiens
tcgggcagccagcag

SEQ ID NO: 1123988 - DNA, 17 bp, Homo sapiens
tcgggcccacctggcca

SEQ ID NO: 1123989 - DNA, 22 bp, Homo sapiens
tcgggccccatcctcatccctg

SEQ ID NO: 1123990 - DNA, 18 bp, Homo sapiens
tcgggcccttcttgctgc

SEQ ID NO: 1123991 - DNA, 20 bp, Homo sapiens
tcgggcccttcttgctgccc

SEQ ID NO: 1123992 - DNA, 19 bp, Homo sapiens
tcgggcgtgggtctctggg

SEQ ID NO: 1123993 - DNA, 22 bp, Homo sapiens
tcgggctctctcacccagcctg

SEQ ID NO: 1123994 - DNA, 20 bp, Homo sapiens
tcgggctgacccttttctga

SEQ ID NO: 1123995 - DNA, 12 bp, Homo sapiens
tcgggctgtgcc

SEQ ID NO: 1123996 - DNA, 13 bp, Homo sapiens
tcgggctgtgccc

SEQ ID NO: 1123997 - DNA, 13 bp, Homo sapiens
tcggggaggcaga

SEQ ID NO: 1123998 - DNA, 11 bp, Homo sapiens
tcggggagggc

SEQ ID NO: 1123999 - DNA, 17 bp, Homo sapiens
tcggggcttgccccact

SEQ ID NO: 1124000 - DNA, 15 bp, Homo sapiens
tcgggggagcagaga

SEQ ID NO: 1124001 - DNA, 14 bp, Homo sapiens
tcgggggcgcctgg

SEQ ID NO: 1124002 - DNA, 15 bp, Homo sapiens
tcgggggcgcctgga

SEQ ID NO: 1124003 - DNA, 12 bp, Homo sapiens
tcgggggctctt

SEQ ID NO: 1124004 - DNA, 13 bp, Homo sapiens
tcgggggctggcc

SEQ ID NO: 1124005 - DNA, 10 bp, Homo sapiens
tcggggggtg

SEQ ID NO: 1124006 - DNA, 16 bp, Homo sapiens
tcgggggtgctggggc

SEQ ID NO: 1124007 - DNA, 20 bp, Homo sapiens
tcgggggtgctggggccagg

SEQ ID NO: 1124008 - DNA, 21 bp, Homo sapiens
tcgggggtgctggggccaggg

SEQ ID NO: 1124009 - DNA, 15 bp, Homo sapiens
tcggggtccaccagt

SEQ ID NO: 1124010 - DNA, 13 bp, Homo sapiens
tcgggtccagaga

SEQ ID NO: 1124011 - DNA, 13 bp, Homo sapiens
tcggtactcccat

SEQ ID NO: 1124012 - DNA, 24 bp, Homo sapiens
tcggtcagaacaacttgctactta

SEQ ID NO: 1124013 - DNA, 13 bp, Homo sapiens
tcggtcctggtgc

SEQ ID NO: 1124014 - DNA, 16 bp, Homo sapiens
tcggtcctggtgccct

SEQ ID NO: 1124015 - DNA, 23 bp, Homo sapiens
tcggtctcccaaagtgctgggat

SEQ ID NO: 1124016 - DNA, 22 bp, Homo sapiens
tcggtcttgcaaagcgacagat

SEQ ID NO: 1124017 - DNA, 23 bp, Homo sapiens
tcggtcttgcaaagcgacagatt

SEQ ID NO: 1124018 - DNA, 16 bp, Homo sapiens
tcggtgaccccatcac

SEQ ID NO: 1124019 - DNA, 12 bp, Homo sapiens
tcggtggctctg

SEQ ID NO: 1124020 - DNA, 14 bp, Homo sapiens
tcggtggctgcctt

SEQ ID NO: 1124021 - DNA, 22 bp, Homo sapiens
tcggtgtccatttatagaataa

SEQ ID NO: 1124022 - DNA, 13 bp, Homo sapiens
tcggtgtgaactt

SEQ ID NO: 1124023 - DNA, 15 bp, Homo sapiens
tcggtgtgctgccaa

SEQ ID NO: 1124024 - DNA, 13 bp, Homo sapiens
tcggttagtcatt

SEQ ID NO: 1124025 - DNA, 23 bp, Homo sapiens
tcggttccacgtccccctggggc

SEQ ID NO: 1124026 - DNA, 14 bp, Homo sapiens
tcggtttctgagca

SEQ ID NO: 1124027 - DNA, 19 bp, Homo sapiens
tcgtaaaaaaatagaaaaa

SEQ ID NO: 1124028 - DNA, 16 bp, Homo sapiens
tcgtacagaaagctgc

SEQ ID NO: 1124029 - DNA, 16 bp, Homo sapiens
tcgtaccgcttcctta

SEQ ID NO: 1124030 - DNA, 16 bp, Homo sapiens
tcgtacgcccaggaca

SEQ ID NO: 1124031 - DNA, 21 bp, Homo sapiens
tcgtataacacaatatgaata

SEQ ID NO: 1124032 - DNA, 20 bp, Homo sapiens
tcgtatatacacacaaaaag

SEQ ID NO: 1124033 - DNA, 18 bp, Homo sapiens
tcgtcactaatacacagt

SEQ ID NO: 1124034 - DNA, 17 bp, Homo sapiens
tcgtcatttgcaagctg

SEQ ID NO: 1124035 - DNA, 21 bp, Homo sapiens
tctaccctctggttgggagat

SEQ ID NO: 1124036 - DNA, 14 bp, Homo sapiens
tctaccctggcact

SEQ ID NO: 1124037 - DNA, 19 bp, Homo sapiens
tctaccctggcactataat

SEQ ID NO: 1124038 - DNA, 12 bp, Homo sapiens
tctaccctgtcc

SEQ ID NO: 1124039 - DNA, 13 bp, Homo sapiens
tctaccctgtcct

SEQ ID NO: 1124040 - DNA, 18 bp, Homo sapiens
tctaccggagagagaatg

SEQ ID NO: 1124041 - DNA, 15 bp, Homo sapiens
tctacctcaggcagc

SEQ ID NO: 1124042 - DNA, 16 bp, Homo sapiens
tctacctcatctctga

SEQ ID NO: 1124043 - DNA, 13 bp, Homo sapiens
tctacctccaccc

SEQ ID NO: 1124044 - DNA, 13 bp, Homo sapiens
tctacctctctcc

SEQ ID NO: 1124045 - DNA, 14 bp, Homo sapiens
tctacctctctcct

SEQ ID NO: 1124046 - DNA, 20 bp, Homo sapiens
tctacctgagcattcaggca

SEQ ID NO: 1124047 - DNA, 22 bp, Homo sapiens
tctacctgagcattcaggcagc

SEQ ID NO: 1124048 - DNA, 18 bp, Homo sapiens
tctacctgccctcaaggg

SEQ ID NO: 1124049 - DNA, 12 bp, Homo sapiens
tctacctggagg

SEQ ID NO: 1124050 - DNA, 13 bp, Homo sapiens
tctacctggaggg

SEQ ID NO: 1124051 - DNA, 13 bp, Homo sapiens
tctacctggcaga

SEQ ID NO: 1124052 - DNA, 19 bp, Homo sapiens
tctacctgttctgtagctt

SEQ ID NO: 1124053 - DNA, 12 bp, Homo sapiens
tctaccttcctg

SEQ ID NO: 1124054 - DNA, 17 bp, Homo sapiens
tctaccttcctgtccct

SEQ ID NO: 1124055 - DNA, 22 bp, Homo sapiens
tctaccttcctgtccctgaggt

SEQ ID NO: 1124056 - DNA, 16 bp, Homo sapiens
tctaccttgaggtctt

SEQ ID NO: 1124057 - DNA, 21 bp, Homo sapiens
tctactaaaaagaaggaaaat

SEQ ID NO: 1124058 - DNA, 13 bp, Homo sapiens
tctactaaaaata

SEQ ID NO: 1124059 - DNA, 21 bp, Homo sapiens
tctactaagtgatgctgtgat

SEQ ID NO: 1124060 - DNA, 22 bp, Homo sapiens
tctactaagtgatgctgtgata

SEQ ID NO: 1124061 - DNA, 12 bp, Homo sapiens
tctactacctac

SEQ ID NO: 1124062 - DNA, 17 bp, Homo sapiens
tctactagattgtgatc

SEQ ID NO: 1124063 - DNA, 14 bp, Homo sapiens
tctactcagaaatt

SEQ ID NO: 1124064 - DNA, 18 bp, Homo sapiens
tctactcagcatttgatt

SEQ ID NO: 1124065 - DNA, 21 bp, Homo sapiens
tctactcccaagtatggggtt

SEQ ID NO: 1124066 - DNA, 17 bp, Homo sapiens
tctactcctacctcagc

SEQ ID NO: 1124067 - DNA, 16 bp, Homo sapiens
tctactcctagaagaa

SEQ ID NO: 1124068 - DNA, 19 bp, Homo sapiens
tctactctgtcttaaatga

SEQ ID NO: 1124069 - DNA, 21 bp, Homo sapiens
tctactgacccaactgggggc

SEQ ID NO: 1124070 - DNA, 22 bp, Homo sapiens
tctactgccaagcccctgccct

SEQ ID NO: 1124071 - DNA, 11 bp, Homo sapiens
tctactgtaaa

SEQ ID NO: 1124072 - DNA, 16 bp, Homo sapiens
tctactgtacacaatc

SEQ ID NO: 1124073 - DNA, 23 bp, Homo sapiens
tctactgtcaaatgatgtgcaaa

SEQ ID NO: 1124074 - DNA, 14 bp, Homo sapiens
tctactgtctcctc

SEQ ID NO: 1124075 - DNA, 17 bp, Homo sapiens
tctacttcagctttgga

SEQ ID NO: 1124076 - DNA, 18 bp, Homo sapiens
tctacttcccctgggatg

SEQ ID NO: 1124077 - DNA, 20 bp, Homo sapiens
tctacttgccagaaccaaat

SEQ ID NO: 1124078 - DNA, 18 bp, Homo sapiens
tctacttgtcatatcact

SEQ ID NO: 1124079 - DNA, 12 bp, Homo sapiens
tctactttgaag

SEQ ID NO: 1124080 - DNA, 17 bp, Homo sapiens
tctactttgattctgat

SEQ ID NO: 1124081 - DNA, 18 bp, Homo sapiens
tctactttttaattttta

SEQ ID NO: 1124082 - DNA, 23 bp, Homo sapiens
tctactttttgaacttttcattc

SEQ ID NO: 1124083 - DNA, 19 bp, Homo sapiens
tctactttttgtatttagt

SEQ ID NO: 1124084 - DNA, 14 bp, Homo sapiens
tctagaaaaaaggg

SEQ ID NO: 1124085 - DNA, 17 bp, Homo sapiens
tctagaaactctggctc

SEQ ID NO: 1124086 - DNA, 23 bp, Homo sapiens
tctagaaagaaaagaccctgaga

SEQ ID NO: 1124087 - DNA, 19 bp, Homo sapiens
tctagaaagagaaacagtt

SEQ ID NO: 1124088 - DNA, 22 bp, Homo sapiens
tctagaaagcctgttcccctca

SEQ ID NO: 1124089 - DNA, 22 bp, Homo sapiens
tctagaaatagatttaaagaat

SEQ ID NO: 1124090 - DNA, 16 bp, Homo sapiens
tctagaaataggttaa

SEQ ID NO: 1124091 - DNA, 13 bp, Homo sapiens
tctagaacacagg

SEQ ID NO: 1124092 - DNA, 17 bp, Homo sapiens
tctagaacacaggcaaa

SEQ ID NO: 1124093 - DNA, 19 bp, Homo sapiens
tctagaacatgcacattta

SEQ ID NO: 1124094 - DNA, 17 bp, Homo sapiens
tctagaactatcatttt

SEQ ID NO: 1124095 - DNA, 18 bp, Homo sapiens
tctagaacttgaccccct

SEQ ID NO: 1124096 - DNA, 20 bp, Homo sapiens
tctagaagactgtcagcttc

SEQ ID NO: 1124097 - DNA, 21 bp, Homo sapiens
tctagaagactgtcagcttcc

SEQ ID NO: 1124098 - DNA, 19 bp, Homo sapiens
tctagaagagtctattgtc

SEQ ID NO: 1124099 - DNA, 20 bp, Homo sapiens
tctagaagagtctattgtct

SEQ ID NO: 1124100 - DNA, 16 bp, Homo sapiens
tctagaagatgtgtaa

SEQ ID NO: 1124101 - DNA, 21 bp, Homo sapiens
tctagaagccaagggaaaggg

SEQ ID NO: 1124102 - DNA, 21 bp, Homo sapiens
tctagaatattatgttcctca

SEQ ID NO: 1124103 - DNA, 17 bp, Homo sapiens
tctagaatgtctgaagt

SEQ ID NO: 1124104 - DNA, 11 bp, Homo sapiens
tctagaatgtg

SEQ ID NO: 1124105 - DNA, 16 bp, Homo sapiens
tctagaatgtggattt

SEQ ID NO: 1124106 - DNA, 17 bp, Homo sapiens
tctagaattatttttca

SEQ ID NO: 1124107 - DNA, 19 bp, Homo sapiens
tctagaattatttttcact

SEQ ID NO: 1124108 - DNA, 19 bp, Homo sapiens
tctagaatttatcacactt

SEQ ID NO: 1124109 - DNA, 13 bp, Homo sapiens
tctagacaaccct

SEQ ID NO: 1124110 - DNA, 17 bp, Homo sapiens
tctagacaaccctgcaa

SEQ ID NO: 1124111 - DNA, 20 bp, Homo sapiens
tctagacaagatattgtaca

SEQ ID NO: 1124112 - DNA, 20 bp, Homo sapiens
tctagacagagttgcttaat

SEQ ID NO: 1124113 - DNA, 16 bp, Homo sapiens
tctagacagtattgcc

SEQ ID NO: 1124114 - DNA, 17 bp, Homo sapiens
tctagacagtattgcca

SEQ ID NO: 1124115 - DNA, 14 bp, Homo sapiens
tctagaccaataaa

SEQ ID NO: 1124116 - DNA, 14 bp, Homo sapiens
tctagacgcccctc

SEQ ID NO: 1124117 - DNA, 15 bp, Homo sapiens
tctagacttccccat

SEQ ID NO: 1124118 - DNA, 14 bp, Homo sapiens
tctagactttctgt

SEQ ID NO: 1124119 - DNA, 15 bp, Homo sapiens
tctagactttctgtt

SEQ ID NO: 1124120 - DNA, 14 bp, Homo sapiens
tctagagacacatt

SEQ ID NO: 1124121 - DNA, 21 bp, Homo sapiens
tctagagagatgagaagccag

SEQ ID NO: 1124122 - DNA, 21 bp, Homo sapiens
tctagagctggaggctgtggg

SEQ ID NO: 1124123 - DNA, 17 bp, Homo sapiens
tctagagcttagcatat

SEQ ID NO: 1124124 - DNA, 16 bp, Homo sapiens
tctagaggcctcagtt

SEQ ID NO: 1124125 - DNA, 23 bp, Homo sapiens
tctagaggtcaggacggctcctc

SEQ ID NO: 1124126 - DNA, 15 bp, Homo sapiens
tctagatacagaagc

SEQ ID NO: 1124127 - DNA, 21 bp, Homo sapiens
tctagatgaagttttacattg

SEQ ID NO: 1124128 - DNA, 22 bp, Homo sapiens
tctagatgaagttttacattgt

SEQ ID NO: 1124129 - DNA, 17 bp, Homo sapiens
tctagattaccatgaag

SEQ ID NO: 1124130 - DNA, 23 bp, Homo sapiens
tctagattaccccctcattgttt

SEQ ID NO: 1124131 - DNA, 16 bp, Homo sapiens
tctagcagcacctcct

SEQ ID NO: 1124132 - DNA, 13 bp, Homo sapiens
tctagcaggcagg

SEQ ID NO: 1124133 - DNA, 22 bp, Homo sapiens
tctagcagtaaatacttgcagt

SEQ ID NO: 1124134 - DNA, 16 bp, Homo sapiens
tctagcatttatttct

SEQ ID NO: 1124135 - DNA, 18 bp, Homo sapiens
tctagcatttatttctct

SEQ ID NO: 1124136 - DNA, 16 bp, Homo sapiens
tctagccactccctcc

SEQ ID NO: 1124137 - DNA, 19 bp, Homo sapiens
tctagccactccctcccag

SEQ ID NO: 1124138 - DNA, 21 bp, Homo sapiens
tctagccagcccctcttcccc

SEQ ID NO: 1124139 - DNA, 20 bp, Homo sapiens
tctagccaggagtctgtgct

SEQ ID NO: 1124140 - DNA, 21 bp, Homo sapiens
tctagccaggagtctgtgctc

SEQ ID NO: 1124141 - DNA, 15 bp, Homo sapiens
tctagccatcccttg

SEQ ID NO: 1124142 - DNA, 17 bp, Homo sapiens
tctagccatcccttggg

SEQ ID NO: 1124143 - DNA, 17 bp, Homo sapiens
tctagcccactccctgc

SEQ ID NO: 1124144 - DNA, 22 bp, Homo sapiens
tctagccttgtagctgttactg

SEQ ID NO: 1124145 - DNA, 22 bp, Homo sapiens
tctagcgaacgtatttctccag

SEQ ID NO: 1124146 - DNA, 23 bp, Homo sapiens
tctagcgcagttttttttttctt

SEQ ID NO: 1124147 - DNA, 14 bp, Homo sapiens
tctagctaaataaa

SEQ ID NO: 1124148 - DNA, 14 bp, Homo sapiens
tctagctctctagg

SEQ ID NO: 1124149 - DNA, 15 bp, Homo sapiens
tctagctctctaggc

SEQ ID NO: 1124150 - DNA, 22 bp, Homo sapiens
tctagctgagctttaaatcatt

SEQ ID NO: 1124151 - DNA, 21 bp, Homo sapiens
tctagctgcagatgcctctgc

SEQ ID NO: 1124152 - DNA, 14 bp, Homo sapiens
tctagctggcagga

SEQ ID NO: 1124153 - DNA, 13 bp, Homo sapiens
tctagctgtatga

SEQ ID NO: 1124154 - DNA, 17 bp, Homo sapiens
tctagctgtatgatttg

SEQ ID NO: 1124155 - DNA, 15 bp, Homo sapiens
tctagctgtctgtga

SEQ ID NO: 1124156 - DNA, 17 bp, Homo sapiens
tctagctgtctgtgaat

SEQ ID NO: 1124157 - DNA, 24 bp, Homo sapiens
tctcatagcattaactaatctatt

SEQ ID NO: 1124158 - DNA, 19 bp, Homo sapiens
tctcataggaaaagtacat

SEQ ID NO: 1124159 - DNA, 21 bp, Homo sapiens
tctcataggaaaagtacattt

SEQ ID NO: 1124160 - DNA, 22 bp, Homo sapiens
tctcataggaaaagtacattta

SEQ ID NO: 1124161 - DNA, 23 bp, Homo sapiens
tctcataggaaaagtacatttaa

SEQ ID NO: 1124162 - DNA, 14 bp, Homo sapiens
tctcataggagact

SEQ ID NO: 1124163 - DNA, 16 bp, Homo sapiens
tctcataggttaaaaa

SEQ ID NO: 1124164 - DNA, 22 bp, Homo sapiens
tctcatattcgctagtgtttaa

SEQ ID NO: 1124165 - DNA, 15 bp, Homo sapiens
tctcatcagtgtcct

SEQ ID NO: 1124166 - DNA, 21 bp, Homo sapiens
tctcatcagtgtcctcttgct

SEQ ID NO: 1124167 - DNA, 15 bp, Homo sapiens
tctcatcatgtctat

SEQ ID NO: 1124168 - DNA, 18 bp, Homo sapiens
tctcatcatgtctattgt

SEQ ID NO: 1124169 - DNA, 17 bp, Homo sapiens
tctcatccccctgtgga

SEQ ID NO: 1124170 - DNA, 21 bp, Homo sapiens
tctcatcctccagtaccttgc

SEQ ID NO: 1124171 - DNA, 14 bp, Homo sapiens
tctcatcctcctgg

SEQ ID NO: 1124172 - DNA, 16 bp, Homo sapiens
tctcatcctcctggaa

SEQ ID NO: 1124173 - DNA, 17 bp, Homo sapiens
tctcatcctcctggaac

SEQ ID NO: 1124174 - DNA, 13 bp, Homo sapiens
tctcatcctcctt

SEQ ID NO: 1124175 - DNA, 14 bp, Homo sapiens
tctcatcctccttt

SEQ ID NO: 1124176 - DNA, 23 bp, Homo sapiens
tctcatcctggcacgccctactc

SEQ ID NO: 1124177 - DNA, 16 bp, Homo sapiens
tctcatccttttggat

SEQ ID NO: 1124178 - DNA, 19 bp, Homo sapiens
tctcatctcagtgaagaat

SEQ ID NO: 1124179 - DNA, 14 bp, Homo sapiens
tctcatctcttcag

SEQ ID NO: 1124180 - DNA, 17 bp, Homo sapiens
tctcatctgtgattccc

SEQ ID NO: 1124181 - DNA, 14 bp, Homo sapiens
tctcatcttgttct

SEQ ID NO: 1124182 - DNA, 16 bp, Homo sapiens
tctcatcttgttcttc

SEQ ID NO: 1124183 - DNA, 21 bp, Homo sapiens
tctcatcttgttcttccccct

SEQ ID NO: 1124184 - DNA, 16 bp, Homo sapiens
tctcatgaagcaggag

SEQ ID NO: 1124185 - DNA, 16 bp, Homo sapiens
tctcatgagaagccaa

SEQ ID NO: 1124186 - DNA, 16 bp, Homo sapiens
tctcatgattccatgc

SEQ ID NO: 1124187 - DNA, 17 bp, Homo sapiens
tctcatgattccatgcc

SEQ ID NO: 1124188 - DNA, 13 bp, Homo sapiens
tctcatgggaagc

SEQ ID NO: 1124189 - DNA, 21 bp, Homo sapiens
tctcatgggaaggggaggacc

SEQ ID NO: 1124190 - DNA, 17 bp, Homo sapiens
tctcatgtaatttgcat

SEQ ID NO: 1124191 - DNA, 21 bp, Homo sapiens
tctcatgtaatttgcattact

SEQ ID NO: 1124192 - DNA, 13 bp, Homo sapiens
tctcatgtatctt

SEQ ID NO: 1124193 - DNA, 14 bp, Homo sapiens
tctcatgtcaatga

SEQ ID NO: 1124194 - DNA, 15 bp, Homo sapiens
tctcatgtccctcca

SEQ ID NO: 1124195 - DNA, 19 bp, Homo sapiens
tctcatgttttcaactgcc

SEQ ID NO: 1124196 - DNA, 15 bp, Homo sapiens
tctcattaaaagaat

SEQ ID NO: 1124197 - DNA, 16 bp, Homo sapiens
tctcattaaaagaata

SEQ ID NO: 1124198 - DNA, 12 bp, Homo sapiens
tctcattaaaat

SEQ ID NO: 1124199 - DNA, 16 bp, Homo sapiens
tctcattacttttgaa

SEQ ID NO: 1124200 - DNA, 12 bp, Homo sapiens
tctcattcagta

SEQ ID NO: 1124201 - DNA, 17 bp, Homo sapiens
tctcattccaacagtga

SEQ ID NO: 1124202 - DNA, 14 bp, Homo sapiens
tctcattccgttgt

SEQ ID NO: 1124203 - DNA, 20 bp, Homo sapiens
tctcattccgttgtctgtgg

SEQ ID NO: 1124204 - DNA, 21 bp, Homo sapiens
tctcattccgttgtctgtgga

SEQ ID NO: 1124205 - DNA, 15 bp, Homo sapiens
tctcattgcttctga

SEQ ID NO: 1124206 - DNA, 23 bp, Homo sapiens
tctcattgtcttgttatgtacaa

SEQ ID NO: 1124207 - DNA, 16 bp, Homo sapiens
tctcatttaagggaaa

SEQ ID NO: 1124208 - DNA, 17 bp, Homo sapiens
tctcatttaagggaaaa

SEQ ID NO: 1124209 - DNA, 14 bp, Homo sapiens
tctcatttctcagg

SEQ ID NO: 1124210 - DNA, 17 bp, Homo sapiens
tctcatttggtctgcca

SEQ ID NO: 1124211 - DNA, 20 bp, Homo sapiens
tctcatttggtctgccagaa

SEQ ID NO: 1124212 - DNA, 21 bp, Homo sapiens
tctcatttggtctgccagaat

SEQ ID NO: 1124213 - DNA, 17 bp, Homo sapiens
tctcatttttccgtaaa

SEQ ID NO: 1124214 - DNA, 13 bp, Homo sapiens
tctccaaaataaa

SEQ ID NO: 1124215 - DNA, 19 bp, Homo sapiens
tctccaaaataaaactttt

SEQ ID NO: 1124216 - DNA, 22 bp, Homo sapiens
tctccaaaataaaactttttaa

SEQ ID NO: 1124217 - DNA, 18 bp, Homo sapiens
tctccaaaggggctgctg

SEQ ID NO: 1124218 - DNA, 19 bp, Homo sapiens
tctccaacatcacagccca

SEQ ID NO: 1124219 - DNA, 13 bp, Homo sapiens
tctccaaccactg

SEQ ID NO: 1124220 - DNA, 15 bp, Homo sapiens
tctccaacctggaca

SEQ ID NO: 1124221 - DNA, 21 bp, Homo sapiens
tctccaagaatggaagcctga

SEQ ID NO: 1124222 - DNA, 14 bp, Homo sapiens
tctccaaggaccag

SEQ ID NO: 1124223 - DNA, 22 bp, Homo sapiens
tctccaaggatcctctccactc

SEQ ID NO: 1124224 - DNA, 19 bp, Homo sapiens
tctccaagtctctctgtga

SEQ ID NO: 1124225 - DNA, 22 bp, Homo sapiens
tctccaagtctctctgtgaata

SEQ ID NO: 1124226 - DNA, 14 bp, Homo sapiens
tctccaatgctctg

SEQ ID NO: 1124227 - DNA, 17 bp, Homo sapiens
tctccaatgctctggag

SEQ ID NO: 1124228 - DNA, 15 bp, Homo sapiens
tctccaattctgaaa

SEQ ID NO: 1124229 - DNA, 16 bp, Homo sapiens
tctccaattctgaaat

SEQ ID NO: 1124230 - DNA, 19 bp, Homo sapiens
tctccaattctgaaatact

SEQ ID NO: 1124231 - DNA, 19 bp, Homo sapiens
tctccacagcaaccccagg

SEQ ID NO: 1124232 - DNA, 22 bp, Homo sapiens
tctccacagtgttgtgcccctt

SEQ ID NO: 1124233 - DNA, 16 bp, Homo sapiens
tctccaccagacgcct

SEQ ID NO: 1124234 - DNA, 23 bp, Homo sapiens
tctccaccagacgccttcctctc

SEQ ID NO: 1124235 - DNA, 14 bp, Homo sapiens
tctccaccagcccc

SEQ ID NO: 1124236 - DNA, 17 bp, Homo sapiens
tctccaccagccctact

SEQ ID NO: 1124237 - DNA, 13 bp, Homo sapiens
tctccacctcagc

SEQ ID NO: 1124238 - DNA, 14 bp, Homo sapiens
tctccacctcagcc

SEQ ID NO: 1124239 - DNA, 15 bp, Homo sapiens
tctccacctcagcct

SEQ ID NO: 1124240 - DNA, 17 bp, Homo sapiens
tctccacctcagccttg

SEQ ID NO: 1124241 - DNA, 19 bp, Homo sapiens
tctccacctcagccttgga

SEQ ID NO: 1124242 - DNA, 21 bp, Homo sapiens
tctccacctgagaccctggga

SEQ ID NO: 1124243 - DNA, 13 bp, Homo sapiens
tctccacgtcttt

SEQ ID NO: 1124244 - DNA, 18 bp, Homo sapiens
tctccactcttctctcct

SEQ ID NO: 1124245 - DNA, 22 bp, Homo sapiens
tctccacttctggtcccctgtg

SEQ ID NO: 1124246 - DNA, 23 bp, Homo sapiens
tctccacttctggtcccctgtgg

SEQ ID NO: 1124247 - DNA, 15 bp, Homo sapiens
tctccacttcttaga

SEQ ID NO: 1124248 - DNA, 13 bp, Homo sapiens
tctccagaaaaat

SEQ ID NO: 1124249 - DNA, 13 bp, Homo sapiens
tctccagaatgta

SEQ ID NO: 1124250 - DNA, 15 bp, Homo sapiens
tctccagaatgtaag

SEQ ID NO: 1124251 - DNA, 15 bp, Homo sapiens
tctccagacccccac

SEQ ID NO: 1124252 - DNA, 19 bp, Homo sapiens
tctccagacccccacccct

SEQ ID NO: 1124253 - DNA, 23 bp, Homo sapiens
tctccagagaacctttagaatat

SEQ ID NO: 1124254 - DNA, 18 bp, Homo sapiens
tctccagatgtttccaga

SEQ ID NO: 1124255 - DNA, 12 bp, Homo sapiens
tctccagccagc

SEQ ID NO: 1124256 - DNA, 18 bp, Homo sapiens
tctccagcggccctgtca

SEQ ID NO: 1124257 - DNA, 16 bp, Homo sapiens
tctccagctcagaacc

SEQ ID NO: 1124258 - DNA, 21 bp, Homo sapiens
tctccagctcagaacccaggg

SEQ ID NO: 1124259 - DNA, 22 bp, Homo sapiens
tctccagctcagaacccagggc

SEQ ID NO: 1124260 - DNA, 14 bp, Homo sapiens
tctccagctgacta

SEQ ID NO: 1124261 - DNA, 16 bp, Homo sapiens
tctccagctgcctggg

SEQ ID NO: 1124262 - DNA, 19 bp, Homo sapiens
tctccagctgcctgggccc

SEQ ID NO: 1124263 - DNA, 19 bp, Homo sapiens
tctccagctgggctctgca

SEQ ID NO: 1124264 - DNA, 14 bp, Homo sapiens
tctccagcttcagc

SEQ ID NO: 1124265 - DNA, 20 bp, Homo sapiens
tctccagcttcagctcaact

SEQ ID NO: 1124266 - DNA, 19 bp, Homo sapiens
tctccaggattttaatttc

SEQ ID NO: 1124267 - DNA, 16 bp, Homo sapiens
tctccaggccaggtgg

SEQ ID NO: 1124268 - DNA, 13 bp, Homo sapiens
tctccaggcccca

SEQ ID NO: 1124269 - DNA, 12 bp, Homo sapiens
tctccagggacc

SEQ ID NO: 1124270 - DNA, 17 bp, Homo sapiens
tctccagggacccttgc

SEQ ID NO: 1124271 - DNA, 17 bp, Homo sapiens
tctccaggggctgcttc

SEQ ID NO: 1124272 - DNA, 18 bp, Homo sapiens
tctccaggggctgcttcc

SEQ ID NO: 1124273 - DNA, 19 bp, Homo sapiens
tctccaggggtttacagtg

SEQ ID NO: 1124274 - DNA, 16 bp, Homo sapiens
tctccagtatgaaatt

SEQ ID NO: 1124275 - DNA, 18 bp, Homo sapiens
tctccagtggttgctgtt

SEQ ID NO: 1124276 - DNA, 23 bp, Homo sapiens
tctccagttgggactcaggatat

SEQ ID NO: 1124277 - DNA, 18 bp, Homo sapiens
tctccagtttgcacctgt

SEQ ID NO: 1124278 - DNA, 15 bp, Homo sapiens
tctccagttttcagt

SEQ ID NO: 1124279 - DNA, 16 bp, Homo sapiens
tctctgtctcatccat

SEQ ID NO: 1124280 - DNA, 14 bp, Homo sapiens
tctctgtctctgct

SEQ ID NO: 1124281 - DNA, 17 bp, Homo sapiens
tctctgtctctgtggaa

SEQ ID NO: 1124282 - DNA, 12 bp, Homo sapiens
tctctgtctggg

SEQ ID NO: 1124283 - DNA, 16 bp, Homo sapiens
tctctgtgaacgattt

SEQ ID NO: 1124284 - DNA, 22 bp, Homo sapiens
tctctgtgaatacaattaaagg

SEQ ID NO: 1124285 - DNA, 17 bp, Homo sapiens
tctctgtgccttcgtct

SEQ ID NO: 1124286 - DNA, 14 bp, Homo sapiens
tctctgtgctctga

SEQ ID NO: 1124287 - DNA, 11 bp, Homo sapiens
tctctgtgctt

SEQ ID NO: 1124288 - DNA, 20 bp, Homo sapiens
tctctgtggttttttttgaa

SEQ ID NO: 1124289 - DNA, 22 bp, Homo sapiens
tctctgtgtgttttctttggtt

SEQ ID NO: 1124290 - DNA, 20 bp, Homo sapiens
tctctgttctgtttggcact

SEQ ID NO: 1124291 - DNA, 20 bp, Homo sapiens
tctctgttggtccactgtgt

SEQ ID NO: 1124292 - DNA, 22 bp, Homo sapiens
tctctgttggtccactgtgttt

SEQ ID NO: 1124293 - DNA, 18 bp, Homo sapiens
tctctgttgtcgtaaaga

SEQ ID NO: 1124294 - DNA, 14 bp, Homo sapiens
tctctgtttcctga

SEQ ID NO: 1124295 - DNA, 13 bp, Homo sapiens
tctcttaaagttg

SEQ ID NO: 1124296 - DNA, 19 bp, Homo sapiens
tctcttaaataaaaataat

SEQ ID NO: 1124297 - DNA, 21 bp, Homo sapiens
tctcttaatattgagaatcag

SEQ ID NO: 1124298 - DNA, 17 bp, Homo sapiens
tctcttaatcactactg

SEQ ID NO: 1124299 - DNA, 21 bp, Homo sapiens
tctcttaatcactactgtatg

SEQ ID NO: 1124300 - DNA, 14 bp, Homo sapiens
tctcttacattttc

SEQ ID NO: 1124301 - DNA, 13 bp, Homo sapiens
tctcttacctgtt

SEQ ID NO: 1124302 - DNA, 13 bp, Homo sapiens
tctcttagaaata

SEQ ID NO: 1124303 - DNA, 15 bp, Homo sapiens
tctcttagaagccat

SEQ ID NO: 1124304 - DNA, 22 bp, Homo sapiens
tctcttagctactgtatgcaaa

SEQ ID NO: 1124305 - DNA, 15 bp, Homo sapiens
tctcttatagaatat

SEQ ID NO: 1124306 - DNA, 17 bp, Homo sapiens
tctcttatagaatattt

SEQ ID NO: 1124307 - DNA, 18 bp, Homo sapiens
tctcttatagaatattta

SEQ ID NO: 1124308 - DNA, 15 bp, Homo sapiens
tctcttattctaata

SEQ ID NO: 1124309 - DNA, 17 bp, Homo sapiens
tctcttcaagcatcctc

SEQ ID NO: 1124310 - DNA, 17 bp, Homo sapiens
tctcttcaatgaaaaaa

SEQ ID NO: 1124311 - DNA, 21 bp, Homo sapiens
tctcttcactaccctgattct

SEQ ID NO: 1124312 - DNA, 22 bp, Homo sapiens
tctcttcactaccctgattctt

SEQ ID NO: 1124313 - DNA, 13 bp, Homo sapiens
tctcttcactccc

SEQ ID NO: 1124314 - DNA, 17 bp, Homo sapiens
tctcttcactcccaata

SEQ ID NO: 1124315 - DNA, 14 bp, Homo sapiens
tctcttcaggttct

SEQ ID NO: 1124316 - DNA, 22 bp, Homo sapiens
tctcttccagaagatgccctcc

SEQ ID NO: 1124317 - DNA, 14 bp, Homo sapiens
tctcttcccaggcc

SEQ ID NO: 1124318 - DNA, 15 bp, Homo sapiens
tctcttccccagaga

SEQ ID NO: 1124319 - DNA, 17 bp, Homo sapiens
tctcttccccagagagg

SEQ ID NO: 1124320 - DNA, 12 bp, Homo sapiens
tctcttccctga

SEQ ID NO: 1124321 - DNA, 13 bp, Homo sapiens
tctcttccgggag

SEQ ID NO: 1124322 - DNA, 15 bp, Homo sapiens
tctcttcctgcccct

SEQ ID NO: 1124323 - DNA, 16 bp, Homo sapiens
tctcttcctgcccctc

SEQ ID NO: 1124324 - DNA, 11 bp, Homo sapiens
tctcttcctgt

SEQ ID NO: 1124325 - DNA, 20 bp, Homo sapiens
tctcttccttttatcagtag

SEQ ID NO: 1124326 - DNA, 18 bp, Homo sapiens
tctcttctcagctcttcc

SEQ ID NO: 1124327 - DNA, 16 bp, Homo sapiens
tctcttctccactgga

SEQ ID NO: 1124328 - DNA, 14 bp, Homo sapiens
tctcttctcccaga

SEQ ID NO: 1124329 - DNA, 14 bp, Homo sapiens
tctcttctctccag

SEQ ID NO: 1124330 - DNA, 15 bp, Homo sapiens
tctcttctctccagc

SEQ ID NO: 1124331 - DNA, 16 bp, Homo sapiens
tctcttctctccagct

SEQ ID NO: 1124332 - DNA, 23 bp, Homo sapiens
tctcttctctccagctgactaaa

SEQ ID NO: 1124333 - DNA, 22 bp, Homo sapiens
tctcttcttcccctttgtcctg

SEQ ID NO: 1124334 - DNA, 19 bp, Homo sapiens
tctcttctttattgcacta

SEQ ID NO: 1124335 - DNA, 15 bp, Homo sapiens
tctcttctttccatt

SEQ ID NO: 1124336 - DNA, 20 bp, Homo sapiens
tctcttgaaaagttcaggga

SEQ ID NO: 1124337 - DNA, 23 bp, Homo sapiens
tctcttgaaaagttcagggaccg

SEQ ID NO: 1124338 - DNA, 12 bp, Homo sapiens
tctcttgaaacc

SEQ ID NO: 1124339 - DNA, 19 bp, Homo sapiens
tctcttgaaacctgttaaa

SEQ ID NO: 1124340 - DNA, 18 bp, Homo sapiens
tctcttgagcatcaatct

SEQ ID NO: 1124341 - DNA, 22 bp, Homo sapiens
tctcttgagcatcaatcttgtt

SEQ ID NO: 1124342 - DNA, 13 bp, Homo sapiens
tctcttgagcctg

SEQ ID NO: 1124343 - DNA, 18 bp, Homo sapiens
tctcttgagcctgggagg

SEQ ID NO: 1124344 - DNA, 13 bp, Homo sapiens
tctcttgagggag

SEQ ID NO: 1124345 - DNA, 22 bp, Homo sapiens
tctcttgagggagcttagccaa

SEQ ID NO: 1124346 - DNA, 14 bp, Homo sapiens
tctcttgcacccgc

SEQ ID NO: 1124347 - DNA, 17 bp, Homo sapiens
tctcttgcacccgcctc

SEQ ID NO: 1124348 - DNA, 22 bp, Homo sapiens
tctcttgcacccgcctctcccg

SEQ ID NO: 1124349 - DNA, 18 bp, Homo sapiens
tctcttgccttaaatata

SEQ ID NO: 1124350 - DNA, 20 bp, Homo sapiens
tctcttgctttcacattgta

SEQ ID NO: 1124351 - DNA, 20 bp, Homo sapiens
tctcttgggaagtgtgttta

SEQ ID NO: 1124352 - DNA, 13 bp, Homo sapiens
tctcttgggagtc

SEQ ID NO: 1124353 - DNA, 18 bp, Homo sapiens
tctcttgggagtcttggg

SEQ ID NO: 1124354 - DNA, 22 bp, Homo sapiens
tctcttgggagtcttgggtggc

SEQ ID NO: 1124355 - DNA, 20 bp, Homo sapiens
tctcttggtatgcatctttt

SEQ ID NO: 1124356 - DNA, 16 bp, Homo sapiens
tctcttggtgaaataa

SEQ ID NO: 1124357 - DNA, 22 bp, Homo sapiens
tctcttgtgacgtgcactgtga

SEQ ID NO: 1124358 - DNA, 15 bp, Homo sapiens
tctcttgtgactcag

SEQ ID NO: 1124359 - DNA, 19 bp, Homo sapiens
tctcttgtttgagagagaa

SEQ ID NO: 1124360 - DNA, 17 bp, Homo sapiens
tctctttaatcttcagt

SEQ ID NO: 1124361 - DNA, 18 bp, Homo sapiens
tctctttacttcccagta

SEQ ID NO: 1124362 - DNA, 17 bp, Homo sapiens
tctctttatacagctgt

SEQ ID NO: 1124363 - DNA, 22 bp, Homo sapiens
tctctttcacattgtttgctgc

SEQ ID NO: 1124364 - DNA, 18 bp, Homo sapiens
tctctttcccccacccta

SEQ ID NO: 1124365 - DNA, 12 bp, Homo sapiens
tctctttccctt

SEQ ID NO: 1124366 - DNA, 12 bp, Homo sapiens
tctctttccttg

SEQ ID NO: 1124367 - DNA, 15 bp, Homo sapiens
tctctttccttgagc

SEQ ID NO: 1124368 - DNA, 15 bp, Homo sapiens
tctctttctctcttc

SEQ ID NO: 1124369 - DNA, 13 bp, Homo sapiens
tctctttctctgg

SEQ ID NO: 1124370 - DNA, 17 bp, Homo sapiens
tctctttcttcctttac

SEQ ID NO: 1124371 - DNA, 17 bp, Homo sapiens
tctctttcttcctttct

SEQ ID NO: 1124372 - DNA, 18 bp, Homo sapiens
tctctttcttcctttcta

SEQ ID NO: 1124373 - DNA, 13 bp, Homo sapiens
tctctttgactta

SEQ ID NO: 1124374 - DNA, 19 bp, Homo sapiens
tctctttggaaaatagttt

SEQ ID NO: 1124375 - DNA, 16 bp, Homo sapiens
tctctttgggaatgtt

SEQ ID NO: 1124376 - DNA, 21 bp, Homo sapiens
tctctttgtttcaactggatt

SEQ ID NO: 1124377 - DNA, 23 bp, Homo sapiens
tctctttgtttctgtttcttgct

SEQ ID NO: 1124378 - DNA, 18 bp, Homo sapiens
tctcttttaaaatatcct

SEQ ID NO: 1124379 - DNA, 20 bp, Homo sapiens
tctcttttatatttgtagga

SEQ ID NO: 1124380 - DNA, 22 bp, Homo sapiens
tctcttttccactccattgtcg

SEQ ID NO: 1124381 - DNA, 14 bp, Homo sapiens
tctcttttgaaagt

SEQ ID NO: 1124382 - DNA, 22 bp, Homo sapiens
tctcttttgaatccatgcttgg

SEQ ID NO: 1124383 - DNA, 15 bp, Homo sapiens
tctctttttcttcct

SEQ ID NO: 1124384 - DNA, 13 bp, Homo sapiens
tctctttttggag

SEQ ID NO: 1124385 - DNA, 19 bp, Homo sapiens
tctctttttggaggtgctt

SEQ ID NO: 1124386 - DNA, 14 bp, Homo sapiens
tctgaaaacaaggt

SEQ ID NO: 1124387 - DNA, 22 bp, Homo sapiens
tctgaaaagcaattgccctgta

SEQ ID NO: 1124388 - DNA, 16 bp, Homo sapiens
tctgaaaatgtatgtg

SEQ ID NO: 1124389 - DNA, 22 bp, Homo sapiens
tctgaaaattccagaaaggata

SEQ ID NO: 1124390 - DNA, 13 bp, Homo sapiens
tctgaaaattctg

SEQ ID NO: 1124391 - DNA, 14 bp, Homo sapiens
tctgaaacacacga

SEQ ID NO: 1124392 - DNA, 15 bp, Homo sapiens
tctgaaacaggccct

SEQ ID NO: 1124393 - DNA, 16 bp, Homo sapiens
tctgaaacccacagat

SEQ ID NO: 1124394 - DNA, 14 bp, Homo sapiens
tctgaaagacagaa

SEQ ID NO: 1124395 - DNA, 12 bp, Homo sapiens
tctgaaagagaa

SEQ ID NO: 1124396 - DNA, 12 bp, Homo sapiens
tctgaaagccac

SEQ ID NO: 1124397 - DNA, 15 bp, Homo sapiens
tctgaaagctttata

SEQ ID NO: 1124398 - DNA, 17 bp, Homo sapiens
tctgaaaggaaatacac

SEQ ID NO: 1124399 - DNA, 21 bp, Homo sapiens
tctgaaaggagacattgctct

SEQ ID NO: 1124400 - DNA, 19 bp, Homo sapiens
tctgaaataaaatgccata

SEQ ID NO: 1124401 - DNA, 23 bp, Homo sapiens
tctgaaataaaatgccatagttt

SEQ ID NO: 1124402 - DNA, 16 bp, Homo sapiens
tctgcccctcccccaa

SEQ ID NO: 1124403 - DNA, 22 bp, Homo sapiens
tctgcccctctactgttgcaca

SEQ ID NO: 1124404 - DNA, 22 bp, Homo sapiens
tctgcccctctccaggcgccgg

SEQ ID NO: 1124405 - DNA, 19 bp, Homo sapiens
tctgccccttgggcatcca

SEQ ID NO: 1124406 - DNA, 13 bp, Homo sapiens
tctgcccgcagag

SEQ ID NO: 1124407 - DNA, 15 bp, Homo sapiens
tctgcccgggcccct

SEQ ID NO: 1124408 - DNA, 19 bp, Homo sapiens
tctgccctatggatttgaa

SEQ ID NO: 1124409 - DNA, 19 bp, Homo sapiens
tctgccctctagagccttc

SEQ ID NO: 1124410 - DNA, 13 bp, Homo sapiens
tctgccctctgct

SEQ ID NO: 1124411 - DNA, 15 bp, Homo sapiens
tctgccctctgctgc

SEQ ID NO: 1124412 - DNA, 13 bp, Homo sapiens
tctgccctctggg

SEQ ID NO: 1124413 - DNA, 13 bp, Homo sapiens
tctgccctgccca

SEQ ID NO: 1124414 - DNA, 13 bp, Homo sapiens
tctgccctgcctg

SEQ ID NO: 1124415 - DNA, 15 bp, Homo sapiens
tctgccctgtgtact

SEQ ID NO: 1124416 - DNA, 19 bp, Homo sapiens
tctgcccttatggagctca

SEQ ID NO: 1124417 - DNA, 21 bp, Homo sapiens
tctgcccttgttccagctttg

SEQ ID NO: 1124418 - DNA, 18 bp, Homo sapiens
tctgccgccccctcctga

SEQ ID NO: 1124419 - DNA, 19 bp, Homo sapiens
tctgccgctacctccctcc

SEQ ID NO: 1124420 - DNA, 23 bp, Homo sapiens
tctgccggctctttccttgctca

SEQ ID NO: 1124421 - DNA, 19 bp, Homo sapiens
tctgccggtcgggcagcca

SEQ ID NO: 1124422 - DNA, 22 bp, Homo sapiens
tctgccggtcgggcagccagca

SEQ ID NO: 1124423 - DNA, 21 bp, Homo sapiens
tctgccggtgctcggagaaga

SEQ ID NO: 1124424 - DNA, 15 bp, Homo sapiens
tctgccgtctctcct

SEQ ID NO: 1124425 - DNA, 14 bp, Homo sapiens
tctgccgtctctgg

SEQ ID NO: 1124426 - DNA, 19 bp, Homo sapiens
tctgcctagagtgtagcct

SEQ ID NO: 1124427 - DNA, 21 bp, Homo sapiens
tctgcctcaatgtgaatcaga

SEQ ID NO: 1124428 - DNA, 15 bp, Homo sapiens
tctgcctcctcttca

SEQ ID NO: 1124429 - DNA, 18 bp, Homo sapiens
tctgcctctaagctgctc

SEQ ID NO: 1124430 - DNA, 13 bp, Homo sapiens
tctgcctctccag

SEQ ID NO: 1124431 - DNA, 14 bp, Homo sapiens
tctgcctctcccag

SEQ ID NO: 1124432 - DNA, 20 bp, Homo sapiens
tctgcctctcccaggctgtc

SEQ ID NO: 1124433 - DNA, 16 bp, Homo sapiens
tctgcctctccctggg

SEQ ID NO: 1124434 - DNA, 18 bp, Homo sapiens
tctgcctctccctgggtc

SEQ ID NO: 1124435 - DNA, 14 bp, Homo sapiens
tctgcctctcttct

SEQ ID NO: 1124436 - DNA, 22 bp, Homo sapiens
tctgcctctcttcttccccttt

SEQ ID NO: 1124437 - DNA, 15 bp, Homo sapiens
tctgcctctgggcag

SEQ ID NO: 1124438 - DNA, 19 bp, Homo sapiens
tctgcctcttctgggaggg

SEQ ID NO: 1124439 - DNA, 12 bp, Homo sapiens
tctgcctgcact

SEQ ID NO: 1124440 - DNA, 15 bp, Homo sapiens
tctgcctgcactccc

SEQ ID NO: 1124441 - DNA, 20 bp, Homo sapiens
tctgcctgcactccctggcc

SEQ ID NO: 1124442 - DNA, 22 bp, Homo sapiens
tctgcctgcactccctggcctt

SEQ ID NO: 1124443 - DNA, 23 bp, Homo sapiens
tctgcctgcactccctggccttg

SEQ ID NO: 1124444 - DNA, 12 bp, Homo sapiens
tctgcctgcccc

SEQ ID NO: 1124445 - DNA, 23 bp, Homo sapiens
tctgcctggagacaaggtgctaa

SEQ ID NO: 1124446 - DNA, 14 bp, Homo sapiens
tctgcctggcctgg

SEQ ID NO: 1124447 - DNA, 15 bp, Homo sapiens
tctgcctggcctggc

SEQ ID NO: 1124448 - DNA, 17 bp, Homo sapiens
tctgcctggcctggctc

SEQ ID NO: 1124449 - DNA, 10 bp, Homo sapiens
tctgcctggg

SEQ ID NO: 1124450 - DNA, 14 bp, Homo sapiens
tctgcctgggatgg

SEQ ID NO: 1124451 - DNA, 12 bp, Homo sapiens
tctgcctgggcc

SEQ ID NO: 1124452 - DNA, 18 bp, Homo sapiens
tctgcctgggcctgtgca

SEQ ID NO: 1124453 - DNA, 19 bp, Homo sapiens
tctgcctgggcctgtgcag

SEQ ID NO: 1124454 - DNA, 14 bp, Homo sapiens
tctgcctgggctct

SEQ ID NO: 1124455 - DNA, 15 bp, Homo sapiens
tctgcctgggctctg

SEQ ID NO: 1124456 - DNA, 17 bp, Homo sapiens
tctgcctggttttattt

SEQ ID NO: 1124457 - DNA, 13 bp, Homo sapiens
tctgcctgtccct

SEQ ID NO: 1124458 - DNA, 17 bp, Homo sapiens
tctgcctgtccctctca

SEQ ID NO: 1124459 - DNA, 13 bp, Homo sapiens
tctgcctgtctgg

SEQ ID NO: 1124460 - DNA, 14 bp, Homo sapiens
tctgcctgtggcct

SEQ ID NO: 1124461 - DNA, 23 bp, Homo sapiens
tctgccttactggtttccccagg

SEQ ID NO: 1124462 - DNA, 11 bp, Homo sapiens
tctgccttcca

SEQ ID NO: 1124463 - DNA, 13 bp, Homo sapiens
tctgccttcccaa

SEQ ID NO: 1124464 - DNA, 19 bp, Homo sapiens
tctgccttgagtccccagg

SEQ ID NO: 1124465 - DNA, 13 bp, Homo sapiens
tctgccttggccc

SEQ ID NO: 1124466 - DNA, 20 bp, Homo sapiens
tctgccttggcttggacaaa

SEQ ID NO: 1124467 - DNA, 20 bp, Homo sapiens
tctgccttggttctggccac

SEQ ID NO: 1124468 - DNA, 12 bp, Homo sapiens
tctgcctttccc

SEQ ID NO: 1124469 - DNA, 22 bp, Homo sapiens
tctgcctttggggacttttctt

SEQ ID NO: 1124470 - DNA, 11 bp, Homo sapiens
tctgccttttc

SEQ ID NO: 1124471 - DNA, 13 bp, Homo sapiens
tctgcgccaggca

SEQ ID NO: 1124472 - DNA, 13 bp, Homo sapiens
tctgcgcctcagg

SEQ ID NO: 1124473 - DNA, 14 bp, Homo sapiens
tctgcgcctcaggc

SEQ ID NO: 1124474 - DNA, 16 bp, Homo sapiens
tctgcggcccgggccg

SEQ ID NO: 1124475 - DNA, 18 bp, Homo sapiens
tctgcgggctccctcctc

SEQ ID NO: 1124476 - DNA, 18 bp, Homo sapiens
tctgcgtccaccaggcct

SEQ ID NO: 1124477 - DNA, 19 bp, Homo sapiens
tctgcgtccaccaggcctc

SEQ ID NO: 1124478 - DNA, 22 bp, Homo sapiens
tctgcgtccaccaggcctcact

SEQ ID NO: 1124479 - DNA, 15 bp, Homo sapiens
tctgcgtctgtgttg

SEQ ID NO: 1124480 - DNA, 22 bp, Homo sapiens
tctgcgtggttcctttctcagc

SEQ ID NO: 1124481 - DNA, 15 bp, Homo sapiens
tctgcgtgtcacctg

SEQ ID NO: 1124482 - DNA, 16 bp, Homo sapiens
tctgctaatgtaaact

SEQ ID NO: 1124483 - DNA, 18 bp, Homo sapiens
tctgctacccactgccag

SEQ ID NO: 1124484 - DNA, 13 bp, Homo sapiens
tctgctagaaagt

SEQ ID NO: 1124485 - DNA, 15 bp, Homo sapiens
tctgctagaaagtta

SEQ ID NO: 1124486 - DNA, 22 bp, Homo sapiens
tctgctagccaatattaaaaga

SEQ ID NO: 1124487 - DNA, 17 bp, Homo sapiens
tctgctagtgctgtaat

SEQ ID NO: 1124488 - DNA, 17 bp, Homo sapiens
tctgctatgcattttct

SEQ ID NO: 1124489 - DNA, 20 bp, Homo sapiens
tctgctatgcattttcttca

SEQ ID NO: 1124490 - DNA, 23 bp, Homo sapiens
tctgctatgcattttcttcacag

SEQ ID NO: 1124491 - DNA, 15 bp, Homo sapiens
tctgctcaccgccca

SEQ ID NO: 1124492 - DNA, 16 bp, Homo sapiens
tctgctcagctctggg

SEQ ID NO: 1124493 - DNA, 14 bp, Homo sapiens
tctgctcagcttct

SEQ ID NO: 1124494 - DNA, 22 bp, Homo sapiens
tctgctcagtaatttgaggaca

SEQ ID NO: 1124495 - DNA, 16 bp, Homo sapiens
tctgctcattaaactg

SEQ ID NO: 1124496 - DNA, 10 bp, Homo sapiens
tctgctccac

SEQ ID NO: 1124497 - DNA, 12 bp, Homo sapiens
tctgctccacca

SEQ ID NO: 1124498 - DNA, 14 bp, Homo sapiens
tctgctccaccaca

SEQ ID NO: 1124499 - DNA, 16 bp, Homo sapiens
tctgctccacccttgg

SEQ ID NO: 1124500 - DNA, 17 bp, Homo sapiens
tctgctccacccttggc

SEQ ID NO: 1124501 - DNA, 19 bp, Homo sapiens
tctgctccacccttggcct

SEQ ID NO: 1124502 - DNA, 20 bp, Homo sapiens
tctgctccacccttggcctg

SEQ ID NO: 1124503 - DNA, 23 bp, Homo sapiens
tctgctccacccttggcctgtct

SEQ ID NO: 1124504 - DNA, 22 bp, Homo sapiens
tctgctccagactcacttgcca

SEQ ID NO: 1124505 - DNA, 22 bp, Homo sapiens
tctgctccagcaactgcccttc

SEQ ID NO: 1124506 - DNA, 23 bp, Homo sapiens
tctgctccagcaactgcccttcc

SEQ ID NO: 1124507 - DNA, 16 bp, Homo sapiens
tctgctccagcccctt

SEQ ID NO: 1124508 - DNA, 23 bp, Homo sapiens
tctgctccagcccctttgcctct

SEQ ID NO: 1124509 - DNA, 16 bp, Homo sapiens
tctgctccccagggga

SEQ ID NO: 1124510 - DNA, 14 bp, Homo sapiens
tctgctcctctcca

SEQ ID NO: 1124511 - DNA, 17 bp, Homo sapiens
tctgctcctctccaggc

SEQ ID NO: 1124512 - DNA, 11 bp, Homo sapiens
tctgctcctgc

SEQ ID NO: 1124513 - DNA, 17 bp, Homo sapiens
tctgctcctgcttttct

SEQ ID NO: 1124514 - DNA, 19 bp, Homo sapiens
tctgctcctgcttttctgt

SEQ ID NO: 1124515 - DNA, 22 bp, Homo sapiens
tctgctcctggagcctttgaat

SEQ ID NO: 1124516 - DNA, 19 bp, Homo sapiens
tctgctccttcactgttcc

SEQ ID NO: 1124517 - DNA, 21 bp, Homo sapiens
tctgctcgccctcctttctgt

SEQ ID NO: 1124518 - DNA, 23 bp, Homo sapiens
tctgctcggcttcttggaccttg

SEQ ID NO: 1124519 - DNA, 13 bp, Homo sapiens
tctgctctagcca

SEQ ID NO: 1124520 - DNA, 18 bp, Homo sapiens
tctgctctagggaatctg

SEQ ID NO: 1124521 - DNA, 13 bp, Homo sapiens
tctgctctgccat

SEQ ID NO: 1124522 - DNA, 18 bp, Homo sapiens
tctgctctgccatcttca

SEQ ID NO: 1124523 - DNA, 16 bp, Homo sapiens
tctgctctgcctggag

SEQ ID NO: 1124524 - DNA, 16 bp, Homo sapiens
tctgctctgcgtgtca

SEQ ID NO: 1124525 - DNA, 18 bp, Homo sapiens
tctgggctttctcctgga

SEQ ID NO: 1124526 - DNA, 20 bp, Homo sapiens
tctgggctttctcctggaga

SEQ ID NO: 1124527 - DNA, 16 bp, Homo sapiens
tctggggaaaaaaaag

SEQ ID NO: 1124528 - DNA, 18 bp, Homo sapiens
tctggggaaaaaaaagag

SEQ ID NO: 1124529 - DNA, 20 bp, Homo sapiens
tctggggaaaaaaaagagac

SEQ ID NO: 1124530 - DNA, 22 bp, Homo sapiens
tctggggaaaaaaaagagactg

SEQ ID NO: 1124531 - DNA, 22 bp, Homo sapiens
tctggggacaggataataaaac

SEQ ID NO: 1124532 - DNA, 14 bp, Homo sapiens
tctggggatgggtg

SEQ ID NO: 1124533 - DNA, 16 bp, Homo sapiens
tctggggatttctggg

SEQ ID NO: 1124534 - DNA, 17 bp, Homo sapiens
tctggggatttctggga

SEQ ID NO: 1124535 - DNA, 19 bp, Homo sapiens
tctggggcaggctgggcca

SEQ ID NO: 1124536 - DNA, 16 bp, Homo sapiens
tctggggccacacaga

SEQ ID NO: 1124537 - DNA, 21 bp, Homo sapiens
tctggggccccatcagctgcc

SEQ ID NO: 1124538 - DNA, 20 bp, Homo sapiens
tctggggccctgggcctcag

SEQ ID NO: 1124539 - DNA, 16 bp, Homo sapiens
tctggggcctttatca

SEQ ID NO: 1124540 - DNA, 15 bp, Homo sapiens
tctggggctctggga

SEQ ID NO: 1124541 - DNA, 23 bp, Homo sapiens
tctggggctgtgttatgaaaata

SEQ ID NO: 1124542 - DNA, 14 bp, Homo sapiens
tctgggggaggcag

SEQ ID NO: 1124543 - DNA, 19 bp, Homo sapiens
tctgggggaggcagggctg

SEQ ID NO: 1124544 - DNA, 14 bp, Homo sapiens
tctgggggcagctg

SEQ ID NO: 1124545 - DNA, 17 bp, Homo sapiens
tctgggggcagctgtcc

SEQ ID NO: 1124546 - DNA, 18 bp, Homo sapiens
tctgggggcagctgtcct

SEQ ID NO: 1124547 - DNA, 17 bp, Homo sapiens
tctggggtgggcagttt

SEQ ID NO: 1124548 - DNA, 18 bp, Homo sapiens
tctgggtagctgtaaggc

SEQ ID NO: 1124549 - DNA, 18 bp, Homo sapiens
tctgggtcatgcactgag

SEQ ID NO: 1124550 - DNA, 13 bp, Homo sapiens
tctgggtcccggg

SEQ ID NO: 1124551 - DNA, 15 bp, Homo sapiens
tctgggtcccggggt

SEQ ID NO: 1124552 - DNA, 17 bp, Homo sapiens
tctgggtccctcggagc

SEQ ID NO: 1124553 - DNA, 18 bp, Homo sapiens
tctgggtccctgctcccc

SEQ ID NO: 1124554 - DNA, 12 bp, Homo sapiens
tctgggtgccct

SEQ ID NO: 1124555 - DNA, 14 bp, Homo sapiens
tctgggtgccctga

SEQ ID NO: 1124556 - DNA, 17 bp, Homo sapiens
tctgggtgccctgaaag

SEQ ID NO: 1124557 - DNA, 13 bp, Homo sapiens
tctgggtgtccgc

SEQ ID NO: 1124558 - DNA, 21 bp, Homo sapiens
tctgggtgtgctttttgggac

SEQ ID NO: 1124559 - DNA, 18 bp, Homo sapiens
tctgggtgttgaccactc

SEQ ID NO: 1124560 - DNA, 22 bp, Homo sapiens
tctgggttccttcctctgagcc

SEQ ID NO: 1124561 - DNA, 13 bp, Homo sapiens
tctgggtttctaa

SEQ ID NO: 1124562 - DNA, 14 bp, Homo sapiens
tctgggtttctaga

SEQ ID NO: 1124563 - DNA, 16 bp, Homo sapiens
tctgggtttgagaaat

SEQ ID NO: 1124564 - DNA, 15 bp, Homo sapiens
tctgggtttgcccag

SEQ ID NO: 1124565 - DNA, 20 bp, Homo sapiens
tctgggtttgcccagtcctg

SEQ ID NO: 1124566 - DNA, 23 bp, Homo sapiens
tctgggtttgcccagtcctgggt

SEQ ID NO: 1124567 - DNA, 16 bp, Homo sapiens
tctgggttttctgaaa

SEQ ID NO: 1124568 - DNA, 13 bp, Homo sapiens
tctggtaaatatg

SEQ ID NO: 1124569 - DNA, 21 bp, Homo sapiens
tctggtaatattgacttgtat

SEQ ID NO: 1124570 - DNA, 22 bp, Homo sapiens
tctggtaatattgacttgtata

SEQ ID NO: 1124571 - DNA, 16 bp, Homo sapiens
tctggtagatagaaat

SEQ ID NO: 1124572 - DNA, 14 bp, Homo sapiens
tctggtaggaagat

SEQ ID NO: 1124573 - DNA, 23 bp, Homo sapiens
tctggtagggatatggcaggact

SEQ ID NO: 1124574 - DNA, 14 bp, Homo sapiens
tctggtatttcccc

SEQ ID NO: 1124575 - DNA, 16 bp, Homo sapiens
tctggtcccctgtggt

SEQ ID NO: 1124576 - DNA, 21 bp, Homo sapiens
tctggtcccctgtggtgatgt

SEQ ID NO: 1124577 - DNA, 11 bp, Homo sapiens
tctggtccttc

SEQ ID NO: 1124578 - DNA, 21 bp, Homo sapiens
tctggtctaatttattaatct

SEQ ID NO: 1124579 - DNA, 15 bp, Homo sapiens
tctggtgaggtggcc

SEQ ID NO: 1124580 - DNA, 21 bp, Homo sapiens
tctggtgaggtggcccaggcc

SEQ ID NO: 1124581 - DNA, 22 bp, Homo sapiens
tctggtgaggtggcccaggccc

SEQ ID NO: 1124582 - DNA, 23 bp, Homo sapiens
tctggtgaggtggcccaggcccc

SEQ ID NO: 1124583 - DNA, 20 bp, Homo sapiens
tctggtgagtcaccacttca

SEQ ID NO: 1124584 - DNA, 12 bp, Homo sapiens
tctggtgcacgc

SEQ ID NO: 1124585 - DNA, 14 bp, Homo sapiens
tctggtggaggagc

SEQ ID NO: 1124586 - DNA, 23 bp, Homo sapiens
tctggtggaggagctgagggagg

SEQ ID NO: 1124587 - DNA, 16 bp, Homo sapiens
tctggtggccacttca

SEQ ID NO: 1124588 - DNA, 12 bp, Homo sapiens
tctggtggctcc

SEQ ID NO: 1124589 - DNA, 13 bp, Homo sapiens
tctggtggctcct

SEQ ID NO: 1124590 - DNA, 15 bp, Homo sapiens
tctggtggctcctcc

SEQ ID NO: 1124591 - DNA, 16 bp, Homo sapiens
tctggtggctcctcct

SEQ ID NO: 1124592 - DNA, 17 bp, Homo sapiens
tctggtggctcctccta

SEQ ID NO: 1124593 - DNA, 20 bp, Homo sapiens
tctggtggctcctcctagga

SEQ ID NO: 1124594 - DNA, 12 bp, Homo sapiens
tctggtggctta

SEQ ID NO: 1124595 - DNA, 18 bp, Homo sapiens
tctggtggtcttccttct

SEQ ID NO: 1124596 - DNA, 16 bp, Homo sapiens
tctggtgtgtggtgag

SEQ ID NO: 1124597 - DNA, 17 bp, Homo sapiens
tctggtgtgtggtgagg

SEQ ID NO: 1124598 - DNA, 13 bp, Homo sapiens
tctggtgttctat

SEQ ID NO: 1124599 - DNA, 13 bp, Homo sapiens
tctggtgtttaca

SEQ ID NO: 1124600 - DNA, 16 bp, Homo sapiens
tctggttagttaaaag

SEQ ID NO: 1124601 - DNA, 20 bp, Homo sapiens
tctggttatttttctcttgt

SEQ ID NO: 1124602 - DNA, 15 bp, Homo sapiens
tctggttctgacact

SEQ ID NO: 1124603 - DNA, 17 bp, Homo sapiens
tctggttctgtgtcctc

SEQ ID NO: 1124604 - DNA, 12 bp, Homo sapiens
tctggttgcctc

SEQ ID NO: 1124605 - DNA, 13 bp, Homo sapiens
tctggttgcctcc

SEQ ID NO: 1124606 - DNA, 14 bp, Homo sapiens
tctggttgcctccc

SEQ ID NO: 1124607 - DNA, 13 bp, Homo sapiens
tctggttgcttca

SEQ ID NO: 1124608 - DNA, 15 bp, Homo sapiens
tctggttgtatttct

SEQ ID NO: 1124609 - DNA, 20 bp, Homo sapiens
tctggttgtatttctatatt

SEQ ID NO: 1124610 - DNA, 16 bp, Homo sapiens
tctggttgtctagtca

SEQ ID NO: 1124611 - DNA, 20 bp, Homo sapiens
tctggttgtttctgttccaa

SEQ ID NO: 1124612 - DNA, 19 bp, Homo sapiens
tctggttgtttttgttctt

SEQ ID NO: 1124613 - DNA, 17 bp, Homo sapiens
tctggtttctgtccccg

SEQ ID NO: 1124614 - DNA, 19 bp, Homo sapiens
tctgtaaaaaatggagctc

SEQ ID NO: 1124615 - DNA, 20 bp, Homo sapiens
tctgtaaaaaatggagctca

SEQ ID NO: 1124616 - DNA, 17 bp, Homo sapiens
tctgtaaacagaataaa

SEQ ID NO: 1124617 - DNA, 15 bp, Homo sapiens
tctgtaaactcaaaa

SEQ ID NO: 1124618 - DNA, 13 bp, Homo sapiens
tctgtaaactgtg

SEQ ID NO: 1124619 - DNA, 22 bp, Homo sapiens
tctgtaaactgtgtattccaag

SEQ ID NO: 1124620 - DNA, 14 bp, Homo sapiens
tctgtaaagaaaac

SEQ ID NO: 1124621 - DNA, 13 bp, Homo sapiens
tctgtaaagccag

SEQ ID NO: 1124622 - DNA, 13 bp, Homo sapiens
tctgtaaagctaa

SEQ ID NO: 1124623 - DNA, 15 bp, Homo sapiens
tctgtaaatatccca

SEQ ID NO: 1124624 - DNA, 19 bp, Homo sapiens
tctgtaaatatcccagaga

SEQ ID NO: 1124625 - DNA, 14 bp, Homo sapiens
tctgtaactgccca

SEQ ID NO: 1124626 - DNA, 16 bp, Homo sapiens
tctgtaactgcccagc

SEQ ID NO: 1124627 - DNA, 23 bp, Homo sapiens
tctgtaacttacacctggaatgt

SEQ ID NO: 1124628 - DNA, 16 bp, Homo sapiens
tctgtaagagcttgct

SEQ ID NO: 1124629 - DNA, 20 bp, Homo sapiens
tctgtaagagcttgctccag

SEQ ID NO: 1124630 - DNA, 22 bp, Homo sapiens
tctgtaagagcttgctccagat

SEQ ID NO: 1124631 - DNA, 20 bp, Homo sapiens
tctgtaagtaattgccacag

SEQ ID NO: 1124632 - DNA, 17 bp, Homo sapiens
tctgtaagtgtagctca

SEQ ID NO: 1124633 - DNA, 13 bp, Homo sapiens
tctgtaatattta

SEQ ID NO: 1124634 - DNA, 17 bp, Homo sapiens
tctgtaatatttacaat

SEQ ID NO: 1124635 - DNA, 23 bp, Homo sapiens
tctgtaatatttacaatgtatta

SEQ ID NO: 1124636 - DNA, 19 bp, Homo sapiens
tctgtaatcaatatcccaa

SEQ ID NO: 1124637 - DNA, 15 bp, Homo sapiens
tctgtaatcccagca

SEQ ID NO: 1124638 - DNA, 20 bp, Homo sapiens
tctgtaatggaactgacccc

SEQ ID NO: 1124639 - DNA, 16 bp, Homo sapiens
tctgtacagaatgcta

SEQ ID NO: 1124640 - DNA, 11 bp, Homo sapiens
tctgtacatac

SEQ ID NO: 1124641 - DNA, 19 bp, Homo sapiens
tctgtacatactggcctct

SEQ ID NO: 1124642 - DNA, 20 bp, Homo sapiens
tctgtacatactggcctctg

SEQ ID NO: 1124643 - DNA, 18 bp, Homo sapiens
tctgtacatattactgtt

SEQ ID NO: 1124644 - DNA, 23 bp, Homo sapiens
tctgtacatgttcttgtcataaa

SEQ ID NO: 1124645 - DNA, 13 bp, Homo sapiens
tctgtaccagtta

SEQ ID NO: 1124646 - DNA, 22 bp, Homo sapiens
tctgtacttcagtatgtgtcaa

SEQ ID NO: 1124647 - DNA, 16 bp, Homo sapiens
tctgttgaaaagcaca

SEQ ID NO: 1124648 - DNA, 12 bp, Homo sapiens
tctgttgaagtt

SEQ ID NO: 1124649 - DNA, 18 bp, Homo sapiens
tctgttgaattatgtttt

SEQ ID NO: 1124650 - DNA, 14 bp, Homo sapiens
tctgttgagtaaaa

SEQ ID NO: 1124651 - DNA, 22 bp, Homo sapiens
tctgttggaagcttgttttcca

SEQ ID NO: 1124652 - DNA, 15 bp, Homo sapiens
tctgttggcaggctg

SEQ ID NO: 1124653 - DNA, 18 bp, Homo sapiens
tctgttggcaggctggcc

SEQ ID NO: 1124654 - DNA, 21 bp, Homo sapiens
tctgttggtgccacgctttga

SEQ ID NO: 1124655 - DNA, 12 bp, Homo sapiens
tctgttgtaata

SEQ ID NO: 1124656 - DNA, 16 bp, Homo sapiens
tctgttgtattcattg

SEQ ID NO: 1124657 - DNA, 14 bp, Homo sapiens
tctgttgtcattgc

SEQ ID NO: 1124658 - DNA, 15 bp, Homo sapiens
tctgttgtcctcccc

SEQ ID NO: 1124659 - DNA, 18 bp, Homo sapiens
tctgtttaattttcactt

SEQ ID NO: 1124660 - DNA, 19 bp, Homo sapiens
tctgtttagataatacacc

SEQ ID NO: 1124661 - DNA, 17 bp, Homo sapiens
tctgtttataattgttt

SEQ ID NO: 1124662 - DNA, 20 bp, Homo sapiens
tctgtttatggccacattta

SEQ ID NO: 1124663 - DNA, 18 bp, Homo sapiens
tctgtttattcttccaga

SEQ ID NO: 1124664 - DNA, 16 bp, Homo sapiens
tctgtttcaaagcaca

SEQ ID NO: 1124665 - DNA, 22 bp, Homo sapiens
tctgtttcaggtttccattctg

SEQ ID NO: 1124666 - DNA, 14 bp, Homo sapiens
tctgtttcctcttg

SEQ ID NO: 1124667 - DNA, 16 bp, Homo sapiens
tctgtttcctgaaata

SEQ ID NO: 1124668 - DNA, 16 bp, Homo sapiens
tctgtttcctgacatt

SEQ ID NO: 1124669 - DNA, 13 bp, Homo sapiens
tctgtttctctgc

SEQ ID NO: 1124670 - DNA, 16 bp, Homo sapiens
tctgtttctctttcct

SEQ ID NO: 1124671 - DNA, 18 bp, Homo sapiens
tctgtttctctttccttg

SEQ ID NO: 1124672 - DNA, 20 bp, Homo sapiens
tctgtttcttaagggcacac

SEQ ID NO: 1124673 - DNA, 13 bp, Homo sapiens
tctgtttcttctc

SEQ ID NO: 1124674 - DNA, 13 bp, Homo sapiens
tctgtttgaaact

SEQ ID NO: 1124675 - DNA, 16 bp, Homo sapiens
tctgtttgccacttga

SEQ ID NO: 1124676 - DNA, 18 bp, Homo sapiens
tctgtttgctgtggaact

SEQ ID NO: 1124677 - DNA, 17 bp, Homo sapiens
tctgtttggcacttgta

SEQ ID NO: 1124678 - DNA, 21 bp, Homo sapiens
tctgtttgtttcaagaacctg

SEQ ID NO: 1124679 - DNA, 17 bp, Homo sapiens
tctgttttcaagtgtaa

SEQ ID NO: 1124680 - DNA, 18 bp, Homo sapiens
tctgttttctgtttgtaa

SEQ ID NO: 1124681 - DNA, 21 bp, Homo sapiens
tctgttttctgtttgtaaatt

SEQ ID NO: 1124682 - DNA, 15 bp, Homo sapiens
tctgttttgttaata

SEQ ID NO: 1124683 - DNA, 16 bp, Homo sapiens
tctgttttgttaatat

SEQ ID NO: 1124684 - DNA, 13 bp, Homo sapiens
tcttaaaaaatgt

SEQ ID NO: 1124685 - DNA, 13 bp, Homo sapiens
tcttaaaaactgt

SEQ ID NO: 1124686 - DNA, 15 bp, Homo sapiens
tcttaaaaactgtgt

SEQ ID NO: 1124687 - DNA, 18 bp, Homo sapiens
tcttaaaaactgtgtatc

SEQ ID NO: 1124688 - DNA, 23 bp, Homo sapiens
tcttaaaaactgtgtatcattaa

SEQ ID NO: 1124689 - DNA, 12 bp, Homo sapiens
tcttaaaacaga

SEQ ID NO: 1124690 - DNA, 14 bp, Homo sapiens
tcttaaaacagaaa

SEQ ID NO: 1124691 - DNA, 12 bp, Homo sapiens
tcttaaaagtac

SEQ ID NO: 1124692 - DNA, 14 bp, Homo sapiens
tcttaaaagtactt

SEQ ID NO: 1124693 - DNA, 23 bp, Homo sapiens
tcttaaaagtactttaaaaagga

SEQ ID NO: 1124694 - DNA, 20 bp, Homo sapiens
tcttaaaattcaagaaaata

SEQ ID NO: 1124695 - DNA, 16 bp, Homo sapiens
tcttaaagaaacagct

SEQ ID NO: 1124696 - DNA, 18 bp, Homo sapiens
tcttaaagaaacagcttt

SEQ ID NO: 1124697 - DNA, 23 bp, Homo sapiens
tcttaaagaaacagctttcaagt

SEQ ID NO: 1124698 - DNA, 16 bp, Homo sapiens
tcttaaagctgcctgt

SEQ ID NO: 1124699 - DNA, 19 bp, Homo sapiens
tcttaaagctgcctgtagt

SEQ ID NO: 1124700 - DNA, 21 bp, Homo sapiens
tcttaaagctgcctgtagtta

SEQ ID NO: 1124701 - DNA, 14 bp, Homo sapiens
tcttaaaggcctgg

SEQ ID NO: 1124702 - DNA, 15 bp, Homo sapiens
tcttaaaggcctgga

SEQ ID NO: 1124703 - DNA, 17 bp, Homo sapiens
tcttaaaggcctggaac

SEQ ID NO: 1124704 - DNA, 13 bp, Homo sapiens
tcttaaatacttt

SEQ ID NO: 1124705 - DNA, 17 bp, Homo sapiens
tcttaaatactttttca

SEQ ID NO: 1124706 - DNA, 18 bp, Homo sapiens
tcttaaatactttttcag

SEQ ID NO: 1124707 - DNA, 13 bp, Homo sapiens
tcttaaatgacag

SEQ ID NO: 1124708 - DNA, 18 bp, Homo sapiens
tcttaaatgacagtgaat

SEQ ID NO: 1124709 - DNA, 21 bp, Homo sapiens
tcttaaatgcaagtgcctaga

SEQ ID NO: 1124710 - DNA, 13 bp, Homo sapiens
tcttaaatgctca

SEQ ID NO: 1124711 - DNA, 16 bp, Homo sapiens
tcttaaatgctcataa

SEQ ID NO: 1124712 - DNA, 22 bp, Homo sapiens
tcttaaatgctcattttctggt

SEQ ID NO: 1124713 - DNA, 23 bp, Homo sapiens
tcttaaatgctcattttctggtt

SEQ ID NO: 1124714 - DNA, 23 bp, Homo sapiens
tcttaaatggaattattttgaat

SEQ ID NO: 1124715 - DNA, 22 bp, Homo sapiens
tcttaaattcatttctagactc

SEQ ID NO: 1124716 - DNA, 13 bp, Homo sapiens
tcttaacaaacca

SEQ ID NO: 1124717 - DNA, 20 bp, Homo sapiens
tcttaacaaaccaacatctt

SEQ ID NO: 1124718 - DNA, 15 bp, Homo sapiens
tcttaacaaactctt

SEQ ID NO: 1124719 - DNA, 17 bp, Homo sapiens
tcttaacacagccttcc

SEQ ID NO: 1124720 - DNA, 23 bp, Homo sapiens
tcttaacacatgtccttgtgtgt

SEQ ID NO: 1124721 - DNA, 15 bp, Homo sapiens
tcttaacactggcaa

SEQ ID NO: 1124722 - DNA, 21 bp, Homo sapiens
tcttaacccctaagactgcct

SEQ ID NO: 1124723 - DNA, 22 bp, Homo sapiens
tcttaacccctaagactgcctt

SEQ ID NO: 1124724 - DNA, 16 bp, Homo sapiens
tcttaacctttgctat

SEQ ID NO: 1124725 - DNA, 20 bp, Homo sapiens
tcttaacctttgctatgtaa

SEQ ID NO: 1124726 - DNA, 12 bp, Homo sapiens
tcttaacttctt

SEQ ID NO: 1124727 - DNA, 15 bp, Homo sapiens
tcttaagacttttgg

SEQ ID NO: 1124728 - DNA, 20 bp, Homo sapiens
tcttaagagcttgatctgtg

SEQ ID NO: 1124729 - DNA, 16 bp, Homo sapiens
tcttaagatgtccagg

SEQ ID NO: 1124730 - DNA, 12 bp, Homo sapiens
tcttaagcactt

SEQ ID NO: 1124731 - DNA, 16 bp, Homo sapiens
tcttaagcactttgaa

SEQ ID NO: 1124732 - DNA, 18 bp, Homo sapiens
tcttaagcagcatggaaa

SEQ ID NO: 1124733 - DNA, 12 bp, Homo sapiens
tcttaagcttcc

SEQ ID NO: 1124734 - DNA, 17 bp, Homo sapiens
tcttaaggtctaactgt

SEQ ID NO: 1124735 - DNA, 18 bp, Homo sapiens
tcttaaggtctaactgtg

SEQ ID NO: 1124736 - DNA, 20 bp, Homo sapiens
tcttaagtaccaatgggaag

SEQ ID NO: 1124737 - DNA, 24 bp, Homo sapiens
tcttaataaaataaactagatatt

SEQ ID NO: 1124738 - DNA, 15 bp, Homo sapiens
tcttaatatatttga

SEQ ID NO: 1124739 - DNA, 16 bp, Homo sapiens
tcttaatcactactgt

SEQ ID NO: 1124740 - DNA, 11 bp, Homo sapiens
tcttaatctgt

SEQ ID NO: 1124741 - DNA, 22 bp, Homo sapiens
tcttaatgttactcagatataa

SEQ ID NO: 1124742 - DNA, 13 bp, Homo sapiens
tcttaatgttcct

SEQ ID NO: 1124743 - DNA, 17 bp, Homo sapiens
tcttaattattataaaa

SEQ ID NO: 1124744 - DNA, 19 bp, Homo sapiens
tcttaattattataaaaat

SEQ ID NO: 1124745 - DNA, 20 bp, Homo sapiens
tcttaattattataaaaata

SEQ ID NO: 1124746 - DNA, 20 bp, Homo sapiens
tcttaattattatttgtgtt

SEQ ID NO: 1124747 - DNA, 14 bp, Homo sapiens
tcttaattctctgc

SEQ ID NO: 1124748 - DNA, 14 bp, Homo sapiens
tcttaattctttgt

SEQ ID NO: 1124749 - DNA, 23 bp, Homo sapiens
tcttaatttaatcttttttatgt

SEQ ID NO: 1124750 - DNA, 15 bp, Homo sapiens
tcttaatttggataa

SEQ ID NO: 1124751 - DNA, 16 bp, Homo sapiens
tcttacaaatgtgaaa

SEQ ID NO: 1124752 - DNA, 17 bp, Homo sapiens
tcttacaaccaagaaca

SEQ ID NO: 1124753 - DNA, 14 bp, Homo sapiens
tcttacaagcttaa

SEQ ID NO: 1124754 - DNA, 16 bp, Homo sapiens
tcttacagagccttga

SEQ ID NO: 1124755 - DNA, 18 bp, Homo sapiens
tcttacaggcctacagaa

SEQ ID NO: 1124756 - DNA, 16 bp, Homo sapiens
tcttacataaaccatt

SEQ ID NO: 1124757 - DNA, 11 bp, Homo sapiens
tcttacatatg

SEQ ID NO: 1124758 - DNA, 14 bp, Homo sapiens
tcttacatgttttc

SEQ ID NO: 1124759 - DNA, 15 bp, Homo sapiens
tcttacatgttttct

SEQ ID NO: 1124760 - DNA, 13 bp, Homo sapiens
tcttaccagatgc

SEQ ID NO: 1124761 - DNA, 14 bp, Homo sapiens
tcttaccagtctcc

SEQ ID NO: 1124762 - DNA, 15 bp, Homo sapiens
tcttacccaatttcc

SEQ ID NO: 1124763 - DNA, 17 bp, Homo sapiens
tcttaccgtagcctccg

SEQ ID NO: 1124764 - DNA, 15 bp, Homo sapiens
tcttacctctcatgc

SEQ ID NO: 1124765 - DNA, 23 bp, Homo sapiens
tcttacctgtatgtctccagtat

SEQ ID NO: 1124766 - DNA, 17 bp, Homo sapiens
tcttactaaaaagtata

SEQ ID NO: 1124767 - DNA, 24 bp, Homo sapiens
tcttactaaacattttgttattgg

SEQ ID NO: 1124768 - DNA, 19 bp, Homo sapiens
tcttactcctcctctttct

SEQ ID NO: 1124769 - DNA, 21 bp, Homo sapiens
tcttactcctcctctttctct

SEQ ID NO: 1124770 - DNA, 21 bp, Homo sapiens
tcttcatattctaaaaccatt

SEQ ID NO: 1124771 - DNA, 18 bp, Homo sapiens
tcttcatctaatatgata

SEQ ID NO: 1124772 - DNA, 16 bp, Homo sapiens
tcttcatctccctgcc

SEQ ID NO: 1124773 - DNA, 18 bp, Homo sapiens
tcttcatctccctgccat

SEQ ID NO: 1124774 - DNA, 12 bp, Homo sapiens
tcttcatctgcc

SEQ ID NO: 1124775 - DNA, 15 bp, Homo sapiens
tcttcatctgcctgc

SEQ ID NO: 1124776 - DNA, 19 bp, Homo sapiens
tcttcatgcgtgccctttt

SEQ ID NO: 1124777 - DNA, 18 bp, Homo sapiens
tcttcatggaattcacaa

SEQ ID NO: 1124778 - DNA, 23 bp, Homo sapiens
tcttcatggcatcttcaatatga

SEQ ID NO: 1124779 - DNA, 15 bp, Homo sapiens
tcttcatttcattgt

SEQ ID NO: 1124780 - DNA, 18 bp, Homo sapiens
tcttccaagcaaaggtga

SEQ ID NO: 1124781 - DNA, 22 bp, Homo sapiens
tcttccaaggtagctctaagtt

SEQ ID NO: 1124782 - DNA, 23 bp, Homo sapiens
tcttccacaaagaaaattcctat

SEQ ID NO: 1124783 - DNA, 21 bp, Homo sapiens
tcttccacctcagcctcccag

SEQ ID NO: 1124784 - DNA, 22 bp, Homo sapiens
tcttccacctcagcctcccagg

SEQ ID NO: 1124785 - DNA, 15 bp, Homo sapiens
tcttccactgtgtgt

SEQ ID NO: 1124786 - DNA, 16 bp, Homo sapiens
tcttccactgtgtgtt

SEQ ID NO: 1124787 - DNA, 22 bp, Homo sapiens
tcttccactgtgtgttgacact

SEQ ID NO: 1124788 - DNA, 13 bp, Homo sapiens
tcttccagaatcc

SEQ ID NO: 1124789 - DNA, 13 bp, Homo sapiens
tcttccagaatgc

SEQ ID NO: 1124790 - DNA, 23 bp, Homo sapiens
tcttccaggagccaccttgccac

SEQ ID NO: 1124791 - DNA, 14 bp, Homo sapiens
tcttccagggcagc

SEQ ID NO: 1124792 - DNA, 17 bp, Homo sapiens
tcttccatcatcactgt

SEQ ID NO: 1124793 - DNA, 20 bp, Homo sapiens
tcttccatcatcactgtaaa

SEQ ID NO: 1124794 - DNA, 18 bp, Homo sapiens
tcttccatcatggattca

SEQ ID NO: 1124795 - DNA, 14 bp, Homo sapiens
tcttccatgatttt

SEQ ID NO: 1124796 - DNA, 14 bp, Homo sapiens
tcttccatgctgtg

SEQ ID NO: 1124797 - DNA, 19 bp, Homo sapiens
tcttccatgtatcttttga

SEQ ID NO: 1124798 - DNA, 14 bp, Homo sapiens
tcttccatgtgaac

SEQ ID NO: 1124799 - DNA, 15 bp, Homo sapiens
tcttccattccttca

SEQ ID NO: 1124800 - DNA, 13 bp, Homo sapiens
tcttcccacagga

SEQ ID NO: 1124801 - DNA, 24 bp, Homo sapiens
tcttcccagcggttcctgtgcaga

SEQ ID NO: 1124802 - DNA, 14 bp, Homo sapiens
tcttcccaggcctt

SEQ ID NO: 1124803 - DNA, 22 bp, Homo sapiens
tcttcccagtgaatccctggga

SEQ ID NO: 1124804 - DNA, 16 bp, Homo sapiens
tcttcccatcactgga

SEQ ID NO: 1124805 - DNA, 19 bp, Homo sapiens
tcttccccaagggccaaac

SEQ ID NO: 1124806 - DNA, 19 bp, Homo sapiens
tcttccccactccccacct

SEQ ID NO: 1124807 - DNA, 14 bp, Homo sapiens
tcttcccccaccac

SEQ ID NO: 1124808 - DNA, 20 bp, Homo sapiens
tcttcccccctctcctccca

SEQ ID NO: 1124809 - DNA, 21 bp, Homo sapiens
tcttcccccctctcctcccag

SEQ ID NO: 1124810 - DNA, 14 bp, Homo sapiens
tcttcccctgagag

SEQ ID NO: 1124811 - DNA, 17 bp, Homo sapiens
tcttccccttcctgttt

SEQ ID NO: 1124812 - DNA, 15 bp, Homo sapiens
tcttccccttgccct

SEQ ID NO: 1124813 - DNA, 23 bp, Homo sapiens
tcttccccttgcccttgccctga

SEQ ID NO: 1124814 - DNA, 17 bp, Homo sapiens
tcttcccctttgtcctg

SEQ ID NO: 1124815 - DNA, 16 bp, Homo sapiens
tcttcccgatgaggga

SEQ ID NO: 1124816 - DNA, 20 bp, Homo sapiens
tcttcccgccccacctccca

SEQ ID NO: 1124817 - DNA, 18 bp, Homo sapiens
tcttcccgtgtgtatttc

SEQ ID NO: 1124818 - DNA, 12 bp, Homo sapiens
tcttccctcaga

SEQ ID NO: 1124819 - DNA, 13 bp, Homo sapiens
tcttccctcagat

SEQ ID NO: 1124820 - DNA, 22 bp, Homo sapiens
tcttccctgaacgttttcttct

SEQ ID NO: 1124821 - DNA, 18 bp, Homo sapiens
tcttcccttagcctctcc

SEQ ID NO: 1124822 - DNA, 22 bp, Homo sapiens
tcttccgcagcccctttcccca

SEQ ID NO: 1124823 - DNA, 16 bp, Homo sapiens
tcttccgcccctgcct

SEQ ID NO: 1124824 - DNA, 19 bp, Homo sapiens
tcttccgcccctgcctgcc

SEQ ID NO: 1124825 - DNA, 16 bp, Homo sapiens
tcttccggagatgtag

SEQ ID NO: 1124826 - DNA, 20 bp, Homo sapiens
tcttccgtctcccccgtgtt

SEQ ID NO: 1124827 - DNA, 18 bp, Homo sapiens
tcttccgtgcatcccaga

SEQ ID NO: 1124828 - DNA, 21 bp, Homo sapiens
tcttcctaccaagtcaaactt

SEQ ID NO: 1124829 - DNA, 19 bp, Homo sapiens
tcttcctagttttctcctc

SEQ ID NO: 1124830 - DNA, 21 bp, Homo sapiens
tcttcctagttttctcctccc

SEQ ID NO: 1124831 - DNA, 23 bp, Homo sapiens
tcttcctcaaaataaagaagtat

SEQ ID NO: 1124832 - DNA, 21 bp, Homo sapiens
tcttcctcacactgctgtcct

SEQ ID NO: 1124833 - DNA, 22 bp, Homo sapiens
tcttcctcacactgctgtcctc

SEQ ID NO: 1124834 - DNA, 19 bp, Homo sapiens
tcttcctccagctgcacca

SEQ ID NO: 1124835 - DNA, 21 bp, Homo sapiens
tcttcctccctgggggcccca

SEQ ID NO: 1124836 - DNA, 18 bp, Homo sapiens
tcttcctccgaggccagt

SEQ ID NO: 1124837 - DNA, 12 bp, Homo sapiens
tcttcctcctct

SEQ ID NO: 1124838 - DNA, 13 bp, Homo sapiens
tcttcctctccat

SEQ ID NO: 1124839 - DNA, 17 bp, Homo sapiens
tcttcctctccatacct

SEQ ID NO: 1124840 - DNA, 14 bp, Homo sapiens
tcttcctctgaggc

SEQ ID NO: 1124841 - DNA, 20 bp, Homo sapiens
tcttcctctgggcagcgcta

SEQ ID NO: 1124842 - DNA, 14 bp, Homo sapiens
tcttcctctggttc

SEQ ID NO: 1124843 - DNA, 15 bp, Homo sapiens
tcttcctctggttcc

SEQ ID NO: 1124844 - DNA, 15 bp, Homo sapiens
tcttcctctgttcta

SEQ ID NO: 1124845 - DNA, 15 bp, Homo sapiens
tcttcctcttgaccc

SEQ ID NO: 1124846 - DNA, 16 bp, Homo sapiens
tcttcctcttgaccct

SEQ ID NO: 1124847 - DNA, 13 bp, Homo sapiens
tcttcctgacact

SEQ ID NO: 1124848 - DNA, 16 bp, Homo sapiens
tcttcctgacacttta

SEQ ID NO: 1124849 - DNA, 11 bp, Homo sapiens
tcttcctgacg

SEQ ID NO: 1124850 - DNA, 18 bp, Homo sapiens
tcttcctgagtggtgcca

SEQ ID NO: 1124851 - DNA, 14 bp, Homo sapiens
tcttcctgcccctc

SEQ ID NO: 1124852 - DNA, 16 bp, Homo sapiens
tcttcctgcccctctt

SEQ ID NO: 1124853 - DNA, 17 bp, Homo sapiens
tcttcctgcccctcttt

SEQ ID NO: 1124854 - DNA, 21 bp, Homo sapiens
tcttcctgcccctctttctct

SEQ ID NO: 1124855 - DNA, 22 bp, Homo sapiens
tcttcctgcccctctttctctt

SEQ ID NO: 1124856 - DNA, 22 bp, Homo sapiens
tcttcctgtaacacaagccaca

SEQ ID NO: 1124857 - DNA, 13 bp, Homo sapiens
tcttcctgtaatc

SEQ ID NO: 1124858 - DNA, 15 bp, Homo sapiens
tcttcctgtaatctt

SEQ ID NO: 1124859 - DNA, 15 bp, Homo sapiens
tcttcctgtctcctt

SEQ ID NO: 1124860 - DNA, 13 bp, Homo sapiens
tcttcctgtgtcc

SEQ ID NO: 1124861 - DNA, 15 bp, Homo sapiens
tcttcctgtgtcctg

SEQ ID NO: 1124862 - DNA, 16 bp, Homo sapiens
tcttcctgtgtcctga

SEQ ID NO: 1124863 - DNA, 21 bp, Homo sapiens
tcttcctgttttgtacataga

SEQ ID NO: 1124864 - DNA, 11 bp, Homo sapiens
tcttccttaaa

SEQ ID NO: 1124865 - DNA, 12 bp, Homo sapiens
tcttccttaaat

SEQ ID NO: 1124866 - DNA, 19 bp, Homo sapiens
tcttccttaaatgactttt

SEQ ID NO: 1124867 - DNA, 14 bp, Homo sapiens
tcttccttccacag

SEQ ID NO: 1124868 - DNA, 11 bp, Homo sapiens
tcttccttccc

SEQ ID NO: 1124869 - DNA, 14 bp, Homo sapiens
tcttccttccccca

SEQ ID NO: 1124870 - DNA, 14 bp, Homo sapiens
tcttccttcctaga

SEQ ID NO: 1124871 - DNA, 14 bp, Homo sapiens
tcttccttgtggaa

SEQ ID NO: 1124872 - DNA, 19 bp, Homo sapiens
tcttccttgtggaatgctg

SEQ ID NO: 1124873 - DNA, 19 bp, Homo sapiens
tcttcctttactttccctt

SEQ ID NO: 1124874 - DNA, 20 bp, Homo sapiens
tcttcctttactttcccttg

SEQ ID NO: 1124875 - DNA, 22 bp, Homo sapiens
tcttcctttactttcccttgct

SEQ ID NO: 1124876 - DNA, 18 bp, Homo sapiens
tcttcctttccctggagc

SEQ ID NO: 1124877 - DNA, 16 bp, Homo sapiens
tcttcctttctctttc

SEQ ID NO: 1124878 - DNA, 17 bp, Homo sapiens
tcttcctttcttgtctt

SEQ ID NO: 1124879 - DNA, 13 bp, Homo sapiens
tcttcgaggtgga

SEQ ID NO: 1124880 - DNA, 22 bp, Homo sapiens
tcttcgctgctctagctggcag

SEQ ID NO: 1124881 - DNA, 14 bp, Homo sapiens
tcttcggtttctga

SEQ ID NO: 1124882 - DNA, 20 bp, Homo sapiens
tcttcgtcctgatccctcca

SEQ ID NO: 1124883 - DNA, 13 bp, Homo sapiens
tcttctaaacttc

SEQ ID NO: 1124884 - DNA, 15 bp, Homo sapiens
tcttctaaatgccca

SEQ ID NO: 1124885 - DNA, 12 bp, Homo sapiens
tcttctaaatgg

SEQ ID NO: 1124886 - DNA, 16 bp, Homo sapiens
tcttctaagaagacat

SEQ ID NO: 1124887 - DNA, 14 bp, Homo sapiens
tcttctaataaagt

SEQ ID NO: 1124888 - DNA, 15 bp, Homo sapiens
tcttctaatttcaaa

SEQ ID NO: 1124889 - DNA, 14 bp, Homo sapiens
tcttctaggcccat

SEQ ID NO: 1124890 - DNA, 19 bp, Homo sapiens
tcttctaggggtagctggt

SEQ ID NO: 1124891 - DNA, 19 bp, Homo sapiens
tcttctagtgcttttcagt

SEQ ID NO: 1124892 - DNA, 12 bp, Homo sapiens
tcttgtaaatgt

SEQ ID NO: 1124893 - DNA, 17 bp, Homo sapiens
tcttgtaaatgtttctt

SEQ ID NO: 1124894 - DNA, 22 bp, Homo sapiens
tcttgtaagtcatctacttaat

SEQ ID NO: 1124895 - DNA, 11 bp, Homo sapiens
tcttgtaattt

SEQ ID NO: 1124896 - DNA, 22 bp, Homo sapiens
tcttgtacagttaactctccca

SEQ ID NO: 1124897 - DNA, 15 bp, Homo sapiens
tcttgtacttctgtg

SEQ ID NO: 1124898 - DNA, 18 bp, Homo sapiens
tcttgtacttctgtgttc

SEQ ID NO: 1124899 - DNA, 19 bp, Homo sapiens
tcttgtacttctgtgttca

SEQ ID NO: 1124900 - DNA, 22 bp, Homo sapiens
tcttgtacttctgtgttcattt

SEQ ID NO: 1124901 - DNA, 23 bp, Homo sapiens
tcttgtaggatctactttttgaa

SEQ ID NO: 1124902 - DNA, 17 bp, Homo sapiens
tcttgtatacttgtatt

SEQ ID NO: 1124903 - DNA, 16 bp, Homo sapiens
tcttgtattaaactct

SEQ ID NO: 1124904 - DNA, 19 bp, Homo sapiens
tcttgtattaaactcttca

SEQ ID NO: 1124905 - DNA, 14 bp, Homo sapiens
tcttgtattcatga

SEQ ID NO: 1124906 - DNA, 11 bp, Homo sapiens
tcttgtatttg

SEQ ID NO: 1124907 - DNA, 15 bp, Homo sapiens
tcttgtcacaataaa

SEQ ID NO: 1124908 - DNA, 14 bp, Homo sapiens
tcttgtcatacaaa

SEQ ID NO: 1124909 - DNA, 16 bp, Homo sapiens
tcttgtccacattcta

SEQ ID NO: 1124910 - DNA, 23 bp, Homo sapiens
tcttgtccacattctacttcagc

SEQ ID NO: 1124911 - DNA, 19 bp, Homo sapiens
tcttgtcccaattaaaata

SEQ ID NO: 1124912 - DNA, 22 bp, Homo sapiens
tcttgtccctaagtaagtttct

SEQ ID NO: 1124913 - DNA, 14 bp, Homo sapiens
tcttgtcctggccc

SEQ ID NO: 1124914 - DNA, 20 bp, Homo sapiens
tcttgtcctggcccttcagt

SEQ ID NO: 1124915 - DNA, 15 bp, Homo sapiens
tcttgtctataaagc

SEQ ID NO: 1124916 - DNA, 16 bp, Homo sapiens
tcttgtctataaagca

SEQ ID NO: 1124917 - DNA, 11 bp, Homo sapiens
tcttgtctccc

SEQ ID NO: 1124918 - DNA, 16 bp, Homo sapiens
tcttgtctcccctgtt

SEQ ID NO: 1124919 - DNA, 12 bp, Homo sapiens
tcttgtctctgg

SEQ ID NO: 1124920 - DNA, 12 bp, Homo sapiens
tcttgtctttcc

SEQ ID NO: 1124921 - DNA, 14 bp, Homo sapiens
tcttgtgcatgttt

SEQ ID NO: 1124922 - DNA, 14 bp, Homo sapiens
tcttgtgctagaat

SEQ ID NO: 1124923 - DNA, 18 bp, Homo sapiens
tcttgtgctagaatactt

SEQ ID NO: 1124924 - DNA, 21 bp, Homo sapiens
tcttgtgctagaatacttttt

SEQ ID NO: 1124925 - DNA, 19 bp, Homo sapiens
tcttgtgctcacgctcccc

SEQ ID NO: 1124926 - DNA, 18 bp, Homo sapiens
tcttgtgcttttcctgat

SEQ ID NO: 1124927 - DNA, 15 bp, Homo sapiens
tcttgtgggagacag

SEQ ID NO: 1124928 - DNA, 18 bp, Homo sapiens
tcttgtgggagacagcag

SEQ ID NO: 1124929 - DNA, 22 bp, Homo sapiens
tcttgtgggagacagcagcctg

SEQ ID NO: 1124930 - DNA, 19 bp, Homo sapiens
tcttgtgtagatttgaaaa

SEQ ID NO: 1124931 - DNA, 21 bp, Homo sapiens
tcttgtgtagatttgaaaatt

SEQ ID NO: 1124932 - DNA, 19 bp, Homo sapiens
tcttgtgtgattaacttat

SEQ ID NO: 1124933 - DNA, 15 bp, Homo sapiens
tcttgtgttcgtgtt

SEQ ID NO: 1124934 - DNA, 22 bp, Homo sapiens
tcttgtgtttccacagcctgca

SEQ ID NO: 1124935 - DNA, 12 bp, Homo sapiens
tcttgtgtttct

SEQ ID NO: 1124936 - DNA, 16 bp, Homo sapiens
tcttgtgtttgctgca

SEQ ID NO: 1124937 - DNA, 13 bp, Homo sapiens
tcttgttactgct

SEQ ID NO: 1124938 - DNA, 18 bp, Homo sapiens
tcttgttactgctgattc

SEQ ID NO: 1124939 - DNA, 20 bp, Homo sapiens
tcttgttactgctgattctt

SEQ ID NO: 1124940 - DNA, 18 bp, Homo sapiens
tcttgttagagagctttt

SEQ ID NO: 1124941 - DNA, 18 bp, Homo sapiens
tcttgttattaatgtttc

SEQ ID NO: 1124942 - DNA, 22 bp, Homo sapiens
tcttgttcattttgagtatttt

SEQ ID NO: 1124943 - DNA, 14 bp, Homo sapiens
tcttgttcttcccc

SEQ ID NO: 1124944 - DNA, 17 bp, Homo sapiens
tcttgttggtagcatgt

SEQ ID NO: 1124945 - DNA, 13 bp, Homo sapiens
tcttgttgttatt

SEQ ID NO: 1124946 - DNA, 17 bp, Homo sapiens
tcttgtttaacatatat

SEQ ID NO: 1124947 - DNA, 18 bp, Homo sapiens
tcttgtttaacatatata

SEQ ID NO: 1124948 - DNA, 15 bp, Homo sapiens
tcttgtttacaataa

SEQ ID NO: 1124949 - DNA, 15 bp, Homo sapiens
tcttgtttccttgtt

SEQ ID NO: 1124950 - DNA, 15 bp, Homo sapiens
tcttgtttctgtgcc

SEQ ID NO: 1124951 - DNA, 13 bp, Homo sapiens
tcttgttttgtct

SEQ ID NO: 1124952 - DNA, 22 bp, Homo sapiens
tcttgttttgtttgcttccatt

SEQ ID NO: 1124953 - DNA, 22 bp, Homo sapiens
tcttgtttttccactactgcta

SEQ ID NO: 1124954 - DNA, 21 bp, Homo sapiens
tcttgttttttttttccactt

SEQ ID NO: 1124955 - DNA, 18 bp, Homo sapiens
tctttaaaaactcactta

SEQ ID NO: 1124956 - DNA, 17 bp, Homo sapiens
tctttaaaagagagaga

SEQ ID NO: 1124957 - DNA, 16 bp, Homo sapiens
tctttaaaaggaaaga

SEQ ID NO: 1124958 - DNA, 16 bp, Homo sapiens
tctttaaaataaaaaa

SEQ ID NO: 1124959 - DNA, 22 bp, Homo sapiens
tctttaaaataaaaaagcaaaa

SEQ ID NO: 1124960 - DNA, 23 bp, Homo sapiens
tctttaaacagcaactacagaag

SEQ ID NO: 1124961 - DNA, 16 bp, Homo sapiens
tctttaaacctttcat

SEQ ID NO: 1124962 - DNA, 14 bp, Homo sapiens
tctttaaaggccca

SEQ ID NO: 1124963 - DNA, 21 bp, Homo sapiens
tctttaaaggcccagccccta

SEQ ID NO: 1124964 - DNA, 18 bp, Homo sapiens
tctttaaagtcaggtcca

SEQ ID NO: 1124965 - DNA, 12 bp, Homo sapiens
tctttaaataga

SEQ ID NO: 1124966 - DNA, 14 bp, Homo sapiens
tctttaaatagata

SEQ ID NO: 1124967 - DNA, 22 bp, Homo sapiens
tctttaactgccgtaatttaac

SEQ ID NO: 1124968 - DNA, 11 bp, Homo sapiens
tctttaacttt

SEQ ID NO: 1124969 - DNA, 15 bp, Homo sapiens
tctttaataaaacaa

SEQ ID NO: 1124970 - DNA, 23 bp, Homo sapiens
tctttaataacaaggagatttct

SEQ ID NO: 1124971 - DNA, 23 bp, Homo sapiens
tctttaatcattttgcctctttt

SEQ ID NO: 1124972 - DNA, 14 bp, Homo sapiens
tctttaatcttcag

SEQ ID NO: 1124973 - DNA, 19 bp, Homo sapiens
tctttaatgctgtctttgt

SEQ ID NO: 1124974 - DNA, 13 bp, Homo sapiens
tctttaatgcttt

SEQ ID NO: 1124975 - DNA, 17 bp, Homo sapiens
tctttaatgttgtccag

SEQ ID NO: 1124976 - DNA, 13 bp, Homo sapiens
tctttaattctgt

SEQ ID NO: 1124977 - DNA, 14 bp, Homo sapiens
tctttacaaaacaa

SEQ ID NO: 1124978 - DNA, 19 bp, Homo sapiens
tctttaccaaaaaccatgt

SEQ ID NO: 1124979 - DNA, 18 bp, Homo sapiens
tctttacctgagaccagt

SEQ ID NO: 1124980 - DNA, 20 bp, Homo sapiens
tctttaccttctaaaagcca

SEQ ID NO: 1124981 - DNA, 22 bp, Homo sapiens
tctttacgtactgtaactgctc

SEQ ID NO: 1124982 - DNA, 15 bp, Homo sapiens
tctttactaacactg

SEQ ID NO: 1124983 - DNA, 19 bp, Homo sapiens
tctttactattaaaatatt

SEQ ID NO: 1124984 - DNA, 22 bp, Homo sapiens
tctttactcccttcctggcctc

SEQ ID NO: 1124985 - DNA, 22 bp, Homo sapiens
tctttactcgtcccctttcatc

SEQ ID NO: 1124986 - DNA, 15 bp, Homo sapiens
tctttagaccctcgg

SEQ ID NO: 1124987 - DNA, 14 bp, Homo sapiens
tctttagaggcttt

SEQ ID NO: 1124988 - DNA, 17 bp, Homo sapiens
tctttagaggctttcaa

SEQ ID NO: 1124989 - DNA, 22 bp, Homo sapiens
tctttagaggctttcaaatgta

SEQ ID NO: 1124990 - DNA, 23 bp, Homo sapiens
tctttagaggctttcaaatgtac

SEQ ID NO: 1124991 - DNA, 15 bp, Homo sapiens
tctttaggacataaa

SEQ ID NO: 1124992 - DNA, 17 bp, Homo sapiens
tctttaggacataaaga

SEQ ID NO: 1124993 - DNA, 20 bp, Homo sapiens
tctttataacaaaacaggga

SEQ ID NO: 1124994 - DNA, 15 bp, Homo sapiens
tctttatacagctgt

SEQ ID NO: 1124995 - DNA, 23 bp, Homo sapiens
tctttatagaaggaatttgtact

SEQ ID NO: 1124996 - DNA, 15 bp, Homo sapiens
tctttatatgaagaa

SEQ ID NO: 1124997 - DNA, 15 bp, Homo sapiens
tctttatgactgttt

SEQ ID NO: 1124998 - DNA, 14 bp, Homo sapiens
tctttattaaaaca

SEQ ID NO: 1124999 - DNA, 16 bp, Homo sapiens
tctttattaatcacta

SEQ ID NO: 1125000 - DNA, 13 bp, Homo sapiens
tctttattagctt

SEQ ID NO: 1125001 - DNA, 15 bp, Homo sapiens
tctttattcttatta

SEQ ID NO: 1125002 - DNA, 15 bp, Homo sapiens
tctttattgagaaag

SEQ ID NO: 1125003 - DNA, 14 bp, Homo sapiens
tctttattgcacta

SEQ ID NO: 1125004 - DNA, 20 bp, Homo sapiens
tctttattgcactaggaatt

SEQ ID NO: 1125005 - DNA, 19 bp, Homo sapiens
tctttattttcttctccag

SEQ ID NO: 1125006 - DNA, 18 bp, Homo sapiens
tctttcaaaccagcttca

SEQ ID NO: 1125007 - DNA, 13 bp, Homo sapiens
tctttcaaagaaa

SEQ ID NO: 1125008 - DNA, 18 bp, Homo sapiens
tctttcaaagaaatccaa

SEQ ID NO: 1125009 - DNA, 22 bp, Homo sapiens
tctttcaaaggtagccatcatg

SEQ ID NO: 1125010 - DNA, 23 bp, Homo sapiens
tctttcaaattatatgctaatta

SEQ ID NO: 1125011 - DNA, 20 bp, Homo sapiens
tctttcaataaatgtatcat

SEQ ID NO: 1125012 - DNA, 15 bp, Homo sapiens
tctttcaattcttca

SEQ ID NO: 1125013 - DNA, 19 bp, Homo sapiens
tctttcacagctcctccca

SEQ ID NO: 1125014 - DNA, 19 bp, Homo sapiens
tgaaaaaggaaatattctt

SEQ ID NO: 1125015 - DNA, 16 bp, Homo sapiens
tgaaaaaggaggaaga

SEQ ID NO: 1125016 - DNA, 20 bp, Homo sapiens
tgaaaaaggaggaagagaaa

SEQ ID NO: 1125017 - DNA, 22 bp, Homo sapiens
tgaaaaaggaggaagagaaaaa

SEQ ID NO: 1125018 - DNA, 22 bp, Homo sapiens
tgaaaaagtatcctgcttctga

SEQ ID NO: 1125019 - DNA, 21 bp, Homo sapiens
tgaaaaatacgttttgtgtat

SEQ ID NO: 1125020 - DNA, 23 bp, Homo sapiens
tgaaaaatacgttttgtgtatat

SEQ ID NO: 1125021 - DNA, 12 bp, Homo sapiens
tgaaaaatatag

SEQ ID NO: 1125022 - DNA, 16 bp, Homo sapiens
tgaaaaatatgtgctt

SEQ ID NO: 1125023 - DNA, 17 bp, Homo sapiens
tgaaaaatattgctaaa

SEQ ID NO: 1125024 - DNA, 22 bp, Homo sapiens
tgaaaaatattgctaaaagtgc

SEQ ID NO: 1125025 - DNA, 24 bp, Homo sapiens
tgaaaaatattgctaaaagtgcat

SEQ ID NO: 1125026 - DNA, 18 bp, Homo sapiens
tgaaaaatcggcttacca

SEQ ID NO: 1125027 - DNA, 20 bp, Homo sapiens
tgaaaaatctgctgttaact

SEQ ID NO: 1125028 - DNA, 13 bp, Homo sapiens
tgaaaaatgtaaa

SEQ ID NO: 1125029 - DNA, 16 bp, Homo sapiens
tgaaaaatgtaaatac

SEQ ID NO: 1125030 - DNA, 21 bp, Homo sapiens
tgaaaaatgtaatttagaaac

SEQ ID NO: 1125031 - DNA, 14 bp, Homo sapiens
tgaaaaattaactt

SEQ ID NO: 1125032 - DNA, 16 bp, Homo sapiens
tgaaaaattaactttt

SEQ ID NO: 1125033 - DNA, 12 bp, Homo sapiens
tgaaaacaaaaa

SEQ ID NO: 1125034 - DNA, 22 bp, Homo sapiens
tgaaaacagaatcagtgttaaa

SEQ ID NO: 1125035 - DNA, 23 bp, Homo sapiens
tgaaaacagatgaccataatttt

SEQ ID NO: 1125036 - DNA, 16 bp, Homo sapiens
tgaaaacccaaggcca

SEQ ID NO: 1125037 - DNA, 15 bp, Homo sapiens
tgaaaacccagagag

SEQ ID NO: 1125038 - DNA, 17 bp, Homo sapiens
tgaaaacgttttattgt

SEQ ID NO: 1125039 - DNA, 18 bp, Homo sapiens
tgaaaacgttttattgtg

SEQ ID NO: 1125040 - DNA, 22 bp, Homo sapiens
tgaaaactagcattacattatt

SEQ ID NO: 1125041 - DNA, 22 bp, Homo sapiens
tgaaaactcatgatcaagatat

SEQ ID NO: 1125042 - DNA, 21 bp, Homo sapiens
tgaaaactgtgcaacttttta

SEQ ID NO: 1125043 - DNA, 14 bp, Homo sapiens
tgaaaacttcaaag

SEQ ID NO: 1125044 - DNA, 15 bp, Homo sapiens
tgaaaacttcagaag

SEQ ID NO: 1125045 - DNA, 16 bp, Homo sapiens
tgaaaacttttgtaaa

SEQ ID NO: 1125046 - DNA, 17 bp, Homo sapiens
tgaaaacttttgtaaat

SEQ ID NO: 1125047 - DNA, 19 bp, Homo sapiens
tgaaaagaaaaatgagcct

SEQ ID NO: 1125048 - DNA, 15 bp, Homo sapiens
tgaaaagaagtagtg

SEQ ID NO: 1125049 - DNA, 19 bp, Homo sapiens
tgaaaagcaatattgtata

SEQ ID NO: 1125050 - DNA, 18 bp, Homo sapiens
tgaaaagcaattgccctg

SEQ ID NO: 1125051 - DNA, 20 bp, Homo sapiens
tgaaaagcacagctgtatat

SEQ ID NO: 1125052 - DNA, 16 bp, Homo sapiens
tgaaaagcctctgttt

SEQ ID NO: 1125053 - DNA, 19 bp, Homo sapiens
tgaaaagcctctgttttga

SEQ ID NO: 1125054 - DNA, 20 bp, Homo sapiens
tgaaaagcctctgttttgat

SEQ ID NO: 1125055 - DNA, 19 bp, Homo sapiens
tgaaaagctgactgttttt

SEQ ID NO: 1125056 - DNA, 12 bp, Homo sapiens
tgaaaaggaatc

SEQ ID NO: 1125057 - DNA, 19 bp, Homo sapiens
tgaaaagggcactcccaac

SEQ ID NO: 1125058 - DNA, 23 bp, Homo sapiens
tgaaaaggtgaccttgcaacttc

SEQ ID NO: 1125059 - DNA, 21 bp, Homo sapiens
tgaaaaggtgtccttttcctt

SEQ ID NO: 1125060 - DNA, 22 bp, Homo sapiens
tgaaaagttactacctgtcaag

SEQ ID NO: 1125061 - DNA, 13 bp, Homo sapiens
tgaaaagttggaa

SEQ ID NO: 1125062 - DNA, 20 bp, Homo sapiens
tgaaaataaaaagatcactt

SEQ ID NO: 1125063 - DNA, 17 bp, Homo sapiens
tgaaaataaagtgtata

SEQ ID NO: 1125064 - DNA, 16 bp, Homo sapiens
tgaaaataactgaatt

SEQ ID NO: 1125065 - DNA, 22 bp, Homo sapiens
tgaaaataatctctgattccct

SEQ ID NO: 1125066 - DNA, 13 bp, Homo sapiens
tgaaaataattgt

SEQ ID NO: 1125067 - DNA, 16 bp, Homo sapiens
tgaaaatagtgtaaga

SEQ ID NO: 1125068 - DNA, 21 bp, Homo sapiens
tgaaaatagtgtaagaactgt

SEQ ID NO: 1125069 - DNA, 16 bp, Homo sapiens
tgaaaatataaccagc

SEQ ID NO: 1125070 - DNA, 22 bp, Homo sapiens
tgaaaatatagacattctcaca

SEQ ID NO: 1125071 - DNA, 23 bp, Homo sapiens
tgaaaatatgtctgcaggtttct

SEQ ID NO: 1125072 - DNA, 20 bp, Homo sapiens
tgaaaatattgttttacaat

SEQ ID NO: 1125073 - DNA, 21 bp, Homo sapiens
tgaaaatattttttatatata

SEQ ID NO: 1125074 - DNA, 13 bp, Homo sapiens
tgaaaatcaaagt

SEQ ID NO: 1125075 - DNA, 14 bp, Homo sapiens
tgaaaatcaaagta

SEQ ID NO: 1125076 - DNA, 16 bp, Homo sapiens
tgaaaatcctatatct

SEQ ID NO: 1125077 - DNA, 22 bp, Homo sapiens
tgaaaatcctatatctgtttgt

SEQ ID NO: 1125078 - DNA, 23 bp, Homo sapiens
tgaaaatcctatatctgtttgta

SEQ ID NO: 1125079 - DNA, 14 bp, Homo sapiens
tgaaaatctaatat

SEQ ID NO: 1125080 - DNA, 17 bp, Homo sapiens
tgaaaatctaatattaa

SEQ ID NO: 1125081 - DNA, 23 bp, Homo sapiens
tgaaaatgaatatctattaatat

SEQ ID NO: 1125082 - DNA, 15 bp, Homo sapiens
tgaaaatgaccaaaa

SEQ ID NO: 1125083 - DNA, 21 bp, Homo sapiens
tgaaaatgggttggtgcttct

SEQ ID NO: 1125084 - DNA, 15 bp, Homo sapiens
tgaaaatggtatttt

SEQ ID NO: 1125085 - DNA, 16 bp, Homo sapiens
tgaaaatggtattttc

SEQ ID NO: 1125086 - DNA, 21 bp, Homo sapiens
tgaaaatggtattttccccct

SEQ ID NO: 1125087 - DNA, 17 bp, Homo sapiens
tgaaaatgtatgtgtaa

SEQ ID NO: 1125088 - DNA, 17 bp, Homo sapiens
tgaaaatgtatttcctg

SEQ ID NO: 1125089 - DNA, 21 bp, Homo sapiens
tgaaaatgtatttcctgaaat

SEQ ID NO: 1125090 - DNA, 14 bp, Homo sapiens
tgaaaatgtcagaa

SEQ ID NO: 1125091 - DNA, 21 bp, Homo sapiens
tgaaaatgtgctatactgcat

SEQ ID NO: 1125092 - DNA, 22 bp, Homo sapiens
tgaaaatgtgctatactgcata

SEQ ID NO: 1125093 - DNA, 12 bp, Homo sapiens
tgaaaatgtgtt

SEQ ID NO: 1125094 - DNA, 16 bp, Homo sapiens
tgaaaatgtgtttgct

SEQ ID NO: 1125095 - DNA, 13 bp, Homo sapiens
tgaaaattattta

SEQ ID NO: 1125096 - DNA, 16 bp, Homo sapiens
tgaaaattatttgaaa

SEQ ID NO: 1125097 - DNA, 21 bp, Homo sapiens
tgaaaattattttaaacaaaa

SEQ ID NO: 1125098 - DNA, 18 bp, Homo sapiens
tgaaaattcaaaaagtgt

SEQ ID NO: 1125099 - DNA, 16 bp, Homo sapiens
tgaaaattgaaaagta

SEQ ID NO: 1125100 - DNA, 17 bp, Homo sapiens
tgaaaattgaaaagtac

SEQ ID NO: 1125101 - DNA, 16 bp, Homo sapiens
tgaaaattgtatacca

SEQ ID NO: 1125102 - DNA, 13 bp, Homo sapiens
tgaaaattgtatt

SEQ ID NO: 1125103 - DNA, 20 bp, Homo sapiens
tgaaaattttaaaaatacat

SEQ ID NO: 1125104 - DNA, 21 bp, Homo sapiens
tgaaaattttaaaaatacata

SEQ ID NO: 1125105 - DNA, 13 bp, Homo sapiens
tgaaaattttgat

SEQ ID NO: 1125106 - DNA, 19 bp, Homo sapiens
tgaaacaaaaaaaaaatga

SEQ ID NO: 1125107 - DNA, 14 bp, Homo sapiens
tgaaacaaagagtt

SEQ ID NO: 1125108 - DNA, 14 bp, Homo sapiens
tgaaacaaagctgc

SEQ ID NO: 1125109 - DNA, 14 bp, Homo sapiens
tgaaacaactcctt

SEQ ID NO: 1125110 - DNA, 19 bp, Homo sapiens
tgaaacaactccttttact

SEQ ID NO: 1125111 - DNA, 20 bp, Homo sapiens
tgaaacaagtctagtcttct

SEQ ID NO: 1125112 - DNA, 22 bp, Homo sapiens
tgaaacaagtctagtcttctgg

SEQ ID NO: 1125113 - DNA, 19 bp, Homo sapiens
tgaaacaatgttgtccaac

SEQ ID NO: 1125114 - DNA, 21 bp, Homo sapiens
tgaaacaatgttgtccaacaa

SEQ ID NO: 1125115 - DNA, 16 bp, Homo sapiens
tgaaacacaccaggct

SEQ ID NO: 1125116 - DNA, 21 bp, Homo sapiens
tgaaacacgaaacttgttatt

SEQ ID NO: 1125117 - DNA, 19 bp, Homo sapiens
tgaaacactggacctgggg

SEQ ID NO: 1125118 - DNA, 20 bp, Homo sapiens
tgaaacactggacctggggg

SEQ ID NO: 1125119 - DNA, 21 bp, Homo sapiens
tgaaacactggacctgggggt

SEQ ID NO: 1125120 - DNA, 14 bp, Homo sapiens
tgaaacagaaacaa

SEQ ID NO: 1125121 - DNA, 12 bp, Homo sapiens
tgaaacagagaa

SEQ ID NO: 1125122 - DNA, 15 bp, Homo sapiens
tgaaacagagaaaga

SEQ ID NO: 1125123 - DNA, 17 bp, Homo sapiens
tgaaacagagaaagaaa

SEQ ID NO: 1125124 - DNA, 20 bp, Homo sapiens
tgaaacagagaaagaaaagg

SEQ ID NO: 1125125 - DNA, 19 bp, Homo sapiens
tgaaacagatgataaatat

SEQ ID NO: 1125126 - DNA, 20 bp, Homo sapiens
tgaaacagatgataaatatt

SEQ ID NO: 1125127 - DNA, 18 bp, Homo sapiens
tgaaacaggccctctgtg

SEQ ID NO: 1125128 - DNA, 18 bp, Homo sapiens
tgaaacagttccatttat

SEQ ID NO: 1125129 - DNA, 22 bp, Homo sapiens
tgaaacagttgctgtgaacttt

SEQ ID NO: 1125130 - DNA, 22 bp, Homo sapiens
tgaaacataataataatgggtt

SEQ ID NO: 1125131 - DNA, 16 bp, Homo sapiens
tgaaacatatcatggt

SEQ ID NO: 1125132 - DNA, 19 bp, Homo sapiens
tgaaacatatcatggtaat

SEQ ID NO: 1125133 - DNA, 19 bp, Homo sapiens
tgaaacatcattacagatt

SEQ ID NO: 1125134 - DNA, 20 bp, Homo sapiens
tgaaacattccgaagaggga

SEQ ID NO: 1125135 - DNA, 12 bp, Homo sapiens
tgaacccaggag

SEQ ID NO: 1125136 - DNA, 19 bp, Homo sapiens
tgaacccaggaggtggagg

SEQ ID NO: 1125137 - DNA, 19 bp, Homo sapiens
tgaacccattttgagtgac

SEQ ID NO: 1125138 - DNA, 14 bp, Homo sapiens
tgaacccctggcca

SEQ ID NO: 1125139 - DNA, 22 bp, Homo sapiens
tgaacccgggacgcaggggttg

SEQ ID NO: 1125140 - DNA, 18 bp, Homo sapiens
tgaaccctagctgtgtca

SEQ ID NO: 1125141 - DNA, 16 bp, Homo sapiens
tgaaccctcctccttt

SEQ ID NO: 1125142 - DNA, 20 bp, Homo sapiens
tgaaccctcttgccatcctg

SEQ ID NO: 1125143 - DNA, 22 bp, Homo sapiens
tgaaccctcttgccatcctgat

SEQ ID NO: 1125144 - DNA, 13 bp, Homo sapiens
tgaaccctgtgct

SEQ ID NO: 1125145 - DNA, 13 bp, Homo sapiens
tgaacccttgctt

SEQ ID NO: 1125146 - DNA, 15 bp, Homo sapiens
tgaacccttgcttgc

SEQ ID NO: 1125147 - DNA, 19 bp, Homo sapiens
tgaaccgactgaccctgag

SEQ ID NO: 1125148 - DNA, 20 bp, Homo sapiens
tgaaccgactgaccctgagg

SEQ ID NO: 1125149 - DNA, 14 bp, Homo sapiens
tgaaccgcacagct

SEQ ID NO: 1125150 - DNA, 18 bp, Homo sapiens
tgaaccgcaccccatccc

SEQ ID NO: 1125151 - DNA, 14 bp, Homo sapiens
tgaacctaccttca

SEQ ID NO: 1125152 - DNA, 20 bp, Homo sapiens
tgaacctaccttcatttcag

SEQ ID NO: 1125153 - DNA, 21 bp, Homo sapiens
tgaacctaggagtgccccatt

SEQ ID NO: 1125154 - DNA, 22 bp, Homo sapiens
tgaacctaggagtgccccattc

SEQ ID NO: 1125155 - DNA, 19 bp, Homo sapiens
tgaacctattttcatttgt

SEQ ID NO: 1125156 - DNA, 21 bp, Homo sapiens
tgaacctattttcatttgtac

SEQ ID NO: 1125157 - DNA, 23 bp, Homo sapiens
tgaacctattttcatttgtacaa

SEQ ID NO: 1125158 - DNA, 15 bp, Homo sapiens
tgaacctgcttcctg

SEQ ID NO: 1125159 - DNA, 16 bp, Homo sapiens
tgaacctgcttcctgg

SEQ ID NO: 1125160 - DNA, 18 bp, Homo sapiens
tgaacctgggaggcagag

SEQ ID NO: 1125161 - DNA, 18 bp, Homo sapiens
tgaacctttaaagtaaag

SEQ ID NO: 1125162 - DNA, 19 bp, Homo sapiens
tgaacctttaaagtaaagg

SEQ ID NO: 1125163 - DNA, 16 bp, Homo sapiens
tgaacgaccttacaaa

SEQ ID NO: 1125164 - DNA, 16 bp, Homo sapiens
tgaacgactgtatatt

SEQ ID NO: 1125165 - DNA, 22 bp, Homo sapiens
tgaacgctgtgatgctgtgtgc

SEQ ID NO: 1125166 - DNA, 23 bp, Homo sapiens
tgaacgctgtgatgctgtgtgcc

SEQ ID NO: 1125167 - DNA, 16 bp, Homo sapiens
tgaacgttattatatt

SEQ ID NO: 1125168 - DNA, 13 bp, Homo sapiens
tgaacgttttaat

SEQ ID NO: 1125169 - DNA, 23 bp, Homo sapiens
tgaacgttttaataatttttgct

SEQ ID NO: 1125170 - DNA, 21 bp, Homo sapiens
tgaacgttttcttctttccct

SEQ ID NO: 1125171 - DNA, 22 bp, Homo sapiens
tgaacgttttcttctttccctg

SEQ ID NO: 1125172 - DNA, 16 bp, Homo sapiens
tgaactaagttttgtg

SEQ ID NO: 1125173 - DNA, 20 bp, Homo sapiens
tgaactaccttggttccccc

SEQ ID NO: 1125174 - DNA, 22 bp, Homo sapiens
tgaactatatcagtagtgtaca

SEQ ID NO: 1125175 - DNA, 14 bp, Homo sapiens
tgaactatgaacac

SEQ ID NO: 1125176 - DNA, 17 bp, Homo sapiens
tgaactatgaacactgt

SEQ ID NO: 1125177 - DNA, 18 bp, Homo sapiens
tgaactatgactggagta

SEQ ID NO: 1125178 - DNA, 17 bp, Homo sapiens
tgaactcaaactgagga

SEQ ID NO: 1125179 - DNA, 18 bp, Homo sapiens
tgaactcaaactgaggaa

SEQ ID NO: 1125180 - DNA, 17 bp, Homo sapiens
tgaactcaactttgaca

SEQ ID NO: 1125181 - DNA, 20 bp, Homo sapiens
tgaactcactttcctcctga

SEQ ID NO: 1125182 - DNA, 20 bp, Homo sapiens
tgaactcagcacattcggga

SEQ ID NO: 1125183 - DNA, 14 bp, Homo sapiens
tgaactccaccgac

SEQ ID NO: 1125184 - DNA, 22 bp, Homo sapiens
tgaactccaccgaccaactgcc

SEQ ID NO: 1125185 - DNA, 23 bp, Homo sapiens
tgaactccaccgaccaactgccc

SEQ ID NO: 1125186 - DNA, 12 bp, Homo sapiens
tgaactccagag

SEQ ID NO: 1125187 - DNA, 14 bp, Homo sapiens
tgaactccatacag

SEQ ID NO: 1125188 - DNA, 23 bp, Homo sapiens
tgaactccatcattcatccagga

SEQ ID NO: 1125189 - DNA, 13 bp, Homo sapiens
tgaactccttgtt

SEQ ID NO: 1125190 - DNA, 23 bp, Homo sapiens
tgaactctcaaaagtctattttt

SEQ ID NO: 1125191 - DNA, 16 bp, Homo sapiens
tgaactctgttccccc

SEQ ID NO: 1125192 - DNA, 17 bp, Homo sapiens
tgaactctgttccccca

SEQ ID NO: 1125193 - DNA, 21 bp, Homo sapiens
tgaactctgttcccccaccct

SEQ ID NO: 1125194 - DNA, 18 bp, Homo sapiens
tgaactcttcaatctctt

SEQ ID NO: 1125195 - DNA, 22 bp, Homo sapiens
tgaactcttcagaacacacaga

SEQ ID NO: 1125196 - DNA, 20 bp, Homo sapiens
tgaactctttctggcctgcc

SEQ ID NO: 1125197 - DNA, 22 bp, Homo sapiens
tgaactctttctggcctgcctt

SEQ ID NO: 1125198 - DNA, 16 bp, Homo sapiens
tgaactgaaacttttc

SEQ ID NO: 1125199 - DNA, 21 bp, Homo sapiens
tgaactgaaacttttctaaag

SEQ ID NO: 1125200 - DNA, 17 bp, Homo sapiens
tgaactgaagtttcaca

SEQ ID NO: 1125201 - DNA, 17 bp, Homo sapiens
tgaactgacaatgaagg

SEQ ID NO: 1125202 - DNA, 13 bp, Homo sapiens
tgaactgacaggc

SEQ ID NO: 1125203 - DNA, 21 bp, Homo sapiens
tgaactgacaggcagcctgga

SEQ ID NO: 1125204 - DNA, 16 bp, Homo sapiens
tgaactgagaaggcag

SEQ ID NO: 1125205 - DNA, 23 bp, Homo sapiens
tgaactgagaaggcaggcctccg

SEQ ID NO: 1125206 - DNA, 23 bp, Homo sapiens
tgaactgaggagatgaccaggga

SEQ ID NO: 1125207 - DNA, 12 bp, Homo sapiens
tgaactgaggcc

SEQ ID NO: 1125208 - DNA, 15 bp, Homo sapiens
tgaactgaggccctg

SEQ ID NO: 1125209 - DNA, 15 bp, Homo sapiens
tgaactgcaacactg

SEQ ID NO: 1125210 - DNA, 15 bp, Homo sapiens
tgaactgctttcaag

SEQ ID NO: 1125211 - DNA, 16 bp, Homo sapiens
tgaactgcttttcctc

SEQ ID NO: 1125212 - DNA, 17 bp, Homo sapiens
tgaactggcaattgtct

SEQ ID NO: 1125213 - DNA, 21 bp, Homo sapiens
tgaactggcaattgtctattt

SEQ ID NO: 1125214 - DNA, 20 bp, Homo sapiens
tgaactgggcacagattgaa

SEQ ID NO: 1125215 - DNA, 15 bp, Homo sapiens
tgaactgggcatttc

SEQ ID NO: 1125216 - DNA, 12 bp, Homo sapiens
tgaactgtaaac

SEQ ID NO: 1125217 - DNA, 13 bp, Homo sapiens
tgaactgtaaact

SEQ ID NO: 1125218 - DNA, 16 bp, Homo sapiens
tgaacttacacttgga

SEQ ID NO: 1125219 - DNA, 17 bp, Homo sapiens
tgaacttagatgttaaa

SEQ ID NO: 1125220 - DNA, 16 bp, Homo sapiens
tgaacttattctgtag

SEQ ID NO: 1125221 - DNA, 21 bp, Homo sapiens
tgaacttccaagctccaaatc

SEQ ID NO: 1125222 - DNA, 22 bp, Homo sapiens
tgaacttctctcagacttactt

SEQ ID NO: 1125223 - DNA, 19 bp, Homo sapiens
tgaacttgagatctgtata

SEQ ID NO: 1125224 - DNA, 23 bp, Homo sapiens
tgaacttgagctctgtaacttac

SEQ ID NO: 1125225 - DNA, 17 bp, Homo sapiens
tgaacttgcattgtgat

SEQ ID NO: 1125226 - DNA, 11 bp, Homo sapiens
tgaactttctc

SEQ ID NO: 1125227 - DNA, 13 bp, Homo sapiens
tgaactttctccc

SEQ ID NO: 1125228 - DNA, 14 bp, Homo sapiens
tgaactttctccct

SEQ ID NO: 1125229 - DNA, 21 bp, Homo sapiens
tgaacttttaatgaactttga

SEQ ID NO: 1125230 - DNA, 11 bp, Homo sapiens
tgaacttttct

SEQ ID NO: 1125231 - DNA, 12 bp, Homo sapiens
tgaacttttgta

SEQ ID NO: 1125232 - DNA, 19 bp, Homo sapiens
tgaacttttgtaatttgaa

SEQ ID NO: 1125233 - DNA, 20 bp, Homo sapiens
tgaacttttgtaatttgaat

SEQ ID NO: 1125234 - DNA, 13 bp, Homo sapiens
tgaacttttgtac

SEQ ID NO: 1125235 - DNA, 14 bp, Homo sapiens
tgaacttttgtact

SEQ ID NO: 1125236 - DNA, 13 bp, Homo sapiens
tgaagaaaaaagc

SEQ ID NO: 1125237 - DNA, 13 bp, Homo sapiens
tgaagaaaaaatc

SEQ ID NO: 1125238 - DNA, 13 bp, Homo sapiens
tgaagaaaaagta

SEQ ID NO: 1125239 - DNA, 15 bp, Homo sapiens
tgaagaaaaagtaca

SEQ ID NO: 1125240 - DNA, 12 bp, Homo sapiens
tgaagaaaacaa

SEQ ID NO: 1125241 - DNA, 18 bp, Homo sapiens
tgaagaaaaggggagcac

SEQ ID NO: 1125242 - DNA, 19 bp, Homo sapiens
tgaagaaaaggttcttctt

SEQ ID NO: 1125243 - DNA, 16 bp, Homo sapiens
tgaagaaaatgacttt

SEQ ID NO: 1125244 - DNA, 17 bp, Homo sapiens
tgaagaaataaatgaaa

SEQ ID NO: 1125245 - DNA, 14 bp, Homo sapiens
tgaagaacacagca

SEQ ID NO: 1125246 - DNA, 17 bp, Homo sapiens
tgaagaacacagcatgt

SEQ ID NO: 1125247 - DNA, 19 bp, Homo sapiens
tgaagaacacagcatgtgc

SEQ ID NO: 1125248 - DNA, 21 bp, Homo sapiens
tgaagaacaggcttggcaaag

SEQ ID NO: 1125249 - DNA, 13 bp, Homo sapiens
tgaagaacagtaa

SEQ ID NO: 1125250 - DNA, 14 bp, Homo sapiens
tgaagaacatgtga

SEQ ID NO: 1125251 - DNA, 13 bp, Homo sapiens
tgaagaactgagg

SEQ ID NO: 1125252 - DNA, 19 bp, Homo sapiens
tgaagaactgaggaggaaa

SEQ ID NO: 1125253 - DNA, 13 bp, Homo sapiens
tgaagaactgcac

SEQ ID NO: 1125254 - DNA, 15 bp, Homo sapiens
tgaagaactgcactt

SEQ ID NO: 1125255 - DNA, 17 bp, Homo sapiens
tgaagaactgcaggccc

SEQ ID NO: 1125256 - DNA, 18 bp, Homo sapiens
tgaagaactgcaggccct

SEQ ID NO: 1125257 - DNA, 15 bp, Homo sapiens
tgaatacatttccaa

SEQ ID NO: 1125258 - DNA, 23 bp, Homo sapiens
tgaataccactctgtaattgcaa

SEQ ID NO: 1125259 - DNA, 20 bp, Homo sapiens
tgaatactctgccctctaga

SEQ ID NO: 1125260 - DNA, 15 bp, Homo sapiens
tgaatactcttgaaa

SEQ ID NO: 1125261 - DNA, 16 bp, Homo sapiens
tgaatactgtattttg

SEQ ID NO: 1125262 - DNA, 16 bp, Homo sapiens
tgaatacttattttca

SEQ ID NO: 1125263 - DNA, 18 bp, Homo sapiens
tgaatagatatgaaagct

SEQ ID NO: 1125264 - DNA, 13 bp, Homo sapiens
tgaatagatgtga

SEQ ID NO: 1125265 - DNA, 20 bp, Homo sapiens
tgaatagattttctctggaa

SEQ ID NO: 1125266 - DNA, 16 bp, Homo sapiens
tgaataggtagtatca

SEQ ID NO: 1125267 - DNA, 12 bp, Homo sapiens
tgaatataaaaa

SEQ ID NO: 1125268 - DNA, 18 bp, Homo sapiens
tgaatataaatgtgtgta

SEQ ID NO: 1125269 - DNA, 14 bp, Homo sapiens
tgaatatataaaca

SEQ ID NO: 1125270 - DNA, 12 bp, Homo sapiens
tgaatatatgat

SEQ ID NO: 1125271 - DNA, 14 bp, Homo sapiens
tgaatatctattaa

SEQ ID NO: 1125272 - DNA, 17 bp, Homo sapiens
tgaatatctattaatat

SEQ ID NO: 1125273 - DNA, 23 bp, Homo sapiens
tgaatatgtagtatctatatgac

SEQ ID NO: 1125274 - DNA, 13 bp, Homo sapiens
tgaatattactct

SEQ ID NO: 1125275 - DNA, 13 bp, Homo sapiens
tgaatattattcc

SEQ ID NO: 1125276 - DNA, 17 bp, Homo sapiens
tgaatattcctggactt

SEQ ID NO: 1125277 - DNA, 19 bp, Homo sapiens
tgaatattgatgttaacaa

SEQ ID NO: 1125278 - DNA, 22 bp, Homo sapiens
tgaatattggtaattaaaagac

SEQ ID NO: 1125279 - DNA, 14 bp, Homo sapiens
tgaatattgttaca

SEQ ID NO: 1125280 - DNA, 15 bp, Homo sapiens
tgaatatttaagaaa

SEQ ID NO: 1125281 - DNA, 18 bp, Homo sapiens
tgaatatttataacagca

SEQ ID NO: 1125282 - DNA, 19 bp, Homo sapiens
tgaatatttataacagcat

SEQ ID NO: 1125283 - DNA, 21 bp, Homo sapiens
tgaatatttccatatggattt

SEQ ID NO: 1125284 - DNA, 19 bp, Homo sapiens
tgaatatttgttttaatac

SEQ ID NO: 1125285 - DNA, 21 bp, Homo sapiens
tgaatattttcattaaaagct

SEQ ID NO: 1125286 - DNA, 17 bp, Homo sapiens
tgaatattttggaaact

SEQ ID NO: 1125287 - DNA, 16 bp, Homo sapiens
tgaatattttgtaata

SEQ ID NO: 1125288 - DNA, 19 bp, Homo sapiens
tgaatattttttatttcta

SEQ ID NO: 1125289 - DNA, 21 bp, Homo sapiens
tgaatattttttatttctaag

SEQ ID NO: 1125290 - DNA, 22 bp, Homo sapiens
tgaatattttttgaaggtttca

SEQ ID NO: 1125291 - DNA, 16 bp, Homo sapiens
tgaatcaaagtgtcta

SEQ ID NO: 1125292 - DNA, 18 bp, Homo sapiens
tgaatcaagcacactgta

SEQ ID NO: 1125293 - DNA, 15 bp, Homo sapiens
tgaatcaataatata

SEQ ID NO: 1125294 - DNA, 19 bp, Homo sapiens
tgaatcaataatatatttt

SEQ ID NO: 1125295 - DNA, 16 bp, Homo sapiens
tgaatcaatcctgggc

SEQ ID NO: 1125296 - DNA, 17 bp, Homo sapiens
tgaatcacgtaaagcta

SEQ ID NO: 1125297 - DNA, 23 bp, Homo sapiens
tgaatcacgtaaagctagaaatg

SEQ ID NO: 1125298 - DNA, 16 bp, Homo sapiens
tgaatcagaaaagcta

SEQ ID NO: 1125299 - DNA, 17 bp, Homo sapiens
tgaatcagaaaagctat

SEQ ID NO: 1125300 - DNA, 13 bp, Homo sapiens
tgaatcagaacag

SEQ ID NO: 1125301 - DNA, 21 bp, Homo sapiens
tgaatcagaacagatgctgag

SEQ ID NO: 1125302 - DNA, 21 bp, Homo sapiens
tgaatcagaccctaccccacc

SEQ ID NO: 1125303 - DNA, 17 bp, Homo sapiens
tgaatcagccagtctca

SEQ ID NO: 1125304 - DNA, 14 bp, Homo sapiens
tgaatcagctggac

SEQ ID NO: 1125305 - DNA, 14 bp, Homo sapiens
tgaatcaggcaaag

SEQ ID NO: 1125306 - DNA, 22 bp, Homo sapiens
tgaatcagttttggaatctaag

SEQ ID NO: 1125307 - DNA, 18 bp, Homo sapiens
tgaatcattgtatgtggt

SEQ ID NO: 1125308 - DNA, 21 bp, Homo sapiens
tgaatcccatcaggctgttat

SEQ ID NO: 1125309 - DNA, 24 bp, Homo sapiens
tgaatccccgacccccctacccca

SEQ ID NO: 1125310 - DNA, 22 bp, Homo sapiens
tgaatcctaagggctggtctct

SEQ ID NO: 1125311 - DNA, 17 bp, Homo sapiens
tgaatcctcttctttat

SEQ ID NO: 1125312 - DNA, 15 bp, Homo sapiens
tgaatcctttgcctg

SEQ ID NO: 1125313 - DNA, 20 bp, Homo sapiens
tgaatccttttaatctagag

SEQ ID NO: 1125314 - DNA, 16 bp, Homo sapiens
tgaatcgcagctgtgg

SEQ ID NO: 1125315 - DNA, 14 bp, Homo sapiens
tgaatcgggctaag

SEQ ID NO: 1125316 - DNA, 17 bp, Homo sapiens
tgaatctacaaaagtga

SEQ ID NO: 1125317 - DNA, 18 bp, Homo sapiens
tgaatctatgccaaagat

SEQ ID NO: 1125318 - DNA, 19 bp, Homo sapiens
tgaatctcataattggaat

SEQ ID NO: 1125319 - DNA, 15 bp, Homo sapiens
tgaatctctgcctct

SEQ ID NO: 1125320 - DNA, 23 bp, Homo sapiens
tgaatctgattggacattttctt

SEQ ID NO: 1125321 - DNA, 18 bp, Homo sapiens
tgaatctgcgagtagatg

SEQ ID NO: 1125322 - DNA, 13 bp, Homo sapiens
tgaatctgtacat

SEQ ID NO: 1125323 - DNA, 20 bp, Homo sapiens
tgaatctgtgtgcatatttg

SEQ ID NO: 1125324 - DNA, 19 bp, Homo sapiens
tgaatcttgttcaaaatgc

SEQ ID NO: 1125325 - DNA, 20 bp, Homo sapiens
tgaatctttcatacatatat

SEQ ID NO: 1125326 - DNA, 12 bp, Homo sapiens
tgaatctttctc

SEQ ID NO: 1125327 - DNA, 20 bp, Homo sapiens
tgaatctttttatcccattt

SEQ ID NO: 1125328 - DNA, 22 bp, Homo sapiens
tgaatcttttttttatataaat

SEQ ID NO: 1125329 - DNA, 17 bp, Homo sapiens
tgaatgaaaaatttaag

SEQ ID NO: 1125330 - DNA, 11 bp, Homo sapiens
tgaatgaaaac

SEQ ID NO: 1125331 - DNA, 16 bp, Homo sapiens
tgaatgaaaacatttt

SEQ ID NO: 1125332 - DNA, 11 bp, Homo sapiens
tgaatgaacac

SEQ ID NO: 1125333 - DNA, 15 bp, Homo sapiens
tgaatgacaacagaa

SEQ ID NO: 1125334 - DNA, 21 bp, Homo sapiens
tgaatgagccaaaatgacttt

SEQ ID NO: 1125335 - DNA, 18 bp, Homo sapiens
tgaatgatctctctgaat

SEQ ID NO: 1125336 - DNA, 16 bp, Homo sapiens
tgaatgatttttcttt

SEQ ID NO: 1125337 - DNA, 19 bp, Homo sapiens
tgaatgcaaaagaaattta

SEQ ID NO: 1125338 - DNA, 20 bp, Homo sapiens
tgaatgcaaaattgttttca

SEQ ID NO: 1125339 - DNA, 15 bp, Homo sapiens
tgaatgcaaaccata

SEQ ID NO: 1125340 - DNA, 19 bp, Homo sapiens
tgaatgcacactagcctct

SEQ ID NO: 1125341 - DNA, 16 bp, Homo sapiens
tgaatgcataatgttt

SEQ ID NO: 1125342 - DNA, 22 bp, Homo sapiens
tgaatgccactgccttcgcttc

SEQ ID NO: 1125343 - DNA, 17 bp, Homo sapiens
tgaatgcccccagctgg

SEQ ID NO: 1125344 - DNA, 22 bp, Homo sapiens
tgaatgcgctttattgcccatg

SEQ ID NO: 1125345 - DNA, 11 bp, Homo sapiens
tgaatgctgcc

SEQ ID NO: 1125346 - DNA, 13 bp, Homo sapiens
tgaatgctgccag

SEQ ID NO: 1125347 - DNA, 18 bp, Homo sapiens
tgaatgctgccagtgtgg

SEQ ID NO: 1125348 - DNA, 11 bp, Homo sapiens
tgaatgctggg

SEQ ID NO: 1125349 - DNA, 15 bp, Homo sapiens
tgaatgctgggactc

SEQ ID NO: 1125350 - DNA, 18 bp, Homo sapiens
tgaatgctttttgaatgt

SEQ ID NO: 1125351 - DNA, 19 bp, Homo sapiens
tgaatgctttttgaatgtt

SEQ ID NO: 1125352 - DNA, 23 bp, Homo sapiens
tgaatgctttttgaatgttattt

SEQ ID NO: 1125353 - DNA, 17 bp, Homo sapiens
tgaatggactaagatga

SEQ ID NO: 1125354 - DNA, 16 bp, Homo sapiens
tgaatggcatttgctg

SEQ ID NO: 1125355 - DNA, 12 bp, Homo sapiens
tgaatggcctgc

SEQ ID NO: 1125356 - DNA, 21 bp, Homo sapiens
tgaatggcttggagtgcactg

SEQ ID NO: 1125357 - DNA, 13 bp, Homo sapiens
tgaatggtatgga

SEQ ID NO: 1125358 - DNA, 20 bp, Homo sapiens
tgaatggtatggaactctct

SEQ ID NO: 1125359 - DNA, 14 bp, Homo sapiens
tgaatggtccaggg

SEQ ID NO: 1125360 - DNA, 18 bp, Homo sapiens
tgaatggtgttgtatgcc

SEQ ID NO: 1125361 - DNA, 20 bp, Homo sapiens
tgaatggtgttgtatgcctt

SEQ ID NO: 1125362 - DNA, 19 bp, Homo sapiens
tgaatggttccatgcctga

SEQ ID NO: 1125363 - DNA, 19 bp, Homo sapiens
tgaatgtagaataggcagg

SEQ ID NO: 1125364 - DNA, 18 bp, Homo sapiens
tgaatgtagcttccacct

SEQ ID NO: 1125365 - DNA, 15 bp, Homo sapiens
tgaatgtatattttg

SEQ ID NO: 1125366 - DNA, 22 bp, Homo sapiens
tgaatgtatgtaatgtgtggtg

SEQ ID NO: 1125367 - DNA, 15 bp, Homo sapiens
tgaatgtatgtgcac

SEQ ID NO: 1125368 - DNA, 16 bp, Homo sapiens
tgaatgtattgaactt

SEQ ID NO: 1125369 - DNA, 11 bp, Homo sapiens
tgaatgtattt

SEQ ID NO: 1125370 - DNA, 14 bp, Homo sapiens
tgaatgtatttgat

SEQ ID NO: 1125371 - DNA, 12 bp, Homo sapiens
tgaatgtatttt

SEQ ID NO: 1125372 - DNA, 22 bp, Homo sapiens
tgaatgtattttggttgctgat

SEQ ID NO: 1125373 - DNA, 21 bp, Homo sapiens
tgaatgtcacatttgaattct

SEQ ID NO: 1125374 - DNA, 12 bp, Homo sapiens
tgaatgtgctgg

SEQ ID NO: 1125375 - DNA, 20 bp, Homo sapiens
tgaatgtgctggtgaacact

SEQ ID NO: 1125376 - DNA, 22 bp, Homo sapiens
tgaatgtggataaaactgtgta

SEQ ID NO: 1125377 - DNA, 18 bp, Homo sapiens
tgaatgtggcttgagaaa

SEQ ID NO: 1125378 - DNA, 15 bp, Homo sapiens
tgaatgtggtctcag

SEQ ID NO: 1125379 - DNA, 16 bp, Homo sapiens
tgacagtgccttctct

SEQ ID NO: 1125380 - DNA, 17 bp, Homo sapiens
tgacagtggctgacaag

SEQ ID NO: 1125381 - DNA, 17 bp, Homo sapiens
tgacagtgttatcccaa

SEQ ID NO: 1125382 - DNA, 13 bp, Homo sapiens
tgacagttatttt

SEQ ID NO: 1125383 - DNA, 16 bp, Homo sapiens
tgacagttctgaagaa

SEQ ID NO: 1125384 - DNA, 17 bp, Homo sapiens
tgacagttctgaagaat

SEQ ID NO: 1125385 - DNA, 14 bp, Homo sapiens
tgacagtttccaaa

SEQ ID NO: 1125386 - DNA, 19 bp, Homo sapiens
tgacagtttcttttgtgtt

SEQ ID NO: 1125387 - DNA, 16 bp, Homo sapiens
tgacagtttttctgtt

SEQ ID NO: 1125388 - DNA, 17 bp, Homo sapiens
tgacagtttttctgttt

SEQ ID NO: 1125389 - DNA, 22 bp, Homo sapiens
tgacataaccaacattaaaact

SEQ ID NO: 1125390 - DNA, 20 bp, Homo sapiens
tgacataattgtccagttat

SEQ ID NO: 1125391 - DNA, 18 bp, Homo sapiens
tgacatatacatacttac

SEQ ID NO: 1125392 - DNA, 11 bp, Homo sapiens
tgacatattta

SEQ ID NO: 1125393 - DNA, 12 bp, Homo sapiens
tgacatatttaa

SEQ ID NO: 1125394 - DNA, 17 bp, Homo sapiens
tgacatatttaatgttt

SEQ ID NO: 1125395 - DNA, 21 bp, Homo sapiens
tgacatatttaatgttttaaa

SEQ ID NO: 1125396 - DNA, 15 bp, Homo sapiens
tgacatcaaaacttg

SEQ ID NO: 1125397 - DNA, 22 bp, Homo sapiens
tgacatcacttgtacaaaataa

SEQ ID NO: 1125398 - DNA, 23 bp, Homo sapiens
tgacatcacttgtacaaaataaa

SEQ ID NO: 1125399 - DNA, 12 bp, Homo sapiens
tgacatcagatt

SEQ ID NO: 1125400 - DNA, 23 bp, Homo sapiens
tgacatcagttcctttgtgtgta

SEQ ID NO: 1125401 - DNA, 15 bp, Homo sapiens
tgacatccactgttt

SEQ ID NO: 1125402 - DNA, 16 bp, Homo sapiens
tgacatcccttcctgg

SEQ ID NO: 1125403 - DNA, 20 bp, Homo sapiens
tgacatcccttcctggaaac

SEQ ID NO: 1125404 - DNA, 21 bp, Homo sapiens
tgacatcggaaaaataatcaa

SEQ ID NO: 1125405 - DNA, 15 bp, Homo sapiens
tgacatctcaggggc

SEQ ID NO: 1125406 - DNA, 15 bp, Homo sapiens
tgacatgaagctgtt

SEQ ID NO: 1125407 - DNA, 13 bp, Homo sapiens
tgacatgaccctc

SEQ ID NO: 1125408 - DNA, 16 bp, Homo sapiens
tgacatgaccctctgt

SEQ ID NO: 1125409 - DNA, 19 bp, Homo sapiens
tgacatgaccctctgtccc

SEQ ID NO: 1125410 - DNA, 23 bp, Homo sapiens
tgacatgaccctctgtccccagg

SEQ ID NO: 1125411 - DNA, 22 bp, Homo sapiens
tgacatgccctcccttctccct

SEQ ID NO: 1125412 - DNA, 23 bp, Homo sapiens
tgacatgccctcccttctccctg

SEQ ID NO: 1125413 - DNA, 22 bp, Homo sapiens
tgacatgctaacctctctgaac

SEQ ID NO: 1125414 - DNA, 22 bp, Homo sapiens
tgacatgggcctttaagaacct

SEQ ID NO: 1125415 - DNA, 21 bp, Homo sapiens
tgacatggggaaggcagaggc

SEQ ID NO: 1125416 - DNA, 17 bp, Homo sapiens
tgacatggtgcctgaga

SEQ ID NO: 1125417 - DNA, 18 bp, Homo sapiens
tgacatggtgcctgagag

SEQ ID NO: 1125418 - DNA, 16 bp, Homo sapiens
tgacatgtaagaaaat

SEQ ID NO: 1125419 - DNA, 20 bp, Homo sapiens
tgacatgtaagaaaatgtta

SEQ ID NO: 1125420 - DNA, 21 bp, Homo sapiens
tgacatgtaagaaaatgttac

SEQ ID NO: 1125421 - DNA, 21 bp, Homo sapiens
tgacatgtggaaagtgaattt

SEQ ID NO: 1125422 - DNA, 17 bp, Homo sapiens
tgacatgtggggccagg

SEQ ID NO: 1125423 - DNA, 18 bp, Homo sapiens
tgacatgtggggccaggt

SEQ ID NO: 1125424 - DNA, 19 bp, Homo sapiens
tgacatgtggggccaggtc

SEQ ID NO: 1125425 - DNA, 19 bp, Homo sapiens
tgacatgttatatattttt

SEQ ID NO: 1125426 - DNA, 19 bp, Homo sapiens
tgacattaacagttttcca

SEQ ID NO: 1125427 - DNA, 21 bp, Homo sapiens
tgacattaacagttttccatg

SEQ ID NO: 1125428 - DNA, 13 bp, Homo sapiens
tgacattcactgg

SEQ ID NO: 1125429 - DNA, 14 bp, Homo sapiens
tgacattcagaaaa

SEQ ID NO: 1125430 - DNA, 16 bp, Homo sapiens
tgacattccatgacga

SEQ ID NO: 1125431 - DNA, 13 bp, Homo sapiens
tgacattcccctc

SEQ ID NO: 1125432 - DNA, 19 bp, Homo sapiens
tgacattcctaagagtgga

SEQ ID NO: 1125433 - DNA, 20 bp, Homo sapiens
tgacattccttgtcaccagc

SEQ ID NO: 1125434 - DNA, 18 bp, Homo sapiens
tgacattcttagctgtaa

SEQ ID NO: 1125435 - DNA, 20 bp, Homo sapiens
tgacattgaaatctaggaaa

SEQ ID NO: 1125436 - DNA, 18 bp, Homo sapiens
tgacattgccaaaaagga

SEQ ID NO: 1125437 - DNA, 19 bp, Homo sapiens
tgacattgccaaaaaggat

SEQ ID NO: 1125438 - DNA, 15 bp, Homo sapiens
tgacattgcgtttga

SEQ ID NO: 1125439 - DNA, 19 bp, Homo sapiens
tgacattgcgtttgacctt

SEQ ID NO: 1125440 - DNA, 20 bp, Homo sapiens
tgacattgctccaagatgtt

SEQ ID NO: 1125441 - DNA, 17 bp, Homo sapiens
tgacatttacaggaggg

SEQ ID NO: 1125442 - DNA, 15 bp, Homo sapiens
tgacatttagaactt

SEQ ID NO: 1125443 - DNA, 18 bp, Homo sapiens
tgacatttatatttgtgt

SEQ ID NO: 1125444 - DNA, 21 bp, Homo sapiens
tgacatttatgtctcatgtaa

SEQ ID NO: 1125445 - DNA, 22 bp, Homo sapiens
tgacatttatgtctcatgtaat

SEQ ID NO: 1125446 - DNA, 23 bp, Homo sapiens
tgacatttatgtctcatgtaatt

SEQ ID NO: 1125447 - DNA, 15 bp, Homo sapiens
tgacatttcatctgg

SEQ ID NO: 1125448 - DNA, 17 bp, Homo sapiens
tgacatttcatctgggt

SEQ ID NO: 1125449 - DNA, 17 bp, Homo sapiens
tgacatttctaacatat

SEQ ID NO: 1125450 - DNA, 21 bp, Homo sapiens
tgacatttggagtgttcccct

SEQ ID NO: 1125451 - DNA, 21 bp, Homo sapiens
tgacatttgggagacatgtga

SEQ ID NO: 1125452 - DNA, 23 bp, Homo sapiens
tgacatttgggagacatgtgaca

SEQ ID NO: 1125453 - DNA, 22 bp, Homo sapiens
tgacattttctttttaaatttt

SEQ ID NO: 1125454 - DNA, 23 bp, Homo sapiens
tgaccaaaagttacatgtttgca

SEQ ID NO: 1125455 - DNA, 14 bp, Homo sapiens
tgaccaaaatacct

SEQ ID NO: 1125456 - DNA, 16 bp, Homo sapiens
tgaccaaaccagcctt

SEQ ID NO: 1125457 - DNA, 22 bp, Homo sapiens
tgaccaaaccagccttcggagc

SEQ ID NO: 1125458 - DNA, 20 bp, Homo sapiens
tgaccaaagtcccttcctgc

SEQ ID NO: 1125459 - DNA, 16 bp, Homo sapiens
tgaccaaagtcctttt

SEQ ID NO: 1125460 - DNA, 18 bp, Homo sapiens
tgaccaaagtgataaatt

SEQ ID NO: 1125461 - DNA, 15 bp, Homo sapiens
tgaccaacatggaga

SEQ ID NO: 1125462 - DNA, 16 bp, Homo sapiens
tgaccaagaactgcat

SEQ ID NO: 1125463 - DNA, 19 bp, Homo sapiens
tgaccaagactgagccagc

SEQ ID NO: 1125464 - DNA, 22 bp, Homo sapiens
tgaccaagcggctcaagaataa

SEQ ID NO: 1125465 - DNA, 14 bp, Homo sapiens
tgaccaagtataaa

SEQ ID NO: 1125466 - DNA, 13 bp, Homo sapiens
tgaccaagttata

SEQ ID NO: 1125467 - DNA, 16 bp, Homo sapiens
tgaccaagttataaat

SEQ ID NO: 1125468 - DNA, 20 bp, Homo sapiens
tgaccaagttataaatcaat

SEQ ID NO: 1125469 - DNA, 15 bp, Homo sapiens
tgaccacacttcctg

SEQ ID NO: 1125470 - DNA, 20 bp, Homo sapiens
tgaccacataagaaggcaat

SEQ ID NO: 1125471 - DNA, 21 bp, Homo sapiens
tgaccacatagcatgaggcca

SEQ ID NO: 1125472 - DNA, 13 bp, Homo sapiens
tgaccacccacca

SEQ ID NO: 1125473 - DNA, 13 bp, Homo sapiens
tgaccaccccctg

SEQ ID NO: 1125474 - DNA, 13 bp, Homo sapiens
tgaccaccctccc

SEQ ID NO: 1125475 - DNA, 16 bp, Homo sapiens
tgaccaccctcccctc

SEQ ID NO: 1125476 - DNA, 20 bp, Homo sapiens
tgaccacgcacctccacgcc

SEQ ID NO: 1125477 - DNA, 20 bp, Homo sapiens
tgaccacggacgtttccatc

SEQ ID NO: 1125478 - DNA, 22 bp, Homo sapiens
tgaccacggacgtttccatcag

SEQ ID NO: 1125479 - DNA, 16 bp, Homo sapiens
tgaccacggctgttcc

SEQ ID NO: 1125480 - DNA, 15 bp, Homo sapiens
tgaccactgggcctg

SEQ ID NO: 1125481 - DNA, 13 bp, Homo sapiens
tgaccagaagcct

SEQ ID NO: 1125482 - DNA, 15 bp, Homo sapiens
tgaccagaagccttg

SEQ ID NO: 1125483 - DNA, 19 bp, Homo sapiens
tgaccagcaacttgtcttt

SEQ ID NO: 1125484 - DNA, 11 bp, Homo sapiens
tgaccagcagc

SEQ ID NO: 1125485 - DNA, 16 bp, Homo sapiens
tgaccagcggaaacag

SEQ ID NO: 1125486 - DNA, 21 bp, Homo sapiens
tgaccagcggaaacaggtgtg

SEQ ID NO: 1125487 - DNA, 16 bp, Homo sapiens
tgaccaggcccaagga

SEQ ID NO: 1125488 - DNA, 16 bp, Homo sapiens
tgaccaggctgcctcc

SEQ ID NO: 1125489 - DNA, 20 bp, Homo sapiens
tgaccagggatgctgggctg

SEQ ID NO: 1125490 - DNA, 23 bp, Homo sapiens
tgaccagtgagaactctctccct

SEQ ID NO: 1125491 - DNA, 19 bp, Homo sapiens
tgaccataattttttttaa

SEQ ID NO: 1125492 - DNA, 22 bp, Homo sapiens
tgaccatccactctaccctccc

SEQ ID NO: 1125493 - DNA, 19 bp, Homo sapiens
tgaccatcgtccttcctct

SEQ ID NO: 1125494 - DNA, 22 bp, Homo sapiens
tgaccatctcttaggtctaatg

SEQ ID NO: 1125495 - DNA, 19 bp, Homo sapiens
tgaccatgcgtcaggggcc

SEQ ID NO: 1125496 - DNA, 16 bp, Homo sapiens
tgaccatgctcatctg

SEQ ID NO: 1125497 - DNA, 19 bp, Homo sapiens
tgaccatgctcatctgctg

SEQ ID NO: 1125498 - DNA, 19 bp, Homo sapiens
tgaccatggttttggctct

SEQ ID NO: 1125499 - DNA, 13 bp, Homo sapiens
tgaccatgttcat

SEQ ID NO: 1125500 - DNA, 19 bp, Homo sapiens
tgactgcacccagctccag

SEQ ID NO: 1125501 - DNA, 22 bp, Homo sapiens
tgactgcactgttgctgactac

SEQ ID NO: 1125502 - DNA, 22 bp, Homo sapiens
tgactgccaggaccccaggtca

SEQ ID NO: 1125503 - DNA, 24 bp, Homo sapiens
tgactgccaggaccccaggtcagg

SEQ ID NO: 1125504 - DNA, 18 bp, Homo sapiens
tgactgcccattcaccaa

SEQ ID NO: 1125505 - DNA, 17 bp, Homo sapiens
tgactgccccaactcct

SEQ ID NO: 1125506 - DNA, 19 bp, Homo sapiens
tgactgccccaactcctgg

SEQ ID NO: 1125507 - DNA, 21 bp, Homo sapiens
tgactgccggtcatttgaatg

SEQ ID NO: 1125508 - DNA, 16 bp, Homo sapiens
tgactgctcagaactt

SEQ ID NO: 1125509 - DNA, 23 bp, Homo sapiens
tgactgctccccagccctggctc

SEQ ID NO: 1125510 - DNA, 15 bp, Homo sapiens
tgactgctgattctc

SEQ ID NO: 1125511 - DNA, 13 bp, Homo sapiens
tgactgctgctcc

SEQ ID NO: 1125512 - DNA, 14 bp, Homo sapiens
tgactgctgctccc

SEQ ID NO: 1125513 - DNA, 19 bp, Homo sapiens
tgactggatcttctatcat

SEQ ID NO: 1125514 - DNA, 21 bp, Homo sapiens
tgactggatcttctatcattc

SEQ ID NO: 1125515 - DNA, 19 bp, Homo sapiens
tgactggctgtctgcctgt

SEQ ID NO: 1125516 - DNA, 20 bp, Homo sapiens
tgactggggtgggaggtctt

SEQ ID NO: 1125517 - DNA, 17 bp, Homo sapiens
tgactgggtgagaccca

SEQ ID NO: 1125518 - DNA, 23 bp, Homo sapiens
tgactggtgttatcaccgtgggc

SEQ ID NO: 1125519 - DNA, 19 bp, Homo sapiens
tgactggtttacaggccct

SEQ ID NO: 1125520 - DNA, 20 bp, Homo sapiens
tgactggtttacaggccctg

SEQ ID NO: 1125521 - DNA, 14 bp, Homo sapiens
tgactgtaattaat

SEQ ID NO: 1125522 - DNA, 16 bp, Homo sapiens
tgactgtactcctccc

SEQ ID NO: 1125523 - DNA, 22 bp, Homo sapiens
tgactgtactcctcccaggcgc

SEQ ID NO: 1125524 - DNA, 16 bp, Homo sapiens
tgactgtagccacagc

SEQ ID NO: 1125525 - DNA, 18 bp, Homo sapiens
tgactgtatctgtgtaga

SEQ ID NO: 1125526 - DNA, 19 bp, Homo sapiens
tgactgtatctgtgtagac

SEQ ID NO: 1125527 - DNA, 13 bp, Homo sapiens
tgactgtcactgt

SEQ ID NO: 1125528 - DNA, 16 bp, Homo sapiens
tgactgtcactgttcc

SEQ ID NO: 1125529 - DNA, 19 bp, Homo sapiens
tgactgtctagccactccc

SEQ ID NO: 1125530 - DNA, 15 bp, Homo sapiens
tgactgtgaccacct

SEQ ID NO: 1125531 - DNA, 18 bp, Homo sapiens
tgactgtgaccaccttct

SEQ ID NO: 1125532 - DNA, 23 bp, Homo sapiens
tgactgtgaccaccttctgtccc

SEQ ID NO: 1125533 - DNA, 12 bp, Homo sapiens
tgactgtgctgt

SEQ ID NO: 1125534 - DNA, 21 bp, Homo sapiens
tgactgtgtaactttctctta

SEQ ID NO: 1125535 - DNA, 15 bp, Homo sapiens
tgactgttgcccccc

SEQ ID NO: 1125536 - DNA, 14 bp, Homo sapiens
tgactgttggctct

SEQ ID NO: 1125537 - DNA, 15 bp, Homo sapiens
tgactgtttcattca

SEQ ID NO: 1125538 - DNA, 13 bp, Homo sapiens
tgactgtttcttt

SEQ ID NO: 1125539 - DNA, 20 bp, Homo sapiens
tgactgtttcttttgtaaag

SEQ ID NO: 1125540 - DNA, 21 bp, Homo sapiens
tgactgtttcttttgtaaaga

SEQ ID NO: 1125541 - DNA, 12 bp, Homo sapiens
tgactgtttggc

SEQ ID NO: 1125542 - DNA, 15 bp, Homo sapiens
tgactgtttggctta

SEQ ID NO: 1125543 - DNA, 19 bp, Homo sapiens
tgactgtttggcttataaa

SEQ ID NO: 1125544 - DNA, 20 bp, Homo sapiens
tgactgtttttcggacagtt

SEQ ID NO: 1125545 - DNA, 16 bp, Homo sapiens
tgacttaactgcattt

SEQ ID NO: 1125546 - DNA, 19 bp, Homo sapiens
tgacttaagcaaaagaaaa

SEQ ID NO: 1125547 - DNA, 16 bp, Homo sapiens
tgacttaatgtgatta

SEQ ID NO: 1125548 - DNA, 12 bp, Homo sapiens
tgacttacaatt

SEQ ID NO: 1125549 - DNA, 15 bp, Homo sapiens
tgacttactgtacat

SEQ ID NO: 1125550 - DNA, 13 bp, Homo sapiens
tgacttagaaact

SEQ ID NO: 1125551 - DNA, 18 bp, Homo sapiens
tgacttagatattaaaat

SEQ ID NO: 1125552 - DNA, 23 bp, Homo sapiens
tgacttagcgtcaagacatttgc

SEQ ID NO: 1125553 - DNA, 20 bp, Homo sapiens
tgacttaggtaaaataaaag

SEQ ID NO: 1125554 - DNA, 15 bp, Homo sapiens
tgacttatagtacat

SEQ ID NO: 1125555 - DNA, 12 bp, Homo sapiens
tgacttatttct

SEQ ID NO: 1125556 - DNA, 23 bp, Homo sapiens
tgacttcaatgatagtaagaaaa

SEQ ID NO: 1125557 - DNA, 15 bp, Homo sapiens
tgacttcactgtata

SEQ ID NO: 1125558 - DNA, 16 bp, Homo sapiens
tgacttcagctgcctg

SEQ ID NO: 1125559 - DNA, 17 bp, Homo sapiens
tgacttcagctgcctga

SEQ ID NO: 1125560 - DNA, 22 bp, Homo sapiens
tgacttcagctgcctgaaacag

SEQ ID NO: 1125561 - DNA, 20 bp, Homo sapiens
tgacttcaggtggagagcac

SEQ ID NO: 1125562 - DNA, 21 bp, Homo sapiens
tgacttcaggtggagagcact

SEQ ID NO: 1125563 - DNA, 21 bp, Homo sapiens
tgacttcagtgaaattttcag

SEQ ID NO: 1125564 - DNA, 21 bp, Homo sapiens
tgacttcatggaatggacatc

SEQ ID NO: 1125565 - DNA, 15 bp, Homo sapiens
tgacttccctggtca

SEQ ID NO: 1125566 - DNA, 18 bp, Homo sapiens
tgacttctagctgtctgt

SEQ ID NO: 1125567 - DNA, 16 bp, Homo sapiens
tgacttctccaggtct

SEQ ID NO: 1125568 - DNA, 21 bp, Homo sapiens
tgacttctcccccgccctgcc

SEQ ID NO: 1125569 - DNA, 23 bp, Homo sapiens
tgacttctcccccgccctgcccc

SEQ ID NO: 1125570 - DNA, 18 bp, Homo sapiens
tgacttctcccctgccct

SEQ ID NO: 1125571 - DNA, 18 bp, Homo sapiens
tgacttctgcctggagac

SEQ ID NO: 1125572 - DNA, 21 bp, Homo sapiens
tgacttcttgcttcagtcatc

SEQ ID NO: 1125573 - DNA, 12 bp, Homo sapiens
tgacttcttggt

SEQ ID NO: 1125574 - DNA, 23 bp, Homo sapiens
tgacttctttactaacactggct

SEQ ID NO: 1125575 - DNA, 17 bp, Homo sapiens
tgacttgcatgaagaga

SEQ ID NO: 1125576 - DNA, 21 bp, Homo sapiens
tgacttgctgtccaggcagct

SEQ ID NO: 1125577 - DNA, 15 bp, Homo sapiens
tgacttgctgtgtga

SEQ ID NO: 1125578 - DNA, 21 bp, Homo sapiens
tgacttggctggggaggacca

SEQ ID NO: 1125579 - DNA, 19 bp, Homo sapiens
tgacttgtggttgaattaa

SEQ ID NO: 1125580 - DNA, 15 bp, Homo sapiens
tgacttgtgtcccat

SEQ ID NO: 1125581 - DNA, 18 bp, Homo sapiens
tgacttgttctgagtaag

SEQ ID NO: 1125582 - DNA, 19 bp, Homo sapiens
tgacttgtttgtcttccat

SEQ ID NO: 1125583 - DNA, 13 bp, Homo sapiens
tgactttaaaaga

SEQ ID NO: 1125584 - DNA, 16 bp, Homo sapiens
tgactttaatttatgt

SEQ ID NO: 1125585 - DNA, 22 bp, Homo sapiens
tgactttacgcccatctcagga

SEQ ID NO: 1125586 - DNA, 15 bp, Homo sapiens
tgactttataaattt

SEQ ID NO: 1125587 - DNA, 21 bp, Homo sapiens
tgactttatttttctaagtgt

SEQ ID NO: 1125588 - DNA, 17 bp, Homo sapiens
tgactttcaaaatatat

SEQ ID NO: 1125589 - DNA, 13 bp, Homo sapiens
tgactttctcccc

SEQ ID NO: 1125590 - DNA, 17 bp, Homo sapiens
tgactttgacaattact

SEQ ID NO: 1125591 - DNA, 21 bp, Homo sapiens
tgactttgcccccttgcccat

SEQ ID NO: 1125592 - DNA, 19 bp, Homo sapiens
tgactttggggacaggggg

SEQ ID NO: 1125593 - DNA, 15 bp, Homo sapiens
tgacttttaaagatt

SEQ ID NO: 1125594 - DNA, 18 bp, Homo sapiens
tgacttttaaagatttag

SEQ ID NO: 1125595 - DNA, 18 bp, Homo sapiens
tgacttttccaagccctt

SEQ ID NO: 1125596 - DNA, 20 bp, Homo sapiens
tgacttttctgattaatata

SEQ ID NO: 1125597 - DNA, 22 bp, Homo sapiens
tgacttttctgtaattcaggtt

SEQ ID NO: 1125598 - DNA, 14 bp, Homo sapiens
tgacttttctgtgg

SEQ ID NO: 1125599 - DNA, 16 bp, Homo sapiens
tgactttttcagagtt

SEQ ID NO: 1125600 - DNA, 14 bp, Homo sapiens
tgactttttgcatt

SEQ ID NO: 1125601 - DNA, 23 bp, Homo sapiens
tgactttttgcatttaaaacaga

SEQ ID NO: 1125602 - DNA, 15 bp, Homo sapiens
tgactttttggaatt

SEQ ID NO: 1125603 - DNA, 19 bp, Homo sapiens
tgactttttggaattcagc

SEQ ID NO: 1125604 - DNA, 15 bp, Homo sapiens
tgactttttttgtat

SEQ ID NO: 1125605 - DNA, 17 bp, Homo sapiens
tgactttttttgtatgt

SEQ ID NO: 1125606 - DNA, 18 bp, Homo sapiens
tgactttttttgtatgtg

SEQ ID NO: 1125607 - DNA, 16 bp, Homo sapiens
tgagaaaaagctcctg

SEQ ID NO: 1125608 - DNA, 22 bp, Homo sapiens
tgagaaaaatagagcaaaatca

SEQ ID NO: 1125609 - DNA, 18 bp, Homo sapiens
tgagaaaaatatatacta

SEQ ID NO: 1125610 - DNA, 23 bp, Homo sapiens
tgagaaaacgaagtctttttcat

SEQ ID NO: 1125611 - DNA, 15 bp, Homo sapiens
tgagaaaagtattct

SEQ ID NO: 1125612 - DNA, 21 bp, Homo sapiens
tgagaaaagtattctcaaaga

SEQ ID NO: 1125613 - DNA, 13 bp, Homo sapiens
tgagaaaatataa

SEQ ID NO: 1125614 - DNA, 16 bp, Homo sapiens
tgagaaaatataataa

SEQ ID NO: 1125615 - DNA, 17 bp, Homo sapiens
tgagaaaatataataaa

SEQ ID NO: 1125616 - DNA, 16 bp, Homo sapiens
tgagaaaatgcctcaa

SEQ ID NO: 1125617 - DNA, 14 bp, Homo sapiens
tgagaaacatagta

SEQ ID NO: 1125618 - DNA, 23 bp, Homo sapiens
tgagaaaccttattgtacctctc

SEQ ID NO: 1125619 - DNA, 12 bp, Homo sapiens
tgagaaactcta

SEQ ID NO: 1125620 - DNA, 21 bp, Homo sapiens
tgagaaagagcacttaagaga

SEQ ID NO: 1125621 - DNA, 20 bp, Homo sapiens
tgagctgcctgtaacttgag

SEQ ID NO: 1125622 - DNA, 19 bp, Homo sapiens
tgagctgccttccctagct

SEQ ID NO: 1125623 - DNA, 19 bp, Homo sapiens
tgagctgctgactgccaat

SEQ ID NO: 1125624 - DNA, 17 bp, Homo sapiens
tgagctggaaggggcca

SEQ ID NO: 1125625 - DNA, 19 bp, Homo sapiens
tgagctggatagacttggg

SEQ ID NO: 1125626 - DNA, 21 bp, Homo sapiens
tgagctggatagacttgggat

SEQ ID NO: 1125627 - DNA, 18 bp, Homo sapiens
tgagctggcctctctagc

SEQ ID NO: 1125628 - DNA, 12 bp, Homo sapiens
tgagctgggaag

SEQ ID NO: 1125629 - DNA, 13 bp, Homo sapiens
tgagctgggaggg

SEQ ID NO: 1125630 - DNA, 18 bp, Homo sapiens
tgagctggggactcaggg

SEQ ID NO: 1125631 - DNA, 20 bp, Homo sapiens
tgagctggggactcagggac

SEQ ID NO: 1125632 - DNA, 16 bp, Homo sapiens
tgagctggggaggtgg

SEQ ID NO: 1125633 - DNA, 15 bp, Homo sapiens
tgagctgtaaaaatg

SEQ ID NO: 1125634 - DNA, 14 bp, Homo sapiens
tgagctgttgcctc

SEQ ID NO: 1125635 - DNA, 11 bp, Homo sapiens
tgagctgtttt

SEQ ID NO: 1125636 - DNA, 22 bp, Homo sapiens
tgagcttaaaatacaagactgc

SEQ ID NO: 1125637 - DNA, 23 bp, Homo sapiens
tgagcttagccttgtgccctgcc

SEQ ID NO: 1125638 - DNA, 15 bp, Homo sapiens
tgagcttcaatataa

SEQ ID NO: 1125639 - DNA, 21 bp, Homo sapiens
tgagcttcggttctccagaat

SEQ ID NO: 1125640 - DNA, 23 bp, Homo sapiens
tgagcttcggttctccagaatgt

SEQ ID NO: 1125641 - DNA, 15 bp, Homo sapiens
tgagcttctctgtga

SEQ ID NO: 1125642 - DNA, 16 bp, Homo sapiens
tgagcttctctgtgaa

SEQ ID NO: 1125643 - DNA, 14 bp, Homo sapiens
tgagcttctgagac

SEQ ID NO: 1125644 - DNA, 15 bp, Homo sapiens
tgagcttctgagaca

SEQ ID NO: 1125645 - DNA, 20 bp, Homo sapiens
tgagcttggcagctgaacta

SEQ ID NO: 1125646 - DNA, 14 bp, Homo sapiens
tgagcttggccaga

SEQ ID NO: 1125647 - DNA, 16 bp, Homo sapiens
tgagcttggccagaag

SEQ ID NO: 1125648 - DNA, 21 bp, Homo sapiens
tgagcttggccagaagggggc

SEQ ID NO: 1125649 - DNA, 21 bp, Homo sapiens
tgagctttccatgttgctgcc

SEQ ID NO: 1125650 - DNA, 20 bp, Homo sapiens
tgagctttgaagtaggtggc

SEQ ID NO: 1125651 - DNA, 14 bp, Homo sapiens
tgagctttgctgct

SEQ ID NO: 1125652 - DNA, 21 bp, Homo sapiens
tgagctttggggacagttggc

SEQ ID NO: 1125653 - DNA, 12 bp, Homo sapiens
tgagcttttcta

SEQ ID NO: 1125654 - DNA, 23 bp, Homo sapiens
tgaggaaaagactgtgggtgggg

SEQ ID NO: 1125655 - DNA, 16 bp, Homo sapiens
tgaggaaacaacagct

SEQ ID NO: 1125656 - DNA, 21 bp, Homo sapiens
tgaggaaagtgcgttctccca

SEQ ID NO: 1125657 - DNA, 18 bp, Homo sapiens
tgaggaaatccattgttt

SEQ ID NO: 1125658 - DNA, 19 bp, Homo sapiens
tgaggaacaggttcctgtg

SEQ ID NO: 1125659 - DNA, 16 bp, Homo sapiens
tgaggaagcagttggg

SEQ ID NO: 1125660 - DNA, 21 bp, Homo sapiens
tgaggaagcagttggggccct

SEQ ID NO: 1125661 - DNA, 20 bp, Homo sapiens
tgaggaagttttgtctaatt

SEQ ID NO: 1125662 - DNA, 11 bp, Homo sapiens
tgaggaataaa

SEQ ID NO: 1125663 - DNA, 19 bp, Homo sapiens
tgaggaatacagaagcagt

SEQ ID NO: 1125664 - DNA, 18 bp, Homo sapiens
tgaggaatccaaaagaca

SEQ ID NO: 1125665 - DNA, 16 bp, Homo sapiens
tgaggaatgatgaagc

SEQ ID NO: 1125666 - DNA, 17 bp, Homo sapiens
tgaggaatgctctgtgc

SEQ ID NO: 1125667 - DNA, 19 bp, Homo sapiens
tgaggaatgtatatgtttt

SEQ ID NO: 1125668 - DNA, 19 bp, Homo sapiens
tgaggaattatcatgggaa

SEQ ID NO: 1125669 - DNA, 15 bp, Homo sapiens
tgaggaatttcacct

SEQ ID NO: 1125670 - DNA, 14 bp, Homo sapiens
tgaggaattttctt

SEQ ID NO: 1125671 - DNA, 20 bp, Homo sapiens
tgaggacaaccattccagac

SEQ ID NO: 1125672 - DNA, 14 bp, Homo sapiens
tgaggacaggctct

SEQ ID NO: 1125673 - DNA, 19 bp, Homo sapiens
tgaggacaggctctagaga

SEQ ID NO: 1125674 - DNA, 12 bp, Homo sapiens
tgaggaccaggg

SEQ ID NO: 1125675 - DNA, 16 bp, Homo sapiens
tgaggaccagggtgga

SEQ ID NO: 1125676 - DNA, 21 bp, Homo sapiens
tgaggaccagggtggagctga

SEQ ID NO: 1125677 - DNA, 22 bp, Homo sapiens
tgaggaccccttaatcttgctt

SEQ ID NO: 1125678 - DNA, 20 bp, Homo sapiens
tgaggaccgctgataagcat

SEQ ID NO: 1125679 - DNA, 21 bp, Homo sapiens
tgaggacctctcagcatagcc

SEQ ID NO: 1125680 - DNA, 21 bp, Homo sapiens
tgaggactcggccactgtgtc

SEQ ID NO: 1125681 - DNA, 23 bp, Homo sapiens
tgaggactcggccactgtgtctc

SEQ ID NO: 1125682 - DNA, 24 bp, Homo sapiens
tgaggactgtcctcccacagacct

SEQ ID NO: 1125683 - DNA, 20 bp, Homo sapiens
tgaggagaagggggtctctg

SEQ ID NO: 1125684 - DNA, 22 bp, Homo sapiens
tgaggagaagggggtctctgtt

SEQ ID NO: 1125685 - DNA, 19 bp, Homo sapiens
tgaggagacacacctgagg

SEQ ID NO: 1125686 - DNA, 22 bp, Homo sapiens
tgaggagatgaccagggatgct

SEQ ID NO: 1125687 - DNA, 14 bp, Homo sapiens
tgaggagcagccag

SEQ ID NO: 1125688 - DNA, 15 bp, Homo sapiens
tgaggagcagccagg

SEQ ID NO: 1125689 - DNA, 20 bp, Homo sapiens
tgaggagcagccaggacccg

SEQ ID NO: 1125690 - DNA, 23 bp, Homo sapiens
tgaggagcccatactcagcctgc

SEQ ID NO: 1125691 - DNA, 12 bp, Homo sapiens
tgaggagctgca

SEQ ID NO: 1125692 - DNA, 13 bp, Homo sapiens
tgaggagctgctg

SEQ ID NO: 1125693 - DNA, 15 bp, Homo sapiens
tgaggaggaaaagga

SEQ ID NO: 1125694 - DNA, 16 bp, Homo sapiens
tgaggaggaggacaca

SEQ ID NO: 1125695 - DNA, 18 bp, Homo sapiens
tgaggaggaggacacagc

SEQ ID NO: 1125696 - DNA, 16 bp, Homo sapiens
tgaggaggggagggta

SEQ ID NO: 1125697 - DNA, 18 bp, Homo sapiens
tgaggagggtggaggaag

SEQ ID NO: 1125698 - DNA, 13 bp, Homo sapiens
tgaggagggtggg

SEQ ID NO: 1125699 - DNA, 17 bp, Homo sapiens
tgaggagggtgggggag

SEQ ID NO: 1125700 - DNA, 19 bp, Homo sapiens
tgaggaggttcactgagct

SEQ ID NO: 1125701 - DNA, 16 bp, Homo sapiens
tgaggagtaaaattca

SEQ ID NO: 1125702 - DNA, 19 bp, Homo sapiens
tgaggataaaaaggaagga

SEQ ID NO: 1125703 - DNA, 17 bp, Homo sapiens
tgaggatataatgtgtg

SEQ ID NO: 1125704 - DNA, 17 bp, Homo sapiens
tgaggatgacagtgaca

SEQ ID NO: 1125705 - DNA, 22 bp, Homo sapiens
tgaggatgacagtgacacccag

SEQ ID NO: 1125706 - DNA, 23 bp, Homo sapiens
tgaggatgacagtgacacccaga

SEQ ID NO: 1125707 - DNA, 15 bp, Homo sapiens
tgaggatgagctgga

SEQ ID NO: 1125708 - DNA, 16 bp, Homo sapiens
tgaggatgagctggaa

SEQ ID NO: 1125709 - DNA, 14 bp, Homo sapiens
tgaggatgatgtac

SEQ ID NO: 1125710 - DNA, 19 bp, Homo sapiens
tgaggatgggatgtatttt

SEQ ID NO: 1125711 - DNA, 20 bp, Homo sapiens
tgaggattattataaaaggg

SEQ ID NO: 1125712 - DNA, 20 bp, Homo sapiens
tgaggattattgatagtact

SEQ ID NO: 1125713 - DNA, 20 bp, Homo sapiens
tgaggattgtggaaaaccag

SEQ ID NO: 1125714 - DNA, 16 bp, Homo sapiens
tgaggatttcaagcct

SEQ ID NO: 1125715 - DNA, 17 bp, Homo sapiens
tgaggatttcctggagt

SEQ ID NO: 1125716 - DNA, 22 bp, Homo sapiens
tgaggatttcctggagtgccct

SEQ ID NO: 1125717 - DNA, 16 bp, Homo sapiens
tgaggcaaacagcaag

SEQ ID NO: 1125718 - DNA, 17 bp, Homo sapiens
tgaggcaaattaactgt

SEQ ID NO: 1125719 - DNA, 20 bp, Homo sapiens
tgaggcaatgtcaggaacag

SEQ ID NO: 1125720 - DNA, 13 bp, Homo sapiens
tgaggcagaagaa

SEQ ID NO: 1125721 - DNA, 18 bp, Homo sapiens
tgaggcagaagaattgaa

SEQ ID NO: 1125722 - DNA, 17 bp, Homo sapiens
tgaggcagacagcagct

SEQ ID NO: 1125723 - DNA, 23 bp, Homo sapiens
tgaggcagacagcagctcaggca

SEQ ID NO: 1125724 - DNA, 24 bp, Homo sapiens
tgaggcagacagcagctcaggcac

SEQ ID NO: 1125725 - DNA, 19 bp, Homo sapiens
tgaggcaggcaatcacttg

SEQ ID NO: 1125726 - DNA, 21 bp, Homo sapiens
tgaggcatgactaatgctttt

SEQ ID NO: 1125727 - DNA, 17 bp, Homo sapiens
tgaggcattcggggaag

SEQ ID NO: 1125728 - DNA, 12 bp, Homo sapiens
tgaggcatttgt

SEQ ID NO: 1125729 - DNA, 19 bp, Homo sapiens
tgaggcatttgtttgaact

SEQ ID NO: 1125730 - DNA, 20 bp, Homo sapiens
tgaggcatttgtttgaactg

SEQ ID NO: 1125731 - DNA, 21 bp, Homo sapiens
tgaggccaagaatattgcaaa

SEQ ID NO: 1125732 - DNA, 23 bp, Homo sapiens
tgaggccaccagtaaaagacatt

SEQ ID NO: 1125733 - DNA, 13 bp, Homo sapiens
tgaggccagagtc

SEQ ID NO: 1125734 - DNA, 13 bp, Homo sapiens
tgaggccagtggc

SEQ ID NO: 1125735 - DNA, 15 bp, Homo sapiens
tgaggccagtggccc

SEQ ID NO: 1125736 - DNA, 16 bp, Homo sapiens
tgaggccagtggcccc

SEQ ID NO: 1125737 - DNA, 14 bp, Homo sapiens
tgaggccatctcag

SEQ ID NO: 1125738 - DNA, 19 bp, Homo sapiens
tgaggccatctcaggagat

SEQ ID NO: 1125739 - DNA, 20 bp, Homo sapiens
tgaggccatctcaggagatg

SEQ ID NO: 1125740 - DNA, 10 bp, Homo sapiens
tgaggcccaa

SEQ ID NO: 1125741 - DNA, 12 bp, Homo sapiens
tgaggcccagcc

SEQ ID NO: 1125742 - DNA, 18 bp, Homo sapiens
tgagtgggccctgcccgg

SEQ ID NO: 1125743 - DNA, 21 bp, Homo sapiens
tgagtgggtgaataatacagt

SEQ ID NO: 1125744 - DNA, 19 bp, Homo sapiens
tgagtggtcactggtcagg

SEQ ID NO: 1125745 - DNA, 16 bp, Homo sapiens
tgagtgtaaataattt

SEQ ID NO: 1125746 - DNA, 17 bp, Homo sapiens
tgagtgtaaataatttt

SEQ ID NO: 1125747 - DNA, 16 bp, Homo sapiens
tgagtgtactgtgcct

SEQ ID NO: 1125748 - DNA, 14 bp, Homo sapiens
tgagtgtatatata

SEQ ID NO: 1125749 - DNA, 15 bp, Homo sapiens
tgagtgtatatatat

SEQ ID NO: 1125750 - DNA, 15 bp, Homo sapiens
tgagtgtatgtgtgt

SEQ ID NO: 1125751 - DNA, 13 bp, Homo sapiens
tgagtgtgaagct

SEQ ID NO: 1125752 - DNA, 14 bp, Homo sapiens
tgagtgtgaagctt

SEQ ID NO: 1125753 - DNA, 12 bp, Homo sapiens
tgagtgtgacag

SEQ ID NO: 1125754 - DNA, 17 bp, Homo sapiens
tgagtgtgacagggcca

SEQ ID NO: 1125755 - DNA, 22 bp, Homo sapiens
tgagtgtgagagatggggcggg

SEQ ID NO: 1125756 - DNA, 18 bp, Homo sapiens
tgagtgtgagtgtgagag

SEQ ID NO: 1125757 - DNA, 16 bp, Homo sapiens
tgagtgtgcatggagg

SEQ ID NO: 1125758 - DNA, 13 bp, Homo sapiens
tgagtgtggactt

SEQ ID NO: 1125759 - DNA, 16 bp, Homo sapiens
tgagtgtggctcccct

SEQ ID NO: 1125760 - DNA, 18 bp, Homo sapiens
tgagtgtggctcccctct

SEQ ID NO: 1125761 - DNA, 13 bp, Homo sapiens
tgagtgtgtgtgc

SEQ ID NO: 1125762 - DNA, 18 bp, Homo sapiens
tgagtgtgtgtgtgcatg

SEQ ID NO: 1125763 - DNA, 17 bp, Homo sapiens
tgagtgttcctttttaa

SEQ ID NO: 1125764 - DNA, 23 bp, Homo sapiens
tgagtgttcctttttaaatgtga

SEQ ID NO: 1125765 - DNA, 22 bp, Homo sapiens
tgagttacttagaatgccataa

SEQ ID NO: 1125766 - DNA, 15 bp, Homo sapiens
tgagttacttcctat

SEQ ID NO: 1125767 - DNA, 21 bp, Homo sapiens
tgagttacttgtctgaggcct

SEQ ID NO: 1125768 - DNA, 16 bp, Homo sapiens
tgagttatcatgaatt

SEQ ID NO: 1125769 - DNA, 21 bp, Homo sapiens
tgagttatcatgaattttaaa

SEQ ID NO: 1125770 - DNA, 16 bp, Homo sapiens
tgagttatctgatttt

SEQ ID NO: 1125771 - DNA, 19 bp, Homo sapiens
tgagttccagttgaagtta

SEQ ID NO: 1125772 - DNA, 15 bp, Homo sapiens
tgagttctccctgta

SEQ ID NO: 1125773 - DNA, 15 bp, Homo sapiens
tgagttcttcctgta

SEQ ID NO: 1125774 - DNA, 19 bp, Homo sapiens
tgagttgattcagctctgc

SEQ ID NO: 1125775 - DNA, 19 bp, Homo sapiens
tgagttgccaagacaaatc

SEQ ID NO: 1125776 - DNA, 23 bp, Homo sapiens
tgagttgccaagacaaatcaaca

SEQ ID NO: 1125777 - DNA, 24 bp, Homo sapiens
tgagttggccagattgtggggtgc

SEQ ID NO: 1125778 - DNA, 23 bp, Homo sapiens
tgagttgggggagggaagaccag

SEQ ID NO: 1125779 - DNA, 19 bp, Homo sapiens
tgagttggggtctggcagc

SEQ ID NO: 1125780 - DNA, 14 bp, Homo sapiens
tgagttgtgatgaa

SEQ ID NO: 1125781 - DNA, 23 bp, Homo sapiens
tgagttgttttcagactcagact

SEQ ID NO: 1125782 - DNA, 16 bp, Homo sapiens
tgagtttattctgatt

SEQ ID NO: 1125783 - DNA, 15 bp, Homo sapiens
tgagtttcactgtac

SEQ ID NO: 1125784 - DNA, 20 bp, Homo sapiens
tgagtttcactgtactgcat

SEQ ID NO: 1125785 - DNA, 16 bp, Homo sapiens
tgagtttgagctgcct

SEQ ID NO: 1125786 - DNA, 18 bp, Homo sapiens
tgagtttgagctgccttc

SEQ ID NO: 1125787 - DNA, 21 bp, Homo sapiens
tgagtttgagctgccttccct

SEQ ID NO: 1125788 - DNA, 20 bp, Homo sapiens
tgagtttgtcgctcatgtgt

SEQ ID NO: 1125789 - DNA, 14 bp, Homo sapiens
tgagttttctcctt

SEQ ID NO: 1125790 - DNA, 15 bp, Homo sapiens
tgagttttgatgctg

SEQ ID NO: 1125791 - DNA, 17 bp, Homo sapiens
tgagttttgatgctgta

SEQ ID NO: 1125792 - DNA, 18 bp, Homo sapiens
tgagtttttatggggctg

SEQ ID NO: 1125793 - DNA, 17 bp, Homo sapiens
tgagtttttcctcccag

SEQ ID NO: 1125794 - DNA, 13 bp, Homo sapiens
tgagtttttgata

SEQ ID NO: 1125795 - DNA, 19 bp, Homo sapiens
tgagtttttgatagcttta

SEQ ID NO: 1125796 - DNA, 14 bp, Homo sapiens
tgataaaactgggt

SEQ ID NO: 1125797 - DNA, 20 bp, Homo sapiens
tgataaaagttttgatattt

SEQ ID NO: 1125798 - DNA, 11 bp, Homo sapiens
tgataaaataa

SEQ ID NO: 1125799 - DNA, 18 bp, Homo sapiens
tgataaaattgtgatgtt

SEQ ID NO: 1125800 - DNA, 21 bp, Homo sapiens
tgataaacattaaacactgta

SEQ ID NO: 1125801 - DNA, 16 bp, Homo sapiens
tgataaagacttttat

SEQ ID NO: 1125802 - DNA, 18 bp, Homo sapiens
tgataaagattttttaat

SEQ ID NO: 1125803 - DNA, 19 bp, Homo sapiens
tgataaagattttttaata

SEQ ID NO: 1125804 - DNA, 20 bp, Homo sapiens
tgataaagattttttaataa

SEQ ID NO: 1125805 - DNA, 21 bp, Homo sapiens
tgataaagtaataatgtgcaa

SEQ ID NO: 1125806 - DNA, 18 bp, Homo sapiens
tgataaagtaattcatac

SEQ ID NO: 1125807 - DNA, 20 bp, Homo sapiens
tgataaagtaattcatacaa

SEQ ID NO: 1125808 - DNA, 16 bp, Homo sapiens
tgataaagtcccctta

SEQ ID NO: 1125809 - DNA, 15 bp, Homo sapiens
tgataaagttcctta

SEQ ID NO: 1125810 - DNA, 16 bp, Homo sapiens
tgataaagttgtaaat

SEQ ID NO: 1125811 - DNA, 15 bp, Homo sapiens
tgataaatcagtcaa

SEQ ID NO: 1125812 - DNA, 17 bp, Homo sapiens
tgataacaagcaaggat

SEQ ID NO: 1125813 - DNA, 13 bp, Homo sapiens
tgataacaccttg

SEQ ID NO: 1125814 - DNA, 17 bp, Homo sapiens
tgataacttggggaggc

SEQ ID NO: 1125815 - DNA, 19 bp, Homo sapiens
tgataacttggggaggcaa

SEQ ID NO: 1125816 - DNA, 20 bp, Homo sapiens
tgataagaacagagtgcctg

SEQ ID NO: 1125817 - DNA, 20 bp, Homo sapiens
tgataagaacccagggtgga

SEQ ID NO: 1125818 - DNA, 19 bp, Homo sapiens
tgataagaggaatttggta

SEQ ID NO: 1125819 - DNA, 13 bp, Homo sapiens
tgataagcacatt

SEQ ID NO: 1125820 - DNA, 19 bp, Homo sapiens
tgataaggaaactttattt

SEQ ID NO: 1125821 - DNA, 16 bp, Homo sapiens
tgataaggatcagaac

SEQ ID NO: 1125822 - DNA, 20 bp, Homo sapiens
tgataaggatcagaacagca

SEQ ID NO: 1125823 - DNA, 19 bp, Homo sapiens
tgataaggcctactataca

SEQ ID NO: 1125824 - DNA, 16 bp, Homo sapiens
tgataagggaaaagat

SEQ ID NO: 1125825 - DNA, 19 bp, Homo sapiens
tgataagggaaaagataaa

SEQ ID NO: 1125826 - DNA, 23 bp, Homo sapiens
tgataaggggccttgctctgagc

SEQ ID NO: 1125827 - DNA, 19 bp, Homo sapiens
tgataatacttgacctctg

SEQ ID NO: 1125828 - DNA, 23 bp, Homo sapiens
tgataataggtgggggaaaatga

SEQ ID NO: 1125829 - DNA, 22 bp, Homo sapiens
tgataatcaattattacattta

SEQ ID NO: 1125830 - DNA, 21 bp, Homo sapiens
tgataatctggtgacaaatat

SEQ ID NO: 1125831 - DNA, 15 bp, Homo sapiens
tgataatgaacagaa

SEQ ID NO: 1125832 - DNA, 16 bp, Homo sapiens
tgataatgaacagaac

SEQ ID NO: 1125833 - DNA, 23 bp, Homo sapiens
tgataatgatttgctctttgaca

SEQ ID NO: 1125834 - DNA, 22 bp, Homo sapiens
tgataatttcagggaaattaat

SEQ ID NO: 1125835 - DNA, 14 bp, Homo sapiens
tgataattttaaat

SEQ ID NO: 1125836 - DNA, 14 bp, Homo sapiens
tgataattttacaa

SEQ ID NO: 1125837 - DNA, 11 bp, Homo sapiens
tgatacaaacc

SEQ ID NO: 1125838 - DNA, 16 bp, Homo sapiens
tgatacaaaccactgt

SEQ ID NO: 1125839 - DNA, 14 bp, Homo sapiens
tgatacaacattaa

SEQ ID NO: 1125840 - DNA, 16 bp, Homo sapiens
tgatacaagattagaa

SEQ ID NO: 1125841 - DNA, 19 bp, Homo sapiens
tgatacacagtaattgtga

SEQ ID NO: 1125842 - DNA, 14 bp, Homo sapiens
tgatacagaactct

SEQ ID NO: 1125843 - DNA, 20 bp, Homo sapiens
tgatacattcaaatttgtct

SEQ ID NO: 1125844 - DNA, 13 bp, Homo sapiens
tgataccacctgc

SEQ ID NO: 1125845 - DNA, 17 bp, Homo sapiens
tgataccacctttactg

SEQ ID NO: 1125846 - DNA, 21 bp, Homo sapiens
tgataccagaagggaaagctt

SEQ ID NO: 1125847 - DNA, 16 bp, Homo sapiens
tgatacccaacagttt

SEQ ID NO: 1125848 - DNA, 13 bp, Homo sapiens
tgatacccagagc

SEQ ID NO: 1125849 - DNA, 21 bp, Homo sapiens
tgatacccatagcttccatga

SEQ ID NO: 1125850 - DNA, 15 bp, Homo sapiens
tgatacccccctctg

SEQ ID NO: 1125851 - DNA, 19 bp, Homo sapiens
tgatacccccctctgtctt

SEQ ID NO: 1125852 - DNA, 18 bp, Homo sapiens
tgataccttcatttaata

SEQ ID NO: 1125853 - DNA, 15 bp, Homo sapiens
tgatacgatgcttca

SEQ ID NO: 1125854 - DNA, 17 bp, Homo sapiens
tgatactagcatactta

SEQ ID NO: 1125855 - DNA, 14 bp, Homo sapiens
tgatactgatgcca

SEQ ID NO: 1125856 - DNA, 23 bp, Homo sapiens
tgatactgtttcttgcactgaat

SEQ ID NO: 1125857 - DNA, 15 bp, Homo sapiens
tgatacttcaggtgc

SEQ ID NO: 1125858 - DNA, 16 bp, Homo sapiens
tgatacttcaggtgct

SEQ ID NO: 1125859 - DNA, 17 bp, Homo sapiens
tgatacttcaggtgctt

SEQ ID NO: 1125860 - DNA, 16 bp, Homo sapiens
tgatacttcatttaaa

SEQ ID NO: 1125861 - DNA, 19 bp, Homo sapiens
tgatacttgttccagatgg

SEQ ID NO: 1125862 - DNA, 19 bp, Homo sapiens
tgatactttagccatcata

SEQ ID NO: 1125863 - DNA, 21 bp, Homo sapiens
tgatagaatgatgttttaaaa

SEQ ID NO: 1125864 - DNA, 14 bp, Homo sapiens
tgatggacctgccc

SEQ ID NO: 1125865 - DNA, 17 bp, Homo sapiens
tgatggagaggacagag

SEQ ID NO: 1125866 - DNA, 14 bp, Homo sapiens
tgatggaggaaaaa

SEQ ID NO: 1125867 - DNA, 20 bp, Homo sapiens
tgatggagggtggaaataat

SEQ ID NO: 1125868 - DNA, 23 bp, Homo sapiens
tgatggagtgtgcagacagccat

SEQ ID NO: 1125869 - DNA, 15 bp, Homo sapiens
tgatggatggcacaa

SEQ ID NO: 1125870 - DNA, 22 bp, Homo sapiens
tgatggatgtcttctagctgca

SEQ ID NO: 1125871 - DNA, 15 bp, Homo sapiens
tgatggcaattttgt

SEQ ID NO: 1125872 - DNA, 20 bp, Homo sapiens
tgatggcagccatagtgcat

SEQ ID NO: 1125873 - DNA, 15 bp, Homo sapiens
tgatggccaagagca

SEQ ID NO: 1125874 - DNA, 17 bp, Homo sapiens
tgatggccaagagcatc

SEQ ID NO: 1125875 - DNA, 17 bp, Homo sapiens
tgatggcctttggaccc

SEQ ID NO: 1125876 - DNA, 23 bp, Homo sapiens
tgatggcctttggacccagggcc

SEQ ID NO: 1125877 - DNA, 18 bp, Homo sapiens
tgatggctatgccttgca

SEQ ID NO: 1125878 - DNA, 18 bp, Homo sapiens
tgatggctcaagacaagg

SEQ ID NO: 1125879 - DNA, 15 bp, Homo sapiens
tgatgggaaaatatt

SEQ ID NO: 1125880 - DNA, 19 bp, Homo sapiens
tgatgggaaaatatttcct

SEQ ID NO: 1125881 - DNA, 23 bp, Homo sapiens
tgatgggaaggaggggagccttt

SEQ ID NO: 1125882 - DNA, 18 bp, Homo sapiens
tgatgggcagatcttttc

SEQ ID NO: 1125883 - DNA, 22 bp, Homo sapiens
tgatgggcagcctgctggtcag

SEQ ID NO: 1125884 - DNA, 14 bp, Homo sapiens
tgatgggctggggc

SEQ ID NO: 1125885 - DNA, 21 bp, Homo sapiens
tgatgggctggggcaggggcc

SEQ ID NO: 1125886 - DNA, 14 bp, Homo sapiens
tgatgggcttctgt

SEQ ID NO: 1125887 - DNA, 22 bp, Homo sapiens
tgatgggcttctgttctctgct

SEQ ID NO: 1125888 - DNA, 23 bp, Homo sapiens
tgatgggcttctgttctctgctg

SEQ ID NO: 1125889 - DNA, 13 bp, Homo sapiens
tgatggggagaaa

SEQ ID NO: 1125890 - DNA, 20 bp, Homo sapiens
tgatggggtccagagagcct

SEQ ID NO: 1125891 - DNA, 13 bp, Homo sapiens
tgatggtgagctg

SEQ ID NO: 1125892 - DNA, 16 bp, Homo sapiens
tgatggtgagctggga

SEQ ID NO: 1125893 - DNA, 22 bp, Homo sapiens
tgatggtgtcattctgcctgct

SEQ ID NO: 1125894 - DNA, 23 bp, Homo sapiens
tgatggtgttaaagctgtacacc

SEQ ID NO: 1125895 - DNA, 22 bp, Homo sapiens
tgatggtgttttggggatgaga

SEQ ID NO: 1125896 - DNA, 18 bp, Homo sapiens
tgatggttttgctccccc

SEQ ID NO: 1125897 - DNA, 15 bp, Homo sapiens
tgatgtaaatagtga

SEQ ID NO: 1125898 - DNA, 19 bp, Homo sapiens
tgatgtaagtttacctatg

SEQ ID NO: 1125899 - DNA, 22 bp, Homo sapiens
tgatgtaatctctctgcagctg

SEQ ID NO: 1125900 - DNA, 23 bp, Homo sapiens
tgatgtaatctctctgcagctgc

SEQ ID NO: 1125901 - DNA, 11 bp, Homo sapiens
tgatgtacaga

SEQ ID NO: 1125902 - DNA, 22 bp, Homo sapiens
tgatgtacagaacacaaatgtc

SEQ ID NO: 1125903 - DNA, 23 bp, Homo sapiens
tgatgtacagaacacaaatgtct

SEQ ID NO: 1125904 - DNA, 18 bp, Homo sapiens
tgatgtaccatgaaacaa

SEQ ID NO: 1125905 - DNA, 18 bp, Homo sapiens
tgatgtagtgcctctttc

SEQ ID NO: 1125906 - DNA, 15 bp, Homo sapiens
tgatgtatatgttta

SEQ ID NO: 1125907 - DNA, 23 bp, Homo sapiens
tgatgtatatttaattaaagcac

SEQ ID NO: 1125908 - DNA, 18 bp, Homo sapiens
tgatgtatctgagttgcc

SEQ ID NO: 1125909 - DNA, 11 bp, Homo sapiens
tgatgtatgtg

SEQ ID NO: 1125910 - DNA, 15 bp, Homo sapiens
tgatgtattttcata

SEQ ID NO: 1125911 - DNA, 17 bp, Homo sapiens
tgatgtcaatttctgtg

SEQ ID NO: 1125912 - DNA, 18 bp, Homo sapiens
tgatgtcaatttctgtgt

SEQ ID NO: 1125913 - DNA, 22 bp, Homo sapiens
tgatgtcataataaagttgttt

SEQ ID NO: 1125914 - DNA, 21 bp, Homo sapiens
tgatgtcatgtacttcctgtg

SEQ ID NO: 1125915 - DNA, 14 bp, Homo sapiens
tgatgtcccagtgc

SEQ ID NO: 1125916 - DNA, 18 bp, Homo sapiens
tgatgtgaagagtttcac

SEQ ID NO: 1125917 - DNA, 19 bp, Homo sapiens
tgatgtgaagagtttcaca

SEQ ID NO: 1125918 - DNA, 20 bp, Homo sapiens
tgatgtgaagagtttcacaa

SEQ ID NO: 1125919 - DNA, 20 bp, Homo sapiens
tgatgtgaagataatttgca

SEQ ID NO: 1125920 - DNA, 14 bp, Homo sapiens
tgatgtgaagccaa

SEQ ID NO: 1125921 - DNA, 21 bp, Homo sapiens
tgatgtgacattccatgacga

SEQ ID NO: 1125922 - DNA, 12 bp, Homo sapiens
tgatgtgcctgt

SEQ ID NO: 1125923 - DNA, 12 bp, Homo sapiens
tgatgtggactg

SEQ ID NO: 1125924 - DNA, 16 bp, Homo sapiens
tgatgtggactgtctt

SEQ ID NO: 1125925 - DNA, 18 bp, Homo sapiens
tgatgtggaggaagagcc

SEQ ID NO: 1125926 - DNA, 16 bp, Homo sapiens
tgatgtgtgagtgtaa

SEQ ID NO: 1125927 - DNA, 16 bp, Homo sapiens
tgatgtgttatctctt

SEQ ID NO: 1125928 - DNA, 14 bp, Homo sapiens
tgatgttaaaattc

SEQ ID NO: 1125929 - DNA, 10 bp, Homo sapiens
tgatgttaac

SEQ ID NO: 1125930 - DNA, 12 bp, Homo sapiens
tgatgttaacaa

SEQ ID NO: 1125931 - DNA, 22 bp, Homo sapiens
tgatgttaaccagaataaagtt

SEQ ID NO: 1125932 - DNA, 21 bp, Homo sapiens
tgatgttaacccattccagta

SEQ ID NO: 1125933 - DNA, 14 bp, Homo sapiens
tgatgttactgaga

SEQ ID NO: 1125934 - DNA, 21 bp, Homo sapiens
tgatgttagaagaagaggaag

SEQ ID NO: 1125935 - DNA, 16 bp, Homo sapiens
tgatgttcagagtggc

SEQ ID NO: 1125936 - DNA, 16 bp, Homo sapiens
tgatgttccacctgcc

SEQ ID NO: 1125937 - DNA, 19 bp, Homo sapiens
tgatgttccacctgccaca

SEQ ID NO: 1125938 - DNA, 14 bp, Homo sapiens
tgatgttgaaatat

SEQ ID NO: 1125939 - DNA, 16 bp, Homo sapiens
tgatgttgaaatatgc

SEQ ID NO: 1125940 - DNA, 17 bp, Homo sapiens
tgatgttgagggaacag

SEQ ID NO: 1125941 - DNA, 11 bp, Homo sapiens
tgatgtttaca

SEQ ID NO: 1125942 - DNA, 13 bp, Homo sapiens
tgatgtttacaat

SEQ ID NO: 1125943 - DNA, 17 bp, Homo sapiens
tgatgtttataaactga

SEQ ID NO: 1125944 - DNA, 19 bp, Homo sapiens
tgatgtttataaactgaga

SEQ ID NO: 1125945 - DNA, 13 bp, Homo sapiens
tgatgtttcattt

SEQ ID NO: 1125946 - DNA, 11 bp, Homo sapiens
tgatgtttgtg

SEQ ID NO: 1125947 - DNA, 19 bp, Homo sapiens
tgatgtttgtggcctcaga

SEQ ID NO: 1125948 - DNA, 20 bp, Homo sapiens
tgatgtttgtgtgttttgta

SEQ ID NO: 1125949 - DNA, 17 bp, Homo sapiens
tgatgttttacgtgcaa

SEQ ID NO: 1125950 - DNA, 18 bp, Homo sapiens
tgatgttttcctataata

SEQ ID NO: 1125951 - DNA, 17 bp, Homo sapiens
tgatgttttgatattta

SEQ ID NO: 1125952 - DNA, 15 bp, Homo sapiens
tgatgtttttaaagg

SEQ ID NO: 1125953 - DNA, 20 bp, Homo sapiens
tgattaaaaataccttctat

SEQ ID NO: 1125954 - DNA, 13 bp, Homo sapiens
tgattaaaaatgt

SEQ ID NO: 1125955 - DNA, 23 bp, Homo sapiens
tgattaaaacacacataaaccaa

SEQ ID NO: 1125956 - DNA, 20 bp, Homo sapiens
tgattaaagtgctcacgtta

SEQ ID NO: 1125957 - DNA, 18 bp, Homo sapiens
tgattaaatatttgaaga

SEQ ID NO: 1125958 - DNA, 19 bp, Homo sapiens
tgattaaatgtctgacaca

SEQ ID NO: 1125959 - DNA, 13 bp, Homo sapiens
tgattaacatttg

SEQ ID NO: 1125960 - DNA, 14 bp, Homo sapiens
tgattaatgtttct

SEQ ID NO: 1125961 - DNA, 17 bp, Homo sapiens
tgattaatgttttcatt

SEQ ID NO: 1125962 - DNA, 13 bp, Homo sapiens
tgattaatttgag

SEQ ID NO: 1125963 - DNA, 17 bp, Homo sapiens
tgattacaaataaacag

SEQ ID NO: 1125964 - DNA, 22 bp, Homo sapiens
tgattacaaataaacagttgtt

SEQ ID NO: 1125965 - DNA, 13 bp, Homo sapiens
tgattacacagtt

SEQ ID NO: 1125966 - DNA, 14 bp, Homo sapiens
tgattacacagttg

SEQ ID NO: 1125967 - DNA, 16 bp, Homo sapiens
tgattacctgctgcat

SEQ ID NO: 1125968 - DNA, 21 bp, Homo sapiens
tgattacctgctgcatgaaaa

SEQ ID NO: 1125969 - DNA, 19 bp, Homo sapiens
tgattacgtgtatgtttct

SEQ ID NO: 1125970 - DNA, 20 bp, Homo sapiens
tgattacgtgtatgtttctt

SEQ ID NO: 1125971 - DNA, 16 bp, Homo sapiens
tgattactctttgaga

SEQ ID NO: 1125972 - DNA, 21 bp, Homo sapiens
tgattactggcctttttcatt

SEQ ID NO: 1125973 - DNA, 15 bp, Homo sapiens
tgattactgtcaata

SEQ ID NO: 1125974 - DNA, 18 bp, Homo sapiens
tgattactgtcaataaac

SEQ ID NO: 1125975 - DNA, 16 bp, Homo sapiens
tgattactttaaaata

SEQ ID NO: 1125976 - DNA, 20 bp, Homo sapiens
tgattagaaaataaactcat

SEQ ID NO: 1125977 - DNA, 15 bp, Homo sapiens
tgattagacagaaca

SEQ ID NO: 1125978 - DNA, 16 bp, Homo sapiens
tgattagacagaacac

SEQ ID NO: 1125979 - DNA, 13 bp, Homo sapiens
tgattagatcaca

SEQ ID NO: 1125980 - DNA, 13 bp, Homo sapiens
tgattagttgaaa

SEQ ID NO: 1125981 - DNA, 15 bp, Homo sapiens
tgattagttgaaagg

SEQ ID NO: 1125982 - DNA, 13 bp, Homo sapiens
tgattataaatgt

SEQ ID NO: 1125983 - DNA, 15 bp, Homo sapiens
tgattataccatgtg

SEQ ID NO: 1125984 - DNA, 14 bp, Homo sapiens
tgattatattcaca

SEQ ID NO: 1125985 - DNA, 21 bp, Homo sapiens
tgattattacttctgtttctc

SEQ ID NO: 1125986 - DNA, 21 bp, Homo sapiens
tgcacaataaaaatgtttaac

SEQ ID NO: 1125987 - DNA, 17 bp, Homo sapiens
tgcacaattttgataaa

SEQ ID NO: 1125988 - DNA, 18 bp, Homo sapiens
tgcacacaaatattattt

SEQ ID NO: 1125989 - DNA, 12 bp, Homo sapiens
tgcacacacagc

SEQ ID NO: 1125990 - DNA, 16 bp, Homo sapiens
tgcacacacagctcct

SEQ ID NO: 1125991 - DNA, 17 bp, Homo sapiens
tgcacacacagctcctc

SEQ ID NO: 1125992 - DNA, 13 bp, Homo sapiens
tgcacacacatat

SEQ ID NO: 1125993 - DNA, 15 bp, Homo sapiens
tgcacacacatatat

SEQ ID NO: 1125994 - DNA, 22 bp, Homo sapiens
tgcacacacggttttggcagct

SEQ ID NO: 1125995 - DNA, 14 bp, Homo sapiens
tgcacacagaatgc

SEQ ID NO: 1125996 - DNA, 17 bp, Homo sapiens
tgcacacagacggccta

SEQ ID NO: 1125997 - DNA, 19 bp, Homo sapiens
tgcacacagacggcctagg

SEQ ID NO: 1125998 - DNA, 12 bp, Homo sapiens
tgcacacaggac

SEQ ID NO: 1125999 - DNA, 16 bp, Homo sapiens
tgcacacaggacagcg

SEQ ID NO: 1126000 - DNA, 15 bp, Homo sapiens
tgcacacagggcagt

SEQ ID NO: 1126001 - DNA, 19 bp, Homo sapiens
tgcacacatcaccaggtgc

SEQ ID NO: 1126002 - DNA, 13 bp, Homo sapiens
tgcacacccactg

SEQ ID NO: 1126003 - DNA, 17 bp, Homo sapiens
tgcacacccactgcccc

SEQ ID NO: 1126004 - DNA, 22 bp, Homo sapiens
tgcacacctactagtcaccaga

SEQ ID NO: 1126005 - DNA, 18 bp, Homo sapiens
tgcacacggctggtcact

SEQ ID NO: 1126006 - DNA, 20 bp, Homo sapiens
tgcacacggctggtcactct

SEQ ID NO: 1126007 - DNA, 21 bp, Homo sapiens
tgcacacggctggtcactctg

SEQ ID NO: 1126008 - DNA, 16 bp, Homo sapiens
tgcacacttctgacct

SEQ ID NO: 1126009 - DNA, 23 bp, Homo sapiens
tgcacacttctgaccttgctgcc

SEQ ID NO: 1126010 - DNA, 13 bp, Homo sapiens
tgcacagaaaacc

SEQ ID NO: 1126011 - DNA, 21 bp, Homo sapiens
tgcacagaaacttgaactcca

SEQ ID NO: 1126012 - DNA, 16 bp, Homo sapiens
tgcacagaagggctct

SEQ ID NO: 1126013 - DNA, 18 bp, Homo sapiens
tgcacagaagggctcttt

SEQ ID NO: 1126014 - DNA, 13 bp, Homo sapiens
tgcacagagaagc

SEQ ID NO: 1126015 - DNA, 17 bp, Homo sapiens
tgcacagagaagctggg

SEQ ID NO: 1126016 - DNA, 12 bp, Homo sapiens
tgcacagagggt

SEQ ID NO: 1126017 - DNA, 21 bp, Homo sapiens
tgcacagagttgttacatttt

SEQ ID NO: 1126018 - DNA, 23 bp, Homo sapiens
tgcacagatggatttgcctgtgc

SEQ ID NO: 1126019 - DNA, 22 bp, Homo sapiens
tgcacagattgctgaaactgtg

SEQ ID NO: 1126020 - DNA, 22 bp, Homo sapiens
tgcacagcacaaattagttata

SEQ ID NO: 1126021 - DNA, 21 bp, Homo sapiens
tgcacagcagcaattgtttta

SEQ ID NO: 1126022 - DNA, 20 bp, Homo sapiens
tgcacagccaacgagacaca

SEQ ID NO: 1126023 - DNA, 21 bp, Homo sapiens
tgcacagccaacgagacacat

SEQ ID NO: 1126024 - DNA, 18 bp, Homo sapiens
tgcacagcggcccctgca

SEQ ID NO: 1126025 - DNA, 12 bp, Homo sapiens
tgcacagcgtgg

SEQ ID NO: 1126026 - DNA, 12 bp, Homo sapiens
tgcacagctgct

SEQ ID NO: 1126027 - DNA, 15 bp, Homo sapiens
tgcacagctgcttgt

SEQ ID NO: 1126028 - DNA, 18 bp, Homo sapiens
tgcacagctgcttgtcct

SEQ ID NO: 1126029 - DNA, 18 bp, Homo sapiens
tgcacaggatgctggcct

SEQ ID NO: 1126030 - DNA, 20 bp, Homo sapiens
tgcacaggcacacagggccc

SEQ ID NO: 1126031 - DNA, 23 bp, Homo sapiens
tgcacaggggaaggaaataacat

SEQ ID NO: 1126032 - DNA, 19 bp, Homo sapiens
tgcacagggtccccgagtg

SEQ ID NO: 1126033 - DNA, 19 bp, Homo sapiens
tgcacaggtggctgtttct

SEQ ID NO: 1126034 - DNA, 18 bp, Homo sapiens
tgcacagtaggatgtgga

SEQ ID NO: 1126035 - DNA, 16 bp, Homo sapiens
tgcacagtatttgtaa

SEQ ID NO: 1126036 - DNA, 18 bp, Homo sapiens
tgcacagtatttgtaatt

SEQ ID NO: 1126037 - DNA, 19 bp, Homo sapiens
tgcacagtatttgtaatta

SEQ ID NO: 1126038 - DNA, 16 bp, Homo sapiens
tgcacagtcaaaacga

SEQ ID NO: 1126039 - DNA, 19 bp, Homo sapiens
tgcacagtgacttctgaga

SEQ ID NO: 1126040 - DNA, 20 bp, Homo sapiens
tgcacagtgacttctgagat

SEQ ID NO: 1126041 - DNA, 21 bp, Homo sapiens
tgcacagtgacttctgagatc

SEQ ID NO: 1126042 - DNA, 19 bp, Homo sapiens
tgcacagtgatttttttct

SEQ ID NO: 1126043 - DNA, 15 bp, Homo sapiens
tgcacagtgcatctc

SEQ ID NO: 1126044 - DNA, 15 bp, Homo sapiens
tgcacagtggcttct

SEQ ID NO: 1126045 - DNA, 16 bp, Homo sapiens
tgcacagtgtgtgact

SEQ ID NO: 1126046 - DNA, 18 bp, Homo sapiens
tgcacagtttagaacaga

SEQ ID NO: 1126047 - DNA, 20 bp, Homo sapiens
tgcacagtttagaacagagg

SEQ ID NO: 1126048 - DNA, 20 bp, Homo sapiens
tgcacatacgggctttaata

SEQ ID NO: 1126049 - DNA, 23 bp, Homo sapiens
tgcacatagttctgcccaaatta

SEQ ID NO: 1126050 - DNA, 15 bp, Homo sapiens
tgcacatctgtgtct

SEQ ID NO: 1126051 - DNA, 16 bp, Homo sapiens
tgcacatctgtgtctt

SEQ ID NO: 1126052 - DNA, 19 bp, Homo sapiens
tgcacatctgtgtcttgtt

SEQ ID NO: 1126053 - DNA, 14 bp, Homo sapiens
tgcacatgaaagtt

SEQ ID NO: 1126054 - DNA, 17 bp, Homo sapiens
tgcacatggattcagtt

SEQ ID NO: 1126055 - DNA, 13 bp, Homo sapiens
tgcacatgtttcc

SEQ ID NO: 1126056 - DNA, 14 bp, Homo sapiens
tgcacatgtttcct

SEQ ID NO: 1126057 - DNA, 18 bp, Homo sapiens
tgcacattcctggccccg

SEQ ID NO: 1126058 - DNA, 21 bp, Homo sapiens
tgcacattgcctgttctgctt

SEQ ID NO: 1126059 - DNA, 23 bp, Homo sapiens
tgcacattgcctgttctgcttcg

SEQ ID NO: 1126060 - DNA, 12 bp, Homo sapiens
tgcacattgttc

SEQ ID NO: 1126061 - DNA, 17 bp, Homo sapiens
tgcacattgttgttttt

SEQ ID NO: 1126062 - DNA, 22 bp, Homo sapiens
tgcacatttatatatatatgta

SEQ ID NO: 1126063 - DNA, 12 bp, Homo sapiens
tgcacatttctg

SEQ ID NO: 1126064 - DNA, 13 bp, Homo sapiens
tgcacatttctgg

SEQ ID NO: 1126065 - DNA, 20 bp, Homo sapiens
tgcacattttccacggaaac

SEQ ID NO: 1126066 - DNA, 11 bp, Homo sapiens
tgcaccaaaga

SEQ ID NO: 1126067 - DNA, 13 bp, Homo sapiens
tgcaccaaagaca

SEQ ID NO: 1126068 - DNA, 17 bp, Homo sapiens
tgcaccaactcacctgg

SEQ ID NO: 1126069 - DNA, 15 bp, Homo sapiens
tgcaccaagaaagct

SEQ ID NO: 1126070 - DNA, 14 bp, Homo sapiens
tgcaccaagcagga

SEQ ID NO: 1126071 - DNA, 22 bp, Homo sapiens
tgcaccaagcaggaaatgaaaa

SEQ ID NO: 1126072 - DNA, 16 bp, Homo sapiens
tgcaccaccaagccaa

SEQ ID NO: 1126073 - DNA, 22 bp, Homo sapiens
tgcaccacggcgtttttttaca

SEQ ID NO: 1126074 - DNA, 21 bp, Homo sapiens
tgcaccactgcactccagcct

SEQ ID NO: 1126075 - DNA, 21 bp, Homo sapiens
tgcaccagagcaacctctcac

SEQ ID NO: 1126076 - DNA, 12 bp, Homo sapiens
tgcaccagagtg

SEQ ID NO: 1126077 - DNA, 18 bp, Homo sapiens
tgcaccagcgcccccaga

SEQ ID NO: 1126078 - DNA, 16 bp, Homo sapiens
tgcaccatcccttttt

SEQ ID NO: 1126079 - DNA, 23 bp, Homo sapiens
tgcaccatccctttttgaagtgt

SEQ ID NO: 1126080 - DNA, 15 bp, Homo sapiens
tgcaccatctgcttg

SEQ ID NO: 1126081 - DNA, 15 bp, Homo sapiens
tgcaccatggagacg

SEQ ID NO: 1126082 - DNA, 18 bp, Homo sapiens
tgcacccacccaggagtg

SEQ ID NO: 1126083 - DNA, 22 bp, Homo sapiens
tgcacccacctgttttctgaaa

SEQ ID NO: 1126084 - DNA, 14 bp, Homo sapiens
tgcacccagaacag

SEQ ID NO: 1126085 - DNA, 12 bp, Homo sapiens
tgcacccagctc

SEQ ID NO: 1126086 - DNA, 16 bp, Homo sapiens
tgcacccagctccagg

SEQ ID NO: 1126087 - DNA, 15 bp, Homo sapiens
tgcacccaggggtgg

SEQ ID NO: 1126088 - DNA, 19 bp, Homo sapiens
tgcaccccaaagctttcct

SEQ ID NO: 1126089 - DNA, 20 bp, Homo sapiens
tgcaccccaaagctttcctg

SEQ ID NO: 1126090 - DNA, 21 bp, Homo sapiens
tgcaccccaaagctttcctgc

SEQ ID NO: 1126091 - DNA, 23 bp, Homo sapiens
tgcaccccaaagctttcctgccc

SEQ ID NO: 1126092 - DNA, 20 bp, Homo sapiens
tgcaccccagcattccagct

SEQ ID NO: 1126093 - DNA, 23 bp, Homo sapiens
tgcaccccagcattccagctctg

SEQ ID NO: 1126094 - DNA, 19 bp, Homo sapiens
tgcaccccagcgtcaggcc

SEQ ID NO: 1126095 - DNA, 12 bp, Homo sapiens
tgcacccctccc

SEQ ID NO: 1126096 - DNA, 16 bp, Homo sapiens
tgcacccctgggccag

SEQ ID NO: 1126097 - DNA, 19 bp, Homo sapiens
tgcaccccttctctcctcc

SEQ ID NO: 1126098 - DNA, 16 bp, Homo sapiens
tgcacccctttcctcc

SEQ ID NO: 1126099 - DNA, 14 bp, Homo sapiens
tgcacccgcctctc

SEQ ID NO: 1126100 - DNA, 16 bp, Homo sapiens
tgcaccctccaccctg

SEQ ID NO: 1126101 - DNA, 17 bp, Homo sapiens
tgcaccctccaccctgt

SEQ ID NO: 1126102 - DNA, 14 bp, Homo sapiens
tgcaccctccgcct

SEQ ID NO: 1126103 - DNA, 22 bp, Homo sapiens
tgcaccctggggcctggacctg

SEQ ID NO: 1126104 - DNA, 18 bp, Homo sapiens
tgcacccttcttttctca

SEQ ID NO: 1126105 - DNA, 17 bp, Homo sapiens
tgcaccgacccgaggcc

SEQ ID NO: 1126106 - DNA, 21 bp, Homo sapiens
tgcaccgacccgaggcccaga

SEQ ID NO: 1126107 - DNA, 19 bp, Homo sapiens
tgcaccgccgcagaagcag

SEQ ID NO: 1126108 - DNA, 17 bp, Homo sapiens
tgcagtacatacgtctg

SEQ ID NO: 1126109 - DNA, 19 bp, Homo sapiens
tgcagtagagtcatctcca

SEQ ID NO: 1126110 - DNA, 16 bp, Homo sapiens
tgcagtaggggaggag

SEQ ID NO: 1126111 - DNA, 18 bp, Homo sapiens
tgcagtaggggaggagca

SEQ ID NO: 1126112 - DNA, 13 bp, Homo sapiens
tgcagtatatttc

SEQ ID NO: 1126113 - DNA, 21 bp, Homo sapiens
tgcagtatcatgccctgtgca

SEQ ID NO: 1126114 - DNA, 17 bp, Homo sapiens
tgcagtatggtgtggtg

SEQ ID NO: 1126115 - DNA, 17 bp, Homo sapiens
tgcagtcactggaggtt

SEQ ID NO: 1126116 - DNA, 23 bp, Homo sapiens
tgcagtcagcagatgctgttgtg

SEQ ID NO: 1126117 - DNA, 23 bp, Homo sapiens
tgcagtcatttgtggttagaatc

SEQ ID NO: 1126118 - DNA, 15 bp, Homo sapiens
tgcagtcctgaggag

SEQ ID NO: 1126119 - DNA, 15 bp, Homo sapiens
tgcagtcggcatgcc

SEQ ID NO: 1126120 - DNA, 18 bp, Homo sapiens
tgcagtcggcatgccagg

SEQ ID NO: 1126121 - DNA, 20 bp, Homo sapiens
tgcagtcggcatgccaggac

SEQ ID NO: 1126122 - DNA, 14 bp, Homo sapiens
tgcagtgagcaggg

SEQ ID NO: 1126123 - DNA, 14 bp, Homo sapiens
tgcagtgagccgag

SEQ ID NO: 1126124 - DNA, 13 bp, Homo sapiens
tgcagtgagctga

SEQ ID NO: 1126125 - DNA, 22 bp, Homo sapiens
tgcagtgatacatgtactccag

SEQ ID NO: 1126126 - DNA, 23 bp, Homo sapiens
tgcagtggagaagacattctggt

SEQ ID NO: 1126127 - DNA, 13 bp, Homo sapiens
tgcagtggcacaa

SEQ ID NO: 1126128 - DNA, 18 bp, Homo sapiens
tgcagtggcgtgatcttg

SEQ ID NO: 1126129 - DNA, 17 bp, Homo sapiens
tgcagtggcttttcatg

SEQ ID NO: 1126130 - DNA, 18 bp, Homo sapiens
tgcagtggtgcaatcaca

SEQ ID NO: 1126131 - DNA, 16 bp, Homo sapiens
tgcagtggtgtgaaac

SEQ ID NO: 1126132 - DNA, 15 bp, Homo sapiens
tgcagtgtagatttt

SEQ ID NO: 1126133 - DNA, 23 bp, Homo sapiens
tgcagttaacaggatattagaca

SEQ ID NO: 1126134 - DNA, 16 bp, Homo sapiens
tgcagttacttgaata

SEQ ID NO: 1126135 - DNA, 15 bp, Homo sapiens
tgcagttcattattt

SEQ ID NO: 1126136 - DNA, 21 bp, Homo sapiens
tgcagttcccacattaaagaa

SEQ ID NO: 1126137 - DNA, 20 bp, Homo sapiens
tgcagttggactctcaggga

SEQ ID NO: 1126138 - DNA, 12 bp, Homo sapiens
tgcagttgtgat

SEQ ID NO: 1126139 - DNA, 17 bp, Homo sapiens
tgcagttgtgatataaa

SEQ ID NO: 1126140 - DNA, 19 bp, Homo sapiens
tgcagtttaagagcagaac

SEQ ID NO: 1126141 - DNA, 17 bp, Homo sapiens
tgcagtttatcattcaa

SEQ ID NO: 1126142 - DNA, 12 bp, Homo sapiens
tgcagtttccaa

SEQ ID NO: 1126143 - DNA, 13 bp, Homo sapiens
tgcagtttcctgg

SEQ ID NO: 1126144 - DNA, 16 bp, Homo sapiens
tgcagtttcttttcac

SEQ ID NO: 1126145 - DNA, 17 bp, Homo sapiens
tgcagtttcttttcaca

SEQ ID NO: 1126146 - DNA, 15 bp, Homo sapiens
tgcagtttggccctg

SEQ ID NO: 1126147 - DNA, 16 bp, Homo sapiens
tgcagtttggccctgg

SEQ ID NO: 1126148 - DNA, 19 bp, Homo sapiens
tgcagtttggccctggagc

SEQ ID NO: 1126149 - DNA, 13 bp, Homo sapiens
tgcagttttgaca

SEQ ID NO: 1126150 - DNA, 15 bp, Homo sapiens
tgcagtttttcagga

SEQ ID NO: 1126151 - DNA, 18 bp, Homo sapiens
tgcagtttttcattttaa

SEQ ID NO: 1126152 - DNA, 16 bp, Homo sapiens
tgcataaaaaaatgat

SEQ ID NO: 1126153 - DNA, 18 bp, Homo sapiens
tgcataacaattcctcta

SEQ ID NO: 1126154 - DNA, 21 bp, Homo sapiens
tgcataagattaaaggaagga

SEQ ID NO: 1126155 - DNA, 22 bp, Homo sapiens
tgcataagattaaaggaaggaa

SEQ ID NO: 1126156 - DNA, 14 bp, Homo sapiens
tgcataagtgaaaa

SEQ ID NO: 1126157 - DNA, 18 bp, Homo sapiens
tgcataagtgaaaatctt

SEQ ID NO: 1126158 - DNA, 17 bp, Homo sapiens
tgcataagttaacttcc

SEQ ID NO: 1126159 - DNA, 19 bp, Homo sapiens
tgcataataagctaaagag

SEQ ID NO: 1126160 - DNA, 22 bp, Homo sapiens
tgcataataagctaaagaggct

SEQ ID NO: 1126161 - DNA, 17 bp, Homo sapiens
tgcataatgataaaata

SEQ ID NO: 1126162 - DNA, 18 bp, Homo sapiens
tgcataatgtttctggat

SEQ ID NO: 1126163 - DNA, 12 bp, Homo sapiens
tgcatacaataa

SEQ ID NO: 1126164 - DNA, 15 bp, Homo sapiens
tgcatacaataaaag

SEQ ID NO: 1126165 - DNA, 18 bp, Homo sapiens
tgcatacaataaaagagc

SEQ ID NO: 1126166 - DNA, 21 bp, Homo sapiens
tgcatacaataaaagagcttt

SEQ ID NO: 1126167 - DNA, 18 bp, Homo sapiens
tgcataccacttttgttc

SEQ ID NO: 1126168 - DNA, 20 bp, Homo sapiens
tgcatactcaaggtgagaat

SEQ ID NO: 1126169 - DNA, 17 bp, Homo sapiens
tgcatactgaaaatcca

SEQ ID NO: 1126170 - DNA, 18 bp, Homo sapiens
tgcatactgttgatacaa

SEQ ID NO: 1126171 - DNA, 20 bp, Homo sapiens
tgcatacttacctagtgaaa

SEQ ID NO: 1126172 - DNA, 19 bp, Homo sapiens
tgcatactttgacaaggaa

SEQ ID NO: 1126173 - DNA, 20 bp, Homo sapiens
tgcatactttgacaaggaaa

SEQ ID NO: 1126174 - DNA, 19 bp, Homo sapiens
tgcatagaggtaccagcaa

SEQ ID NO: 1126175 - DNA, 16 bp, Homo sapiens
tgcatagcagtatatg

SEQ ID NO: 1126176 - DNA, 16 bp, Homo sapiens
tgcatagcgtcctgcc

SEQ ID NO: 1126177 - DNA, 15 bp, Homo sapiens
tgcatagctctattt

SEQ ID NO: 1126178 - DNA, 17 bp, Homo sapiens
tgcatagctctccttcc

SEQ ID NO: 1126179 - DNA, 21 bp, Homo sapiens
tgcatagtaccaatcatttta

SEQ ID NO: 1126180 - DNA, 13 bp, Homo sapiens
tgcatagtgctgg

SEQ ID NO: 1126181 - DNA, 18 bp, Homo sapiens
tgcatataaaggttatga

SEQ ID NO: 1126182 - DNA, 22 bp, Homo sapiens
tgcatataaaggttatgaaaca

SEQ ID NO: 1126183 - DNA, 18 bp, Homo sapiens
tgcatataacttatattg

SEQ ID NO: 1126184 - DNA, 22 bp, Homo sapiens
tgcatataacttatattgtaag

SEQ ID NO: 1126185 - DNA, 13 bp, Homo sapiens
tgcatatcctgag

SEQ ID NO: 1126186 - DNA, 14 bp, Homo sapiens
tgcatatgagcctg

SEQ ID NO: 1126187 - DNA, 16 bp, Homo sapiens
tgcatatgtagataca

SEQ ID NO: 1126188 - DNA, 19 bp, Homo sapiens
tgcatatgttgaatacttt

SEQ ID NO: 1126189 - DNA, 13 bp, Homo sapiens
tgcatatgtttcg

SEQ ID NO: 1126190 - DNA, 23 bp, Homo sapiens
tgcatattataaaggataaagaa

SEQ ID NO: 1126191 - DNA, 13 bp, Homo sapiens
tgcatattctatt

SEQ ID NO: 1126192 - DNA, 15 bp, Homo sapiens
tgcatatttatccaa

SEQ ID NO: 1126193 - DNA, 13 bp, Homo sapiens
tgcatatttattt

SEQ ID NO: 1126194 - DNA, 15 bp, Homo sapiens
tgcatatttctgtat

SEQ ID NO: 1126195 - DNA, 18 bp, Homo sapiens
tgcatatttctgtatatt

SEQ ID NO: 1126196 - DNA, 24 bp, Homo sapiens
tgcatatttctgtatatttgtcat

SEQ ID NO: 1126197 - DNA, 19 bp, Homo sapiens
tgcatatttgcaaagtgta

SEQ ID NO: 1126198 - DNA, 13 bp, Homo sapiens
tgcatatttgcca

SEQ ID NO: 1126199 - DNA, 16 bp, Homo sapiens
tgcatatttgttactt

SEQ ID NO: 1126200 - DNA, 14 bp, Homo sapiens
tgcatcactgggtg

SEQ ID NO: 1126201 - DNA, 19 bp, Homo sapiens
tgcatcactgggtgttgat

SEQ ID NO: 1126202 - DNA, 17 bp, Homo sapiens
tgcatcagataacaact

SEQ ID NO: 1126203 - DNA, 23 bp, Homo sapiens
tgcatcagtgactgaattctgcc

SEQ ID NO: 1126204 - DNA, 19 bp, Homo sapiens
tgcatcatcttgaacatta

SEQ ID NO: 1126205 - DNA, 19 bp, Homo sapiens
tgcatcattactgttccag

SEQ ID NO: 1126206 - DNA, 16 bp, Homo sapiens
tgcatccaaaggtgct

SEQ ID NO: 1126207 - DNA, 18 bp, Homo sapiens
tgcatccaaaggtgctca

SEQ ID NO: 1126208 - DNA, 16 bp, Homo sapiens
tgcatccaactccagg

SEQ ID NO: 1126209 - DNA, 17 bp, Homo sapiens
tgcatccaactccagga

SEQ ID NO: 1126210 - DNA, 19 bp, Homo sapiens
tgcatccattcctcaggga

SEQ ID NO: 1126211 - DNA, 20 bp, Homo sapiens
tgcatccattcctcagggac

SEQ ID NO: 1126212 - DNA, 19 bp, Homo sapiens
tgcatccatttactgacac

SEQ ID NO: 1126213 - DNA, 20 bp, Homo sapiens
tgcatccatttactgacact

SEQ ID NO: 1126214 - DNA, 13 bp, Homo sapiens
tgcatccatttga

SEQ ID NO: 1126215 - DNA, 15 bp, Homo sapiens
tgcatcccccccacc

SEQ ID NO: 1126216 - DNA, 19 bp, Homo sapiens
tgcatccgtagttccctga

SEQ ID NO: 1126217 - DNA, 19 bp, Homo sapiens
tgcatcctcctcagccccc

SEQ ID NO: 1126218 - DNA, 20 bp, Homo sapiens
tgcatcctcctcagccccca

SEQ ID NO: 1126219 - DNA, 21 bp, Homo sapiens
tgcatcctcctcagcccccag

SEQ ID NO: 1126220 - DNA, 12 bp, Homo sapiens
tgcatcctgagg

SEQ ID NO: 1126221 - DNA, 14 bp, Homo sapiens
tgcatcctgaggcc

SEQ ID NO: 1126222 - DNA, 18 bp, Homo sapiens
tgcatcctgaggccagtg

SEQ ID NO: 1126223 - DNA, 22 bp, Homo sapiens
tgcatcctgaggccagtggccc

SEQ ID NO: 1126224 - DNA, 13 bp, Homo sapiens
tgcatcctgctgg

SEQ ID NO: 1126225 - DNA, 20 bp, Homo sapiens
tgcatccttaacctttatta

SEQ ID NO: 1126226 - DNA, 19 bp, Homo sapiens
tgcatccttgtaatacctg

SEQ ID NO: 1126227 - DNA, 20 bp, Homo sapiens
tgcatccttgtaatacctga

SEQ ID NO: 1126228 - DNA, 15 bp, Homo sapiens
tgcatcgggaaagaa

SEQ ID NO: 1126229 - DNA, 18 bp, Homo sapiens
tgcatcgggaaagaagaa

SEQ ID NO: 1126230 - DNA, 23 bp, Homo sapiens
tgccagcaaataaatacgtgtca

SEQ ID NO: 1126231 - DNA, 11 bp, Homo sapiens
tgccagcaact

SEQ ID NO: 1126232 - DNA, 13 bp, Homo sapiens
tgccagcaactga

SEQ ID NO: 1126233 - DNA, 14 bp, Homo sapiens
tgccagcacagggg

SEQ ID NO: 1126234 - DNA, 19 bp, Homo sapiens
tgccagcacaggggcccca

SEQ ID NO: 1126235 - DNA, 14 bp, Homo sapiens
tgccagcaccacag

SEQ ID NO: 1126236 - DNA, 18 bp, Homo sapiens
tgccagcagcagcaggtg

SEQ ID NO: 1126237 - DNA, 12 bp, Homo sapiens
tgccagcagcct

SEQ ID NO: 1126238 - DNA, 22 bp, Homo sapiens
tgccagcagcctcgcacaggcc

SEQ ID NO: 1126239 - DNA, 21 bp, Homo sapiens
tgccagcaggggggctgtgcc

SEQ ID NO: 1126240 - DNA, 15 bp, Homo sapiens
tgccagccagcagcc

SEQ ID NO: 1126241 - DNA, 16 bp, Homo sapiens
tgccagccagcagcca

SEQ ID NO: 1126242 - DNA, 22 bp, Homo sapiens
tgccagccagcagccagctctc

SEQ ID NO: 1126243 - DNA, 15 bp, Homo sapiens
tgccagcccggaggg

SEQ ID NO: 1126244 - DNA, 18 bp, Homo sapiens
tgccagccgaccctcctg

SEQ ID NO: 1126245 - DNA, 21 bp, Homo sapiens
tgccagccgaccctcctggcc

SEQ ID NO: 1126246 - DNA, 23 bp, Homo sapiens
tgccagccgaccctcctggcctt

SEQ ID NO: 1126247 - DNA, 19 bp, Homo sapiens
tgccagccgtgatgctcag

SEQ ID NO: 1126248 - DNA, 20 bp, Homo sapiens
tgccagccgtgatgctcagg

SEQ ID NO: 1126249 - DNA, 21 bp, Homo sapiens
tgccagccgtgatgctcaggc

SEQ ID NO: 1126250 - DNA, 13 bp, Homo sapiens
tgccagcctcctt

SEQ ID NO: 1126251 - DNA, 17 bp, Homo sapiens
tgccagcctgagcggag

SEQ ID NO: 1126252 - DNA, 15 bp, Homo sapiens
tgccagcctggcttc

SEQ ID NO: 1126253 - DNA, 18 bp, Homo sapiens
tgccagcctggcttctgg

SEQ ID NO: 1126254 - DNA, 23 bp, Homo sapiens
tgccagcctggcttctggagccc

SEQ ID NO: 1126255 - DNA, 18 bp, Homo sapiens
tgccagccttcctctgca

SEQ ID NO: 1126256 - DNA, 15 bp, Homo sapiens
tgccagctactcagg

SEQ ID NO: 1126257 - DNA, 19 bp, Homo sapiens
tgccagctacttcctcctc

SEQ ID NO: 1126258 - DNA, 21 bp, Homo sapiens
tgccagctgccttcctcatcc

SEQ ID NO: 1126259 - DNA, 12 bp, Homo sapiens
tgccagctggcc

SEQ ID NO: 1126260 - DNA, 15 bp, Homo sapiens
tgccagctggccttt

SEQ ID NO: 1126261 - DNA, 19 bp, Homo sapiens
tgccagctggcctttgtaa

SEQ ID NO: 1126262 - DNA, 13 bp, Homo sapiens
tgccagcttctct

SEQ ID NO: 1126263 - DNA, 19 bp, Homo sapiens
tgccagcttctctctccag

SEQ ID NO: 1126264 - DNA, 18 bp, Homo sapiens
tgccaggaaacaagggaa

SEQ ID NO: 1126265 - DNA, 22 bp, Homo sapiens
tgccaggaaaggagagtacttt

SEQ ID NO: 1126266 - DNA, 11 bp, Homo sapiens
tgccaggacaa

SEQ ID NO: 1126267 - DNA, 14 bp, Homo sapiens
tgccaggaccccag

SEQ ID NO: 1126268 - DNA, 23 bp, Homo sapiens
tgccaggacccgccagccccgct

SEQ ID NO: 1126269 - DNA, 16 bp, Homo sapiens
tgccaggactccccag

SEQ ID NO: 1126270 - DNA, 22 bp, Homo sapiens
tgccaggactccccaggccagg

SEQ ID NO: 1126271 - DNA, 16 bp, Homo sapiens
tgccaggagatggccc

SEQ ID NO: 1126272 - DNA, 16 bp, Homo sapiens
tgccaggaggcggcag

SEQ ID NO: 1126273 - DNA, 23 bp, Homo sapiens
tgccaggagggcacagcagggga

SEQ ID NO: 1126274 - DNA, 13 bp, Homo sapiens
tgccaggcacctg

SEQ ID NO: 1126275 - DNA, 14 bp, Homo sapiens
tgccaggcacctgg

SEQ ID NO: 1126276 - DNA, 19 bp, Homo sapiens
tgccaggcacctggcctgc

SEQ ID NO: 1126277 - DNA, 23 bp, Homo sapiens
tgccaggcactctcatcacccca

SEQ ID NO: 1126278 - DNA, 19 bp, Homo sapiens
tgccaggccagagggcagt

SEQ ID NO: 1126279 - DNA, 18 bp, Homo sapiens
tgccaggccagcctccga

SEQ ID NO: 1126280 - DNA, 21 bp, Homo sapiens
tgccaggcccatctcaggtgc

SEQ ID NO: 1126281 - DNA, 11 bp, Homo sapiens
tgccaggcccg

SEQ ID NO: 1126282 - DNA, 14 bp, Homo sapiens
tgccaggcccgggg

SEQ ID NO: 1126283 - DNA, 16 bp, Homo sapiens
tgccaggcggccctgg

SEQ ID NO: 1126284 - DNA, 21 bp, Homo sapiens
tgccaggcggccctggggagg

SEQ ID NO: 1126285 - DNA, 20 bp, Homo sapiens
tgccaggcgttggtgccact

SEQ ID NO: 1126286 - DNA, 19 bp, Homo sapiens
tgccaggctccctttctct

SEQ ID NO: 1126287 - DNA, 23 bp, Homo sapiens
tgccaggctccctttctcttctt

SEQ ID NO: 1126288 - DNA, 12 bp, Homo sapiens
tgccaggctggg

SEQ ID NO: 1126289 - DNA, 14 bp, Homo sapiens
tgccaggctgggca

SEQ ID NO: 1126290 - DNA, 21 bp, Homo sapiens
tgccaggctgtaagcattctg

SEQ ID NO: 1126291 - DNA, 16 bp, Homo sapiens
tgccaggctgtttcag

SEQ ID NO: 1126292 - DNA, 17 bp, Homo sapiens
tgccaggcttgcctggg

SEQ ID NO: 1126293 - DNA, 11 bp, Homo sapiens
tgccagggagc

SEQ ID NO: 1126294 - DNA, 15 bp, Homo sapiens
tgccagggcagggtc

SEQ ID NO: 1126295 - DNA, 19 bp, Homo sapiens
tgccagggcagggtctggg

SEQ ID NO: 1126296 - DNA, 22 bp, Homo sapiens
tgccagggcagggtctgggctg

SEQ ID NO: 1126297 - DNA, 12 bp, Homo sapiens
tgccagggcccg

SEQ ID NO: 1126298 - DNA, 18 bp, Homo sapiens
tgccaggggcatccaagg

SEQ ID NO: 1126299 - DNA, 18 bp, Homo sapiens
tgccagggtgggctgggg

SEQ ID NO: 1126300 - DNA, 14 bp, Homo sapiens
tgccaggtggctca

SEQ ID NO: 1126301 - DNA, 18 bp, Homo sapiens
tgccaggttaggaaggca

SEQ ID NO: 1126302 - DNA, 14 bp, Homo sapiens
tgccagtaaaaaaa

SEQ ID NO: 1126303 - DNA, 22 bp, Homo sapiens
tgccagtaacgcgtcttcctga

SEQ ID NO: 1126304 - DNA, 23 bp, Homo sapiens
tgccagtaacgcgtcttcctgag

SEQ ID NO: 1126305 - DNA, 14 bp, Homo sapiens
tgccagtcctgggg

SEQ ID NO: 1126306 - DNA, 15 bp, Homo sapiens
tgccagtgaagtcct

SEQ ID NO: 1126307 - DNA, 16 bp, Homo sapiens
tgccagtgacacttcc

SEQ ID NO: 1126308 - DNA, 19 bp, Homo sapiens
tgccagtgacagacaggct

SEQ ID NO: 1126309 - DNA, 14 bp, Homo sapiens
tgccagtgcagcca

SEQ ID NO: 1126310 - DNA, 15 bp, Homo sapiens
tgccagtgcagccac

SEQ ID NO: 1126311 - DNA, 14 bp, Homo sapiens
tgccagtgccaggg

SEQ ID NO: 1126312 - DNA, 16 bp, Homo sapiens
tgccagtgccagggtg

SEQ ID NO: 1126313 - DNA, 20 bp, Homo sapiens
tgccagtgccttacctcctg

SEQ ID NO: 1126314 - DNA, 23 bp, Homo sapiens
tgccagtgccttacctcctgccc

SEQ ID NO: 1126315 - DNA, 14 bp, Homo sapiens
tgccagtgctggtc

SEQ ID NO: 1126316 - DNA, 17 bp, Homo sapiens
tgccagttacttgcttt

SEQ ID NO: 1126317 - DNA, 21 bp, Homo sapiens
tgccagtttttaaaatgctgc

SEQ ID NO: 1126318 - DNA, 13 bp, Homo sapiens
tgccataaaacat

SEQ ID NO: 1126319 - DNA, 16 bp, Homo sapiens
tgccataaaacattaa

SEQ ID NO: 1126320 - DNA, 12 bp, Homo sapiens
tgccatactaat

SEQ ID NO: 1126321 - DNA, 18 bp, Homo sapiens
tgccatactaatgatgag

SEQ ID NO: 1126322 - DNA, 18 bp, Homo sapiens
tgccatagagtttaacac

SEQ ID NO: 1126323 - DNA, 21 bp, Homo sapiens
tgccatagagtttaacacaag

SEQ ID NO: 1126324 - DNA, 17 bp, Homo sapiens
tgccatagtcttaactg

SEQ ID NO: 1126325 - DNA, 20 bp, Homo sapiens
tgccatagtcttaactggtc

SEQ ID NO: 1126326 - DNA, 15 bp, Homo sapiens
tgccatagtttgtga

SEQ ID NO: 1126327 - DNA, 18 bp, Homo sapiens
tgccatattaaaatctga

SEQ ID NO: 1126328 - DNA, 14 bp, Homo sapiens
tgccatattttcac

SEQ ID NO: 1126329 - DNA, 21 bp, Homo sapiens
tgccatcactggtccaggtct

SEQ ID NO: 1126330 - DNA, 15 bp, Homo sapiens
tgccatcagcccctg

SEQ ID NO: 1126331 - DNA, 15 bp, Homo sapiens
tgccatcagtgaaaa

SEQ ID NO: 1126332 - DNA, 14 bp, Homo sapiens
tgccatcccctccc

SEQ ID NO: 1126333 - DNA, 21 bp, Homo sapiens
tgccatcctgatggacctgcc

SEQ ID NO: 1126334 - DNA, 14 bp, Homo sapiens
tgccatcgctgtga

SEQ ID NO: 1126335 - DNA, 17 bp, Homo sapiens
tgccatcggacaggagg

SEQ ID NO: 1126336 - DNA, 22 bp, Homo sapiens
tgccatctgcgtgacaataaaa

SEQ ID NO: 1126337 - DNA, 23 bp, Homo sapiens
tgccatctgtacatattactgtt

SEQ ID NO: 1126338 - DNA, 15 bp, Homo sapiens
tgccatctgttttca

SEQ ID NO: 1126339 - DNA, 12 bp, Homo sapiens
tgccatcttcag

SEQ ID NO: 1126340 - DNA, 15 bp, Homo sapiens
tgccatcttcccagc

SEQ ID NO: 1126341 - DNA, 12 bp, Homo sapiens
tgccatcttctc

SEQ ID NO: 1126342 - DNA, 21 bp, Homo sapiens
tgccatcttctccccgaggct

SEQ ID NO: 1126343 - DNA, 22 bp, Homo sapiens
tgccatgacatttcatctgggt

SEQ ID NO: 1126344 - DNA, 14 bp, Homo sapiens
tgccatgatttttg

SEQ ID NO: 1126345 - DNA, 23 bp, Homo sapiens
tgccatgatttttggtatttatg

SEQ ID NO: 1126346 - DNA, 22 bp, Homo sapiens
tgccatgcaggaagaggcccac

SEQ ID NO: 1126347 - DNA, 19 bp, Homo sapiens
tgccatgccactgccaggc

SEQ ID NO: 1126348 - DNA, 21 bp, Homo sapiens
tgccatgccactgccaggcac

SEQ ID NO: 1126349 - DNA, 19 bp, Homo sapiens
tgccatgctgggccactgg

SEQ ID NO: 1126350 - DNA, 13 bp, Homo sapiens
tgccatgcttttt

SEQ ID NO: 1126351 - DNA, 22 bp, Homo sapiens
tgccatggagatctgaaggggc

SEQ ID NO: 1126352 - DNA, 18 bp, Homo sapiens
tgccctggatccatcagg

SEQ ID NO: 1126353 - DNA, 17 bp, Homo sapiens
tgccctggcagcagcag

SEQ ID NO: 1126354 - DNA, 13 bp, Homo sapiens
tgccctggccctg

SEQ ID NO: 1126355 - DNA, 16 bp, Homo sapiens
tgccctggccctgagg

SEQ ID NO: 1126356 - DNA, 18 bp, Homo sapiens
tgccctggccctgaggtg

SEQ ID NO: 1126357 - DNA, 22 bp, Homo sapiens
tgccctggccctgaggtgtggg

SEQ ID NO: 1126358 - DNA, 14 bp, Homo sapiens
tgccctggctgctg

SEQ ID NO: 1126359 - DNA, 17 bp, Homo sapiens
tgccctgggatgcctca

SEQ ID NO: 1126360 - DNA, 23 bp, Homo sapiens
tgccctgggccaaaaccaatgct

SEQ ID NO: 1126361 - DNA, 15 bp, Homo sapiens
tgccctgggccaggc

SEQ ID NO: 1126362 - DNA, 19 bp, Homo sapiens
tgccctgggccaggcaggc

SEQ ID NO: 1126363 - DNA, 21 bp, Homo sapiens
tgccctgggccaggcaggcga

SEQ ID NO: 1126364 - DNA, 14 bp, Homo sapiens
tgccctggtgctgc

SEQ ID NO: 1126365 - DNA, 15 bp, Homo sapiens
tgccctggtggagaa

SEQ ID NO: 1126366 - DNA, 12 bp, Homo sapiens
tgccctgtgcaa

SEQ ID NO: 1126367 - DNA, 13 bp, Homo sapiens
tgccctgtgccgc

SEQ ID NO: 1126368 - DNA, 11 bp, Homo sapiens
tgccctgtgta

SEQ ID NO: 1126369 - DNA, 15 bp, Homo sapiens
tgccctgtgtggctg

SEQ ID NO: 1126370 - DNA, 16 bp, Homo sapiens
tgccctgtgtggctgg

SEQ ID NO: 1126371 - DNA, 19 bp, Homo sapiens
tgccctgttgtgtatagat

SEQ ID NO: 1126372 - DNA, 14 bp, Homo sapiens
tgcccttccctctg

SEQ ID NO: 1126373 - DNA, 16 bp, Homo sapiens
tgcccttccctctggg

SEQ ID NO: 1126374 - DNA, 15 bp, Homo sapiens
tgcccttccctgtcc

SEQ ID NO: 1126375 - DNA, 18 bp, Homo sapiens
tgcccttccctgtccctc

SEQ ID NO: 1126376 - DNA, 16 bp, Homo sapiens
tgcccttcctactcct

SEQ ID NO: 1126377 - DNA, 16 bp, Homo sapiens
tgcccttcctcagttt

SEQ ID NO: 1126378 - DNA, 15 bp, Homo sapiens
tgcccttcctcctga

SEQ ID NO: 1126379 - DNA, 23 bp, Homo sapiens
tgcccttcctcctgatggagtgt

SEQ ID NO: 1126380 - DNA, 14 bp, Homo sapiens
tgcccttctcaaga

SEQ ID NO: 1126381 - DNA, 19 bp, Homo sapiens
tgcccttctcaagacttta

SEQ ID NO: 1126382 - DNA, 20 bp, Homo sapiens
tgcccttggtagcagcctgg

SEQ ID NO: 1126383 - DNA, 21 bp, Homo sapiens
tgcccttggtagcagcctggg

SEQ ID NO: 1126384 - DNA, 22 bp, Homo sapiens
tgcccttggtagcagcctgggg

SEQ ID NO: 1126385 - DNA, 22 bp, Homo sapiens
tgccctttgcagtgtgcagggt

SEQ ID NO: 1126386 - DNA, 17 bp, Homo sapiens
tgccctttggccaacag

SEQ ID NO: 1126387 - DNA, 19 bp, Homo sapiens
tgccctttggccaacaggg

SEQ ID NO: 1126388 - DNA, 17 bp, Homo sapiens
tgccgaacattaggaat

SEQ ID NO: 1126389 - DNA, 18 bp, Homo sapiens
tgccgaacattaggaatt

SEQ ID NO: 1126390 - DNA, 18 bp, Homo sapiens
tgccgaagaattgtcttg

SEQ ID NO: 1126391 - DNA, 21 bp, Homo sapiens
tgccgaagaattgtcttgcaa

SEQ ID NO: 1126392 - DNA, 19 bp, Homo sapiens
tgccgaatgactatgtcca

SEQ ID NO: 1126393 - DNA, 23 bp, Homo sapiens
tgccgacatccctcccccagcag

SEQ ID NO: 1126394 - DNA, 16 bp, Homo sapiens
tgccgaccgaggctgg

SEQ ID NO: 1126395 - DNA, 23 bp, Homo sapiens
tgccgaccgaggctggagctggc

SEQ ID NO: 1126396 - DNA, 15 bp, Homo sapiens
tgccgacctcgtcct

SEQ ID NO: 1126397 - DNA, 22 bp, Homo sapiens
tgccgacctcgtcctccccctg

SEQ ID NO: 1126398 - DNA, 20 bp, Homo sapiens
tgccgagacagaccctctgc

SEQ ID NO: 1126399 - DNA, 17 bp, Homo sapiens
tgccgagcctaatgaaa

SEQ ID NO: 1126400 - DNA, 20 bp, Homo sapiens
tgccgagggggctgtcatgc

SEQ ID NO: 1126401 - DNA, 16 bp, Homo sapiens
tgccgatgttgaactt

SEQ ID NO: 1126402 - DNA, 20 bp, Homo sapiens
tgccgatgttgaactttttt

SEQ ID NO: 1126403 - DNA, 13 bp, Homo sapiens
tgccgatttctgt

SEQ ID NO: 1126404 - DNA, 13 bp, Homo sapiens
tgccgcaccccag

SEQ ID NO: 1126405 - DNA, 17 bp, Homo sapiens
tgccgcagcggtgggaa

SEQ ID NO: 1126406 - DNA, 21 bp, Homo sapiens
tgccgcaggtgggtgctgccc

SEQ ID NO: 1126407 - DNA, 17 bp, Homo sapiens
tgccgcatgctccctcc

SEQ ID NO: 1126408 - DNA, 12 bp, Homo sapiens
tgccgcccacct

SEQ ID NO: 1126409 - DNA, 13 bp, Homo sapiens
tgccgcccacctc

SEQ ID NO: 1126410 - DNA, 22 bp, Homo sapiens
tgccgcccacctcgctcccctc

SEQ ID NO: 1126411 - DNA, 19 bp, Homo sapiens
tgccgccgtctctgtcccg

SEQ ID NO: 1126412 - DNA, 20 bp, Homo sapiens
tgccgcctgctcctcactgg

SEQ ID NO: 1126413 - DNA, 18 bp, Homo sapiens
tgccgctacctccctccc

SEQ ID NO: 1126414 - DNA, 23 bp, Homo sapiens
tgccgctccccttggacctccag

SEQ ID NO: 1126415 - DNA, 12 bp, Homo sapiens
tgccgctcctgc

SEQ ID NO: 1126416 - DNA, 19 bp, Homo sapiens
tgccgctcctgcttcccct

SEQ ID NO: 1126417 - DNA, 21 bp, Homo sapiens
tgccgctcctgcttcccctcc

SEQ ID NO: 1126418 - DNA, 15 bp, Homo sapiens
tgccgctgcaccacg

SEQ ID NO: 1126419 - DNA, 13 bp, Homo sapiens
tgccgctgcacct

SEQ ID NO: 1126420 - DNA, 12 bp, Homo sapiens
tgccgctgcagg

SEQ ID NO: 1126421 - DNA, 16 bp, Homo sapiens
tgccgggcgccaggac

SEQ ID NO: 1126422 - DNA, 18 bp, Homo sapiens
tgccgggcgccaggacag

SEQ ID NO: 1126423 - DNA, 23 bp, Homo sapiens
tgccgggctgagggcctgctgga

SEQ ID NO: 1126424 - DNA, 14 bp, Homo sapiens
tgccgggttttata

SEQ ID NO: 1126425 - DNA, 13 bp, Homo sapiens
tgccggtcatttg

SEQ ID NO: 1126426 - DNA, 13 bp, Homo sapiens
tgccggtgggacc

SEQ ID NO: 1126427 - DNA, 16 bp, Homo sapiens
tgccggtgggaccctg

SEQ ID NO: 1126428 - DNA, 19 bp, Homo sapiens
tgccggtgggaccctgtcc

SEQ ID NO: 1126429 - DNA, 23 bp, Homo sapiens
tgccgtagggagtacctgctgcc

SEQ ID NO: 1126430 - DNA, 13 bp, Homo sapiens
tgccgtcaccacc

SEQ ID NO: 1126431 - DNA, 18 bp, Homo sapiens
tgccgtcaccaccacccc

SEQ ID NO: 1126432 - DNA, 19 bp, Homo sapiens
tgccgtcctgctggagtga

SEQ ID NO: 1126433 - DNA, 19 bp, Homo sapiens
tgccgtctcatcttctctc

SEQ ID NO: 1126434 - DNA, 12 bp, Homo sapiens
tgccgtctctgg

SEQ ID NO: 1126435 - DNA, 20 bp, Homo sapiens
tgccgtgggcctgtcgtgcc

SEQ ID NO: 1126436 - DNA, 19 bp, Homo sapiens
tgccgtgtgagtgtgacag

SEQ ID NO: 1126437 - DNA, 14 bp, Homo sapiens
tgcctaaaatgaat

SEQ ID NO: 1126438 - DNA, 18 bp, Homo sapiens
tgcctaaaattgtatgaa

SEQ ID NO: 1126439 - DNA, 18 bp, Homo sapiens
tgcctaaatccactctgc

SEQ ID NO: 1126440 - DNA, 15 bp, Homo sapiens
tgcctaaatcccaag

SEQ ID NO: 1126441 - DNA, 18 bp, Homo sapiens
tgcctaaatcccaagaaa

SEQ ID NO: 1126442 - DNA, 21 bp, Homo sapiens
tgcctaaatttaatgctgcct

SEQ ID NO: 1126443 - DNA, 14 bp, Homo sapiens
tgcctaacaccagc

SEQ ID NO: 1126444 - DNA, 15 bp, Homo sapiens
tgcctaacaccagcg

SEQ ID NO: 1126445 - DNA, 23 bp, Homo sapiens
tgcctaagaagttattttcttgt

SEQ ID NO: 1126446 - DNA, 22 bp, Homo sapiens
tgcctaagtccagtgtttcttt

SEQ ID NO: 1126447 - DNA, 14 bp, Homo sapiens
tgcctaagtggctg

SEQ ID NO: 1126448 - DNA, 22 bp, Homo sapiens
tgcctacagaacttcagaaaga

SEQ ID NO: 1126449 - DNA, 23 bp, Homo sapiens
tgcctacagaacttcagaaagac

SEQ ID NO: 1126450 - DNA, 17 bp, Homo sapiens
tgcctacgtgacaacac

SEQ ID NO: 1126451 - DNA, 17 bp, Homo sapiens
tgcctacttttctttat

SEQ ID NO: 1126452 - DNA, 23 bp, Homo sapiens
tgcctagaaatatctttctctta

SEQ ID NO: 1126453 - DNA, 16 bp, Homo sapiens
tgcctagacttcccaa

SEQ ID NO: 1126454 - DNA, 17 bp, Homo sapiens
tgcctaggaattcccag

SEQ ID NO: 1126455 - DNA, 18 bp, Homo sapiens
tgcctaggaggctggcca

SEQ ID NO: 1126456 - DNA, 20 bp, Homo sapiens
tgcctaggttggtttcccct

SEQ ID NO: 1126457 - DNA, 19 bp, Homo sapiens
tgcctagtcgggacttgta

SEQ ID NO: 1126458 - DNA, 21 bp, Homo sapiens
tgcctagtcgggacttgtaac

SEQ ID NO: 1126459 - DNA, 24 bp, Homo sapiens
tgcctagtcgggacttgtaacata

SEQ ID NO: 1126460 - DNA, 20 bp, Homo sapiens
tgcctataatcttatacaac

SEQ ID NO: 1126461 - DNA, 14 bp, Homo sapiens
tgcctatagtccca

SEQ ID NO: 1126462 - DNA, 17 bp, Homo sapiens
tgcctatagtcccagct

SEQ ID NO: 1126463 - DNA, 22 bp, Homo sapiens
tgcctatctttaaacatttcaa

SEQ ID NO: 1126464 - DNA, 15 bp, Homo sapiens
tgcctcaatgccagt

SEQ ID NO: 1126465 - DNA, 16 bp, Homo sapiens
tgcctcaatgccagta

SEQ ID NO: 1126466 - DNA, 22 bp, Homo sapiens
tgcctcaccacacccaggtctc

SEQ ID NO: 1126467 - DNA, 12 bp, Homo sapiens
tgcctcacccac

SEQ ID NO: 1126468 - DNA, 13 bp, Homo sapiens
tgcctcacccaca

SEQ ID NO: 1126469 - DNA, 15 bp, Homo sapiens
tgcctcacccacacc

SEQ ID NO: 1126470 - DNA, 14 bp, Homo sapiens
tgcctcacctcgaa

SEQ ID NO: 1126471 - DNA, 16 bp, Homo sapiens
tgcctcacctcgaaag

SEQ ID NO: 1126472 - DNA, 16 bp, Homo sapiens
tgcctcacgagatttg

SEQ ID NO: 1126473 - DNA, 15 bp, Homo sapiens
tgcctcactaatttt

SEQ ID NO: 1126474 - DNA, 18 bp, Homo sapiens
tgcgaaacaggtctgttt

SEQ ID NO: 1126475 - DNA, 13 bp, Homo sapiens
tgcgaaaggatga

SEQ ID NO: 1126476 - DNA, 19 bp, Homo sapiens
tgcgaaaggatgaaagtga

SEQ ID NO: 1126477 - DNA, 22 bp, Homo sapiens
tgcgaaatgttctcatgaacta

SEQ ID NO: 1126478 - DNA, 22 bp, Homo sapiens
tgcgaacctatgtctaaattca

SEQ ID NO: 1126479 - DNA, 21 bp, Homo sapiens
tgcgaaggggccctggtcctt

SEQ ID NO: 1126480 - DNA, 13 bp, Homo sapiens
tgcgaatgtgcag

SEQ ID NO: 1126481 - DNA, 14 bp, Homo sapiens
tgcgacaagtagtt

SEQ ID NO: 1126482 - DNA, 16 bp, Homo sapiens
tgcgacggagagaaaa

SEQ ID NO: 1126483 - DNA, 15 bp, Homo sapiens
tgcgactttctgcct

SEQ ID NO: 1126484 - DNA, 12 bp, Homo sapiens
tgcgagacccaa

SEQ ID NO: 1126485 - DNA, 13 bp, Homo sapiens
tgcgagactctga

SEQ ID NO: 1126486 - DNA, 19 bp, Homo sapiens
tgcgagctgccgtgtgggt

SEQ ID NO: 1126487 - DNA, 19 bp, Homo sapiens
tgcgagcttggccttgggc

SEQ ID NO: 1126488 - DNA, 15 bp, Homo sapiens
tgcgaggacatcaaa

SEQ ID NO: 1126489 - DNA, 13 bp, Homo sapiens
tgcgaggggccag

SEQ ID NO: 1126490 - DNA, 19 bp, Homo sapiens
tgcgaggggccagcagagg

SEQ ID NO: 1126491 - DNA, 19 bp, Homo sapiens
tgcgagtgtgtgcatgtgt

SEQ ID NO: 1126492 - DNA, 16 bp, Homo sapiens
tgcgcacaggtgggag

SEQ ID NO: 1126493 - DNA, 16 bp, Homo sapiens
tgcgcagaaaacaaga

SEQ ID NO: 1126494 - DNA, 17 bp, Homo sapiens
tgcgcagatgaggggcc

SEQ ID NO: 1126495 - DNA, 23 bp, Homo sapiens
tgcgcagggtggtggtattctgt

SEQ ID NO: 1126496 - DNA, 16 bp, Homo sapiens
tgcgccaccatgccct

SEQ ID NO: 1126497 - DNA, 18 bp, Homo sapiens
tgcgccaccatgccctat

SEQ ID NO: 1126498 - DNA, 17 bp, Homo sapiens
tgcgccaccgcccagag

SEQ ID NO: 1126499 - DNA, 19 bp, Homo sapiens
tgcgccactgctccgtgga

SEQ ID NO: 1126500 - DNA, 17 bp, Homo sapiens
tgcgccaggcagagctg

SEQ ID NO: 1126501 - DNA, 18 bp, Homo sapiens
tgcgcccagggctgggag

SEQ ID NO: 1126502 - DNA, 17 bp, Homo sapiens
tgcgcccagtccttcca

SEQ ID NO: 1126503 - DNA, 18 bp, Homo sapiens
tgcgcccagtccttccac

SEQ ID NO: 1126504 - DNA, 16 bp, Homo sapiens
tgcgcccttaccttcc

SEQ ID NO: 1126505 - DNA, 13 bp, Homo sapiens
tgcgcctcagccc

SEQ ID NO: 1126506 - DNA, 15 bp, Homo sapiens
tgcgcctcagccctc

SEQ ID NO: 1126507 - DNA, 16 bp, Homo sapiens
tgcgcctcagccctca

SEQ ID NO: 1126508 - DNA, 13 bp, Homo sapiens
tgcgcctccagag

SEQ ID NO: 1126509 - DNA, 14 bp, Homo sapiens
tgcgcctccagagg

SEQ ID NO: 1126510 - DNA, 22 bp, Homo sapiens
tgcgcctccatccatctgtccg

SEQ ID NO: 1126511 - DNA, 15 bp, Homo sapiens
tgcgcctgctgcctg

SEQ ID NO: 1126512 - DNA, 16 bp, Homo sapiens
tgcgcctgctgcctgc

SEQ ID NO: 1126513 - DNA, 17 bp, Homo sapiens
tgcgcctgctgcctgct

SEQ ID NO: 1126514 - DNA, 14 bp, Homo sapiens
tgcgcctgtgacca

SEQ ID NO: 1126515 - DNA, 17 bp, Homo sapiens
tgcgccttgtagaatgc

SEQ ID NO: 1126516 - DNA, 21 bp, Homo sapiens
tgcgcgccaccgtgcctggct

SEQ ID NO: 1126517 - DNA, 23 bp, Homo sapiens
tgcgcggatgtagcatgttctat

SEQ ID NO: 1126518 - DNA, 17 bp, Homo sapiens
tgcgcgtggcgtggccc

SEQ ID NO: 1126519 - DNA, 15 bp, Homo sapiens
tgcgctcagggccat

SEQ ID NO: 1126520 - DNA, 19 bp, Homo sapiens
tgcgctcagggccatgctg

SEQ ID NO: 1126521 - DNA, 21 bp, Homo sapiens
tgcgctcagggccatgctgag

SEQ ID NO: 1126522 - DNA, 23 bp, Homo sapiens
tgcgctgacaaccaccgctcccc

SEQ ID NO: 1126523 - DNA, 21 bp, Homo sapiens
tgcgctgctctgcaggctggg

SEQ ID NO: 1126524 - DNA, 13 bp, Homo sapiens
tgcgctgtcccag

SEQ ID NO: 1126525 - DNA, 14 bp, Homo sapiens
tgcgctgtcccagg

SEQ ID NO: 1126526 - DNA, 16 bp, Homo sapiens
tgcgctgtcccaggca

SEQ ID NO: 1126527 - DNA, 22 bp, Homo sapiens
tgcgcttatttggaaattttag

SEQ ID NO: 1126528 - DNA, 15 bp, Homo sapiens
tgcgcttctgctgga

SEQ ID NO: 1126529 - DNA, 22 bp, Homo sapiens
tgcggaagccatagggggctgc

SEQ ID NO: 1126530 - DNA, 21 bp, Homo sapiens
tgcggaggaaggaggacccag

SEQ ID NO: 1126531 - DNA, 13 bp, Homo sapiens
tgcggaggcagga

SEQ ID NO: 1126532 - DNA, 18 bp, Homo sapiens
tgcggaggcaggagcatg

SEQ ID NO: 1126533 - DNA, 14 bp, Homo sapiens
tgcggagtccaggc

SEQ ID NO: 1126534 - DNA, 16 bp, Homo sapiens
tgcggagtgaagaggg

SEQ ID NO: 1126535 - DNA, 23 bp, Homo sapiens
tgcggatggacactaatgcagcc

SEQ ID NO: 1126536 - DNA, 15 bp, Homo sapiens
tgcggcaaaaggaaa

SEQ ID NO: 1126537 - DNA, 15 bp, Homo sapiens
tgcggcagggaagag

SEQ ID NO: 1126538 - DNA, 13 bp, Homo sapiens
tgcggcctcacca

SEQ ID NO: 1126539 - DNA, 14 bp, Homo sapiens
tgcggcgccagcct

SEQ ID NO: 1126540 - DNA, 16 bp, Homo sapiens
tgcggcgccagcctca

SEQ ID NO: 1126541 - DNA, 18 bp, Homo sapiens
tgcggcggtcccagctcc

SEQ ID NO: 1126542 - DNA, 16 bp, Homo sapiens
tgcggctcagccttgc

SEQ ID NO: 1126543 - DNA, 14 bp, Homo sapiens
tgcggctttctctg

SEQ ID NO: 1126544 - DNA, 18 bp, Homo sapiens
tgcggctttctctgcctc

SEQ ID NO: 1126545 - DNA, 20 bp, Homo sapiens
tgcggctttctctgcctctg

SEQ ID NO: 1126546 - DNA, 21 bp, Homo sapiens
tgcggctttctctgcctctgg

SEQ ID NO: 1126547 - DNA, 17 bp, Homo sapiens
tgcgggatggtcctggg

SEQ ID NO: 1126548 - DNA, 16 bp, Homo sapiens
tgcgggcacaataaat

SEQ ID NO: 1126549 - DNA, 22 bp, Homo sapiens
tgcgggcgcgggcagccaccca

SEQ ID NO: 1126550 - DNA, 14 bp, Homo sapiens
tgcgggctcgccca

SEQ ID NO: 1126551 - DNA, 20 bp, Homo sapiens
tgcgggtcctcagctgctcc

SEQ ID NO: 1126552 - DNA, 23 bp, Homo sapiens
tgcgggtggggcttggggctcac

SEQ ID NO: 1126553 - DNA, 16 bp, Homo sapiens
tgcggtagccagcaca

SEQ ID NO: 1126554 - DNA, 23 bp, Homo sapiens
tgcggtgcctcatgcctgtaatc

SEQ ID NO: 1126555 - DNA, 22 bp, Homo sapiens
tgcggttataaaaaatggttca

SEQ ID NO: 1126556 - DNA, 14 bp, Homo sapiens
tgcgtacacagaga

SEQ ID NO: 1126557 - DNA, 16 bp, Homo sapiens
tgcgtacacagagaag

SEQ ID NO: 1126558 - DNA, 21 bp, Homo sapiens
tgcgtacttgtaatatgtata

SEQ ID NO: 1126559 - DNA, 22 bp, Homo sapiens
tgcgtatatgtgcgtctctctt

SEQ ID NO: 1126560 - DNA, 14 bp, Homo sapiens
tgcgtattctgtgg

SEQ ID NO: 1126561 - DNA, 16 bp, Homo sapiens
tgcgtattctgtggcc

SEQ ID NO: 1126562 - DNA, 20 bp, Homo sapiens
tgcgtattctgtggccgcca

SEQ ID NO: 1126563 - DNA, 19 bp, Homo sapiens
tgcgtcagaccagtactgg

SEQ ID NO: 1126564 - DNA, 23 bp, Homo sapiens
tgcgtccaccaggcctcactggc

SEQ ID NO: 1126565 - DNA, 19 bp, Homo sapiens
tgcgtccacgagctgttta

SEQ ID NO: 1126566 - DNA, 14 bp, Homo sapiens
tgcgtccccactcc

SEQ ID NO: 1126567 - DNA, 23 bp, Homo sapiens
tgcgtccccccccaacctttccc

SEQ ID NO: 1126568 - DNA, 14 bp, Homo sapiens
tgcgtcctcctcac

SEQ ID NO: 1126569 - DNA, 13 bp, Homo sapiens
tgcgtctccagtc

SEQ ID NO: 1126570 - DNA, 20 bp, Homo sapiens
tgcgtcttccgcccctgcct

SEQ ID NO: 1126571 - DNA, 21 bp, Homo sapiens
tgcgtcttccgcccctgcctg

SEQ ID NO: 1126572 - DNA, 15 bp, Homo sapiens
tgcgtcttggtgtaa

SEQ ID NO: 1126573 - DNA, 22 bp, Homo sapiens
tgcgtcttggtgtaatttgaag

SEQ ID NO: 1126574 - DNA, 14 bp, Homo sapiens
tgcgtgaaacacac

SEQ ID NO: 1126575 - DNA, 20 bp, Homo sapiens
tgcgtgaatgtatgtaatgt

SEQ ID NO: 1126576 - DNA, 22 bp, Homo sapiens
tgcgtgatggctatgccttgca

SEQ ID NO: 1126577 - DNA, 17 bp, Homo sapiens
tgcgtgcccggggcagc

SEQ ID NO: 1126578 - DNA, 17 bp, Homo sapiens
tgcgtgccgcctgctcc

SEQ ID NO: 1126579 - DNA, 18 bp, Homo sapiens
tgcgtgccgtgtgagtgt

SEQ ID NO: 1126580 - DNA, 19 bp, Homo sapiens
tgcgtgccgtgtgagtgtg

SEQ ID NO: 1126581 - DNA, 20 bp, Homo sapiens
tgcgtggaatgcccttcact

SEQ ID NO: 1126582 - DNA, 13 bp, Homo sapiens
tgcgtggatcaag

SEQ ID NO: 1126583 - DNA, 20 bp, Homo sapiens
tgcgtggatcaagcttgtgt

SEQ ID NO: 1126584 - DNA, 18 bp, Homo sapiens
tgcgtgggagtgtgtgcc

SEQ ID NO: 1126585 - DNA, 13 bp, Homo sapiens
tgcgtgtcgtggg

SEQ ID NO: 1126586 - DNA, 19 bp, Homo sapiens
tgcgtgtgtccatgtgtgt

SEQ ID NO: 1126587 - DNA, 22 bp, Homo sapiens
tgcgtgttagtgtgtgtgcatg

SEQ ID NO: 1126588 - DNA, 15 bp, Homo sapiens
tgcgttcgcctctgg

SEQ ID NO: 1126589 - DNA, 16 bp, Homo sapiens
tgcgttctcccagcac

SEQ ID NO: 1126590 - DNA, 15 bp, Homo sapiens
tgcgttggagccact

SEQ ID NO: 1126591 - DNA, 23 bp, Homo sapiens
tgcgttggagccactcctgtccc

SEQ ID NO: 1126592 - DNA, 16 bp, Homo sapiens
tgcgtttgcctcctgg

SEQ ID NO: 1126593 - DNA, 17 bp, Homo sapiens
tgcgtttggtttacttg

SEQ ID NO: 1126594 - DNA, 14 bp, Homo sapiens
tgcgtttttacagt

SEQ ID NO: 1126595 - DNA, 14 bp, Homo sapiens
tgctaaaagaagag

SEQ ID NO: 1126596 - DNA, 21 bp, Homo sapiens
tgctgaatcccatcaggctgt

SEQ ID NO: 1126597 - DNA, 15 bp, Homo sapiens
tgctgaatgcaggga

SEQ ID NO: 1126598 - DNA, 20 bp, Homo sapiens
tgctgaatgccccctgctta

SEQ ID NO: 1126599 - DNA, 18 bp, Homo sapiens
tgctgaatgttgggactg

SEQ ID NO: 1126600 - DNA, 18 bp, Homo sapiens
tgctgaattcctttacaa

SEQ ID NO: 1126601 - DNA, 16 bp, Homo sapiens
tgctgaattgagaata

SEQ ID NO: 1126602 - DNA, 22 bp, Homo sapiens
tgctgaattgtttataatggca

SEQ ID NO: 1126603 - DNA, 14 bp, Homo sapiens
tgctgaatttcagg

SEQ ID NO: 1126604 - DNA, 15 bp, Homo sapiens
tgctgacagctgacc

SEQ ID NO: 1126605 - DNA, 14 bp, Homo sapiens
tgctgacagctgct

SEQ ID NO: 1126606 - DNA, 16 bp, Homo sapiens
tgctgacagctgctcc

SEQ ID NO: 1126607 - DNA, 17 bp, Homo sapiens
tgctgacagctgctcct

SEQ ID NO: 1126608 - DNA, 21 bp, Homo sapiens
tgctgacaggtgatgctctgg

SEQ ID NO: 1126609 - DNA, 14 bp, Homo sapiens
tgctgaccaaatgg

SEQ ID NO: 1126610 - DNA, 16 bp, Homo sapiens
tgctgaccaattgtgc

SEQ ID NO: 1126611 - DNA, 18 bp, Homo sapiens
tgctgaccaattgtgctg

SEQ ID NO: 1126612 - DNA, 20 bp, Homo sapiens
tgctgaccaattgtgctgcc

SEQ ID NO: 1126613 - DNA, 21 bp, Homo sapiens
tgctgaccaattgtgctgcca

SEQ ID NO: 1126614 - DNA, 18 bp, Homo sapiens
tgctgacccaggaatagt

SEQ ID NO: 1126615 - DNA, 23 bp, Homo sapiens
tgctgacccaggaatagtggaca

SEQ ID NO: 1126616 - DNA, 12 bp, Homo sapiens
tgctgaccccag

SEQ ID NO: 1126617 - DNA, 22 bp, Homo sapiens
tgctgaccccaggtcagccctg

SEQ ID NO: 1126618 - DNA, 23 bp, Homo sapiens
tgctgaccccaggtcagccctgt

SEQ ID NO: 1126619 - DNA, 13 bp, Homo sapiens
tgctgacctgctg

SEQ ID NO: 1126620 - DNA, 23 bp, Homo sapiens
tgctgacctgctgacctgtgcac

SEQ ID NO: 1126621 - DNA, 14 bp, Homo sapiens
tgctgactctctga

SEQ ID NO: 1126622 - DNA, 16 bp, Homo sapiens
tgctgactctctgagc

SEQ ID NO: 1126623 - DNA, 20 bp, Homo sapiens
tgctgactctctgagctggg

SEQ ID NO: 1126624 - DNA, 19 bp, Homo sapiens
tgctgactgtactcctccc

SEQ ID NO: 1126625 - DNA, 19 bp, Homo sapiens
tgctgactgtttcattcac

SEQ ID NO: 1126626 - DNA, 17 bp, Homo sapiens
tgctgactgttttctct

SEQ ID NO: 1126627 - DNA, 14 bp, Homo sapiens
tgctgagagccccc

SEQ ID NO: 1126628 - DNA, 15 bp, Homo sapiens
tgctgagcaccctct

SEQ ID NO: 1126629 - DNA, 16 bp, Homo sapiens
tgctgagcctctgctc

SEQ ID NO: 1126630 - DNA, 20 bp, Homo sapiens
tgctgagcctctgctcccca

SEQ ID NO: 1126631 - DNA, 12 bp, Homo sapiens
tgctgagctggc

SEQ ID NO: 1126632 - DNA, 16 bp, Homo sapiens
tgctgagctgggccca

SEQ ID NO: 1126633 - DNA, 19 bp, Homo sapiens
tgctgagctgggcccagcc

SEQ ID NO: 1126634 - DNA, 21 bp, Homo sapiens
tgctgagctgggcccagcccc

SEQ ID NO: 1126635 - DNA, 24 bp, Homo sapiens
tgctgagctgggcccagcccctcc

SEQ ID NO: 1126636 - DNA, 14 bp, Homo sapiens
tgctgagctgtgat

SEQ ID NO: 1126637 - DNA, 14 bp, Homo sapiens
tgctgagcttagcc

SEQ ID NO: 1126638 - DNA, 15 bp, Homo sapiens
tgctgagcttagcct

SEQ ID NO: 1126639 - DNA, 16 bp, Homo sapiens
tgctgagcttagcctt

SEQ ID NO: 1126640 - DNA, 18 bp, Homo sapiens
tgctgagcttagccttgt

SEQ ID NO: 1126641 - DNA, 24 bp, Homo sapiens
tgctgagcttagccttgtgccctg

SEQ ID NO: 1126642 - DNA, 21 bp, Homo sapiens
tgctgaggagtctgaggactg

SEQ ID NO: 1126643 - DNA, 17 bp, Homo sapiens
tgctgaggcctccagct

SEQ ID NO: 1126644 - DNA, 15 bp, Homo sapiens
tgctgaggcctgggc

SEQ ID NO: 1126645 - DNA, 16 bp, Homo sapiens
tgctgaggcctgggcc

SEQ ID NO: 1126646 - DNA, 17 bp, Homo sapiens
tgctgaggcctgggccg

SEQ ID NO: 1126647 - DNA, 13 bp, Homo sapiens
tgctgaggccttc

SEQ ID NO: 1126648 - DNA, 22 bp, Homo sapiens
tgctgaggggcagggagagcgc

SEQ ID NO: 1126649 - DNA, 12 bp, Homo sapiens
tgctgagggtgt

SEQ ID NO: 1126650 - DNA, 20 bp, Homo sapiens
tgctgaggttttgaataaaa

SEQ ID NO: 1126651 - DNA, 13 bp, Homo sapiens
tgctgagtgctgg

SEQ ID NO: 1126652 - DNA, 17 bp, Homo sapiens
tgctgagtgctgggcac

SEQ ID NO: 1126653 - DNA, 18 bp, Homo sapiens
tgctgagtgctgggcact

SEQ ID NO: 1126654 - DNA, 20 bp, Homo sapiens
tgctgagtgctgggcactgc

SEQ ID NO: 1126655 - DNA, 16 bp, Homo sapiens
tgctgagttgttctaa

SEQ ID NO: 1126656 - DNA, 23 bp, Homo sapiens
tgctgataattgtgtattttctt

SEQ ID NO: 1126657 - DNA, 15 bp, Homo sapiens
tgctgatattttctc

SEQ ID NO: 1126658 - DNA, 21 bp, Homo sapiens
tgctgatattttctctaggaa

SEQ ID NO: 1126659 - DNA, 19 bp, Homo sapiens
tgctgatcatcgccagagg

SEQ ID NO: 1126660 - DNA, 20 bp, Homo sapiens
tgctgatccggctgctcctc

SEQ ID NO: 1126661 - DNA, 21 bp, Homo sapiens
tgctgatccggctgctcctcc

SEQ ID NO: 1126662 - DNA, 15 bp, Homo sapiens
tgctgatcgtagaaa

SEQ ID NO: 1126663 - DNA, 18 bp, Homo sapiens
tgctgatcgtagaaaatt

SEQ ID NO: 1126664 - DNA, 15 bp, Homo sapiens
tgctgatcttttaaa

SEQ ID NO: 1126665 - DNA, 19 bp, Homo sapiens
tgctgatcttttaaaatca

SEQ ID NO: 1126666 - DNA, 20 bp, Homo sapiens
tgctgatgattttgcaaaat

SEQ ID NO: 1126667 - DNA, 15 bp, Homo sapiens
tgctgatggagcctt

SEQ ID NO: 1126668 - DNA, 17 bp, Homo sapiens
tgctgatggagccttcc

SEQ ID NO: 1126669 - DNA, 20 bp, Homo sapiens
tgctgatggctgctagattt

SEQ ID NO: 1126670 - DNA, 19 bp, Homo sapiens
tgctgatggcttgacatgt

SEQ ID NO: 1126671 - DNA, 23 bp, Homo sapiens
tgctgatggcttgacatgtgcaa

SEQ ID NO: 1126672 - DNA, 16 bp, Homo sapiens
tgctgatgggaaggag

SEQ ID NO: 1126673 - DNA, 20 bp, Homo sapiens
tgctgatgggaaggagggga

SEQ ID NO: 1126674 - DNA, 16 bp, Homo sapiens
tgctgatgtttataaa

SEQ ID NO: 1126675 - DNA, 14 bp, Homo sapiens
tgctgatgtttcct

SEQ ID NO: 1126676 - DNA, 15 bp, Homo sapiens
tgctgatgtttcctg

SEQ ID NO: 1126677 - DNA, 12 bp, Homo sapiens
tgctgattattt

SEQ ID NO: 1126678 - DNA, 13 bp, Homo sapiens
tgctgattattta

SEQ ID NO: 1126679 - DNA, 14 bp, Homo sapiens
tgctgattatttat

SEQ ID NO: 1126680 - DNA, 16 bp, Homo sapiens
tgctgattatttatga

SEQ ID NO: 1126681 - DNA, 17 bp, Homo sapiens
tgctgattatttatgac

SEQ ID NO: 1126682 - DNA, 21 bp, Homo sapiens
tgctgattatttatgacctga

SEQ ID NO: 1126683 - DNA, 20 bp, Homo sapiens
tgctgattcaaaccaaagct

SEQ ID NO: 1126684 - DNA, 14 bp, Homo sapiens
tgctgattcttgta

SEQ ID NO: 1126685 - DNA, 15 bp, Homo sapiens
tgctgattcttgtaa

SEQ ID NO: 1126686 - DNA, 16 bp, Homo sapiens
tgctgattcttgtaaa

SEQ ID NO: 1126687 - DNA, 17 bp, Homo sapiens
tgctgattcttgtaaat

SEQ ID NO: 1126688 - DNA, 19 bp, Homo sapiens
tgctgattcttgtaaatct

SEQ ID NO: 1126689 - DNA, 21 bp, Homo sapiens
tgctgatttctagtgtatact

SEQ ID NO: 1126690 - DNA, 18 bp, Homo sapiens
tgctgatttggtgaccaa

SEQ ID NO: 1126691 - DNA, 20 bp, Homo sapiens
tgctgcaaacctgacccctg

SEQ ID NO: 1126692 - DNA, 16 bp, Homo sapiens
tgctgcaaagagaaac

SEQ ID NO: 1126693 - DNA, 16 bp, Homo sapiens
tgctgcaaaggagaag

SEQ ID NO: 1126694 - DNA, 17 bp, Homo sapiens
tgctgcaaaggagaagc

SEQ ID NO: 1126695 - DNA, 22 bp, Homo sapiens
tgctgcaaaggagaagcacagc

SEQ ID NO: 1126696 - DNA, 14 bp, Homo sapiens
tgctgcaaggtggc

SEQ ID NO: 1126697 - DNA, 17 bp, Homo sapiens
tgctgcacagcaggacc

SEQ ID NO: 1126698 - DNA, 14 bp, Homo sapiens
tgctgcaccagagt

SEQ ID NO: 1126699 - DNA, 15 bp, Homo sapiens
tgctgcactaggact

SEQ ID NO: 1126700 - DNA, 15 bp, Homo sapiens
tgctgcacttcctgt

SEQ ID NO: 1126701 - DNA, 22 bp, Homo sapiens
tgctgcagagaaacttaagcaa

SEQ ID NO: 1126702 - DNA, 16 bp, Homo sapiens
tgctgcagcagagtga

SEQ ID NO: 1126703 - DNA, 16 bp, Homo sapiens
tgctgcaggtggcaga

SEQ ID NO: 1126704 - DNA, 22 bp, Homo sapiens
tgctgcatactttgacaaggaa

SEQ ID NO: 1126705 - DNA, 15 bp, Homo sapiens
tgctgcatagctcta

SEQ ID NO: 1126706 - DNA, 19 bp, Homo sapiens
tgctgcatgaaaaacattc

SEQ ID NO: 1126707 - DNA, 12 bp, Homo sapiens
tgctgcattcca

SEQ ID NO: 1126708 - DNA, 13 bp, Homo sapiens
tgctgcattcctt

SEQ ID NO: 1126709 - DNA, 14 bp, Homo sapiens
tgctgcatttaaaa

SEQ ID NO: 1126710 - DNA, 23 bp, Homo sapiens
tgctgcattttaattttaaccaa

SEQ ID NO: 1126711 - DNA, 16 bp, Homo sapiens
tgctgcattttacaca

SEQ ID NO: 1126712 - DNA, 19 bp, Homo sapiens
tgctgcattttacacatgt

SEQ ID NO: 1126713 - DNA, 14 bp, Homo sapiens
tgctgcattttata

SEQ ID NO: 1126714 - DNA, 19 bp, Homo sapiens
tgctgccaaaaccacatgg

SEQ ID NO: 1126715 - DNA, 20 bp, Homo sapiens
tgctgccacaaccagccagg

SEQ ID NO: 1126716 - DNA, 19 bp, Homo sapiens
tgctgccacacttcaggct

SEQ ID NO: 1126717 - DNA, 17 bp, Homo sapiens
tgctgccacagcaagga

SEQ ID NO: 1126718 - DNA, 18 bp, Homo sapiens
tgctgttgaggtggctgt

SEQ ID NO: 1126719 - DNA, 21 bp, Homo sapiens
tgctgttgatttctttccaga

SEQ ID NO: 1126720 - DNA, 15 bp, Homo sapiens
tgctgttgccatagc

SEQ ID NO: 1126721 - DNA, 16 bp, Homo sapiens
tgctgttggtcatgtg

SEQ ID NO: 1126722 - DNA, 21 bp, Homo sapiens
tgctgtttactcccttctgta

SEQ ID NO: 1126723 - DNA, 22 bp, Homo sapiens
tgctgtttactcccttctgtag

SEQ ID NO: 1126724 - DNA, 19 bp, Homo sapiens
tgctgtttagcttcctcca

SEQ ID NO: 1126725 - DNA, 20 bp, Homo sapiens
tgctgtttagcttcctccag

SEQ ID NO: 1126726 - DNA, 22 bp, Homo sapiens
tgctgtttagcttcctccagag

SEQ ID NO: 1126727 - DNA, 14 bp, Homo sapiens
tgctgtttattaat

SEQ ID NO: 1126728 - DNA, 17 bp, Homo sapiens
tgctgtttattaatctt

SEQ ID NO: 1126729 - DNA, 13 bp, Homo sapiens
tgctgtttctaag

SEQ ID NO: 1126730 - DNA, 16 bp, Homo sapiens
tgctgtttctaagaaa

SEQ ID NO: 1126731 - DNA, 23 bp, Homo sapiens
tgctgtttctaagaaaatgtagt

SEQ ID NO: 1126732 - DNA, 19 bp, Homo sapiens
tgctgtttgtttgacaaag

SEQ ID NO: 1126733 - DNA, 12 bp, Homo sapiens
tgcttaaaagac

SEQ ID NO: 1126734 - DNA, 12 bp, Homo sapiens
tgcttaaaatat

SEQ ID NO: 1126735 - DNA, 23 bp, Homo sapiens
tgcttaaaatatgtatgtctaat

SEQ ID NO: 1126736 - DNA, 15 bp, Homo sapiens
tgcttaaaatatgtg

SEQ ID NO: 1126737 - DNA, 16 bp, Homo sapiens
tgcttaaaatatgtga

SEQ ID NO: 1126738 - DNA, 23 bp, Homo sapiens
tgcttaaaatatgtgaagttttc

SEQ ID NO: 1126739 - DNA, 12 bp, Homo sapiens
tgcttaaacaaa

SEQ ID NO: 1126740 - DNA, 15 bp, Homo sapiens
tgcttaaacaaagca

SEQ ID NO: 1126741 - DNA, 18 bp, Homo sapiens
tgcttaaactaaataatg

SEQ ID NO: 1126742 - DNA, 21 bp, Homo sapiens
tgcttaaactaatgaacaaat

SEQ ID NO: 1126743 - DNA, 20 bp, Homo sapiens
tgcttaaatcagttggagtt

SEQ ID NO: 1126744 - DNA, 13 bp, Homo sapiens
tgcttaaatttta

SEQ ID NO: 1126745 - DNA, 15 bp, Homo sapiens
tgcttaacattagat

SEQ ID NO: 1126746 - DNA, 22 bp, Homo sapiens
tgcttaacattagatgtcatga

SEQ ID NO: 1126747 - DNA, 12 bp, Homo sapiens
tgcttaatgaaa

SEQ ID NO: 1126748 - DNA, 13 bp, Homo sapiens
tgcttaatttcct

SEQ ID NO: 1126749 - DNA, 16 bp, Homo sapiens
tgcttacacatctcag

SEQ ID NO: 1126750 - DNA, 17 bp, Homo sapiens
tgcttacacatctcaga

SEQ ID NO: 1126751 - DNA, 16 bp, Homo sapiens
tgcttacagtaactaa

SEQ ID NO: 1126752 - DNA, 23 bp, Homo sapiens
tgcttacattttaatagagatga

SEQ ID NO: 1126753 - DNA, 15 bp, Homo sapiens
tgcttacccttcacc

SEQ ID NO: 1126754 - DNA, 18 bp, Homo sapiens
tgcttacccttcaccttt

SEQ ID NO: 1126755 - DNA, 17 bp, Homo sapiens
tgcttacctactttctt

SEQ ID NO: 1126756 - DNA, 19 bp, Homo sapiens
tgcttacctactttcttca

SEQ ID NO: 1126757 - DNA, 15 bp, Homo sapiens
tgcttaccttctgct

SEQ ID NO: 1126758 - DNA, 14 bp, Homo sapiens
tgcttaccttttcc

SEQ ID NO: 1126759 - DNA, 23 bp, Homo sapiens
tgcttactaagctttgccagctg

SEQ ID NO: 1126760 - DNA, 18 bp, Homo sapiens
tgcttactaatgtgcccc

SEQ ID NO: 1126761 - DNA, 14 bp, Homo sapiens
tgcttactgatata

SEQ ID NO: 1126762 - DNA, 22 bp, Homo sapiens
tgcttactgatatattttacaa

SEQ ID NO: 1126763 - DNA, 13 bp, Homo sapiens
tgcttagcaaaaa

SEQ ID NO: 1126764 - DNA, 14 bp, Homo sapiens
tgcttagcctgtgc

SEQ ID NO: 1126765 - DNA, 15 bp, Homo sapiens
tgcttagcctgtgct

SEQ ID NO: 1126766 - DNA, 21 bp, Homo sapiens
tgcttagcttatctttctttc

SEQ ID NO: 1126767 - DNA, 23 bp, Homo sapiens
tgcttagtcacttatttcataaa

SEQ ID NO: 1126768 - DNA, 20 bp, Homo sapiens
tgcttagtccaattccttgc

SEQ ID NO: 1126769 - DNA, 23 bp, Homo sapiens
tgcttagttggctttgcccaccc

SEQ ID NO: 1126770 - DNA, 23 bp, Homo sapiens
tgcttataacctagttaaagaaa

SEQ ID NO: 1126771 - DNA, 16 bp, Homo sapiens
tgcttataagagagag

SEQ ID NO: 1126772 - DNA, 13 bp, Homo sapiens
tgcttatacactt

SEQ ID NO: 1126773 - DNA, 15 bp, Homo sapiens
tgcttatttttataa

SEQ ID NO: 1126774 - DNA, 17 bp, Homo sapiens
tgcttatttttataatt

SEQ ID NO: 1126775 - DNA, 13 bp, Homo sapiens
tgcttcaaaaaca

SEQ ID NO: 1126776 - DNA, 21 bp, Homo sapiens
tgcttcaaaaacattcttaca

SEQ ID NO: 1126777 - DNA, 18 bp, Homo sapiens
tgcttcaaaccctcaaga

SEQ ID NO: 1126778 - DNA, 19 bp, Homo sapiens
tgcttcaaatccatccaga

SEQ ID NO: 1126779 - DNA, 16 bp, Homo sapiens
tgcttcaagtgttgct

SEQ ID NO: 1126780 - DNA, 19 bp, Homo sapiens
tgcttcaagtgttgctctt

SEQ ID NO: 1126781 - DNA, 15 bp, Homo sapiens
tgcttcaattaataa

SEQ ID NO: 1126782 - DNA, 16 bp, Homo sapiens
tgcttcaattaataaa

SEQ ID NO: 1126783 - DNA, 23 bp, Homo sapiens
tgcttcaattaataaaaaatgga

SEQ ID NO: 1126784 - DNA, 16 bp, Homo sapiens
tgcttcacagtagagc

SEQ ID NO: 1126785 - DNA, 14 bp, Homo sapiens
tgcttcacatagca

SEQ ID NO: 1126786 - DNA, 13 bp, Homo sapiens
tgcttcacatttg

SEQ ID NO: 1126787 - DNA, 18 bp, Homo sapiens
tgcttcactttgccttct

SEQ ID NO: 1126788 - DNA, 13 bp, Homo sapiens
tgcttcagagttt

SEQ ID NO: 1126789 - DNA, 17 bp, Homo sapiens
tgcttcagagtttgtgt

SEQ ID NO: 1126790 - DNA, 22 bp, Homo sapiens
tgcttcagagtttgtgtgtatt

SEQ ID NO: 1126791 - DNA, 14 bp, Homo sapiens
tgcttcagcctgag

SEQ ID NO: 1126792 - DNA, 17 bp, Homo sapiens
tgcttcagcctgaggct

SEQ ID NO: 1126793 - DNA, 16 bp, Homo sapiens
tgcttcagtggagaat

SEQ ID NO: 1126794 - DNA, 20 bp, Homo sapiens
tgcttcataaatgaagcagc

SEQ ID NO: 1126795 - DNA, 20 bp, Homo sapiens
tgcttcatagtattggagca

SEQ ID NO: 1126796 - DNA, 17 bp, Homo sapiens
tgcttcatctccttttg

SEQ ID NO: 1126797 - DNA, 17 bp, Homo sapiens
tgcttcatgctcagccc

SEQ ID NO: 1126798 - DNA, 20 bp, Homo sapiens
tgcttccaacaaggacagcc

SEQ ID NO: 1126799 - DNA, 20 bp, Homo sapiens
tgcttccatggcttcctgag

SEQ ID NO: 1126800 - DNA, 22 bp, Homo sapiens
tgcttcccagaggagcagctct

SEQ ID NO: 1126801 - DNA, 15 bp, Homo sapiens
tgcttcccatcctac

SEQ ID NO: 1126802 - DNA, 23 bp, Homo sapiens
tgcttcccatcctaccctcgggc

SEQ ID NO: 1126803 - DNA, 23 bp, Homo sapiens
tgcttcccattgtggctcctatc

SEQ ID NO: 1126804 - DNA, 12 bp, Homo sapiens
tgcttcccctcc

SEQ ID NO: 1126805 - DNA, 14 bp, Homo sapiens
tgcttccccttcct

SEQ ID NO: 1126806 - DNA, 15 bp, Homo sapiens
tgcttccccttttgc

SEQ ID NO: 1126807 - DNA, 15 bp, Homo sapiens
tgcttccctaatcta

SEQ ID NO: 1126808 - DNA, 14 bp, Homo sapiens
tgcttcctcctgga

SEQ ID NO: 1126809 - DNA, 19 bp, Homo sapiens
tgcttcctgttacctgtct

SEQ ID NO: 1126810 - DNA, 14 bp, Homo sapiens
tgcttccttcagtt

SEQ ID NO: 1126811 - DNA, 22 bp, Homo sapiens
tgcttccttcagtttgtaaagt

SEQ ID NO: 1126812 - DNA, 13 bp, Homo sapiens
tgcttcctttctc

SEQ ID NO: 1126813 - DNA, 14 bp, Homo sapiens
tgcttcctttctct

SEQ ID NO: 1126814 - DNA, 20 bp, Homo sapiens
tgcttcctttctctcctggc

SEQ ID NO: 1126815 - DNA, 21 bp, Homo sapiens
tgcttcctttctctcctggct

SEQ ID NO: 1126816 - DNA, 14 bp, Homo sapiens
tgcttcgactactg

SEQ ID NO: 1126817 - DNA, 15 bp, Homo sapiens
tgcttcgactactgc

SEQ ID NO: 1126818 - DNA, 21 bp, Homo sapiens
tgcttcgactactgctcctgt

SEQ ID NO: 1126819 - DNA, 23 bp, Homo sapiens
tgcttctaaatgcccagttcact

SEQ ID NO: 1126820 - DNA, 22 bp, Homo sapiens
tgcttctaagtaaatacaattt

SEQ ID NO: 1126821 - DNA, 14 bp, Homo sapiens
tgcttctacatgat

SEQ ID NO: 1126822 - DNA, 18 bp, Homo sapiens
tgcttctagaaactctgg

SEQ ID NO: 1126823 - DNA, 22 bp, Homo sapiens
tgcttctaggagtcaactggct

SEQ ID NO: 1126824 - DNA, 19 bp, Homo sapiens
tgcttctataattttgcct

SEQ ID NO: 1126825 - DNA, 17 bp, Homo sapiens
tgcttctccatgagaca

SEQ ID NO: 1126826 - DNA, 19 bp, Homo sapiens
tgcttctcccatttcctga

SEQ ID NO: 1126827 - DNA, 21 bp, Homo sapiens
tgcttctcccatttcctgatc

SEQ ID NO: 1126828 - DNA, 11 bp, Homo sapiens
tgcttctcccc

SEQ ID NO: 1126829 - DNA, 13 bp, Homo sapiens
tgcttctcccccc

SEQ ID NO: 1126830 - DNA, 20 bp, Homo sapiens
tgcttctccccccatcccag

SEQ ID NO: 1126831 - DNA, 22 bp, Homo sapiens
tgcttctccccccatcccaggg

SEQ ID NO: 1126832 - DNA, 15 bp, Homo sapiens
tgcttctcccgggga

SEQ ID NO: 1126833 - DNA, 16 bp, Homo sapiens
tgcttctcggccagcc

SEQ ID NO: 1126834 - DNA, 22 bp, Homo sapiens
tgcttctctagctctctaggcc

SEQ ID NO: 1126835 - DNA, 15 bp, Homo sapiens
tgcttctctcttctc

SEQ ID NO: 1126836 - DNA, 23 bp, Homo sapiens
tgcttctctgacttctgcctgga

SEQ ID NO: 1126837 - DNA, 22 bp, Homo sapiens
tgcttctcttctttattgcact

SEQ ID NO: 1126838 - DNA, 23 bp, Homo sapiens
tgcttctcttctttattgcacta

SEQ ID NO: 1126839 - DNA, 22 bp, Homo sapiens
tggaacaagacagccttcactt

SEQ ID NO: 1126840 - DNA, 18 bp, Homo sapiens
tggaacaatattttatgg

SEQ ID NO: 1126841 - DNA, 14 bp, Homo sapiens
tggaacaccttggg

SEQ ID NO: 1126842 - DNA, 17 bp, Homo sapiens
tggaacacggccacatc

SEQ ID NO: 1126843 - DNA, 20 bp, Homo sapiens
tggaacagatatttagctct

SEQ ID NO: 1126844 - DNA, 22 bp, Homo sapiens
tggaacagatatttagctctgt

SEQ ID NO: 1126845 - DNA, 16 bp, Homo sapiens
tggaacagcgggagac

SEQ ID NO: 1126846 - DNA, 14 bp, Homo sapiens
tggaacatccttgg

SEQ ID NO: 1126847 - DNA, 19 bp, Homo sapiens
tggaacatggctagccttt

SEQ ID NO: 1126848 - DNA, 13 bp, Homo sapiens
tggaacattggaa

SEQ ID NO: 1126849 - DNA, 12 bp, Homo sapiens
tggaaccagact

SEQ ID NO: 1126850 - DNA, 19 bp, Homo sapiens
tggaaccagactcttgcct

SEQ ID NO: 1126851 - DNA, 20 bp, Homo sapiens
tggaaccagcaagtcccaga

SEQ ID NO: 1126852 - DNA, 12 bp, Homo sapiens
tggaaccagccc

SEQ ID NO: 1126853 - DNA, 13 bp, Homo sapiens
tggaaccagcccc

SEQ ID NO: 1126854 - DNA, 14 bp, Homo sapiens
tggaaccagcccca

SEQ ID NO: 1126855 - DNA, 23 bp, Homo sapiens
tggaaccagccccatcagaacct

SEQ ID NO: 1126856 - DNA, 17 bp, Homo sapiens
tggaaccagggaggaga

SEQ ID NO: 1126857 - DNA, 21 bp, Homo sapiens
tggaaccagggaggagaggaa

SEQ ID NO: 1126858 - DNA, 18 bp, Homo sapiens
tggaacccttttggcccc

SEQ ID NO: 1126859 - DNA, 19 bp, Homo sapiens
tggaacctgcaaaaaatac

SEQ ID NO: 1126860 - DNA, 14 bp, Homo sapiens
tggaaccttctaga

SEQ ID NO: 1126861 - DNA, 13 bp, Homo sapiens
tggaaccttgctg

SEQ ID NO: 1126862 - DNA, 23 bp, Homo sapiens
tggaaccttgctgtcctgatctg

SEQ ID NO: 1126863 - DNA, 22 bp, Homo sapiens
tggaacgggcatgggcctctct

SEQ ID NO: 1126864 - DNA, 23 bp, Homo sapiens
tggaacgggcatgggcctctctg

SEQ ID NO: 1126865 - DNA, 21 bp, Homo sapiens
tggaacgtttttcctgttctt

SEQ ID NO: 1126866 - DNA, 14 bp, Homo sapiens
tggaactaataaat

SEQ ID NO: 1126867 - DNA, 20 bp, Homo sapiens
tggaactatacccgggacca

SEQ ID NO: 1126868 - DNA, 19 bp, Homo sapiens
tggaactctactcaaccca

SEQ ID NO: 1126869 - DNA, 13 bp, Homo sapiens
tggaactgacccc

SEQ ID NO: 1126870 - DNA, 21 bp, Homo sapiens
tggaactgaccccctcccctg

SEQ ID NO: 1126871 - DNA, 20 bp, Homo sapiens
tggaactgcgataactgaga

SEQ ID NO: 1126872 - DNA, 23 bp, Homo sapiens
tggaactgcgataactgagaaac

SEQ ID NO: 1126873 - DNA, 14 bp, Homo sapiens
tggaactgtgtatt

SEQ ID NO: 1126874 - DNA, 20 bp, Homo sapiens
tggaactgtgtatttattta

SEQ ID NO: 1126875 - DNA, 21 bp, Homo sapiens
tggaacttctaatatattttt

SEQ ID NO: 1126876 - DNA, 16 bp, Homo sapiens
tggaacttgaactgat

SEQ ID NO: 1126877 - DNA, 21 bp, Homo sapiens
tggaagaaactaaaaatatag

SEQ ID NO: 1126878 - DNA, 22 bp, Homo sapiens
tggaagaaatggctatgaacag

SEQ ID NO: 1126879 - DNA, 23 bp, Homo sapiens
tggaagaaatggctatgaacaga

SEQ ID NO: 1126880 - DNA, 17 bp, Homo sapiens
tggaagaaattcctgta

SEQ ID NO: 1126881 - DNA, 20 bp, Homo sapiens
tggaagaaattcctgtagca

SEQ ID NO: 1126882 - DNA, 13 bp, Homo sapiens
tggaagaacatca

SEQ ID NO: 1126883 - DNA, 20 bp, Homo sapiens
tggaagacacttcagatctg

SEQ ID NO: 1126884 - DNA, 23 bp, Homo sapiens
tggaagacacttcagatctgagg

SEQ ID NO: 1126885 - DNA, 14 bp, Homo sapiens
tggaagagagaaag

SEQ ID NO: 1126886 - DNA, 17 bp, Homo sapiens
tggaagagaggcacctg

SEQ ID NO: 1126887 - DNA, 21 bp, Homo sapiens
tggaagagaggcacctgctgg

SEQ ID NO: 1126888 - DNA, 13 bp, Homo sapiens
tggaagagattcc

SEQ ID NO: 1126889 - DNA, 13 bp, Homo sapiens
tggaagagcagcc

SEQ ID NO: 1126890 - DNA, 15 bp, Homo sapiens
tggaagagcagcctg

SEQ ID NO: 1126891 - DNA, 17 bp, Homo sapiens
tggaagagcagcctgat

SEQ ID NO: 1126892 - DNA, 13 bp, Homo sapiens
tggaagagctctt

SEQ ID NO: 1126893 - DNA, 13 bp, Homo sapiens
tggaagatcctgc

SEQ ID NO: 1126894 - DNA, 19 bp, Homo sapiens
tggaagatctgcaaacatt

SEQ ID NO: 1126895 - DNA, 23 bp, Homo sapiens
tggaagatggtccgtgcccaggc

SEQ ID NO: 1126896 - DNA, 14 bp, Homo sapiens
tggaagattcagct

SEQ ID NO: 1126897 - DNA, 15 bp, Homo sapiens
tggaagcaaagacaa

SEQ ID NO: 1126898 - DNA, 16 bp, Homo sapiens
tggaagcaaagacaaa

SEQ ID NO: 1126899 - DNA, 13 bp, Homo sapiens
tggaagcaggtgc

SEQ ID NO: 1126900 - DNA, 16 bp, Homo sapiens
tggaagcatggctgtc

SEQ ID NO: 1126901 - DNA, 21 bp, Homo sapiens
tggaagcatgtttattctgtt

SEQ ID NO: 1126902 - DNA, 16 bp, Homo sapiens
tggaagccagctttcc

SEQ ID NO: 1126903 - DNA, 17 bp, Homo sapiens
tggaagccggagggtgt

SEQ ID NO: 1126904 - DNA, 15 bp, Homo sapiens
tggaagcctggactc

SEQ ID NO: 1126905 - DNA, 18 bp, Homo sapiens
tggaagctaatttgcatt

SEQ ID NO: 1126906 - DNA, 20 bp, Homo sapiens
tggaagctgattaaaacaca

SEQ ID NO: 1126907 - DNA, 18 bp, Homo sapiens
tggaagctgctgaggccc

SEQ ID NO: 1126908 - DNA, 15 bp, Homo sapiens
tggaagctgtgtcct

SEQ ID NO: 1126909 - DNA, 16 bp, Homo sapiens
tggaagctgtgtcctt

SEQ ID NO: 1126910 - DNA, 23 bp, Homo sapiens
tggaagctgtttggaaaagacag

SEQ ID NO: 1126911 - DNA, 16 bp, Homo sapiens
tggaaggacacagtga

SEQ ID NO: 1126912 - DNA, 15 bp, Homo sapiens
tggaaggatctgctg

SEQ ID NO: 1126913 - DNA, 19 bp, Homo sapiens
tggaaggatctgctgaggc

SEQ ID NO: 1126914 - DNA, 23 bp, Homo sapiens
tggaaggatctgctgaggcccag

SEQ ID NO: 1126915 - DNA, 14 bp, Homo sapiens
tggaaggcagagaa

SEQ ID NO: 1126916 - DNA, 15 bp, Homo sapiens
tggaaggcagagaaa

SEQ ID NO: 1126917 - DNA, 18 bp, Homo sapiens
tggaaggcagagaaatct

SEQ ID NO: 1126918 - DNA, 23 bp, Homo sapiens
tggaagggaggaaggcctttctt

SEQ ID NO: 1126919 - DNA, 21 bp, Homo sapiens
tggaagggcgttctaggtagg

SEQ ID NO: 1126920 - DNA, 18 bp, Homo sapiens
tggaaggggcagccctga

SEQ ID NO: 1126921 - DNA, 19 bp, Homo sapiens
tggaaggggcagccctgag

SEQ ID NO: 1126922 - DNA, 18 bp, Homo sapiens
tggaagggggtgtgcgtg

SEQ ID NO: 1126923 - DNA, 17 bp, Homo sapiens
tggaagggtttgtggct

SEQ ID NO: 1126924 - DNA, 21 bp, Homo sapiens
tggaaggtatttttttaaatt

SEQ ID NO: 1126925 - DNA, 12 bp, Homo sapiens
tggaaggtgcca

SEQ ID NO: 1126926 - DNA, 16 bp, Homo sapiens
tggaaggtgccagaag

SEQ ID NO: 1126927 - DNA, 20 bp, Homo sapiens
tggaaggtgccagaaggaag

SEQ ID NO: 1126928 - DNA, 22 bp, Homo sapiens
tggaaggtgccagaaggaaggt

SEQ ID NO: 1126929 - DNA, 21 bp, Homo sapiens
tggaagtcacctttctgggct

SEQ ID NO: 1126930 - DNA, 22 bp, Homo sapiens
tggaagtcagtacgatcaagtt

SEQ ID NO: 1126931 - DNA, 17 bp, Homo sapiens
tggaagtccaatgtggc

SEQ ID NO: 1126932 - DNA, 21 bp, Homo sapiens
tggaagtctccatgaagagct

SEQ ID NO: 1126933 - DNA, 22 bp, Homo sapiens
tggaagtctccatgaagagctt

SEQ ID NO: 1126934 - DNA, 17 bp, Homo sapiens
tggaagtgttcaagaaa

SEQ ID NO: 1126935 - DNA, 15 bp, Homo sapiens
tggaagttcttcaag

SEQ ID NO: 1126936 - DNA, 16 bp, Homo sapiens
tggaagttgagactta

SEQ ID NO: 1126937 - DNA, 13 bp, Homo sapiens
tggaagttggggc

SEQ ID NO: 1126938 - DNA, 23 bp, Homo sapiens
tggaataaaatataaaactgaaa

SEQ ID NO: 1126939 - DNA, 18 bp, Homo sapiens
tggaataaacagtgagca

SEQ ID NO: 1126940 - DNA, 20 bp, Homo sapiens
tggaataaacagtgagcata

SEQ ID NO: 1126941 - DNA, 21 bp, Homo sapiens
tggaataaacagtgagcatat

SEQ ID NO: 1126942 - DNA, 14 bp, Homo sapiens
tggaataaacatta

SEQ ID NO: 1126943 - DNA, 17 bp, Homo sapiens
tggaataaacattaatt

SEQ ID NO: 1126944 - DNA, 18 bp, Homo sapiens
tggaataaagttgcagat

SEQ ID NO: 1126945 - DNA, 20 bp, Homo sapiens
tggaataaatccttcgtcct

SEQ ID NO: 1126946 - DNA, 17 bp, Homo sapiens
tggaataatttctatta

SEQ ID NO: 1126947 - DNA, 14 bp, Homo sapiens
tggaataatttgta

SEQ ID NO: 1126948 - DNA, 14 bp, Homo sapiens
tggaatacatgaaa

SEQ ID NO: 1126949 - DNA, 15 bp, Homo sapiens
tggaatacatgaaat

SEQ ID NO: 1126950 - DNA, 17 bp, Homo sapiens
tggaataggaataagct

SEQ ID NO: 1126951 - DNA, 14 bp, Homo sapiens
tggaatataaggaa

SEQ ID NO: 1126952 - DNA, 16 bp, Homo sapiens
tggaatattcatttta

SEQ ID NO: 1126953 - DNA, 17 bp, Homo sapiens
tggaatattcattttac

SEQ ID NO: 1126954 - DNA, 24 bp, Homo sapiens
tggaatatttataggccagggcat

SEQ ID NO: 1126955 - DNA, 13 bp, Homo sapiens
tggaatatttgaa

SEQ ID NO: 1126956 - DNA, 16 bp, Homo sapiens
tggaatcagctcagga

SEQ ID NO: 1126957 - DNA, 21 bp, Homo sapiens
tggaatcagtatttccttcca

SEQ ID NO: 1126958 - DNA, 15 bp, Homo sapiens
tggaatccatctgtc

SEQ ID NO: 1126959 - DNA, 22 bp, Homo sapiens
tggaatcctccttaatttaatt

SEQ ID NO: 1126960 - DNA, 19 bp, Homo sapiens
tggagaagctcccaggaac

SEQ ID NO: 1126961 - DNA, 15 bp, Homo sapiens
tggagaagtctcagc

SEQ ID NO: 1126962 - DNA, 23 bp, Homo sapiens
tggagaagtctcagctaagctca

SEQ ID NO: 1126963 - DNA, 22 bp, Homo sapiens
tggagaagtcttagacttgaaa

SEQ ID NO: 1126964 - DNA, 13 bp, Homo sapiens
tggagaatacttt

SEQ ID NO: 1126965 - DNA, 20 bp, Homo sapiens
tggagaatactttgcttcat

SEQ ID NO: 1126966 - DNA, 19 bp, Homo sapiens
tggagaatgtatcagccag

SEQ ID NO: 1126967 - DNA, 14 bp, Homo sapiens
tggagacaaggtgc

SEQ ID NO: 1126968 - DNA, 22 bp, Homo sapiens
tggagacagtcctttcccacca

SEQ ID NO: 1126969 - DNA, 14 bp, Homo sapiens
tggagaccacactg

SEQ ID NO: 1126970 - DNA, 18 bp, Homo sapiens
tggagaccagggagcctt

SEQ ID NO: 1126971 - DNA, 19 bp, Homo sapiens
tggagaccagggagccttt

SEQ ID NO: 1126972 - DNA, 14 bp, Homo sapiens
tggagaccctgcca

SEQ ID NO: 1126973 - DNA, 20 bp, Homo sapiens
tggagaccctgccacagcca

SEQ ID NO: 1126974 - DNA, 23 bp, Homo sapiens
tggagaccgcttcacccctgcac

SEQ ID NO: 1126975 - DNA, 16 bp, Homo sapiens
tggagacctcatgcca

SEQ ID NO: 1126976 - DNA, 12 bp, Homo sapiens
tggagacgtgga

SEQ ID NO: 1126977 - DNA, 13 bp, Homo sapiens
tggagactcctgc

SEQ ID NO: 1126978 - DNA, 16 bp, Homo sapiens
tggagactcctggtct

SEQ ID NO: 1126979 - DNA, 19 bp, Homo sapiens
tggagactctgtggggcct

SEQ ID NO: 1126980 - DNA, 16 bp, Homo sapiens
tggagactttgctgtt

SEQ ID NO: 1126981 - DNA, 16 bp, Homo sapiens
tggagagaagtgagca

SEQ ID NO: 1126982 - DNA, 13 bp, Homo sapiens
tggagagaatcat

SEQ ID NO: 1126983 - DNA, 15 bp, Homo sapiens
tggagagagaggctg

SEQ ID NO: 1126984 - DNA, 15 bp, Homo sapiens
tggagagcaaaggcc

SEQ ID NO: 1126985 - DNA, 19 bp, Homo sapiens
tggagagcaaaggcccatg

SEQ ID NO: 1126986 - DNA, 22 bp, Homo sapiens
tggagagcaaaggcccatgccc

SEQ ID NO: 1126987 - DNA, 14 bp, Homo sapiens
tggagagcagcagg

SEQ ID NO: 1126988 - DNA, 14 bp, Homo sapiens
tggagagcagctgg

SEQ ID NO: 1126989 - DNA, 21 bp, Homo sapiens
tggagagcccggcgcccctgc

SEQ ID NO: 1126990 - DNA, 11 bp, Homo sapiens
tggagagccct

SEQ ID NO: 1126991 - DNA, 14 bp, Homo sapiens
tggagagccctgga

SEQ ID NO: 1126992 - DNA, 20 bp, Homo sapiens
tggagagcctcttagtgatt

SEQ ID NO: 1126993 - DNA, 16 bp, Homo sapiens
tggagagctggtgccc

SEQ ID NO: 1126994 - DNA, 19 bp, Homo sapiens
tggagagctgttcgctcct

SEQ ID NO: 1126995 - DNA, 20 bp, Homo sapiens
tggagaggaagccagtggag

SEQ ID NO: 1126996 - DNA, 21 bp, Homo sapiens
tggagaggacggccctgcctg

SEQ ID NO: 1126997 - DNA, 11 bp, Homo sapiens
tggagaggaga

SEQ ID NO: 1126998 - DNA, 21 bp, Homo sapiens
tggagaggagggatgctgcct

SEQ ID NO: 1126999 - DNA, 23 bp, Homo sapiens
tggagaggagggatgctgcctga

SEQ ID NO: 1127000 - DNA, 14 bp, Homo sapiens
tggagaggcggcct

SEQ ID NO: 1127001 - DNA, 15 bp, Homo sapiens
tggagaggcggcctc

SEQ ID NO: 1127002 - DNA, 20 bp, Homo sapiens
tggagagggacagcccactg

SEQ ID NO: 1127003 - DNA, 19 bp, Homo sapiens
tggagagggagactcctgg

SEQ ID NO: 1127004 - DNA, 17 bp, Homo sapiens
tggagagggggccggac

SEQ ID NO: 1127005 - DNA, 17 bp, Homo sapiens
tggagaggtggctgcgc

SEQ ID NO: 1127006 - DNA, 16 bp, Homo sapiens
tggagagtggggagag

SEQ ID NO: 1127007 - DNA, 20 bp, Homo sapiens
tggagataaagatttcttga

SEQ ID NO: 1127008 - DNA, 19 bp, Homo sapiens
tggagataacagcctcttg

SEQ ID NO: 1127009 - DNA, 15 bp, Homo sapiens
tggagatagctgggg

SEQ ID NO: 1127010 - DNA, 18 bp, Homo sapiens
tggagatagctggggctt

SEQ ID NO: 1127011 - DNA, 17 bp, Homo sapiens
tggagatagtgccaggt

SEQ ID NO: 1127012 - DNA, 22 bp, Homo sapiens
tggagatattataagggagagc

SEQ ID NO: 1127013 - DNA, 23 bp, Homo sapiens
tggagatatttatggggggagaa

SEQ ID NO: 1127014 - DNA, 22 bp, Homo sapiens
tggagatcaggtaccaaggaaa

SEQ ID NO: 1127015 - DNA, 16 bp, Homo sapiens
tggagatcctcctgca

SEQ ID NO: 1127016 - DNA, 19 bp, Homo sapiens
tggagatctgaacccagct

SEQ ID NO: 1127017 - DNA, 20 bp, Homo sapiens
tggagatctgaacccagctg

SEQ ID NO: 1127018 - DNA, 17 bp, Homo sapiens
tggagatgaggccagac

SEQ ID NO: 1127019 - DNA, 15 bp, Homo sapiens
tggagatgcaaggtg

SEQ ID NO: 1127020 - DNA, 14 bp, Homo sapiens
tggagatgcagagg

SEQ ID NO: 1127021 - DNA, 18 bp, Homo sapiens
tggagatgctgagggtgt

SEQ ID NO: 1127022 - DNA, 13 bp, Homo sapiens
tggagatggactc

SEQ ID NO: 1127023 - DNA, 14 bp, Homo sapiens
tggagatggactca

SEQ ID NO: 1127024 - DNA, 15 bp, Homo sapiens
tggagatgtaaaatg

SEQ ID NO: 1127025 - DNA, 20 bp, Homo sapiens
tggagatgtaaaatgagttt

SEQ ID NO: 1127026 - DNA, 16 bp, Homo sapiens
tggagattctgattca

SEQ ID NO: 1127027 - DNA, 19 bp, Homo sapiens
tggagatttggaattgaac

SEQ ID NO: 1127028 - DNA, 23 bp, Homo sapiens
tggagatttttcatacttttctt

SEQ ID NO: 1127029 - DNA, 15 bp, Homo sapiens
tggagcaaaaggcag

SEQ ID NO: 1127030 - DNA, 19 bp, Homo sapiens
tggagcaaaaggcagctca

SEQ ID NO: 1127031 - DNA, 21 bp, Homo sapiens
tggagcaaagaaggagctgag

SEQ ID NO: 1127032 - DNA, 15 bp, Homo sapiens
tggagcaagaaggaa

SEQ ID NO: 1127033 - DNA, 22 bp, Homo sapiens
tggagcacgtggagatagtgcc

SEQ ID NO: 1127034 - DNA, 15 bp, Homo sapiens
tggagcactggactc

SEQ ID NO: 1127035 - DNA, 21 bp, Homo sapiens
tggagcactggactccggggc

SEQ ID NO: 1127036 - DNA, 13 bp, Homo sapiens
tggagcagagctc

SEQ ID NO: 1127037 - DNA, 13 bp, Homo sapiens
tggagcagagggg

SEQ ID NO: 1127038 - DNA, 13 bp, Homo sapiens
tggagcagcagcc

SEQ ID NO: 1127039 - DNA, 15 bp, Homo sapiens
tggagcagccaaggc

SEQ ID NO: 1127040 - DNA, 14 bp, Homo sapiens
tggagcagccagag

SEQ ID NO: 1127041 - DNA, 17 bp, Homo sapiens
tggagcagccagagctg

SEQ ID NO: 1127042 - DNA, 21 bp, Homo sapiens
tggagcagccagagctgtgcc

SEQ ID NO: 1127043 - DNA, 20 bp, Homo sapiens
tggagcagcggattgctctg

SEQ ID NO: 1127044 - DNA, 22 bp, Homo sapiens
tggagcagctattttaagccat

SEQ ID NO: 1127045 - DNA, 17 bp, Homo sapiens
tggagcatcaagccact

SEQ ID NO: 1127046 - DNA, 15 bp, Homo sapiens
tggagcatctgactc

SEQ ID NO: 1127047 - DNA, 17 bp, Homo sapiens
tggagcatgggcctggc

SEQ ID NO: 1127048 - DNA, 18 bp, Homo sapiens
tggagcatgggcctggcc

SEQ ID NO: 1127049 - DNA, 20 bp, Homo sapiens
tggagcattaactaaatgct

SEQ ID NO: 1127050 - DNA, 23 bp, Homo sapiens
tggagcattaactaaatgctcat

SEQ ID NO: 1127051 - DNA, 17 bp, Homo sapiens
tggagcatttctcatca

SEQ ID NO: 1127052 - DNA, 21 bp, Homo sapiens
tggagcatttctcatcagtag

SEQ ID NO: 1127053 - DNA, 16 bp, Homo sapiens
tggagccaagtccaga

SEQ ID NO: 1127054 - DNA, 14 bp, Homo sapiens
tggagccagagaga

SEQ ID NO: 1127055 - DNA, 15 bp, Homo sapiens
tggagccagagagaa

SEQ ID NO: 1127056 - DNA, 13 bp, Homo sapiens
tggagccagctcc

SEQ ID NO: 1127057 - DNA, 23 bp, Homo sapiens
tggagccagggagcggccgcctg

SEQ ID NO: 1127058 - DNA, 14 bp, Homo sapiens
tggagccagggcag

SEQ ID NO: 1127059 - DNA, 22 bp, Homo sapiens
tggagccagggcagaggaatgt

SEQ ID NO: 1127060 - DNA, 14 bp, Homo sapiens
tggagccagggcct

SEQ ID NO: 1127061 - DNA, 21 bp, Homo sapiens
tggagccattgaacagctgtg

SEQ ID NO: 1127062 - DNA, 17 bp, Homo sapiens
tggagcccacagcgagc

SEQ ID NO: 1127063 - DNA, 12 bp, Homo sapiens
tggagcccccag

SEQ ID NO: 1127064 - DNA, 15 bp, Homo sapiens
tggagcccccagcag

SEQ ID NO: 1127065 - DNA, 17 bp, Homo sapiens
tggagcccccagcagag

SEQ ID NO: 1127066 - DNA, 21 bp, Homo sapiens
tggagcccccagcagaggcag

SEQ ID NO: 1127067 - DNA, 22 bp, Homo sapiens
tggagcccgtgcagtacaggca

SEQ ID NO: 1127068 - DNA, 13 bp, Homo sapiens
tggagccctgggc

SEQ ID NO: 1127069 - DNA, 12 bp, Homo sapiens
tggagccgaggc

SEQ ID NO: 1127070 - DNA, 17 bp, Homo sapiens
tggagcctacattcctt

SEQ ID NO: 1127071 - DNA, 18 bp, Homo sapiens
tggagcctctttttcctt

SEQ ID NO: 1127072 - DNA, 19 bp, Homo sapiens
tggagcctctttttccttc

SEQ ID NO: 1127073 - DNA, 22 bp, Homo sapiens
tggagcctctttttccttcttc

SEQ ID NO: 1127074 - DNA, 15 bp, Homo sapiens
tggagcctgcagggt

SEQ ID NO: 1127075 - DNA, 14 bp, Homo sapiens
tggagcgcacctgc

SEQ ID NO: 1127076 - DNA, 21 bp, Homo sapiens
tggagcgcacctgccccctgg

SEQ ID NO: 1127077 - DNA, 23 bp, Homo sapiens
tggagcgggcatggccgggccct

SEQ ID NO: 1127078 - DNA, 18 bp, Homo sapiens
tggagcggggtatgaaga

SEQ ID NO: 1127079 - DNA, 17 bp, Homo sapiens
tggagcgtttgctgtgc

SEQ ID NO: 1127080 - DNA, 22 bp, Homo sapiens
tggagctcagccccgagctgtc

SEQ ID NO: 1127081 - DNA, 22 bp, Homo sapiens
tggagctctgtgggtctctgga

SEQ ID NO: 1127082 - DNA, 19 bp, Homo sapiens
tggattttaaaaaatcaat

SEQ ID NO: 1127083 - DNA, 19 bp, Homo sapiens
tggattttctattgttact

SEQ ID NO: 1127084 - DNA, 20 bp, Homo sapiens
tggattttctattgttactc

SEQ ID NO: 1127085 - DNA, 15 bp, Homo sapiens
tggatttttaaatta

SEQ ID NO: 1127086 - DNA, 19 bp, Homo sapiens
tggattttttatgtacaac

SEQ ID NO: 1127087 - DNA, 15 bp, Homo sapiens
tggcaaaagccacat

SEQ ID NO: 1127088 - DNA, 17 bp, Homo sapiens
tggcaaaccctcccaga

SEQ ID NO: 1127089 - DNA, 20 bp, Homo sapiens
tggcaaaccctcccagaaac

SEQ ID NO: 1127090 - DNA, 15 bp, Homo sapiens
tggcaaacttttctt

SEQ ID NO: 1127091 - DNA, 13 bp, Homo sapiens
tggcaaagcagaa

SEQ ID NO: 1127092 - DNA, 17 bp, Homo sapiens
tggcaaagcttttagaa

SEQ ID NO: 1127093 - DNA, 14 bp, Homo sapiens
tggcaaagtgctgt

SEQ ID NO: 1127094 - DNA, 17 bp, Homo sapiens
tggcaaatcacttcaat

SEQ ID NO: 1127095 - DNA, 16 bp, Homo sapiens
tggcaaatcaggggcc

SEQ ID NO: 1127096 - DNA, 21 bp, Homo sapiens
tggcaaatcaggggccagaga

SEQ ID NO: 1127097 - DNA, 21 bp, Homo sapiens
tggcaaatggaggcttttcac

SEQ ID NO: 1127098 - DNA, 18 bp, Homo sapiens
tggcaaattttaaaacat

SEQ ID NO: 1127099 - DNA, 13 bp, Homo sapiens
tggcaacacagag

SEQ ID NO: 1127100 - DNA, 13 bp, Homo sapiens
tggcaacagaagc

SEQ ID NO: 1127101 - DNA, 21 bp, Homo sapiens
tggcaacagttagctggagct

SEQ ID NO: 1127102 - DNA, 16 bp, Homo sapiens
tggcaacattcattgc

SEQ ID NO: 1127103 - DNA, 19 bp, Homo sapiens
tggcaactcttcagacgga

SEQ ID NO: 1127104 - DNA, 15 bp, Homo sapiens
tggcaagaaagctgg

SEQ ID NO: 1127105 - DNA, 22 bp, Homo sapiens
tggcaagagggtgacagcttcc

SEQ ID NO: 1127106 - DNA, 17 bp, Homo sapiens
tggcaagagtgtggagg

SEQ ID NO: 1127107 - DNA, 16 bp, Homo sapiens
tggcaagatgtttctt

SEQ ID NO: 1127108 - DNA, 17 bp, Homo sapiens
tggcaagatgtttctta

SEQ ID NO: 1127109 - DNA, 15 bp, Homo sapiens
tggcaagcagggaaa

SEQ ID NO: 1127110 - DNA, 16 bp, Homo sapiens
tggcaagctgcaggtt

SEQ ID NO: 1127111 - DNA, 19 bp, Homo sapiens
tggcaaggactttgtacat

SEQ ID NO: 1127112 - DNA, 21 bp, Homo sapiens
tggcaaggactttgtacattt

SEQ ID NO: 1127113 - DNA, 17 bp, Homo sapiens
tggcaagtaacttctga

SEQ ID NO: 1127114 - DNA, 13 bp, Homo sapiens
tggcaataaactc

SEQ ID NO: 1127115 - DNA, 17 bp, Homo sapiens
tggcaatagtgtgttct

SEQ ID NO: 1127116 - DNA, 19 bp, Homo sapiens
tggcaatcccaccaaatca

SEQ ID NO: 1127117 - DNA, 23 bp, Homo sapiens
tggcaatcccaccaaatcatcct

SEQ ID NO: 1127118 - DNA, 19 bp, Homo sapiens
tggcaatgactcaaagtct

SEQ ID NO: 1127119 - DNA, 17 bp, Homo sapiens
tggcaattctggaagct

SEQ ID NO: 1127120 - DNA, 16 bp, Homo sapiens
tggcaattgtctattt

SEQ ID NO: 1127121 - DNA, 16 bp, Homo sapiens
tggcaatttaacatgt

SEQ ID NO: 1127122 - DNA, 14 bp, Homo sapiens
tggcaattttgtaa

SEQ ID NO: 1127123 - DNA, 17 bp, Homo sapiens
tggcacacgcctgtagt

SEQ ID NO: 1127124 - DNA, 13 bp, Homo sapiens
tggcacactccct

SEQ ID NO: 1127125 - DNA, 20 bp, Homo sapiens
tggcacactccctctccttg

SEQ ID NO: 1127126 - DNA, 18 bp, Homo sapiens
tggcacagaccaggcctt

SEQ ID NO: 1127127 - DNA, 21 bp, Homo sapiens
tggcacaggagtgtcctcttc

SEQ ID NO: 1127128 - DNA, 13 bp, Homo sapiens
tggcacaggcact

SEQ ID NO: 1127129 - DNA, 17 bp, Homo sapiens
tggcacagtgatgccgg

SEQ ID NO: 1127130 - DNA, 22 bp, Homo sapiens
tggcacagtgatgccgggcgcc

SEQ ID NO: 1127131 - DNA, 23 bp, Homo sapiens
tggcacagtgatgccgggcgcca

SEQ ID NO: 1127132 - DNA, 14 bp, Homo sapiens
tggcacatcagaaa

SEQ ID NO: 1127133 - DNA, 18 bp, Homo sapiens
tggcacatcagaaaggaa

SEQ ID NO: 1127134 - DNA, 21 bp, Homo sapiens
tggcacatcagcacgatttct

SEQ ID NO: 1127135 - DNA, 23 bp, Homo sapiens
tggcacatcagcacgatttctgt

SEQ ID NO: 1127136 - DNA, 16 bp, Homo sapiens
tggcaccaccagggtg

SEQ ID NO: 1127137 - DNA, 19 bp, Homo sapiens
tggcaccagaggctgcaga

SEQ ID NO: 1127138 - DNA, 23 bp, Homo sapiens
tggcaccagaggctgcagaaggc

SEQ ID NO: 1127139 - DNA, 20 bp, Homo sapiens
tggcaccagaggtgcttctg

SEQ ID NO: 1127140 - DNA, 14 bp, Homo sapiens
tggcaccagatgca

SEQ ID NO: 1127141 - DNA, 19 bp, Homo sapiens
tggcaccagatgcaacctc

SEQ ID NO: 1127142 - DNA, 20 bp, Homo sapiens
tggcaccagatgcaacctca

SEQ ID NO: 1127143 - DNA, 17 bp, Homo sapiens
tggcaccagccccctgg

SEQ ID NO: 1127144 - DNA, 20 bp, Homo sapiens
tggcaccagccccctggatg

SEQ ID NO: 1127145 - DNA, 11 bp, Homo sapiens
tggcacccacc

SEQ ID NO: 1127146 - DNA, 22 bp, Homo sapiens
tggcacccaccgtctcggccct

SEQ ID NO: 1127147 - DNA, 16 bp, Homo sapiens
tggcacccccatgctg

SEQ ID NO: 1127148 - DNA, 20 bp, Homo sapiens
tggcacccccatgctgcctt

SEQ ID NO: 1127149 - DNA, 16 bp, Homo sapiens
tggcaccgccttctct

SEQ ID NO: 1127150 - DNA, 13 bp, Homo sapiens
tggcacctcctga

SEQ ID NO: 1127151 - DNA, 16 bp, Homo sapiens
tggcacctcctgagaa

SEQ ID NO: 1127152 - DNA, 19 bp, Homo sapiens
tggcacctcctgagaaggc

SEQ ID NO: 1127153 - DNA, 19 bp, Homo sapiens
tggcacctctgcccttccc

SEQ ID NO: 1127154 - DNA, 14 bp, Homo sapiens
tggcacgaaggccc

SEQ ID NO: 1127155 - DNA, 15 bp, Homo sapiens
tggcacgcacctgta

SEQ ID NO: 1127156 - DNA, 19 bp, Homo sapiens
tggcacgcacctgtagtcc

SEQ ID NO: 1127157 - DNA, 14 bp, Homo sapiens
tggcacgccctact

SEQ ID NO: 1127158 - DNA, 15 bp, Homo sapiens
tggcacgccctactc

SEQ ID NO: 1127159 - DNA, 20 bp, Homo sapiens
tggcacgggccctccctccc

SEQ ID NO: 1127160 - DNA, 20 bp, Homo sapiens
tggcacggtggctcaggcct

SEQ ID NO: 1127161 - DNA, 17 bp, Homo sapiens
tggcacgtgacaggctc

SEQ ID NO: 1127162 - DNA, 15 bp, Homo sapiens
tggcactataatgta

SEQ ID NO: 1127163 - DNA, 19 bp, Homo sapiens
tggcactcacagacctgga

SEQ ID NO: 1127164 - DNA, 22 bp, Homo sapiens
tggcactgagatttaaatgcaa

SEQ ID NO: 1127165 - DNA, 15 bp, Homo sapiens
tggcactggatggac

SEQ ID NO: 1127166 - DNA, 16 bp, Homo sapiens
tggcactggatggact

SEQ ID NO: 1127167 - DNA, 19 bp, Homo sapiens
tggcactggatggacttgg

SEQ ID NO: 1127168 - DNA, 19 bp, Homo sapiens
tggcactggggaaacataa

SEQ ID NO: 1127169 - DNA, 20 bp, Homo sapiens
tggcactgttaatacacagt

SEQ ID NO: 1127170 - DNA, 18 bp, Homo sapiens
tggcacttaagtgcactt

SEQ ID NO: 1127171 - DNA, 21 bp, Homo sapiens
tggcacttagctatcagaaga

SEQ ID NO: 1127172 - DNA, 12 bp, Homo sapiens
tggcacttgtat

SEQ ID NO: 1127173 - DNA, 18 bp, Homo sapiens
tggcacttgtatttaatt

SEQ ID NO: 1127174 - DNA, 22 bp, Homo sapiens
tggcacttgtatttaattcttc

SEQ ID NO: 1127175 - DNA, 19 bp, Homo sapiens
tggcagaaaagaggagacc

SEQ ID NO: 1127176 - DNA, 23 bp, Homo sapiens
tggcagaaaagaggagaccctgg

SEQ ID NO: 1127177 - DNA, 24 bp, Homo sapiens
tggcagaaaagaggagaccctgga

SEQ ID NO: 1127178 - DNA, 23 bp, Homo sapiens
tggcagaaatacagtcttccaca

SEQ ID NO: 1127179 - DNA, 21 bp, Homo sapiens
tggcagaagggaattgctcag

SEQ ID NO: 1127180 - DNA, 20 bp, Homo sapiens
tggcagactcaaggggctgg

SEQ ID NO: 1127181 - DNA, 19 bp, Homo sapiens
tggcagactctttaataaa

SEQ ID NO: 1127182 - DNA, 22 bp, Homo sapiens
tggcagactctttaataaattg

SEQ ID NO: 1127183 - DNA, 12 bp, Homo sapiens
tggcagagaagg

SEQ ID NO: 1127184 - DNA, 19 bp, Homo sapiens
tggcagagaaggcctcttg

SEQ ID NO: 1127185 - DNA, 16 bp, Homo sapiens
tggcagagcacagccc

SEQ ID NO: 1127186 - DNA, 17 bp, Homo sapiens
tggcagagcacagccca

SEQ ID NO: 1127187 - DNA, 12 bp, Homo sapiens
tggcagagttac

SEQ ID NO: 1127188 - DNA, 15 bp, Homo sapiens
tggcagagttgtaaa

SEQ ID NO: 1127189 - DNA, 17 bp, Homo sapiens
tggcagagttgtaaata

SEQ ID NO: 1127190 - DNA, 19 bp, Homo sapiens
tggcagagttgtaaatata

SEQ ID NO: 1127191 - DNA, 22 bp, Homo sapiens
tggcagagtttgtgtgttgtct

SEQ ID NO: 1127192 - DNA, 19 bp, Homo sapiens
tggcagataatcagcctct

SEQ ID NO: 1127193 - DNA, 18 bp, Homo sapiens
tggcagattcccactgcc

SEQ ID NO: 1127194 - DNA, 20 bp, Homo sapiens
tggcagattcccactgccgc

SEQ ID NO: 1127195 - DNA, 22 bp, Homo sapiens
tggcagattttacaaaagatgt

SEQ ID NO: 1127196 - DNA, 13 bp, Homo sapiens
tggcagcaacaat

SEQ ID NO: 1127197 - DNA, 20 bp, Homo sapiens
tggcagcaacggcacagcta

SEQ ID NO: 1127198 - DNA, 14 bp, Homo sapiens
tggcagcacagccc

SEQ ID NO: 1127199 - DNA, 17 bp, Homo sapiens
tggcagcacagcccagg

SEQ ID NO: 1127200 - DNA, 16 bp, Homo sapiens
tggcagcacgcaggcg

SEQ ID NO: 1127201 - DNA, 22 bp, Homo sapiens
tggcagcacggcccggcccctc

SEQ ID NO: 1127202 - DNA, 23 bp, Homo sapiens
tggcagcacggcccggcccctca

SEQ ID NO: 1127203 - DNA, 22 bp, Homo sapiens
tggccccagtgcggttcctcat

SEQ ID NO: 1127204 - DNA, 16 bp, Homo sapiens
tggcccccaataaagg

SEQ ID NO: 1127205 - DNA, 17 bp, Homo sapiens
tggcccccaataaaggc

SEQ ID NO: 1127206 - DNA, 19 bp, Homo sapiens
tggcccccaataaaggcag

SEQ ID NO: 1127207 - DNA, 23 bp, Homo sapiens
tggcccccaataaaggcagctgc

SEQ ID NO: 1127208 - DNA, 14 bp, Homo sapiens
tggcccccagccct

SEQ ID NO: 1127209 - DNA, 17 bp, Homo sapiens
tggcccccagccctggg

SEQ ID NO: 1127210 - DNA, 16 bp, Homo sapiens
tggcccccgagctggg

SEQ ID NO: 1127211 - DNA, 17 bp, Homo sapiens
tggccccctttcccggg

SEQ ID NO: 1127212 - DNA, 16 bp, Homo sapiens
tggccccgcctgcctg

SEQ ID NO: 1127213 - DNA, 18 bp, Homo sapiens
tggccccgggctctggcc

SEQ ID NO: 1127214 - DNA, 22 bp, Homo sapiens
tggccccgggctctggccaccc

SEQ ID NO: 1127215 - DNA, 17 bp, Homo sapiens
tggcccctcacatcctc

SEQ ID NO: 1127216 - DNA, 23 bp, Homo sapiens
tggcccctcacatcctctccagg

SEQ ID NO: 1127217 - DNA, 23 bp, Homo sapiens
tggcccctcacccaccatggacc

SEQ ID NO: 1127218 - DNA, 13 bp, Homo sapiens
tggcccctcacct

SEQ ID NO: 1127219 - DNA, 16 bp, Homo sapiens
tggcccctcacctggg

SEQ ID NO: 1127220 - DNA, 19 bp, Homo sapiens
tggcccctccccctgccag

SEQ ID NO: 1127221 - DNA, 15 bp, Homo sapiens
tggcccctccttgca

SEQ ID NO: 1127222 - DNA, 10 bp, Homo sapiens
tggcccctct

SEQ ID NO: 1127223 - DNA, 12 bp, Homo sapiens
tggcccctctga

SEQ ID NO: 1127224 - DNA, 21 bp, Homo sapiens
tggcccctgagcccagagaag

SEQ ID NO: 1127225 - DNA, 16 bp, Homo sapiens
tggccccttcacttct

SEQ ID NO: 1127226 - DNA, 17 bp, Homo sapiens
tggccccttttactttt

SEQ ID NO: 1127227 - DNA, 15 bp, Homo sapiens
tggcccgacagcctg

SEQ ID NO: 1127228 - DNA, 17 bp, Homo sapiens
tggcccgaggaagctgg

SEQ ID NO: 1127229 - DNA, 21 bp, Homo sapiens
tggcccgcccctcgctgctgc

SEQ ID NO: 1127230 - DNA, 18 bp, Homo sapiens
tggcccgcggcctgcacc

SEQ ID NO: 1127231 - DNA, 15 bp, Homo sapiens
tggcccgtgacagac

SEQ ID NO: 1127232 - DNA, 18 bp, Homo sapiens
tggcccgtgacagactcc

SEQ ID NO: 1127233 - DNA, 20 bp, Homo sapiens
tggcccgtgacagactcctg

SEQ ID NO: 1127234 - DNA, 14 bp, Homo sapiens
tggcccgtggcctg

SEQ ID NO: 1127235 - DNA, 18 bp, Homo sapiens
tggcccgtggcctggcat

SEQ ID NO: 1127236 - DNA, 23 bp, Homo sapiens
tggcccgtggcctggcatctgtg

SEQ ID NO: 1127237 - DNA, 21 bp, Homo sapiens
tggccctacttccaggatgga

SEQ ID NO: 1127238 - DNA, 13 bp, Homo sapiens
tggccctccctca

SEQ ID NO: 1127239 - DNA, 17 bp, Homo sapiens
tggccctccctccctag

SEQ ID NO: 1127240 - DNA, 20 bp, Homo sapiens
tggccctccctccctagccc

SEQ ID NO: 1127241 - DNA, 19 bp, Homo sapiens
tggccctcttgcgggcctg

SEQ ID NO: 1127242 - DNA, 20 bp, Homo sapiens
tggccctcttgcgggcctgg

SEQ ID NO: 1127243 - DNA, 21 bp, Homo sapiens
tggccctcttgcgggcctgga

SEQ ID NO: 1127244 - DNA, 21 bp, Homo sapiens
tggccctgactgtcagggagg

SEQ ID NO: 1127245 - DNA, 19 bp, Homo sapiens
tggccctgccatcttccca

SEQ ID NO: 1127246 - DNA, 20 bp, Homo sapiens
tggccctgcccttggcacca

SEQ ID NO: 1127247 - DNA, 13 bp, Homo sapiens
tggccctggagcc

SEQ ID NO: 1127248 - DNA, 16 bp, Homo sapiens
tggccctggagccagg

SEQ ID NO: 1127249 - DNA, 23 bp, Homo sapiens
tggccctggggatcttcccacag

SEQ ID NO: 1127250 - DNA, 18 bp, Homo sapiens
tggccctgggggtctggg

SEQ ID NO: 1127251 - DNA, 19 bp, Homo sapiens
tggccctggggtcccacga

SEQ ID NO: 1127252 - DNA, 16 bp, Homo sapiens
tggccctgtgcctggg

SEQ ID NO: 1127253 - DNA, 19 bp, Homo sapiens
tggccctgtgcctgggccc

SEQ ID NO: 1127254 - DNA, 21 bp, Homo sapiens
tggccctgttctcctccccaa

SEQ ID NO: 1127255 - DNA, 12 bp, Homo sapiens
tggcccttcagt

SEQ ID NO: 1127256 - DNA, 19 bp, Homo sapiens
tggcccttgcttacctctc

SEQ ID NO: 1127257 - DNA, 13 bp, Homo sapiens
tggcccttgggga

SEQ ID NO: 1127258 - DNA, 22 bp, Homo sapiens
tggccgagctcctggggagctc

SEQ ID NO: 1127259 - DNA, 20 bp, Homo sapiens
tggccgagggtcctggctcc

SEQ ID NO: 1127260 - DNA, 19 bp, Homo sapiens
tggccgagtccaagctggg

SEQ ID NO: 1127261 - DNA, 17 bp, Homo sapiens
tggccgcacgcctctcc

SEQ ID NO: 1127262 - DNA, 14 bp, Homo sapiens
tggccgcagaggtg

SEQ ID NO: 1127263 - DNA, 21 bp, Homo sapiens
tggccgcataggcccagccag

SEQ ID NO: 1127264 - DNA, 19 bp, Homo sapiens
tggccgccacccccatctt

SEQ ID NO: 1127265 - DNA, 12 bp, Homo sapiens
tggccgccacct

SEQ ID NO: 1127266 - DNA, 13 bp, Homo sapiens
tggccgccccctg

SEQ ID NO: 1127267 - DNA, 13 bp, Homo sapiens
tggccgctcctcc

SEQ ID NO: 1127268 - DNA, 15 bp, Homo sapiens
tggccgctcctccct

SEQ ID NO: 1127269 - DNA, 16 bp, Homo sapiens
tggccgctcctccctg

SEQ ID NO: 1127270 - DNA, 14 bp, Homo sapiens
tggccgctgagcgc

SEQ ID NO: 1127271 - DNA, 19 bp, Homo sapiens
tggccgctgagtggcaggg

SEQ ID NO: 1127272 - DNA, 19 bp, Homo sapiens
tggccggcaaccccagttc

SEQ ID NO: 1127273 - DNA, 24 bp, Homo sapiens
tggccggcaaccccagttctgctc

SEQ ID NO: 1127274 - DNA, 20 bp, Homo sapiens
tggccggcggctactctgga

SEQ ID NO: 1127275 - DNA, 13 bp, Homo sapiens
tggccggctgtgc

SEQ ID NO: 1127276 - DNA, 20 bp, Homo sapiens
tggccggctgtgctcagaga

SEQ ID NO: 1127277 - DNA, 15 bp, Homo sapiens
tggccgggagcctga

SEQ ID NO: 1127278 - DNA, 19 bp, Homo sapiens
tggccgggtcaccctgtga

SEQ ID NO: 1127279 - DNA, 18 bp, Homo sapiens
tggccgggtgcggtggct

SEQ ID NO: 1127280 - DNA, 14 bp, Homo sapiens
tggccgtggatggc

SEQ ID NO: 1127281 - DNA, 21 bp, Homo sapiens
tggcctaaaactggcctgact

SEQ ID NO: 1127282 - DNA, 13 bp, Homo sapiens
tggcctaaatttc

SEQ ID NO: 1127283 - DNA, 15 bp, Homo sapiens
tggcctaatcactct

SEQ ID NO: 1127284 - DNA, 14 bp, Homo sapiens
tggcctacattctt

SEQ ID NO: 1127285 - DNA, 16 bp, Homo sapiens
tggcctacattcttta

SEQ ID NO: 1127286 - DNA, 18 bp, Homo sapiens
tggcctatccgctgccag

SEQ ID NO: 1127287 - DNA, 17 bp, Homo sapiens
tggcctattatattaaa

SEQ ID NO: 1127288 - DNA, 17 bp, Homo sapiens
tggcctattccaggaat

SEQ ID NO: 1127289 - DNA, 13 bp, Homo sapiens
tggcctcaaccct

SEQ ID NO: 1127290 - DNA, 20 bp, Homo sapiens
tggcctcaaccctccctcag

SEQ ID NO: 1127291 - DNA, 21 bp, Homo sapiens
tggcctcaaccctccctcagc

SEQ ID NO: 1127292 - DNA, 15 bp, Homo sapiens
tggcctcaagaaagg

SEQ ID NO: 1127293 - DNA, 22 bp, Homo sapiens
tggcctcacccacccctgcaca

SEQ ID NO: 1127294 - DNA, 20 bp, Homo sapiens
tggcctcactggctggggca

SEQ ID NO: 1127295 - DNA, 13 bp, Homo sapiens
tggcctcagctgc

SEQ ID NO: 1127296 - DNA, 20 bp, Homo sapiens
tggcctcagttcccagctcc

SEQ ID NO: 1127297 - DNA, 13 bp, Homo sapiens
tggcctcatgtgg

SEQ ID NO: 1127298 - DNA, 18 bp, Homo sapiens
tggcctcatgtggctgga

SEQ ID NO: 1127299 - DNA, 21 bp, Homo sapiens
tggcctcatgtggctggaaga

SEQ ID NO: 1127300 - DNA, 18 bp, Homo sapiens
tggcctccagctgttctt

SEQ ID NO: 1127301 - DNA, 14 bp, Homo sapiens
tggcctccatttct

SEQ ID NO: 1127302 - DNA, 16 bp, Homo sapiens
tggcctccatttctgt

SEQ ID NO: 1127303 - DNA, 18 bp, Homo sapiens
tggcctccatttctgtct

SEQ ID NO: 1127304 - DNA, 13 bp, Homo sapiens
tggcctcccaaag

SEQ ID NO: 1127305 - DNA, 20 bp, Homo sapiens
tggcctcccaaagtgctgag

SEQ ID NO: 1127306 - DNA, 20 bp, Homo sapiens
tggcctcccaaagtgctggg

SEQ ID NO: 1127307 - DNA, 21 bp, Homo sapiens
tggcctcccaaagtgctggga

SEQ ID NO: 1127308 - DNA, 20 bp, Homo sapiens
tggcctcccaaatgagccat

SEQ ID NO: 1127309 - DNA, 18 bp, Homo sapiens
tggcctcccacagactca

SEQ ID NO: 1127310 - DNA, 14 bp, Homo sapiens
tggcctcccacccg

SEQ ID NO: 1127311 - DNA, 22 bp, Homo sapiens
tggcctccccatgggcacagtg

SEQ ID NO: 1127312 - DNA, 13 bp, Homo sapiens
tggcctcccccaa

SEQ ID NO: 1127313 - DNA, 17 bp, Homo sapiens
tggcctcccctgccacc

SEQ ID NO: 1127314 - DNA, 20 bp, Homo sapiens
tggcctcccctgccaccagg

SEQ ID NO: 1127315 - DNA, 15 bp, Homo sapiens
tggcctcccctgctg

SEQ ID NO: 1127316 - DNA, 13 bp, Homo sapiens
tggcctccctgct

SEQ ID NO: 1127317 - DNA, 14 bp, Homo sapiens
tggcctccctgctg

SEQ ID NO: 1127318 - DNA, 19 bp, Homo sapiens
tggcctccctgctgtgcca

SEQ ID NO: 1127319 - DNA, 15 bp, Homo sapiens
tggcctccggcctcc

SEQ ID NO: 1127320 - DNA, 21 bp, Homo sapiens
tggcctccgtcctgtcactga

SEQ ID NO: 1127321 - DNA, 19 bp, Homo sapiens
tggcctcctaaggctcccc

SEQ ID NO: 1127322 - DNA, 23 bp, Homo sapiens
tggcctcctaaggctccccaccc

SEQ ID NO: 1127323 - DNA, 21 bp, Homo sapiens
tggcctcctggcccgccctca

SEQ ID NO: 1127324 - DNA, 13 bp, Homo sapiens
tggcctcgcctcc

SEQ ID NO: 1127325 - DNA, 20 bp, Homo sapiens
tggctggaagatcctgcggg

SEQ ID NO: 1127326 - DNA, 21 bp, Homo sapiens
tggctggaagatcctgcgggt

SEQ ID NO: 1127327 - DNA, 18 bp, Homo sapiens
tggctggaaggggtccag

SEQ ID NO: 1127328 - DNA, 15 bp, Homo sapiens
tggctggaatttctg

SEQ ID NO: 1127329 - DNA, 18 bp, Homo sapiens
tggctggaatttctgctg

SEQ ID NO: 1127330 - DNA, 15 bp, Homo sapiens
tggctggactgtaga

SEQ ID NO: 1127331 - DNA, 19 bp, Homo sapiens
tggctggagcggagatgag

SEQ ID NO: 1127332 - DNA, 20 bp, Homo sapiens
tggctggagcggagatgagg

SEQ ID NO: 1127333 - DNA, 22 bp, Homo sapiens
tggctggctaactggaagcatg

SEQ ID NO: 1127334 - DNA, 22 bp, Homo sapiens
tggctgggaacatgacccagcc

SEQ ID NO: 1127335 - DNA, 23 bp, Homo sapiens
tggctgggacgtggctcagccag

SEQ ID NO: 1127336 - DNA, 16 bp, Homo sapiens
tggctgggcccagaag

SEQ ID NO: 1127337 - DNA, 12 bp, Homo sapiens
tggctgggcccc

SEQ ID NO: 1127338 - DNA, 13 bp, Homo sapiens
tggctgggcccct

SEQ ID NO: 1127339 - DNA, 18 bp, Homo sapiens
tggctgggcgtgctagag

SEQ ID NO: 1127340 - DNA, 15 bp, Homo sapiens
tggctgggctacaat

SEQ ID NO: 1127341 - DNA, 16 bp, Homo sapiens
tggctgggggcaggag

SEQ ID NO: 1127342 - DNA, 17 bp, Homo sapiens
tggctgggggcaggagg

SEQ ID NO: 1127343 - DNA, 20 bp, Homo sapiens
tggctgggtcagggccagac

SEQ ID NO: 1127344 - DNA, 16 bp, Homo sapiens
tggctgggtgccctct

SEQ ID NO: 1127345 - DNA, 13 bp, Homo sapiens
tggctgggttcag

SEQ ID NO: 1127346 - DNA, 18 bp, Homo sapiens
tggctggtagcagcaggc

SEQ ID NO: 1127347 - DNA, 16 bp, Homo sapiens
tggctggtctggagtc

SEQ ID NO: 1127348 - DNA, 23 bp, Homo sapiens
tggctggtgagaccccgcactgc

SEQ ID NO: 1127349 - DNA, 20 bp, Homo sapiens
tggctggtgagccggtcagg

SEQ ID NO: 1127350 - DNA, 17 bp, Homo sapiens
tggctggtgcccatgaa

SEQ ID NO: 1127351 - DNA, 16 bp, Homo sapiens
tggctggtgtcccctt

SEQ ID NO: 1127352 - DNA, 15 bp, Homo sapiens
tggctggtttctgag

SEQ ID NO: 1127353 - DNA, 16 bp, Homo sapiens
tggctgtaacctgctg

SEQ ID NO: 1127354 - DNA, 13 bp, Homo sapiens
tggctgtaatcat

SEQ ID NO: 1127355 - DNA, 17 bp, Homo sapiens
tggctgtagatcccaag

SEQ ID NO: 1127356 - DNA, 18 bp, Homo sapiens
tggctgtccttccccttc

SEQ ID NO: 1127357 - DNA, 14 bp, Homo sapiens
tggctgtctagaat

SEQ ID NO: 1127358 - DNA, 13 bp, Homo sapiens
tggctgtctgcct

SEQ ID NO: 1127359 - DNA, 17 bp, Homo sapiens
tggctgtctgtgggccg

SEQ ID NO: 1127360 - DNA, 15 bp, Homo sapiens
tggctgtgcccagca

SEQ ID NO: 1127361 - DNA, 18 bp, Homo sapiens
tggctgtgcccagcaggc

SEQ ID NO: 1127362 - DNA, 16 bp, Homo sapiens
tggctgtgcccctgat

SEQ ID NO: 1127363 - DNA, 17 bp, Homo sapiens
tggctgtgcctgcttct

SEQ ID NO: 1127364 - DNA, 13 bp, Homo sapiens
tggctgtggaggc

SEQ ID NO: 1127365 - DNA, 23 bp, Homo sapiens
tggctgtggtcagcagatgccag

SEQ ID NO: 1127366 - DNA, 14 bp, Homo sapiens
tggctgtggtccta

SEQ ID NO: 1127367 - DNA, 20 bp, Homo sapiens
tggctgtgtaaccttgggtg

SEQ ID NO: 1127368 - DNA, 14 bp, Homo sapiens
tggctgtgtctctc

SEQ ID NO: 1127369 - DNA, 14 bp, Homo sapiens
tggctgtgtgacag

SEQ ID NO: 1127370 - DNA, 20 bp, Homo sapiens
tggctgttcatgctccaaga

SEQ ID NO: 1127371 - DNA, 13 bp, Homo sapiens
tggcttaaagtga

SEQ ID NO: 1127372 - DNA, 20 bp, Homo sapiens
tggcttacctatctgtggaa

SEQ ID NO: 1127373 - DNA, 21 bp, Homo sapiens
tggcttacctgacctcttgct

SEQ ID NO: 1127374 - DNA, 13 bp, Homo sapiens
tggcttataaaca

SEQ ID NO: 1127375 - DNA, 19 bp, Homo sapiens
tggcttataaacacattga

SEQ ID NO: 1127376 - DNA, 13 bp, Homo sapiens
tggcttatttcta

SEQ ID NO: 1127377 - DNA, 14 bp, Homo sapiens
tggcttcacggaag

SEQ ID NO: 1127378 - DNA, 20 bp, Homo sapiens
tggcttcacggaagagcctt

SEQ ID NO: 1127379 - DNA, 23 bp, Homo sapiens
tggcttcacggaagagccttgcg

SEQ ID NO: 1127380 - DNA, 21 bp, Homo sapiens
tggcttcagagcgataataca

SEQ ID NO: 1127381 - DNA, 18 bp, Homo sapiens
tggcttcagcccccacca

SEQ ID NO: 1127382 - DNA, 14 bp, Homo sapiens
tggcttcagggagg

SEQ ID NO: 1127383 - DNA, 15 bp, Homo sapiens
tggcttcagggaggg

SEQ ID NO: 1127384 - DNA, 12 bp, Homo sapiens
tggcttcatgtg

SEQ ID NO: 1127385 - DNA, 23 bp, Homo sapiens
tggcttccagaaaaccccagcat

SEQ ID NO: 1127386 - DNA, 19 bp, Homo sapiens
tggcttccagaaggcagca

SEQ ID NO: 1127387 - DNA, 21 bp, Homo sapiens
tggcttccaggtatctccagg

SEQ ID NO: 1127388 - DNA, 15 bp, Homo sapiens
tggcttcccgctcag

SEQ ID NO: 1127389 - DNA, 18 bp, Homo sapiens
tggcttcccgctcagccc

SEQ ID NO: 1127390 - DNA, 21 bp, Homo sapiens
tggcttcccgctcagccctcc

SEQ ID NO: 1127391 - DNA, 22 bp, Homo sapiens
tggcttcccgctcagccctccc

SEQ ID NO: 1127392 - DNA, 18 bp, Homo sapiens
tggcttccctaaactgca

SEQ ID NO: 1127393 - DNA, 19 bp, Homo sapiens
tggcttccctaaactgcag

SEQ ID NO: 1127394 - DNA, 15 bp, Homo sapiens
tggcttcctccgtcc

SEQ ID NO: 1127395 - DNA, 16 bp, Homo sapiens
tggcttcctccgtcca

SEQ ID NO: 1127396 - DNA, 16 bp, Homo sapiens
tggcttcggacaaaat

SEQ ID NO: 1127397 - DNA, 17 bp, Homo sapiens
tggcttctcctgtgacc

SEQ ID NO: 1127398 - DNA, 11 bp, Homo sapiens
tggcttctggg

SEQ ID NO: 1127399 - DNA, 13 bp, Homo sapiens
tggcttctgtgat

SEQ ID NO: 1127400 - DNA, 22 bp, Homo sapiens
tggcttctgtgattaggtgaag

SEQ ID NO: 1127401 - DNA, 14 bp, Homo sapiens
tggcttctgtgcac

SEQ ID NO: 1127402 - DNA, 13 bp, Homo sapiens
tggcttcttaaaa

SEQ ID NO: 1127403 - DNA, 16 bp, Homo sapiens
tggcttcttaaaaact

SEQ ID NO: 1127404 - DNA, 19 bp, Homo sapiens
tggcttcttaaaaactgtg

SEQ ID NO: 1127405 - DNA, 19 bp, Homo sapiens
tggcttgactcaggattta

SEQ ID NO: 1127406 - DNA, 15 bp, Homo sapiens
tggcttgcctggtgg

SEQ ID NO: 1127407 - DNA, 12 bp, Homo sapiens
tggcttgctcca

SEQ ID NO: 1127408 - DNA, 19 bp, Homo sapiens
tggcttgctccagggtctt

SEQ ID NO: 1127409 - DNA, 12 bp, Homo sapiens
tggcttgctgtt

SEQ ID NO: 1127410 - DNA, 14 bp, Homo sapiens
tggcttgctgttta

SEQ ID NO: 1127411 - DNA, 16 bp, Homo sapiens
tggcttggcatctgtg

SEQ ID NO: 1127412 - DNA, 18 bp, Homo sapiens
tggcttgggctggtcaga

SEQ ID NO: 1127413 - DNA, 23 bp, Homo sapiens
tggcttggggtcaagaaacagcc

SEQ ID NO: 1127414 - DNA, 16 bp, Homo sapiens
tggcttgtacatagta

SEQ ID NO: 1127415 - DNA, 24 bp, Homo sapiens
tggcttgtatcaacactgttactt

SEQ ID NO: 1127416 - DNA, 12 bp, Homo sapiens
tggcttgttcat

SEQ ID NO: 1127417 - DNA, 19 bp, Homo sapiens
tggcttgttctctggaacc

SEQ ID NO: 1127418 - DNA, 16 bp, Homo sapiens
tggcttgtttgatttc

SEQ ID NO: 1127419 - DNA, 14 bp, Homo sapiens
tggctttaattgta

SEQ ID NO: 1127420 - DNA, 23 bp, Homo sapiens
tggctttaattgtataagtcaag

SEQ ID NO: 1127421 - DNA, 17 bp, Homo sapiens
tggctttatttgttttt

SEQ ID NO: 1127422 - DNA, 21 bp, Homo sapiens
tggctttcaaggctggggcat

SEQ ID NO: 1127423 - DNA, 21 bp, Homo sapiens
tggctttcagagccagcctgg

SEQ ID NO: 1127424 - DNA, 22 bp, Homo sapiens
tggctttcataaatcatgttgt

SEQ ID NO: 1127425 - DNA, 15 bp, Homo sapiens
tggctttcatcctgt

SEQ ID NO: 1127426 - DNA, 12 bp, Homo sapiens
tggctttccagg

SEQ ID NO: 1127427 - DNA, 21 bp, Homo sapiens
tggctttccaggcaccctcag

SEQ ID NO: 1127428 - DNA, 14 bp, Homo sapiens
tggctttcccagga

SEQ ID NO: 1127429 - DNA, 14 bp, Homo sapiens
tggctttctccctc

SEQ ID NO: 1127430 - DNA, 23 bp, Homo sapiens
tggctttctccgactgctaggga

SEQ ID NO: 1127431 - DNA, 15 bp, Homo sapiens
tggctttgcccaccc

SEQ ID NO: 1127432 - DNA, 18 bp, Homo sapiens
tggctttgcccacccctc

SEQ ID NO: 1127433 - DNA, 20 bp, Homo sapiens
tggctttgcccacccctcac

SEQ ID NO: 1127434 - DNA, 17 bp, Homo sapiens
tggctttggcagtgttt

SEQ ID NO: 1127435 - DNA, 15 bp, Homo sapiens
tggcttttactttat

SEQ ID NO: 1127436 - DNA, 20 bp, Homo sapiens
tggcttttactttattaata

SEQ ID NO: 1127437 - DNA, 19 bp, Homo sapiens
tggcttttcactgctggct

SEQ ID NO: 1127438 - DNA, 20 bp, Homo sapiens
tggcttttgccacatacata

SEQ ID NO: 1127439 - DNA, 19 bp, Homo sapiens
tggcttttgcctgtaagaa

SEQ ID NO: 1127440 - DNA, 18 bp, Homo sapiens
tggctttttgttcagaat

SEQ ID NO: 1127441 - DNA, 21 bp, Homo sapiens
tgggaaaaaagttttgatgaa

SEQ ID NO: 1127442 - DNA, 16 bp, Homo sapiens
tgggaaaacactgcca

SEQ ID NO: 1127443 - DNA, 18 bp, Homo sapiens
tgggaaaagaccagggct

SEQ ID NO: 1127444 - DNA, 20 bp, Homo sapiens
tgggaaaagcccacaggcct

SEQ ID NO: 1127445 - DNA, 19 bp, Homo sapiens
tgggaaaatatttcctgac

SEQ ID NO: 1127446 - DNA, 19 bp, Homo sapiens
tgggaaacagagtccaatt

SEQ ID NO: 1127447 - DNA, 18 bp, Homo sapiens
tgggatctttctgggagc

SEQ ID NO: 1127448 - DNA, 20 bp, Homo sapiens
tgggatctttctgggagctg

SEQ ID NO: 1127449 - DNA, 22 bp, Homo sapiens
tgggatctttctgggagctgcg

SEQ ID NO: 1127450 - DNA, 16 bp, Homo sapiens
tgggatgagccgctgt

SEQ ID NO: 1127451 - DNA, 14 bp, Homo sapiens
tgggatgaggtcac

SEQ ID NO: 1127452 - DNA, 22 bp, Homo sapiens
tgggatgcctcaccacacccag

SEQ ID NO: 1127453 - DNA, 15 bp, Homo sapiens
tgggatgctgaccca

SEQ ID NO: 1127454 - DNA, 17 bp, Homo sapiens
tgggatgctgacccagg

SEQ ID NO: 1127455 - DNA, 19 bp, Homo sapiens
tgggatgcttgcctagggc

SEQ ID NO: 1127456 - DNA, 13 bp, Homo sapiens
tgggatggaacct

SEQ ID NO: 1127457 - DNA, 14 bp, Homo sapiens
tgggatggacagga

SEQ ID NO: 1127458 - DNA, 14 bp, Homo sapiens
tgggatggaggaga

SEQ ID NO: 1127459 - DNA, 15 bp, Homo sapiens
tgggatgggaccagg

SEQ ID NO: 1127460 - DNA, 14 bp, Homo sapiens
tgggatgggctcta

SEQ ID NO: 1127461 - DNA, 22 bp, Homo sapiens
tgggatgggctctacctctctt

SEQ ID NO: 1127462 - DNA, 15 bp, Homo sapiens
tgggatggggaggga

SEQ ID NO: 1127463 - DNA, 19 bp, Homo sapiens
tgggatgggttccagaggt

SEQ ID NO: 1127464 - DNA, 18 bp, Homo sapiens
tgggatggtggagggcca

SEQ ID NO: 1127465 - DNA, 23 bp, Homo sapiens
tgggatgtatttttcttgctgtt

SEQ ID NO: 1127466 - DNA, 16 bp, Homo sapiens
tgggatgtcacagtcc

SEQ ID NO: 1127467 - DNA, 22 bp, Homo sapiens
tgggatgtcacagtccaaccag

SEQ ID NO: 1127468 - DNA, 22 bp, Homo sapiens
tgggatgtcctctttactccct

SEQ ID NO: 1127469 - DNA, 15 bp, Homo sapiens
tgggattacagacat

SEQ ID NO: 1127470 - DNA, 22 bp, Homo sapiens
tgggattcctgacccaggccgc

SEQ ID NO: 1127471 - DNA, 13 bp, Homo sapiens
tgggattgggggg

SEQ ID NO: 1127472 - DNA, 14 bp, Homo sapiens
tgggattgggggga

SEQ ID NO: 1127473 - DNA, 19 bp, Homo sapiens
tgggattgtggtacaatct

SEQ ID NO: 1127474 - DNA, 14 bp, Homo sapiens
tgggatttaatttc

SEQ ID NO: 1127475 - DNA, 16 bp, Homo sapiens
tgggatttaatttcca

SEQ ID NO: 1127476 - DNA, 15 bp, Homo sapiens
tgggatttcttcgct

SEQ ID NO: 1127477 - DNA, 13 bp, Homo sapiens
tgggatttgagat

SEQ ID NO: 1127478 - DNA, 14 bp, Homo sapiens
tgggatttgctgtg

SEQ ID NO: 1127479 - DNA, 21 bp, Homo sapiens
tgggcaaagcctagtgaaggc

SEQ ID NO: 1127480 - DNA, 14 bp, Homo sapiens
tgggcaaaggcagg

SEQ ID NO: 1127481 - DNA, 17 bp, Homo sapiens
tgggcaacactgcagga

SEQ ID NO: 1127482 - DNA, 19 bp, Homo sapiens
tgggcaacactgcaggaca

SEQ ID NO: 1127483 - DNA, 12 bp, Homo sapiens
tgggcaacagag

SEQ ID NO: 1127484 - DNA, 19 bp, Homo sapiens
tgggcaacagagcaagact

SEQ ID NO: 1127485 - DNA, 14 bp, Homo sapiens
tgggcaagtagcag

SEQ ID NO: 1127486 - DNA, 17 bp, Homo sapiens
tgggcaagtagcaggac

SEQ ID NO: 1127487 - DNA, 18 bp, Homo sapiens
tgggcaagtggatggccc

SEQ ID NO: 1127488 - DNA, 16 bp, Homo sapiens
tgggcacacgcctccc

SEQ ID NO: 1127489 - DNA, 13 bp, Homo sapiens
tgggcacagattg

SEQ ID NO: 1127490 - DNA, 13 bp, Homo sapiens
tgggcacagtcca

SEQ ID NO: 1127491 - DNA, 14 bp, Homo sapiens
tgggcacagtccag

SEQ ID NO: 1127492 - DNA, 15 bp, Homo sapiens
tgggcacagtccaga

SEQ ID NO: 1127493 - DNA, 19 bp, Homo sapiens
tgggcacagtccagaccca

SEQ ID NO: 1127494 - DNA, 12 bp, Homo sapiens
tgggcacagtgc

SEQ ID NO: 1127495 - DNA, 20 bp, Homo sapiens
tgggcacagtgctgcccctt

SEQ ID NO: 1127496 - DNA, 21 bp, Homo sapiens
tgggcacagtgctgccccttg

SEQ ID NO: 1127497 - DNA, 22 bp, Homo sapiens
tgggcaccagcatttggcagca

SEQ ID NO: 1127498 - DNA, 14 bp, Homo sapiens
tgggcacccaccct

SEQ ID NO: 1127499 - DNA, 20 bp, Homo sapiens
tgggcacccaccctgggacc

SEQ ID NO: 1127500 - DNA, 20 bp, Homo sapiens
tgggcaccgtgtcctcctct

SEQ ID NO: 1127501 - DNA, 23 bp, Homo sapiens
tgggcaccgtgtcctcctctgag

SEQ ID NO: 1127502 - DNA, 13 bp, Homo sapiens
tgggcacctcaga

SEQ ID NO: 1127503 - DNA, 21 bp, Homo sapiens
tgggcacctgcgcacaggtgg

SEQ ID NO: 1127504 - DNA, 19 bp, Homo sapiens
tgggcacctggggagtggg

SEQ ID NO: 1127505 - DNA, 23 bp, Homo sapiens
tgggcactccgcgccgatgccac

SEQ ID NO: 1127506 - DNA, 24 bp, Homo sapiens
tgggcactccgcgccgatgccacc

SEQ ID NO: 1127507 - DNA, 20 bp, Homo sapiens
tgggcactgctccaagggac

SEQ ID NO: 1127508 - DNA, 16 bp, Homo sapiens
tgggcactggcccagg

SEQ ID NO: 1127509 - DNA, 22 bp, Homo sapiens
tgggcactgggatgagccgctg

SEQ ID NO: 1127510 - DNA, 15 bp, Homo sapiens
tgggcactttttaat

SEQ ID NO: 1127511 - DNA, 18 bp, Homo sapiens
tgggcagaagggagaagg

SEQ ID NO: 1127512 - DNA, 13 bp, Homo sapiens
tgggcagagccca

SEQ ID NO: 1127513 - DNA, 16 bp, Homo sapiens
tgggcagagctggctc

SEQ ID NO: 1127514 - DNA, 17 bp, Homo sapiens
tgggcagatcttttctt

SEQ ID NO: 1127515 - DNA, 22 bp, Homo sapiens
tgggcagatgtcccccactgct

SEQ ID NO: 1127516 - DNA, 15 bp, Homo sapiens
tgggcagattttcag

SEQ ID NO: 1127517 - DNA, 17 bp, Homo sapiens
tgggcagattttcagca

SEQ ID NO: 1127518 - DNA, 12 bp, Homo sapiens
tgggcagcaatt

SEQ ID NO: 1127519 - DNA, 17 bp, Homo sapiens
tgggcagcaatttaaat

SEQ ID NO: 1127520 - DNA, 18 bp, Homo sapiens
tgggcagcaatttaaatg

SEQ ID NO: 1127521 - DNA, 17 bp, Homo sapiens
tgggcagcacaaggcct

SEQ ID NO: 1127522 - DNA, 13 bp, Homo sapiens
tgggcagcaccct

SEQ ID NO: 1127523 - DNA, 15 bp, Homo sapiens
tgggcagcaccctcc

SEQ ID NO: 1127524 - DNA, 22 bp, Homo sapiens
tgggcagcaccctcccccgcag

SEQ ID NO: 1127525 - DNA, 18 bp, Homo sapiens
tgggcagcagcatcccag

SEQ ID NO: 1127526 - DNA, 18 bp, Homo sapiens
tgggcagcatagcaagac

SEQ ID NO: 1127527 - DNA, 17 bp, Homo sapiens
tgggcagcatgcccaga

SEQ ID NO: 1127528 - DNA, 12 bp, Homo sapiens
tgggcagccaga

SEQ ID NO: 1127529 - DNA, 14 bp, Homo sapiens
tgggcagccaggag

SEQ ID NO: 1127530 - DNA, 16 bp, Homo sapiens
tgggcagccaggctgc

SEQ ID NO: 1127531 - DNA, 11 bp, Homo sapiens
tgggcagcccg

SEQ ID NO: 1127532 - DNA, 20 bp, Homo sapiens
tgggcagctcctccctgtgc

SEQ ID NO: 1127533 - DNA, 12 bp, Homo sapiens
tgggcagctggg

SEQ ID NO: 1127534 - DNA, 18 bp, Homo sapiens
tgggcagcttagggccct

SEQ ID NO: 1127535 - DNA, 19 bp, Homo sapiens
tgggcagcttagggccctg

SEQ ID NO: 1127536 - DNA, 19 bp, Homo sapiens
tgggcaggaccctgctgac

SEQ ID NO: 1127537 - DNA, 21 bp, Homo sapiens
tgggcaggaccctgctgactc

SEQ ID NO: 1127538 - DNA, 13 bp, Homo sapiens
tgggcaggacctc

SEQ ID NO: 1127539 - DNA, 19 bp, Homo sapiens
tgggcaggatctcaagcca

SEQ ID NO: 1127540 - DNA, 23 bp, Homo sapiens
tgggcaggatctcaagccagccc

SEQ ID NO: 1127541 - DNA, 23 bp, Homo sapiens
tgggcaggcggtccccatcccca

SEQ ID NO: 1127542 - DNA, 17 bp, Homo sapiens
tgggcagggaggggctg

SEQ ID NO: 1127543 - DNA, 21 bp, Homo sapiens
tgggcagggtctgtttggact

SEQ ID NO: 1127544 - DNA, 22 bp, Homo sapiens
tgggcaggtggccgcccctgag

SEQ ID NO: 1127545 - DNA, 16 bp, Homo sapiens
tgggcaggtgggagct

SEQ ID NO: 1127546 - DNA, 17 bp, Homo sapiens
tgggcaggtgggagctg

SEQ ID NO: 1127547 - DNA, 19 bp, Homo sapiens
tgggcagtcaccacccagc

SEQ ID NO: 1127548 - DNA, 15 bp, Homo sapiens
tgggcagtgccagcc

SEQ ID NO: 1127549 - DNA, 15 bp, Homo sapiens
tgggcagtgccccag

SEQ ID NO: 1127550 - DNA, 16 bp, Homo sapiens
tgggcagtgccccagg

SEQ ID NO: 1127551 - DNA, 21 bp, Homo sapiens
tgggcatcagggcctttctcc

SEQ ID NO: 1127552 - DNA, 23 bp, Homo sapiens
tgggcatcagggcctttctcctc

SEQ ID NO: 1127553 - DNA, 16 bp, Homo sapiens
tgggcatcattttaac

SEQ ID NO: 1127554 - DNA, 15 bp, Homo sapiens
tgggcatccacccag

SEQ ID NO: 1127555 - DNA, 16 bp, Homo sapiens
tgggcatccacccagt

SEQ ID NO: 1127556 - DNA, 19 bp, Homo sapiens
tgggcatccacccagtgct

SEQ ID NO: 1127557 - DNA, 15 bp, Homo sapiens
tgggcatcccagctt

SEQ ID NO: 1127558 - DNA, 13 bp, Homo sapiens
tgggcatgccacc

SEQ ID NO: 1127559 - DNA, 16 bp, Homo sapiens
tgggcatgccaccctc

SEQ ID NO: 1127560 - DNA, 12 bp, Homo sapiens
tgggcatggccg

SEQ ID NO: 1127561 - DNA, 22 bp, Homo sapiens
tgggcattagtgtccccccttg

SEQ ID NO: 1127562 - DNA, 15 bp, Homo sapiens
tgggcattgcagcct

SEQ ID NO: 1127563 - DNA, 17 bp, Homo sapiens
tgggcattgcagccttg

SEQ ID NO: 1127564 - DNA, 18 bp, Homo sapiens
tgggcattgcagccttgc

SEQ ID NO: 1127565 - DNA, 13 bp, Homo sapiens
tgggcattgggct

SEQ ID NO: 1127566 - DNA, 14 bp, Homo sapiens
tgggcattgggctg

SEQ ID NO: 1127567 - DNA, 15 bp, Homo sapiens
tgggcattgggctga

SEQ ID NO: 1127568 - DNA, 19 bp, Homo sapiens
tgggcattgggttctaaag

SEQ ID NO: 1127569 - DNA, 22 bp, Homo sapiens
tggggaaaggaatcaattattt

SEQ ID NO: 1127570 - DNA, 17 bp, Homo sapiens
tggggaaaggaggtggg

SEQ ID NO: 1127571 - DNA, 23 bp, Homo sapiens
tggggaaatttttaagtttttca

SEQ ID NO: 1127572 - DNA, 15 bp, Homo sapiens
tggggaacaagggtg

SEQ ID NO: 1127573 - DNA, 19 bp, Homo sapiens
tggggaacaagggtggcat

SEQ ID NO: 1127574 - DNA, 14 bp, Homo sapiens
tggggaagactgtg

SEQ ID NO: 1127575 - DNA, 12 bp, Homo sapiens
tggggaaggagg

SEQ ID NO: 1127576 - DNA, 18 bp, Homo sapiens
tggggaaggagggacttg

SEQ ID NO: 1127577 - DNA, 19 bp, Homo sapiens
tggggaaggagggacttgg

SEQ ID NO: 1127578 - DNA, 16 bp, Homo sapiens
tggggaaggcagaggc

SEQ ID NO: 1127579 - DNA, 17 bp, Homo sapiens
tggggaagtcaggggag

SEQ ID NO: 1127580 - DNA, 19 bp, Homo sapiens
tggggaagtcaggggagaa

SEQ ID NO: 1127581 - DNA, 20 bp, Homo sapiens
tggggaagtcaggggagaag

SEQ ID NO: 1127582 - DNA, 14 bp, Homo sapiens
tggggacacagcag

SEQ ID NO: 1127583 - DNA, 14 bp, Homo sapiens
tggggacagagcca

SEQ ID NO: 1127584 - DNA, 15 bp, Homo sapiens
tggggacagagccac

SEQ ID NO: 1127585 - DNA, 12 bp, Homo sapiens
tggggacagatt

SEQ ID NO: 1127586 - DNA, 13 bp, Homo sapiens
tggggacagattc

SEQ ID NO: 1127587 - DNA, 18 bp, Homo sapiens
tggggacagggggtggga

SEQ ID NO: 1127588 - DNA, 15 bp, Homo sapiens
tggggacagttggca

SEQ ID NO: 1127589 - DNA, 20 bp, Homo sapiens
tggggacatctctttgaatt

SEQ ID NO: 1127590 - DNA, 13 bp, Homo sapiens
tggggacccaggc

SEQ ID NO: 1127591 - DNA, 22 bp, Homo sapiens
tggggacccctcgcaaccctgc

SEQ ID NO: 1127592 - DNA, 18 bp, Homo sapiens
tggggacctggcactggg

SEQ ID NO: 1127593 - DNA, 19 bp, Homo sapiens
tggggaccttggcagtgtg

SEQ ID NO: 1127594 - DNA, 20 bp, Homo sapiens
tggggacgccaaggaggtgg

SEQ ID NO: 1127595 - DNA, 23 bp, Homo sapiens
tggggacttccgctccctggata

SEQ ID NO: 1127596 - DNA, 12 bp, Homo sapiens
tggggagaaagg

SEQ ID NO: 1127597 - DNA, 19 bp, Homo sapiens
tggggagaaatccctcaga

SEQ ID NO: 1127598 - DNA, 21 bp, Homo sapiens
tggggagactgggctgaggga

SEQ ID NO: 1127599 - DNA, 19 bp, Homo sapiens
tggggagacttggggccag

SEQ ID NO: 1127600 - DNA, 20 bp, Homo sapiens
tggggagatgcttctctcct

SEQ ID NO: 1127601 - DNA, 22 bp, Homo sapiens
tggggagcacaggtgtctgcct

SEQ ID NO: 1127602 - DNA, 18 bp, Homo sapiens
tggggagcaggaggccaa

SEQ ID NO: 1127603 - DNA, 21 bp, Homo sapiens
tggggagcaggaggccaataa

SEQ ID NO: 1127604 - DNA, 22 bp, Homo sapiens
tggggagcaggaggccaataaa

SEQ ID NO: 1127605 - DNA, 20 bp, Homo sapiens
tggggagcagttttcccctg

SEQ ID NO: 1127606 - DNA, 12 bp, Homo sapiens
tggggagccctc

SEQ ID NO: 1127607 - DNA, 14 bp, Homo sapiens
tggggagctcctgg

SEQ ID NO: 1127608 - DNA, 12 bp, Homo sapiens
tggggaggagac

SEQ ID NO: 1127609 - DNA, 16 bp, Homo sapiens
tggggaggaggaagcc

SEQ ID NO: 1127610 - DNA, 12 bp, Homo sapiens
tggggaggccct

SEQ ID NO: 1127611 - DNA, 13 bp, Homo sapiens
tggggaggccctg

SEQ ID NO: 1127612 - DNA, 15 bp, Homo sapiens
tggggaggccctgcc

SEQ ID NO: 1127613 - DNA, 17 bp, Homo sapiens
tggggaggccctgcctg

SEQ ID NO: 1127614 - DNA, 23 bp, Homo sapiens
tggggaggctgcactggagccac

SEQ ID NO: 1127615 - DNA, 18 bp, Homo sapiens
tggggagggattctggtt

SEQ ID NO: 1127616 - DNA, 12 bp, Homo sapiens
tggggaggggcg

SEQ ID NO: 1127617 - DNA, 19 bp, Homo sapiens
tggggaggggcgctggccc

SEQ ID NO: 1127618 - DNA, 11 bp, Homo sapiens
tggggaggggg

SEQ ID NO: 1127619 - DNA, 14 bp, Homo sapiens
tggggagggggaag

SEQ ID NO: 1127620 - DNA, 22 bp, Homo sapiens
tggggagggggaagagaaattt

SEQ ID NO: 1127621 - DNA, 21 bp, Homo sapiens
tggggaggggggcgggtgacg

SEQ ID NO: 1127622 - DNA, 19 bp, Homo sapiens
tggggaggtgggaggccag

SEQ ID NO: 1127623 - DNA, 21 bp, Homo sapiens
tggggaggtgggaggccaggc

SEQ ID NO: 1127624 - DNA, 19 bp, Homo sapiens
tggggagtaggacatacca

SEQ ID NO: 1127625 - DNA, 15 bp, Homo sapiens
tggggatagaggaaa

SEQ ID NO: 1127626 - DNA, 18 bp, Homo sapiens
tggggatccccgcctggc

SEQ ID NO: 1127627 - DNA, 21 bp, Homo sapiens
tggggatccccgcctggccag

SEQ ID NO: 1127628 - DNA, 15 bp, Homo sapiens
tggggatgggtgggg

SEQ ID NO: 1127629 - DNA, 16 bp, Homo sapiens
tggggatgggtgggga

SEQ ID NO: 1127630 - DNA, 22 bp, Homo sapiens
tggggatggtagttttttcatc

SEQ ID NO: 1127631 - DNA, 14 bp, Homo sapiens
tggggatggtggca

SEQ ID NO: 1127632 - DNA, 14 bp, Homo sapiens
tggggatgtgggag

SEQ ID NO: 1127633 - DNA, 18 bp, Homo sapiens
tggggattcaggggcttt

SEQ ID NO: 1127634 - DNA, 16 bp, Homo sapiens
tggggattggtgggtc

SEQ ID NO: 1127635 - DNA, 15 bp, Homo sapiens
tggggatttctccca

SEQ ID NO: 1127636 - DNA, 15 bp, Homo sapiens
tggggatttctggga

SEQ ID NO: 1127637 - DNA, 21 bp, Homo sapiens
tggggcaagactgcaaacttt

SEQ ID NO: 1127638 - DNA, 15 bp, Homo sapiens
tggggcaagccaggg

SEQ ID NO: 1127639 - DNA, 20 bp, Homo sapiens
tggggcaagccagggcccag

SEQ ID NO: 1127640 - DNA, 21 bp, Homo sapiens
tggggcaagccagggcccaga

SEQ ID NO: 1127641 - DNA, 12 bp, Homo sapiens
tggggcaaggct

SEQ ID NO: 1127642 - DNA, 11 bp, Homo sapiens
tggggcacagt

SEQ ID NO: 1127643 - DNA, 17 bp, Homo sapiens
tggggcacagtccagga

SEQ ID NO: 1127644 - DNA, 17 bp, Homo sapiens
tggggcaggagtgccag

SEQ ID NO: 1127645 - DNA, 20 bp, Homo sapiens
tggggcaggagtgccaggac

SEQ ID NO: 1127646 - DNA, 21 bp, Homo sapiens
tggggcaggagtgccaggacc

SEQ ID NO: 1127647 - DNA, 18 bp, Homo sapiens
tggggcaggctctctcct

SEQ ID NO: 1127648 - DNA, 17 bp, Homo sapiens
tggggcaggctggctgg

SEQ ID NO: 1127649 - DNA, 20 bp, Homo sapiens
tggggcaggctgggccatgt

SEQ ID NO: 1127650 - DNA, 12 bp, Homo sapiens
tggggcaggggc

SEQ ID NO: 1127651 - DNA, 23 bp, Homo sapiens
tggggcaggggtgcttcctcctc

SEQ ID NO: 1127652 - DNA, 15 bp, Homo sapiens
tggggcatcctggat

SEQ ID NO: 1127653 - DNA, 17 bp, Homo sapiens
tggggcatcctgtgcca

SEQ ID NO: 1127654 - DNA, 21 bp, Homo sapiens
tggggcatgacctcagtcagg

SEQ ID NO: 1127655 - DNA, 21 bp, Homo sapiens
tggggcatggcaaatcagggg

SEQ ID NO: 1127656 - DNA, 21 bp, Homo sapiens
tggggcatggttccttccctg

SEQ ID NO: 1127657 - DNA, 18 bp, Homo sapiens
tggggcatgtgtgcctgt

SEQ ID NO: 1127658 - DNA, 22 bp, Homo sapiens
tggggcatgtgtgcctgtggca

SEQ ID NO: 1127659 - DNA, 14 bp, Homo sapiens
tggggccacacaga

SEQ ID NO: 1127660 - DNA, 20 bp, Homo sapiens
tggggccaccaaagctgccc

SEQ ID NO: 1127661 - DNA, 21 bp, Homo sapiens
tggggccaccaaagctgccca

SEQ ID NO: 1127662 - DNA, 17 bp, Homo sapiens
tggggccagaggctggg

SEQ ID NO: 1127663 - DNA, 11 bp, Homo sapiens
tggggccagga

SEQ ID NO: 1127664 - DNA, 14 bp, Homo sapiens
tggggccagggcag

SEQ ID NO: 1127665 - DNA, 17 bp, Homo sapiens
tggggccagggcagatg

SEQ ID NO: 1127666 - DNA, 18 bp, Homo sapiens
tggggccatggtggaggg

SEQ ID NO: 1127667 - DNA, 23 bp, Homo sapiens
tggggcccaagttgcagtgagca

SEQ ID NO: 1127668 - DNA, 18 bp, Homo sapiens
tggggcccagccgatgtg

SEQ ID NO: 1127669 - DNA, 13 bp, Homo sapiens
tggggccccatct

SEQ ID NO: 1127670 - DNA, 16 bp, Homo sapiens
tggggcccctggccca

SEQ ID NO: 1127671 - DNA, 17 bp, Homo sapiens
tggggcccctggcccag

SEQ ID NO: 1127672 - DNA, 21 bp, Homo sapiens
tggggccctctatgctggctt

SEQ ID NO: 1127673 - DNA, 22 bp, Homo sapiens
tggggccctctatgctggcttt

SEQ ID NO: 1127674 - DNA, 14 bp, Homo sapiens
tggggccctgcccc

SEQ ID NO: 1127675 - DNA, 16 bp, Homo sapiens
tggggccctgggcctc

SEQ ID NO: 1127676 - DNA, 18 bp, Homo sapiens
tggggccctgggcctcag

SEQ ID NO: 1127677 - DNA, 19 bp, Homo sapiens
tggggccgcctgccctgcc

SEQ ID NO: 1127678 - DNA, 23 bp, Homo sapiens
tggggcctcaatctaaggccttc

SEQ ID NO: 1127679 - DNA, 13 bp, Homo sapiens
tggggcctcagac

SEQ ID NO: 1127680 - DNA, 21 bp, Homo sapiens
tggggcctcagcctggggctc

SEQ ID NO: 1127681 - DNA, 16 bp, Homo sapiens
tggggcctccagaagc

SEQ ID NO: 1127682 - DNA, 18 bp, Homo sapiens
tggggcctccagaagctg

SEQ ID NO: 1127683 - DNA, 20 bp, Homo sapiens
tggggcctccagaagctgct

SEQ ID NO: 1127684 - DNA, 17 bp, Homo sapiens
tggggcctgactgctca

SEQ ID NO: 1127685 - DNA, 18 bp, Homo sapiens
tggggcctgactgctcag

SEQ ID NO: 1127686 - DNA, 15 bp, Homo sapiens
tggggcctggacctg

SEQ ID NO: 1127687 - DNA, 20 bp, Homo sapiens
tggggcctggacctgcctcc

SEQ ID NO: 1127688 - DNA, 14 bp, Homo sapiens
tggggcctgggagg

SEQ ID NO: 1127689 - DNA, 13 bp, Homo sapiens
tggggcctgggtt

SEQ ID NO: 1127690 - DNA, 13 bp, Homo sapiens
tggggcctgtgga

SEQ ID NO: 1127691 - DNA, 13 bp, Homo sapiens
tggtaggtgtggt

SEQ ID NO: 1127692 - DNA, 18 bp, Homo sapiens
tggtaggttgggacacca

SEQ ID NO: 1127693 - DNA, 22 bp, Homo sapiens
tggtagtggaatagtgaatact

SEQ ID NO: 1127694 - DNA, 22 bp, Homo sapiens
tggtagtgtagctgtgtggctt

SEQ ID NO: 1127695 - DNA, 18 bp, Homo sapiens
tggtagttctgtgcctcc

SEQ ID NO: 1127696 - DNA, 18 bp, Homo sapiens
tggtagttttttcatctt

SEQ ID NO: 1127697 - DNA, 18 bp, Homo sapiens
tggtataaggtacatatt

SEQ ID NO: 1127698 - DNA, 19 bp, Homo sapiens
tggtataaggtacatattt

SEQ ID NO: 1127699 - DNA, 18 bp, Homo sapiens
tggtataatgtttaaatc

SEQ ID NO: 1127700 - DNA, 20 bp, Homo sapiens
tggtataatgtttaaatcat

SEQ ID NO: 1127701 - DNA, 19 bp, Homo sapiens
tggtatatccaaaagcttt

SEQ ID NO: 1127702 - DNA, 18 bp, Homo sapiens
tggtatatgtcattattt

SEQ ID NO: 1127703 - DNA, 15 bp, Homo sapiens
tggtatcaagaaagt

SEQ ID NO: 1127704 - DNA, 20 bp, Homo sapiens
tggtatcatattaacatatt

SEQ ID NO: 1127705 - DNA, 22 bp, Homo sapiens
tggtatctcagaaagtgcctga

SEQ ID NO: 1127706 - DNA, 16 bp, Homo sapiens
tggtatcttaaagtgt

SEQ ID NO: 1127707 - DNA, 22 bp, Homo sapiens
tggtatgaaataaattctgact

SEQ ID NO: 1127708 - DNA, 15 bp, Homo sapiens
tggtatgctggccag

SEQ ID NO: 1127709 - DNA, 16 bp, Homo sapiens
tggtatgctggccagc

SEQ ID NO: 1127710 - DNA, 17 bp, Homo sapiens
tggtatggttgtataca

SEQ ID NO: 1127711 - DNA, 16 bp, Homo sapiens
tggtattaataaaaag

SEQ ID NO: 1127712 - DNA, 17 bp, Homo sapiens
tggtattaatcttgtgt

SEQ ID NO: 1127713 - DNA, 18 bp, Homo sapiens
tggtattacactgtattt

SEQ ID NO: 1127714 - DNA, 18 bp, Homo sapiens
tggtattagttaaaacac

SEQ ID NO: 1127715 - DNA, 19 bp, Homo sapiens
tggtattattctgttttgc

SEQ ID NO: 1127716 - DNA, 13 bp, Homo sapiens
tggtatttatatt

SEQ ID NO: 1127717 - DNA, 22 bp, Homo sapiens
tggtcaaacaaactctctgaac

SEQ ID NO: 1127718 - DNA, 22 bp, Homo sapiens
tggtcaagaaaggaggggagaa

SEQ ID NO: 1127719 - DNA, 19 bp, Homo sapiens
tggtcaagttcccaactga

SEQ ID NO: 1127720 - DNA, 15 bp, Homo sapiens
tggtcaagttgagat

SEQ ID NO: 1127721 - DNA, 15 bp, Homo sapiens
tggtcacagcggagg

SEQ ID NO: 1127722 - DNA, 20 bp, Homo sapiens
tggtcacaggactctgcctc

SEQ ID NO: 1127723 - DNA, 20 bp, Homo sapiens
tggtcacagtcctatgtaca

SEQ ID NO: 1127724 - DNA, 23 bp, Homo sapiens
tggtcaccaaatcagctgctact

SEQ ID NO: 1127725 - DNA, 15 bp, Homo sapiens
tggtcaccagctcct

SEQ ID NO: 1127726 - DNA, 18 bp, Homo sapiens
tggtcaccctggggctgc

SEQ ID NO: 1127727 - DNA, 19 bp, Homo sapiens
tggtcaccctggggctgct

SEQ ID NO: 1127728 - DNA, 22 bp, Homo sapiens
tggtcaccctggggctgcttag

SEQ ID NO: 1127729 - DNA, 20 bp, Homo sapiens
tggtcacgtttggtgcttct

SEQ ID NO: 1127730 - DNA, 18 bp, Homo sapiens
tggtcactaaccaacaag

SEQ ID NO: 1127731 - DNA, 18 bp, Homo sapiens
tggtcactggtcagggca

SEQ ID NO: 1127732 - DNA, 10 bp, Homo sapiens
tggtcagagg

SEQ ID NO: 1127733 - DNA, 13 bp, Homo sapiens
tggtcagcagatg

SEQ ID NO: 1127734 - DNA, 17 bp, Homo sapiens
tggtcagcttgctcaga

SEQ ID NO: 1127735 - DNA, 15 bp, Homo sapiens
tggtcagcttttgtt

SEQ ID NO: 1127736 - DNA, 13 bp, Homo sapiens
tggtcagggcagt

SEQ ID NO: 1127737 - DNA, 22 bp, Homo sapiens
tggtcagtagtttcatgtttta

SEQ ID NO: 1127738 - DNA, 21 bp, Homo sapiens
tggtcagtgtggagaggggtg

SEQ ID NO: 1127739 - DNA, 21 bp, Homo sapiens
tggtcatagcccagatcagct

SEQ ID NO: 1127740 - DNA, 23 bp, Homo sapiens
tggtcatccttggtgctcttgct

SEQ ID NO: 1127741 - DNA, 13 bp, Homo sapiens
tggtcatggacag

SEQ ID NO: 1127742 - DNA, 19 bp, Homo sapiens
tggtcatgtgggtcttcca

SEQ ID NO: 1127743 - DNA, 19 bp, Homo sapiens
tggtccaaaaaaaggaaaa

SEQ ID NO: 1127744 - DNA, 19 bp, Homo sapiens
tggtccaaccaggagctga

SEQ ID NO: 1127745 - DNA, 21 bp, Homo sapiens
tggtccaattagtttcctttt

SEQ ID NO: 1127746 - DNA, 11 bp, Homo sapiens
tggtccactgt

SEQ ID NO: 1127747 - DNA, 12 bp, Homo sapiens
tggtccactgtg

SEQ ID NO: 1127748 - DNA, 14 bp, Homo sapiens
tggtccactgtgtt

SEQ ID NO: 1127749 - DNA, 22 bp, Homo sapiens
tggtccagaaactcctgtttct

SEQ ID NO: 1127750 - DNA, 12 bp, Homo sapiens
tggtccagagcg

SEQ ID NO: 1127751 - DNA, 21 bp, Homo sapiens
tggtccagctctgacatccct

SEQ ID NO: 1127752 - DNA, 22 bp, Homo sapiens
tggtccagctctgacatccctt

SEQ ID NO: 1127753 - DNA, 15 bp, Homo sapiens
tggtccagcttgctc

SEQ ID NO: 1127754 - DNA, 12 bp, Homo sapiens
tggtccaggaga

SEQ ID NO: 1127755 - DNA, 19 bp, Homo sapiens
tggtccaggccctgtggca

SEQ ID NO: 1127756 - DNA, 13 bp, Homo sapiens
tggtccagggcta

SEQ ID NO: 1127757 - DNA, 21 bp, Homo sapiens
tggtccagggctagtgacttg

SEQ ID NO: 1127758 - DNA, 21 bp, Homo sapiens
tggtccaggtcttcagtttcc

SEQ ID NO: 1127759 - DNA, 14 bp, Homo sapiens
tggtccatgcaggg

SEQ ID NO: 1127760 - DNA, 15 bp, Homo sapiens
tggtccatgctgatg

SEQ ID NO: 1127761 - DNA, 18 bp, Homo sapiens
tggtccatttgttcctgc

SEQ ID NO: 1127762 - DNA, 20 bp, Homo sapiens
tggtccatttgttcctgctt

SEQ ID NO: 1127763 - DNA, 13 bp, Homo sapiens
tggtcccatccag

SEQ ID NO: 1127764 - DNA, 17 bp, Homo sapiens
tggtcccatcctctaaa

SEQ ID NO: 1127765 - DNA, 13 bp, Homo sapiens
tggtcccatggct

SEQ ID NO: 1127766 - DNA, 12 bp, Homo sapiens
tggtcccctgtg

SEQ ID NO: 1127767 - DNA, 14 bp, Homo sapiens
tggtccctcgtcca

SEQ ID NO: 1127768 - DNA, 13 bp, Homo sapiens
tggtccctgcctt

SEQ ID NO: 1127769 - DNA, 21 bp, Homo sapiens
tggtccctgggccaccgggca

SEQ ID NO: 1127770 - DNA, 13 bp, Homo sapiens
tggtcccttaagg

SEQ ID NO: 1127771 - DNA, 13 bp, Homo sapiens
tggtccgtgccca

SEQ ID NO: 1127772 - DNA, 19 bp, Homo sapiens
tggtccgtgcccaggccct

SEQ ID NO: 1127773 - DNA, 12 bp, Homo sapiens
tggtcctaccca

SEQ ID NO: 1127774 - DNA, 22 bp, Homo sapiens
tggtcctaggtcctctgaggca

SEQ ID NO: 1127775 - DNA, 23 bp, Homo sapiens
tggtcctctctctgtggggctga

SEQ ID NO: 1127776 - DNA, 14 bp, Homo sapiens
tggtcctgagacct

SEQ ID NO: 1127777 - DNA, 19 bp, Homo sapiens
tggtcctggacacctccca

SEQ ID NO: 1127778 - DNA, 22 bp, Homo sapiens
tggtcctggacacctcccaggg

SEQ ID NO: 1127779 - DNA, 11 bp, Homo sapiens
tggtcctgggg

SEQ ID NO: 1127780 - DNA, 15 bp, Homo sapiens
tggtcctgtctgtcc

SEQ ID NO: 1127781 - DNA, 17 bp, Homo sapiens
tggtcctgtctgtcctt

SEQ ID NO: 1127782 - DNA, 18 bp, Homo sapiens
tggtcctgtctgtccttc

SEQ ID NO: 1127783 - DNA, 18 bp, Homo sapiens
tggtccttccctgatggc

SEQ ID NO: 1127784 - DNA, 11 bp, Homo sapiens
tggtcctttct

SEQ ID NO: 1127785 - DNA, 23 bp, Homo sapiens
tggtcgagaaagaggcaccagga

SEQ ID NO: 1127786 - DNA, 16 bp, Homo sapiens
tggtcgaggagtaaca

SEQ ID NO: 1127787 - DNA, 20 bp, Homo sapiens
tggtcgaggagtaacaatac

SEQ ID NO: 1127788 - DNA, 17 bp, Homo sapiens
tggtcgagtctttgtgt

SEQ ID NO: 1127789 - DNA, 19 bp, Homo sapiens
tggtcgagtgacacacctc

SEQ ID NO: 1127790 - DNA, 14 bp, Homo sapiens
tggtcgcccaggag

SEQ ID NO: 1127791 - DNA, 15 bp, Homo sapiens
tggtcgcccaggaga

SEQ ID NO: 1127792 - DNA, 22 bp, Homo sapiens
tggtcggggagctggggtacag

SEQ ID NO: 1127793 - DNA, 15 bp, Homo sapiens
tggtctaatgtttgt

SEQ ID NO: 1127794 - DNA, 18 bp, Homo sapiens
tggtctataaaataaact

SEQ ID NO: 1127795 - DNA, 19 bp, Homo sapiens
tggtctataaaataaactt

SEQ ID NO: 1127796 - DNA, 20 bp, Homo sapiens
tggtctcagcgggagccagt

SEQ ID NO: 1127797 - DNA, 13 bp, Homo sapiens
tggtctcaggata

SEQ ID NO: 1127798 - DNA, 23 bp, Homo sapiens
tggtctcaggatatccttatcag

SEQ ID NO: 1127799 - DNA, 17 bp, Homo sapiens
tggtctcgaactcctga

SEQ ID NO: 1127800 - DNA, 19 bp, Homo sapiens
tggtctctctccctctgtc

SEQ ID NO: 1127801 - DNA, 22 bp, Homo sapiens
tggtctctgctgaaggttgtaa

SEQ ID NO: 1127802 - DNA, 21 bp, Homo sapiens
tggtctgaatattaaagctct

SEQ ID NO: 1127803 - DNA, 18 bp, Homo sapiens
tggtctgaatgttctgac

SEQ ID NO: 1127804 - DNA, 21 bp, Homo sapiens
tggtctgaatgttctgacatt

SEQ ID NO: 1127805 - DNA, 17 bp, Homo sapiens
tggtctgaggatgtaga

SEQ ID NO: 1127806 - DNA, 16 bp, Homo sapiens
tggtctgatttcagga

SEQ ID NO: 1127807 - DNA, 14 bp, Homo sapiens
tggtctgccagaat

SEQ ID NO: 1127808 - DNA, 17 bp, Homo sapiens
tggtctgccagaatact

SEQ ID NO: 1127809 - DNA, 19 bp, Homo sapiens
tggtctgcttaaagcttcc

SEQ ID NO: 1127810 - DNA, 14 bp, Homo sapiens
tggtctggaaacag

SEQ ID NO: 1127811 - DNA, 17 bp, Homo sapiens
tggtctggctttaagaa

SEQ ID NO: 1127812 - DNA, 21 bp, Homo sapiens
tggtctgggacttccttgctc

SEQ ID NO: 1127813 - DNA, 18 bp, Homo sapiens
tgtaaataatttattaca

SEQ ID NO: 1127814 - DNA, 18 bp, Homo sapiens
tgtaaataatttgcactg

SEQ ID NO: 1127815 - DNA, 19 bp, Homo sapiens
tgtaaataatttgcactga

SEQ ID NO: 1127816 - DNA, 20 bp, Homo sapiens
tgtaaataattttaaataac

SEQ ID NO: 1127817 - DNA, 22 bp, Homo sapiens
tgtaaataattttaaataacct

SEQ ID NO: 1127818 - DNA, 16 bp, Homo sapiens
tgtaaataattttcta

SEQ ID NO: 1127819 - DNA, 12 bp, Homo sapiens
tgtaaatacata

SEQ ID NO: 1127820 - DNA, 13 bp, Homo sapiens
tgtaaatacataa

SEQ ID NO: 1127821 - DNA, 15 bp, Homo sapiens
tgtaaatacccatat

SEQ ID NO: 1127822 - DNA, 20 bp, Homo sapiens
tgtaaatactcatgaatgaa

SEQ ID NO: 1127823 - DNA, 23 bp, Homo sapiens
tgtaaatactttgtcctaagaga

SEQ ID NO: 1127824 - DNA, 19 bp, Homo sapiens
tgtaaatagaagagtttaa

SEQ ID NO: 1127825 - DNA, 13 bp, Homo sapiens
tgtaaataggttt

SEQ ID NO: 1127826 - DNA, 15 bp, Homo sapiens
tgtaaatatataaat

SEQ ID NO: 1127827 - DNA, 17 bp, Homo sapiens
tgtaaatatgaagagtt

SEQ ID NO: 1127828 - DNA, 13 bp, Homo sapiens
tgtaaatatgttt

SEQ ID NO: 1127829 - DNA, 12 bp, Homo sapiens
tgtaaatattct

SEQ ID NO: 1127830 - DNA, 13 bp, Homo sapiens
tgtaaatattctt

SEQ ID NO: 1127831 - DNA, 20 bp, Homo sapiens
tgtaaatattttgatacaaa

SEQ ID NO: 1127832 - DNA, 22 bp, Homo sapiens
tgtaaatattttgatacaaatg

SEQ ID NO: 1127833 - DNA, 20 bp, Homo sapiens
tgtaaatcctagacttgaaa

SEQ ID NO: 1127834 - DNA, 22 bp, Homo sapiens
tgtaaatcctttttctttataa

SEQ ID NO: 1127835 - DNA, 16 bp, Homo sapiens
tgtaaatctaacatta

SEQ ID NO: 1127836 - DNA, 14 bp, Homo sapiens
tgtaaatctgccac

SEQ ID NO: 1127837 - DNA, 16 bp, Homo sapiens
tgtaaatggtgtacat

SEQ ID NO: 1127838 - DNA, 18 bp, Homo sapiens
tgtaaatggtgtacataa

SEQ ID NO: 1127839 - DNA, 22 bp, Homo sapiens
tgtaaatgtgttagcactgata

SEQ ID NO: 1127840 - DNA, 14 bp, Homo sapiens
tgtaaatgtttctt

SEQ ID NO: 1127841 - DNA, 13 bp, Homo sapiens
tgtaaattaactt

SEQ ID NO: 1127842 - DNA, 15 bp, Homo sapiens
tgtaaattaatactt

SEQ ID NO: 1127843 - DNA, 16 bp, Homo sapiens
tgtaaattatgtaatg

SEQ ID NO: 1127844 - DNA, 15 bp, Homo sapiens
tgtaaattattgtaa

SEQ ID NO: 1127845 - DNA, 14 bp, Homo sapiens
tgtaaattatttgc

SEQ ID NO: 1127846 - DNA, 17 bp, Homo sapiens
tgtaaattatttgctaa

SEQ ID NO: 1127847 - DNA, 18 bp, Homo sapiens
tgtaaattatttgctaag

SEQ ID NO: 1127848 - DNA, 22 bp, Homo sapiens
tgtaaattgactgtactaggcc

SEQ ID NO: 1127849 - DNA, 16 bp, Homo sapiens
tgtaaattgcacagag

SEQ ID NO: 1127850 - DNA, 11 bp, Homo sapiens
tgtaaattggc

SEQ ID NO: 1127851 - DNA, 21 bp, Homo sapiens
tgtaaattttagagcatacca

SEQ ID NO: 1127852 - DNA, 15 bp, Homo sapiens
tgtaacaagaaaaca

SEQ ID NO: 1127853 - DNA, 20 bp, Homo sapiens
tgtaacaagaaagtggtctg

SEQ ID NO: 1127854 - DNA, 18 bp, Homo sapiens
tgtaacaagccagatttt

SEQ ID NO: 1127855 - DNA, 19 bp, Homo sapiens
tgtaacaattgtgtagcct

SEQ ID NO: 1127856 - DNA, 20 bp, Homo sapiens
tgtaacaattgtgtagcctt

SEQ ID NO: 1127857 - DNA, 11 bp, Homo sapiens
tgtaacacaag

SEQ ID NO: 1127858 - DNA, 20 bp, Homo sapiens
tgtaacacaagccacagaag

SEQ ID NO: 1127859 - DNA, 24 bp, Homo sapiens
tgtaacacaagccacagaagccag

SEQ ID NO: 1127860 - DNA, 21 bp, Homo sapiens
tgtaacacagtcattctagga

SEQ ID NO: 1127861 - DNA, 11 bp, Homo sapiens
tgtaacactgt

SEQ ID NO: 1127862 - DNA, 18 bp, Homo sapiens
tgtaacaggtctcctctt

SEQ ID NO: 1127863 - DNA, 17 bp, Homo sapiens
tgtaacagttgtgtcat

SEQ ID NO: 1127864 - DNA, 20 bp, Homo sapiens
tgtaacagttgtgtcataaa

SEQ ID NO: 1127865 - DNA, 14 bp, Homo sapiens
tgtaacatcataat

SEQ ID NO: 1127866 - DNA, 20 bp, Homo sapiens
tgtaacatcataattacatt

SEQ ID NO: 1127867 - DNA, 15 bp, Homo sapiens
tgtaacatgatgtta

SEQ ID NO: 1127868 - DNA, 17 bp, Homo sapiens
tgtaacatgatgttaac

SEQ ID NO: 1127869 - DNA, 13 bp, Homo sapiens
tgtaacattgtaa

SEQ ID NO: 1127870 - DNA, 19 bp, Homo sapiens
tgtaacattgtaaagtatg

SEQ ID NO: 1127871 - DNA, 12 bp, Homo sapiens
tgtaacctcagc

SEQ ID NO: 1127872 - DNA, 15 bp, Homo sapiens
tgtaacctcagctct

SEQ ID NO: 1127873 - DNA, 18 bp, Homo sapiens
tgtaacctcagctctggg

SEQ ID NO: 1127874 - DNA, 19 bp, Homo sapiens
tgtaacctcagctctggga

SEQ ID NO: 1127875 - DNA, 23 bp, Homo sapiens
tgtaacctcagctctgggagagg

SEQ ID NO: 1127876 - DNA, 13 bp, Homo sapiens
tgtaacctgctgg

SEQ ID NO: 1127877 - DNA, 21 bp, Homo sapiens
tgtaaccttgggtggcccctg

SEQ ID NO: 1127878 - DNA, 16 bp, Homo sapiens
tgtaacgtggcactgg

SEQ ID NO: 1127879 - DNA, 15 bp, Homo sapiens
tgtaactaaaataat

SEQ ID NO: 1127880 - DNA, 15 bp, Homo sapiens
tgtaactaagttatt

SEQ ID NO: 1127881 - DNA, 18 bp, Homo sapiens
tgtaactacaaagctttg

SEQ ID NO: 1127882 - DNA, 15 bp, Homo sapiens
tgtaactatttcttc

SEQ ID NO: 1127883 - DNA, 12 bp, Homo sapiens
tgtaactccacc

SEQ ID NO: 1127884 - DNA, 13 bp, Homo sapiens
tgtaactctccag

SEQ ID NO: 1127885 - DNA, 15 bp, Homo sapiens
tgtaactgcccagcc

SEQ ID NO: 1127886 - DNA, 16 bp, Homo sapiens
tgtaactgcccagccc

SEQ ID NO: 1127887 - DNA, 18 bp, Homo sapiens
tgtaactgctcagagctt

SEQ ID NO: 1127888 - DNA, 12 bp, Homo sapiens
tgtaactgctga

SEQ ID NO: 1127889 - DNA, 12 bp, Homo sapiens
tgtaactgttac

SEQ ID NO: 1127890 - DNA, 18 bp, Homo sapiens
tgtaacttagctttattt

SEQ ID NO: 1127891 - DNA, 16 bp, Homo sapiens
tgtaacttatattgaa

SEQ ID NO: 1127892 - DNA, 23 bp, Homo sapiens
tgtaacttatattgaagacaatt

SEQ ID NO: 1127893 - DNA, 17 bp, Homo sapiens
tgtaacttccaaataaa

SEQ ID NO: 1127894 - DNA, 19 bp, Homo sapiens
tgtaacttccaaataaata

SEQ ID NO: 1127895 - DNA, 20 bp, Homo sapiens
tgtaacttccaaataaataa

SEQ ID NO: 1127896 - DNA, 13 bp, Homo sapiens
tgtaacttcctgc

SEQ ID NO: 1127897 - DNA, 15 bp, Homo sapiens
tgtaacttcctgctg

SEQ ID NO: 1127898 - DNA, 17 bp, Homo sapiens
tgtaacttcctgctgca

SEQ ID NO: 1127899 - DNA, 19 bp, Homo sapiens
tgtaacttcctgctgcacc

SEQ ID NO: 1127900 - DNA, 14 bp, Homo sapiens
tgtaactttaaaca

SEQ ID NO: 1127901 - DNA, 17 bp, Homo sapiens
tgtaactttaaacatct

SEQ ID NO: 1127902 - DNA, 11 bp, Homo sapiens
tgtaacttttt

SEQ ID NO: 1127903 - DNA, 17 bp, Homo sapiens
tgtaactttttttcagt

SEQ ID NO: 1127904 - DNA, 19 bp, Homo sapiens
tgtaactttttttcagttc

SEQ ID NO: 1127905 - DNA, 19 bp, Homo sapiens
tgtaagaaaacaaaatcta

SEQ ID NO: 1127906 - DNA, 17 bp, Homo sapiens
tgtaagaaaagctgatg

SEQ ID NO: 1127907 - DNA, 15 bp, Homo sapiens
tgtaagaaatacaga

SEQ ID NO: 1127908 - DNA, 12 bp, Homo sapiens
tgtaagaaatga

SEQ ID NO: 1127909 - DNA, 19 bp, Homo sapiens
tgtaagaacaatgccaggg

SEQ ID NO: 1127910 - DNA, 13 bp, Homo sapiens
tgtaagaactgta

SEQ ID NO: 1127911 - DNA, 14 bp, Homo sapiens
tgtaagaactgtac

SEQ ID NO: 1127912 - DNA, 16 bp, Homo sapiens
tgtaagaactgtacat

SEQ ID NO: 1127913 - DNA, 19 bp, Homo sapiens
tgtaagaagccccttattt

SEQ ID NO: 1127914 - DNA, 17 bp, Homo sapiens
tgtaagaaggcaatatt

SEQ ID NO: 1127915 - DNA, 16 bp, Homo sapiens
tgtaagaattcagaag

SEQ ID NO: 1127916 - DNA, 20 bp, Homo sapiens
tgtaagacaaaggttttcct

SEQ ID NO: 1127917 - DNA, 21 bp, Homo sapiens
tgtaagacaaaggttttcctc

SEQ ID NO: 1127918 - DNA, 14 bp, Homo sapiens
tgtaagacatttgt

SEQ ID NO: 1127919 - DNA, 15 bp, Homo sapiens
tgtaagacatttgta

SEQ ID NO: 1127920 - DNA, 19 bp, Homo sapiens
tgtaagacgtatgtaacat

SEQ ID NO: 1127921 - DNA, 19 bp, Homo sapiens
tgtaagagcaccttcctca

SEQ ID NO: 1127922 - DNA, 15 bp, Homo sapiens
tgtaagagcttgctc

SEQ ID NO: 1127923 - DNA, 19 bp, Homo sapiens
tgtaagatcgttctctgcc

SEQ ID NO: 1127924 - DNA, 14 bp, Homo sapiens
tgtaagatgctggg

SEQ ID NO: 1127925 - DNA, 15 bp, Homo sapiens
tgtaagatgctgggt

SEQ ID NO: 1127926 - DNA, 15 bp, Homo sapiens
tgtaagcaacttgct

SEQ ID NO: 1127927 - DNA, 17 bp, Homo sapiens
tgtaagcaacttgcttc

SEQ ID NO: 1127928 - DNA, 21 bp, Homo sapiens
tgtaagcaacttgcttctaaa

SEQ ID NO: 1127929 - DNA, 17 bp, Homo sapiens
tgtaagcactctggatg

SEQ ID NO: 1127930 - DNA, 13 bp, Homo sapiens
tgtaagccctctt

SEQ ID NO: 1127931 - DNA, 16 bp, Homo sapiens
tgtaagccctctttaa

SEQ ID NO: 1127932 - DNA, 14 bp, Homo sapiens
tgtaaggtcttctt

SEQ ID NO: 1127933 - DNA, 16 bp, Homo sapiens
tgtaaggtctttgtaa

SEQ ID NO: 1127934 - DNA, 22 bp, Homo sapiens
tgtaagtaataatttgtaaatt

SEQ ID NO: 1127935 - DNA, 14 bp, Homo sapiens
tgtaagtaattatc

SEQ ID NO: 1127936 - DNA, 22 bp, Homo sapiens
tgtagaataaatggtttctcat

SEQ ID NO: 1127937 - DNA, 16 bp, Homo sapiens
tgtagaatgatttcat

SEQ ID NO: 1127938 - DNA, 17 bp, Homo sapiens
tgtagaatgatttcatg

SEQ ID NO: 1127939 - DNA, 15 bp, Homo sapiens
tgtagaattgtatat

SEQ ID NO: 1127940 - DNA, 16 bp, Homo sapiens
tgtagacaaagtacat

SEQ ID NO: 1127941 - DNA, 12 bp, Homo sapiens
tgtagacgatat

SEQ ID NO: 1127942 - DNA, 17 bp, Homo sapiens
tgtagacgatatactcc

SEQ ID NO: 1127943 - DNA, 20 bp, Homo sapiens
tgtagacgatatactccctg

SEQ ID NO: 1127944 - DNA, 16 bp, Homo sapiens
tgtagactgtttcaca

SEQ ID NO: 1127945 - DNA, 15 bp, Homo sapiens
tgtagagagaacagg

SEQ ID NO: 1127946 - DNA, 19 bp, Homo sapiens
tgtagagagagctgtatta

SEQ ID NO: 1127947 - DNA, 14 bp, Homo sapiens
tgtagagtgggagc

SEQ ID NO: 1127948 - DNA, 13 bp, Homo sapiens
tgtagagttgctg

SEQ ID NO: 1127949 - DNA, 20 bp, Homo sapiens
tgtagagttgctgagagggc

SEQ ID NO: 1127950 - DNA, 20 bp, Homo sapiens
tgtagatacaaggatgcaca

SEQ ID NO: 1127951 - DNA, 14 bp, Homo sapiens
tgtagatcaggttt

SEQ ID NO: 1127952 - DNA, 22 bp, Homo sapiens
tgtagatgaacttgagctctgt

SEQ ID NO: 1127953 - DNA, 13 bp, Homo sapiens
tgtagatggagtt

SEQ ID NO: 1127954 - DNA, 17 bp, Homo sapiens
tgtagatggcgatgtgt

SEQ ID NO: 1127955 - DNA, 21 bp, Homo sapiens
tgtagatgggggaactgtgaa

SEQ ID NO: 1127956 - DNA, 16 bp, Homo sapiens
tgtagatgtagcattg

SEQ ID NO: 1127957 - DNA, 15 bp, Homo sapiens
tgtagattctgtgga

SEQ ID NO: 1127958 - DNA, 18 bp, Homo sapiens
tgtagattgattgtattg

SEQ ID NO: 1127959 - DNA, 14 bp, Homo sapiens
tgtagatttgaaaa

SEQ ID NO: 1127960 - DNA, 17 bp, Homo sapiens
tgtagatttgaaaattg

SEQ ID NO: 1127961 - DNA, 18 bp, Homo sapiens
tgtagatttgaaaattgt

SEQ ID NO: 1127962 - DNA, 18 bp, Homo sapiens
tgtagattttatagtgtg

SEQ ID NO: 1127963 - DNA, 20 bp, Homo sapiens
tgtagcaaaacgcatggagt

SEQ ID NO: 1127964 - DNA, 22 bp, Homo sapiens
tgtagcaaaattcttaagtatg

SEQ ID NO: 1127965 - DNA, 22 bp, Homo sapiens
tgtagcacgctgcctgccaaag

SEQ ID NO: 1127966 - DNA, 13 bp, Homo sapiens
tgtagcactgagg

SEQ ID NO: 1127967 - DNA, 20 bp, Homo sapiens
tgtagcacttacgtaaaaca

SEQ ID NO: 1127968 - DNA, 16 bp, Homo sapiens
tgtagcaggtttcact

SEQ ID NO: 1127969 - DNA, 18 bp, Homo sapiens
tgtagcaggtttcactat

SEQ ID NO: 1127970 - DNA, 15 bp, Homo sapiens
tgtagcatataggtg

SEQ ID NO: 1127971 - DNA, 18 bp, Homo sapiens
tgtagcatttcttgatgt

SEQ ID NO: 1127972 - DNA, 19 bp, Homo sapiens
tgtagccacccaactttgt

SEQ ID NO: 1127973 - DNA, 19 bp, Homo sapiens
tgtagccagccaggtgcat

SEQ ID NO: 1127974 - DNA, 22 bp, Homo sapiens
tgtagccaggtatggctctgca

SEQ ID NO: 1127975 - DNA, 16 bp, Homo sapiens
tgtagccatggctcag

SEQ ID NO: 1127976 - DNA, 17 bp, Homo sapiens
tgtagccatggctcagg

SEQ ID NO: 1127977 - DNA, 18 bp, Homo sapiens
tgtagccatggctcaggc

SEQ ID NO: 1127978 - DNA, 19 bp, Homo sapiens
tgtagccatggctcaggca

SEQ ID NO: 1127979 - DNA, 16 bp, Homo sapiens
tgtagccccctggcct

SEQ ID NO: 1127980 - DNA, 14 bp, Homo sapiens
tgtagccctgggtt

SEQ ID NO: 1127981 - DNA, 14 bp, Homo sapiens
tgtagccgccctga

SEQ ID NO: 1127982 - DNA, 19 bp, Homo sapiens
tgtagcctaaagggcaggg

SEQ ID NO: 1127983 - DNA, 21 bp, Homo sapiens
tgtagcctaaagggcagggcc

SEQ ID NO: 1127984 - DNA, 22 bp, Homo sapiens
tgtagcctaaagggcagggccc

SEQ ID NO: 1127985 - DNA, 16 bp, Homo sapiens
tgtagcctcctttgta

SEQ ID NO: 1127986 - DNA, 15 bp, Homo sapiens
tgtagccttcacaca

SEQ ID NO: 1127987 - DNA, 15 bp, Homo sapiens
tgtagccttctcccc

SEQ ID NO: 1127988 - DNA, 16 bp, Homo sapiens
tgtagccttgcccgga

SEQ ID NO: 1127989 - DNA, 16 bp, Homo sapiens
tgtagcgaccccagac

SEQ ID NO: 1127990 - DNA, 11 bp, Homo sapiens
tgtagctatta

SEQ ID NO: 1127991 - DNA, 21 bp, Homo sapiens
tgtagctattagcggctcctc

SEQ ID NO: 1127992 - DNA, 14 bp, Homo sapiens
tgtagctcaagttt

SEQ ID NO: 1127993 - DNA, 22 bp, Homo sapiens
tgtagctcccctgctgaggcag

SEQ ID NO: 1127994 - DNA, 16 bp, Homo sapiens
tgtagctgaagcagga

SEQ ID NO: 1127995 - DNA, 17 bp, Homo sapiens
tgtagctgagctgtgac

SEQ ID NO: 1127996 - DNA, 13 bp, Homo sapiens
tgtagctgctata

SEQ ID NO: 1127997 - DNA, 14 bp, Homo sapiens
tgtagctggtttcc

SEQ ID NO: 1127998 - DNA, 16 bp, Homo sapiens
tgtagctgtaagggca

SEQ ID NO: 1127999 - DNA, 18 bp, Homo sapiens
tgtagctgtaagggcagt

SEQ ID NO: 1128000 - DNA, 12 bp, Homo sapiens
tgtagctgtgaa

SEQ ID NO: 1128001 - DNA, 13 bp, Homo sapiens
tgtagctgtgaaa

SEQ ID NO: 1128002 - DNA, 16 bp, Homo sapiens
tgtagcttcagtcatt

SEQ ID NO: 1128003 - DNA, 20 bp, Homo sapiens
tgtagcttccacctcatgga

SEQ ID NO: 1128004 - DNA, 15 bp, Homo sapiens
tgtagctttctggaa

SEQ ID NO: 1128005 - DNA, 15 bp, Homo sapiens
tgtagctttgctctt

SEQ ID NO: 1128006 - DNA, 18 bp, Homo sapiens
tgtagcttttggggaggg

SEQ ID NO: 1128007 - DNA, 15 bp, Homo sapiens
tgtaggaacaagcat

SEQ ID NO: 1128008 - DNA, 21 bp, Homo sapiens
tgtaggaaccgtggtatgtct

SEQ ID NO: 1128009 - DNA, 21 bp, Homo sapiens
tgtaggaattcttttggggaa

SEQ ID NO: 1128010 - DNA, 12 bp, Homo sapiens
tgtaggagctgc

SEQ ID NO: 1128011 - DNA, 15 bp, Homo sapiens
tgtaggagctgcctt

SEQ ID NO: 1128012 - DNA, 22 bp, Homo sapiens
tgtaggagctgccttggctcag

SEQ ID NO: 1128013 - DNA, 16 bp, Homo sapiens
tgtaggcagaggctgc

SEQ ID NO: 1128014 - DNA, 21 bp, Homo sapiens
tgtaggctgttccctttgcct

SEQ ID NO: 1128015 - DNA, 17 bp, Homo sapiens
tgtaggcttagtttgtg

SEQ ID NO: 1128016 - DNA, 16 bp, Homo sapiens
tgtagggaaaccttgg

SEQ ID NO: 1128017 - DNA, 18 bp, Homo sapiens
tgtagggaaaccttggag

SEQ ID NO: 1128018 - DNA, 19 bp, Homo sapiens
tgtagggaaaccttggaga

SEQ ID NO: 1128019 - DNA, 13 bp, Homo sapiens
tgtagggagggcg

SEQ ID NO: 1128020 - DNA, 20 bp, Homo sapiens
tgtagggcaagggtgcctca

SEQ ID NO: 1128021 - DNA, 19 bp, Homo sapiens
tgtagggcctgcatggaga

SEQ ID NO: 1128022 - DNA, 19 bp, Homo sapiens
tgtaggggacgagaaagat

SEQ ID NO: 1128023 - DNA, 16 bp, Homo sapiens
tgtaggggccacctcc

SEQ ID NO: 1128024 - DNA, 20 bp, Homo sapiens
tgtaggggccacctcctccc

SEQ ID NO: 1128025 - DNA, 23 bp, Homo sapiens
tgtagggggccttgcggaagcca

SEQ ID NO: 1128026 - DNA, 17 bp, Homo sapiens
tgtaggtatgaataagt

SEQ ID NO: 1128027 - DNA, 14 bp, Homo sapiens
tgtaggtgaaatga

SEQ ID NO: 1128028 - DNA, 16 bp, Homo sapiens
tgtaggtgagcctggg

SEQ ID NO: 1128029 - DNA, 20 bp, Homo sapiens
tgtaggtgtctgcacccagg

SEQ ID NO: 1128030 - DNA, 14 bp, Homo sapiens
tgtagtaaaagtgg

SEQ ID NO: 1128031 - DNA, 17 bp, Homo sapiens
tgtagtaaaagtggtct

SEQ ID NO: 1128032 - DNA, 15 bp, Homo sapiens
tgtagtaattgacat

SEQ ID NO: 1128033 - DNA, 16 bp, Homo sapiens
tgtagtaattgacatg

SEQ ID NO: 1128034 - DNA, 18 bp, Homo sapiens
tgtagtaattgacatgtg

SEQ ID NO: 1128035 - DNA, 16 bp, Homo sapiens
tgtagtagcgtttttt

SEQ ID NO: 1128036 - DNA, 13 bp, Homo sapiens
tgtagtagtctca

SEQ ID NO: 1128037 - DNA, 15 bp, Homo sapiens
tgtagtatggtatat

SEQ ID NO: 1128038 - DNA, 20 bp, Homo sapiens
tgtagtatttttgccaaaat

SEQ ID NO: 1128039 - DNA, 19 bp, Homo sapiens
tgtagtattttttgtataa

SEQ ID NO: 1128040 - DNA, 23 bp, Homo sapiens
tgtagtcccagctacttgggagg

SEQ ID NO: 1128041 - DNA, 20 bp, Homo sapiens
tgtagtccgtgctgacagct

SEQ ID NO: 1128042 - DNA, 23 bp, Homo sapiens
tgtagtcctagccactcaggagg

SEQ ID NO: 1128043 - DNA, 20 bp, Homo sapiens
tgtagtcctagctactcagg

SEQ ID NO: 1128044 - DNA, 12 bp, Homo sapiens
tgtagtctctga

SEQ ID NO: 1128045 - DNA, 17 bp, Homo sapiens
tgtagtgagaaactgat

SEQ ID NO: 1128046 - DNA, 21 bp, Homo sapiens
tgtagtgcatttttaaacttg

SEQ ID NO: 1128047 - DNA, 21 bp, Homo sapiens
tgtagtgcctctttcatccac

SEQ ID NO: 1128048 - DNA, 20 bp, Homo sapiens
tgtagtggaagagcagcctg

SEQ ID NO: 1128049 - DNA, 21 bp, Homo sapiens
tgtagtggaagagcagcctga

SEQ ID NO: 1128050 - DNA, 23 bp, Homo sapiens
tgtagtggcttcttttgaactgt

SEQ ID NO: 1128051 - DNA, 19 bp, Homo sapiens
tgtagtgtctttatttgct

SEQ ID NO: 1128052 - DNA, 17 bp, Homo sapiens
tgtagttaaggagccta

SEQ ID NO: 1128053 - DNA, 23 bp, Homo sapiens
tgtagttaggaaataaaaccttt

SEQ ID NO: 1128054 - DNA, 15 bp, Homo sapiens
tgtagttctgccagg

SEQ ID NO: 1128055 - DNA, 18 bp, Homo sapiens
tgtagttctgtgtacttt

SEQ ID NO: 1128056 - DNA, 19 bp, Homo sapiens
tgtagttcttgtctgattg

SEQ ID NO: 1128057 - DNA, 16 bp, Homo sapiens
tgtagttgacaattct

SEQ ID NO: 1128058 - DNA, 22 bp, Homo sapiens
tgtcactactcacagtctcttt

SEQ ID NO: 1128059 - DNA, 20 bp, Homo sapiens
tgtcactcactgaggccatc

SEQ ID NO: 1128060 - DNA, 13 bp, Homo sapiens
tgtcactgatgga

SEQ ID NO: 1128061 - DNA, 17 bp, Homo sapiens
tgtcactgtagttttga

SEQ ID NO: 1128062 - DNA, 17 bp, Homo sapiens
tgtcactgtttctctgc

SEQ ID NO: 1128063 - DNA, 22 bp, Homo sapiens
tgtcacttcgcgtgccctcgct

SEQ ID NO: 1128064 - DNA, 12 bp, Homo sapiens
tgtcacttctgg

SEQ ID NO: 1128065 - DNA, 14 bp, Homo sapiens
tgtcacttcttcac

SEQ ID NO: 1128066 - DNA, 16 bp, Homo sapiens
tgtcacttgccacatg

SEQ ID NO: 1128067 - DNA, 23 bp, Homo sapiens
tgtcacttggtggcggggtgggg

SEQ ID NO: 1128068 - DNA, 14 bp, Homo sapiens
tgtcacttgtcggg

SEQ ID NO: 1128069 - DNA, 18 bp, Homo sapiens
tgtcacttgtcgggggcc

SEQ ID NO: 1128070 - DNA, 15 bp, Homo sapiens
tgtcactttgctctg

SEQ ID NO: 1128071 - DNA, 23 bp, Homo sapiens
tgtcacttttttataaaagttta

SEQ ID NO: 1128072 - DNA, 15 bp, Homo sapiens
tgtcagaaacaatga

SEQ ID NO: 1128073 - DNA, 22 bp, Homo sapiens
tgtcagaaacaatgacatccag

SEQ ID NO: 1128074 - DNA, 14 bp, Homo sapiens
tgtcagaaacatga

SEQ ID NO: 1128075 - DNA, 16 bp, Homo sapiens
tgtcagaaacatgaaa

SEQ ID NO: 1128076 - DNA, 21 bp, Homo sapiens
tgtcagaaaccagttatgtga

SEQ ID NO: 1128077 - DNA, 16 bp, Homo sapiens
tgtcagaataggaaaa

SEQ ID NO: 1128078 - DNA, 20 bp, Homo sapiens
tgtcagacctatttgacata

SEQ ID NO: 1128079 - DNA, 12 bp, Homo sapiens
tgtcagacttta

SEQ ID NO: 1128080 - DNA, 14 bp, Homo sapiens
tgtcagactttaaa

SEQ ID NO: 1128081 - DNA, 20 bp, Homo sapiens
tgtcagactttgctgcattt

SEQ ID NO: 1128082 - DNA, 12 bp, Homo sapiens
tgtcagagccca

SEQ ID NO: 1128083 - DNA, 13 bp, Homo sapiens
tgtcagagcccag

SEQ ID NO: 1128084 - DNA, 15 bp, Homo sapiens
tgtcagagcccaggg

SEQ ID NO: 1128085 - DNA, 19 bp, Homo sapiens
tgtcagagcccaggggaga

SEQ ID NO: 1128086 - DNA, 12 bp, Homo sapiens
tgtcagagccta

SEQ ID NO: 1128087 - DNA, 12 bp, Homo sapiens
tgtcagagctgg

SEQ ID NO: 1128088 - DNA, 15 bp, Homo sapiens
tgtcagagctgggag

SEQ ID NO: 1128089 - DNA, 16 bp, Homo sapiens
tgtcagaggaccccag

SEQ ID NO: 1128090 - DNA, 20 bp, Homo sapiens
tgtcagaggaccccagggtg

SEQ ID NO: 1128091 - DNA, 16 bp, Homo sapiens
tgtcagagttctgctc

SEQ ID NO: 1128092 - DNA, 16 bp, Homo sapiens
tgtcagataagtgtaa

SEQ ID NO: 1128093 - DNA, 21 bp, Homo sapiens
tgtcagatattttttcagaaa

SEQ ID NO: 1128094 - DNA, 17 bp, Homo sapiens
tgtcagatgagaacaaa

SEQ ID NO: 1128095 - DNA, 21 bp, Homo sapiens
tgtcagatgagaacaaagctg

SEQ ID NO: 1128096 - DNA, 23 bp, Homo sapiens
tgtcagatgagaacaaagctgtt

SEQ ID NO: 1128097 - DNA, 21 bp, Homo sapiens
tgtcagatgcgtgcccagctc

SEQ ID NO: 1128098 - DNA, 17 bp, Homo sapiens
tgtcagatttctggttg

SEQ ID NO: 1128099 - DNA, 14 bp, Homo sapiens
tgtcagcaaaaagc

SEQ ID NO: 1128100 - DNA, 14 bp, Homo sapiens
tgtcagccacctcc

SEQ ID NO: 1128101 - DNA, 15 bp, Homo sapiens
tgtcagccagccgcc

SEQ ID NO: 1128102 - DNA, 17 bp, Homo sapiens
tgtcagccagccgccct

SEQ ID NO: 1128103 - DNA, 19 bp, Homo sapiens
tgtcagccagccgccctgg

SEQ ID NO: 1128104 - DNA, 12 bp, Homo sapiens
tgtcagcccctc

SEQ ID NO: 1128105 - DNA, 13 bp, Homo sapiens
tgtcagcccctct

SEQ ID NO: 1128106 - DNA, 14 bp, Homo sapiens
tgtcagcccctctt

SEQ ID NO: 1128107 - DNA, 17 bp, Homo sapiens
tgtcagcccctcttccc

SEQ ID NO: 1128108 - DNA, 22 bp, Homo sapiens
tgtcagccgggccctgagtaat

SEQ ID NO: 1128109 - DNA, 18 bp, Homo sapiens
tgtcagctactaatgatg

SEQ ID NO: 1128110 - DNA, 23 bp, Homo sapiens
tgtcagctactgcggaaaaggaa

SEQ ID NO: 1128111 - DNA, 22 bp, Homo sapiens
tgtcagctgcaaggtactctgg

SEQ ID NO: 1128112 - DNA, 20 bp, Homo sapiens
tgtcagcttggctgtaggac

SEQ ID NO: 1128113 - DNA, 12 bp, Homo sapiens
tgtcaggcaggt

SEQ ID NO: 1128114 - DNA, 20 bp, Homo sapiens
tgtcaggcatggctcagagc

SEQ ID NO: 1128115 - DNA, 22 bp, Homo sapiens
tgtcaggcccgtcggagctgcc

SEQ ID NO: 1128116 - DNA, 15 bp, Homo sapiens
tgtcaggccctctgc

SEQ ID NO: 1128117 - DNA, 22 bp, Homo sapiens
tgtcaggccctctgcctgcact

SEQ ID NO: 1128118 - DNA, 13 bp, Homo sapiens
tgtcaggctggga

SEQ ID NO: 1128119 - DNA, 17 bp, Homo sapiens
tgtcagggagggccagg

SEQ ID NO: 1128120 - DNA, 16 bp, Homo sapiens
tgtcagggatgagttg

SEQ ID NO: 1128121 - DNA, 21 bp, Homo sapiens
tgtcagggtccaggagagcct

SEQ ID NO: 1128122 - DNA, 20 bp, Homo sapiens
tgtcaggtcccagcgagcca

SEQ ID NO: 1128123 - DNA, 14 bp, Homo sapiens
tgtcagtatccagg

SEQ ID NO: 1128124 - DNA, 17 bp, Homo sapiens
tgtcagtcacagccacc

SEQ ID NO: 1128125 - DNA, 18 bp, Homo sapiens
tgtcagtcacagccaccc

SEQ ID NO: 1128126 - DNA, 22 bp, Homo sapiens
tgtcagtcacagccacccctga

SEQ ID NO: 1128127 - DNA, 17 bp, Homo sapiens
tgtcagtctgcttagaa

SEQ ID NO: 1128128 - DNA, 16 bp, Homo sapiens
tgtcagtgcagcccgt

SEQ ID NO: 1128129 - DNA, 18 bp, Homo sapiens
tgtcagtggtttctactt

SEQ ID NO: 1128130 - DNA, 20 bp, Homo sapiens
tgtcagtgttaaagattttg

SEQ ID NO: 1128131 - DNA, 18 bp, Homo sapiens
tgtcagttgtacttctgc

SEQ ID NO: 1128132 - DNA, 14 bp, Homo sapiens
tgtcagtttcccct

SEQ ID NO: 1128133 - DNA, 15 bp, Homo sapiens
tgtcagtttcccctc

SEQ ID NO: 1128134 - DNA, 17 bp, Homo sapiens
tgtcagtttcccctctc

SEQ ID NO: 1128135 - DNA, 17 bp, Homo sapiens
tgtcagtttcctctcct

SEQ ID NO: 1128136 - DNA, 21 bp, Homo sapiens
tgtcataaaatgcatactgtt

SEQ ID NO: 1128137 - DNA, 22 bp, Homo sapiens
tgtcataacatttaaagagatt

SEQ ID NO: 1128138 - DNA, 23 bp, Homo sapiens
tgtcataacatttaaagagattt

SEQ ID NO: 1128139 - DNA, 14 bp, Homo sapiens
tgtcataagaatga

SEQ ID NO: 1128140 - DNA, 15 bp, Homo sapiens
tgtcatacaaattta

SEQ ID NO: 1128141 - DNA, 16 bp, Homo sapiens
tgtcatatactgccat

SEQ ID NO: 1128142 - DNA, 17 bp, Homo sapiens
tgtcatatactgccatg

SEQ ID NO: 1128143 - DNA, 18 bp, Homo sapiens
tgtcatatagctggttat

SEQ ID NO: 1128144 - DNA, 18 bp, Homo sapiens
tgtcatatcatttcactg

SEQ ID NO: 1128145 - DNA, 17 bp, Homo sapiens
tgtcatatgactgatta

SEQ ID NO: 1128146 - DNA, 21 bp, Homo sapiens
tgtcatatgtaggtgtctgca

SEQ ID NO: 1128147 - DNA, 14 bp, Homo sapiens
tgtcatcactccct

SEQ ID NO: 1128148 - DNA, 15 bp, Homo sapiens
tgtcatcagaagata

SEQ ID NO: 1128149 - DNA, 15 bp, Homo sapiens
tgtcatcagccacca

SEQ ID NO: 1128150 - DNA, 16 bp, Homo sapiens
tgtcatcctcaaagaa

SEQ ID NO: 1128151 - DNA, 20 bp, Homo sapiens
tgtcatcctcaaagaaagtg

SEQ ID NO: 1128152 - DNA, 23 bp, Homo sapiens
tgtcatcctcaaagaaagtgtat

SEQ ID NO: 1128153 - DNA, 16 bp, Homo sapiens
tgtcatcctctggaag

SEQ ID NO: 1128154 - DNA, 14 bp, Homo sapiens
tgtcatctctctgg

SEQ ID NO: 1128155 - DNA, 20 bp, Homo sapiens
tgtcatctttttctagagtt

SEQ ID NO: 1128156 - DNA, 12 bp, Homo sapiens
tgtcatgaacat

SEQ ID NO: 1128157 - DNA, 15 bp, Homo sapiens
tgtcatgaggaaact

SEQ ID NO: 1128158 - DNA, 19 bp, Homo sapiens
tgtcatgcctcactttctt

SEQ ID NO: 1128159 - DNA, 19 bp, Homo sapiens
tgtcatgcggtttccaagg

SEQ ID NO: 1128160 - DNA, 17 bp, Homo sapiens
tgtcatgcttcatcatt

SEQ ID NO: 1128161 - DNA, 22 bp, Homo sapiens
tgtcatgcttcatcattccctc

SEQ ID NO: 1128162 - DNA, 17 bp, Homo sapiens
tgtcatgtggaaactat

SEQ ID NO: 1128163 - DNA, 13 bp, Homo sapiens
tgtcattaaaggt

SEQ ID NO: 1128164 - DNA, 13 bp, Homo sapiens
tgtcattatgatt

SEQ ID NO: 1128165 - DNA, 17 bp, Homo sapiens
tgtcattatttattgtt

SEQ ID NO: 1128166 - DNA, 13 bp, Homo sapiens
tgtcattctgcct

SEQ ID NO: 1128167 - DNA, 15 bp, Homo sapiens
tgtcattctgcctgc

SEQ ID NO: 1128168 - DNA, 16 bp, Homo sapiens
tgtcattctgcctgct

SEQ ID NO: 1128169 - DNA, 17 bp, Homo sapiens
tgtcattctgcctgctc

SEQ ID NO: 1128170 - DNA, 22 bp, Homo sapiens
tgtcattctgcctgctccatcg

SEQ ID NO: 1128171 - DNA, 15 bp, Homo sapiens
tgtcattgccttcgc

SEQ ID NO: 1128172 - DNA, 13 bp, Homo sapiens
tgtcattgctaaa

SEQ ID NO: 1128173 - DNA, 19 bp, Homo sapiens
tgtcattgctaaaaaataa

SEQ ID NO: 1128174 - DNA, 13 bp, Homo sapiens
tgtcattggaagc

SEQ ID NO: 1128175 - DNA, 14 bp, Homo sapiens
tgtcattggaagcc

SEQ ID NO: 1128176 - DNA, 13 bp, Homo sapiens
tgtcattgtccag

SEQ ID NO: 1128177 - DNA, 14 bp, Homo sapiens
tgtcattgtccagc

SEQ ID NO: 1128178 - DNA, 20 bp, Homo sapiens
tgtcatttagttcagcatcc

SEQ ID NO: 1128179 - DNA, 15 bp, Homo sapiens
tgtcatttcagaagt

SEQ ID NO: 1128180 - DNA, 17 bp, Homo sapiens
tgtcctttttgttatta

SEQ ID NO: 1128181 - DNA, 22 bp, Homo sapiens
tgtcgaaacctacaagatttcc

SEQ ID NO: 1128182 - DNA, 14 bp, Homo sapiens
tgtcgacatgtttt

SEQ ID NO: 1128183 - DNA, 17 bp, Homo sapiens
tgtcgagagctggccaa

SEQ ID NO: 1128184 - DNA, 19 bp, Homo sapiens
tgtcgatcaagagaatcaa

SEQ ID NO: 1128185 - DNA, 17 bp, Homo sapiens
tgtcgcccacccagctg

SEQ ID NO: 1128186 - DNA, 18 bp, Homo sapiens
tgtcgcccacccagctgg

SEQ ID NO: 1128187 - DNA, 21 bp, Homo sapiens
tgtcgcccacccagctggtcc

SEQ ID NO: 1128188 - DNA, 21 bp, Homo sapiens
tgtcgcgcgtctcccatcctg

SEQ ID NO: 1128189 - DNA, 14 bp, Homo sapiens
tgtcgctcatgtgt

SEQ ID NO: 1128190 - DNA, 16 bp, Homo sapiens
tgtcgctcatgtgtgc

SEQ ID NO: 1128191 - DNA, 17 bp, Homo sapiens
tgtcgctctgctggcct

SEQ ID NO: 1128192 - DNA, 19 bp, Homo sapiens
tgtcgctctgctggcctgg

SEQ ID NO: 1128193 - DNA, 14 bp, Homo sapiens
tgtcggagaggctg

SEQ ID NO: 1128194 - DNA, 22 bp, Homo sapiens
tgtcggagaggctgtctggggc

SEQ ID NO: 1128195 - DNA, 22 bp, Homo sapiens
tgtcggggttggggtgggaggg

SEQ ID NO: 1128196 - DNA, 20 bp, Homo sapiens
tgtcggtcatagtttcctga

SEQ ID NO: 1128197 - DNA, 23 bp, Homo sapiens
tgtcggttttttttaaataaaag

SEQ ID NO: 1128198 - DNA, 16 bp, Homo sapiens
tgtcgtaaagatttgg

SEQ ID NO: 1128199 - DNA, 14 bp, Homo sapiens
tgtcgtctgactct

SEQ ID NO: 1128200 - DNA, 17 bp, Homo sapiens
tgtcgtctgactctggg

SEQ ID NO: 1128201 - DNA, 20 bp, Homo sapiens
tgtcgtggacacacacagac

SEQ ID NO: 1128202 - DNA, 15 bp, Homo sapiens
tgtcgtggttcttaa

SEQ ID NO: 1128203 - DNA, 21 bp, Homo sapiens
tgtcgtgttttcaaggaagaa

SEQ ID NO: 1128204 - DNA, 14 bp, Homo sapiens
tgtcgtttgtgaac

SEQ ID NO: 1128205 - DNA, 20 bp, Homo sapiens
tgtcgtttgtgaacgctgtg

SEQ ID NO: 1128206 - DNA, 13 bp, Homo sapiens
tgtctaaaaacac

SEQ ID NO: 1128207 - DNA, 21 bp, Homo sapiens
tgtctaaacaatgctgatttg

SEQ ID NO: 1128208 - DNA, 24 bp, Homo sapiens
tgtctaaagccttaactaagactc

SEQ ID NO: 1128209 - DNA, 23 bp, Homo sapiens
tgtctaaagtgtattttcagagc

SEQ ID NO: 1128210 - DNA, 16 bp, Homo sapiens
tgtctaatagcccata

SEQ ID NO: 1128211 - DNA, 21 bp, Homo sapiens
tgtctaatagcccataaagtc

SEQ ID NO: 1128212 - DNA, 22 bp, Homo sapiens
tgtctaatatcttaattctttg

SEQ ID NO: 1128213 - DNA, 18 bp, Homo sapiens
tgtctaattgcatctcaa

SEQ ID NO: 1128214 - DNA, 23 bp, Homo sapiens
tgtctaattttctttccgacaca

SEQ ID NO: 1128215 - DNA, 17 bp, Homo sapiens
tgtctacagaaaatgct

SEQ ID NO: 1128216 - DNA, 18 bp, Homo sapiens
tgtctacagtagctgcta

SEQ ID NO: 1128217 - DNA, 15 bp, Homo sapiens
tgtctacctggcaga

SEQ ID NO: 1128218 - DNA, 22 bp, Homo sapiens
tgtctactaagtgatgctgtga

SEQ ID NO: 1128219 - DNA, 23 bp, Homo sapiens
tgtctactcctagaagaaccaaa

SEQ ID NO: 1128220 - DNA, 15 bp, Homo sapiens
tgtctactgtggtga

SEQ ID NO: 1128221 - DNA, 13 bp, Homo sapiens
tgtctacttttta

SEQ ID NO: 1128222 - DNA, 12 bp, Homo sapiens
tgtctagaatgt

SEQ ID NO: 1128223 - DNA, 17 bp, Homo sapiens
tgtctagaatgtggatt

SEQ ID NO: 1128224 - DNA, 14 bp, Homo sapiens
tgtctagagtagct

SEQ ID NO: 1128225 - DNA, 17 bp, Homo sapiens
tgtctagagtcatgtga

SEQ ID NO: 1128226 - DNA, 17 bp, Homo sapiens
tgtctagccactccctc

SEQ ID NO: 1128227 - DNA, 19 bp, Homo sapiens
tgtctagccactccctccc

SEQ ID NO: 1128228 - DNA, 19 bp, Homo sapiens
tgtctaggaaggtgtgatg

SEQ ID NO: 1128229 - DNA, 17 bp, Homo sapiens
tgtctaggttaaagcta

SEQ ID NO: 1128230 - DNA, 19 bp, Homo sapiens
tgtctaggttaaagctaaa

SEQ ID NO: 1128231 - DNA, 22 bp, Homo sapiens
tgtctaggttaaagctaaactg

SEQ ID NO: 1128232 - DNA, 13 bp, Homo sapiens
tgtctagtgtctg

SEQ ID NO: 1128233 - DNA, 14 bp, Homo sapiens
tgtctagtttctag

SEQ ID NO: 1128234 - DNA, 15 bp, Homo sapiens
tgtctagtttctagt

SEQ ID NO: 1128235 - DNA, 13 bp, Homo sapiens
tgtctataaagca

SEQ ID NO: 1128236 - DNA, 22 bp, Homo sapiens
tgtctataatcccagcactttg

SEQ ID NO: 1128237 - DNA, 13 bp, Homo sapiens
tgtctattcagct

SEQ ID NO: 1128238 - DNA, 15 bp, Homo sapiens
tgtctattctgagcc

SEQ ID NO: 1128239 - DNA, 16 bp, Homo sapiens
tgtctattctgagcct

SEQ ID NO: 1128240 - DNA, 18 bp, Homo sapiens
tgtctattgtccaaagtt

SEQ ID NO: 1128241 - DNA, 16 bp, Homo sapiens
tgtctatttaagtgca

SEQ ID NO: 1128242 - DNA, 15 bp, Homo sapiens
tgtctattttaaaat

SEQ ID NO: 1128243 - DNA, 22 bp, Homo sapiens
tgtctattttaaaataaattag

SEQ ID NO: 1128244 - DNA, 20 bp, Homo sapiens
tgtctatttttaatgtttgt

SEQ ID NO: 1128245 - DNA, 18 bp, Homo sapiens
tgtctcaaaggagctttc

SEQ ID NO: 1128246 - DNA, 22 bp, Homo sapiens
tgtctcaaaggagctttctcaa

SEQ ID NO: 1128247 - DNA, 17 bp, Homo sapiens
tgtctcaagagggcact

SEQ ID NO: 1128248 - DNA, 19 bp, Homo sapiens
tgtctcaagagggcactgg

SEQ ID NO: 1128249 - DNA, 21 bp, Homo sapiens
tgtctcaagagggcactggtg

SEQ ID NO: 1128250 - DNA, 23 bp, Homo sapiens
tgtctcaagagggcactggtggc

SEQ ID NO: 1128251 - DNA, 16 bp, Homo sapiens
tgtctcactgttctgc

SEQ ID NO: 1128252 - DNA, 23 bp, Homo sapiens
tgtctcactttttacccagaaca

SEQ ID NO: 1128253 - DNA, 12 bp, Homo sapiens
tgtctcagagcc

SEQ ID NO: 1128254 - DNA, 13 bp, Homo sapiens
tgtctcagagcct

SEQ ID NO: 1128255 - DNA, 20 bp, Homo sapiens
tgtctcagatggtgtgtcca

SEQ ID NO: 1128256 - DNA, 13 bp, Homo sapiens
tgtctcagcctcc

SEQ ID NO: 1128257 - DNA, 15 bp, Homo sapiens
tgtctcagcctctgc

SEQ ID NO: 1128258 - DNA, 11 bp, Homo sapiens
tgtctcatccc

SEQ ID NO: 1128259 - DNA, 19 bp, Homo sapiens
tgtctcatttagaaacaat

SEQ ID NO: 1128260 - DNA, 22 bp, Homo sapiens
tgtctcattttggtctgttttg

SEQ ID NO: 1128261 - DNA, 18 bp, Homo sapiens
tgtctccacccaccttga

SEQ ID NO: 1128262 - DNA, 22 bp, Homo sapiens
tgtctccacctacacccctgtg

SEQ ID NO: 1128263 - DNA, 13 bp, Homo sapiens
tgtctccactgtg

SEQ ID NO: 1128264 - DNA, 14 bp, Homo sapiens
tgtctccactgtgc

SEQ ID NO: 1128265 - DNA, 12 bp, Homo sapiens
tgtctccagacc

SEQ ID NO: 1128266 - DNA, 16 bp, Homo sapiens
tgtctccagaccccca

SEQ ID NO: 1128267 - DNA, 13 bp, Homo sapiens
tgtctccagctgc

SEQ ID NO: 1128268 - DNA, 21 bp, Homo sapiens
tgtctccagctgcctgggccc

SEQ ID NO: 1128269 - DNA, 19 bp, Homo sapiens
tgtctccagggcccccacc

SEQ ID NO: 1128270 - DNA, 16 bp, Homo sapiens
tgtctccattgtgtga

SEQ ID NO: 1128271 - DNA, 22 bp, Homo sapiens
tgtctcccaacatgggagggat

SEQ ID NO: 1128272 - DNA, 15 bp, Homo sapiens
tgtctcccacaccca

SEQ ID NO: 1128273 - DNA, 14 bp, Homo sapiens
tgtctcccagaact

SEQ ID NO: 1128274 - DNA, 17 bp, Homo sapiens
tgtctcccaggctgctg

SEQ ID NO: 1128275 - DNA, 13 bp, Homo sapiens
tgtctcccgcccc

SEQ ID NO: 1128276 - DNA, 21 bp, Homo sapiens
tgtctccctcccctctcagaa

SEQ ID NO: 1128277 - DNA, 19 bp, Homo sapiens
tgtctcccttcttgggtag

SEQ ID NO: 1128278 - DNA, 20 bp, Homo sapiens
tgtctcctacctgctgctgc

SEQ ID NO: 1128279 - DNA, 15 bp, Homo sapiens
tgtctcctactctgt

SEQ ID NO: 1128280 - DNA, 16 bp, Homo sapiens
tgtctcctcaagcctg

SEQ ID NO: 1128281 - DNA, 17 bp, Homo sapiens
tgtctcctcaagcctgt

SEQ ID NO: 1128282 - DNA, 18 bp, Homo sapiens
tgtctcctcaagcctgtg

SEQ ID NO: 1128283 - DNA, 20 bp, Homo sapiens
tgtctcctcaagcctgtggg

SEQ ID NO: 1128284 - DNA, 19 bp, Homo sapiens
tgtctcgcgcgactgagaa

SEQ ID NO: 1128285 - DNA, 14 bp, Homo sapiens
tgtctcgggctgac

SEQ ID NO: 1128286 - DNA, 15 bp, Homo sapiens
tgtctcgttcctgtt

SEQ ID NO: 1128287 - DNA, 21 bp, Homo sapiens
tgtctctaaccattcaaatga

SEQ ID NO: 1128288 - DNA, 15 bp, Homo sapiens
tgtctctcccacccc

SEQ ID NO: 1128289 - DNA, 18 bp, Homo sapiens
tgtctctcccaccccggc

SEQ ID NO: 1128290 - DNA, 16 bp, Homo sapiens
tgtctctctgccaaga

SEQ ID NO: 1128291 - DNA, 13 bp, Homo sapiens
tgtctctgaggac

SEQ ID NO: 1128292 - DNA, 13 bp, Homo sapiens
tgtctctgatgca

SEQ ID NO: 1128293 - DNA, 17 bp, Homo sapiens
tgtctctgcctccctca

SEQ ID NO: 1128294 - DNA, 13 bp, Homo sapiens
tgtctctgctcct

SEQ ID NO: 1128295 - DNA, 17 bp, Homo sapiens
tgtctctgcttccatgg

SEQ ID NO: 1128296 - DNA, 14 bp, Homo sapiens
tgtctctgctttcc

SEQ ID NO: 1128297 - DNA, 16 bp, Homo sapiens
tgtctctgctttcctt

SEQ ID NO: 1128298 - DNA, 18 bp, Homo sapiens
tgtctctgctttcctttt

SEQ ID NO: 1128299 - DNA, 21 bp, Homo sapiens
tgtctctgggcctgtgtgtgg

SEQ ID NO: 1128300 - DNA, 16 bp, Homo sapiens
tgtctctgggctgagg

SEQ ID NO: 1128301 - DNA, 23 bp, Homo sapiens
tgtctctgggcttggggcttcct

SEQ ID NO: 1128302 - DNA, 16 bp, Homo sapiens
tgtgacatttatgtct

SEQ ID NO: 1128303 - DNA, 18 bp, Homo sapiens
tgtgaccaaaagttacat

SEQ ID NO: 1128304 - DNA, 17 bp, Homo sapiens
tgtgaccaactgtgttg

SEQ ID NO: 1128305 - DNA, 21 bp, Homo sapiens
tgtgaccaactgtgttgtatt

SEQ ID NO: 1128306 - DNA, 15 bp, Homo sapiens
tgtgaccaagtataa

SEQ ID NO: 1128307 - DNA, 19 bp, Homo sapiens
tgtgaccaagtataaactt

SEQ ID NO: 1128308 - DNA, 15 bp, Homo sapiens
tgtgaccaatgtctt

SEQ ID NO: 1128309 - DNA, 22 bp, Homo sapiens
tgtgaccacatacgtgttagga

SEQ ID NO: 1128310 - DNA, 17 bp, Homo sapiens
tgtgaccattctgcctc

SEQ ID NO: 1128311 - DNA, 15 bp, Homo sapiens
tgtgacccccagctc

SEQ ID NO: 1128312 - DNA, 17 bp, Homo sapiens
tgtgacccccagctccg

SEQ ID NO: 1128313 - DNA, 17 bp, Homo sapiens
tgtgacccgtgaatgtg

SEQ ID NO: 1128314 - DNA, 15 bp, Homo sapiens
tgtgaccctccaaat

SEQ ID NO: 1128315 - DNA, 13 bp, Homo sapiens
tgtgaccctctca

SEQ ID NO: 1128316 - DNA, 16 bp, Homo sapiens
tgtgaccctctgaatg

SEQ ID NO: 1128317 - DNA, 15 bp, Homo sapiens
tgtgacctcctgtga

SEQ ID NO: 1128318 - DNA, 14 bp, Homo sapiens
tgtgacctgaggcc

SEQ ID NO: 1128319 - DNA, 16 bp, Homo sapiens
tgtgacgtgcactgtg

SEQ ID NO: 1128320 - DNA, 17 bp, Homo sapiens
tgtgacgtgcactgtga

SEQ ID NO: 1128321 - DNA, 16 bp, Homo sapiens
tgtgactagcgcctgg

SEQ ID NO: 1128322 - DNA, 19 bp, Homo sapiens
tgtgactcagcagaggcag

SEQ ID NO: 1128323 - DNA, 20 bp, Homo sapiens
tgtgactcagcagaggcagt

SEQ ID NO: 1128324 - DNA, 20 bp, Homo sapiens
tgtgactcgggagctgcaca

SEQ ID NO: 1128325 - DNA, 21 bp, Homo sapiens
tgtgactcgggagctgcacac

SEQ ID NO: 1128326 - DNA, 23 bp, Homo sapiens
tgtgactctttttagggccaggc

SEQ ID NO: 1128327 - DNA, 16 bp, Homo sapiens
tgtgactgaatttctt

SEQ ID NO: 1128328 - DNA, 14 bp, Homo sapiens
tgtgactgagaaat

SEQ ID NO: 1128329 - DNA, 22 bp, Homo sapiens
tgtgactgatgttacatcacag

SEQ ID NO: 1128330 - DNA, 15 bp, Homo sapiens
tgtgactggatcttc

SEQ ID NO: 1128331 - DNA, 20 bp, Homo sapiens
tgtgactgtacccaaatgga

SEQ ID NO: 1128332 - DNA, 15 bp, Homo sapiens
tgtgacttcactgta

SEQ ID NO: 1128333 - DNA, 18 bp, Homo sapiens
tgtgacttctcccctgcc

SEQ ID NO: 1128334 - DNA, 18 bp, Homo sapiens
tgtgacttggagataata

SEQ ID NO: 1128335 - DNA, 15 bp, Homo sapiens
tgtgacttttctgat

SEQ ID NO: 1128336 - DNA, 20 bp, Homo sapiens
tgtgacttttctgattaata

SEQ ID NO: 1128337 - DNA, 17 bp, Homo sapiens
tgtgactttttttggta

SEQ ID NO: 1128338 - DNA, 14 bp, Homo sapiens
tgtgagaaatgtct

SEQ ID NO: 1128339 - DNA, 21 bp, Homo sapiens
tgtgagaagtgaatgctggga

SEQ ID NO: 1128340 - DNA, 23 bp, Homo sapiens
tgtgagaagtgaatgctgggact

SEQ ID NO: 1128341 - DNA, 24 bp, Homo sapiens
tgtgagaagtgaatgctgggactc

SEQ ID NO: 1128342 - DNA, 13 bp, Homo sapiens
tgtgagaccccca

SEQ ID NO: 1128343 - DNA, 14 bp, Homo sapiens
tgtgagacccccac

SEQ ID NO: 1128344 - DNA, 15 bp, Homo sapiens
tgtgagacccccaca

SEQ ID NO: 1128345 - DNA, 15 bp, Homo sapiens
tgtgagagagactga

SEQ ID NO: 1128346 - DNA, 17 bp, Homo sapiens
tgtgagagatggggcgg

SEQ ID NO: 1128347 - DNA, 13 bp, Homo sapiens
tgtgagagcccag

SEQ ID NO: 1128348 - DNA, 16 bp, Homo sapiens
tgtgagagcccagtca

SEQ ID NO: 1128349 - DNA, 17 bp, Homo sapiens
tgtgagagcccagtcat

SEQ ID NO: 1128350 - DNA, 21 bp, Homo sapiens
tgtgagagcccagtcattgta

SEQ ID NO: 1128351 - DNA, 15 bp, Homo sapiens
tgtgagaggtttgac

SEQ ID NO: 1128352 - DNA, 19 bp, Homo sapiens
tgtgagcaagcatttatgt

SEQ ID NO: 1128353 - DNA, 16 bp, Homo sapiens
tgtgagcatcctgcaa

SEQ ID NO: 1128354 - DNA, 19 bp, Homo sapiens
tgtgagccactgcgcccag

SEQ ID NO: 1128355 - DNA, 15 bp, Homo sapiens
tgtgagccatgcctc

SEQ ID NO: 1128356 - DNA, 16 bp, Homo sapiens
tgtgagccatgcctcc

SEQ ID NO: 1128357 - DNA, 18 bp, Homo sapiens
tgtgagcccagctgggtc

SEQ ID NO: 1128358 - DNA, 12 bp, Homo sapiens
tgtgagcccctg

SEQ ID NO: 1128359 - DNA, 21 bp, Homo sapiens
tgtgagcccctggtcctgagg

SEQ ID NO: 1128360 - DNA, 20 bp, Homo sapiens
tgtgagccctctagggcagg

SEQ ID NO: 1128361 - DNA, 14 bp, Homo sapiens
tgtgagcgagcaag

SEQ ID NO: 1128362 - DNA, 22 bp, Homo sapiens
tgtgagcgctggctccctgggc

SEQ ID NO: 1128363 - DNA, 15 bp, Homo sapiens
tgtgagcgtggcctt

SEQ ID NO: 1128364 - DNA, 18 bp, Homo sapiens
tgtgagcgtggccttggg

SEQ ID NO: 1128365 - DNA, 22 bp, Homo sapiens
tgtgagcgtggccttgggagga

SEQ ID NO: 1128366 - DNA, 16 bp, Homo sapiens
tgtgagctttgaagta

SEQ ID NO: 1128367 - DNA, 23 bp, Homo sapiens
tgtgaggaactcacatactgact

SEQ ID NO: 1128368 - DNA, 21 bp, Homo sapiens
tgtgaggaatgctctgtgcca

SEQ ID NO: 1128369 - DNA, 17 bp, Homo sapiens
tgtgaggacctccctgt

SEQ ID NO: 1128370 - DNA, 13 bp, Homo sapiens
tgtgaggagctgc

SEQ ID NO: 1128371 - DNA, 14 bp, Homo sapiens
tgtgaggagctgct

SEQ ID NO: 1128372 - DNA, 18 bp, Homo sapiens
tgtgaggagctgctggct

SEQ ID NO: 1128373 - DNA, 20 bp, Homo sapiens
tgtgaggagctgctggcttg

SEQ ID NO: 1128374 - DNA, 14 bp, Homo sapiens
tgtgaggaggaaaa

SEQ ID NO: 1128375 - DNA, 15 bp, Homo sapiens
tgtgaggaggaaaag

SEQ ID NO: 1128376 - DNA, 22 bp, Homo sapiens
tgtgaggccagggcagagtgag

SEQ ID NO: 1128377 - DNA, 15 bp, Homo sapiens
tgtgaggctgtgtct

SEQ ID NO: 1128378 - DNA, 17 bp, Homo sapiens
tgtgagggacatgctca

SEQ ID NO: 1128379 - DNA, 19 bp, Homo sapiens
tgtgagggagtgcagaaca

SEQ ID NO: 1128380 - DNA, 14 bp, Homo sapiens
tgtgagggcagcac

SEQ ID NO: 1128381 - DNA, 16 bp, Homo sapiens
tgtgagggcagcactg

SEQ ID NO: 1128382 - DNA, 15 bp, Homo sapiens
tgtgagggtgctgac

SEQ ID NO: 1128383 - DNA, 18 bp, Homo sapiens
tgtgaggtaactgggatc

SEQ ID NO: 1128384 - DNA, 14 bp, Homo sapiens
tgtgagtaggctgg

SEQ ID NO: 1128385 - DNA, 21 bp, Homo sapiens
tgtgagtcaatacatagtgct

SEQ ID NO: 1128386 - DNA, 18 bp, Homo sapiens
tgtgagtggcagccatgc

SEQ ID NO: 1128387 - DNA, 19 bp, Homo sapiens
tgtgagtggcagccatgcc

SEQ ID NO: 1128388 - DNA, 11 bp, Homo sapiens
tgtgagtgtga

SEQ ID NO: 1128389 - DNA, 13 bp, Homo sapiens
tgtgagtgtgaat

SEQ ID NO: 1128390 - DNA, 14 bp, Homo sapiens
tgtgagtgtgacag

SEQ ID NO: 1128391 - DNA, 17 bp, Homo sapiens
tgtgagtgtgacagggc

SEQ ID NO: 1128392 - DNA, 17 bp, Homo sapiens
tgtgagtgtttggggga

SEQ ID NO: 1128393 - DNA, 17 bp, Homo sapiens
tgtgagtgtttttatct

SEQ ID NO: 1128394 - DNA, 21 bp, Homo sapiens
tgtgagtttaccttgtatact

SEQ ID NO: 1128395 - DNA, 22 bp, Homo sapiens
tgtgagtttaccttgtatactg

SEQ ID NO: 1128396 - DNA, 17 bp, Homo sapiens
tgtgatacatttctgaa

SEQ ID NO: 1128397 - DNA, 18 bp, Homo sapiens
tgtgatacatttctgaat

SEQ ID NO: 1128398 - DNA, 14 bp, Homo sapiens
tgtgatagcacttt

SEQ ID NO: 1128399 - DNA, 17 bp, Homo sapiens
tgtgatagcactttcta

SEQ ID NO: 1128400 - DNA, 15 bp, Homo sapiens
tgtgatatataagtg

SEQ ID NO: 1128401 - DNA, 16 bp, Homo sapiens
tgtgatatataagtgt

SEQ ID NO: 1128402 - DNA, 14 bp, Homo sapiens
tgtgatattaacag

SEQ ID NO: 1128403 - DNA, 17 bp, Homo sapiens
tgtgatattctgttgct

SEQ ID NO: 1128404 - DNA, 17 bp, Homo sapiens
tgtgatcacgcctggct

SEQ ID NO: 1128405 - DNA, 16 bp, Homo sapiens
tgtgatcagcattgtg

SEQ ID NO: 1128406 - DNA, 18 bp, Homo sapiens
tgtgatcatgtgtggaag

SEQ ID NO: 1128407 - DNA, 18 bp, Homo sapiens
tgtgatcccaagtgccag

SEQ ID NO: 1128408 - DNA, 23 bp, Homo sapiens
tgtgatcccaagtgccagtcttg

SEQ ID NO: 1128409 - DNA, 16 bp, Homo sapiens
tgtgatccggtttctt

SEQ ID NO: 1128410 - DNA, 22 bp, Homo sapiens
tgtgatctgggcattttcctcc

SEQ ID NO: 1128411 - DNA, 16 bp, Homo sapiens
tgtgatcttttaaagt

SEQ ID NO: 1128412 - DNA, 15 bp, Homo sapiens
tgtgatgaacatatt

SEQ ID NO: 1128413 - DNA, 20 bp, Homo sapiens
tgtgatgaacatattcatga

SEQ ID NO: 1128414 - DNA, 20 bp, Homo sapiens
tgtgatgaatcaatgaaaaa

SEQ ID NO: 1128415 - DNA, 17 bp, Homo sapiens
tgtgatgccaaagatgt

SEQ ID NO: 1128416 - DNA, 22 bp, Homo sapiens
tgtgatgccaaagatgtttgaa

SEQ ID NO: 1128417 - DNA, 16 bp, Homo sapiens
tgtgatggatggcaca

SEQ ID NO: 1128418 - DNA, 15 bp, Homo sapiens
tgtgattaatgtttt

SEQ ID NO: 1128419 - DNA, 19 bp, Homo sapiens
tgtgattaatgttttcatt

SEQ ID NO: 1128420 - DNA, 22 bp, Homo sapiens
tgtgattacatagatcagccat

SEQ ID NO: 1128421 - DNA, 14 bp, Homo sapiens
tgtgattcaatctg

SEQ ID NO: 1128422 - DNA, 22 bp, Homo sapiens
tgtgattcaatctgtaaactgt

SEQ ID NO: 1128423 - DNA, 23 bp, Homo sapiens
tgtgattccttttgatggggaga

SEQ ID NO: 1128424 - DNA, 17 bp, Homo sapiens
tgtgattctaatgtctt

SEQ ID NO: 1128425 - DNA, 21 bp, Homo sapiens
tgtgattctaatgtcttcatt

SEQ ID NO: 1128426 - DNA, 14 bp, Homo sapiens
tgtgattctgttta

SEQ ID NO: 1128427 - DNA, 16 bp, Homo sapiens
tgtgattgacagcttt

SEQ ID NO: 1128428 - DNA, 14 bp, Homo sapiens
tgtgattgcacaga

SEQ ID NO: 1128429 - DNA, 23 bp, Homo sapiens
tgtgatttagaactgtatgtcag

SEQ ID NO: 1128430 - DNA, 17 bp, Homo sapiens
tgtgatttcctaaacat

SEQ ID NO: 1128431 - DNA, 14 bp, Homo sapiens
tgtgatttcctaca

SEQ ID NO: 1128432 - DNA, 17 bp, Homo sapiens
tgtgatttcctacagaa

SEQ ID NO: 1128433 - DNA, 12 bp, Homo sapiens
tgtgatttcttc

SEQ ID NO: 1128434 - DNA, 19 bp, Homo sapiens
tgtgatttctttaaaagaa

SEQ ID NO: 1128435 - DNA, 22 bp, Homo sapiens
tgtgatttctttaaaagaatga

SEQ ID NO: 1128436 - DNA, 15 bp, Homo sapiens
tgtgatttgaattct

SEQ ID NO: 1128437 - DNA, 17 bp, Homo sapiens
tgtgatttgaattctgt

SEQ ID NO: 1128438 - DNA, 16 bp, Homo sapiens
tgtgattttgccctcc

SEQ ID NO: 1128439 - DNA, 21 bp, Homo sapiens
tgtgattttgccctcctgccc

SEQ ID NO: 1128440 - DNA, 17 bp, Homo sapiens
tgtgatttttcttcagg

SEQ ID NO: 1128441 - DNA, 15 bp, Homo sapiens
tgtgcaaattaacag

SEQ ID NO: 1128442 - DNA, 17 bp, Homo sapiens
tgtgcaaattttgcatt

SEQ ID NO: 1128443 - DNA, 14 bp, Homo sapiens
tgtgcaacctgtgg

SEQ ID NO: 1128444 - DNA, 18 bp, Homo sapiens
tgtgcaacctgtggctca

SEQ ID NO: 1128445 - DNA, 16 bp, Homo sapiens
tgtgcaactggccagc

SEQ ID NO: 1128446 - DNA, 19 bp, Homo sapiens
tgtgcaactggccagccaa

SEQ ID NO: 1128447 - DNA, 14 bp, Homo sapiens
tgtgcaacttttta

SEQ ID NO: 1128448 - DNA, 21 bp, Homo sapiens
tgtgcaaggtggcctttgtgc

SEQ ID NO: 1128449 - DNA, 18 bp, Homo sapiens
tgtgcaagtatgtgagtg

SEQ ID NO: 1128450 - DNA, 16 bp, Homo sapiens
tgtgcaagtgtatgca

SEQ ID NO: 1128451 - DNA, 12 bp, Homo sapiens
tgtgcaagtgtg

SEQ ID NO: 1128452 - DNA, 16 bp, Homo sapiens
tgtgcaatagaaggtg

SEQ ID NO: 1128453 - DNA, 17 bp, Homo sapiens
tgtgcaatgtaaatatt

SEQ ID NO: 1128454 - DNA, 14 bp, Homo sapiens
tgtgcacagaaaac

SEQ ID NO: 1128455 - DNA, 13 bp, Homo sapiens
tgtgcacatcttc

SEQ ID NO: 1128456 - DNA, 13 bp, Homo sapiens
tgtgcaccagggt

SEQ ID NO: 1128457 - DNA, 22 bp, Homo sapiens
tgtgcacctaccccttggaaat

SEQ ID NO: 1128458 - DNA, 21 bp, Homo sapiens
tgtgcaccttaccaactttct

SEQ ID NO: 1128459 - DNA, 12 bp, Homo sapiens
tgtgcactaagg

SEQ ID NO: 1128460 - DNA, 13 bp, Homo sapiens
tgtgcactgggca

SEQ ID NO: 1128461 - DNA, 16 bp, Homo sapiens
tgtgcactgggcaggt

SEQ ID NO: 1128462 - DNA, 22 bp, Homo sapiens
tgtgcactgggcaggttcctgg

SEQ ID NO: 1128463 - DNA, 23 bp, Homo sapiens
tgtgcactgggcaggttcctggg

SEQ ID NO: 1128464 - DNA, 21 bp, Homo sapiens
tgtgcactgtcactttgctct

SEQ ID NO: 1128465 - DNA, 13 bp, Homo sapiens
tgtgcagaaaagc

SEQ ID NO: 1128466 - DNA, 15 bp, Homo sapiens
tgtgcagacagccat

SEQ ID NO: 1128467 - DNA, 16 bp, Homo sapiens
tgtgcagacagccatg

SEQ ID NO: 1128468 - DNA, 18 bp, Homo sapiens
tgtgcagacagccatgcg

SEQ ID NO: 1128469 - DNA, 17 bp, Homo sapiens
tgtgcagaccttactca

SEQ ID NO: 1128470 - DNA, 13 bp, Homo sapiens
tgtgcagactgat

SEQ ID NO: 1128471 - DNA, 13 bp, Homo sapiens
tgtgcagatgaag

SEQ ID NO: 1128472 - DNA, 16 bp, Homo sapiens
tgtgcagatgctgctg

SEQ ID NO: 1128473 - DNA, 22 bp, Homo sapiens
tgtgcagcagcccagcttcctg

SEQ ID NO: 1128474 - DNA, 23 bp, Homo sapiens
tgtgcagcagcccagcttcctgg

SEQ ID NO: 1128475 - DNA, 20 bp, Homo sapiens
tgtgcagcgacccttggtgt

SEQ ID NO: 1128476 - DNA, 20 bp, Homo sapiens
tgtgcagcgcagctggactc

SEQ ID NO: 1128477 - DNA, 20 bp, Homo sapiens
tgtgcagcttcgaggacagg

SEQ ID NO: 1128478 - DNA, 15 bp, Homo sapiens
tgtgcagggagggca

SEQ ID NO: 1128479 - DNA, 17 bp, Homo sapiens
tgtgcagggagggcagt

SEQ ID NO: 1128480 - DNA, 19 bp, Homo sapiens
tgtgcagggatattgcctt

SEQ ID NO: 1128481 - DNA, 17 bp, Homo sapiens
tgtgcagtcactggagg

SEQ ID NO: 1128482 - DNA, 16 bp, Homo sapiens
tgtgcagttgctgttt

SEQ ID NO: 1128483 - DNA, 18 bp, Homo sapiens
tgtgcataatgataaaat

SEQ ID NO: 1128484 - DNA, 20 bp, Homo sapiens
tgtgcataatgataaaataa

SEQ ID NO: 1128485 - DNA, 20 bp, Homo sapiens
tgtgcatatctgcctcccct

SEQ ID NO: 1128486 - DNA, 16 bp, Homo sapiens
tgtgcatggaggccct

SEQ ID NO: 1128487 - DNA, 22 bp, Homo sapiens
tgtgcatggaggccctcctgtg

SEQ ID NO: 1128488 - DNA, 14 bp, Homo sapiens
tgtgcatgtgtgtg

SEQ ID NO: 1128489 - DNA, 15 bp, Homo sapiens
tgtgcatgtgtgtgt

SEQ ID NO: 1128490 - DNA, 21 bp, Homo sapiens
tgtgcatgtgtgtgtctgtct

SEQ ID NO: 1128491 - DNA, 22 bp, Homo sapiens
tgtgcatgtttactttattaga

SEQ ID NO: 1128492 - DNA, 23 bp, Homo sapiens
tgtgcattatctagatactgtat

SEQ ID NO: 1128493 - DNA, 22 bp, Homo sapiens
tgtgcattcttttaaaagacaa

SEQ ID NO: 1128494 - DNA, 16 bp, Homo sapiens
tgtgcatttcacctgt

SEQ ID NO: 1128495 - DNA, 20 bp, Homo sapiens
tgtgcattttattgactggg

SEQ ID NO: 1128496 - DNA, 21 bp, Homo sapiens
tgtgcatttttgtgaaatgaa

SEQ ID NO: 1128497 - DNA, 13 bp, Homo sapiens
tgtgccaacctga

SEQ ID NO: 1128498 - DNA, 17 bp, Homo sapiens
tgtgccaacctgatgcc

SEQ ID NO: 1128499 - DNA, 12 bp, Homo sapiens
tgtgccaagcct

SEQ ID NO: 1128500 - DNA, 18 bp, Homo sapiens
tgtgccaatatgtattgt

SEQ ID NO: 1128501 - DNA, 14 bp, Homo sapiens
tgtgccacattttc

SEQ ID NO: 1128502 - DNA, 19 bp, Homo sapiens
tgtgccaccacgcccggct

SEQ ID NO: 1128503 - DNA, 17 bp, Homo sapiens
tgtgccaccatgcctca

SEQ ID NO: 1128504 - DNA, 21 bp, Homo sapiens
tgtgccactaaactacattgt

SEQ ID NO: 1128505 - DNA, 13 bp, Homo sapiens
tgtgccactgact

SEQ ID NO: 1128506 - DNA, 21 bp, Homo sapiens
tgtgccagaggaaggaaaagg

SEQ ID NO: 1128507 - DNA, 13 bp, Homo sapiens
tgtgccagcccgg

SEQ ID NO: 1128508 - DNA, 21 bp, Homo sapiens
tgtgccaggcagatcctctgg

SEQ ID NO: 1128509 - DNA, 13 bp, Homo sapiens
tgtgccaggcttg

SEQ ID NO: 1128510 - DNA, 19 bp, Homo sapiens
tgtgccaggcttgcctggg

SEQ ID NO: 1128511 - DNA, 21 bp, Homo sapiens
tgtgccaggcttgcctgggct

SEQ ID NO: 1128512 - DNA, 18 bp, Homo sapiens
tgtgccagggcaatgatg

SEQ ID NO: 1128513 - DNA, 21 bp, Homo sapiens
tgtgccagggcaatgatgaat

SEQ ID NO: 1128514 - DNA, 15 bp, Homo sapiens
tgtgccagttcctgt

SEQ ID NO: 1128515 - DNA, 22 bp, Homo sapiens
tgtgccatagagtttaacacaa

SEQ ID NO: 1128516 - DNA, 20 bp, Homo sapiens
tgtgccatggatctgatctg

SEQ ID NO: 1128517 - DNA, 14 bp, Homo sapiens
tgtgcccaaaagcc

SEQ ID NO: 1128518 - DNA, 17 bp, Homo sapiens
tgtgcccaagtgggcag

SEQ ID NO: 1128519 - DNA, 21 bp, Homo sapiens
tgtgcccacatcccaggcttc

SEQ ID NO: 1128520 - DNA, 19 bp, Homo sapiens
tgtgcccacggtctgagct

SEQ ID NO: 1128521 - DNA, 13 bp, Homo sapiens
tgtgcccagcagg

SEQ ID NO: 1128522 - DNA, 14 bp, Homo sapiens
tgtgcccagcaggc

SEQ ID NO: 1128523 - DNA, 16 bp, Homo sapiens
tgtgcccagcaggccc

SEQ ID NO: 1128524 - DNA, 22 bp, Homo sapiens
tgtgcccagcctccatgtttta

SEQ ID NO: 1128525 - DNA, 19 bp, Homo sapiens
tgtgcccagggttttgccc

SEQ ID NO: 1128526 - DNA, 17 bp, Homo sapiens
tgtgcccattcctaata

SEQ ID NO: 1128527 - DNA, 15 bp, Homo sapiens
tgtgccccagctgcc

SEQ ID NO: 1128528 - DNA, 21 bp, Homo sapiens
tgtgccccagctgccaggcgg

SEQ ID NO: 1128529 - DNA, 15 bp, Homo sapiens
tgtgccccatgcctg

SEQ ID NO: 1128530 - DNA, 15 bp, Homo sapiens
tgtgcccccagcctc

SEQ ID NO: 1128531 - DNA, 19 bp, Homo sapiens
tgtgcccccagcctcagcc

SEQ ID NO: 1128532 - DNA, 20 bp, Homo sapiens
tgtgcccccagcctcagccc

SEQ ID NO: 1128533 - DNA, 21 bp, Homo sapiens
tgtgcccccagcctcagccca

SEQ ID NO: 1128534 - DNA, 22 bp, Homo sapiens
tgtgccccctcccaccctgcgg

SEQ ID NO: 1128535 - DNA, 21 bp, Homo sapiens
tgtgcccctgatgcagcctgt

SEQ ID NO: 1128536 - DNA, 15 bp, Homo sapiens
tgtgcccctggccca

SEQ ID NO: 1128537 - DNA, 20 bp, Homo sapiens
tgtgccccttcactcatttt

SEQ ID NO: 1128538 - DNA, 13 bp, Homo sapiens
tgtgccctcaccc

SEQ ID NO: 1128539 - DNA, 15 bp, Homo sapiens
tgtgccctcacccca

SEQ ID NO: 1128540 - DNA, 11 bp, Homo sapiens
tgtgccctggg

SEQ ID NO: 1128541 - DNA, 12 bp, Homo sapiens
tgtgccctgggc

SEQ ID NO: 1128542 - DNA, 20 bp, Homo sapiens
tgtgccctgggccaggcagg

SEQ ID NO: 1128543 - DNA, 14 bp, Homo sapiens
tgtgccctggtgga

SEQ ID NO: 1128544 - DNA, 15 bp, Homo sapiens
tgtgccgaatgtgca

SEQ ID NO: 1128545 - DNA, 16 bp, Homo sapiens
tgtgccgaatgtgcag

SEQ ID NO: 1128546 - DNA, 16 bp, Homo sapiens
tgtggggccaggacca

SEQ ID NO: 1128547 - DNA, 15 bp, Homo sapiens
tgtggggctgggcac

SEQ ID NO: 1128548 - DNA, 13 bp, Homo sapiens
tgtgggggagatt

SEQ ID NO: 1128549 - DNA, 13 bp, Homo sapiens
tgtgggggctgca

SEQ ID NO: 1128550 - DNA, 18 bp, Homo sapiens
tgtggggggctgggggag

SEQ ID NO: 1128551 - DNA, 17 bp, Homo sapiens
tgtggggtggagcactg

SEQ ID NO: 1128552 - DNA, 21 bp, Homo sapiens
tgtggggtggagcactggact

SEQ ID NO: 1128553 - DNA, 22 bp, Homo sapiens
tgtggggtggagcactggactc

SEQ ID NO: 1128554 - DNA, 14 bp, Homo sapiens
tgtggggttgctga

SEQ ID NO: 1128555 - DNA, 21 bp, Homo sapiens
tgtggggtttttggagaaggt

SEQ ID NO: 1128556 - DNA, 16 bp, Homo sapiens
tgtgggtaaatgcttt

SEQ ID NO: 1128557 - DNA, 20 bp, Homo sapiens
tgtgggtcgaggattctgtg

SEQ ID NO: 1128558 - DNA, 15 bp, Homo sapiens
tgtgggtcttccagg

SEQ ID NO: 1128559 - DNA, 20 bp, Homo sapiens
tgtgggtgggagtgtgtctg

SEQ ID NO: 1128560 - DNA, 23 bp, Homo sapiens
tgtgggtgggagtgtgtctgctg

SEQ ID NO: 1128561 - DNA, 19 bp, Homo sapiens
tgtgggtggggaggccctg

SEQ ID NO: 1128562 - DNA, 21 bp, Homo sapiens
tgtgggtggggaggccctgcc

SEQ ID NO: 1128563 - DNA, 22 bp, Homo sapiens
tgtgggtggggaggccctgcct

SEQ ID NO: 1128564 - DNA, 13 bp, Homo sapiens
tgtgggtggggcc

SEQ ID NO: 1128565 - DNA, 22 bp, Homo sapiens
tgtgggtggggttatgtgaggg

SEQ ID NO: 1128566 - DNA, 14 bp, Homo sapiens
tgtgggtgttaatt

SEQ ID NO: 1128567 - DNA, 23 bp, Homo sapiens
tgtgggtgtttattacaagtggc

SEQ ID NO: 1128568 - DNA, 16 bp, Homo sapiens
tgtgggttatcctcct

SEQ ID NO: 1128569 - DNA, 17 bp, Homo sapiens
tgtgggttatcctcctc

SEQ ID NO: 1128570 - DNA, 16 bp, Homo sapiens
tgtggtacatggtgtt

SEQ ID NO: 1128571 - DNA, 20 bp, Homo sapiens
tgtggtaccttcagccctgg

SEQ ID NO: 1128572 - DNA, 20 bp, Homo sapiens
tgtggtagcttatcttagaa

SEQ ID NO: 1128573 - DNA, 22 bp, Homo sapiens
tgtggtagggacttaaaaaact

SEQ ID NO: 1128574 - DNA, 15 bp, Homo sapiens
tgtggtcagcagatg

SEQ ID NO: 1128575 - DNA, 21 bp, Homo sapiens
tgtggtctataaaataaactt

SEQ ID NO: 1128576 - DNA, 14 bp, Homo sapiens
tgtggtctattgtc

SEQ ID NO: 1128577 - DNA, 17 bp, Homo sapiens
tgtggtctattgtcgct

SEQ ID NO: 1128578 - DNA, 13 bp, Homo sapiens
tgtggtctcagga

SEQ ID NO: 1128579 - DNA, 15 bp, Homo sapiens
tgtggtctcaggata

SEQ ID NO: 1128580 - DNA, 22 bp, Homo sapiens
tgtggtctttgctgctgctctc

SEQ ID NO: 1128581 - DNA, 17 bp, Homo sapiens
tgtggtgaagtgtggct

SEQ ID NO: 1128582 - DNA, 15 bp, Homo sapiens
tgtggtgacaggccc

SEQ ID NO: 1128583 - DNA, 23 bp, Homo sapiens
tgtggtgaggggctttctcttcc

SEQ ID NO: 1128584 - DNA, 22 bp, Homo sapiens
tgtggtgaggggtgtgggaaga

SEQ ID NO: 1128585 - DNA, 20 bp, Homo sapiens
tgtggtgatggagatgcagt

SEQ ID NO: 1128586 - DNA, 17 bp, Homo sapiens
tgtggtgcagtgtgaaa

SEQ ID NO: 1128587 - DNA, 18 bp, Homo sapiens
tgtggtgcctctcttggc

SEQ ID NO: 1128588 - DNA, 14 bp, Homo sapiens
tgtggtggagccag

SEQ ID NO: 1128589 - DNA, 15 bp, Homo sapiens
tgtggtgtagactgt

SEQ ID NO: 1128590 - DNA, 22 bp, Homo sapiens
tgtggtgtcccctatcctcccc

SEQ ID NO: 1128591 - DNA, 15 bp, Homo sapiens
tgtggtgtgaccatg

SEQ ID NO: 1128592 - DNA, 22 bp, Homo sapiens
tgtggttaccgagtatctgtaa

SEQ ID NO: 1128593 - DNA, 16 bp, Homo sapiens
tgtggttccatgcagc

SEQ ID NO: 1128594 - DNA, 22 bp, Homo sapiens
tgtggttccatgcagccttggg

SEQ ID NO: 1128595 - DNA, 13 bp, Homo sapiens
tgtggttcctctg

SEQ ID NO: 1128596 - DNA, 20 bp, Homo sapiens
tgtggttctataataagttt

SEQ ID NO: 1128597 - DNA, 16 bp, Homo sapiens
tgtggttggaaaactt

SEQ ID NO: 1128598 - DNA, 18 bp, Homo sapiens
tgtggtttccctgcccct

SEQ ID NO: 1128599 - DNA, 19 bp, Homo sapiens
tgtggtttccctgcccctg

SEQ ID NO: 1128600 - DNA, 15 bp, Homo sapiens
tgtgtaaaaaatgga

SEQ ID NO: 1128601 - DNA, 23 bp, Homo sapiens
tgtgtaaaaaatggaaaaaaaca

SEQ ID NO: 1128602 - DNA, 19 bp, Homo sapiens
tgtgtaaaggtttcatgtt

SEQ ID NO: 1128603 - DNA, 19 bp, Homo sapiens
tgtgtaaatatttttccct

SEQ ID NO: 1128604 - DNA, 14 bp, Homo sapiens
tgtgtaaatttctc

SEQ ID NO: 1128605 - DNA, 17 bp, Homo sapiens
tgtgtaaatttgtatcc

SEQ ID NO: 1128606 - DNA, 19 bp, Homo sapiens
tgtgtaacctcttcacctt

SEQ ID NO: 1128607 - DNA, 21 bp, Homo sapiens
tgtgtaatagaaaactgaaaa

SEQ ID NO: 1128608 - DNA, 19 bp, Homo sapiens
tgtgtaattgatttataaa

SEQ ID NO: 1128609 - DNA, 14 bp, Homo sapiens
tgtgtacaaagaaa

SEQ ID NO: 1128610 - DNA, 17 bp, Homo sapiens
tgtgtacaagttgttat

SEQ ID NO: 1128611 - DNA, 19 bp, Homo sapiens
tgtgtacacctgcggggcc

SEQ ID NO: 1128612 - DNA, 21 bp, Homo sapiens
tgtgtacagaattctgctacc

SEQ ID NO: 1128613 - DNA, 14 bp, Homo sapiens
tgtgtacagtgaat

SEQ ID NO: 1128614 - DNA, 15 bp, Homo sapiens
tgtgtacagtgaatt

SEQ ID NO: 1128615 - DNA, 19 bp, Homo sapiens
tgtgtacagtgaattgtct

SEQ ID NO: 1128616 - DNA, 19 bp, Homo sapiens
tgtgtacagtgtgtaaagt

SEQ ID NO: 1128617 - DNA, 18 bp, Homo sapiens
tgtgtaccacttctgtgg

SEQ ID NO: 1128618 - DNA, 15 bp, Homo sapiens
tgtgtacccaaacgt

SEQ ID NO: 1128619 - DNA, 19 bp, Homo sapiens
tgtgtacgtgcatgctgta

SEQ ID NO: 1128620 - DNA, 22 bp, Homo sapiens
tgtgtactcactgaagcctgcg

SEQ ID NO: 1128621 - DNA, 14 bp, Homo sapiens
tgtgtactctgtcc

SEQ ID NO: 1128622 - DNA, 15 bp, Homo sapiens
tgtgtagatagtatg

SEQ ID NO: 1128623 - DNA, 14 bp, Homo sapiens
tgtgtagccttttt

SEQ ID NO: 1128624 - DNA, 20 bp, Homo sapiens
tgtgtagcctttttgtataa

SEQ ID NO: 1128625 - DNA, 18 bp, Homo sapiens
tgtgtagctgcaaaaata

SEQ ID NO: 1128626 - DNA, 17 bp, Homo sapiens
tgtgtagctttgctctt

SEQ ID NO: 1128627 - DNA, 15 bp, Homo sapiens
tgtgtaggttatctt

SEQ ID NO: 1128628 - DNA, 14 bp, Homo sapiens
tgtgtatagcatgt

SEQ ID NO: 1128629 - DNA, 16 bp, Homo sapiens
tgtgtatataattttt

SEQ ID NO: 1128630 - DNA, 12 bp, Homo sapiens
tgtgtatatatc

SEQ ID NO: 1128631 - DNA, 20 bp, Homo sapiens
tgtgtatatatcttataact

SEQ ID NO: 1128632 - DNA, 19 bp, Homo sapiens
tgtgtatattggtgtatat

SEQ ID NO: 1128633 - DNA, 13 bp, Homo sapiens
tgtgtatcattaa

SEQ ID NO: 1128634 - DNA, 14 bp, Homo sapiens
tgtgtatcattaaa

SEQ ID NO: 1128635 - DNA, 18 bp, Homo sapiens
tgtgtatcattaaaatat

SEQ ID NO: 1128636 - DNA, 17 bp, Homo sapiens
tgtgtatctctttcaca

SEQ ID NO: 1128637 - DNA, 15 bp, Homo sapiens
tgtgtatgagtgcgc

SEQ ID NO: 1128638 - DNA, 22 bp, Homo sapiens
tgtgtatgggggaaggcgctgg

SEQ ID NO: 1128639 - DNA, 19 bp, Homo sapiens
tgtgtatgtatacacacat

SEQ ID NO: 1128640 - DNA, 19 bp, Homo sapiens
tgtgtatgtgcgtgtgtgc

SEQ ID NO: 1128641 - DNA, 12 bp, Homo sapiens
tgtgtatgtttt

SEQ ID NO: 1128642 - DNA, 14 bp, Homo sapiens
tgtgtattaaaaaa

SEQ ID NO: 1128643 - DNA, 14 bp, Homo sapiens
tgtgtattccaaga

SEQ ID NO: 1128644 - DNA, 13 bp, Homo sapiens
tgtgtattgttcc

SEQ ID NO: 1128645 - DNA, 14 bp, Homo sapiens
tgtgtattgttccc

SEQ ID NO: 1128646 - DNA, 19 bp, Homo sapiens
tgtgtatttatttaaaact

SEQ ID NO: 1128647 - DNA, 23 bp, Homo sapiens
tgtgtatttatttaaaactctgg

SEQ ID NO: 1128648 - DNA, 15 bp, Homo sapiens
tgtgtatttctaaga

SEQ ID NO: 1128649 - DNA, 21 bp, Homo sapiens
tgtgtatttctaagaaataga

SEQ ID NO: 1128650 - DNA, 15 bp, Homo sapiens
tgtgtatttgctaat

SEQ ID NO: 1128651 - DNA, 15 bp, Homo sapiens
tgtgtatttgtatta

SEQ ID NO: 1128652 - DNA, 21 bp, Homo sapiens
tgtgtattttctttgggggtg

SEQ ID NO: 1128653 - DNA, 17 bp, Homo sapiens
tgtgtcaaaactggttt

SEQ ID NO: 1128654 - DNA, 17 bp, Homo sapiens
tgtgtcacagttcttgg

SEQ ID NO: 1128655 - DNA, 16 bp, Homo sapiens
tgtgtcacagtttcag

SEQ ID NO: 1128656 - DNA, 14 bp, Homo sapiens
tgtgtcacttgtgc

SEQ ID NO: 1128657 - DNA, 16 bp, Homo sapiens
tgtgtcacttgtgctt

SEQ ID NO: 1128658 - DNA, 21 bp, Homo sapiens
tgtgtcacttgtgctttgctc

SEQ ID NO: 1128659 - DNA, 20 bp, Homo sapiens
tgtgtcagaataggaaaaca

SEQ ID NO: 1128660 - DNA, 13 bp, Homo sapiens
tgtgtcagagcct

SEQ ID NO: 1128661 - DNA, 16 bp, Homo sapiens
tgtgtcagagcctacc

SEQ ID NO: 1128662 - DNA, 13 bp, Homo sapiens
tgtgtcagagtgt

SEQ ID NO: 1128663 - DNA, 13 bp, Homo sapiens
tgtgtcaggccct

SEQ ID NO: 1128664 - DNA, 19 bp, Homo sapiens
tgtgtcaggccctctgcct

SEQ ID NO: 1128665 - DNA, 21 bp, Homo sapiens
tgtgtcaggccctctgcctgc

SEQ ID NO: 1128666 - DNA, 15 bp, Homo sapiens
tgtgtcagttttcat

SEQ ID NO: 1128667 - DNA, 16 bp, Homo sapiens
tgtgtcataaattaca

SEQ ID NO: 1128668 - DNA, 21 bp, Homo sapiens
tgtgtcatgaagaatgtttct

SEQ ID NO: 1128669 - DNA, 16 bp, Homo sapiens
tgtgtccaaaactgcc

SEQ ID NO: 1128670 - DNA, 16 bp, Homo sapiens
tgtgtccacctgtggg

SEQ ID NO: 1128671 - DNA, 19 bp, Homo sapiens
tgtgtccacgactgtctcc

SEQ ID NO: 1128672 - DNA, 19 bp, Homo sapiens
tgtgtccaggctctgggca

SEQ ID NO: 1128673 - DNA, 18 bp, Homo sapiens
tgtgtccatgtgtgtgca

SEQ ID NO: 1128674 - DNA, 21 bp, Homo sapiens
tgtgtcccatgacccacccct

SEQ ID NO: 1128675 - DNA, 16 bp, Homo sapiens
tgtgtcccccccaggc

SEQ ID NO: 1128676 - DNA, 21 bp, Homo sapiens
tgtgtccccctctgtccaggc

SEQ ID NO: 1128677 - DNA, 13 bp, Homo sapiens
tgtgtcccctcac

SEQ ID NO: 1128678 - DNA, 21 bp, Homo sapiens
tgtgtcccctcacgcaagtgc

SEQ ID NO: 1128679 - DNA, 19 bp, Homo sapiens
tgtgtccgctaaatattta

SEQ ID NO: 1128680 - DNA, 18 bp, Homo sapiens
tgtgtcctaaatgcaaag

SEQ ID NO: 1128681 - DNA, 18 bp, Homo sapiens
tgtgtcctccaggagctt

SEQ ID NO: 1128682 - DNA, 14 bp, Homo sapiens
tgtgtcctctgcct

SEQ ID NO: 1128683 - DNA, 20 bp, Homo sapiens
tgtgtcctgaaacgctcctt

SEQ ID NO: 1128684 - DNA, 15 bp, Homo sapiens
tgtgtcctggtgctc

SEQ ID NO: 1128685 - DNA, 17 bp, Homo sapiens
tgtgtccttccctgcat

SEQ ID NO: 1128686 - DNA, 20 bp, Homo sapiens
tgtgtccttgcacctgcatc

SEQ ID NO: 1128687 - DNA, 18 bp, Homo sapiens
tgtgtctcccagaactat

SEQ ID NO: 1128688 - DNA, 12 bp, Homo sapiens
tgtgtctctgtt

SEQ ID NO: 1128689 - DNA, 15 bp, Homo sapiens
tgtgtctgacatgtt

SEQ ID NO: 1128690 - DNA, 21 bp, Homo sapiens
tgtgtctgccaaacacattta

SEQ ID NO: 1128691 - DNA, 10 bp, Homo sapiens
tgtgtctgct

SEQ ID NO: 1128692 - DNA, 12 bp, Homo sapiens
tgtgtctgctga

SEQ ID NO: 1128693 - DNA, 22 bp, Homo sapiens
tgtgtctgctgagtaaggaaca

SEQ ID NO: 1128694 - DNA, 22 bp, Homo sapiens
tgtgtctgctttaaagggcctg

SEQ ID NO: 1128695 - DNA, 17 bp, Homo sapiens
tgtgtctgggagagcct

SEQ ID NO: 1128696 - DNA, 13 bp, Homo sapiens
tgtgtctggtaac

SEQ ID NO: 1128697 - DNA, 13 bp, Homo sapiens
tgtgtctgtcaca

SEQ ID NO: 1128698 - DNA, 23 bp, Homo sapiens
tgtgtctgtcacaggctgggtca

SEQ ID NO: 1128699 - DNA, 18 bp, Homo sapiens
tgtgtctttatagatgta

SEQ ID NO: 1128700 - DNA, 18 bp, Homo sapiens
tgtgtctttcacagctcc

SEQ ID NO: 1128701 - DNA, 22 bp, Homo sapiens
tgtgtctttcacagctcctccc

SEQ ID NO: 1128702 - DNA, 19 bp, Homo sapiens
tgtgtgaaaaaagaaaatg

SEQ ID NO: 1128703 - DNA, 22 bp, Homo sapiens
tgtgtgaaaaaagaaaatggct

SEQ ID NO: 1128704 - DNA, 14 bp, Homo sapiens
tgtgtgaaacaatg

SEQ ID NO: 1128705 - DNA, 13 bp, Homo sapiens
tgtgtgaacgtgt

SEQ ID NO: 1128706 - DNA, 18 bp, Homo sapiens
tgtgtgaatgaacactct

SEQ ID NO: 1128707 - DNA, 22 bp, Homo sapiens
tgtgtgaatgaacactcttttg

SEQ ID NO: 1128708 - DNA, 13 bp, Homo sapiens
tgtgtgaatgtgg

SEQ ID NO: 1128709 - DNA, 17 bp, Homo sapiens
tgtgtgaattctgcaac

SEQ ID NO: 1128710 - DNA, 20 bp, Homo sapiens
tgtgtgacaattctgttttt

SEQ ID NO: 1128711 - DNA, 23 bp, Homo sapiens
tgtgtgacagaatcttgtatttg

SEQ ID NO: 1128712 - DNA, 16 bp, Homo sapiens
tgtgtgaccaactgtg

SEQ ID NO: 1128713 - DNA, 16 bp, Homo sapiens
tgtgtgacttacagaa

SEQ ID NO: 1128714 - DNA, 21 bp, Homo sapiens
tgtgtgagcatcctgcaaggt

SEQ ID NO: 1128715 - DNA, 20 bp, Homo sapiens
tgtgtgaggctgtgtctctg

SEQ ID NO: 1128716 - DNA, 16 bp, Homo sapiens
tgtgtgatccagccct

SEQ ID NO: 1128717 - DNA, 19 bp, Homo sapiens
tgtgtgatccggtttcttt

SEQ ID NO: 1128718 - DNA, 16 bp, Homo sapiens
tgtgtgatgaactttc

SEQ ID NO: 1128719 - DNA, 17 bp, Homo sapiens
tgtgtgatgaactttct

SEQ ID NO: 1128720 - DNA, 16 bp, Homo sapiens
tgtgtgattgaatctg

SEQ ID NO: 1128721 - DNA, 21 bp, Homo sapiens
tgtgtgattgacagctttgct

SEQ ID NO: 1128722 - DNA, 19 bp, Homo sapiens
tgtgtgatttcctaaacat

SEQ ID NO: 1128723 - DNA, 23 bp, Homo sapiens
tgtgtgatttcctaaacataatt

SEQ ID NO: 1128724 - DNA, 9 bp, Homo sapiens
tgtgtgcac

SEQ ID NO: 1128725 - DNA, 22 bp, Homo sapiens
tgtgtgcaccttaccaactttc

SEQ ID NO: 1128726 - DNA, 23 bp, Homo sapiens
tgtgtgcaccttaccaactttct

SEQ ID NO: 1128727 - DNA, 18 bp, Homo sapiens
tgtgtgcagagtccattt

SEQ ID NO: 1128728 - DNA, 14 bp, Homo sapiens
tgtgtgcaggagcc

SEQ ID NO: 1128729 - DNA, 16 bp, Homo sapiens
tgtgtgcaggagcctc

SEQ ID NO: 1128730 - DNA, 14 bp, Homo sapiens
tgtgtgcatgtgag

SEQ ID NO: 1128731 - DNA, 14 bp, Homo sapiens
tgtgtgcatgtgtg

SEQ ID NO: 1128732 - DNA, 20 bp, Homo sapiens
tgtgtgcatgtgtgtgctca

SEQ ID NO: 1128733 - DNA, 23 bp, Homo sapiens
tgtgtgccatagagtttaacaca

SEQ ID NO: 1128734 - DNA, 15 bp, Homo sapiens
tgtgtgcctgtggca

SEQ ID NO: 1128735 - DNA, 18 bp, Homo sapiens
tgtgtgcgagtgtgtgca

SEQ ID NO: 1128736 - DNA, 17 bp, Homo sapiens
tgtgtgcgcctgagtga

SEQ ID NO: 1128737 - DNA, 21 bp, Homo sapiens
tgtgtgcgtgtttgggttttt

SEQ ID NO: 1128738 - DNA, 13 bp, Homo sapiens
tgtgtgctgatgt

SEQ ID NO: 1128739 - DNA, 12 bp, Homo sapiens
tgtgtgctgttt

SEQ ID NO: 1128740 - DNA, 21 bp, Homo sapiens
tgtgtgcttacagtaactaat

SEQ ID NO: 1128741 - DNA, 13 bp, Homo sapiens
tgtgtgctttccc

SEQ ID NO: 1128742 - DNA, 17 bp, Homo sapiens
tgtgtggatgctgagct

SEQ ID NO: 1128743 - DNA, 13 bp, Homo sapiens
tgtgtggcctccc

SEQ ID NO: 1128744 - DNA, 11 bp, Homo sapiens
tgtgtggcctg

SEQ ID NO: 1128745 - DNA, 11 bp, Homo sapiens
tgtgtggctgt

SEQ ID NO: 1128746 - DNA, 15 bp, Homo sapiens
tgtgtggctgtgggt

SEQ ID NO: 1128747 - DNA, 20 bp, Homo sapiens
tgtgtgggatcattgcattt

SEQ ID NO: 1128748 - DNA, 12 bp, Homo sapiens
tgtgtgggcagg

SEQ ID NO: 1128749 - DNA, 14 bp, Homo sapiens
tgtgtggtagaaac

SEQ ID NO: 1128750 - DNA, 20 bp, Homo sapiens
tgtgtggtgaggggctttct

SEQ ID NO: 1128751 - DNA, 21 bp, Homo sapiens
tgtgtggtgcacgtttgtaat

SEQ ID NO: 1128752 - DNA, 14 bp, Homo sapiens
tgtgtggtggcctc

SEQ ID NO: 1128753 - DNA, 16 bp, Homo sapiens
tgtgtggtggcctcag

SEQ ID NO: 1128754 - DNA, 11 bp, Homo sapiens
tgtgtgtactc

SEQ ID NO: 1128755 - DNA, 13 bp, Homo sapiens
tgtgtgtatatat

SEQ ID NO: 1128756 - DNA, 14 bp, Homo sapiens
tgtgtgtatgctgc

SEQ ID NO: 1128757 - DNA, 16 bp, Homo sapiens
tgtgtgtatgctgctt

SEQ ID NO: 1128758 - DNA, 19 bp, Homo sapiens
tgtgtgtatgtttgcacac

SEQ ID NO: 1128759 - DNA, 14 bp, Homo sapiens
tgtgtgtatttgta

SEQ ID NO: 1128760 - DNA, 15 bp, Homo sapiens
tgtgtgtatttgtat

SEQ ID NO: 1128761 - DNA, 20 bp, Homo sapiens
tgtgtgtatttgtattaata

SEQ ID NO: 1128762 - DNA, 19 bp, Homo sapiens
tgtgtgtccaaaactgcct

SEQ ID NO: 1128763 - DNA, 16 bp, Homo sapiens
tgtgtgtctcacccct

SEQ ID NO: 1128764 - DNA, 14 bp, Homo sapiens
tgtgtgtctgcttt

SEQ ID NO: 1128765 - DNA, 14 bp, Homo sapiens
tgtgtgtctgtcct

SEQ ID NO: 1128766 - DNA, 13 bp, Homo sapiens
tgtgtgtctgtct

SEQ ID NO: 1128767 - DNA, 13 bp, Homo sapiens
tgtgtgtgagttt

SEQ ID NO: 1128768 - DNA, 13 bp, Homo sapiens
tgtgtgtggcagg

SEQ ID NO: 1128769 - DNA, 19 bp, Homo sapiens
tgtgtgtgggctgtgagtg

SEQ ID NO: 1128770 - DNA, 17 bp, Homo sapiens
tgtgtgtgggtgtgtgc

SEQ ID NO: 1128771 - DNA, 9 bp, Homo sapiens
tgtgtgtgt

SEQ ID NO: 1128772 - DNA, 13 bp, Homo sapiens
tgtgtgtgtctgt

SEQ ID NO: 1128773 - DNA, 13 bp, Homo sapiens
tgtgtgtgtgcat

SEQ ID NO: 1128774 - DNA, 15 bp, Homo sapiens
tgtgtgtgtgggtgt

SEQ ID NO: 1128775 - DNA, 15 bp, Homo sapiens
tgtgtgtgtgtatga

SEQ ID NO: 1128776 - DNA, 14 bp, Homo sapiens
tgtgtgtgtgtgca

SEQ ID NO: 1128777 - DNA, 14 bp, Homo sapiens
tgtgtgtgtgtgta

SEQ ID NO: 1128778 - DNA, 15 bp, Homo sapiens
tgtgtgtgtgtgtgc

SEQ ID NO: 1128779 - DNA, 15 bp, Homo sapiens
tgtgtgtgttctgta

SEQ ID NO: 1128780 - DNA, 12 bp, Homo sapiens
tgtgtgttcacc

SEQ ID NO: 1128781 - DNA, 13 bp, Homo sapiens
tgtgtgttcacct

SEQ ID NO: 1128782 - DNA, 16 bp, Homo sapiens
tgtgtgtttaaataaa

SEQ ID NO: 1128783 - DNA, 19 bp, Homo sapiens
tgtgtgtttaaataaagta

SEQ ID NO: 1128784 - DNA, 13 bp, Homo sapiens
tgtgtgtttggaa

SEQ ID NO: 1128785 - DNA, 19 bp, Homo sapiens
tgtgtgttttcccaaagca

SEQ ID NO: 1128786 - DNA, 16 bp, Homo sapiens
tgtgttaaacatgcta

SEQ ID NO: 1128787 - DNA, 20 bp, Homo sapiens
tgtgttaaacatgctaaata

SEQ ID NO: 1128788 - DNA, 14 bp, Homo sapiens
tgtgttacattatt

SEQ ID NO: 1128789 - DNA, 15 bp, Homo sapiens
tgtgttacattattc

SEQ ID NO: 1128790 - DNA, 23 bp, Homo sapiens
tgtgttactaaaaaaaagatgaa

SEQ ID NO: 1128791 - DNA, 13 bp, Homo sapiens
tgttatgtacaaa

SEQ ID NO: 1128792 - DNA, 18 bp, Homo sapiens
tgttatgtacaaactagt

SEQ ID NO: 1128793 - DNA, 12 bp, Homo sapiens
tgttatgtatga

SEQ ID NO: 1128794 - DNA, 15 bp, Homo sapiens
tgttatgtatgaagg

SEQ ID NO: 1128795 - DNA, 21 bp, Homo sapiens
tgttatgttttcgaaaatcaa

SEQ ID NO: 1128796 - DNA, 13 bp, Homo sapiens
tgttattaaatgt

SEQ ID NO: 1128797 - DNA, 21 bp, Homo sapiens
tgttattagagattacctcct

SEQ ID NO: 1128798 - DNA, 15 bp, Homo sapiens
tgttattatatttga

SEQ ID NO: 1128799 - DNA, 22 bp, Homo sapiens
tgttattgatcccttctcctgc

SEQ ID NO: 1128800 - DNA, 21 bp, Homo sapiens
tgttattgggcaagtgattga

SEQ ID NO: 1128801 - DNA, 14 bp, Homo sapiens
tgttattgtattta

SEQ ID NO: 1128802 - DNA, 13 bp, Homo sapiens
tgttattgtgaat

SEQ ID NO: 1128803 - DNA, 14 bp, Homo sapiens
tgttattgtggaag

SEQ ID NO: 1128804 - DNA, 16 bp, Homo sapiens
tgttattgttttgtta

SEQ ID NO: 1128805 - DNA, 18 bp, Homo sapiens
tgttatttaacagctgaa

SEQ ID NO: 1128806 - DNA, 18 bp, Homo sapiens
tgttatttacactggtct

SEQ ID NO: 1128807 - DNA, 17 bp, Homo sapiens
tgttatttagactcatc

SEQ ID NO: 1128808 - DNA, 17 bp, Homo sapiens
tgttatttgtaatagat

SEQ ID NO: 1128809 - DNA, 18 bp, Homo sapiens
tgttattttcagtatttt

SEQ ID NO: 1128810 - DNA, 19 bp, Homo sapiens
tgttattttctttgaaatt

SEQ ID NO: 1128811 - DNA, 17 bp, Homo sapiens
tgttattttgtgtacaa

SEQ ID NO: 1128812 - DNA, 16 bp, Homo sapiens
tgttatttttgtttct

SEQ ID NO: 1128813 - DNA, 18 bp, Homo sapiens
tgttattttttaattatt

SEQ ID NO: 1128814 - DNA, 20 bp, Homo sapiens
tgttcaaagccacattattt

SEQ ID NO: 1128815 - DNA, 22 bp, Homo sapiens
tgttcaaagccacattatttct

SEQ ID NO: 1128816 - DNA, 21 bp, Homo sapiens
tgttcaaagccagcgtcctcc

SEQ ID NO: 1128817 - DNA, 22 bp, Homo sapiens
tgttcaaagccagcgtcctcct

SEQ ID NO: 1128818 - DNA, 13 bp, Homo sapiens
tgttcaaattttt

SEQ ID NO: 1128819 - DNA, 19 bp, Homo sapiens
tgttcaacaatcagtcatc

SEQ ID NO: 1128820 - DNA, 13 bp, Homo sapiens
tgttcaagcaaaa

SEQ ID NO: 1128821 - DNA, 20 bp, Homo sapiens
tgttcaatgaaataaaagca

SEQ ID NO: 1128822 - DNA, 15 bp, Homo sapiens
tgttcaatgttccat

SEQ ID NO: 1128823 - DNA, 16 bp, Homo sapiens
tgttcacaatatattt

SEQ ID NO: 1128824 - DNA, 16 bp, Homo sapiens
tgttcacaccagagaa

SEQ ID NO: 1128825 - DNA, 13 bp, Homo sapiens
tgttcacattttt

SEQ ID NO: 1128826 - DNA, 18 bp, Homo sapiens
tgttcacggtgacacagg

SEQ ID NO: 1128827 - DNA, 17 bp, Homo sapiens
tgttcacttttgacaaa

SEQ ID NO: 1128828 - DNA, 21 bp, Homo sapiens
tgttcagaaagcaataacttt

SEQ ID NO: 1128829 - DNA, 15 bp, Homo sapiens
tgttcagaagaaatt

SEQ ID NO: 1128830 - DNA, 22 bp, Homo sapiens
tgttcagaaggttgctctagat

SEQ ID NO: 1128831 - DNA, 12 bp, Homo sapiens
tgttcagaggca

SEQ ID NO: 1128832 - DNA, 15 bp, Homo sapiens
tgttcagagtggctc

SEQ ID NO: 1128833 - DNA, 22 bp, Homo sapiens
tgttcagagtggctcactggct

SEQ ID NO: 1128834 - DNA, 17 bp, Homo sapiens
tgttcagagttgtttgg

SEQ ID NO: 1128835 - DNA, 15 bp, Homo sapiens
tgttcagcactgtcc

SEQ ID NO: 1128836 - DNA, 17 bp, Homo sapiens
tgttcagctctttccaa

SEQ ID NO: 1128837 - DNA, 19 bp, Homo sapiens
tgttcagctctttccaaat

SEQ ID NO: 1128838 - DNA, 13 bp, Homo sapiens
tgttcagtaataa

SEQ ID NO: 1128839 - DNA, 15 bp, Homo sapiens
tgttcagtgagatat

SEQ ID NO: 1128840 - DNA, 17 bp, Homo sapiens
tgttcagtgctttttcc

SEQ ID NO: 1128841 - DNA, 19 bp, Homo sapiens
tgttcatagcccagtagac

SEQ ID NO: 1128842 - DNA, 15 bp, Homo sapiens
tgttcatctgtaact

SEQ ID NO: 1128843 - DNA, 15 bp, Homo sapiens
tgttcatgctccaag

SEQ ID NO: 1128844 - DNA, 22 bp, Homo sapiens
tgttcattaaagcatgaatggt

SEQ ID NO: 1128845 - DNA, 20 bp, Homo sapiens
tgttcattataatctcaaag

SEQ ID NO: 1128846 - DNA, 14 bp, Homo sapiens
tgttcattgtaatg

SEQ ID NO: 1128847 - DNA, 21 bp, Homo sapiens
tgttcattgtaatgttactga

SEQ ID NO: 1128848 - DNA, 21 bp, Homo sapiens
tgttcatttagataatttgaa

SEQ ID NO: 1128849 - DNA, 17 bp, Homo sapiens
tgttcatttcacacagt

SEQ ID NO: 1128850 - DNA, 20 bp, Homo sapiens
tgttcatttggtgttcctgg

SEQ ID NO: 1128851 - DNA, 13 bp, Homo sapiens
tgttcattttctc

SEQ ID NO: 1128852 - DNA, 20 bp, Homo sapiens
tgttcattttgagctgaaat

SEQ ID NO: 1128853 - DNA, 20 bp, Homo sapiens
tgttcatttttaaagcctgg

SEQ ID NO: 1128854 - DNA, 22 bp, Homo sapiens
tgttcatttttaaagcctggct

SEQ ID NO: 1128855 - DNA, 21 bp, Homo sapiens
tgttccaaattcagtttcata

SEQ ID NO: 1128856 - DNA, 14 bp, Homo sapiens
tgttccaactgccc

SEQ ID NO: 1128857 - DNA, 22 bp, Homo sapiens
tgttccagactcaggttccaga

SEQ ID NO: 1128858 - DNA, 14 bp, Homo sapiens
tgttccagcagttt

SEQ ID NO: 1128859 - DNA, 18 bp, Homo sapiens
tgttccaggccctccagt

SEQ ID NO: 1128860 - DNA, 16 bp, Homo sapiens
tgttccattttatgca

SEQ ID NO: 1128861 - DNA, 19 bp, Homo sapiens
tgttccattttatgcagaa

SEQ ID NO: 1128862 - DNA, 16 bp, Homo sapiens
tgttcccatttcagct

SEQ ID NO: 1128863 - DNA, 17 bp, Homo sapiens
tgttcccatttcagctg

SEQ ID NO: 1128864 - DNA, 21 bp, Homo sapiens
tgttccccaaatggccatttt

SEQ ID NO: 1128865 - DNA, 18 bp, Homo sapiens
tgttccccatggccactt

SEQ ID NO: 1128866 - DNA, 17 bp, Homo sapiens
tgttcccccagcctgcc

SEQ ID NO: 1128867 - DNA, 15 bp, Homo sapiens
tgttcccctaagtgg

SEQ ID NO: 1128868 - DNA, 15 bp, Homo sapiens
tgttcccctctccct

SEQ ID NO: 1128869 - DNA, 17 bp, Homo sapiens
tgttcccctctcccttc

SEQ ID NO: 1128870 - DNA, 18 bp, Homo sapiens
tgttcccctcttgtctcc

SEQ ID NO: 1128871 - DNA, 20 bp, Homo sapiens
tgttcccctcttgtctcccc

SEQ ID NO: 1128872 - DNA, 23 bp, Homo sapiens
tgttcccctcttgtctcccctgt

SEQ ID NO: 1128873 - DNA, 17 bp, Homo sapiens
tgttccccttccactga

SEQ ID NO: 1128874 - DNA, 20 bp, Homo sapiens
tgttccccttccactgaggg

SEQ ID NO: 1128875 - DNA, 23 bp, Homo sapiens
tgttccccttccactgagggcag

SEQ ID NO: 1128876 - DNA, 18 bp, Homo sapiens
tgttccctctccctgttg

SEQ ID NO: 1128877 - DNA, 19 bp, Homo sapiens
tgttccctctgctcctgga

SEQ ID NO: 1128878 - DNA, 18 bp, Homo sapiens
tgttccctctggcttccc

SEQ ID NO: 1128879 - DNA, 20 bp, Homo sapiens
tgttccctgcaccctggaaa

SEQ ID NO: 1128880 - DNA, 14 bp, Homo sapiens
tgttccctgttctg

SEQ ID NO: 1128881 - DNA, 20 bp, Homo sapiens
tgttcccttcctcttcctgc

SEQ ID NO: 1128882 - DNA, 22 bp, Homo sapiens
tgttcccttgaccattggctgc

SEQ ID NO: 1128883 - DNA, 17 bp, Homo sapiens
tgttcccttgtggcttg

SEQ ID NO: 1128884 - DNA, 13 bp, Homo sapiens
tgttccctttgcc

SEQ ID NO: 1128885 - DNA, 17 bp, Homo sapiens
tgttcctaacaaaatga

SEQ ID NO: 1128886 - DNA, 21 bp, Homo sapiens
tgttcctatattccaggttta

SEQ ID NO: 1128887 - DNA, 21 bp, Homo sapiens
tgttcctatggaaacatttta

SEQ ID NO: 1128888 - DNA, 22 bp, Homo sapiens
tgttcctcaaagcttggattaa

SEQ ID NO: 1128889 - DNA, 19 bp, Homo sapiens
tgttcctcggtgggccaga

SEQ ID NO: 1128890 - DNA, 22 bp, Homo sapiens
tgttcctcggtgggccagagct

SEQ ID NO: 1128891 - DNA, 12 bp, Homo sapiens
tgttcctgaagc

SEQ ID NO: 1128892 - DNA, 16 bp, Homo sapiens
tgttcctgaagctgct

SEQ ID NO: 1128893 - DNA, 17 bp, Homo sapiens
tgttcctgaagctgctg

SEQ ID NO: 1128894 - DNA, 22 bp, Homo sapiens
tgttcctgaattctatttgctg

SEQ ID NO: 1128895 - DNA, 14 bp, Homo sapiens
tgttcctggaagca

SEQ ID NO: 1128896 - DNA, 18 bp, Homo sapiens
tgttcctggagttttgat

SEQ ID NO: 1128897 - DNA, 20 bp, Homo sapiens
tgttcctggcccactctgta

SEQ ID NO: 1128898 - DNA, 13 bp, Homo sapiens
tgttcctggctga

SEQ ID NO: 1128899 - DNA, 17 bp, Homo sapiens
tgttcctggctgatgat

SEQ ID NO: 1128900 - DNA, 16 bp, Homo sapiens
tgttcctgtgttcttc

SEQ ID NO: 1128901 - DNA, 23 bp, Homo sapiens
tgttccttatttctctctcctgg

SEQ ID NO: 1128902 - DNA, 17 bp, Homo sapiens
tgttccttttctctcct

SEQ ID NO: 1128903 - DNA, 21 bp, Homo sapiens
tgttcctttttaaatgtgaat

SEQ ID NO: 1128904 - DNA, 17 bp, Homo sapiens
tgttctagacttcccca

SEQ ID NO: 1128905 - DNA, 22 bp, Homo sapiens
tgttctagacttccccatcccg

SEQ ID NO: 1128906 - DNA, 20 bp, Homo sapiens
tgttctaggtcagtctaaca

SEQ ID NO: 1128907 - DNA, 15 bp, Homo sapiens
tgttctagttttcag

SEQ ID NO: 1128908 - DNA, 14 bp, Homo sapiens
tgttctatgaacaa

SEQ ID NO: 1128909 - DNA, 22 bp, Homo sapiens
tgttctattaatcacctctctg

SEQ ID NO: 1128910 - DNA, 13 bp, Homo sapiens
tgttctcacacca

SEQ ID NO: 1128911 - DNA, 16 bp, Homo sapiens
tgttctcaggacagca

SEQ ID NO: 1128912 - DNA, 17 bp, Homo sapiens
tgttctcatgaagcagg

SEQ ID NO: 1128913 - DNA, 16 bp, Homo sapiens
tgttctctcccctcac

SEQ ID NO: 1128914 - DNA, 16 bp, Homo sapiens
tgttctctcttctcca

SEQ ID NO: 1128915 - DNA, 13 bp, Homo sapiens
tgttctctgctga

SEQ ID NO: 1128916 - DNA, 13 bp, Homo sapiens
tgttctctgggag

SEQ ID NO: 1128917 - DNA, 19 bp, Homo sapiens
tgttctcttcccaggcctt

SEQ ID NO: 1128918 - DNA, 16 bp, Homo sapiens
tgttctcttctgcgta

SEQ ID NO: 1128919 - DNA, 20 bp, Homo sapiens
tgttctcttctgcgtaggcg

SEQ ID NO: 1128920 - DNA, 17 bp, Homo sapiens
tgttctgaaaggagaca

SEQ ID NO: 1128921 - DNA, 18 bp, Homo sapiens
tgttctgaaatgttctta

SEQ ID NO: 1128922 - DNA, 13 bp, Homo sapiens
tgttctgacatta

SEQ ID NO: 1128923 - DNA, 16 bp, Homo sapiens
tgttctgacattaaca

SEQ ID NO: 1128924 - DNA, 17 bp, Homo sapiens
tgttctgacattaacag

SEQ ID NO: 1128925 - DNA, 20 bp, Homo sapiens
tgttctgacattaacagttt

SEQ ID NO: 1128926 - DNA, 18 bp, Homo sapiens
tgttctgagaactgactt

SEQ ID NO: 1128927 - DNA, 19 bp, Homo sapiens
tgttctgagaactgacttt

SEQ ID NO: 1128928 - DNA, 17 bp, Homo sapiens
tgttctgagtaagtgtg

SEQ ID NO: 1128929 - DNA, 21 bp, Homo sapiens
tgttctgagtaagtgtgttca

SEQ ID NO: 1128930 - DNA, 14 bp, Homo sapiens
tgttctgcaagaat

SEQ ID NO: 1128931 - DNA, 23 bp, Homo sapiens
tgttctgcccaatgcctttttga

SEQ ID NO: 1128932 - DNA, 22 bp, Homo sapiens
tgttctgcccccagcccaaagg

SEQ ID NO: 1128933 - DNA, 16 bp, Homo sapiens
tgttctgctcctgctt

SEQ ID NO: 1128934 - DNA, 23 bp, Homo sapiens
tgttctgctcctgcttttctgtc

SEQ ID NO: 1128935 - DNA, 21 bp, Homo sapiens
tgttctgcttcgaagtattca

SEQ ID NO: 1128936 - DNA, 13 bp, Homo sapiens
tgttctggaggaa

SEQ ID NO: 1128937 - DNA, 17 bp, Homo sapiens
tgttctgggctggggcc

SEQ ID NO: 1128938 - DNA, 22 bp, Homo sapiens
tgttctgggctggggccacctt

SEQ ID NO: 1128939 - DNA, 19 bp, Homo sapiens
tgttctggtatttcccctg

SEQ ID NO: 1128940 - DNA, 22 bp, Homo sapiens
tgttctgtgatacagaactctt

SEQ ID NO: 1128941 - DNA, 19 bp, Homo sapiens
tgttctgtggttcctctgc

SEQ ID NO: 1128942 - DNA, 17 bp, Homo sapiens
tgttctgttaactgaat

SEQ ID NO: 1128943 - DNA, 19 bp, Homo sapiens
tgttctgttaactgaatac

SEQ ID NO: 1128944 - DNA, 21 bp, Homo sapiens
tgttctgttaactgaatacca

SEQ ID NO: 1128945 - DNA, 23 bp, Homo sapiens
tgttctgttaactgaataccact

SEQ ID NO: 1128946 - DNA, 15 bp, Homo sapiens
tgttctgttgaaggt

SEQ ID NO: 1128947 - DNA, 16 bp, Homo sapiens
tgttctgtttggcact

SEQ ID NO: 1128948 - DNA, 20 bp, Homo sapiens
tgttcttacaaatgtgaaac

SEQ ID NO: 1128949 - DNA, 13 bp, Homo sapiens
tgttcttcctcca

SEQ ID NO: 1128950 - DNA, 14 bp, Homo sapiens
tgttcttccttcct

SEQ ID NO: 1128951 - DNA, 17 bp, Homo sapiens
tgttcttccttcctaga

SEQ ID NO: 1128952 - DNA, 20 bp, Homo sapiens
tgttcttgaagcagtagcct

SEQ ID NO: 1128953 - DNA, 15 bp, Homo sapiens
tgttcttgaagctgg

SEQ ID NO: 1128954 - DNA, 18 bp, Homo sapiens
tgttcttggttcctgttt

SEQ ID NO: 1128955 - DNA, 17 bp, Homo sapiens
tgttcttggtttgtaaa

SEQ ID NO: 1128956 - DNA, 13 bp, Homo sapiens
tgttcttgtattt

SEQ ID NO: 1128957 - DNA, 20 bp, Homo sapiens
tgttctttccaaagtacact

SEQ ID NO: 1128958 - DNA, 14 bp, Homo sapiens
tgttctttcctgcc

SEQ ID NO: 1128959 - DNA, 20 bp, Homo sapiens
tgttcttttctcctttacca

SEQ ID NO: 1128960 - DNA, 14 bp, Homo sapiens
tgttcttttgcaat

SEQ ID NO: 1128961 - DNA, 14 bp, Homo sapiens
tgttctttttattg

SEQ ID NO: 1128962 - DNA, 23 bp, Homo sapiens
tgttctttttctgaactccattt

SEQ ID NO: 1128963 - DNA, 15 bp, Homo sapiens
tgttgaaaaaattta

SEQ ID NO: 1128964 - DNA, 18 bp, Homo sapiens
tgttgaaaaagtttgttt

SEQ ID NO: 1128965 - DNA, 17 bp, Homo sapiens
tgttgaaaatgttcaga

SEQ ID NO: 1128966 - DNA, 23 bp, Homo sapiens
tgttgaaaggttttttttcagtt

SEQ ID NO: 1128967 - DNA, 14 bp, Homo sapiens
tgttgaaatagctt

SEQ ID NO: 1128968 - DNA, 20 bp, Homo sapiens
tgttgaaatagctttactgt

SEQ ID NO: 1128969 - DNA, 16 bp, Homo sapiens
tgttgaaatatgcata

SEQ ID NO: 1128970 - DNA, 15 bp, Homo sapiens
tgttgaaattatgta

SEQ ID NO: 1128971 - DNA, 22 bp, Homo sapiens
tgttgaaattatgtatgtttac

SEQ ID NO: 1128972 - DNA, 20 bp, Homo sapiens
tgttgaagacttcctctcta

SEQ ID NO: 1128973 - DNA, 18 bp, Homo sapiens
tgttgaaggaacttgtct

SEQ ID NO: 1128974 - DNA, 17 bp, Homo sapiens
tgttgaagggaggtggc

SEQ ID NO: 1128975 - DNA, 13 bp, Homo sapiens
tgttgaatacttt

SEQ ID NO: 1128976 - DNA, 22 bp, Homo sapiens
tgttgaatgcccacaggcaaat

SEQ ID NO: 1128977 - DNA, 14 bp, Homo sapiens
tgttgacacaccag

SEQ ID NO: 1128978 - DNA, 19 bp, Homo sapiens
tgttgacacatatgaacac

SEQ ID NO: 1128979 - DNA, 21 bp, Homo sapiens
tgttgacagcaaaatgttgaa

SEQ ID NO: 1128980 - DNA, 21 bp, Homo sapiens
tgttgacatatttaatgtttt

SEQ ID NO: 1128981 - DNA, 14 bp, Homo sapiens
tgttgacattagtc

SEQ ID NO: 1128982 - DNA, 15 bp, Homo sapiens
tgttgacattctgaa

SEQ ID NO: 1128983 - DNA, 17 bp, Homo sapiens
tgttgacattctgaatg

SEQ ID NO: 1128984 - DNA, 23 bp, Homo sapiens
tgttgacattctgaatgcttcta

SEQ ID NO: 1128985 - DNA, 17 bp, Homo sapiens
tgttgacccttttttga

SEQ ID NO: 1128986 - DNA, 18 bp, Homo sapiens
tgttgacctgtgcaccta

SEQ ID NO: 1128987 - DNA, 13 bp, Homo sapiens
tgttgactgctgc

SEQ ID NO: 1128988 - DNA, 22 bp, Homo sapiens
tgttgactgctgctccccaccc

SEQ ID NO: 1128989 - DNA, 20 bp, Homo sapiens
tgttgacttattttctctgt

SEQ ID NO: 1128990 - DNA, 13 bp, Homo sapiens
tgttgagacagag

SEQ ID NO: 1128991 - DNA, 23 bp, Homo sapiens
tgttgagcaagcagtagcatttg

SEQ ID NO: 1128992 - DNA, 18 bp, Homo sapiens
tgttgagccttttccctc

SEQ ID NO: 1128993 - DNA, 20 bp, Homo sapiens
tgttgaggtggtctgaatgt

SEQ ID NO: 1128994 - DNA, 19 bp, Homo sapiens
tgttgaggttaagtttctc

SEQ ID NO: 1128995 - DNA, 14 bp, Homo sapiens
tgttgagtaaaaca

SEQ ID NO: 1128996 - DNA, 15 bp, Homo sapiens
tgttgagtaaaacac

SEQ ID NO: 1128997 - DNA, 13 bp, Homo sapiens
tgttgagtgttca

SEQ ID NO: 1128998 - DNA, 18 bp, Homo sapiens
tgttgagttctgattgtg

SEQ ID NO: 1128999 - DNA, 19 bp, Homo sapiens
tgttgataaaaatactgac

SEQ ID NO: 1129000 - DNA, 18 bp, Homo sapiens
tgttgatacaaaccactg

SEQ ID NO: 1129001 - DNA, 16 bp, Homo sapiens
tgttgatattgtttgc

SEQ ID NO: 1129002 - DNA, 17 bp, Homo sapiens
tgttgatattgtttgct

SEQ ID NO: 1129003 - DNA, 19 bp, Homo sapiens
tgttgatattgtttgctgt

SEQ ID NO: 1129004 - DNA, 17 bp, Homo sapiens
tgttgatcatgtacttt

SEQ ID NO: 1129005 - DNA, 16 bp, Homo sapiens
tgttgatcccaagaca

SEQ ID NO: 1129006 - DNA, 23 bp, Homo sapiens
tgttgatctgcatatttctgtat

SEQ ID NO: 1129007 - DNA, 19 bp, Homo sapiens
tgttgatgactcgaaactg

SEQ ID NO: 1129008 - DNA, 13 bp, Homo sapiens
tgttgatgtatct

SEQ ID NO: 1129009 - DNA, 16 bp, Homo sapiens
tgttgattaatttgag

SEQ ID NO: 1129010 - DNA, 22 bp, Homo sapiens
tgttgattacataatcaaagct

SEQ ID NO: 1129011 - DNA, 23 bp, Homo sapiens
tgttgattacataatcaaagcta

SEQ ID NO: 1129012 - DNA, 22 bp, Homo sapiens
tgttgattatcttcagcccagg

SEQ ID NO: 1129013 - DNA, 20 bp, Homo sapiens
tgttgattgcaggaataagg

SEQ ID NO: 1129014 - DNA, 19 bp, Homo sapiens
tgttgatttctttccagag

SEQ ID NO: 1129015 - DNA, 20 bp, Homo sapiens
tgttgatttctttccagagg

SEQ ID NO: 1129016 - DNA, 14 bp, Homo sapiens
tgttgattttctgt

SEQ ID NO: 1129017 - DNA, 15 bp, Homo sapiens
tgttgattttctgtt

SEQ ID NO: 1129018 - DNA, 16 bp, Homo sapiens
tgttgcaagatgtgaa

SEQ ID NO: 1129019 - DNA, 23 bp, Homo sapiens
tgttgcaagatgtgaattattga

SEQ ID NO: 1129020 - DNA, 19 bp, Homo sapiens
tgttgcaagtactgctgta

SEQ ID NO: 1129021 - DNA, 17 bp, Homo sapiens
tgttgcactgccccctg

SEQ ID NO: 1129022 - DNA, 14 bp, Homo sapiens
tgttgcatgtttga

SEQ ID NO: 1129023 - DNA, 15 bp, Homo sapiens
tgttgcatgtttgaa

SEQ ID NO: 1129024 - DNA, 17 bp, Homo sapiens
tgttgccaaagctggtc

SEQ ID NO: 1129025 - DNA, 19 bp, Homo sapiens
tgttgccaactaagccctc

SEQ ID NO: 1129026 - DNA, 20 bp, Homo sapiens
tgttgccaagctccaagccc

SEQ ID NO: 1129027 - DNA, 16 bp, Homo sapiens
tgttgccagtcagcaa

SEQ ID NO: 1129028 - DNA, 20 bp, Homo sapiens
tgttgccatttctctgctta

SEQ ID NO: 1129029 - DNA, 14 bp, Homo sapiens
tgttgcccaggctg

SEQ ID NO: 1129030 - DNA, 23 bp, Homo sapiens
tgttgcccaggctggagtacaat

SEQ ID NO: 1129031 - DNA, 16 bp, Homo sapiens
tgttgcctctctttga

SEQ ID NO: 1129032 - DNA, 15 bp, Homo sapiens
tgttgccttatttct

SEQ ID NO: 1129033 - DNA, 14 bp, Homo sapiens
tgtttcttctccaa

SEQ ID NO: 1129034 - DNA, 14 bp, Homo sapiens
tgtttcttctggct

SEQ ID NO: 1129035 - DNA, 16 bp, Homo sapiens
tgtttcttgacaagct

SEQ ID NO: 1129036 - DNA, 17 bp, Homo sapiens
tgtttcttgtgtttgag

SEQ ID NO: 1129037 - DNA, 16 bp, Homo sapiens
tgtttctttatatttt

SEQ ID NO: 1129038 - DNA, 20 bp, Homo sapiens
tgtttctttctctgaggaca

SEQ ID NO: 1129039 - DNA, 12 bp, Homo sapiens
tgtttctttgtg

SEQ ID NO: 1129040 - DNA, 21 bp, Homo sapiens
tgtttcttttgtaaagagaat

SEQ ID NO: 1129041 - DNA, 23 bp, Homo sapiens
tgtttcttttttttttttttaca

SEQ ID NO: 1129042 - DNA, 14 bp, Homo sapiens
tgtttgaaatatca

SEQ ID NO: 1129043 - DNA, 18 bp, Homo sapiens
tgtttgaaatatcatgtt

SEQ ID NO: 1129044 - DNA, 16 bp, Homo sapiens
tgtttgaaatcatcgg

SEQ ID NO: 1129045 - DNA, 21 bp, Homo sapiens
tgtttgaaatgaggtctgttt

SEQ ID NO: 1129046 - DNA, 14 bp, Homo sapiens
tgtttgaaatgtcg

SEQ ID NO: 1129047 - DNA, 22 bp, Homo sapiens
tgtttgaattcctcctctattt

SEQ ID NO: 1129048 - DNA, 21 bp, Homo sapiens
tgtttgacaaagaaacccaag

SEQ ID NO: 1129049 - DNA, 22 bp, Homo sapiens
tgtttgacaaagaaacccaagt

SEQ ID NO: 1129050 - DNA, 13 bp, Homo sapiens
tgtttgacactaa

SEQ ID NO: 1129051 - DNA, 21 bp, Homo sapiens
tgtttgaccttcagagccagc

SEQ ID NO: 1129052 - DNA, 11 bp, Homo sapiens
tgtttgagaac

SEQ ID NO: 1129053 - DNA, 22 bp, Homo sapiens
tgtttgagacagggtctcactc

SEQ ID NO: 1129054 - DNA, 20 bp, Homo sapiens
tgtttgaggcaaattaactg

SEQ ID NO: 1129055 - DNA, 19 bp, Homo sapiens
tgtttgagtttttcctccc

SEQ ID NO: 1129056 - DNA, 13 bp, Homo sapiens
tgtttgatgcatt

SEQ ID NO: 1129057 - DNA, 16 bp, Homo sapiens
tgtttgatgcattaaa

SEQ ID NO: 1129058 - DNA, 19 bp, Homo sapiens
tgtttgatgcattaaaaga

SEQ ID NO: 1129059 - DNA, 16 bp, Homo sapiens
tgtttgatgtatgtgt

SEQ ID NO: 1129060 - DNA, 20 bp, Homo sapiens
tgtttgatgtatgtgtgaaa

SEQ ID NO: 1129061 - DNA, 14 bp, Homo sapiens
tgtttgatgtcccc

SEQ ID NO: 1129062 - DNA, 19 bp, Homo sapiens
tgtttgatgtccccaaagt

SEQ ID NO: 1129063 - DNA, 14 bp, Homo sapiens
tgtttgatgttttt

SEQ ID NO: 1129064 - DNA, 14 bp, Homo sapiens
tgtttgattccatt

SEQ ID NO: 1129065 - DNA, 13 bp, Homo sapiens
tgtttgatttcaa

SEQ ID NO: 1129066 - DNA, 18 bp, Homo sapiens
tgtttgcacctttctagt

SEQ ID NO: 1129067 - DNA, 20 bp, Homo sapiens
tgtttgccaaataaaaaaca

SEQ ID NO: 1129068 - DNA, 15 bp, Homo sapiens
tgtttgccatacttt

SEQ ID NO: 1129069 - DNA, 22 bp, Homo sapiens
tgtttgccatactttgtctgaa

SEQ ID NO: 1129070 - DNA, 24 bp, Homo sapiens
tgtttgctctcccggttcttccag

SEQ ID NO: 1129071 - DNA, 14 bp, Homo sapiens
tgtttgctgcagag

SEQ ID NO: 1129072 - DNA, 23 bp, Homo sapiens
tgtttgctgccttgctcctagca

SEQ ID NO: 1129073 - DNA, 20 bp, Homo sapiens
tgtttgctgttgggtttttg

SEQ ID NO: 1129074 - DNA, 24 bp, Homo sapiens
tgtttgcttaatttccttctgtta

SEQ ID NO: 1129075 - DNA, 16 bp, Homo sapiens
tgtttgcttattgttc

SEQ ID NO: 1129076 - DNA, 21 bp, Homo sapiens
tgtttgcttattgttccaaga

SEQ ID NO: 1129077 - DNA, 12 bp, Homo sapiens
tgtttgcttctt

SEQ ID NO: 1129078 - DNA, 22 bp, Homo sapiens
tgtttgcttcttgccatcactg

SEQ ID NO: 1129079 - DNA, 20 bp, Homo sapiens
tgtttggaaaaaactctgaa

SEQ ID NO: 1129080 - DNA, 16 bp, Homo sapiens
tgtttggaaaagacag

SEQ ID NO: 1129081 - DNA, 14 bp, Homo sapiens
tgtttggactgttt

SEQ ID NO: 1129082 - DNA, 18 bp, Homo sapiens
tgtttggatacagctgct

SEQ ID NO: 1129083 - DNA, 15 bp, Homo sapiens
tgtttggcacttgta

SEQ ID NO: 1129084 - DNA, 16 bp, Homo sapiens
tgtttggcacttgtat

SEQ ID NO: 1129085 - DNA, 19 bp, Homo sapiens
tgtttggcacttgtattta

SEQ ID NO: 1129086 - DNA, 22 bp, Homo sapiens
tgtttggcctttcttggggaga

SEQ ID NO: 1129087 - DNA, 18 bp, Homo sapiens
tgtttgggatcagcttct

SEQ ID NO: 1129088 - DNA, 16 bp, Homo sapiens
tgtttgggcagaaggg

SEQ ID NO: 1129089 - DNA, 23 bp, Homo sapiens
tgtttggggatcgatgtgctcag

SEQ ID NO: 1129090 - DNA, 16 bp, Homo sapiens
tgtttgggggaaaaaa

SEQ ID NO: 1129091 - DNA, 24 bp, Homo sapiens
tgtttgggggacgtttctcatttg

SEQ ID NO: 1129092 - DNA, 16 bp, Homo sapiens
tgtttggtcgagtctt

SEQ ID NO: 1129093 - DNA, 22 bp, Homo sapiens
tgtttggtgggccatatgccta

SEQ ID NO: 1129094 - DNA, 20 bp, Homo sapiens
tgtttggtgtttgtctgtgt

SEQ ID NO: 1129095 - DNA, 16 bp, Homo sapiens
tgtttggttgtaaatg

SEQ ID NO: 1129096 - DNA, 10 bp, Homo sapiens
tgtttgtaaa

SEQ ID NO: 1129097 - DNA, 16 bp, Homo sapiens
tgtttgtaaataagag

SEQ ID NO: 1129098 - DNA, 18 bp, Homo sapiens
tgtttgtaaataagagat

SEQ ID NO: 1129099 - DNA, 15 bp, Homo sapiens
tgtttgtaaattaat

SEQ ID NO: 1129100 - DNA, 16 bp, Homo sapiens
tgtttgtagtgaaata

SEQ ID NO: 1129101 - DNA, 15 bp, Homo sapiens
tgtttgtatgtataa

SEQ ID NO: 1129102 - DNA, 21 bp, Homo sapiens
tgtttgtattttttatttaca

SEQ ID NO: 1129103 - DNA, 15 bp, Homo sapiens
tgtttgtcccttcta

SEQ ID NO: 1129104 - DNA, 14 bp, Homo sapiens
tgtttgtcctgggt

SEQ ID NO: 1129105 - DNA, 16 bp, Homo sapiens
tgtttgtcctgggttc

SEQ ID NO: 1129106 - DNA, 16 bp, Homo sapiens
tgtttgtctgaacaaa

SEQ ID NO: 1129107 - DNA, 19 bp, Homo sapiens
tgtttgtctgtttgtttca

SEQ ID NO: 1129108 - DNA, 20 bp, Homo sapiens
tgtttgtctgtttgtttcaa

SEQ ID NO: 1129109 - DNA, 16 bp, Homo sapiens
tgtttgtgagaagctt

SEQ ID NO: 1129110 - DNA, 18 bp, Homo sapiens
tgtttgtgctctgttcca

SEQ ID NO: 1129111 - DNA, 14 bp, Homo sapiens
tgtttgtggcctca

SEQ ID NO: 1129112 - DNA, 14 bp, Homo sapiens
tgtttgtgtattta

SEQ ID NO: 1129113 - DNA, 17 bp, Homo sapiens
tgtttgttaaaactggc

SEQ ID NO: 1129114 - DNA, 12 bp, Homo sapiens
tgtttgttatgg

SEQ ID NO: 1129115 - DNA, 20 bp, Homo sapiens
tgtttgttatttacactggt

SEQ ID NO: 1129116 - DNA, 16 bp, Homo sapiens
tgtttgtttaagctga

SEQ ID NO: 1129117 - DNA, 19 bp, Homo sapiens
tgtttgtttcaagaacctg

SEQ ID NO: 1129118 - DNA, 13 bp, Homo sapiens
tgtttgtttcttt

SEQ ID NO: 1129119 - DNA, 12 bp, Homo sapiens
tgtttgtttgag

SEQ ID NO: 1129120 - DNA, 12 bp, Homo sapiens
tgtttgttttgt

SEQ ID NO: 1129121 - DNA, 12 bp, Homo sapiens
tgttttaaaaaa

SEQ ID NO: 1129122 - DNA, 17 bp, Homo sapiens
tgttttaaaaaaactga

SEQ ID NO: 1129123 - DNA, 23 bp, Homo sapiens
tgttttaaaataaaaattctgaa

SEQ ID NO: 1129124 - DNA, 23 bp, Homo sapiens
tgttttaaaataagttaaaggca

SEQ ID NO: 1129125 - DNA, 22 bp, Homo sapiens
tgttttaaacattaatagcagc

SEQ ID NO: 1129126 - DNA, 22 bp, Homo sapiens
tgttttaaatacgcactacatg

SEQ ID NO: 1129127 - DNA, 22 bp, Homo sapiens
tgttttaaatttatttcaaaaa

SEQ ID NO: 1129128 - DNA, 19 bp, Homo sapiens
tgttttaagactgaatgtt

SEQ ID NO: 1129129 - DNA, 23 bp, Homo sapiens
tgttttaagactgaatgttttat

SEQ ID NO: 1129130 - DNA, 23 bp, Homo sapiens
tgttttaatatcaactctcactc

SEQ ID NO: 1129131 - DNA, 15 bp, Homo sapiens
tgttttaatctactt

SEQ ID NO: 1129132 - DNA, 17 bp, Homo sapiens
tgttttacattccattt

SEQ ID NO: 1129133 - DNA, 15 bp, Homo sapiens
tgttttaccagctcc

SEQ ID NO: 1129134 - DNA, 21 bp, Homo sapiens
tgttttacctgttctgaaatg

SEQ ID NO: 1129135 - DNA, 19 bp, Homo sapiens
tgttttacgtctgggagaa

SEQ ID NO: 1129136 - DNA, 20 bp, Homo sapiens
tgttttacttttttaacatg

SEQ ID NO: 1129137 - DNA, 14 bp, Homo sapiens
tgttttagttcttg

SEQ ID NO: 1129138 - DNA, 19 bp, Homo sapiens
tgttttataaaattttgct

SEQ ID NO: 1129139 - DNA, 14 bp, Homo sapiens
tgttttattcctgt

SEQ ID NO: 1129140 - DNA, 15 bp, Homo sapiens
tgttttattcctgta

SEQ ID NO: 1129141 - DNA, 16 bp, Homo sapiens
tgttttatttatcaaa

SEQ ID NO: 1129142 - DNA, 17 bp, Homo sapiens
tgttttatttatcaaaa

SEQ ID NO: 1129143 - DNA, 18 bp, Homo sapiens
tgttttatttcattggtt

SEQ ID NO: 1129144 - DNA, 18 bp, Homo sapiens
tgttttattttttattgt

SEQ ID NO: 1129145 - DNA, 19 bp, Homo sapiens
tgttttcaagtgtaaatga

SEQ ID NO: 1129146 - DNA, 11 bp, Homo sapiens
tgttttcaata

SEQ ID NO: 1129147 - DNA, 17 bp, Homo sapiens
tgttttcacttgtattg

SEQ ID NO: 1129148 - DNA, 14 bp, Homo sapiens
tgttttcatcattt

SEQ ID NO: 1129149 - DNA, 19 bp, Homo sapiens
tgttttcatgtaaataaat

SEQ ID NO: 1129150 - DNA, 19 bp, Homo sapiens
tgttttcattatgttcatg

SEQ ID NO: 1129151 - DNA, 18 bp, Homo sapiens
tgttttccattgtttgaa

SEQ ID NO: 1129152 - DNA, 16 bp, Homo sapiens
tgttttcccacgagga

SEQ ID NO: 1129153 - DNA, 12 bp, Homo sapiens
tgttttccctga

SEQ ID NO: 1129154 - DNA, 21 bp, Homo sapiens
tgttttccctttaaagccttt

SEQ ID NO: 1129155 - DNA, 22 bp, Homo sapiens
tgttttcctcccttctgctact

SEQ ID NO: 1129156 - DNA, 23 bp, Homo sapiens
tgttttcctcccttctgctactg

SEQ ID NO: 1129157 - DNA, 17 bp, Homo sapiens
tgttttccttacctatt

SEQ ID NO: 1129158 - DNA, 21 bp, Homo sapiens
tgttttcgttgttgttaacaa

SEQ ID NO: 1129159 - DNA, 16 bp, Homo sapiens
tgttttctccctctca

SEQ ID NO: 1129160 - DNA, 17 bp, Homo sapiens
tgttttctctgaacaca

SEQ ID NO: 1129161 - DNA, 15 bp, Homo sapiens
tgttttctcttgaga

SEQ ID NO: 1129162 - DNA, 12 bp, Homo sapiens
tgttttctgaaa

SEQ ID NO: 1129163 - DNA, 14 bp, Homo sapiens
tgttttctgctgtt

SEQ ID NO: 1129164 - DNA, 14 bp, Homo sapiens
tgttttctgtaaat

SEQ ID NO: 1129165 - DNA, 20 bp, Homo sapiens
tgttttctgtttgtaaatta

SEQ ID NO: 1129166 - DNA, 13 bp, Homo sapiens
tgttttcttcaac

SEQ ID NO: 1129167 - DNA, 11 bp, Homo sapiens
tgttttcttct

SEQ ID NO: 1129168 - DNA, 22 bp, Homo sapiens
tgttttcttgtaaatgtttctt

SEQ ID NO: 1129169 - DNA, 17 bp, Homo sapiens
tgttttcttttggtaaa

SEQ ID NO: 1129170 - DNA, 17 bp, Homo sapiens
tgttttgaaatcaatgc

SEQ ID NO: 1129171 - DNA, 22 bp, Homo sapiens
tgttttgaaatcaatgcaagag

SEQ ID NO: 1129172 - DNA, 15 bp, Homo sapiens
tgttttgaaatgata

SEQ ID NO: 1129173 - DNA, 13 bp, Homo sapiens
tgttttgaataaa

SEQ ID NO: 1129174 - DNA, 19 bp, Homo sapiens
tgttttgaatggtgttgta

SEQ ID NO: 1129175 - DNA, 16 bp, Homo sapiens
tgttttgaatgtggat

SEQ ID NO: 1129176 - DNA, 17 bp, Homo sapiens
tgttttgaatgtggata

SEQ ID NO: 1129177 - DNA, 14 bp, Homo sapiens
tgttttgaattttg

SEQ ID NO: 1129178 - DNA, 20 bp, Homo sapiens
tgttttgatgagaaaaaact

SEQ ID NO: 1129179 - DNA, 11 bp, Homo sapiens
tgttttgcaag

SEQ ID NO: 1129180 - DNA, 18 bp, Homo sapiens
tgttttgcacagccaaat

SEQ ID NO: 1129181 - DNA, 22 bp, Homo sapiens
tgttttgcacgtcttgctattt

SEQ ID NO: 1129182 - DNA, 12 bp, Homo sapiens
tgttttgcactt

SEQ ID NO: 1129183 - DNA, 15 bp, Homo sapiens
tgttttgcttttgtt

SEQ ID NO: 1129184 - DNA, 19 bp, Homo sapiens
tgttttggacagtttacca

SEQ ID NO: 1129185 - DNA, 19 bp, Homo sapiens
tgttttgggatcaggagcc

SEQ ID NO: 1129186 - DNA, 23 bp, Homo sapiens
tgttttgggcctccatgccccag

SEQ ID NO: 1129187 - DNA, 20 bp, Homo sapiens
tgttttggggatgagagggt

SEQ ID NO: 1129188 - DNA, 16 bp, Homo sapiens
tgttttggtcccctcc

SEQ ID NO: 1129189 - DNA, 19 bp, Homo sapiens
tgttttggtcccctccctc

SEQ ID NO: 1129190 - DNA, 16 bp, Homo sapiens
tgttttgtaaacattt

SEQ ID NO: 1129191 - DNA, 13 bp, Homo sapiens
tgttttgtacaat

SEQ ID NO: 1129192 - DNA, 21 bp, Homo sapiens
tgttttgtacaattactaaat

SEQ ID NO: 1129193 - DNA, 22 bp, Homo sapiens
tgttttgtacaattactaaatt

SEQ ID NO: 1129194 - DNA, 15 bp, Homo sapiens
tgttttgtgcatttg

SEQ ID NO: 1129195 - DNA, 19 bp, Homo sapiens
tgttttgttgacattctga

SEQ ID NO: 1129196 - DNA, 20 bp, Homo sapiens
tgttttgttgacattctgaa

SEQ ID NO: 1129197 - DNA, 14 bp, Homo sapiens
tgttttgtttatta

SEQ ID NO: 1129198 - DNA, 13 bp, Homo sapiens
tgttttgtttctg

SEQ ID NO: 1129199 - DNA, 22 bp, Homo sapiens
tgtttttaaaatagaatgatag

SEQ ID NO: 1129200 - DNA, 16 bp, Homo sapiens
tgtttttaaactgtac

SEQ ID NO: 1129201 - DNA, 19 bp, Homo sapiens
tgtttttaagtaacttaag

SEQ ID NO: 1129202 - DNA, 13 bp, Homo sapiens
tgtttttaatgct

SEQ ID NO: 1129203 - DNA, 19 bp, Homo sapiens
tgtttttaatgctatttga

SEQ ID NO: 1129204 - DNA, 20 bp, Homo sapiens
tgtttttaatgctttgatat

SEQ ID NO: 1129205 - DNA, 19 bp, Homo sapiens
tgtttttacattatgcaaa

SEQ ID NO: 1129206 - DNA, 20 bp, Homo sapiens
tgtttttacattatgcaaat

SEQ ID NO: 1129207 - DNA, 20 bp, Homo sapiens
tgtttttagagcttccaaat

SEQ ID NO: 1129208 - DNA, 16 bp, Homo sapiens
tgtttttattccttcc

SEQ ID NO: 1129209 - DNA, 18 bp, Homo sapiens
tgtttttattccttccat

SEQ ID NO: 1129210 - DNA, 18 bp, Homo sapiens
tgtttttccctccccaga

SEQ ID NO: 1129211 - DNA, 15 bp, Homo sapiens
tgtttttcctttctt

SEQ ID NO: 1129212 - DNA, 17 bp, Homo sapiens
tgtttttcctttcttaa

SEQ ID NO: 1129213 - DNA, 19 bp, Homo sapiens
tgtttttctttttccacaa

SEQ ID NO: 1129214 - DNA, 13 bp, Homo sapiens
tgtttttgaaata

SEQ ID NO: 1129215 - DNA, 18 bp, Homo sapiens
tgtttttgaaggcagaaa

SEQ ID NO: 1129216 - DNA, 18 bp, Homo sapiens
tgtttttgaggctttctg

SEQ ID NO: 1129217 - DNA, 10 bp, Homo sapiens
tgtttttggg

SEQ ID NO: 1129218 - DNA, 19 bp, Homo sapiens
tgtttttgtatttttaatg

SEQ ID NO: 1129219 - DNA, 13 bp, Homo sapiens
tgtttttgttctt

SEQ ID NO: 1129220 - DNA, 14 bp, Homo sapiens
tgttttttaaaatg

SEQ ID NO: 1129221 - DNA, 14 bp, Homo sapiens
tgttttttaaagca

SEQ ID NO: 1129222 - DNA, 16 bp, Homo sapiens
tgttttttaagatagt

SEQ ID NO: 1129223 - DNA, 19 bp, Homo sapiens
tgttttttaattctctgtt

SEQ ID NO: 1129224 - DNA, 21 bp, Homo sapiens
tgttttttagatcaaatactt

SEQ ID NO: 1129225 - DNA, 15 bp, Homo sapiens
tgttttttcatttgt

SEQ ID NO: 1129226 - DNA, 17 bp, Homo sapiens
tgttttttcatttgtaa

SEQ ID NO: 1129227 - DNA, 23 bp, Homo sapiens
tgttttttcggacatgcttttct

SEQ ID NO: 1129228 - DNA, 14 bp, Homo sapiens
tgttttttgaaaac

SEQ ID NO: 1129229 - DNA, 19 bp, Homo sapiens
tgttttttgaaaacatggt

SEQ ID NO: 1129230 - DNA, 15 bp, Homo sapiens
tgttttttgtaacta

SEQ ID NO: 1129231 - DNA, 18 bp, Homo sapiens
tgttttttgtaactacaa

SEQ ID NO: 1129232 - DNA, 15 bp, Homo sapiens
tgttttttgttactg

SEQ ID NO: 1129233 - DNA, 16 bp, Homo sapiens
tgttttttgttcaatg

SEQ ID NO: 1129234 - DNA, 22 bp, Homo sapiens
tgtttttttcctcatgtaacat

SEQ ID NO: 1129235 - DNA, 14 bp, Homo sapiens
tgtttttttctaaa

SEQ ID NO: 1129236 - DNA, 13 bp, Homo sapiens
tgtttttttgtag

SEQ ID NO: 1129237 - DNA, 19 bp, Homo sapiens
tgttttttttttccactta

SEQ ID NO: 1129238 - DNA, 16 bp, Homo sapiens
tgttttttttttgaaa

SEQ ID NO: 1129239 - DNA, 21 bp, Homo sapiens
tgtttttttttttttacatgt

SEQ ID NO: 1129240 - DNA, 19 bp, Homo sapiens
ttaaaaaaaaattgtatct

SEQ ID NO: 1129241 - DNA, 14 bp, Homo sapiens
ttaaaaaaaacaaa

SEQ ID NO: 1129242 - DNA, 18 bp, Homo sapiens
ttaaaaaaaacaaaaaga

SEQ ID NO: 1129243 - DNA, 21 bp, Homo sapiens
ttaaaaaaaacaaaaagaaca

SEQ ID NO: 1129244 - DNA, 14 bp, Homo sapiens
ttaaaaaaatgaca

SEQ ID NO: 1129245 - DNA, 13 bp, Homo sapiens
ttaaaaaacaaaa

SEQ ID NO: 1129246 - DNA, 17 bp, Homo sapiens
ttaaaaaacaaatgttc

SEQ ID NO: 1129247 - DNA, 22 bp, Homo sapiens
ttaaaaaagaaatctgtttcaa

SEQ ID NO: 1129248 - DNA, 15 bp, Homo sapiens
ttaaaaaagagacat

SEQ ID NO: 1129249 - DNA, 20 bp, Homo sapiens
ttaaaaaatattttaagaaa

SEQ ID NO: 1129250 - DNA, 21 bp, Homo sapiens
ttaaaaaatattttaagaaag

SEQ ID NO: 1129251 - DNA, 23 bp, Homo sapiens
ttaaaaaatattttaagaaagag

SEQ ID NO: 1129252 - DNA, 16 bp, Homo sapiens
ttaaaaaatcaatcaa

SEQ ID NO: 1129253 - DNA, 12 bp, Homo sapiens
ttaaaaaatgtc

SEQ ID NO: 1129254 - DNA, 13 bp, Homo sapiens
ttaaaaaatgtga

SEQ ID NO: 1129255 - DNA, 21 bp, Homo sapiens
ttaaaaaatgtgaaatgcttt

SEQ ID NO: 1129256 - DNA, 14 bp, Homo sapiens
ttaaaaaatgtttc

SEQ ID NO: 1129257 - DNA, 13 bp, Homo sapiens
ttaaaaaattctc

SEQ ID NO: 1129258 - DNA, 17 bp, Homo sapiens
ttaaaaaatttttgaaa

SEQ ID NO: 1129259 - DNA, 13 bp, Homo sapiens
ttaaaaacaaaaa

SEQ ID NO: 1129260 - DNA, 12 bp, Homo sapiens
ttaaaaactctt

SEQ ID NO: 1129261 - DNA, 14 bp, Homo sapiens
ttaaaaactgagtg

SEQ ID NO: 1129262 - DNA, 18 bp, Homo sapiens
ttaaaaactttaaagata

SEQ ID NO: 1129263 - DNA, 14 bp, Homo sapiens
ttaaaaagaaatct

SEQ ID NO: 1129264 - DNA, 16 bp, Homo sapiens
ttaaaaagaatgacgt

SEQ ID NO: 1129265 - DNA, 12 bp, Homo sapiens
ttaaaaaggaaa

SEQ ID NO: 1129266 - DNA, 21 bp, Homo sapiens
ttaaaaaggaaatttgtttgt

SEQ ID NO: 1129267 - DNA, 16 bp, Homo sapiens
ttaaaaaggccaaaga

SEQ ID NO: 1129268 - DNA, 21 bp, Homo sapiens
ttaaaaagggaagaaactgct

SEQ ID NO: 1129269 - DNA, 23 bp, Homo sapiens
ttaaaaagggagaaagaaaactg

SEQ ID NO: 1129270 - DNA, 23 bp, Homo sapiens
ttaaaaagtccataccttatata

SEQ ID NO: 1129271 - DNA, 14 bp, Homo sapiens
ttaaaaagtgctat

SEQ ID NO: 1129272 - DNA, 11 bp, Homo sapiens
ttaaaaataaa

SEQ ID NO: 1129273 - DNA, 16 bp, Homo sapiens
ttaaaaataaaattac

SEQ ID NO: 1129274 - DNA, 20 bp, Homo sapiens
ttaaaaataaacaagcattt

SEQ ID NO: 1129275 - DNA, 21 bp, Homo sapiens
ttaaaaataagtcaacagtaa

SEQ ID NO: 1129276 - DNA, 20 bp, Homo sapiens
ttaaaaataatagagcccca

SEQ ID NO: 1129277 - DNA, 17 bp, Homo sapiens
ttaaatgattccaaata

SEQ ID NO: 1129278 - DNA, 17 bp, Homo sapiens
ttaaatgcacctggaat

SEQ ID NO: 1129279 - DNA, 15 bp, Homo sapiens
ttaaatgcatgtctt

SEQ ID NO: 1129280 - DNA, 20 bp, Homo sapiens
ttaaatgcatgtcttaaatg

SEQ ID NO: 1129281 - DNA, 12 bp, Homo sapiens
ttaaatgccaaa

SEQ ID NO: 1129282 - DNA, 20 bp, Homo sapiens
ttaaatgccaaaatgtactt

SEQ ID NO: 1129283 - DNA, 13 bp, Homo sapiens
ttaaatgccttgt

SEQ ID NO: 1129284 - DNA, 17 bp, Homo sapiens
ttaaatgccttgtataa

SEQ ID NO: 1129285 - DNA, 21 bp, Homo sapiens
ttaaatgggaatatttataaa

SEQ ID NO: 1129286 - DNA, 13 bp, Homo sapiens
ttaaatgtaaaga

SEQ ID NO: 1129287 - DNA, 14 bp, Homo sapiens
ttaaatgtaactta

SEQ ID NO: 1129288 - DNA, 19 bp, Homo sapiens
ttaaatgtacagacatatt

SEQ ID NO: 1129289 - DNA, 19 bp, Homo sapiens
ttaaatgtagcttcagtca

SEQ ID NO: 1129290 - DNA, 12 bp, Homo sapiens
ttaaatgtatac

SEQ ID NO: 1129291 - DNA, 14 bp, Homo sapiens
ttaaatgtatacta

SEQ ID NO: 1129292 - DNA, 12 bp, Homo sapiens
ttaaatgtgaat

SEQ ID NO: 1129293 - DNA, 17 bp, Homo sapiens
ttaaatgtgtacaatgt

SEQ ID NO: 1129294 - DNA, 19 bp, Homo sapiens
ttaaatgtttatactgtat

SEQ ID NO: 1129295 - DNA, 12 bp, Homo sapiens
ttaaattaaaca

SEQ ID NO: 1129296 - DNA, 14 bp, Homo sapiens
ttaaattaaacaat

SEQ ID NO: 1129297 - DNA, 19 bp, Homo sapiens
ttaaattaaacaatttatt

SEQ ID NO: 1129298 - DNA, 11 bp, Homo sapiens
ttaaattaata

SEQ ID NO: 1129299 - DNA, 15 bp, Homo sapiens
ttaaattacaatttt

SEQ ID NO: 1129300 - DNA, 14 bp, Homo sapiens
ttaaattagaaaat

SEQ ID NO: 1129301 - DNA, 14 bp, Homo sapiens
ttaaattattgctt

SEQ ID NO: 1129302 - DNA, 22 bp, Homo sapiens
ttaaattcatttctagactcaa

SEQ ID NO: 1129303 - DNA, 16 bp, Homo sapiens
ttaaattccactgaaa

SEQ ID NO: 1129304 - DNA, 19 bp, Homo sapiens
ttaaattccactgaaaatt

SEQ ID NO: 1129305 - DNA, 16 bp, Homo sapiens
ttaaattcttgcaaag

SEQ ID NO: 1129306 - DNA, 20 bp, Homo sapiens
ttaaattcttgcaaagtatc

SEQ ID NO: 1129307 - DNA, 22 bp, Homo sapiens
ttaaattgtcagatcgttcatt

SEQ ID NO: 1129308 - DNA, 13 bp, Homo sapiens
ttaaattgtttca

SEQ ID NO: 1129309 - DNA, 23 bp, Homo sapiens
ttaaattgtttcatatctggtca

SEQ ID NO: 1129310 - DNA, 14 bp, Homo sapiens
ttaaatttcaaatg

SEQ ID NO: 1129311 - DNA, 19 bp, Homo sapiens
ttaaatttcaaatgcagaa

SEQ ID NO: 1129312 - DNA, 14 bp, Homo sapiens
ttaaatttcttatg

SEQ ID NO: 1129313 - DNA, 17 bp, Homo sapiens
ttaaatttcttatgtga

SEQ ID NO: 1129314 - DNA, 22 bp, Homo sapiens
ttaaatttcttggcaaatttta

SEQ ID NO: 1129315 - DNA, 12 bp, Homo sapiens
ttaaatttgaat

SEQ ID NO: 1129316 - DNA, 16 bp, Homo sapiens
ttaaattttaatttat

SEQ ID NO: 1129317 - DNA, 19 bp, Homo sapiens
ttaaattttgtaggatttt

SEQ ID NO: 1129318 - DNA, 19 bp, Homo sapiens
ttaaatttttgtcatttta

SEQ ID NO: 1129319 - DNA, 19 bp, Homo sapiens
ttaacaaaccaacatcttt

SEQ ID NO: 1129320 - DNA, 21 bp, Homo sapiens
ttaacaacaataacactgtct

SEQ ID NO: 1129321 - DNA, 18 bp, Homo sapiens
ttaacaactgctcttact

SEQ ID NO: 1129322 - DNA, 15 bp, Homo sapiens
ttaacaactgggtca

SEQ ID NO: 1129323 - DNA, 21 bp, Homo sapiens
ttaacaaggaatgcctgtgcc

SEQ ID NO: 1129324 - DNA, 20 bp, Homo sapiens
ttaacaataactactgtgtt

SEQ ID NO: 1129325 - DNA, 21 bp, Homo sapiens
ttaacaataactactgtgttc

SEQ ID NO: 1129326 - DNA, 20 bp, Homo sapiens
ttaacaatgcctattgtaat

SEQ ID NO: 1129327 - DNA, 15 bp, Homo sapiens
ttaacaattgtctta

SEQ ID NO: 1129328 - DNA, 12 bp, Homo sapiens
ttaacacactac

SEQ ID NO: 1129329 - DNA, 13 bp, Homo sapiens
ttaacacattctt

SEQ ID NO: 1129330 - DNA, 16 bp, Homo sapiens
ttaacaccttcatcca

SEQ ID NO: 1129331 - DNA, 15 bp, Homo sapiens
ttaacacttaaattt

SEQ ID NO: 1129332 - DNA, 19 bp, Homo sapiens
ttaacacttaaatttcttg

SEQ ID NO: 1129333 - DNA, 17 bp, Homo sapiens
ttaacagaaactttcaa

SEQ ID NO: 1129334 - DNA, 21 bp, Homo sapiens
ttaacagcatgctgctttgcc

SEQ ID NO: 1129335 - DNA, 13 bp, Homo sapiens
ttaacagttttcc

SEQ ID NO: 1129336 - DNA, 17 bp, Homo sapiens
ttaacagttttccatga

SEQ ID NO: 1129337 - DNA, 23 bp, Homo sapiens
ttaacataatggttgtgaaatgt

SEQ ID NO: 1129338 - DNA, 20 bp, Homo sapiens
ttaacatacaagaaaatgta

SEQ ID NO: 1129339 - DNA, 17 bp, Homo sapiens
ttaacatacctaagaag

SEQ ID NO: 1129340 - DNA, 13 bp, Homo sapiens
ttaacatatatat

SEQ ID NO: 1129341 - DNA, 17 bp, Homo sapiens
ttaacatatttactaag

SEQ ID NO: 1129342 - DNA, 16 bp, Homo sapiens
ttaacatcatcacttt

SEQ ID NO: 1129343 - DNA, 22 bp, Homo sapiens
ttaacatctagcctaaagtata

SEQ ID NO: 1129344 - DNA, 19 bp, Homo sapiens
ttaacatctttgtttttaa

SEQ ID NO: 1129345 - DNA, 15 bp, Homo sapiens
ttaacatgatttcaa

SEQ ID NO: 1129346 - DNA, 22 bp, Homo sapiens
ttaacatgggctcttcactagt

SEQ ID NO: 1129347 - DNA, 22 bp, Homo sapiens
ttaacattaggaccttagaatt

SEQ ID NO: 1129348 - DNA, 23 bp, Homo sapiens
ttaacattaggaccttagaattt

SEQ ID NO: 1129349 - DNA, 13 bp, Homo sapiens
ttaacattattta

SEQ ID NO: 1129350 - DNA, 15 bp, Homo sapiens
ttaacattcacagcc

SEQ ID NO: 1129351 - DNA, 19 bp, Homo sapiens
ttaacattcacagcccaga

SEQ ID NO: 1129352 - DNA, 15 bp, Homo sapiens
ttaacattcatagag

SEQ ID NO: 1129353 - DNA, 14 bp, Homo sapiens
ttaacattgaccaa

SEQ ID NO: 1129354 - DNA, 22 bp, Homo sapiens
ttaacattgaccaagaactgca

SEQ ID NO: 1129355 - DNA, 23 bp, Homo sapiens
ttaacattgaccaagaactgcat

SEQ ID NO: 1129356 - DNA, 17 bp, Homo sapiens
ttaacatttcattgtac

SEQ ID NO: 1129357 - DNA, 19 bp, Homo sapiens
ttaacatttcattgtacaa

SEQ ID NO: 1129358 - DNA, 13 bp, Homo sapiens
ttaacatttgcct

SEQ ID NO: 1129359 - DNA, 20 bp, Homo sapiens
ttaaccaccgcatatgcatg

SEQ ID NO: 1129360 - DNA, 22 bp, Homo sapiens
ttaaccaccgcatatgcatgcc

SEQ ID NO: 1129361 - DNA, 13 bp, Homo sapiens
ttaaccagaataa

SEQ ID NO: 1129362 - DNA, 14 bp, Homo sapiens
ttaaccatttaata

SEQ ID NO: 1129363 - DNA, 19 bp, Homo sapiens
ttaaccatttaataaagaa

SEQ ID NO: 1129364 - DNA, 22 bp, Homo sapiens
ttaaccatttaataaagaaata

SEQ ID NO: 1129365 - DNA, 13 bp, Homo sapiens
ttaacccaaggag

SEQ ID NO: 1129366 - DNA, 17 bp, Homo sapiens
ttaaccccatgtcctca

SEQ ID NO: 1129367 - DNA, 14 bp, Homo sapiens
ttaacccccctgta

SEQ ID NO: 1129368 - DNA, 17 bp, Homo sapiens
ttaacccccctgtacac

SEQ ID NO: 1129369 - DNA, 21 bp, Homo sapiens
ttaaccctagaaggtggggac

SEQ ID NO: 1129370 - DNA, 13 bp, Homo sapiens
ttaaccctctctt

SEQ ID NO: 1129371 - DNA, 16 bp, Homo sapiens
ttaaccctctcttccc

SEQ ID NO: 1129372 - DNA, 17 bp, Homo sapiens
ttaaccctctcttccct

SEQ ID NO: 1129373 - DNA, 17 bp, Homo sapiens
ttaacctagatgtttaa

SEQ ID NO: 1129374 - DNA, 20 bp, Homo sapiens
ttaacctatgatattttctg

SEQ ID NO: 1129375 - DNA, 21 bp, Homo sapiens
ttaacctatgatattttctgt

SEQ ID NO: 1129376 - DNA, 17 bp, Homo sapiens
ttaacctggtgctggat

SEQ ID NO: 1129377 - DNA, 14 bp, Homo sapiens
ttaacctttgctat

SEQ ID NO: 1129378 - DNA, 21 bp, Homo sapiens
ttaacctttgctatgtaaggg

SEQ ID NO: 1129379 - DNA, 12 bp, Homo sapiens
ttaacctttttt

SEQ ID NO: 1129380 - DNA, 16 bp, Homo sapiens
ttaaccttttttgtct

SEQ ID NO: 1129381 - DNA, 18 bp, Homo sapiens
ttaacgatgtccaacccg

SEQ ID NO: 1129382 - DNA, 19 bp, Homo sapiens
ttaacggctccaggatttt

SEQ ID NO: 1129383 - DNA, 20 bp, Homo sapiens
ttaactaaaattgttctctt

SEQ ID NO: 1129384 - DNA, 17 bp, Homo sapiens
ttaactaaataaacaga

SEQ ID NO: 1129385 - DNA, 20 bp, Homo sapiens
ttaactaaataaacagatgt

SEQ ID NO: 1129386 - DNA, 14 bp, Homo sapiens
ttaactaaatgctc

SEQ ID NO: 1129387 - DNA, 18 bp, Homo sapiens
ttaactaaattttaaagc

SEQ ID NO: 1129388 - DNA, 17 bp, Homo sapiens
ttaactacatctgcctc

SEQ ID NO: 1129389 - DNA, 12 bp, Homo sapiens
ttaactagaatt

SEQ ID NO: 1129390 - DNA, 17 bp, Homo sapiens
ttaactataaggtgcct

SEQ ID NO: 1129391 - DNA, 21 bp, Homo sapiens
ttaactattgcatttatatgt

SEQ ID NO: 1129392 - DNA, 12 bp, Homo sapiens
ttaactccctcc

SEQ ID NO: 1129393 - DNA, 20 bp, Homo sapiens
ttaactccctccaccagcct

SEQ ID NO: 1129394 - DNA, 22 bp, Homo sapiens
ttaactccctccaccagcctgc

SEQ ID NO: 1129395 - DNA, 20 bp, Homo sapiens
ttaactctaaccctgtggaa

SEQ ID NO: 1129396 - DNA, 15 bp, Homo sapiens
ttaactctctttatg

SEQ ID NO: 1129397 - DNA, 19 bp, Homo sapiens
ttaactctctttatgtctg

SEQ ID NO: 1129398 - DNA, 11 bp, Homo sapiens
ttaactgaaga

SEQ ID NO: 1129399 - DNA, 11 bp, Homo sapiens
ttaagtattta

SEQ ID NO: 1129400 - DNA, 13 bp, Homo sapiens
ttaagtcagaaca

SEQ ID NO: 1129401 - DNA, 19 bp, Homo sapiens
ttaagtcagtggctttgca

SEQ ID NO: 1129402 - DNA, 21 bp, Homo sapiens
ttaagtcattttgtaatattt

SEQ ID NO: 1129403 - DNA, 16 bp, Homo sapiens
ttaagtgcaacatttc

SEQ ID NO: 1129404 - DNA, 23 bp, Homo sapiens
ttaagtgccattactactgtaca

SEQ ID NO: 1129405 - DNA, 12 bp, Homo sapiens
ttaagtgcttac

SEQ ID NO: 1129406 - DNA, 19 bp, Homo sapiens
ttaagtgcttcacatttgt

SEQ ID NO: 1129407 - DNA, 20 bp, Homo sapiens
ttaagtggggttgataacac

SEQ ID NO: 1129408 - DNA, 20 bp, Homo sapiens
ttaagtggtctagtcaagga

SEQ ID NO: 1129409 - DNA, 15 bp, Homo sapiens
ttaagtgtaaatgaa

SEQ ID NO: 1129410 - DNA, 19 bp, Homo sapiens
ttaagtgtaaatgaagtac

SEQ ID NO: 1129411 - DNA, 20 bp, Homo sapiens
ttaagtgttggaaaaaattt

SEQ ID NO: 1129412 - DNA, 20 bp, Homo sapiens
ttaagttagttccactgaga

SEQ ID NO: 1129413 - DNA, 20 bp, Homo sapiens
ttaagttctttgatttgtac

SEQ ID NO: 1129414 - DNA, 21 bp, Homo sapiens
ttaagttctttgatttgtacc

SEQ ID NO: 1129415 - DNA, 21 bp, Homo sapiens
ttaagttgagatagttttcat

SEQ ID NO: 1129416 - DNA, 23 bp, Homo sapiens
ttaagttgagatagttttcatcc

SEQ ID NO: 1129417 - DNA, 13 bp, Homo sapiens
ttaagttgtcaaa

SEQ ID NO: 1129418 - DNA, 15 bp, Homo sapiens
ttaagtttcaaactt

SEQ ID NO: 1129419 - DNA, 16 bp, Homo sapiens
ttaagtttcaaactta

SEQ ID NO: 1129420 - DNA, 13 bp, Homo sapiens
ttaataaaaagac

SEQ ID NO: 1129421 - DNA, 20 bp, Homo sapiens
ttaataaaactgcgaggaca

SEQ ID NO: 1129422 - DNA, 12 bp, Homo sapiens
ttaataaaagaa

SEQ ID NO: 1129423 - DNA, 15 bp, Homo sapiens
ttaataaagaaaaag

SEQ ID NO: 1129424 - DNA, 14 bp, Homo sapiens
ttaataaagaaata

SEQ ID NO: 1129425 - DNA, 23 bp, Homo sapiens
ttaataaagaaatatttacctaa

SEQ ID NO: 1129426 - DNA, 13 bp, Homo sapiens
ttaataaagacag

SEQ ID NO: 1129427 - DNA, 20 bp, Homo sapiens
ttaataaaggccacaggaga

SEQ ID NO: 1129428 - DNA, 21 bp, Homo sapiens
ttaataaaggccacaggagac

SEQ ID NO: 1129429 - DNA, 21 bp, Homo sapiens
ttaataaaggtcttaaataat

SEQ ID NO: 1129430 - DNA, 15 bp, Homo sapiens
ttaataaattgctta

SEQ ID NO: 1129431 - DNA, 14 bp, Homo sapiens
ttaataacagctcc

SEQ ID NO: 1129432 - DNA, 13 bp, Homo sapiens
ttaataagaacag

SEQ ID NO: 1129433 - DNA, 15 bp, Homo sapiens
ttaataagaacagat

SEQ ID NO: 1129434 - DNA, 13 bp, Homo sapiens
ttaataatgtatt

SEQ ID NO: 1129435 - DNA, 14 bp, Homo sapiens
ttaataatgtattg

SEQ ID NO: 1129436 - DNA, 19 bp, Homo sapiens
ttaataatttttgctgaat

SEQ ID NO: 1129437 - DNA, 16 bp, Homo sapiens
ttaatacacagtactt

SEQ ID NO: 1129438 - DNA, 14 bp, Homo sapiens
ttaatacaggaaat

SEQ ID NO: 1129439 - DNA, 17 bp, Homo sapiens
ttaatacaggaaattga

SEQ ID NO: 1129440 - DNA, 15 bp, Homo sapiens
ttaataccaaatatt

SEQ ID NO: 1129441 - DNA, 17 bp, Homo sapiens
ttaatactaccttgaaa

SEQ ID NO: 1129442 - DNA, 19 bp, Homo sapiens
ttaatactataaataatat

SEQ ID NO: 1129443 - DNA, 12 bp, Homo sapiens
ttaatagagttg

SEQ ID NO: 1129444 - DNA, 16 bp, Homo sapiens
ttaatagagttggagt

SEQ ID NO: 1129445 - DNA, 17 bp, Homo sapiens
ttaatagagttggagtt

SEQ ID NO: 1129446 - DNA, 15 bp, Homo sapiens
ttaatagcaaagaat

SEQ ID NO: 1129447 - DNA, 16 bp, Homo sapiens
ttaatagcagcctttc

SEQ ID NO: 1129448 - DNA, 20 bp, Homo sapiens
ttaatagcttttattgtata

SEQ ID NO: 1129449 - DNA, 17 bp, Homo sapiens
ttaatagggaatatatc

SEQ ID NO: 1129450 - DNA, 15 bp, Homo sapiens
ttaatagtaatttgt

SEQ ID NO: 1129451 - DNA, 18 bp, Homo sapiens
ttaatagtaatttgtaaa

SEQ ID NO: 1129452 - DNA, 19 bp, Homo sapiens
ttaatagtaatttgtaaag

SEQ ID NO: 1129453 - DNA, 23 bp, Homo sapiens
ttaatagtcatcacatttctatg

SEQ ID NO: 1129454 - DNA, 15 bp, Homo sapiens
ttaatagtcattcca

SEQ ID NO: 1129455 - DNA, 16 bp, Homo sapiens
ttaatatatacatttt

SEQ ID NO: 1129456 - DNA, 21 bp, Homo sapiens
ttaatatatagtccagacact

SEQ ID NO: 1129457 - DNA, 20 bp, Homo sapiens
ttaatatatcccagaaatta

SEQ ID NO: 1129458 - DNA, 20 bp, Homo sapiens
ttaatatattaaaattccaa

SEQ ID NO: 1129459 - DNA, 21 bp, Homo sapiens
ttaatatcactaatttcttct

SEQ ID NO: 1129460 - DNA, 17 bp, Homo sapiens
ttaatatcctaaacatc

SEQ ID NO: 1129461 - DNA, 19 bp, Homo sapiens
ttaatatctggcactgtta

SEQ ID NO: 1129462 - DNA, 20 bp, Homo sapiens
ttaatatctggcactgttaa

SEQ ID NO: 1129463 - DNA, 16 bp, Homo sapiens
ttaatatctttctgca

SEQ ID NO: 1129464 - DNA, 17 bp, Homo sapiens
ttaatatgaaaacttat

SEQ ID NO: 1129465 - DNA, 19 bp, Homo sapiens
ttaatatgagcttcaatat

SEQ ID NO: 1129466 - DNA, 12 bp, Homo sapiens
ttaatatgagtt

SEQ ID NO: 1129467 - DNA, 22 bp, Homo sapiens
ttaatatgattctagtacataa

SEQ ID NO: 1129468 - DNA, 20 bp, Homo sapiens
ttaatatgctgcaacaaaat

SEQ ID NO: 1129469 - DNA, 23 bp, Homo sapiens
ttaatatgttaacctcagtgtca

SEQ ID NO: 1129470 - DNA, 15 bp, Homo sapiens
ttaatattctattaa

SEQ ID NO: 1129471 - DNA, 12 bp, Homo sapiens
ttaatatttaaa

SEQ ID NO: 1129472 - DNA, 16 bp, Homo sapiens
ttaatatttaaacagc

SEQ ID NO: 1129473 - DNA, 17 bp, Homo sapiens
ttaatatttaaacagca

SEQ ID NO: 1129474 - DNA, 12 bp, Homo sapiens
ttaatatttaac

SEQ ID NO: 1129475 - DNA, 20 bp, Homo sapiens
ttaatatttgctgacagctg

SEQ ID NO: 1129476 - DNA, 23 bp, Homo sapiens
ttaatattttgtaatattctgtt

SEQ ID NO: 1129477 - DNA, 15 bp, Homo sapiens
ttaatattttgtatt

SEQ ID NO: 1129478 - DNA, 19 bp, Homo sapiens
ttaatattttttcttttcc

SEQ ID NO: 1129479 - DNA, 19 bp, Homo sapiens
ttaatcaaaggcatatctt

SEQ ID NO: 1129480 - DNA, 16 bp, Homo sapiens
ttaatcaacagaagta

SEQ ID NO: 1129481 - DNA, 13 bp, Homo sapiens
ttaatcaactgta

SEQ ID NO: 1129482 - DNA, 14 bp, Homo sapiens
ttaatcactactgt

SEQ ID NO: 1129483 - DNA, 22 bp, Homo sapiens
ttaatcagttcattagaaatat

SEQ ID NO: 1129484 - DNA, 15 bp, Homo sapiens
ttaatcatctataaa

SEQ ID NO: 1129485 - DNA, 21 bp, Homo sapiens
ttaatcatctataaagaagaa

SEQ ID NO: 1129486 - DNA, 18 bp, Homo sapiens
ttaatcatgaatatgatg

SEQ ID NO: 1129487 - DNA, 15 bp, Homo sapiens
ttaatcccctgcact

SEQ ID NO: 1129488 - DNA, 22 bp, Homo sapiens
ttaatcccctgcactaggcagg

SEQ ID NO: 1129489 - DNA, 14 bp, Homo sapiens
ttaatccttctagt

SEQ ID NO: 1129490 - DNA, 20 bp, Homo sapiens
ttaatccttctagtttccca

SEQ ID NO: 1129491 - DNA, 18 bp, Homo sapiens
ttaatcgtcaaccacttt

SEQ ID NO: 1129492 - DNA, 15 bp, Homo sapiens
ttaatctaaaatgat

SEQ ID NO: 1129493 - DNA, 17 bp, Homo sapiens
ttaatctctaacagtgg

SEQ ID NO: 1129494 - DNA, 23 bp, Homo sapiens
ttaatctctgtgtgttttctttg

SEQ ID NO: 1129495 - DNA, 13 bp, Homo sapiens
ttaatctggacac

SEQ ID NO: 1129496 - DNA, 22 bp, Homo sapiens
ttaatctggtttatttttgttc

SEQ ID NO: 1129497 - DNA, 13 bp, Homo sapiens
ttaatctgtgtgt

SEQ ID NO: 1129498 - DNA, 17 bp, Homo sapiens
ttaatcttaatgtatat

SEQ ID NO: 1129499 - DNA, 16 bp, Homo sapiens
ttaatcttagtgtatg

SEQ ID NO: 1129500 - DNA, 14 bp, Homo sapiens
ttaatcttgctttc

SEQ ID NO: 1129501 - DNA, 15 bp, Homo sapiens
ttaatcttgtgtagt

SEQ ID NO: 1129502 - DNA, 20 bp, Homo sapiens
ttaatctttctacctctttt

SEQ ID NO: 1129503 - DNA, 24 bp, Homo sapiens
ttaatctttctttacctgagacca

SEQ ID NO: 1129504 - DNA, 16 bp, Homo sapiens
ttaatgaaaaggaatc

SEQ ID NO: 1129505 - DNA, 18 bp, Homo sapiens
ttaatgaaagactgtaca

SEQ ID NO: 1129506 - DNA, 15 bp, Homo sapiens
ttaatgaaccttaga

SEQ ID NO: 1129507 - DNA, 18 bp, Homo sapiens
ttaatgaagaaagtggaa

SEQ ID NO: 1129508 - DNA, 23 bp, Homo sapiens
ttaatgaagaaagtggaaaacaa

SEQ ID NO: 1129509 - DNA, 22 bp, Homo sapiens
ttaatgaatatcaggctattat

SEQ ID NO: 1129510 - DNA, 22 bp, Homo sapiens
ttaatgaatattgatgttaaca

SEQ ID NO: 1129511 - DNA, 21 bp, Homo sapiens
ttaatgaatttaaggcaaaaa

SEQ ID NO: 1129512 - DNA, 19 bp, Homo sapiens
ttaatgacaacacttaata

SEQ ID NO: 1129513 - DNA, 22 bp, Homo sapiens
ttaatgacaacacttaatagca

SEQ ID NO: 1129514 - DNA, 16 bp, Homo sapiens
ttaatgactctttctg

SEQ ID NO: 1129515 - DNA, 18 bp, Homo sapiens
ttaatgagactttaaaag

SEQ ID NO: 1129516 - DNA, 17 bp, Homo sapiens
ttaatgataaactcaga

SEQ ID NO: 1129517 - DNA, 22 bp, Homo sapiens
ttaatgataaactcagatctga

SEQ ID NO: 1129518 - DNA, 23 bp, Homo sapiens
ttaatgataaactcagatctgat

SEQ ID NO: 1129519 - DNA, 21 bp, Homo sapiens
ttaatgatctcggatgaccaa

SEQ ID NO: 1129520 - DNA, 14 bp, Homo sapiens
ttacaaatgaggaa

SEQ ID NO: 1129521 - DNA, 11 bp, Homo sapiens
ttacaaatgtt

SEQ ID NO: 1129522 - DNA, 15 bp, Homo sapiens
ttacaacattcaact

SEQ ID NO: 1129523 - DNA, 18 bp, Homo sapiens
ttacaaccattgtatttt

SEQ ID NO: 1129524 - DNA, 14 bp, Homo sapiens
ttacaactaaataa

SEQ ID NO: 1129525 - DNA, 19 bp, Homo sapiens
ttacaactgaccaagtttc

SEQ ID NO: 1129526 - DNA, 18 bp, Homo sapiens
ttacaagaagtttattct

SEQ ID NO: 1129527 - DNA, 20 bp, Homo sapiens
ttacaagggcataaagtaaa

SEQ ID NO: 1129528 - DNA, 19 bp, Homo sapiens
ttacaagtggctccccacc

SEQ ID NO: 1129529 - DNA, 15 bp, Homo sapiens
ttacaagttatagta

SEQ ID NO: 1129530 - DNA, 23 bp, Homo sapiens
ttacaataaaatcttgaaaatgc

SEQ ID NO: 1129531 - DNA, 20 bp, Homo sapiens
ttacaataggtgcttattct

SEQ ID NO: 1129532 - DNA, 14 bp, Homo sapiens
ttacaatcaaatct

SEQ ID NO: 1129533 - DNA, 16 bp, Homo sapiens
ttacaatcaaatctcc

SEQ ID NO: 1129534 - DNA, 16 bp, Homo sapiens
ttacaatgtatcttta

SEQ ID NO: 1129535 - DNA, 14 bp, Homo sapiens
ttacaatgtattaa

SEQ ID NO: 1129536 - DNA, 14 bp, Homo sapiens
ttacaatgttttat

SEQ ID NO: 1129537 - DNA, 15 bp, Homo sapiens
ttacaattgaaatga

SEQ ID NO: 1129538 - DNA, 17 bp, Homo sapiens
ttacaattgaaatgact

SEQ ID NO: 1129539 - DNA, 16 bp, Homo sapiens
ttacaatttacaaagt

SEQ ID NO: 1129540 - DNA, 13 bp, Homo sapiens
ttacaatttgcac

SEQ ID NO: 1129541 - DNA, 18 bp, Homo sapiens
ttacaatttgcacaatat

SEQ ID NO: 1129542 - DNA, 18 bp, Homo sapiens
ttacaattttttatcatg

SEQ ID NO: 1129543 - DNA, 15 bp, Homo sapiens
ttacacaattaattc

SEQ ID NO: 1129544 - DNA, 18 bp, Homo sapiens
ttacacagaaatgctgct

SEQ ID NO: 1129545 - DNA, 20 bp, Homo sapiens
ttacacagaaatgctgctgg

SEQ ID NO: 1129546 - DNA, 16 bp, Homo sapiens
ttacacagcccaagag

SEQ ID NO: 1129547 - DNA, 15 bp, Homo sapiens
ttacacatttttcag

SEQ ID NO: 1129548 - DNA, 16 bp, Homo sapiens
ttacaccaactcctaa

SEQ ID NO: 1129549 - DNA, 18 bp, Homo sapiens
ttacaccgactagccagg

SEQ ID NO: 1129550 - DNA, 15 bp, Homo sapiens
ttacacgagatttct

SEQ ID NO: 1129551 - DNA, 14 bp, Homo sapiens
ttacacgcttttgt

SEQ ID NO: 1129552 - DNA, 21 bp, Homo sapiens
ttacactaatatatggaccta

SEQ ID NO: 1129553 - DNA, 22 bp, Homo sapiens
ttacactatgataaagttgtaa

SEQ ID NO: 1129554 - DNA, 14 bp, Homo sapiens
ttacactattgtga

SEQ ID NO: 1129555 - DNA, 14 bp, Homo sapiens
ttacactctttgta

SEQ ID NO: 1129556 - DNA, 15 bp, Homo sapiens
ttacactctttgtaa

SEQ ID NO: 1129557 - DNA, 14 bp, Homo sapiens
ttacactgccatct

SEQ ID NO: 1129558 - DNA, 21 bp, Homo sapiens
ttacactggaggagagaagaa

SEQ ID NO: 1129559 - DNA, 22 bp, Homo sapiens
ttacactggaggagagaagaat

SEQ ID NO: 1129560 - DNA, 18 bp, Homo sapiens
ttacactggtctaatgtt

SEQ ID NO: 1129561 - DNA, 15 bp, Homo sapiens
ttacagaaaaatctt

SEQ ID NO: 1129562 - DNA, 12 bp, Homo sapiens
ttacagaaatga

SEQ ID NO: 1129563 - DNA, 22 bp, Homo sapiens
ttacagaaatgtttttaacact

SEQ ID NO: 1129564 - DNA, 22 bp, Homo sapiens
ttacagaagagtaaactggtga

SEQ ID NO: 1129565 - DNA, 15 bp, Homo sapiens
ttacagaatgcatta

SEQ ID NO: 1129566 - DNA, 18 bp, Homo sapiens
ttacagagaggatacatt

SEQ ID NO: 1129567 - DNA, 21 bp, Homo sapiens
ttacagagaggatacatttaa

SEQ ID NO: 1129568 - DNA, 18 bp, Homo sapiens
ttacagatgtttttaatt

SEQ ID NO: 1129569 - DNA, 16 bp, Homo sapiens
ttacagattgcctcct

SEQ ID NO: 1129570 - DNA, 17 bp, Homo sapiens
ttacagcctcacttgaa

SEQ ID NO: 1129571 - DNA, 13 bp, Homo sapiens
ttacagctgcctg

SEQ ID NO: 1129572 - DNA, 14 bp, Homo sapiens
ttacagctgcctgc

SEQ ID NO: 1129573 - DNA, 21 bp, Homo sapiens
ttacaggaaaaaaaattctgt

SEQ ID NO: 1129574 - DNA, 17 bp, Homo sapiens
ttacaggcaccgagaat

SEQ ID NO: 1129575 - DNA, 16 bp, Homo sapiens
ttacaggcatgtgcca

SEQ ID NO: 1129576 - DNA, 11 bp, Homo sapiens
ttacaggccct

SEQ ID NO: 1129577 - DNA, 17 bp, Homo sapiens
ttacaggccctgctcct

SEQ ID NO: 1129578 - DNA, 22 bp, Homo sapiens
ttacaggccctgctcctgcagc

SEQ ID NO: 1129579 - DNA, 18 bp, Homo sapiens
ttacagggagctgggaca

SEQ ID NO: 1129580 - DNA, 20 bp, Homo sapiens
ttacagggatgagccaccgc

SEQ ID NO: 1129581 - DNA, 22 bp, Homo sapiens
ttacagtaaagtatagaaatat

SEQ ID NO: 1129582 - DNA, 14 bp, Homo sapiens
ttacagtaatgtca

SEQ ID NO: 1129583 - DNA, 18 bp, Homo sapiens
ttacagtaatgtcataaa

SEQ ID NO: 1129584 - DNA, 17 bp, Homo sapiens
ttacagtaggagcccag

SEQ ID NO: 1129585 - DNA, 17 bp, Homo sapiens
ttacagtatgatgaaaa

SEQ ID NO: 1129586 - DNA, 22 bp, Homo sapiens
ttacagtcattggaataaggca

SEQ ID NO: 1129587 - DNA, 14 bp, Homo sapiens
ttacagtgaagaaa

SEQ ID NO: 1129588 - DNA, 12 bp, Homo sapiens
ttacagtgttta

SEQ ID NO: 1129589 - DNA, 22 bp, Homo sapiens
ttacagttagggttttgcaata

SEQ ID NO: 1129590 - DNA, 11 bp, Homo sapiens
ttacagttctg

SEQ ID NO: 1129591 - DNA, 12 bp, Homo sapiens
ttacagttctgt

SEQ ID NO: 1129592 - DNA, 13 bp, Homo sapiens
ttacagttctgtg

SEQ ID NO: 1129593 - DNA, 14 bp, Homo sapiens
ttacagttctttcc

SEQ ID NO: 1129594 - DNA, 14 bp, Homo sapiens
ttacagtttgtgtt

SEQ ID NO: 1129595 - DNA, 15 bp, Homo sapiens
ttacataaagactgt

SEQ ID NO: 1129596 - DNA, 17 bp, Homo sapiens
ttacataaagctccctt

SEQ ID NO: 1129597 - DNA, 17 bp, Homo sapiens
ttacataatcaaagcta

SEQ ID NO: 1129598 - DNA, 16 bp, Homo sapiens
ttacatactttatcaa

SEQ ID NO: 1129599 - DNA, 24 bp, Homo sapiens
ttacatactttatcaatgtgtctt

SEQ ID NO: 1129600 - DNA, 17 bp, Homo sapiens
ttacatagaacacttca

SEQ ID NO: 1129601 - DNA, 18 bp, Homo sapiens
ttacatagatcagccatt

SEQ ID NO: 1129602 - DNA, 19 bp, Homo sapiens
ttacatagatcagccatta

SEQ ID NO: 1129603 - DNA, 23 bp, Homo sapiens
ttacatagatcagccattaaaat

SEQ ID NO: 1129604 - DNA, 20 bp, Homo sapiens
ttacatagtgcaaaactgtg

SEQ ID NO: 1129605 - DNA, 17 bp, Homo sapiens
ttacatcactttgtgaa

SEQ ID NO: 1129606 - DNA, 23 bp, Homo sapiens
ttacatcactttgtgaattaaca

SEQ ID NO: 1129607 - DNA, 17 bp, Homo sapiens
ttacatcagtagcattt

SEQ ID NO: 1129608 - DNA, 17 bp, Homo sapiens
ttacatcctctgatagc

SEQ ID NO: 1129609 - DNA, 16 bp, Homo sapiens
ttacatctaatgcttc

SEQ ID NO: 1129610 - DNA, 14 bp, Homo sapiens
ttacatctgtttta

SEQ ID NO: 1129611 - DNA, 14 bp, Homo sapiens
ttacatcttttcta

SEQ ID NO: 1129612 - DNA, 16 bp, Homo sapiens
ttacatcttttctaat

SEQ ID NO: 1129613 - DNA, 23 bp, Homo sapiens
ttacatgactgtttcttttgtaa

SEQ ID NO: 1129614 - DNA, 23 bp, Homo sapiens
ttacatgcaatttattaaaatga

SEQ ID NO: 1129615 - DNA, 16 bp, Homo sapiens
ttacatggctgtggtt

SEQ ID NO: 1129616 - DNA, 17 bp, Homo sapiens
ttacatgtttaaattgt

SEQ ID NO: 1129617 - DNA, 14 bp, Homo sapiens
ttacatgtttgcac

SEQ ID NO: 1129618 - DNA, 14 bp, Homo sapiens
ttacattaatgtta

SEQ ID NO: 1129619 - DNA, 16 bp, Homo sapiens
ttacattaatgttaat

SEQ ID NO: 1129620 - DNA, 17 bp, Homo sapiens
ttacattatgcaaataa

SEQ ID NO: 1129621 - DNA, 19 bp, Homo sapiens
ttacattattatcaacaat

SEQ ID NO: 1129622 - DNA, 22 bp, Homo sapiens
ttacattcaacttttctaagaa

SEQ ID NO: 1129623 - DNA, 14 bp, Homo sapiens
ttacattcagaaat

SEQ ID NO: 1129624 - DNA, 20 bp, Homo sapiens
ttacattcctaactagaatt

SEQ ID NO: 1129625 - DNA, 15 bp, Homo sapiens
ttacattgtcctgta

SEQ ID NO: 1129626 - DNA, 19 bp, Homo sapiens
ttacatttacaaactgaag

SEQ ID NO: 1129627 - DNA, 20 bp, Homo sapiens
ttacatttacaaactgaaga

SEQ ID NO: 1129628 - DNA, 11 bp, Homo sapiens
ttacattttaa

SEQ ID NO: 1129629 - DNA, 15 bp, Homo sapiens
ttacattttacacac

SEQ ID NO: 1129630 - DNA, 17 bp, Homo sapiens
ttacatttttaaaggta

SEQ ID NO: 1129631 - DNA, 13 bp, Homo sapiens
ttacatttttaca

SEQ ID NO: 1129632 - DNA, 15 bp, Homo sapiens
ttacatttttacaat

SEQ ID NO: 1129633 - DNA, 21 bp, Homo sapiens
ttacattttttgggcagcaat

SEQ ID NO: 1129634 - DNA, 17 bp, Homo sapiens
ttaccaaaaaccatgtt

SEQ ID NO: 1129635 - DNA, 21 bp, Homo sapiens
ttaccaaaaataaatatatct

SEQ ID NO: 1129636 - DNA, 20 bp, Homo sapiens
ttaccaacctgttacctact

SEQ ID NO: 1129637 - DNA, 15 bp, Homo sapiens
ttaccaactttctgt

SEQ ID NO: 1129638 - DNA, 16 bp, Homo sapiens
ttaccaactttctgta

SEQ ID NO: 1129639 - DNA, 17 bp, Homo sapiens
ttaccaagagtaacttt

SEQ ID NO: 1129640 - DNA, 22 bp, Homo sapiens
ttaccaagtatgaagtataaat

SEQ ID NO: 1129641 - DNA, 16 bp, Homo sapiens
ttaccaataaactgag

SEQ ID NO: 1129642 - DNA, 17 bp, Homo sapiens
ttaccaataaactgagc

SEQ ID NO: 1129643 - DNA, 17 bp, Homo sapiens
ttagaatcaaacatttt

SEQ ID NO: 1129644 - DNA, 15 bp, Homo sapiens
ttagaatcttttaaa

SEQ ID NO: 1129645 - DNA, 17 bp, Homo sapiens
ttagaatcttttaaata

SEQ ID NO: 1129646 - DNA, 12 bp, Homo sapiens
ttagaatgaaaa

SEQ ID NO: 1129647 - DNA, 19 bp, Homo sapiens
ttagaatgaatttatcttt

SEQ ID NO: 1129648 - DNA, 23 bp, Homo sapiens
ttagaatgaatttatctttacca

SEQ ID NO: 1129649 - DNA, 13 bp, Homo sapiens
ttagaatgcaagc

SEQ ID NO: 1129650 - DNA, 21 bp, Homo sapiens
ttagaatgccataaaattgca

SEQ ID NO: 1129651 - DNA, 15 bp, Homo sapiens
ttagaattatttaaa

SEQ ID NO: 1129652 - DNA, 19 bp, Homo sapiens
ttagacaaagccttaagca

SEQ ID NO: 1129653 - DNA, 22 bp, Homo sapiens
ttagacaaagccttaagcaaat

SEQ ID NO: 1129654 - DNA, 16 bp, Homo sapiens
ttagacaagagatggg

SEQ ID NO: 1129655 - DNA, 22 bp, Homo sapiens
ttagacagaacacctatgcaaa

SEQ ID NO: 1129656 - DNA, 20 bp, Homo sapiens
ttagacatttttgtgccatt

SEQ ID NO: 1129657 - DNA, 20 bp, Homo sapiens
ttagaccagaaagtgtgtgt

SEQ ID NO: 1129658 - DNA, 13 bp, Homo sapiens
ttagaccctgggt

SEQ ID NO: 1129659 - DNA, 11 bp, Homo sapiens
ttagacctcag

SEQ ID NO: 1129660 - DNA, 14 bp, Homo sapiens
ttagactacattta

SEQ ID NO: 1129661 - DNA, 21 bp, Homo sapiens
ttagactggaacttgaactga

SEQ ID NO: 1129662 - DNA, 16 bp, Homo sapiens
ttagactggacagctt

SEQ ID NO: 1129663 - DNA, 17 bp, Homo sapiens
ttagactggacagcttg

SEQ ID NO: 1129664 - DNA, 19 bp, Homo sapiens
ttagactggacagcttgtg

SEQ ID NO: 1129665 - DNA, 14 bp, Homo sapiens
ttagactgtagcct

SEQ ID NO: 1129666 - DNA, 20 bp, Homo sapiens
ttagactgtagcctggatat

SEQ ID NO: 1129667 - DNA, 21 bp, Homo sapiens
ttagacttcgactcaggatcc

SEQ ID NO: 1129668 - DNA, 16 bp, Homo sapiens
ttagagaaatgaatta

SEQ ID NO: 1129669 - DNA, 13 bp, Homo sapiens
ttagagaactgga

SEQ ID NO: 1129670 - DNA, 15 bp, Homo sapiens
ttagagaactggagg

SEQ ID NO: 1129671 - DNA, 16 bp, Homo sapiens
ttagagaagtttgtgg

SEQ ID NO: 1129672 - DNA, 18 bp, Homo sapiens
ttagagaatgtgtttcaa

SEQ ID NO: 1129673 - DNA, 22 bp, Homo sapiens
ttagagagattggccagcaaaa

SEQ ID NO: 1129674 - DNA, 13 bp, Homo sapiens
ttagagatgaatt

SEQ ID NO: 1129675 - DNA, 13 bp, Homo sapiens
ttagagattataa

SEQ ID NO: 1129676 - DNA, 16 bp, Homo sapiens
ttagagccaagctgca

SEQ ID NO: 1129677 - DNA, 17 bp, Homo sapiens
ttagagccaagctgcac

SEQ ID NO: 1129678 - DNA, 15 bp, Homo sapiens
ttagagccttttatc

SEQ ID NO: 1129679 - DNA, 16 bp, Homo sapiens
ttagaggaaaaatatt

SEQ ID NO: 1129680 - DNA, 13 bp, Homo sapiens
ttagaggaaaagg

SEQ ID NO: 1129681 - DNA, 15 bp, Homo sapiens
ttagaggaaaatgag

SEQ ID NO: 1129682 - DNA, 23 bp, Homo sapiens
ttagaggcattcagttagcaaag

SEQ ID NO: 1129683 - DNA, 20 bp, Homo sapiens
ttagaggctttcaaatgtac

SEQ ID NO: 1129684 - DNA, 10 bp, Homo sapiens
ttagagggcc

SEQ ID NO: 1129685 - DNA, 14 bp, Homo sapiens
ttagagggccttgc

SEQ ID NO: 1129686 - DNA, 20 bp, Homo sapiens
ttagagtcaatttgctgaaa

SEQ ID NO: 1129687 - DNA, 14 bp, Homo sapiens
ttagagtcagcctt

SEQ ID NO: 1129688 - DNA, 20 bp, Homo sapiens
ttagagtcctagttttccta

SEQ ID NO: 1129689 - DNA, 18 bp, Homo sapiens
ttagagtcgtcactctct

SEQ ID NO: 1129690 - DNA, 23 bp, Homo sapiens
ttagagtggttattcattattcc

SEQ ID NO: 1129691 - DNA, 16 bp, Homo sapiens
ttagagttcttctttc

SEQ ID NO: 1129692 - DNA, 14 bp, Homo sapiens
ttagagtttacagt

SEQ ID NO: 1129693 - DNA, 15 bp, Homo sapiens
ttagagtttctgttt

SEQ ID NO: 1129694 - DNA, 17 bp, Homo sapiens
ttagagtttctgtttga

SEQ ID NO: 1129695 - DNA, 22 bp, Homo sapiens
ttagataaagtaagcctaggtg

SEQ ID NO: 1129696 - DNA, 18 bp, Homo sapiens
ttagataacttcttgaaa

SEQ ID NO: 1129697 - DNA, 22 bp, Homo sapiens
ttagataatacaccactacatt

SEQ ID NO: 1129698 - DNA, 15 bp, Homo sapiens
ttagataatttgaaa

SEQ ID NO: 1129699 - DNA, 16 bp, Homo sapiens
ttagataatttgaaaa

SEQ ID NO: 1129700 - DNA, 13 bp, Homo sapiens
ttagatcaaatac

SEQ ID NO: 1129701 - DNA, 23 bp, Homo sapiens
ttagatcaaatactttaaaggaa

SEQ ID NO: 1129702 - DNA, 15 bp, Homo sapiens
ttagatccattaatt

SEQ ID NO: 1129703 - DNA, 20 bp, Homo sapiens
ttagatcccatgtcacctca

SEQ ID NO: 1129704 - DNA, 17 bp, Homo sapiens
ttagatgagggtgactg

SEQ ID NO: 1129705 - DNA, 20 bp, Homo sapiens
ttagatgagtgaaataccct

SEQ ID NO: 1129706 - DNA, 19 bp, Homo sapiens
ttagatgctgaatatctgt

SEQ ID NO: 1129707 - DNA, 16 bp, Homo sapiens
ttagatgtaattttgt

SEQ ID NO: 1129708 - DNA, 20 bp, Homo sapiens
ttagatgtgcaacctgtggc

SEQ ID NO: 1129709 - DNA, 18 bp, Homo sapiens
ttagatgttactacctta

SEQ ID NO: 1129710 - DNA, 21 bp, Homo sapiens
ttagatgttccagtaatctaa

SEQ ID NO: 1129711 - DNA, 22 bp, Homo sapiens
ttagatgttccagtaatctaat

SEQ ID NO: 1129712 - DNA, 13 bp, Homo sapiens
ttagatgttctaa

SEQ ID NO: 1129713 - DNA, 20 bp, Homo sapiens
ttagatgttctaagtctttc

SEQ ID NO: 1129714 - DNA, 21 bp, Homo sapiens
ttagatgttttgggatcagga

SEQ ID NO: 1129715 - DNA, 14 bp, Homo sapiens
ttagattattgaaa

SEQ ID NO: 1129716 - DNA, 15 bp, Homo sapiens
ttagattatttctgt

SEQ ID NO: 1129717 - DNA, 19 bp, Homo sapiens
ttagattgagaaatgtgta

SEQ ID NO: 1129718 - DNA, 13 bp, Homo sapiens
ttagattgagtag

SEQ ID NO: 1129719 - DNA, 22 bp, Homo sapiens
ttagattgagtaggtaccttgt

SEQ ID NO: 1129720 - DNA, 13 bp, Homo sapiens
ttagattgcaaag

SEQ ID NO: 1129721 - DNA, 17 bp, Homo sapiens
ttagattgggccatggc

SEQ ID NO: 1129722 - DNA, 16 bp, Homo sapiens
ttagattggttctgtt

SEQ ID NO: 1129723 - DNA, 20 bp, Homo sapiens
ttagcaaactgatgctgagg

SEQ ID NO: 1129724 - DNA, 18 bp, Homo sapiens
ttagcaaattctgttttt

SEQ ID NO: 1129725 - DNA, 15 bp, Homo sapiens
ttagcaactagggct

SEQ ID NO: 1129726 - DNA, 21 bp, Homo sapiens
ttagcaactgctggggagaca

SEQ ID NO: 1129727 - DNA, 16 bp, Homo sapiens
ttagcacaatttgaga

SEQ ID NO: 1129728 - DNA, 12 bp, Homo sapiens
ttagcactgttg

SEQ ID NO: 1129729 - DNA, 19 bp, Homo sapiens
ttagcagaatggagaaagt

SEQ ID NO: 1129730 - DNA, 12 bp, Homo sapiens
ttagcagacagg

SEQ ID NO: 1129731 - DNA, 18 bp, Homo sapiens
ttagcagggatgttcctt

SEQ ID NO: 1129732 - DNA, 23 bp, Homo sapiens
ttagcagtggctggtgcccatga

SEQ ID NO: 1129733 - DNA, 21 bp, Homo sapiens
ttagcagttctgcaaatagaa

SEQ ID NO: 1129734 - DNA, 19 bp, Homo sapiens
ttagcagttgctcacatgt

SEQ ID NO: 1129735 - DNA, 16 bp, Homo sapiens
ttagcagtttgctttg

SEQ ID NO: 1129736 - DNA, 17 bp, Homo sapiens
ttagcatcaagttctcc

SEQ ID NO: 1129737 - DNA, 14 bp, Homo sapiens
ttagcatgcaagct

SEQ ID NO: 1129738 - DNA, 19 bp, Homo sapiens
ttagcatgttgttgaaagg

SEQ ID NO: 1129739 - DNA, 18 bp, Homo sapiens
ttagcattttaattctct

SEQ ID NO: 1129740 - DNA, 18 bp, Homo sapiens
ttagcatttttatgcaga

SEQ ID NO: 1129741 - DNA, 14 bp, Homo sapiens
ttagccaagcccta

SEQ ID NO: 1129742 - DNA, 12 bp, Homo sapiens
ttagccagtgac

SEQ ID NO: 1129743 - DNA, 22 bp, Homo sapiens
ttagccagttcaaagtgtatat

SEQ ID NO: 1129744 - DNA, 20 bp, Homo sapiens
ttagccatctaatgcttgtt

SEQ ID NO: 1129745 - DNA, 14 bp, Homo sapiens
ttagccattgaaat

SEQ ID NO: 1129746 - DNA, 21 bp, Homo sapiens
ttagcccaagaggtctgagcc

SEQ ID NO: 1129747 - DNA, 13 bp, Homo sapiens
ttagcccttcaga

SEQ ID NO: 1129748 - DNA, 22 bp, Homo sapiens
ttagcctcttggaaatcaggta

SEQ ID NO: 1129749 - DNA, 17 bp, Homo sapiens
ttagcctgcctcaccca

SEQ ID NO: 1129750 - DNA, 12 bp, Homo sapiens
ttagcctggact

SEQ ID NO: 1129751 - DNA, 18 bp, Homo sapiens
ttagcgcacccagagaaa

SEQ ID NO: 1129752 - DNA, 20 bp, Homo sapiens
ttagcggctcctcgccccca

SEQ ID NO: 1129753 - DNA, 21 bp, Homo sapiens
ttagcgtcaagacatttgctg

SEQ ID NO: 1129754 - DNA, 17 bp, Homo sapiens
ttagctaaaccaagaag

SEQ ID NO: 1129755 - DNA, 22 bp, Homo sapiens
ttagctaataaaaagcttttgt

SEQ ID NO: 1129756 - DNA, 20 bp, Homo sapiens
ttagctacatagcagacttt

SEQ ID NO: 1129757 - DNA, 21 bp, Homo sapiens
ttagctatttatccctttcct

SEQ ID NO: 1129758 - DNA, 17 bp, Homo sapiens
ttagctcactgaatctt

SEQ ID NO: 1129759 - DNA, 16 bp, Homo sapiens
ttagctgcacggcatt

SEQ ID NO: 1129760 - DNA, 16 bp, Homo sapiens
ttagctggcattacag

SEQ ID NO: 1129761 - DNA, 13 bp, Homo sapiens
ttagctgtactat

SEQ ID NO: 1129762 - DNA, 23 bp, Homo sapiens
ttagctgtactataagtagttgg

SEQ ID NO: 1129763 - DNA, 17 bp, Homo sapiens
ttagctgtctgctcaga

SEQ ID NO: 1129764 - DNA, 18 bp, Homo sapiens
ttagcttagacctcagcc

SEQ ID NO: 1129765 - DNA, 15 bp, Homo sapiens
ttataaaattttaaa

SEQ ID NO: 1129766 - DNA, 17 bp, Homo sapiens
ttataaaattttgcttt

SEQ ID NO: 1129767 - DNA, 12 bp, Homo sapiens
ttataaacacat

SEQ ID NO: 1129768 - DNA, 21 bp, Homo sapiens
ttataaacagacaatatgtga

SEQ ID NO: 1129769 - DNA, 15 bp, Homo sapiens
ttataaactataaac

SEQ ID NO: 1129770 - DNA, 14 bp, Homo sapiens
ttataaactgagag

SEQ ID NO: 1129771 - DNA, 11 bp, Homo sapiens
ttataaataaa

SEQ ID NO: 1129772 - DNA, 15 bp, Homo sapiens
ttataaatatattta

SEQ ID NO: 1129773 - DNA, 18 bp, Homo sapiens
ttataaattaaatatatg

SEQ ID NO: 1129774 - DNA, 18 bp, Homo sapiens
ttataaattactatctgt

SEQ ID NO: 1129775 - DNA, 17 bp, Homo sapiens
ttataacagcattcttg

SEQ ID NO: 1129776 - DNA, 15 bp, Homo sapiens
ttataactaacatgt

SEQ ID NO: 1129777 - DNA, 22 bp, Homo sapiens
ttataactactccggagacagg

SEQ ID NO: 1129778 - DNA, 20 bp, Homo sapiens
ttataactagacatctgctg

SEQ ID NO: 1129779 - DNA, 23 bp, Homo sapiens
ttataactagacatctgctgtta

SEQ ID NO: 1129780 - DNA, 17 bp, Homo sapiens
ttataactcatcataaa

SEQ ID NO: 1129781 - DNA, 21 bp, Homo sapiens
ttataactcatcataaaataa

SEQ ID NO: 1129782 - DNA, 16 bp, Homo sapiens
ttataactctgcacta

SEQ ID NO: 1129783 - DNA, 19 bp, Homo sapiens
ttataactctgcactactc

SEQ ID NO: 1129784 - DNA, 17 bp, Homo sapiens
ttataactctgtataat

SEQ ID NO: 1129785 - DNA, 15 bp, Homo sapiens
ttataacttaatgaa

SEQ ID NO: 1129786 - DNA, 16 bp, Homo sapiens
ttataagaaaaacttt

SEQ ID NO: 1129787 - DNA, 17 bp, Homo sapiens
ttataagaaaaactttt

SEQ ID NO: 1129788 - DNA, 14 bp, Homo sapiens
ttataagcgtattt

SEQ ID NO: 1129789 - DNA, 21 bp, Homo sapiens
ttataagggagagctgagcca

SEQ ID NO: 1129790 - DNA, 22 bp, Homo sapiens
ttataataaaaggaaaagcaaa

SEQ ID NO: 1129791 - DNA, 18 bp, Homo sapiens
ttataataaaggactgta

SEQ ID NO: 1129792 - DNA, 21 bp, Homo sapiens
ttataataaaggactgtaatc

SEQ ID NO: 1129793 - DNA, 13 bp, Homo sapiens
ttataataactga

SEQ ID NO: 1129794 - DNA, 16 bp, Homo sapiens
ttataataactgaact

SEQ ID NO: 1129795 - DNA, 18 bp, Homo sapiens
ttataataactgaactgt

SEQ ID NO: 1129796 - DNA, 14 bp, Homo sapiens
ttataatactctgt

SEQ ID NO: 1129797 - DNA, 15 bp, Homo sapiens
ttataatactctgtt

SEQ ID NO: 1129798 - DNA, 23 bp, Homo sapiens
ttataatcagaatggaagagaga

SEQ ID NO: 1129799 - DNA, 17 bp, Homo sapiens
ttataatgaaatctgtt

SEQ ID NO: 1129800 - DNA, 12 bp, Homo sapiens
ttataatgattc

SEQ ID NO: 1129801 - DNA, 13 bp, Homo sapiens
ttataatgggtaa

SEQ ID NO: 1129802 - DNA, 14 bp, Homo sapiens
ttataatgtatttg

SEQ ID NO: 1129803 - DNA, 17 bp, Homo sapiens
ttataatgtatttgaaa

SEQ ID NO: 1129804 - DNA, 14 bp, Homo sapiens
ttataattaaagat

SEQ ID NO: 1129805 - DNA, 21 bp, Homo sapiens
ttataattaaagatgccatag

SEQ ID NO: 1129806 - DNA, 20 bp, Homo sapiens
ttataattggtgctatttga

SEQ ID NO: 1129807 - DNA, 14 bp, Homo sapiens
ttataattgtaatg

SEQ ID NO: 1129808 - DNA, 15 bp, Homo sapiens
ttataattgtttata

SEQ ID NO: 1129809 - DNA, 16 bp, Homo sapiens
ttataatttaaatgat

SEQ ID NO: 1129810 - DNA, 21 bp, Homo sapiens
ttatacaaacctaccaaaatg

SEQ ID NO: 1129811 - DNA, 19 bp, Homo sapiens
ttatacaaattagaaaatg

SEQ ID NO: 1129812 - DNA, 21 bp, Homo sapiens
ttatacaacagcaaaccctga

SEQ ID NO: 1129813 - DNA, 16 bp, Homo sapiens
ttatacaaccttcatt

SEQ ID NO: 1129814 - DNA, 21 bp, Homo sapiens
ttatacaataacccagttact

SEQ ID NO: 1129815 - DNA, 15 bp, Homo sapiens
ttatacaccagcaat

SEQ ID NO: 1129816 - DNA, 16 bp, Homo sapiens
ttatacagattttcta

SEQ ID NO: 1129817 - DNA, 21 bp, Homo sapiens
ttatacagttataaaattaaa

SEQ ID NO: 1129818 - DNA, 20 bp, Homo sapiens
ttatacagttgaaaacttgt

SEQ ID NO: 1129819 - DNA, 11 bp, Homo sapiens
ttatacataaa

SEQ ID NO: 1129820 - DNA, 19 bp, Homo sapiens
ttataccagatgaacattt

SEQ ID NO: 1129821 - DNA, 22 bp, Homo sapiens
ttataccagcttaatagctgta

SEQ ID NO: 1129822 - DNA, 16 bp, Homo sapiens
ttataccattcagatc

SEQ ID NO: 1129823 - DNA, 18 bp, Homo sapiens
ttataccccaataatcaa

SEQ ID NO: 1129824 - DNA, 21 bp, Homo sapiens
ttatacctgtgtattttttaa

SEQ ID NO: 1129825 - DNA, 17 bp, Homo sapiens
ttatacgaaataattgt

SEQ ID NO: 1129826 - DNA, 20 bp, Homo sapiens
ttatacgagtaatatgcctg

SEQ ID NO: 1129827 - DNA, 11 bp, Homo sapiens
ttatactaact

SEQ ID NO: 1129828 - DNA, 18 bp, Homo sapiens
ttatactaacttatttat

SEQ ID NO: 1129829 - DNA, 12 bp, Homo sapiens
ttatactaagaa

SEQ ID NO: 1129830 - DNA, 16 bp, Homo sapiens
ttatactaagaaaaga

SEQ ID NO: 1129831 - DNA, 14 bp, Homo sapiens
ttatactcagaact

SEQ ID NO: 1129832 - DNA, 16 bp, Homo sapiens
ttatactcagaactgt

SEQ ID NO: 1129833 - DNA, 18 bp, Homo sapiens
ttatactcagaactgtcc

SEQ ID NO: 1129834 - DNA, 19 bp, Homo sapiens
ttatactcttcctattttt

SEQ ID NO: 1129835 - DNA, 19 bp, Homo sapiens
ttatactgcacagtggcac

SEQ ID NO: 1129836 - DNA, 24 bp, Homo sapiens
ttatactgggacaccattaccaaa

SEQ ID NO: 1129837 - DNA, 13 bp, Homo sapiens
ttatactgtacaa

SEQ ID NO: 1129838 - DNA, 14 bp, Homo sapiens
ttatactgtacaat

SEQ ID NO: 1129839 - DNA, 14 bp, Homo sapiens
ttatactttattga

SEQ ID NO: 1129840 - DNA, 11 bp, Homo sapiens
ttatagaaaat

SEQ ID NO: 1129841 - DNA, 18 bp, Homo sapiens
ttatagaacttcatggat

SEQ ID NO: 1129842 - DNA, 18 bp, Homo sapiens
ttatagaaggaatttgta

SEQ ID NO: 1129843 - DNA, 16 bp, Homo sapiens
ttatagaataaaagct

SEQ ID NO: 1129844 - DNA, 22 bp, Homo sapiens
ttatagaataaaagctataaag

SEQ ID NO: 1129845 - DNA, 14 bp, Homo sapiens
ttatagaatacttt

SEQ ID NO: 1129846 - DNA, 19 bp, Homo sapiens
ttatagagggccaagactt

SEQ ID NO: 1129847 - DNA, 21 bp, Homo sapiens
ttatagcaagatattgatcaa

SEQ ID NO: 1129848 - DNA, 15 bp, Homo sapiens
ttatagctcatttgt

SEQ ID NO: 1129849 - DNA, 24 bp, Homo sapiens
ttataggatttatttaaaatagca

SEQ ID NO: 1129850 - DNA, 16 bp, Homo sapiens
ttatagtacatgataa

SEQ ID NO: 1129851 - DNA, 17 bp, Homo sapiens
ttatagtacatgataaa

SEQ ID NO: 1129852 - DNA, 17 bp, Homo sapiens
ttatagtactagagata

SEQ ID NO: 1129853 - DNA, 15 bp, Homo sapiens
ttatagtcttagtaa

SEQ ID NO: 1129854 - DNA, 15 bp, Homo sapiens
ttatagtgaatactg

SEQ ID NO: 1129855 - DNA, 16 bp, Homo sapiens
ttatagtgtttaactg

SEQ ID NO: 1129856 - DNA, 22 bp, Homo sapiens
ttatagtgtttaactggcatgg

SEQ ID NO: 1129857 - DNA, 16 bp, Homo sapiens
ttatataaagtattct

SEQ ID NO: 1129858 - DNA, 22 bp, Homo sapiens
ttatataaagtattctttttct

SEQ ID NO: 1129859 - DNA, 13 bp, Homo sapiens
ttatataaatata

SEQ ID NO: 1129860 - DNA, 23 bp, Homo sapiens
ttatataaatatatatttttcaa

SEQ ID NO: 1129861 - DNA, 22 bp, Homo sapiens
ttatataactgtatttgaaata

SEQ ID NO: 1129862 - DNA, 23 bp, Homo sapiens
ttatataagtctgttatttatta

SEQ ID NO: 1129863 - DNA, 18 bp, Homo sapiens
ttatataatatctaaagt

SEQ ID NO: 1129864 - DNA, 23 bp, Homo sapiens
ttatatacagtacacagatacct

SEQ ID NO: 1129865 - DNA, 21 bp, Homo sapiens
ttatatacctggcttttactt

SEQ ID NO: 1129866 - DNA, 23 bp, Homo sapiens
ttatatactgggttcttgtttta

SEQ ID NO: 1129867 - DNA, 21 bp, Homo sapiens
ttatatagtctacagttgtcc

SEQ ID NO: 1129868 - DNA, 15 bp, Homo sapiens
ttatatatacagtaa

SEQ ID NO: 1129869 - DNA, 16 bp, Homo sapiens
ttatatatatatgtat

SEQ ID NO: 1129870 - DNA, 17 bp, Homo sapiens
ttatatatggacatggc

SEQ ID NO: 1129871 - DNA, 17 bp, Homo sapiens
ttatatatgtatttata

SEQ ID NO: 1129872 - DNA, 21 bp, Homo sapiens
ttatatattgaaagttgcttt

SEQ ID NO: 1129873 - DNA, 15 bp, Homo sapiens
ttatatattgttgtt

SEQ ID NO: 1129874 - DNA, 14 bp, Homo sapiens
ttatatatttacag

SEQ ID NO: 1129875 - DNA, 20 bp, Homo sapiens
ttatatatttataactcatc

SEQ ID NO: 1129876 - DNA, 18 bp, Homo sapiens
ttatatatttttctgaga

SEQ ID NO: 1129877 - DNA, 15 bp, Homo sapiens
ttatatcaaatgcct

SEQ ID NO: 1129878 - DNA, 15 bp, Homo sapiens
ttatatcatacagtt

SEQ ID NO: 1129879 - DNA, 16 bp, Homo sapiens
ttatatcatacagttt

SEQ ID NO: 1129880 - DNA, 17 bp, Homo sapiens
ttatatcatacagtttt

SEQ ID NO: 1129881 - DNA, 18 bp, Homo sapiens
ttatatcatacagttttc

SEQ ID NO: 1129882 - DNA, 20 bp, Homo sapiens
ttatatcatgcaaaatatgt

SEQ ID NO: 1129883 - DNA, 16 bp, Homo sapiens
ttatatctggcctctg

SEQ ID NO: 1129884 - DNA, 21 bp, Homo sapiens
ttatatctgggttaagtgttt

SEQ ID NO: 1129885 - DNA, 17 bp, Homo sapiens
ttatatcttttggttat

SEQ ID NO: 1129886 - DNA, 18 bp, Homo sapiens
ttatatgagagaatcaca

SEQ ID NO: 1129887 - DNA, 18 bp, Homo sapiens
ttattaaatacaaaactt

SEQ ID NO: 1129888 - DNA, 21 bp, Homo sapiens
ttattaacgggcatgtattat

SEQ ID NO: 1129889 - DNA, 15 bp, Homo sapiens
ttattaactttaatg

SEQ ID NO: 1129890 - DNA, 23 bp, Homo sapiens
ttattaagccaggaaacatgaag

SEQ ID NO: 1129891 - DNA, 16 bp, Homo sapiens
ttattaataccaaata

SEQ ID NO: 1129892 - DNA, 13 bp, Homo sapiens
ttattaatataat

SEQ ID NO: 1129893 - DNA, 13 bp, Homo sapiens
ttattaatcacta

SEQ ID NO: 1129894 - DNA, 22 bp, Homo sapiens
ttattaatcatacaaactctca

SEQ ID NO: 1129895 - DNA, 15 bp, Homo sapiens
ttattaatgtttctt

SEQ ID NO: 1129896 - DNA, 14 bp, Homo sapiens
ttattaattgcttt

SEQ ID NO: 1129897 - DNA, 22 bp, Homo sapiens
ttattacaaatattgtcatctt

SEQ ID NO: 1129898 - DNA, 13 bp, Homo sapiens
ttattacaatttt

SEQ ID NO: 1129899 - DNA, 23 bp, Homo sapiens
ttattacagggcattcaaatggg

SEQ ID NO: 1129900 - DNA, 12 bp, Homo sapiens
ttattacattta

SEQ ID NO: 1129901 - DNA, 19 bp, Homo sapiens
ttattacccaagtcttctc

SEQ ID NO: 1129902 - DNA, 15 bp, Homo sapiens
ttattacctctgata

SEQ ID NO: 1129903 - DNA, 16 bp, Homo sapiens
ttattactgaactatt

SEQ ID NO: 1129904 - DNA, 14 bp, Homo sapiens
ttattactgctaag

SEQ ID NO: 1129905 - DNA, 19 bp, Homo sapiens
ttattactgctaagtattt

SEQ ID NO: 1129906 - DNA, 14 bp, Homo sapiens
ttattacttccatg

SEQ ID NO: 1129907 - DNA, 15 bp, Homo sapiens
ttattacttccatga

SEQ ID NO: 1129908 - DNA, 17 bp, Homo sapiens
ttattacttccatgaat

SEQ ID NO: 1129909 - DNA, 18 bp, Homo sapiens
ttattacttgtgcactta

SEQ ID NO: 1129910 - DNA, 12 bp, Homo sapiens
ttattagaaacc

SEQ ID NO: 1129911 - DNA, 18 bp, Homo sapiens
ttattagaatcaaacatt

SEQ ID NO: 1129912 - DNA, 21 bp, Homo sapiens
ttattagagattacctcctga

SEQ ID NO: 1129913 - DNA, 12 bp, Homo sapiens
ttattagataat

SEQ ID NO: 1129914 - DNA, 22 bp, Homo sapiens
ttattagccaggtaatgtgaat

SEQ ID NO: 1129915 - DNA, 18 bp, Homo sapiens
ttattagccctgcatttt

SEQ ID NO: 1129916 - DNA, 23 bp, Homo sapiens
ttattagccctgcattttcatag

SEQ ID NO: 1129917 - DNA, 16 bp, Homo sapiens
ttattagtattgttgt

SEQ ID NO: 1129918 - DNA, 18 bp, Homo sapiens
ttattagtattgttgtcc

SEQ ID NO: 1129919 - DNA, 19 bp, Homo sapiens
ttattagtattgttgtcct

SEQ ID NO: 1129920 - DNA, 22 bp, Homo sapiens
ttattagttccccaaatacaaa

SEQ ID NO: 1129921 - DNA, 18 bp, Homo sapiens
ttattagtttaaaatgca

SEQ ID NO: 1129922 - DNA, 21 bp, Homo sapiens
ttattataaactataaactta

SEQ ID NO: 1129923 - DNA, 23 bp, Homo sapiens
ttattataaactataaacttaag

SEQ ID NO: 1129924 - DNA, 17 bp, Homo sapiens
ttattataccacttata

SEQ ID NO: 1129925 - DNA, 23 bp, Homo sapiens
ttattatatatttacagaagaaa

SEQ ID NO: 1129926 - DNA, 19 bp, Homo sapiens
ttattatcctcctgttctg

SEQ ID NO: 1129927 - DNA, 14 bp, Homo sapiens
ttattatgcataaa

SEQ ID NO: 1129928 - DNA, 14 bp, Homo sapiens
ttattattaattta

SEQ ID NO: 1129929 - DNA, 15 bp, Homo sapiens
ttattattatttgct

SEQ ID NO: 1129930 - DNA, 16 bp, Homo sapiens
ttattattatttttta

SEQ ID NO: 1129931 - DNA, 13 bp, Homo sapiens
ttattattcttga

SEQ ID NO: 1129932 - DNA, 22 bp, Homo sapiens
ttattatttgtgttttaattta

SEQ ID NO: 1129933 - DNA, 21 bp, Homo sapiens
ttattcaaaccaatttcttcc

SEQ ID NO: 1129934 - DNA, 15 bp, Homo sapiens
ttattcaaagagaaa

SEQ ID NO: 1129935 - DNA, 19 bp, Homo sapiens
ttattcaaagagaaaacat

SEQ ID NO: 1129936 - DNA, 23 bp, Homo sapiens
ttattcaagaatgccagtagaaa

SEQ ID NO: 1129937 - DNA, 16 bp, Homo sapiens
ttattcaagttattgt

SEQ ID NO: 1129938 - DNA, 19 bp, Homo sapiens
ttattcaattcctctggga

SEQ ID NO: 1129939 - DNA, 19 bp, Homo sapiens
ttattcagaactatttaaa

SEQ ID NO: 1129940 - DNA, 19 bp, Homo sapiens
ttattcagctagaatttct

SEQ ID NO: 1129941 - DNA, 13 bp, Homo sapiens
ttattcagtgtca

SEQ ID NO: 1129942 - DNA, 13 bp, Homo sapiens
ttattcataatga

SEQ ID NO: 1129943 - DNA, 14 bp, Homo sapiens
ttattcataatgaa

SEQ ID NO: 1129944 - DNA, 24 bp, Homo sapiens
ttattcataatgaattataacagt

SEQ ID NO: 1129945 - DNA, 17 bp, Homo sapiens
ttattcatgccatctgt

SEQ ID NO: 1129946 - DNA, 18 bp, Homo sapiens
ttattcattatttgtcaa

SEQ ID NO: 1129947 - DNA, 11 bp, Homo sapiens
ttattcattgg

SEQ ID NO: 1129948 - DNA, 15 bp, Homo sapiens
ttattccaggagaag

SEQ ID NO: 1129949 - DNA, 20 bp, Homo sapiens
ttattccccattcttcctag

SEQ ID NO: 1129950 - DNA, 14 bp, Homo sapiens
ttattccctgccca

SEQ ID NO: 1129951 - DNA, 21 bp, Homo sapiens
ttattccctgcccaaaccctt

SEQ ID NO: 1129952 - DNA, 19 bp, Homo sapiens
ttattcctcagattgctga

SEQ ID NO: 1129953 - DNA, 20 bp, Homo sapiens
ttattcctcctgctcatatt

SEQ ID NO: 1129954 - DNA, 16 bp, Homo sapiens
ttattcctcttattgg

SEQ ID NO: 1129955 - DNA, 17 bp, Homo sapiens
ttattcctgataataat

SEQ ID NO: 1129956 - DNA, 21 bp, Homo sapiens
ttattcctgataataattgat

SEQ ID NO: 1129957 - DNA, 13 bp, Homo sapiens
ttattcctgtatg

SEQ ID NO: 1129958 - DNA, 19 bp, Homo sapiens
ttattcctgtatgttgtcc

SEQ ID NO: 1129959 - DNA, 12 bp, Homo sapiens
ttattccttcca

SEQ ID NO: 1129960 - DNA, 14 bp, Homo sapiens
ttattctaataaat

SEQ ID NO: 1129961 - DNA, 13 bp, Homo sapiens
ttattctcctccc

SEQ ID NO: 1129962 - DNA, 16 bp, Homo sapiens
ttattctgttttgcac

SEQ ID NO: 1129963 - DNA, 22 bp, Homo sapiens
ttattctttgaaaacagatgac

SEQ ID NO: 1129964 - DNA, 24 bp, Homo sapiens
ttattgaaaaaaaaaatgttgaga

SEQ ID NO: 1129965 - DNA, 23 bp, Homo sapiens
ttattgaaaggggacacctgtac

SEQ ID NO: 1129966 - DNA, 19 bp, Homo sapiens
ttattgaagatttaccata

SEQ ID NO: 1129967 - DNA, 16 bp, Homo sapiens
ttattgaatatatgat

SEQ ID NO: 1129968 - DNA, 16 bp, Homo sapiens
ttattgaattagaaaa

SEQ ID NO: 1129969 - DNA, 14 bp, Homo sapiens
ttattgacaataat

SEQ ID NO: 1129970 - DNA, 23 bp, Homo sapiens
ttattgacacagaaaatgttgag

SEQ ID NO: 1129971 - DNA, 12 bp, Homo sapiens
ttattgacactg

SEQ ID NO: 1129972 - DNA, 15 bp, Homo sapiens
ttattgactgggcaa

SEQ ID NO: 1129973 - DNA, 16 bp, Homo sapiens
ttattgagaaagagca

SEQ ID NO: 1129974 - DNA, 23 bp, Homo sapiens
ttattgagaaagagcacttaaga

SEQ ID NO: 1129975 - DNA, 19 bp, Homo sapiens
ttattgagttccagttgaa

SEQ ID NO: 1129976 - DNA, 17 bp, Homo sapiens
ttattgcaaagttgtat

SEQ ID NO: 1129977 - DNA, 16 bp, Homo sapiens
ttattgcagtttatca

SEQ ID NO: 1129978 - DNA, 15 bp, Homo sapiens
ttattgcatatagat

SEQ ID NO: 1129979 - DNA, 18 bp, Homo sapiens
ttattgcccatgggatat

SEQ ID NO: 1129980 - DNA, 17 bp, Homo sapiens
ttattgccctaagtgat

SEQ ID NO: 1129981 - DNA, 12 bp, Homo sapiens
ttattgctgcca

SEQ ID NO: 1129982 - DNA, 13 bp, Homo sapiens
ttattgctgccaa

SEQ ID NO: 1129983 - DNA, 15 bp, Homo sapiens
ttattgctgccaaaa

SEQ ID NO: 1129984 - DNA, 19 bp, Homo sapiens
ttattgctgccaaaaccac

SEQ ID NO: 1129985 - DNA, 20 bp, Homo sapiens
ttattgctgccaaaaccaca

SEQ ID NO: 1129986 - DNA, 21 bp, Homo sapiens
ttattgctgccaaaaccacat

SEQ ID NO: 1129987 - DNA, 15 bp, Homo sapiens
ttattggaaatgtac

SEQ ID NO: 1129988 - DNA, 14 bp, Homo sapiens
ttattggaaatgtg

SEQ ID NO: 1129989 - DNA, 16 bp, Homo sapiens
ttattggaattaacct

SEQ ID NO: 1129990 - DNA, 22 bp, Homo sapiens
ttattggcagccaaggaatgtg

SEQ ID NO: 1129991 - DNA, 12 bp, Homo sapiens
ttattggccact

SEQ ID NO: 1129992 - DNA, 14 bp, Homo sapiens
ttattggctgagat

SEQ ID NO: 1129993 - DNA, 22 bp, Homo sapiens
ttattggctgagatatgaacat

SEQ ID NO: 1129994 - DNA, 12 bp, Homo sapiens
ttattgggactt

SEQ ID NO: 1129995 - DNA, 22 bp, Homo sapiens
ttattgggagtcttaataaaat

SEQ ID NO: 1129996 - DNA, 19 bp, Homo sapiens
ttattgggatatcatttta

SEQ ID NO: 1129997 - DNA, 21 bp, Homo sapiens
ttattgggatatcattttaaa

SEQ ID NO: 1129998 - DNA, 22 bp, Homo sapiens
ttattggggaattaaatagtgt

SEQ ID NO: 1129999 - DNA, 19 bp, Homo sapiens
ttattgtaaactttttcaa

SEQ ID NO: 1130000 - DNA, 14 bp, Homo sapiens
ttattgtatttatg

SEQ ID NO: 1130001 - DNA, 20 bp, Homo sapiens
ttattgtcagttttgttcac

SEQ ID NO: 1130002 - DNA, 18 bp, Homo sapiens
ttattgtccttcagagct

SEQ ID NO: 1130003 - DNA, 14 bp, Homo sapiens
ttattgtccttcta

SEQ ID NO: 1130004 - DNA, 13 bp, Homo sapiens
ttattgtctgtaa

SEQ ID NO: 1130005 - DNA, 18 bp, Homo sapiens
ttattgtgacttcactgt

SEQ ID NO: 1130006 - DNA, 20 bp, Homo sapiens
ttattgtgacttcactgtat

SEQ ID NO: 1130007 - DNA, 17 bp, Homo sapiens
ttattgttccaagacat

SEQ ID NO: 1130008 - DNA, 18 bp, Homo sapiens
ttattgttccaagacatt

SEQ ID NO: 1130009 - DNA, 15 bp, Homo sapiens
ttcaaaataaaaagt

SEQ ID NO: 1130010 - DNA, 19 bp, Homo sapiens
ttcaaaatagggtatattt

SEQ ID NO: 1130011 - DNA, 16 bp, Homo sapiens
ttcaaaatatattttg

SEQ ID NO: 1130012 - DNA, 13 bp, Homo sapiens
ttcaaaatattta

SEQ ID NO: 1130013 - DNA, 15 bp, Homo sapiens
ttcaaaatatttaaa

SEQ ID NO: 1130014 - DNA, 12 bp, Homo sapiens
ttcaaaatgctc

SEQ ID NO: 1130015 - DNA, 16 bp, Homo sapiens
ttcaaaatggagggaa

SEQ ID NO: 1130016 - DNA, 12 bp, Homo sapiens
ttcaaaattaat

SEQ ID NO: 1130017 - DNA, 16 bp, Homo sapiens
ttcaaaccaggatttt

SEQ ID NO: 1130018 - DNA, 16 bp, Homo sapiens
ttcaaaccctcaagag

SEQ ID NO: 1130019 - DNA, 17 bp, Homo sapiens
ttcaaactgctgcatac

SEQ ID NO: 1130020 - DNA, 21 bp, Homo sapiens
ttcaaactggggcctccagaa

SEQ ID NO: 1130021 - DNA, 12 bp, Homo sapiens
ttcaaactgtga

SEQ ID NO: 1130022 - DNA, 19 bp, Homo sapiens
ttcaaactgtgaagcattt

SEQ ID NO: 1130023 - DNA, 17 bp, Homo sapiens
ttcaaacttactatttt

SEQ ID NO: 1130024 - DNA, 12 bp, Homo sapiens
ttcaaactttca

SEQ ID NO: 1130025 - DNA, 22 bp, Homo sapiens
ttcaaagagatgggccttttct

SEQ ID NO: 1130026 - DNA, 23 bp, Homo sapiens
ttcaaagagatgggccttttctt

SEQ ID NO: 1130027 - DNA, 22 bp, Homo sapiens
ttcaaagaggtgaacattaaaa

SEQ ID NO: 1130028 - DNA, 13 bp, Homo sapiens
ttcaaagatattt

SEQ ID NO: 1130029 - DNA, 21 bp, Homo sapiens
ttcaaagattatctgattcct

SEQ ID NO: 1130030 - DNA, 23 bp, Homo sapiens
ttcaaagattatctgattccttt

SEQ ID NO: 1130031 - DNA, 19 bp, Homo sapiens
ttcaaagcaccaaaataag

SEQ ID NO: 1130032 - DNA, 23 bp, Homo sapiens
ttcaaagcaccaaaataagaaaa

SEQ ID NO: 1130033 - DNA, 21 bp, Homo sapiens
ttcaaagccagcgtcctcctc

SEQ ID NO: 1130034 - DNA, 14 bp, Homo sapiens
ttcaaagccctgcc

SEQ ID NO: 1130035 - DNA, 22 bp, Homo sapiens
ttcaaagctttttccagaggct

SEQ ID NO: 1130036 - DNA, 13 bp, Homo sapiens
ttcaaagtgtata

SEQ ID NO: 1130037 - DNA, 21 bp, Homo sapiens
ttcaaagtgttgtgttcctgg

SEQ ID NO: 1130038 - DNA, 22 bp, Homo sapiens
ttcaaagtgttgtgttcctggc

SEQ ID NO: 1130039 - DNA, 23 bp, Homo sapiens
ttcaaagtgttgtgttcctggct

SEQ ID NO: 1130040 - DNA, 14 bp, Homo sapiens
ttcaaagtttaata

SEQ ID NO: 1130041 - DNA, 13 bp, Homo sapiens
ttcaaataaagaa

SEQ ID NO: 1130042 - DNA, 21 bp, Homo sapiens
ttcaaatagatttttgattca

SEQ ID NO: 1130043 - DNA, 18 bp, Homo sapiens
ttcaaatagggtctaact

SEQ ID NO: 1130044 - DNA, 19 bp, Homo sapiens
ttcaaatagggtctaactc

SEQ ID NO: 1130045 - DNA, 18 bp, Homo sapiens
ttcaaatcattccttaga

SEQ ID NO: 1130046 - DNA, 19 bp, Homo sapiens
ttcaaatgggctgctgctt

SEQ ID NO: 1130047 - DNA, 16 bp, Homo sapiens
ttcaaatgtttgaaaa

SEQ ID NO: 1130048 - DNA, 22 bp, Homo sapiens
ttcaaatgtttgaaaacaaaaa

SEQ ID NO: 1130049 - DNA, 15 bp, Homo sapiens
ttcaaatgttttaaa

SEQ ID NO: 1130050 - DNA, 22 bp, Homo sapiens
ttcaaattcctatttttaaata

SEQ ID NO: 1130051 - DNA, 15 bp, Homo sapiens
ttcaaattgaatttg

SEQ ID NO: 1130052 - DNA, 21 bp, Homo sapiens
ttcaaattggtctgaaaggct

SEQ ID NO: 1130053 - DNA, 11 bp, Homo sapiens
ttcaaatttag

SEQ ID NO: 1130054 - DNA, 21 bp, Homo sapiens
ttcaacaaagaaacaaagatg

SEQ ID NO: 1130055 - DNA, 13 bp, Homo sapiens
ttcaacagggaag

SEQ ID NO: 1130056 - DNA, 15 bp, Homo sapiens
ttcaacagggaagaa

SEQ ID NO: 1130057 - DNA, 20 bp, Homo sapiens
ttcaaccattccccatggga

SEQ ID NO: 1130058 - DNA, 22 bp, Homo sapiens
ttcaacctggtggcaccagatg

SEQ ID NO: 1130059 - DNA, 15 bp, Homo sapiens
ttcaacgcagccctg

SEQ ID NO: 1130060 - DNA, 14 bp, Homo sapiens
ttcaactcctggct

SEQ ID NO: 1130061 - DNA, 17 bp, Homo sapiens
ttcaactgaccagcctc

SEQ ID NO: 1130062 - DNA, 21 bp, Homo sapiens
ttcaactgccaaaatgctcta

SEQ ID NO: 1130063 - DNA, 15 bp, Homo sapiens
ttcaactgtcttcct

SEQ ID NO: 1130064 - DNA, 12 bp, Homo sapiens
ttcaacttttct

SEQ ID NO: 1130065 - DNA, 13 bp, Homo sapiens
ttcaacttttcta

SEQ ID NO: 1130066 - DNA, 15 bp, Homo sapiens
ttcaagaaaatcttt

SEQ ID NO: 1130067 - DNA, 20 bp, Homo sapiens
ttcaagaaaatctttgttga

SEQ ID NO: 1130068 - DNA, 13 bp, Homo sapiens
ttcaagaaaggaa

SEQ ID NO: 1130069 - DNA, 23 bp, Homo sapiens
ttcaagaataatcacgctttcct

SEQ ID NO: 1130070 - DNA, 16 bp, Homo sapiens
ttcaagaatgaaaaat

SEQ ID NO: 1130071 - DNA, 20 bp, Homo sapiens
ttcaagaatgaaaaatataa

SEQ ID NO: 1130072 - DNA, 21 bp, Homo sapiens
ttcaagacatcaccatcagca

SEQ ID NO: 1130073 - DNA, 18 bp, Homo sapiens
ttcaagaccttctcccca

SEQ ID NO: 1130074 - DNA, 20 bp, Homo sapiens
ttcaagagctagaaaaataa

SEQ ID NO: 1130075 - DNA, 23 bp, Homo sapiens
ttcaagaggaaaggcgcccccgc

SEQ ID NO: 1130076 - DNA, 18 bp, Homo sapiens
ttcaagagggcaagtgga

SEQ ID NO: 1130077 - DNA, 19 bp, Homo sapiens
ttcaagagtggggggagga

SEQ ID NO: 1130078 - DNA, 21 bp, Homo sapiens
ttcaagagtggggggaggaag

SEQ ID NO: 1130079 - DNA, 23 bp, Homo sapiens
ttcaagatctaaatcatatataa

SEQ ID NO: 1130080 - DNA, 21 bp, Homo sapiens
ttcaagattctaaagctcaat

SEQ ID NO: 1130081 - DNA, 17 bp, Homo sapiens
ttcaagcagtcgtgcct

SEQ ID NO: 1130082 - DNA, 18 bp, Homo sapiens
ttcaagcagtcgtgcctg

SEQ ID NO: 1130083 - DNA, 22 bp, Homo sapiens
ttcaagcagtcgtgcctgtgtc

SEQ ID NO: 1130084 - DNA, 14 bp, Homo sapiens
ttcaagccattcca

SEQ ID NO: 1130085 - DNA, 16 bp, Homo sapiens
ttcaagcctctaaaca

SEQ ID NO: 1130086 - DNA, 10 bp, Homo sapiens
ttcaagctga

SEQ ID NO: 1130087 - DNA, 14 bp, Homo sapiens
ttcaagctgagaaa

SEQ ID NO: 1130088 - DNA, 16 bp, Homo sapiens
ttcaagctgagaaaag

SEQ ID NO: 1130089 - DNA, 20 bp, Homo sapiens
ttcaagctgtcccctctgtc

SEQ ID NO: 1130090 - DNA, 13 bp, Homo sapiens
ttcaaggaagaaa

SEQ ID NO: 1130091 - DNA, 20 bp, Homo sapiens
ttcaaggaagaaaacggaaa

SEQ ID NO: 1130092 - DNA, 21 bp, Homo sapiens
ttcaaggaatccatcctgcaa

SEQ ID NO: 1130093 - DNA, 16 bp, Homo sapiens
ttcaaggaatttctta

SEQ ID NO: 1130094 - DNA, 17 bp, Homo sapiens
ttcaaggaatttcttaa

SEQ ID NO: 1130095 - DNA, 15 bp, Homo sapiens
ttcaaggactagaac

SEQ ID NO: 1130096 - DNA, 16 bp, Homo sapiens
ttcaaggagaatatga

SEQ ID NO: 1130097 - DNA, 18 bp, Homo sapiens
ttcaaggccacaaaaaca

SEQ ID NO: 1130098 - DNA, 14 bp, Homo sapiens
ttcaaggccttcag

SEQ ID NO: 1130099 - DNA, 15 bp, Homo sapiens
ttcaaggccttcagt

SEQ ID NO: 1130100 - DNA, 19 bp, Homo sapiens
ttcaaggccttcagtttat

SEQ ID NO: 1130101 - DNA, 14 bp, Homo sapiens
ttcaaggccttcca

SEQ ID NO: 1130102 - DNA, 15 bp, Homo sapiens
ttcaaggctggggca

SEQ ID NO: 1130103 - DNA, 15 bp, Homo sapiens
ttcaaggcttccact

SEQ ID NO: 1130104 - DNA, 16 bp, Homo sapiens
ttcaaggcttccactg

SEQ ID NO: 1130105 - DNA, 15 bp, Homo sapiens
ttcaagggaagaaac

SEQ ID NO: 1130106 - DNA, 20 bp, Homo sapiens
ttcaaggtggccaaattatt

SEQ ID NO: 1130107 - DNA, 14 bp, Homo sapiens
ttcaagtaattttc

SEQ ID NO: 1130108 - DNA, 16 bp, Homo sapiens
ttcaagtaattttcat

SEQ ID NO: 1130109 - DNA, 19 bp, Homo sapiens
ttcaagtaattttcatatt

SEQ ID NO: 1130110 - DNA, 21 bp, Homo sapiens
ttcaagtaattttcatattaa

SEQ ID NO: 1130111 - DNA, 19 bp, Homo sapiens
ttcaagtgcttaaaaatac

SEQ ID NO: 1130112 - DNA, 19 bp, Homo sapiens
ttcaagtgtaaaatatttt

SEQ ID NO: 1130113 - DNA, 21 bp, Homo sapiens
ttcaagtgttgctcttggaaa

SEQ ID NO: 1130114 - DNA, 12 bp, Homo sapiens
ttcaagttattc

SEQ ID NO: 1130115 - DNA, 20 bp, Homo sapiens
ttcaagttattcaaatttgt

SEQ ID NO: 1130116 - DNA, 13 bp, Homo sapiens
ttcaagtttacac

SEQ ID NO: 1130117 - DNA, 16 bp, Homo sapiens
ttcaagttttaaagtt

SEQ ID NO: 1130118 - DNA, 12 bp, Homo sapiens
ttcaataaagca

SEQ ID NO: 1130119 - DNA, 18 bp, Homo sapiens
ttcaataccgctcagtat

SEQ ID NO: 1130120 - DNA, 17 bp, Homo sapiens
ttcaatagcacatatgg

SEQ ID NO: 1130121 - DNA, 15 bp, Homo sapiens
ttcaatagccactaa

SEQ ID NO: 1130122 - DNA, 15 bp, Homo sapiens
ttcaatatattgaac

SEQ ID NO: 1130123 - DNA, 12 bp, Homo sapiens
ttcaatatgcaa

SEQ ID NO: 1130124 - DNA, 19 bp, Homo sapiens
ttcaatatgcaagcagctt

SEQ ID NO: 1130125 - DNA, 11 bp, Homo sapiens
ttcaatattta

SEQ ID NO: 1130126 - DNA, 15 bp, Homo sapiens
ttcaatatttagaaa

SEQ ID NO: 1130127 - DNA, 11 bp, Homo sapiens
ttcaatatttt

SEQ ID NO: 1130128 - DNA, 21 bp, Homo sapiens
ttcaatcaactttactgtaat

SEQ ID NO: 1130129 - DNA, 14 bp, Homo sapiens
ttcaatcatcaaaa

SEQ ID NO: 1130130 - DNA, 16 bp, Homo sapiens
ttcaatcatttattca

SEQ ID NO: 1130131 - DNA, 19 bp, Homo sapiens
ttcagcccctgatctctga

SEQ ID NO: 1130132 - DNA, 20 bp, Homo sapiens
ttcagcccctgatctctgac

SEQ ID NO: 1130133 - DNA, 11 bp, Homo sapiens
ttcagccctgg

SEQ ID NO: 1130134 - DNA, 18 bp, Homo sapiens
ttcagccctggccaagct

SEQ ID NO: 1130135 - DNA, 18 bp, Homo sapiens
ttcagccctttgctctga

SEQ ID NO: 1130136 - DNA, 20 bp, Homo sapiens
ttcagcctagccgacctcag

SEQ ID NO: 1130137 - DNA, 21 bp, Homo sapiens
ttcagcctagccgacctcagc

SEQ ID NO: 1130138 - DNA, 13 bp, Homo sapiens
ttcagcctcctgt

SEQ ID NO: 1130139 - DNA, 24 bp, Homo sapiens
ttcagcgatgtatgcagctatctg

SEQ ID NO: 1130140 - DNA, 20 bp, Homo sapiens
ttcagctaagctaggaatga

SEQ ID NO: 1130141 - DNA, 19 bp, Homo sapiens
ttcagctcattatgaaaaa

SEQ ID NO: 1130142 - DNA, 18 bp, Homo sapiens
ttcagctcccttcccttg

SEQ ID NO: 1130143 - DNA, 12 bp, Homo sapiens
ttcagctcctga

SEQ ID NO: 1130144 - DNA, 13 bp, Homo sapiens
ttcagctcctgag

SEQ ID NO: 1130145 - DNA, 14 bp, Homo sapiens
ttcagctcctgagt

SEQ ID NO: 1130146 - DNA, 17 bp, Homo sapiens
ttcagctctgcaagaat

SEQ ID NO: 1130147 - DNA, 18 bp, Homo sapiens
ttcagctgcctgaaacag

SEQ ID NO: 1130148 - DNA, 19 bp, Homo sapiens
ttcagctgcctgaaacagc

SEQ ID NO: 1130149 - DNA, 20 bp, Homo sapiens
ttcagcttataatgaaatct

SEQ ID NO: 1130150 - DNA, 15 bp, Homo sapiens
ttcagcttgaacctg

SEQ ID NO: 1130151 - DNA, 19 bp, Homo sapiens
ttcagcttgaacctgcttc

SEQ ID NO: 1130152 - DNA, 22 bp, Homo sapiens
ttcagctttctcgcgccctccc

SEQ ID NO: 1130153 - DNA, 13 bp, Homo sapiens
ttcagctttggat

SEQ ID NO: 1130154 - DNA, 22 bp, Homo sapiens
ttcaggaacaagtaatgtatta

SEQ ID NO: 1130155 - DNA, 19 bp, Homo sapiens
ttcaggaatgtgtggcctg

SEQ ID NO: 1130156 - DNA, 14 bp, Homo sapiens
ttcaggaatttaaa

SEQ ID NO: 1130157 - DNA, 20 bp, Homo sapiens
ttcaggaggaatactgaaca

SEQ ID NO: 1130158 - DNA, 17 bp, Homo sapiens
ttcaggagttttaatgt

SEQ ID NO: 1130159 - DNA, 16 bp, Homo sapiens
ttcaggatacatgtgc

SEQ ID NO: 1130160 - DNA, 21 bp, Homo sapiens
ttcaggatactctgtcagatg

SEQ ID NO: 1130161 - DNA, 20 bp, Homo sapiens
ttcaggatattggttcttcc

SEQ ID NO: 1130162 - DNA, 12 bp, Homo sapiens
ttcaggcactga

SEQ ID NO: 1130163 - DNA, 17 bp, Homo sapiens
ttcaggcagcactgaca

SEQ ID NO: 1130164 - DNA, 15 bp, Homo sapiens
ttcaggcattttgtt

SEQ ID NO: 1130165 - DNA, 13 bp, Homo sapiens
ttcaggccagccc

SEQ ID NO: 1130166 - DNA, 18 bp, Homo sapiens
ttcaggccagcccagcca

SEQ ID NO: 1130167 - DNA, 20 bp, Homo sapiens
ttcaggccagcccagccagg

SEQ ID NO: 1130168 - DNA, 14 bp, Homo sapiens
ttcaggctctgaga

SEQ ID NO: 1130169 - DNA, 15 bp, Homo sapiens
ttcaggctcttctcc

SEQ ID NO: 1130170 - DNA, 21 bp, Homo sapiens
ttcagggacctcaggggcacc

SEQ ID NO: 1130171 - DNA, 14 bp, Homo sapiens
ttcagggattccct

SEQ ID NO: 1130172 - DNA, 18 bp, Homo sapiens
ttcagggcagggctctga

SEQ ID NO: 1130173 - DNA, 15 bp, Homo sapiens
ttcagggccagtcct

SEQ ID NO: 1130174 - DNA, 23 bp, Homo sapiens
ttcagggccagtcctcctgggag

SEQ ID NO: 1130175 - DNA, 14 bp, Homo sapiens
ttcaggggaagggc

SEQ ID NO: 1130176 - DNA, 18 bp, Homo sapiens
ttcaggggctttgggccc

SEQ ID NO: 1130177 - DNA, 21 bp, Homo sapiens
ttcaggggggttgtgaggcct

SEQ ID NO: 1130178 - DNA, 19 bp, Homo sapiens
ttcagggtggtaaagtatg

SEQ ID NO: 1130179 - DNA, 17 bp, Homo sapiens
ttcaggtacagaaaaca

SEQ ID NO: 1130180 - DNA, 21 bp, Homo sapiens
ttcaggtaggcccttgtcctg

SEQ ID NO: 1130181 - DNA, 20 bp, Homo sapiens
ttcaggtgcttttgatgtga

SEQ ID NO: 1130182 - DNA, 18 bp, Homo sapiens
ttcaggtggagagcacta

SEQ ID NO: 1130183 - DNA, 21 bp, Homo sapiens
ttcaggtggagagcactagaa

SEQ ID NO: 1130184 - DNA, 20 bp, Homo sapiens
ttcaggtggatgaggagaca

SEQ ID NO: 1130185 - DNA, 15 bp, Homo sapiens
ttcaggttctcatga

SEQ ID NO: 1130186 - DNA, 19 bp, Homo sapiens
ttcaggttttgtaaagatg

SEQ ID NO: 1130187 - DNA, 16 bp, Homo sapiens
ttcagtaatgtcttca

SEQ ID NO: 1130188 - DNA, 17 bp, Homo sapiens
ttcagtaatgtcttcag

SEQ ID NO: 1130189 - DNA, 14 bp, Homo sapiens
ttcagtagaattac

SEQ ID NO: 1130190 - DNA, 17 bp, Homo sapiens
ttcagtagaattaccat

SEQ ID NO: 1130191 - DNA, 21 bp, Homo sapiens
ttcagtaggaacaagctggct

SEQ ID NO: 1130192 - DNA, 14 bp, Homo sapiens
ttcagtaggaactg

SEQ ID NO: 1130193 - DNA, 20 bp, Homo sapiens
ttcagtataatttaacttca

SEQ ID NO: 1130194 - DNA, 23 bp, Homo sapiens
ttcagtataatttaacttcagag

SEQ ID NO: 1130195 - DNA, 15 bp, Homo sapiens
ttcagtatactgtgt

SEQ ID NO: 1130196 - DNA, 17 bp, Homo sapiens
ttcagtatactgtgtgg

SEQ ID NO: 1130197 - DNA, 12 bp, Homo sapiens
ttcagtatctta

SEQ ID NO: 1130198 - DNA, 19 bp, Homo sapiens
ttcagtatgtgtcaactga

SEQ ID NO: 1130199 - DNA, 18 bp, Homo sapiens
ttcagtattttggagaaa

SEQ ID NO: 1130200 - DNA, 19 bp, Homo sapiens
ttcagtattttggagaaat

SEQ ID NO: 1130201 - DNA, 21 bp, Homo sapiens
ttcagtattttggagaaatta

SEQ ID NO: 1130202 - DNA, 14 bp, Homo sapiens
ttcagtcaattctg

SEQ ID NO: 1130203 - DNA, 12 bp, Homo sapiens
ttcagtctgtgt

SEQ ID NO: 1130204 - DNA, 19 bp, Homo sapiens
ttcagtcttaatactttat

SEQ ID NO: 1130205 - DNA, 20 bp, Homo sapiens
ttcagtcttggtaaaacatt

SEQ ID NO: 1130206 - DNA, 22 bp, Homo sapiens
ttcagtgagagacgccctattt

SEQ ID NO: 1130207 - DNA, 21 bp, Homo sapiens
ttcagtgagcccctccccagc

SEQ ID NO: 1130208 - DNA, 15 bp, Homo sapiens
ttcagtgatactcac

SEQ ID NO: 1130209 - DNA, 16 bp, Homo sapiens
ttcagtgctttttcct

SEQ ID NO: 1130210 - DNA, 18 bp, Homo sapiens
ttcagtggaacacaaatg

SEQ ID NO: 1130211 - DNA, 23 bp, Homo sapiens
ttcagtggaccgaaatctgtatt

SEQ ID NO: 1130212 - DNA, 12 bp, Homo sapiens
ttcagtgtacat

SEQ ID NO: 1130213 - DNA, 16 bp, Homo sapiens
ttcagtgtcccaggca

SEQ ID NO: 1130214 - DNA, 13 bp, Homo sapiens
ttcagtgtcccgg

SEQ ID NO: 1130215 - DNA, 18 bp, Homo sapiens
ttcagtgttaaatgtgat

SEQ ID NO: 1130216 - DNA, 22 bp, Homo sapiens
ttcagtgttaaatgtgatgaat

SEQ ID NO: 1130217 - DNA, 19 bp, Homo sapiens
ttcagttaattcttagata

SEQ ID NO: 1130218 - DNA, 19 bp, Homo sapiens
ttcagttacaagattgtaa

SEQ ID NO: 1130219 - DNA, 14 bp, Homo sapiens
ttcagttccctcct

SEQ ID NO: 1130220 - DNA, 16 bp, Homo sapiens
ttcagttgattttaca

SEQ ID NO: 1130221 - DNA, 13 bp, Homo sapiens
ttcagtttcagga

SEQ ID NO: 1130222 - DNA, 13 bp, Homo sapiens
ttcagtttcataa

SEQ ID NO: 1130223 - DNA, 16 bp, Homo sapiens
ttcagtttcataaaag

SEQ ID NO: 1130224 - DNA, 22 bp, Homo sapiens
ttcagtttgtacaatccacaat

SEQ ID NO: 1130225 - DNA, 19 bp, Homo sapiens
ttcagttttatttttgcca

SEQ ID NO: 1130226 - DNA, 21 bp, Homo sapiens
ttcagttttcatttggttcat

SEQ ID NO: 1130227 - DNA, 16 bp, Homo sapiens
ttcagttttgatattt

SEQ ID NO: 1130228 - DNA, 17 bp, Homo sapiens
ttcagtttttcatttgt

SEQ ID NO: 1130229 - DNA, 19 bp, Homo sapiens
ttcagtttttttttttcca

SEQ ID NO: 1130230 - DNA, 15 bp, Homo sapiens
ttcataaagtaatga

SEQ ID NO: 1130231 - DNA, 13 bp, Homo sapiens
ttcataaatcatg

SEQ ID NO: 1130232 - DNA, 16 bp, Homo sapiens
ttcataaggcctgccc

SEQ ID NO: 1130233 - DNA, 17 bp, Homo sapiens
ttcataaggcctgccct

SEQ ID NO: 1130234 - DNA, 19 bp, Homo sapiens
ttcataagtattatgtctc

SEQ ID NO: 1130235 - DNA, 20 bp, Homo sapiens
ttcataagtattatgtctct

SEQ ID NO: 1130236 - DNA, 16 bp, Homo sapiens
ttcataataaaagtga

SEQ ID NO: 1130237 - DNA, 13 bp, Homo sapiens
ttcataatcagta

SEQ ID NO: 1130238 - DNA, 14 bp, Homo sapiens
ttcataatcagtaa

SEQ ID NO: 1130239 - DNA, 17 bp, Homo sapiens
ttcataatgaattataa

SEQ ID NO: 1130240 - DNA, 19 bp, Homo sapiens
ttcataatgaattataaca

SEQ ID NO: 1130241 - DNA, 17 bp, Homo sapiens
ttcataattctgaaaca

SEQ ID NO: 1130242 - DNA, 18 bp, Homo sapiens
ttcataattctgaaacaa

SEQ ID NO: 1130243 - DNA, 22 bp, Homo sapiens
ttcatacaaagtactgtcctca

SEQ ID NO: 1130244 - DNA, 21 bp, Homo sapiens
ttcatacatatatatatttgt

SEQ ID NO: 1130245 - DNA, 22 bp, Homo sapiens
ttcatacatatatatatttgta

SEQ ID NO: 1130246 - DNA, 16 bp, Homo sapiens
ttcataccacttgaat

SEQ ID NO: 1130247 - DNA, 20 bp, Homo sapiens
ttcatacgcatcccatctct

SEQ ID NO: 1130248 - DNA, 22 bp, Homo sapiens
ttcatacgcatcccatctctcc

SEQ ID NO: 1130249 - DNA, 23 bp, Homo sapiens
ttcatacgcatcccatctctccc

SEQ ID NO: 1130250 - DNA, 15 bp, Homo sapiens
ttcatactacccttt

SEQ ID NO: 1130251 - DNA, 23 bp, Homo sapiens
ttcatactccttttaagcagtga

SEQ ID NO: 1130252 - DNA, 15 bp, Homo sapiens
ttcattccattgcct

SEQ ID NO: 1130253 - DNA, 15 bp, Homo sapiens
ttcattccctgtagt

SEQ ID NO: 1130254 - DNA, 23 bp, Homo sapiens
ttcattcgtcttgttgttattga

SEQ ID NO: 1130255 - DNA, 12 bp, Homo sapiens
ttcattctcaga

SEQ ID NO: 1130256 - DNA, 12 bp, Homo sapiens
ttcattctcctt

SEQ ID NO: 1130257 - DNA, 18 bp, Homo sapiens
ttcattctgcaagtatac

SEQ ID NO: 1130258 - DNA, 14 bp, Homo sapiens
ttcattctgcattg

SEQ ID NO: 1130259 - DNA, 16 bp, Homo sapiens
ttcattgactatcaaa

SEQ ID NO: 1130260 - DNA, 17 bp, Homo sapiens
ttcattgagagttttgt

SEQ ID NO: 1130261 - DNA, 19 bp, Homo sapiens
ttcattgagagttttgtct

SEQ ID NO: 1130262 - DNA, 22 bp, Homo sapiens
ttcattgagagttttgtcttga

SEQ ID NO: 1130263 - DNA, 18 bp, Homo sapiens
ttcattgagttggttact

SEQ ID NO: 1130264 - DNA, 20 bp, Homo sapiens
ttcattgatggatgtcttct

SEQ ID NO: 1130265 - DNA, 14 bp, Homo sapiens
ttcattgctaagac

SEQ ID NO: 1130266 - DNA, 17 bp, Homo sapiens
ttcattggttaattttt

SEQ ID NO: 1130267 - DNA, 20 bp, Homo sapiens
ttcattgtaatgttactgat

SEQ ID NO: 1130268 - DNA, 12 bp, Homo sapiens
ttcattgtctct

SEQ ID NO: 1130269 - DNA, 14 bp, Homo sapiens
ttcatttaaactaa

SEQ ID NO: 1130270 - DNA, 18 bp, Homo sapiens
ttcatttagataatttga

SEQ ID NO: 1130271 - DNA, 21 bp, Homo sapiens
ttcatttagataatttgaaaa

SEQ ID NO: 1130272 - DNA, 22 bp, Homo sapiens
ttcatttagataatttgaaaaa

SEQ ID NO: 1130273 - DNA, 16 bp, Homo sapiens
ttcatttcaatcattg

SEQ ID NO: 1130274 - DNA, 18 bp, Homo sapiens
ttcatttcaatcattgaa

SEQ ID NO: 1130275 - DNA, 14 bp, Homo sapiens
ttcatttcatgtat

SEQ ID NO: 1130276 - DNA, 15 bp, Homo sapiens
ttcatttcattgtat

SEQ ID NO: 1130277 - DNA, 15 bp, Homo sapiens
ttcatttctaattaa

SEQ ID NO: 1130278 - DNA, 11 bp, Homo sapiens
ttcatttctta

SEQ ID NO: 1130279 - DNA, 16 bp, Homo sapiens
ttcatttgcacaagta

SEQ ID NO: 1130280 - DNA, 22 bp, Homo sapiens
ttcatttgctaagtgtatgatg

SEQ ID NO: 1130281 - DNA, 19 bp, Homo sapiens
ttcatttggtgttcctgga

SEQ ID NO: 1130282 - DNA, 18 bp, Homo sapiens
ttcatttgtaaaaatgag

SEQ ID NO: 1130283 - DNA, 18 bp, Homo sapiens
ttcatttgtatgtcaaag

SEQ ID NO: 1130284 - DNA, 13 bp, Homo sapiens
ttcatttgtattg

SEQ ID NO: 1130285 - DNA, 13 bp, Homo sapiens
ttcatttgtgcca

SEQ ID NO: 1130286 - DNA, 14 bp, Homo sapiens
ttcatttgtgccac

SEQ ID NO: 1130287 - DNA, 15 bp, Homo sapiens
ttcatttgtgtcaat

SEQ ID NO: 1130288 - DNA, 18 bp, Homo sapiens
ttcatttgttttgctttt

SEQ ID NO: 1130289 - DNA, 21 bp, Homo sapiens
ttcattttaacatgatttcaa

SEQ ID NO: 1130290 - DNA, 19 bp, Homo sapiens
ttcattttaggaataataa

SEQ ID NO: 1130291 - DNA, 20 bp, Homo sapiens
ttcattttaggaataataaa

SEQ ID NO: 1130292 - DNA, 17 bp, Homo sapiens
ttcattttagtgactgt

SEQ ID NO: 1130293 - DNA, 12 bp, Homo sapiens
ttcattttcctg

SEQ ID NO: 1130294 - DNA, 14 bp, Homo sapiens
ttcattttctagat

SEQ ID NO: 1130295 - DNA, 17 bp, Homo sapiens
ttcattttgaaaaacac

SEQ ID NO: 1130296 - DNA, 16 bp, Homo sapiens
ttcattttgaaaagta

SEQ ID NO: 1130297 - DNA, 20 bp, Homo sapiens
ttcattttgagctgaaatgc

SEQ ID NO: 1130298 - DNA, 22 bp, Homo sapiens
ttcattttgcactgaggatatt

SEQ ID NO: 1130299 - DNA, 15 bp, Homo sapiens
ttcattttgcagaag

SEQ ID NO: 1130300 - DNA, 18 bp, Homo sapiens
ttcattttgcagaaggaa

SEQ ID NO: 1130301 - DNA, 16 bp, Homo sapiens
ttcattttggttttgt

SEQ ID NO: 1130302 - DNA, 20 bp, Homo sapiens
ttcattttgttttgctctga

SEQ ID NO: 1130303 - DNA, 21 bp, Homo sapiens
ttcatttttaaagcctggctt

SEQ ID NO: 1130304 - DNA, 14 bp, Homo sapiens
ttcatttttaaatg

SEQ ID NO: 1130305 - DNA, 18 bp, Homo sapiens
ttcatttttaagactgta

SEQ ID NO: 1130306 - DNA, 19 bp, Homo sapiens
ttcatttttaagactgtaa

SEQ ID NO: 1130307 - DNA, 24 bp, Homo sapiens
ttcatttttgtgagcctctttgta

SEQ ID NO: 1130308 - DNA, 19 bp, Homo sapiens
ttcatttttttctctctgg

SEQ ID NO: 1130309 - DNA, 16 bp, Homo sapiens
ttccaaaaaattaaaa

SEQ ID NO: 1130310 - DNA, 15 bp, Homo sapiens
ttccaaaacctgctt

SEQ ID NO: 1130311 - DNA, 18 bp, Homo sapiens
ttccaaaacctgcttcct

SEQ ID NO: 1130312 - DNA, 23 bp, Homo sapiens
ttccaaaacctgcttccttcagt

SEQ ID NO: 1130313 - DNA, 19 bp, Homo sapiens
ttccaaaataatctatatt

SEQ ID NO: 1130314 - DNA, 23 bp, Homo sapiens
ttccaaaataatctatattaaat

SEQ ID NO: 1130315 - DNA, 16 bp, Homo sapiens
ttccaaaatctcccat

SEQ ID NO: 1130316 - DNA, 19 bp, Homo sapiens
ttccaaaatctcccatttt

SEQ ID NO: 1130317 - DNA, 16 bp, Homo sapiens
ttccaaaccagtttat

SEQ ID NO: 1130318 - DNA, 14 bp, Homo sapiens
ttccaaactaattt

SEQ ID NO: 1130319 - DNA, 20 bp, Homo sapiens
ttccaaactcttccctctct

SEQ ID NO: 1130320 - DNA, 21 bp, Homo sapiens
ttccaaagagtagaattgcat

SEQ ID NO: 1130321 - DNA, 16 bp, Homo sapiens
ttccaaagctttatta

SEQ ID NO: 1130322 - DNA, 16 bp, Homo sapiens
ttccaaagtacactgt

SEQ ID NO: 1130323 - DNA, 22 bp, Homo sapiens
ttccaaataaaacttgagccca

SEQ ID NO: 1130324 - DNA, 15 bp, Homo sapiens
ttccaaataaaatga

SEQ ID NO: 1130325 - DNA, 16 bp, Homo sapiens
ttccaaataaataatt

SEQ ID NO: 1130326 - DNA, 22 bp, Homo sapiens
ttccaaatgcagttcattgcag

SEQ ID NO: 1130327 - DNA, 17 bp, Homo sapiens
ttccaaatgcccaagga

SEQ ID NO: 1130328 - DNA, 19 bp, Homo sapiens
ttccaaatgtggcctccat

SEQ ID NO: 1130329 - DNA, 22 bp, Homo sapiens
ttccaaatgtttataaaggtaa

SEQ ID NO: 1130330 - DNA, 19 bp, Homo sapiens
ttccaaattaaaacaaata

SEQ ID NO: 1130331 - DNA, 12 bp, Homo sapiens
ttccaaattatt

SEQ ID NO: 1130332 - DNA, 23 bp, Homo sapiens
ttccaaattattaattgtcctgt

SEQ ID NO: 1130333 - DNA, 18 bp, Homo sapiens
ttccaaattatttcttaa

SEQ ID NO: 1130334 - DNA, 19 bp, Homo sapiens
ttccaaattatttcttaat

SEQ ID NO: 1130335 - DNA, 23 bp, Homo sapiens
ttccaaattcacaagttgtgttt

SEQ ID NO: 1130336 - DNA, 20 bp, Homo sapiens
ttccaaattcagtttcataa

SEQ ID NO: 1130337 - DNA, 15 bp, Homo sapiens
ttccaaattctgctt

SEQ ID NO: 1130338 - DNA, 12 bp, Homo sapiens
ttccaacaccac

SEQ ID NO: 1130339 - DNA, 11 bp, Homo sapiens
ttccaacagca

SEQ ID NO: 1130340 - DNA, 16 bp, Homo sapiens
ttccaaccaggcagta

SEQ ID NO: 1130341 - DNA, 15 bp, Homo sapiens
ttccaacccagccac

SEQ ID NO: 1130342 - DNA, 17 bp, Homo sapiens
ttccaacttgaaggatt

SEQ ID NO: 1130343 - DNA, 20 bp, Homo sapiens
ttccaacttgaaggattgca

SEQ ID NO: 1130344 - DNA, 15 bp, Homo sapiens
ttccaagaaaatatc

SEQ ID NO: 1130345 - DNA, 23 bp, Homo sapiens
ttccaagaaagatgaatacattt

SEQ ID NO: 1130346 - DNA, 13 bp, Homo sapiens
ttccaagacattg

SEQ ID NO: 1130347 - DNA, 19 bp, Homo sapiens
ttccaagactgaagactgc

SEQ ID NO: 1130348 - DNA, 17 bp, Homo sapiens
ttccaagcccttttaca

SEQ ID NO: 1130349 - DNA, 20 bp, Homo sapiens
ttccaagctgtgttaactgt

SEQ ID NO: 1130350 - DNA, 16 bp, Homo sapiens
ttccaaggaaaattga

SEQ ID NO: 1130351 - DNA, 18 bp, Homo sapiens
ttccaaggccagaaggag

SEQ ID NO: 1130352 - DNA, 22 bp, Homo sapiens
ttccaaggccagaaggaggggg

SEQ ID NO: 1130353 - DNA, 17 bp, Homo sapiens
ttccaagggtactaagg

SEQ ID NO: 1130354 - DNA, 18 bp, Homo sapiens
ttccaaggtcactcttgg

SEQ ID NO: 1130355 - DNA, 19 bp, Homo sapiens
ttccaagtcaacactcttc

SEQ ID NO: 1130356 - DNA, 15 bp, Homo sapiens
ttccaagtctccacc

SEQ ID NO: 1130357 - DNA, 16 bp, Homo sapiens
ttccaagttgctaata

SEQ ID NO: 1130358 - DNA, 20 bp, Homo sapiens
ttccaataccctagaagaaa

SEQ ID NO: 1130359 - DNA, 23 bp, Homo sapiens
ttccaataccctagaagaaaacc

SEQ ID NO: 1130360 - DNA, 15 bp, Homo sapiens
ttccaatgcttctta

SEQ ID NO: 1130361 - DNA, 18 bp, Homo sapiens
ttccaattctaaatccga

SEQ ID NO: 1130362 - DNA, 19 bp, Homo sapiens
ttccacaagattcccagag

SEQ ID NO: 1130363 - DNA, 14 bp, Homo sapiens
ttccacacatttaa

SEQ ID NO: 1130364 - DNA, 18 bp, Homo sapiens
ttccacacatttaaaaca

SEQ ID NO: 1130365 - DNA, 18 bp, Homo sapiens
ttccacaccaagcagcaa

SEQ ID NO: 1130366 - DNA, 16 bp, Homo sapiens
ttccacacgcattaat

SEQ ID NO: 1130367 - DNA, 14 bp, Homo sapiens
ttccacagaggaca

SEQ ID NO: 1130368 - DNA, 18 bp, Homo sapiens
ttccacagttgccaccac

SEQ ID NO: 1130369 - DNA, 17 bp, Homo sapiens
ttccaccaaatgtgctt

SEQ ID NO: 1130370 - DNA, 16 bp, Homo sapiens
ttccaccacagccagc

SEQ ID NO: 1130371 - DNA, 22 bp, Homo sapiens
ttccaccacagccagcacctgg

SEQ ID NO: 1130372 - DNA, 11 bp, Homo sapiens
ttccaccctgg

SEQ ID NO: 1130373 - DNA, 14 bp, Homo sapiens
ttccacctgccaca

SEQ ID NO: 1130374 - DNA, 15 bp, Homo sapiens
ttccccccatctctg

SEQ ID NO: 1130375 - DNA, 16 bp, Homo sapiens
ttccccccatctctga

SEQ ID NO: 1130376 - DNA, 20 bp, Homo sapiens
ttccccccatctctgagtgg

SEQ ID NO: 1130377 - DNA, 21 bp, Homo sapiens
ttccccccatgttgtaatgct

SEQ ID NO: 1130378 - DNA, 17 bp, Homo sapiens
ttcccccccctttccta

SEQ ID NO: 1130379 - DNA, 18 bp, Homo sapiens
ttcccccccctttcctaa

SEQ ID NO: 1130380 - DNA, 23 bp, Homo sapiens
ttcccccctctcctcccagctgc

SEQ ID NO: 1130381 - DNA, 16 bp, Homo sapiens
ttccccctgcaaaaag

SEQ ID NO: 1130382 - DNA, 14 bp, Homo sapiens
ttccccctgccctg

SEQ ID NO: 1130383 - DNA, 15 bp, Homo sapiens
ttccccctgccctgt

SEQ ID NO: 1130384 - DNA, 17 bp, Homo sapiens
ttcccccttcacaaagc

SEQ ID NO: 1130385 - DNA, 12 bp, Homo sapiens
ttcccccttccc

SEQ ID NO: 1130386 - DNA, 21 bp, Homo sapiens
ttccccgatgtcccctgcggg

SEQ ID NO: 1130387 - DNA, 16 bp, Homo sapiens
ttccccgggggaggaa

SEQ ID NO: 1130388 - DNA, 17 bp, Homo sapiens
ttccccggtcccttgag

SEQ ID NO: 1130389 - DNA, 15 bp, Homo sapiens
ttccccgtcccctgc

SEQ ID NO: 1130390 - DNA, 22 bp, Homo sapiens
ttccccgtcccctgcagcctgg

SEQ ID NO: 1130391 - DNA, 23 bp, Homo sapiens
ttccccgtcccctgcagcctggg

SEQ ID NO: 1130392 - DNA, 22 bp, Homo sapiens
ttcccctcagaaaaaaattcat

SEQ ID NO: 1130393 - DNA, 16 bp, Homo sapiens
ttcccctcagagctct

SEQ ID NO: 1130394 - DNA, 23 bp, Homo sapiens
ttcccctccaagaccctgtgttc

SEQ ID NO: 1130395 - DNA, 14 bp, Homo sapiens
ttcccctcccacct

SEQ ID NO: 1130396 - DNA, 16 bp, Homo sapiens
ttcccctcccccactc

SEQ ID NO: 1130397 - DNA, 21 bp, Homo sapiens
ttcccctcccgacagcccatc

SEQ ID NO: 1130398 - DNA, 16 bp, Homo sapiens
ttcccctccctaccct

SEQ ID NO: 1130399 - DNA, 17 bp, Homo sapiens
ttcccctccctggctcc

SEQ ID NO: 1130400 - DNA, 14 bp, Homo sapiens
ttcccctccctggg

SEQ ID NO: 1130401 - DNA, 17 bp, Homo sapiens
ttcccctccttctccct

SEQ ID NO: 1130402 - DNA, 12 bp, Homo sapiens
ttcccctctccc

SEQ ID NO: 1130403 - DNA, 14 bp, Homo sapiens
ttcccctctgctgc

SEQ ID NO: 1130404 - DNA, 15 bp, Homo sapiens
ttcccctctgctgct

SEQ ID NO: 1130405 - DNA, 18 bp, Homo sapiens
ttcccctctgctgctgtc

SEQ ID NO: 1130406 - DNA, 19 bp, Homo sapiens
ttcccctcttgtctcccct

SEQ ID NO: 1130407 - DNA, 22 bp, Homo sapiens
ttcccctgagagtttcctcaga

SEQ ID NO: 1130408 - DNA, 13 bp, Homo sapiens
ttcccctggcctc

SEQ ID NO: 1130409 - DNA, 14 bp, Homo sapiens
ttcccctggcctta

SEQ ID NO: 1130410 - DNA, 21 bp, Homo sapiens
ttcccctgtcagtttcccctc

SEQ ID NO: 1130411 - DNA, 17 bp, Homo sapiens
ttccccttactctcaca

SEQ ID NO: 1130412 - DNA, 15 bp, Homo sapiens
ttccccttcaccgct

SEQ ID NO: 1130413 - DNA, 18 bp, Homo sapiens
ttccccttcaccgctccc

SEQ ID NO: 1130414 - DNA, 15 bp, Homo sapiens
ttccccttccactga

SEQ ID NO: 1130415 - DNA, 22 bp, Homo sapiens
ttccccttcctaattccacagc

SEQ ID NO: 1130416 - DNA, 23 bp, Homo sapiens
ttccccttgccacggtttatcct

SEQ ID NO: 1130417 - DNA, 23 bp, Homo sapiens
ttccccttgcccagggctcagcc

SEQ ID NO: 1130418 - DNA, 23 bp, Homo sapiens
ttccccttgcccttgccctgacc

SEQ ID NO: 1130419 - DNA, 12 bp, Homo sapiens
ttccccttggac

SEQ ID NO: 1130420 - DNA, 22 bp, Homo sapiens
ttccccttttgcctggctgtgg

SEQ ID NO: 1130421 - DNA, 16 bp, Homo sapiens
ttcccgaagtaaaata

SEQ ID NO: 1130422 - DNA, 15 bp, Homo sapiens
ttcccgccccacctc

SEQ ID NO: 1130423 - DNA, 19 bp, Homo sapiens
ttcccgccccacctcccat

SEQ ID NO: 1130424 - DNA, 15 bp, Homo sapiens
ttcccgctcagccct

SEQ ID NO: 1130425 - DNA, 16 bp, Homo sapiens
ttcccgctcagccctc

SEQ ID NO: 1130426 - DNA, 18 bp, Homo sapiens
ttcccggagcacagccct

SEQ ID NO: 1130427 - DNA, 22 bp, Homo sapiens
ttcccggcccttacctttcctg

SEQ ID NO: 1130428 - DNA, 19 bp, Homo sapiens
ttcccggtcccgagtacag

SEQ ID NO: 1130429 - DNA, 19 bp, Homo sapiens
ttcccggttcaggaccact

SEQ ID NO: 1130430 - DNA, 21 bp, Homo sapiens
ttcccgtcccatatcctgcct

SEQ ID NO: 1130431 - DNA, 13 bp, Homo sapiens
ttcccgtctcaga

SEQ ID NO: 1130432 - DNA, 14 bp, Homo sapiens
ttccctaaactgca

SEQ ID NO: 1130433 - DNA, 20 bp, Homo sapiens
ttccctacagcctagggcag

SEQ ID NO: 1130434 - DNA, 13 bp, Homo sapiens
ttccctacctcag

SEQ ID NO: 1130435 - DNA, 22 bp, Homo sapiens
ttccctactgaaccctgcctct

SEQ ID NO: 1130436 - DNA, 14 bp, Homo sapiens
ttccctacttcctg

SEQ ID NO: 1130437 - DNA, 22 bp, Homo sapiens
ttccctagaaagccatattcca

SEQ ID NO: 1130438 - DNA, 14 bp, Homo sapiens
ttccctcaccccct

SEQ ID NO: 1130439 - DNA, 18 bp, Homo sapiens
ttccctcaccccctccca

SEQ ID NO: 1130440 - DNA, 13 bp, Homo sapiens
ttccctcactctt

SEQ ID NO: 1130441 - DNA, 16 bp, Homo sapiens
ttccctcatcctttca

SEQ ID NO: 1130442 - DNA, 17 bp, Homo sapiens
ttccctcatctctcctc

SEQ ID NO: 1130443 - DNA, 13 bp, Homo sapiens
ttccctccccctc

SEQ ID NO: 1130444 - DNA, 22 bp, Homo sapiens
ttccctccccctccttgtgcct

SEQ ID NO: 1130445 - DNA, 11 bp, Homo sapiens
ttccctcctcc

SEQ ID NO: 1130446 - DNA, 13 bp, Homo sapiens
ttccctcctgaca

SEQ ID NO: 1130447 - DNA, 22 bp, Homo sapiens
ttccctcctgagtgccccactt

SEQ ID NO: 1130448 - DNA, 15 bp, Homo sapiens
ttccctcctgcccag

SEQ ID NO: 1130449 - DNA, 12 bp, Homo sapiens
ttccctcctggt

SEQ ID NO: 1130450 - DNA, 13 bp, Homo sapiens
ttccctcctggtc

SEQ ID NO: 1130451 - DNA, 15 bp, Homo sapiens
ttccctcctggtcct

SEQ ID NO: 1130452 - DNA, 21 bp, Homo sapiens
ttccctcctggtcctggacac

SEQ ID NO: 1130453 - DNA, 18 bp, Homo sapiens
ttccctcgacttgaccct

SEQ ID NO: 1130454 - DNA, 14 bp, Homo sapiens
ttccctcgtccgtc

SEQ ID NO: 1130455 - DNA, 16 bp, Homo sapiens
ttccctcgtccgtctg

SEQ ID NO: 1130456 - DNA, 12 bp, Homo sapiens
ttccctctccca

SEQ ID NO: 1130457 - DNA, 14 bp, Homo sapiens
ttccctctcccagt

SEQ ID NO: 1130458 - DNA, 12 bp, Homo sapiens
ttccctctctag

SEQ ID NO: 1130459 - DNA, 14 bp, Homo sapiens
ttccctctctcact

SEQ ID NO: 1130460 - DNA, 21 bp, Homo sapiens
ttccctctctgatgtcccagt

SEQ ID NO: 1130461 - DNA, 11 bp, Homo sapiens
ttccctctgag

SEQ ID NO: 1130462 - DNA, 23 bp, Homo sapiens
ttccctctgagaattccaaggag

SEQ ID NO: 1130463 - DNA, 13 bp, Homo sapiens
ttccctctgcctg

SEQ ID NO: 1130464 - DNA, 17 bp, Homo sapiens
ttccctctgcctgtccc

SEQ ID NO: 1130465 - DNA, 21 bp, Homo sapiens
ttccctctgcctgtccctctc

SEQ ID NO: 1130466 - DNA, 14 bp, Homo sapiens
ttccctctggcttc

SEQ ID NO: 1130467 - DNA, 20 bp, Homo sapiens
ttccctctgggcacgcctgc

SEQ ID NO: 1130468 - DNA, 21 bp, Homo sapiens
ttccctcttgtccctttccct

SEQ ID NO: 1130469 - DNA, 16 bp, Homo sapiens
ttccctctttggctcc

SEQ ID NO: 1130470 - DNA, 20 bp, Homo sapiens
ttccctctttggctcccctg

SEQ ID NO: 1130471 - DNA, 23 bp, Homo sapiens
ttccctcttttcttactcctcct

SEQ ID NO: 1130472 - DNA, 19 bp, Homo sapiens
ttccctgaaaacccagaga

SEQ ID NO: 1130473 - DNA, 20 bp, Homo sapiens
ttccctgaacgttttcttct

SEQ ID NO: 1130474 - DNA, 15 bp, Homo sapiens
ttccctgaatgtatt

SEQ ID NO: 1130475 - DNA, 18 bp, Homo sapiens
ttccctgactcctctaag

SEQ ID NO: 1130476 - DNA, 18 bp, Homo sapiens
ttccctgagtcaccagga

SEQ ID NO: 1130477 - DNA, 19 bp, Homo sapiens
ttccctgattgacctgctc

SEQ ID NO: 1130478 - DNA, 10 bp, Homo sapiens
ttccctgcaa

SEQ ID NO: 1130479 - DNA, 11 bp, Homo sapiens
ttccctgcaga

SEQ ID NO: 1130480 - DNA, 23 bp, Homo sapiens
ttccctgcagacctcaagccatc

SEQ ID NO: 1130481 - DNA, 22 bp, Homo sapiens
ttccctgcagagctttggccat

SEQ ID NO: 1130482 - DNA, 23 bp, Homo sapiens
ttccctgcagggcgcccctggga

SEQ ID NO: 1130483 - DNA, 12 bp, Homo sapiens
ttccctgcccaa

SEQ ID NO: 1130484 - DNA, 17 bp, Homo sapiens
ttccctgcccaaaccct

SEQ ID NO: 1130485 - DNA, 13 bp, Homo sapiens
ttccctgcccctg

SEQ ID NO: 1130486 - DNA, 14 bp, Homo sapiens
ttccctgccctccc

SEQ ID NO: 1130487 - DNA, 23 bp, Homo sapiens
ttccctgcctctcatcaactgaa

SEQ ID NO: 1130488 - DNA, 13 bp, Homo sapiens
ttccctgcttcca

SEQ ID NO: 1130489 - DNA, 15 bp, Homo sapiens
ttccctgcttccagg

SEQ ID NO: 1130490 - DNA, 17 bp, Homo sapiens
ttccctggagctgaggt

SEQ ID NO: 1130491 - DNA, 20 bp, Homo sapiens
ttccctggcatgatggacaa

SEQ ID NO: 1130492 - DNA, 20 bp, Homo sapiens
ttccctggcggccccaactc

SEQ ID NO: 1130493 - DNA, 13 bp, Homo sapiens
ttccctgggctgc

SEQ ID NO: 1130494 - DNA, 20 bp, Homo sapiens
ttccctgggctgtgctacct

SEQ ID NO: 1130495 - DNA, 10 bp, Homo sapiens
ttccctgggg

SEQ ID NO: 1130496 - DNA, 23 bp, Homo sapiens
ttcctcaagtatcttctattttt

SEQ ID NO: 1130497 - DNA, 23 bp, Homo sapiens
ttcctcacgtgcaggacagctct

SEQ ID NO: 1130498 - DNA, 19 bp, Homo sapiens
ttcctcactgcctggtaaa

SEQ ID NO: 1130499 - DNA, 11 bp, Homo sapiens
ttcctcagaat

SEQ ID NO: 1130500 - DNA, 16 bp, Homo sapiens
ttcctcagatccccag

SEQ ID NO: 1130501 - DNA, 16 bp, Homo sapiens
ttcctcagattgctga

SEQ ID NO: 1130502 - DNA, 15 bp, Homo sapiens
ttcctcagctgccaa

SEQ ID NO: 1130503 - DNA, 12 bp, Homo sapiens
ttcctcagctta

SEQ ID NO: 1130504 - DNA, 21 bp, Homo sapiens
ttcctcaggaaggacatgggt

SEQ ID NO: 1130505 - DNA, 22 bp, Homo sapiens
ttcctcagttgatataaaactc

SEQ ID NO: 1130506 - DNA, 20 bp, Homo sapiens
ttcctcatcccctcgtcctg

SEQ ID NO: 1130507 - DNA, 15 bp, Homo sapiens
ttcctcatgtaacat

SEQ ID NO: 1130508 - DNA, 18 bp, Homo sapiens
ttcctccacagtccccca

SEQ ID NO: 1130509 - DNA, 14 bp, Homo sapiens
ttcctccacatcct

SEQ ID NO: 1130510 - DNA, 12 bp, Homo sapiens
ttcctccagcct

SEQ ID NO: 1130511 - DNA, 17 bp, Homo sapiens
ttcctccagcctcccct

SEQ ID NO: 1130512 - DNA, 18 bp, Homo sapiens
ttcctccagcctcccctc

SEQ ID NO: 1130513 - DNA, 19 bp, Homo sapiens
ttcctccagcctcccctcc

SEQ ID NO: 1130514 - DNA, 21 bp, Homo sapiens
ttcctccagcctcccctcccc

SEQ ID NO: 1130515 - DNA, 22 bp, Homo sapiens
ttcctccagctgcaccagagca

SEQ ID NO: 1130516 - DNA, 17 bp, Homo sapiens
ttcctccatttgagaaa

SEQ ID NO: 1130517 - DNA, 19 bp, Homo sapiens
ttcctcccagtgagactgc

SEQ ID NO: 1130518 - DNA, 17 bp, Homo sapiens
ttcctccccacactcca

SEQ ID NO: 1130519 - DNA, 14 bp, Homo sapiens
ttcctccccagcag

SEQ ID NO: 1130520 - DNA, 14 bp, Homo sapiens
ttcctccccataca

SEQ ID NO: 1130521 - DNA, 14 bp, Homo sapiens
ttcctccccctgca

SEQ ID NO: 1130522 - DNA, 22 bp, Homo sapiens
ttcctccccgcctcctcccact

SEQ ID NO: 1130523 - DNA, 21 bp, Homo sapiens
ttcctcccctcaacagtgagt

SEQ ID NO: 1130524 - DNA, 12 bp, Homo sapiens
ttcctcccctct

SEQ ID NO: 1130525 - DNA, 22 bp, Homo sapiens
ttcctccctggtttgcagctgt

SEQ ID NO: 1130526 - DNA, 16 bp, Homo sapiens
ttcctccggagcctca

SEQ ID NO: 1130527 - DNA, 18 bp, Homo sapiens
ttcctccgtccacccagg

SEQ ID NO: 1130528 - DNA, 20 bp, Homo sapiens
ttcctccgtccacccaggct

SEQ ID NO: 1130529 - DNA, 12 bp, Homo sapiens
ttcctcctacct

SEQ ID NO: 1130530 - DNA, 17 bp, Homo sapiens
ttcctcctccctcctgc

SEQ ID NO: 1130531 - DNA, 12 bp, Homo sapiens
ttcctcctctgc

SEQ ID NO: 1130532 - DNA, 11 bp, Homo sapiens
ttcctcctgga

SEQ ID NO: 1130533 - DNA, 11 bp, Homo sapiens
ttcctccttcc

SEQ ID NO: 1130534 - DNA, 16 bp, Homo sapiens
ttcctccttcccccca

SEQ ID NO: 1130535 - DNA, 23 bp, Homo sapiens
ttcctccttccccccatctctga

SEQ ID NO: 1130536 - DNA, 18 bp, Homo sapiens
ttcctcctttacctttca

SEQ ID NO: 1130537 - DNA, 15 bp, Homo sapiens
ttcctcggtctccct

SEQ ID NO: 1130538 - DNA, 23 bp, Homo sapiens
ttcctcggtctcccttccgtcca

SEQ ID NO: 1130539 - DNA, 21 bp, Homo sapiens
ttcctcggtgggccagagctg

SEQ ID NO: 1130540 - DNA, 22 bp, Homo sapiens
ttcctcggtgggccagagctga

SEQ ID NO: 1130541 - DNA, 22 bp, Homo sapiens
ttcctcgttgggccgctctgat

SEQ ID NO: 1130542 - DNA, 16 bp, Homo sapiens
ttcctctaacattttt

SEQ ID NO: 1130543 - DNA, 15 bp, Homo sapiens
ttcctctaactcact

SEQ ID NO: 1130544 - DNA, 20 bp, Homo sapiens
ttcctctaactcactgccta

SEQ ID NO: 1130545 - DNA, 15 bp, Homo sapiens
ttcctctagaagcca

SEQ ID NO: 1130546 - DNA, 23 bp, Homo sapiens
ttcctctagtgccctccacagcc

SEQ ID NO: 1130547 - DNA, 23 bp, Homo sapiens
ttcctctattgatgtacagtctg

SEQ ID NO: 1130548 - DNA, 14 bp, Homo sapiens
ttcctctccacttc

SEQ ID NO: 1130549 - DNA, 19 bp, Homo sapiens
ttcctctccttcgtatccc

SEQ ID NO: 1130550 - DNA, 20 bp, Homo sapiens
ttcctctcgcggccctcagt

SEQ ID NO: 1130551 - DNA, 17 bp, Homo sapiens
ttcctctctacccccca

SEQ ID NO: 1130552 - DNA, 13 bp, Homo sapiens
ttcctctgaggct

SEQ ID NO: 1130553 - DNA, 23 bp, Homo sapiens
ttcctctgataatatattttcaa

SEQ ID NO: 1130554 - DNA, 10 bp, Homo sapiens
ttcctctgca

SEQ ID NO: 1130555 - DNA, 16 bp, Homo sapiens
ttcctctgcagcactt

SEQ ID NO: 1130556 - DNA, 13 bp, Homo sapiens
ttcctctgcagct

SEQ ID NO: 1130557 - DNA, 19 bp, Homo sapiens
ttcctctgcagctgacctc

SEQ ID NO: 1130558 - DNA, 20 bp, Homo sapiens
ttcctctgcccttcctgcag

SEQ ID NO: 1130559 - DNA, 12 bp, Homo sapiens
ttcctctgcctg

SEQ ID NO: 1130560 - DNA, 13 bp, Homo sapiens
ttcctctgcctgc

SEQ ID NO: 1130561 - DNA, 22 bp, Homo sapiens
ttcctctgttcaaagctgcctg

SEQ ID NO: 1130562 - DNA, 16 bp, Homo sapiens
ttcctctgttcttttc

SEQ ID NO: 1130563 - DNA, 13 bp, Homo sapiens
ttcctcttcccca

SEQ ID NO: 1130564 - DNA, 15 bp, Homo sapiens
ttcctcttcctgccc

SEQ ID NO: 1130565 - DNA, 16 bp, Homo sapiens
ttcctcttcctgccct

SEQ ID NO: 1130566 - DNA, 17 bp, Homo sapiens
ttcctcttcctgccctt

SEQ ID NO: 1130567 - DNA, 20 bp, Homo sapiens
ttcctcttcctgcccttgaa

SEQ ID NO: 1130568 - DNA, 20 bp, Homo sapiens
ttcctcttctattttgtaaa

SEQ ID NO: 1130569 - DNA, 15 bp, Homo sapiens
ttcctcttcttgttg

SEQ ID NO: 1130570 - DNA, 15 bp, Homo sapiens
ttcctcttgaccctg

SEQ ID NO: 1130571 - DNA, 22 bp, Homo sapiens
ttcctcttgaccctgcaccctc

SEQ ID NO: 1130572 - DNA, 17 bp, Homo sapiens
ttcctcttgcctctctc

SEQ ID NO: 1130573 - DNA, 18 bp, Homo sapiens
ttcctcttgcctctctca

SEQ ID NO: 1130574 - DNA, 22 bp, Homo sapiens
ttcctcttggcaagatgtttct

SEQ ID NO: 1130575 - DNA, 21 bp, Homo sapiens
ttcctcttgtcctggcccttc

SEQ ID NO: 1130576 - DNA, 22 bp, Homo sapiens
ttcctcttgtcctggcccttca

SEQ ID NO: 1130577 - DNA, 18 bp, Homo sapiens
ttcctctttctgctctgc

SEQ ID NO: 1130578 - DNA, 21 bp, Homo sapiens
ttcctctttctgctctgccat

SEQ ID NO: 1130579 - DNA, 15 bp, Homo sapiens
ttcctctttgctttg

SEQ ID NO: 1130580 - DNA, 20 bp, Homo sapiens
ttcctcttttgggtaaaatc

SEQ ID NO: 1130581 - DNA, 21 bp, Homo sapiens
ttcctcttttgtgctgcttct

SEQ ID NO: 1130582 - DNA, 22 bp, Homo sapiens
ttcctctttttatttagttcct

SEQ ID NO: 1130583 - DNA, 16 bp, Homo sapiens
ttcctgaaaagttgaa

SEQ ID NO: 1130584 - DNA, 12 bp, Homo sapiens
ttcctgaaagaa

SEQ ID NO: 1130585 - DNA, 18 bp, Homo sapiens
ttcctgaaagaaacagtt

SEQ ID NO: 1130586 - DNA, 15 bp, Homo sapiens
ttcctgaaatgcagt

SEQ ID NO: 1130587 - DNA, 15 bp, Homo sapiens
ttcctgaagcattta

SEQ ID NO: 1130588 - DNA, 15 bp, Homo sapiens
ttcctgaagccagat

SEQ ID NO: 1130589 - DNA, 13 bp, Homo sapiens
ttcctgaagggaa

SEQ ID NO: 1130590 - DNA, 14 bp, Homo sapiens
ttcctgaatgaaat

SEQ ID NO: 1130591 - DNA, 16 bp, Homo sapiens
ttcctgaatgaaatat

SEQ ID NO: 1130592 - DNA, 14 bp, Homo sapiens
ttcctgacccaggc

SEQ ID NO: 1130593 - DNA, 16 bp, Homo sapiens
ttcctgactctcacct

SEQ ID NO: 1130594 - DNA, 13 bp, Homo sapiens
ttcctgacttgag

SEQ ID NO: 1130595 - DNA, 20 bp, Homo sapiens
ttcctgagaaagcccacctg

SEQ ID NO: 1130596 - DNA, 22 bp, Homo sapiens
ttcctgagaaagcccacctggg

SEQ ID NO: 1130597 - DNA, 18 bp, Homo sapiens
ttcctgagacacccgatt

SEQ ID NO: 1130598 - DNA, 20 bp, Homo sapiens
ttcctgagcttggccagaag

SEQ ID NO: 1130599 - DNA, 22 bp, Homo sapiens
ttcctgattaccagtctgatta

SEQ ID NO: 1130600 - DNA, 17 bp, Homo sapiens
ttcctgcagccccagaa

SEQ ID NO: 1130601 - DNA, 20 bp, Homo sapiens
ttcctgcagccccagaagaa

SEQ ID NO: 1130602 - DNA, 21 bp, Homo sapiens
ttcctgcaggcaggaacaaac

SEQ ID NO: 1130603 - DNA, 11 bp, Homo sapiens
ttcctgcatgt

SEQ ID NO: 1130604 - DNA, 15 bp, Homo sapiens
ttcctgcatttgtga

SEQ ID NO: 1130605 - DNA, 12 bp, Homo sapiens
ttcctgccacca

SEQ ID NO: 1130606 - DNA, 17 bp, Homo sapiens
ttcctgccaggcatggt

SEQ ID NO: 1130607 - DNA, 16 bp, Homo sapiens
ttcctgccccaggcct

SEQ ID NO: 1130608 - DNA, 18 bp, Homo sapiens
ttcctgcccctctttctc

SEQ ID NO: 1130609 - DNA, 21 bp, Homo sapiens
ttcctgcccctctttctcttt

SEQ ID NO: 1130610 - DNA, 15 bp, Homo sapiens
ttcctgccctgtcca

SEQ ID NO: 1130611 - DNA, 18 bp, Homo sapiens
ttcctgcccttccctctg

SEQ ID NO: 1130612 - DNA, 19 bp, Homo sapiens
ttcctgcccttccctctgg

SEQ ID NO: 1130613 - DNA, 23 bp, Homo sapiens
ttcctgcccttccctctgggcac

SEQ ID NO: 1130614 - DNA, 21 bp, Homo sapiens
ttcctgcccttgaaccccctc

SEQ ID NO: 1130615 - DNA, 15 bp, Homo sapiens
ttcctgcgtcctcct

SEQ ID NO: 1130616 - DNA, 16 bp, Homo sapiens
ttcctgcgtcctcctc

SEQ ID NO: 1130617 - DNA, 23 bp, Homo sapiens
ttcctgctatattaacatcatct

SEQ ID NO: 1130618 - DNA, 18 bp, Homo sapiens
ttctaagaaaagcatttt

SEQ ID NO: 1130619 - DNA, 16 bp, Homo sapiens
ttctaagaaaatgtag

SEQ ID NO: 1130620 - DNA, 14 bp, Homo sapiens
ttctaagaaataga

SEQ ID NO: 1130621 - DNA, 19 bp, Homo sapiens
ttctaagaaatagagccaa

SEQ ID NO: 1130622 - DNA, 13 bp, Homo sapiens
ttctaagaagaca

SEQ ID NO: 1130623 - DNA, 14 bp, Homo sapiens
ttctaagaagacat

SEQ ID NO: 1130624 - DNA, 15 bp, Homo sapiens
ttctaagaagacatt

SEQ ID NO: 1130625 - DNA, 12 bp, Homo sapiens
ttctaagatgtt

SEQ ID NO: 1130626 - DNA, 17 bp, Homo sapiens
ttctaagtaaatacaat

SEQ ID NO: 1130627 - DNA, 20 bp, Homo sapiens
ttctaagtaaatacaatttt

SEQ ID NO: 1130628 - DNA, 15 bp, Homo sapiens
ttctaagtctttcca

SEQ ID NO: 1130629 - DNA, 15 bp, Homo sapiens
ttctaagtgtaacct

SEQ ID NO: 1130630 - DNA, 16 bp, Homo sapiens
ttctaagtgtaacctc

SEQ ID NO: 1130631 - DNA, 19 bp, Homo sapiens
ttctaagtgtaacctcagt

SEQ ID NO: 1130632 - DNA, 20 bp, Homo sapiens
ttctaagtgtaacctcagta

SEQ ID NO: 1130633 - DNA, 22 bp, Homo sapiens
ttctaagttagactcttcccct

SEQ ID NO: 1130634 - DNA, 18 bp, Homo sapiens
ttctaagttatttacttt

SEQ ID NO: 1130635 - DNA, 15 bp, Homo sapiens
ttctaataaaacaaa

SEQ ID NO: 1130636 - DNA, 13 bp, Homo sapiens
ttctaataaagta

SEQ ID NO: 1130637 - DNA, 16 bp, Homo sapiens
ttctaataaatatact

SEQ ID NO: 1130638 - DNA, 22 bp, Homo sapiens
ttctaataaatatactatgaaa

SEQ ID NO: 1130639 - DNA, 16 bp, Homo sapiens
ttctaatggaatggtt

SEQ ID NO: 1130640 - DNA, 14 bp, Homo sapiens
ttctaatgtcttca

SEQ ID NO: 1130641 - DNA, 16 bp, Homo sapiens
ttctaatgtcttcatt

SEQ ID NO: 1130642 - DNA, 21 bp, Homo sapiens
ttctaatttcaaaaatataac

SEQ ID NO: 1130643 - DNA, 23 bp, Homo sapiens
ttctaatttgcactaatgtgtta

SEQ ID NO: 1130644 - DNA, 16 bp, Homo sapiens
ttctacaagcatattt

SEQ ID NO: 1130645 - DNA, 15 bp, Homo sapiens
ttctacacagagcag

SEQ ID NO: 1130646 - DNA, 17 bp, Homo sapiens
ttctacacatgtaaaat

SEQ ID NO: 1130647 - DNA, 14 bp, Homo sapiens
ttctacacctggac

SEQ ID NO: 1130648 - DNA, 15 bp, Homo sapiens
ttctacagtggtttt

SEQ ID NO: 1130649 - DNA, 15 bp, Homo sapiens
ttctacatagatgct

SEQ ID NO: 1130650 - DNA, 18 bp, Homo sapiens
ttctacatgactgggcct

SEQ ID NO: 1130651 - DNA, 14 bp, Homo sapiens
ttctaccatttcag

SEQ ID NO: 1130652 - DNA, 21 bp, Homo sapiens
ttctaccccaaggccagtagt

SEQ ID NO: 1130653 - DNA, 14 bp, Homo sapiens
ttctaccctagcca

SEQ ID NO: 1130654 - DNA, 15 bp, Homo sapiens
ttctaccctagccat

SEQ ID NO: 1130655 - DNA, 23 bp, Homo sapiens
ttctacctataacactctaggat

SEQ ID NO: 1130656 - DNA, 23 bp, Homo sapiens
ttctacctgtacacattcctgca

SEQ ID NO: 1130657 - DNA, 15 bp, Homo sapiens
ttctacgtcatgtat

SEQ ID NO: 1130658 - DNA, 20 bp, Homo sapiens
ttctacgtcatgtattttat

SEQ ID NO: 1130659 - DNA, 21 bp, Homo sapiens
ttctacgtcatgtattttatg

SEQ ID NO: 1130660 - DNA, 14 bp, Homo sapiens
ttctactatataca

SEQ ID NO: 1130661 - DNA, 16 bp, Homo sapiens
ttctactatgatcaga

SEQ ID NO: 1130662 - DNA, 17 bp, Homo sapiens
ttctactctgtcttaaa

SEQ ID NO: 1130663 - DNA, 17 bp, Homo sapiens
ttctactcttgtcattt

SEQ ID NO: 1130664 - DNA, 18 bp, Homo sapiens
ttctactggaaaaaaata

SEQ ID NO: 1130665 - DNA, 14 bp, Homo sapiens
ttctacttcccctg

SEQ ID NO: 1130666 - DNA, 15 bp, Homo sapiens
ttctacttcccctgg

SEQ ID NO: 1130667 - DNA, 13 bp, Homo sapiens
ttctacttgtaaa

SEQ ID NO: 1130668 - DNA, 19 bp, Homo sapiens
ttctactttgatatgactg

SEQ ID NO: 1130669 - DNA, 22 bp, Homo sapiens
ttctagaaactctggctcagcc

SEQ ID NO: 1130670 - DNA, 23 bp, Homo sapiens
ttctagaaagcctgttcccctca

SEQ ID NO: 1130671 - DNA, 15 bp, Homo sapiens
ttctagaatttatca

SEQ ID NO: 1130672 - DNA, 17 bp, Homo sapiens
ttctagacagtattgcc

SEQ ID NO: 1130673 - DNA, 15 bp, Homo sapiens
ttctagacttcccca

SEQ ID NO: 1130674 - DNA, 17 bp, Homo sapiens
ttctagacttccccatc

SEQ ID NO: 1130675 - DNA, 12 bp, Homo sapiens
ttctagagaaga

SEQ ID NO: 1130676 - DNA, 15 bp, Homo sapiens
ttctagaggcctcag

SEQ ID NO: 1130677 - DNA, 16 bp, Homo sapiens
ttctagatacaataaa

SEQ ID NO: 1130678 - DNA, 15 bp, Homo sapiens
ttctagatcctgcac

SEQ ID NO: 1130679 - DNA, 16 bp, Homo sapiens
ttctagatcctgcacc

SEQ ID NO: 1130680 - DNA, 15 bp, Homo sapiens
ttctagattaccatg

SEQ ID NO: 1130681 - DNA, 14 bp, Homo sapiens
ttctagattacttt

SEQ ID NO: 1130682 - DNA, 19 bp, Homo sapiens
ttctagcaattttctttgt

SEQ ID NO: 1130683 - DNA, 13 bp, Homo sapiens
ttctagcaggcag

SEQ ID NO: 1130684 - DNA, 13 bp, Homo sapiens
ttctagccataat

SEQ ID NO: 1130685 - DNA, 15 bp, Homo sapiens
ttctagccataataa

SEQ ID NO: 1130686 - DNA, 16 bp, Homo sapiens
ttctagccataataaa

SEQ ID NO: 1130687 - DNA, 17 bp, Homo sapiens
ttctagccatacctcag

SEQ ID NO: 1130688 - DNA, 15 bp, Homo sapiens
ttctagccttagaca

SEQ ID NO: 1130689 - DNA, 16 bp, Homo sapiens
ttctagctagaaatat

SEQ ID NO: 1130690 - DNA, 22 bp, Homo sapiens
ttctagctagaaatatgatttt

SEQ ID NO: 1130691 - DNA, 22 bp, Homo sapiens
ttctagcttatctacttccaaa

SEQ ID NO: 1130692 - DNA, 21 bp, Homo sapiens
ttctaggagtcaactggctgg

SEQ ID NO: 1130693 - DNA, 20 bp, Homo sapiens
ttctaggcatctctgtactt

SEQ ID NO: 1130694 - DNA, 21 bp, Homo sapiens
ttctaggcccattgtcctcct

SEQ ID NO: 1130695 - DNA, 16 bp, Homo sapiens
ttctagggacatgaaa

SEQ ID NO: 1130696 - DNA, 22 bp, Homo sapiens
ttctaggggagaagagccctgg

SEQ ID NO: 1130697 - DNA, 21 bp, Homo sapiens
ttctaggtggaggttgtgcat

SEQ ID NO: 1130698 - DNA, 19 bp, Homo sapiens
ttctagtacataattgatt

SEQ ID NO: 1130699 - DNA, 14 bp, Homo sapiens
ttctagtactgtat

SEQ ID NO: 1130700 - DNA, 12 bp, Homo sapiens
ttctagtgctgc

SEQ ID NO: 1130701 - DNA, 13 bp, Homo sapiens
ttctagtggctgt

SEQ ID NO: 1130702 - DNA, 17 bp, Homo sapiens
ttctagtgtatactctg

SEQ ID NO: 1130703 - DNA, 14 bp, Homo sapiens
ttctagtgtcactg

SEQ ID NO: 1130704 - DNA, 15 bp, Homo sapiens
ttctagtttcccaca

SEQ ID NO: 1130705 - DNA, 18 bp, Homo sapiens
ttctagtttgcaacttca

SEQ ID NO: 1130706 - DNA, 19 bp, Homo sapiens
ttctagttttcagtttgta

SEQ ID NO: 1130707 - DNA, 13 bp, Homo sapiens
ttctagttttgtc

SEQ ID NO: 1130708 - DNA, 14 bp, Homo sapiens
ttctataaatcagt

SEQ ID NO: 1130709 - DNA, 13 bp, Homo sapiens
ttctataaattta

SEQ ID NO: 1130710 - DNA, 15 bp, Homo sapiens
ttctataagttgtac

SEQ ID NO: 1130711 - DNA, 21 bp, Homo sapiens
ttctataataagttttgatat

SEQ ID NO: 1130712 - DNA, 22 bp, Homo sapiens
ttctataataagttttgatata

SEQ ID NO: 1130713 - DNA, 23 bp, Homo sapiens
ttctataataagttttgatataa

SEQ ID NO: 1130714 - DNA, 15 bp, Homo sapiens
ttctataatatttcc

SEQ ID NO: 1130715 - DNA, 22 bp, Homo sapiens
ttctatataaaatgtattcaag

SEQ ID NO: 1130716 - DNA, 18 bp, Homo sapiens
ttctatattattatatat

SEQ ID NO: 1130717 - DNA, 17 bp, Homo sapiens
ttctatcacatatttga

SEQ ID NO: 1130718 - DNA, 20 bp, Homo sapiens
ttctatcagttatcctttgt

SEQ ID NO: 1130719 - DNA, 20 bp, Homo sapiens
ttctatccccaagctggcca

SEQ ID NO: 1130720 - DNA, 14 bp, Homo sapiens
ttctatcctctgta

SEQ ID NO: 1130721 - DNA, 15 bp, Homo sapiens
ttctatcctctgtaa

SEQ ID NO: 1130722 - DNA, 14 bp, Homo sapiens
ttctatccttttgc

SEQ ID NO: 1130723 - DNA, 18 bp, Homo sapiens
ttctatccttttgcctgc

SEQ ID NO: 1130724 - DNA, 17 bp, Homo sapiens
ttctatctactgatttg

SEQ ID NO: 1130725 - DNA, 20 bp, Homo sapiens
ttctatctgcttagcaacta

SEQ ID NO: 1130726 - DNA, 16 bp, Homo sapiens
ttctatgaactagtct

SEQ ID NO: 1130727 - DNA, 16 bp, Homo sapiens
ttctatgcaggcagca

SEQ ID NO: 1130728 - DNA, 21 bp, Homo sapiens
ttctatgcataaaaaaatgat

SEQ ID NO: 1130729 - DNA, 15 bp, Homo sapiens
ttctatggagacttt

SEQ ID NO: 1130730 - DNA, 21 bp, Homo sapiens
ttctatgtaaattattgtaaa

SEQ ID NO: 1130731 - DNA, 17 bp, Homo sapiens
ttctatgtccattctca

SEQ ID NO: 1130732 - DNA, 12 bp, Homo sapiens
ttctatgttaaa

SEQ ID NO: 1130733 - DNA, 18 bp, Homo sapiens
ttctatgttggtttcagt

SEQ ID NO: 1130734 - DNA, 19 bp, Homo sapiens
ttctatgttggtttcagtg

SEQ ID NO: 1130735 - DNA, 22 bp, Homo sapiens
ttctatgttggtttcagtggct

SEQ ID NO: 1130736 - DNA, 17 bp, Homo sapiens
ttctattaatcaagaga

SEQ ID NO: 1130737 - DNA, 13 bp, Homo sapiens
ttctattccttat

SEQ ID NO: 1130738 - DNA, 18 bp, Homo sapiens
ttctattgcagttataga

SEQ ID NO: 1130739 - DNA, 17 bp, Homo sapiens
ttctattgtattatttg

SEQ ID NO: 1130740 - DNA, 21 bp, Homo sapiens
ttctattgtattatttggagt

SEQ ID NO: 1130741 - DNA, 16 bp, Homo sapiens
ttctattgtgtggatg

SEQ ID NO: 1130742 - DNA, 14 bp, Homo sapiens
ttctattgtttact

SEQ ID NO: 1130743 - DNA, 15 bp, Homo sapiens
ttctattgtttacta

SEQ ID NO: 1130744 - DNA, 14 bp, Homo sapiens
ttctatttaatgga

SEQ ID NO: 1130745 - DNA, 16 bp, Homo sapiens
ttctatttaattgaaa

SEQ ID NO: 1130746 - DNA, 17 bp, Homo sapiens
ttctatttattatgctt

SEQ ID NO: 1130747 - DNA, 17 bp, Homo sapiens
ttctatttctcctccat

SEQ ID NO: 1130748 - DNA, 18 bp, Homo sapiens
ttctatttcttgaagaat

SEQ ID NO: 1130749 - DNA, 18 bp, Homo sapiens
ttctatttgctgggcttt

SEQ ID NO: 1130750 - DNA, 17 bp, Homo sapiens
ttctatttttcaatcat

SEQ ID NO: 1130751 - DNA, 17 bp, Homo sapiens
ttctatttttgtccttg

SEQ ID NO: 1130752 - DNA, 18 bp, Homo sapiens
ttctattttttaaagact

SEQ ID NO: 1130753 - DNA, 22 bp, Homo sapiens
ttctattttttacttgttttcg

SEQ ID NO: 1130754 - DNA, 15 bp, Homo sapiens
ttctattttttgttt

SEQ ID NO: 1130755 - DNA, 22 bp, Homo sapiens
ttctcaaagttaattcacctat

SEQ ID NO: 1130756 - DNA, 22 bp, Homo sapiens
ttctcaaccttatcaaggattt

SEQ ID NO: 1130757 - DNA, 11 bp, Homo sapiens
ttctcaagaat

SEQ ID NO: 1130758 - DNA, 20 bp, Homo sapiens
ttctcaagacctgagtattt

SEQ ID NO: 1130759 - DNA, 17 bp, Homo sapiens
ttctcaagtgccttaat

SEQ ID NO: 1130760 - DNA, 22 bp, Homo sapiens
ttctcaatacttgaatatggaa

SEQ ID NO: 1130761 - DNA, 13 bp, Homo sapiens
ttctcaatgaaaa

SEQ ID NO: 1130762 - DNA, 14 bp, Homo sapiens
ttctcaatgaaaaa

SEQ ID NO: 1130763 - DNA, 12 bp, Homo sapiens
ttctcacaaaaa

SEQ ID NO: 1130764 - DNA, 23 bp, Homo sapiens
ttctcacaatagccgatatcaga

SEQ ID NO: 1130765 - DNA, 22 bp, Homo sapiens
ttctcacaccaacagtgtgaag

SEQ ID NO: 1130766 - DNA, 18 bp, Homo sapiens
ttctcacacccaccgtcc

SEQ ID NO: 1130767 - DNA, 21 bp, Homo sapiens
ttctcacactctaactgtata

SEQ ID NO: 1130768 - DNA, 21 bp, Homo sapiens
ttctcacactggtctgctgtc

SEQ ID NO: 1130769 - DNA, 18 bp, Homo sapiens
ttctcacatctgtccaga

SEQ ID NO: 1130770 - DNA, 14 bp, Homo sapiens
ttctcactccacca

SEQ ID NO: 1130771 - DNA, 19 bp, Homo sapiens
ttctcactccttttggtgt

SEQ ID NO: 1130772 - DNA, 21 bp, Homo sapiens
ttctcactgccatgccagctt

SEQ ID NO: 1130773 - DNA, 18 bp, Homo sapiens
ttctcacttcaattaatg

SEQ ID NO: 1130774 - DNA, 16 bp, Homo sapiens
ttctcagaacagctga

SEQ ID NO: 1130775 - DNA, 13 bp, Homo sapiens
ttctcagaatctc

SEQ ID NO: 1130776 - DNA, 16 bp, Homo sapiens
ttctcagagcatgtgt

SEQ ID NO: 1130777 - DNA, 17 bp, Homo sapiens
ttctcagagcatgtgtc

SEQ ID NO: 1130778 - DNA, 19 bp, Homo sapiens
ttctcagagtggtggggga

SEQ ID NO: 1130779 - DNA, 15 bp, Homo sapiens
ttctcagatatttat

SEQ ID NO: 1130780 - DNA, 20 bp, Homo sapiens
ttctcagatatttatatttt

SEQ ID NO: 1130781 - DNA, 20 bp, Homo sapiens
ttctcagatttctgaggaaa

SEQ ID NO: 1130782 - DNA, 13 bp, Homo sapiens
ttctcagcccctt

SEQ ID NO: 1130783 - DNA, 13 bp, Homo sapiens
ttctcagctccca

SEQ ID NO: 1130784 - DNA, 16 bp, Homo sapiens
ttctcagggctggagc

SEQ ID NO: 1130785 - DNA, 17 bp, Homo sapiens
ttctcagggggtcagca

SEQ ID NO: 1130786 - DNA, 17 bp, Homo sapiens
ttctcaggtgttgccaa

SEQ ID NO: 1130787 - DNA, 22 bp, Homo sapiens
ttctcagtcagtaattgccaaa

SEQ ID NO: 1130788 - DNA, 14 bp, Homo sapiens
ttctcagttttcat

SEQ ID NO: 1130789 - DNA, 15 bp, Homo sapiens
ttctcagttttcata

SEQ ID NO: 1130790 - DNA, 22 bp, Homo sapiens
ttctcataggaaaagtacattt

SEQ ID NO: 1130791 - DNA, 24 bp, Homo sapiens
ttctcataggaaaagtacatttaa

SEQ ID NO: 1130792 - DNA, 12 bp, Homo sapiens
ttctcatatttg

SEQ ID NO: 1130793 - DNA, 15 bp, Homo sapiens
ttctcatcatattgt

SEQ ID NO: 1130794 - DNA, 21 bp, Homo sapiens
ttctcatcatattgtatgtaa

SEQ ID NO: 1130795 - DNA, 14 bp, Homo sapiens
ttctcatctgcacc

SEQ ID NO: 1130796 - DNA, 13 bp, Homo sapiens
ttctcatgaagca

SEQ ID NO: 1130797 - DNA, 17 bp, Homo sapiens
ttctcatgaagctaata

SEQ ID NO: 1130798 - DNA, 14 bp, Homo sapiens
ttctcatgatccaa

SEQ ID NO: 1130799 - DNA, 20 bp, Homo sapiens
ttctcatgatttacagagaa

SEQ ID NO: 1130800 - DNA, 13 bp, Homo sapiens
ttctcattaaact

SEQ ID NO: 1130801 - DNA, 21 bp, Homo sapiens
ttctcattaacaatattttat

SEQ ID NO: 1130802 - DNA, 18 bp, Homo sapiens
ttctcattccaacagtga

SEQ ID NO: 1130803 - DNA, 15 bp, Homo sapiens
ttctcatttctcagg

SEQ ID NO: 1130804 - DNA, 23 bp, Homo sapiens
ttctcatttggtctgccagaata

SEQ ID NO: 1130805 - DNA, 23 bp, Homo sapiens
ttctcattttttaaaaaagctta

SEQ ID NO: 1130806 - DNA, 16 bp, Homo sapiens
ttctccaagagctaca

SEQ ID NO: 1130807 - DNA, 19 bp, Homo sapiens
ttctccaatatcagtgctc

SEQ ID NO: 1130808 - DNA, 19 bp, Homo sapiens
ttctccacaacagcctggg

SEQ ID NO: 1130809 - DNA, 20 bp, Homo sapiens
ttctccacaacagcctgggg

SEQ ID NO: 1130810 - DNA, 22 bp, Homo sapiens
ttctccacaacagcctggggtt

SEQ ID NO: 1130811 - DNA, 15 bp, Homo sapiens
ttctccacagcaacc

SEQ ID NO: 1130812 - DNA, 14 bp, Homo sapiens
ttctccagaatgta

SEQ ID NO: 1130813 - DNA, 13 bp, Homo sapiens
ttctccagaccca

SEQ ID NO: 1130814 - DNA, 19 bp, Homo sapiens
ttctccagacccaccacac

SEQ ID NO: 1130815 - DNA, 19 bp, Homo sapiens
ttctccagctcagaaccca

SEQ ID NO: 1130816 - DNA, 20 bp, Homo sapiens
ttctccagctcagaacccag

SEQ ID NO: 1130817 - DNA, 12 bp, Homo sapiens
ttctccagctgg

SEQ ID NO: 1130818 - DNA, 13 bp, Homo sapiens
ttctccatcagct

SEQ ID NO: 1130819 - DNA, 12 bp, Homo sapiens
ttctccatcttt

SEQ ID NO: 1130820 - DNA, 23 bp, Homo sapiens
ttctccatgagacacatctcctc

SEQ ID NO: 1130821 - DNA, 23 bp, Homo sapiens
ttctccatgctgcaaaggagaag

SEQ ID NO: 1130822 - DNA, 22 bp, Homo sapiens
ttctccatggccaccttttcag

SEQ ID NO: 1130823 - DNA, 19 bp, Homo sapiens
ttctccatgggccaccgcc

SEQ ID NO: 1130824 - DNA, 14 bp, Homo sapiens
ttctccattgtaaa

SEQ ID NO: 1130825 - DNA, 13 bp, Homo sapiens
ttctcccacactg

SEQ ID NO: 1130826 - DNA, 23 bp, Homo sapiens
ttctcccacatgaggccatctca

SEQ ID NO: 1130827 - DNA, 12 bp, Homo sapiens
ttctcccacccc

SEQ ID NO: 1130828 - DNA, 17 bp, Homo sapiens
ttctcccaccccttggc

SEQ ID NO: 1130829 - DNA, 12 bp, Homo sapiens
ttctcccaggaa

SEQ ID NO: 1130830 - DNA, 14 bp, Homo sapiens
ttctcccaggaagc

SEQ ID NO: 1130831 - DNA, 15 bp, Homo sapiens
ttctcccaggaagct

SEQ ID NO: 1130832 - DNA, 11 bp, Homo sapiens
ttctcccaggg

SEQ ID NO: 1130833 - DNA, 20 bp, Homo sapiens
ttctcccaggtaccagctgc

SEQ ID NO: 1130834 - DNA, 13 bp, Homo sapiens
ttctcccatttcc

SEQ ID NO: 1130835 - DNA, 14 bp, Homo sapiens
ttctcccatttcct

SEQ ID NO: 1130836 - DNA, 15 bp, Homo sapiens
ttctcccatttcctg

SEQ ID NO: 1130837 - DNA, 18 bp, Homo sapiens
ttctcccatttcctgatc

SEQ ID NO: 1130838 - DNA, 22 bp, Homo sapiens
ttctccccacgatgatatctat

SEQ ID NO: 1130839 - DNA, 18 bp, Homo sapiens
ttctccccccatcccagg

SEQ ID NO: 1130840 - DNA, 21 bp, Homo sapiens
ttctcccccgccctgccccgc

SEQ ID NO: 1130841 - DNA, 23 bp, Homo sapiens
ttctccccgcagcccgcctgccg

SEQ ID NO: 1130842 - DNA, 10 bp, Homo sapiens
ttctcccctc

SEQ ID NO: 1130843 - DNA, 14 bp, Homo sapiens
ttctcccctgccct

SEQ ID NO: 1130844 - DNA, 20 bp, Homo sapiens
ttctccccttcctggacaca

SEQ ID NO: 1130845 - DNA, 12 bp, Homo sapiens
ttctccctcacc

SEQ ID NO: 1130846 - DNA, 22 bp, Homo sapiens
ttctccctcacccccaggtgtt

SEQ ID NO: 1130847 - DNA, 15 bp, Homo sapiens
ttctccctggacccc

SEQ ID NO: 1130848 - DNA, 12 bp, Homo sapiens
ttctccctggat

SEQ ID NO: 1130849 - DNA, 10 bp, Homo sapiens
ttctccctgt

SEQ ID NO: 1130850 - DNA, 18 bp, Homo sapiens
ttctccctttctctctcc

SEQ ID NO: 1130851 - DNA, 13 bp, Homo sapiens
ttctccgccagcc

SEQ ID NO: 1130852 - DNA, 14 bp, Homo sapiens
ttctccgccagcct

SEQ ID NO: 1130853 - DNA, 18 bp, Homo sapiens
ttctccgccagcctcctc

SEQ ID NO: 1130854 - DNA, 19 bp, Homo sapiens
ttctccgccagcctcctct

SEQ ID NO: 1130855 - DNA, 21 bp, Homo sapiens
ttctccgccagcctcctctgg

SEQ ID NO: 1130856 - DNA, 16 bp, Homo sapiens
ttctccggggtctgtg

SEQ ID NO: 1130857 - DNA, 23 bp, Homo sapiens
ttctccggggtctgtgctgtgcc

SEQ ID NO: 1130858 - DNA, 15 bp, Homo sapiens
ttctccgggtcctcc

SEQ ID NO: 1130859 - DNA, 18 bp, Homo sapiens
ttctcctcactgtatcca

SEQ ID NO: 1130860 - DNA, 16 bp, Homo sapiens
ttctcctcaggacaag

SEQ ID NO: 1130861 - DNA, 23 bp, Homo sapiens
ttctcctccatgggagaaaatag

SEQ ID NO: 1130862 - DNA, 13 bp, Homo sapiens
ttctcctccccac

SEQ ID NO: 1130863 - DNA, 18 bp, Homo sapiens
ttctgctcctgcttttct

SEQ ID NO: 1130864 - DNA, 20 bp, Homo sapiens
ttctgctcctgcttttctgt

SEQ ID NO: 1130865 - DNA, 16 bp, Homo sapiens
ttctgctctgccatct

SEQ ID NO: 1130866 - DNA, 22 bp, Homo sapiens
ttctgctctggttgtttctgtt

SEQ ID NO: 1130867 - DNA, 18 bp, Homo sapiens
ttctgctcttccaaagct

SEQ ID NO: 1130868 - DNA, 23 bp, Homo sapiens
ttctgctgcttgagttgcctgat

SEQ ID NO: 1130869 - DNA, 18 bp, Homo sapiens
ttctgctggaaacagact

SEQ ID NO: 1130870 - DNA, 21 bp, Homo sapiens
ttctgctggataaaatgaggt

SEQ ID NO: 1130871 - DNA, 17 bp, Homo sapiens
ttctgctggcatcaaga

SEQ ID NO: 1130872 - DNA, 13 bp, Homo sapiens
ttctgctggcctg

SEQ ID NO: 1130873 - DNA, 14 bp, Homo sapiens
ttctgctggcctgg

SEQ ID NO: 1130874 - DNA, 19 bp, Homo sapiens
ttctgctgtggtctataaa

SEQ ID NO: 1130875 - DNA, 17 bp, Homo sapiens
ttctgctgttcttcact

SEQ ID NO: 1130876 - DNA, 20 bp, Homo sapiens
ttctgcttaaagttgtaaca

SEQ ID NO: 1130877 - DNA, 14 bp, Homo sapiens
ttctgcttaggaga

SEQ ID NO: 1130878 - DNA, 16 bp, Homo sapiens
ttctgcttcaataaat

SEQ ID NO: 1130879 - DNA, 17 bp, Homo sapiens
ttctgcttcgaagtatt

SEQ ID NO: 1130880 - DNA, 13 bp, Homo sapiens
ttctgcttttctg

SEQ ID NO: 1130881 - DNA, 19 bp, Homo sapiens
ttctgcttttgaaatctgt

SEQ ID NO: 1130882 - DNA, 20 bp, Homo sapiens
ttctggaaaaaaaatatata

SEQ ID NO: 1130883 - DNA, 22 bp, Homo sapiens
ttctggaaaaaaaatatatata

SEQ ID NO: 1130884 - DNA, 18 bp, Homo sapiens
ttctggaaaagaggagtt

SEQ ID NO: 1130885 - DNA, 13 bp, Homo sapiens
ttctggaagactg

SEQ ID NO: 1130886 - DNA, 13 bp, Homo sapiens
ttctggaaggaat

SEQ ID NO: 1130887 - DNA, 22 bp, Homo sapiens
ttctggaatgtaatcaatgttt

SEQ ID NO: 1130888 - DNA, 10 bp, Homo sapiens
ttctggagcc

SEQ ID NO: 1130889 - DNA, 15 bp, Homo sapiens
ttctggagtctccag

SEQ ID NO: 1130890 - DNA, 15 bp, Homo sapiens
ttctggagtttctct

SEQ ID NO: 1130891 - DNA, 20 bp, Homo sapiens
ttctggatagagtcctggga

SEQ ID NO: 1130892 - DNA, 21 bp, Homo sapiens
ttctggatctgaccctcccag

SEQ ID NO: 1130893 - DNA, 14 bp, Homo sapiens
ttctggcaagagca

SEQ ID NO: 1130894 - DNA, 23 bp, Homo sapiens
ttctggcagatgtaggtaaagag

SEQ ID NO: 1130895 - DNA, 11 bp, Homo sapiens
ttctggcagga

SEQ ID NO: 1130896 - DNA, 16 bp, Homo sapiens
ttctggcataattttt

SEQ ID NO: 1130897 - DNA, 16 bp, Homo sapiens
ttctggccagtgttta

SEQ ID NO: 1130898 - DNA, 21 bp, Homo sapiens
ttctggccagtgtttaaaact

SEQ ID NO: 1130899 - DNA, 11 bp, Homo sapiens
ttctggcctgt

SEQ ID NO: 1130900 - DNA, 16 bp, Homo sapiens
ttctggctatgcattt

SEQ ID NO: 1130901 - DNA, 10 bp, Homo sapiens
ttctggctca

SEQ ID NO: 1130902 - DNA, 17 bp, Homo sapiens
ttctggctcctcaaaca

SEQ ID NO: 1130903 - DNA, 22 bp, Homo sapiens
ttctggctggagcctagaacag

SEQ ID NO: 1130904 - DNA, 20 bp, Homo sapiens
ttctggcttccttctctcaa

SEQ ID NO: 1130905 - DNA, 22 bp, Homo sapiens
ttctgggaaattgaagtgtctt

SEQ ID NO: 1130906 - DNA, 13 bp, Homo sapiens
ttctgggaaggga

SEQ ID NO: 1130907 - DNA, 14 bp, Homo sapiens
ttctgggaagggag

SEQ ID NO: 1130908 - DNA, 22 bp, Homo sapiens
ttctgggagctgcgccggacag

SEQ ID NO: 1130909 - DNA, 16 bp, Homo sapiens
ttctgggatgtcacag

SEQ ID NO: 1130910 - DNA, 19 bp, Homo sapiens
ttctgggatgtcacagtcc

SEQ ID NO: 1130911 - DNA, 23 bp, Homo sapiens
ttctgggcaccacaaaatataca

SEQ ID NO: 1130912 - DNA, 18 bp, Homo sapiens
ttctgggctttctcctgg

SEQ ID NO: 1130913 - DNA, 23 bp, Homo sapiens
ttctggggaaaaaaaagagactg

SEQ ID NO: 1130914 - DNA, 17 bp, Homo sapiens
ttctggggcaggctggg

SEQ ID NO: 1130915 - DNA, 21 bp, Homo sapiens
ttctggggcaggctgggccat

SEQ ID NO: 1130916 - DNA, 16 bp, Homo sapiens
ttctggggctgtgtta

SEQ ID NO: 1130917 - DNA, 21 bp, Homo sapiens
ttctgggtgaaacccttttct

SEQ ID NO: 1130918 - DNA, 15 bp, Homo sapiens
ttctgggtttgccca

SEQ ID NO: 1130919 - DNA, 16 bp, Homo sapiens
ttctgggtttgcccag

SEQ ID NO: 1130920 - DNA, 15 bp, Homo sapiens
ttctgggttttctga

SEQ ID NO: 1130921 - DNA, 18 bp, Homo sapiens
ttctggtcccctgtggtg

SEQ ID NO: 1130922 - DNA, 19 bp, Homo sapiens
ttctggtctcgtcttccgt

SEQ ID NO: 1130923 - DNA, 21 bp, Homo sapiens
ttctggtggtggcctgtttga

SEQ ID NO: 1130924 - DNA, 17 bp, Homo sapiens
ttctggtgtgttaacat

SEQ ID NO: 1130925 - DNA, 13 bp, Homo sapiens
ttctggtgtttta

SEQ ID NO: 1130926 - DNA, 15 bp, Homo sapiens
ttctggttccagggt

SEQ ID NO: 1130927 - DNA, 14 bp, Homo sapiens
ttctggttttagga

SEQ ID NO: 1130928 - DNA, 18 bp, Homo sapiens
ttctgtaaacagaataaa

SEQ ID NO: 1130929 - DNA, 20 bp, Homo sapiens
ttctgtaaactcaaaactta

SEQ ID NO: 1130930 - DNA, 15 bp, Homo sapiens
ttctgtaaataacct

SEQ ID NO: 1130931 - DNA, 14 bp, Homo sapiens
ttctgtaacaaatt

SEQ ID NO: 1130932 - DNA, 21 bp, Homo sapiens
ttctgtaatatttacaatgta

SEQ ID NO: 1130933 - DNA, 23 bp, Homo sapiens
ttctgtaatatttacaatgtatt

SEQ ID NO: 1130934 - DNA, 15 bp, Homo sapiens
ttctgtaattacata

SEQ ID NO: 1130935 - DNA, 13 bp, Homo sapiens
ttctgtaccagtt

SEQ ID NO: 1130936 - DNA, 21 bp, Homo sapiens
ttctgtagaaaagaaaacatt

SEQ ID NO: 1130937 - DNA, 22 bp, Homo sapiens
ttctgtagaaaagaaaacattt

SEQ ID NO: 1130938 - DNA, 11 bp, Homo sapiens
ttctgtataaa

SEQ ID NO: 1130939 - DNA, 13 bp, Homo sapiens
ttctgtatacaac

SEQ ID NO: 1130940 - DNA, 21 bp, Homo sapiens
ttctgtatacaaccctggcat

SEQ ID NO: 1130941 - DNA, 14 bp, Homo sapiens
ttctgtatttctag

SEQ ID NO: 1130942 - DNA, 15 bp, Homo sapiens
ttctgtatttctagg

SEQ ID NO: 1130943 - DNA, 15 bp, Homo sapiens
ttctgtattttaaga

SEQ ID NO: 1130944 - DNA, 16 bp, Homo sapiens
ttctgtattttaagaa

SEQ ID NO: 1130945 - DNA, 20 bp, Homo sapiens
ttctgtatttttttttctaa

SEQ ID NO: 1130946 - DNA, 14 bp, Homo sapiens
ttctgtcaagaaga

SEQ ID NO: 1130947 - DNA, 17 bp, Homo sapiens
ttctgtcacgtgaaata

SEQ ID NO: 1130948 - DNA, 16 bp, Homo sapiens
ttctgtcagatgagaa

SEQ ID NO: 1130949 - DNA, 18 bp, Homo sapiens
ttctgtcagatgagaaca

SEQ ID NO: 1130950 - DNA, 22 bp, Homo sapiens
ttctgtcagatgagaacaaagc

SEQ ID NO: 1130951 - DNA, 23 bp, Homo sapiens
ttctgtcagatgagaacaaagct

SEQ ID NO: 1130952 - DNA, 24 bp, Homo sapiens
ttctgtcagatgagaacaaagctg

SEQ ID NO: 1130953 - DNA, 16 bp, Homo sapiens
ttctgtcagtgttaaa

SEQ ID NO: 1130954 - DNA, 22 bp, Homo sapiens
ttctgtccccagccctgtcctg

SEQ ID NO: 1130955 - DNA, 16 bp, Homo sapiens
ttctgtccctgtccct

SEQ ID NO: 1130956 - DNA, 17 bp, Homo sapiens
ttctgtccgagctttga

SEQ ID NO: 1130957 - DNA, 13 bp, Homo sapiens
ttctgtcctgggc

SEQ ID NO: 1130958 - DNA, 14 bp, Homo sapiens
ttctgtccttcaga

SEQ ID NO: 1130959 - DNA, 23 bp, Homo sapiens
ttctgtccttttggcactgagat

SEQ ID NO: 1130960 - DNA, 16 bp, Homo sapiens
ttctgtctactaagtg

SEQ ID NO: 1130961 - DNA, 20 bp, Homo sapiens
ttctgtctaggttaaagcta

SEQ ID NO: 1130962 - DNA, 17 bp, Homo sapiens
ttctgtcttctacagat

SEQ ID NO: 1130963 - DNA, 22 bp, Homo sapiens
ttctgtcttgttcattttgagt

SEQ ID NO: 1130964 - DNA, 16 bp, Homo sapiens
ttctgtgaaatataat

SEQ ID NO: 1130965 - DNA, 11 bp, Homo sapiens
ttctgtgaaga

SEQ ID NO: 1130966 - DNA, 16 bp, Homo sapiens
ttctgtgacatttatg

SEQ ID NO: 1130967 - DNA, 20 bp, Homo sapiens
ttctgtgaccaaaatacctt

SEQ ID NO: 1130968 - DNA, 11 bp, Homo sapiens
ttctgtgcctc

SEQ ID NO: 1130969 - DNA, 16 bp, Homo sapiens
ttctgtgcctcccccc

SEQ ID NO: 1130970 - DNA, 22 bp, Homo sapiens
ttctgtgcctccccccagaccc

SEQ ID NO: 1130971 - DNA, 15 bp, Homo sapiens
ttctgtgcctgaata

SEQ ID NO: 1130972 - DNA, 20 bp, Homo sapiens
ttctgtggccgccatctgcg

SEQ ID NO: 1130973 - DNA, 22 bp, Homo sapiens
ttctgtggctaaacagatgtaa

SEQ ID NO: 1130974 - DNA, 17 bp, Homo sapiens
ttctgtggggctgggca

SEQ ID NO: 1130975 - DNA, 16 bp, Homo sapiens
ttctgtggttcctctg

SEQ ID NO: 1130976 - DNA, 20 bp, Homo sapiens
ttctgtggttcctctgctca

SEQ ID NO: 1130977 - DNA, 21 bp, Homo sapiens
ttctgtggttcctctgctcac

SEQ ID NO: 1130978 - DNA, 21 bp, Homo sapiens
ttctgtggttctataataagt

SEQ ID NO: 1130979 - DNA, 13 bp, Homo sapiens
ttctgtgtacttt

SEQ ID NO: 1130980 - DNA, 16 bp, Homo sapiens
ttctgtgtagaaactg

SEQ ID NO: 1130981 - DNA, 15 bp, Homo sapiens
ttctgtgtagagaat

SEQ ID NO: 1130982 - DNA, 12 bp, Homo sapiens
ttctgtgtattt

SEQ ID NO: 1130983 - DNA, 22 bp, Homo sapiens
ttctgtgtctttcacagctcct

SEQ ID NO: 1130984 - DNA, 14 bp, Homo sapiens
ttctgtgttcattt

SEQ ID NO: 1130985 - DNA, 15 bp, Homo sapiens
ttctgttaactgaat

SEQ ID NO: 1130986 - DNA, 16 bp, Homo sapiens
ttctgttaactgaata

SEQ ID NO: 1130987 - DNA, 9 bp, Homo sapiens
ttctgttcc

SEQ ID NO: 1130988 - DNA, 15 bp, Homo sapiens
ttctgttctctgctg

SEQ ID NO: 1130989 - DNA, 12 bp, Homo sapiens
ttctgttctggg

SEQ ID NO: 1130990 - DNA, 14 bp, Homo sapiens
ttctgttctggggg

SEQ ID NO: 1130991 - DNA, 15 bp, Homo sapiens
ttctgttctgttgat

SEQ ID NO: 1130992 - DNA, 16 bp, Homo sapiens
ttctgttcttacaaat

SEQ ID NO: 1130993 - DNA, 22 bp, Homo sapiens
ttctgttcttacaaatgtgaaa

SEQ ID NO: 1130994 - DNA, 11 bp, Homo sapiens
ttctgttcttt

SEQ ID NO: 1130995 - DNA, 19 bp, Homo sapiens
ttctgttgaaaagcacaca

SEQ ID NO: 1130996 - DNA, 14 bp, Homo sapiens
ttctgttgaaggtg

SEQ ID NO: 1130997 - DNA, 24 bp, Homo sapiens
ttctgttgatcccacttcactgtg

SEQ ID NO: 1130998 - DNA, 18 bp, Homo sapiens
ttctgttgctggaggggc

SEQ ID NO: 1130999 - DNA, 19 bp, Homo sapiens
ttctgttgtaatagtccat

SEQ ID NO: 1131000 - DNA, 19 bp, Homo sapiens
ttctgttgttttgtgtata

SEQ ID NO: 1131001 - DNA, 14 bp, Homo sapiens
ttctgtttaatttt

SEQ ID NO: 1131002 - DNA, 19 bp, Homo sapiens
ttctgtttaattttcactt

SEQ ID NO: 1131003 - DNA, 13 bp, Homo sapiens
ttctgtttagata

SEQ ID NO: 1131004 - DNA, 17 bp, Homo sapiens
ttctgtttataattgtt

SEQ ID NO: 1131005 - DNA, 16 bp, Homo sapiens
ttctgtttcaaagcac

SEQ ID NO: 1131006 - DNA, 21 bp, Homo sapiens
ttctgtttctcttttggtttc

SEQ ID NO: 1131007 - DNA, 23 bp, Homo sapiens
ttctgtttctcttttggtttctg

SEQ ID NO: 1131008 - DNA, 12 bp, Homo sapiens
ttctgtttcttg

SEQ ID NO: 1131009 - DNA, 13 bp, Homo sapiens
ttctgtttggcac

SEQ ID NO: 1131010 - DNA, 21 bp, Homo sapiens
ttctgtttggcacttgtattt

SEQ ID NO: 1131011 - DNA, 18 bp, Homo sapiens
ttctgtttgtaaattatt

SEQ ID NO: 1131012 - DNA, 14 bp, Homo sapiens
ttctgtttgttaaa

SEQ ID NO: 1131013 - DNA, 17 bp, Homo sapiens
ttctgttttcccccagc

SEQ ID NO: 1131014 - DNA, 14 bp, Homo sapiens
ttctgttttgttaa

SEQ ID NO: 1131015 - DNA, 21 bp, Homo sapiens
ttctgttttgttaatataccc

SEQ ID NO: 1131016 - DNA, 12 bp, Homo sapiens
ttcttaaaaact

SEQ ID NO: 1131017 - DNA, 13 bp, Homo sapiens
ttcttaaaaactg

SEQ ID NO: 1131018 - DNA, 20 bp, Homo sapiens
ttcttaaaaactgtgtatca

SEQ ID NO: 1131019 - DNA, 22 bp, Homo sapiens
ttcttaaaaactgtgtatcatt

SEQ ID NO: 1131020 - DNA, 21 bp, Homo sapiens
ttcttaaaaatattttttctg

SEQ ID NO: 1131021 - DNA, 23 bp, Homo sapiens
ttcttaaaagaaatcttgcttca

SEQ ID NO: 1131022 - DNA, 23 bp, Homo sapiens
ttcttaaaagtactttaaaaagg

SEQ ID NO: 1131023 - DNA, 15 bp, Homo sapiens
ttcttaaaatatatt

SEQ ID NO: 1131024 - DNA, 15 bp, Homo sapiens
ttcttaaagcaaact

SEQ ID NO: 1131025 - DNA, 15 bp, Homo sapiens
ttcttaaagcttttt

SEQ ID NO: 1131026 - DNA, 15 bp, Homo sapiens
ttcttaaagtgccag

SEQ ID NO: 1131027 - DNA, 11 bp, Homo sapiens
ttcttaaataa

SEQ ID NO: 1131028 - DNA, 16 bp, Homo sapiens
ttcttaaatatgtata

SEQ ID NO: 1131029 - DNA, 14 bp, Homo sapiens
ttcttaaatggaat

SEQ ID NO: 1131030 - DNA, 13 bp, Homo sapiens
ttcttaaatgttt

SEQ ID NO: 1131031 - DNA, 15 bp, Homo sapiens
ttcttaaattatttt

SEQ ID NO: 1131032 - DNA, 16 bp, Homo sapiens
ttcttaacaaactctt

SEQ ID NO: 1131033 - DNA, 18 bp, Homo sapiens
ttcttaacacagccttcc

SEQ ID NO: 1131034 - DNA, 19 bp, Homo sapiens
ttcttaacctttgctatgt

SEQ ID NO: 1131035 - DNA, 13 bp, Homo sapiens
ttcttaacttctt

SEQ ID NO: 1131036 - DNA, 16 bp, Homo sapiens
ttcttaacttcttgct

SEQ ID NO: 1131037 - DNA, 23 bp, Homo sapiens
ttcttaagacgtgattttgctgt

SEQ ID NO: 1131038 - DNA, 15 bp, Homo sapiens
ttcttaagcactttg

SEQ ID NO: 1131039 - DNA, 21 bp, Homo sapiens
ttcttaagccctttgctctgg

SEQ ID NO: 1131040 - DNA, 17 bp, Homo sapiens
ttcttaaggaattttgt

SEQ ID NO: 1131041 - DNA, 20 bp, Homo sapiens
ttcttaaggattgtgatatt

SEQ ID NO: 1131042 - DNA, 13 bp, Homo sapiens
ttcttaaggtttt

SEQ ID NO: 1131043 - DNA, 14 bp, Homo sapiens
ttcttaaggttttg

SEQ ID NO: 1131044 - DNA, 13 bp, Homo sapiens
ttcttaattctta

SEQ ID NO: 1131045 - DNA, 18 bp, Homo sapiens
ttcttacacacccccaga

SEQ ID NO: 1131046 - DNA, 22 bp, Homo sapiens
ttcttacagcacatcacctctt

SEQ ID NO: 1131047 - DNA, 18 bp, Homo sapiens
ttcttacaggcctacaga

SEQ ID NO: 1131048 - DNA, 21 bp, Homo sapiens
ttcttacagttaagaagccct

SEQ ID NO: 1131049 - DNA, 16 bp, Homo sapiens
ttcttacataattttt

SEQ ID NO: 1131050 - DNA, 13 bp, Homo sapiens
ttcttacatgttt

SEQ ID NO: 1131051 - DNA, 17 bp, Homo sapiens
ttcttacccaatttccc

SEQ ID NO: 1131052 - DNA, 15 bp, Homo sapiens
ttcttacctgtatgt

SEQ ID NO: 1131053 - DNA, 15 bp, Homo sapiens
ttcttactaaaaagt

SEQ ID NO: 1131054 - DNA, 20 bp, Homo sapiens
ttcttactaaaaagtataaa

SEQ ID NO: 1131055 - DNA, 15 bp, Homo sapiens
ttcttactaaacatt

SEQ ID NO: 1131056 - DNA, 16 bp, Homo sapiens
ttcttactcctcctct

SEQ ID NO: 1131057 - DNA, 19 bp, Homo sapiens
ttcttagctgtaacttaac

SEQ ID NO: 1131058 - DNA, 15 bp, Homo sapiens
ttcttagctttgaaa

SEQ ID NO: 1131059 - DNA, 19 bp, Homo sapiens
ttcttagtgcttcagagtt

SEQ ID NO: 1131060 - DNA, 13 bp, Homo sapiens
ttcttagttctca

SEQ ID NO: 1131061 - DNA, 18 bp, Homo sapiens
ttcttagttgacaaccta

SEQ ID NO: 1131062 - DNA, 20 bp, Homo sapiens
ttcttatacagataaaacat

SEQ ID NO: 1131063 - DNA, 21 bp, Homo sapiens
ttcttatacatttgataaagt

SEQ ID NO: 1131064 - DNA, 20 bp, Homo sapiens
ttcttatacgcttttctttg

SEQ ID NO: 1131065 - DNA, 16 bp, Homo sapiens
ttcttatcttctgcaa

SEQ ID NO: 1131066 - DNA, 16 bp, Homo sapiens
ttcttatgatgttttc

SEQ ID NO: 1131067 - DNA, 15 bp, Homo sapiens
ttcttatggaattga

SEQ ID NO: 1131068 - DNA, 18 bp, Homo sapiens
ttcttatggaattgattt

SEQ ID NO: 1131069 - DNA, 16 bp, Homo sapiens
ttcttattggaaatgt

SEQ ID NO: 1131070 - DNA, 19 bp, Homo sapiens
ttcttatttaatgaaagac

SEQ ID NO: 1131071 - DNA, 17 bp, Homo sapiens
ttcttatttttgtactt

SEQ ID NO: 1131072 - DNA, 19 bp, Homo sapiens
ttcttcaaatctcagcaaa

SEQ ID NO: 1131073 - DNA, 22 bp, Homo sapiens
ttcttcaaatctcagcaaagct

SEQ ID NO: 1131074 - DNA, 17 bp, Homo sapiens
ttcttcaacatcaatgt

SEQ ID NO: 1131075 - DNA, 11 bp, Homo sapiens
ttcttcaagag

SEQ ID NO: 1131076 - DNA, 21 bp, Homo sapiens
ttcttcacagtgcagcttgca

SEQ ID NO: 1131077 - DNA, 16 bp, Homo sapiens
ttcttcaccaaatctt

SEQ ID NO: 1131078 - DNA, 15 bp, Homo sapiens
ttcttcacctcttcc

SEQ ID NO: 1131079 - DNA, 17 bp, Homo sapiens
ttcttcacctgttatgt

SEQ ID NO: 1131080 - DNA, 18 bp, Homo sapiens
ttcttcacttacaagaaa

SEQ ID NO: 1131081 - DNA, 16 bp, Homo sapiens
ttcttcagaattagat

SEQ ID NO: 1131082 - DNA, 19 bp, Homo sapiens
ttcttcagaattatccatt

SEQ ID NO: 1131083 - DNA, 12 bp, Homo sapiens
ttcttcagaggg

SEQ ID NO: 1131084 - DNA, 20 bp, Homo sapiens
ttcttcagagtgaagaatct

SEQ ID NO: 1131085 - DNA, 16 bp, Homo sapiens
ttcttcaggtaacact

SEQ ID NO: 1131086 - DNA, 20 bp, Homo sapiens
ttcttcaggtaacactacag

SEQ ID NO: 1131087 - DNA, 18 bp, Homo sapiens
ttcttcataacaatttta

SEQ ID NO: 1131088 - DNA, 19 bp, Homo sapiens
ttcttcatgtgatgtcatg

SEQ ID NO: 1131089 - DNA, 17 bp, Homo sapiens
ttcttccaaatgcagtt

SEQ ID NO: 1131090 - DNA, 19 bp, Homo sapiens
ttcttccattccttcatgt

SEQ ID NO: 1131091 - DNA, 19 bp, Homo sapiens
ttcttcccatcactggagc

SEQ ID NO: 1131092 - DNA, 20 bp, Homo sapiens
ttcttcccccacttcccctc

SEQ ID NO: 1131093 - DNA, 19 bp, Homo sapiens
ttcttcccctttgtcctgc

SEQ ID NO: 1131094 - DNA, 19 bp, Homo sapiens
ttcttcccgtgtgtatttc

SEQ ID NO: 1131095 - DNA, 21 bp, Homo sapiens
ttcttcccgtgtgtatttcta

SEQ ID NO: 1131096 - DNA, 22 bp, Homo sapiens
ttcttcccttttacatactgct

SEQ ID NO: 1131097 - DNA, 21 bp, Homo sapiens
ttcttcctcctccatcacctg

SEQ ID NO: 1131098 - DNA, 13 bp, Homo sapiens
ttcttcctgccag

SEQ ID NO: 1131099 - DNA, 10 bp, Homo sapiens
ttcttccttc

SEQ ID NO: 1131100 - DNA, 15 bp, Homo sapiens
ttcttccttcctaga

SEQ ID NO: 1131101 - DNA, 19 bp, Homo sapiens
ttcttcctttgaagcttta

SEQ ID NO: 1131102 - DNA, 14 bp, Homo sapiens
ttcttcgaaaatct

SEQ ID NO: 1131103 - DNA, 17 bp, Homo sapiens
ttcttcgaaaatctaga

SEQ ID NO: 1131104 - DNA, 20 bp, Homo sapiens
ttcttcggggaactcctgga

SEQ ID NO: 1131105 - DNA, 17 bp, Homo sapiens
ttcttcgtccttttggt

SEQ ID NO: 1131106 - DNA, 19 bp, Homo sapiens
ttcttcgtccttttggttt

SEQ ID NO: 1131107 - DNA, 23 bp, Homo sapiens
ttcttcgttaatagattatttca

SEQ ID NO: 1131108 - DNA, 13 bp, Homo sapiens
ttgaagacaattt

SEQ ID NO: 1131109 - DNA, 15 bp, Homo sapiens
ttgaagacaatttga

SEQ ID NO: 1131110 - DNA, 22 bp, Homo sapiens
ttgaagacaatttgatacataa

SEQ ID NO: 1131111 - DNA, 18 bp, Homo sapiens
ttgaagacacagcctccc

SEQ ID NO: 1131112 - DNA, 13 bp, Homo sapiens
ttgaagacgtgga

SEQ ID NO: 1131113 - DNA, 14 bp, Homo sapiens
ttgaagagacagag

SEQ ID NO: 1131114 - DNA, 20 bp, Homo sapiens
ttgaagagacagagacaagt

SEQ ID NO: 1131115 - DNA, 17 bp, Homo sapiens
ttgaagaggggaggggc

SEQ ID NO: 1131116 - DNA, 20 bp, Homo sapiens
ttgaagataataatcttggc

SEQ ID NO: 1131117 - DNA, 20 bp, Homo sapiens
ttgaagcaaatcgaatgaaa

SEQ ID NO: 1131118 - DNA, 19 bp, Homo sapiens
ttgaagcaactacaacttc

SEQ ID NO: 1131119 - DNA, 21 bp, Homo sapiens
ttgaagcaactacaacttctc

SEQ ID NO: 1131120 - DNA, 17 bp, Homo sapiens
ttgaagcaataactcca

SEQ ID NO: 1131121 - DNA, 15 bp, Homo sapiens
ttgaagccaaagaaa

SEQ ID NO: 1131122 - DNA, 23 bp, Homo sapiens
ttgaagccaagtcagctttgcct

SEQ ID NO: 1131123 - DNA, 13 bp, Homo sapiens
ttgaagccactga

SEQ ID NO: 1131124 - DNA, 17 bp, Homo sapiens
ttgaagccactgaagct

SEQ ID NO: 1131125 - DNA, 17 bp, Homo sapiens
ttgaagctgttgctatt

SEQ ID NO: 1131126 - DNA, 19 bp, Homo sapiens
ttgaaggacaacagcatct

SEQ ID NO: 1131127 - DNA, 13 bp, Homo sapiens
ttgaaggattgca

SEQ ID NO: 1131128 - DNA, 22 bp, Homo sapiens
ttgaaggattgcatcctgctgg

SEQ ID NO: 1131129 - DNA, 17 bp, Homo sapiens
ttgaaggcaaaattgca

SEQ ID NO: 1131130 - DNA, 17 bp, Homo sapiens
ttgaaggcagaaagcaa

SEQ ID NO: 1131131 - DNA, 13 bp, Homo sapiens
ttgaaggcagtct

SEQ ID NO: 1131132 - DNA, 15 bp, Homo sapiens
ttgaaggccctgctg

SEQ ID NO: 1131133 - DNA, 12 bp, Homo sapiens
ttgaaggcttaa

SEQ ID NO: 1131134 - DNA, 23 bp, Homo sapiens
ttgaaggctttaataaaggccac

SEQ ID NO: 1131135 - DNA, 19 bp, Homo sapiens
ttgaagggcaagaaatggc

SEQ ID NO: 1131136 - DNA, 12 bp, Homo sapiens
ttgaaggtttca

SEQ ID NO: 1131137 - DNA, 20 bp, Homo sapiens
ttgaagtatattcttattgg

SEQ ID NO: 1131138 - DNA, 22 bp, Homo sapiens
ttgaagtatattcttattggaa

SEQ ID NO: 1131139 - DNA, 21 bp, Homo sapiens
ttgaagtcagccacactgggc

SEQ ID NO: 1131140 - DNA, 17 bp, Homo sapiens
ttgaagtgtaggcagac

SEQ ID NO: 1131141 - DNA, 18 bp, Homo sapiens
ttgaagtgtcttctgttc

SEQ ID NO: 1131142 - DNA, 21 bp, Homo sapiens
ttgaagttcatggtgatcagt

SEQ ID NO: 1131143 - DNA, 21 bp, Homo sapiens
ttgaagttgttactaactaaa

SEQ ID NO: 1131144 - DNA, 21 bp, Homo sapiens
ttgaagttgtttatcaacttc

SEQ ID NO: 1131145 - DNA, 15 bp, Homo sapiens
ttgaagtttgaacca

SEQ ID NO: 1131146 - DNA, 15 bp, Homo sapiens
ttgaataaaaagtga

SEQ ID NO: 1131147 - DNA, 20 bp, Homo sapiens
ttgaataaaaagtgaacttt

SEQ ID NO: 1131148 - DNA, 23 bp, Homo sapiens
ttgaataaaaagtgaacttttgt

SEQ ID NO: 1131149 - DNA, 15 bp, Homo sapiens
ttgaataaaatgaca

SEQ ID NO: 1131150 - DNA, 19 bp, Homo sapiens
ttgaataaagttgaagcta

SEQ ID NO: 1131151 - DNA, 17 bp, Homo sapiens
ttgaataaatgagaaaa

SEQ ID NO: 1131152 - DNA, 22 bp, Homo sapiens
ttgaataaatgagaaaaaatgc

SEQ ID NO: 1131153 - DNA, 14 bp, Homo sapiens
ttgaataaatgtgt

SEQ ID NO: 1131154 - DNA, 12 bp, Homo sapiens
ttgaataataag

SEQ ID NO: 1131155 - DNA, 20 bp, Homo sapiens
ttgaataataagcaggatgt

SEQ ID NO: 1131156 - DNA, 22 bp, Homo sapiens
ttgaataccattaaaactgctt

SEQ ID NO: 1131157 - DNA, 16 bp, Homo sapiens
ttgaatactctgccct

SEQ ID NO: 1131158 - DNA, 17 bp, Homo sapiens
ttgaatagattttctct

SEQ ID NO: 1131159 - DNA, 19 bp, Homo sapiens
ttgaatagattttctctgg

SEQ ID NO: 1131160 - DNA, 20 bp, Homo sapiens
ttgaatagattttctctgga

SEQ ID NO: 1131161 - DNA, 16 bp, Homo sapiens
ttgaatagtattgtgt

SEQ ID NO: 1131162 - DNA, 21 bp, Homo sapiens
ttgaatataatatatttgtgt

SEQ ID NO: 1131163 - DNA, 20 bp, Homo sapiens
ttgaatatatcagaatctgt

SEQ ID NO: 1131164 - DNA, 13 bp, Homo sapiens
ttgaatatattat

SEQ ID NO: 1131165 - DNA, 18 bp, Homo sapiens
ttgaatattcctggactt

SEQ ID NO: 1131166 - DNA, 16 bp, Homo sapiens
ttgaatattttttgaa

SEQ ID NO: 1131167 - DNA, 17 bp, Homo sapiens
ttgaatattttttgaag

SEQ ID NO: 1131168 - DNA, 14 bp, Homo sapiens
ttgaatcaataata

SEQ ID NO: 1131169 - DNA, 20 bp, Homo sapiens
ttgaatctacaaaagtgaac

SEQ ID NO: 1131170 - DNA, 17 bp, Homo sapiens
ttgaatctatttaagta

SEQ ID NO: 1131171 - DNA, 14 bp, Homo sapiens
ttgaatctgggagg

SEQ ID NO: 1131172 - DNA, 15 bp, Homo sapiens
ttgaatctttccaat

SEQ ID NO: 1131173 - DNA, 12 bp, Homo sapiens
ttgaatgaaaaa

SEQ ID NO: 1131174 - DNA, 15 bp, Homo sapiens
ttgaatgaaaaattt

SEQ ID NO: 1131175 - DNA, 18 bp, Homo sapiens
ttgaatgaaaaatttaag

SEQ ID NO: 1131176 - DNA, 17 bp, Homo sapiens
ttgaatgacaacagaag

SEQ ID NO: 1131177 - DNA, 20 bp, Homo sapiens
ttgaatgacaacagaagctt

SEQ ID NO: 1131178 - DNA, 21 bp, Homo sapiens
ttgaatgacaacagaagcttc

SEQ ID NO: 1131179 - DNA, 20 bp, Homo sapiens
ttgaatgatttttctttaca

SEQ ID NO: 1131180 - DNA, 23 bp, Homo sapiens
ttgaatgcaaaagaaatttagag

SEQ ID NO: 1131181 - DNA, 14 bp, Homo sapiens
ttgaatgctgccag

SEQ ID NO: 1131182 - DNA, 23 bp, Homo sapiens
ttgaatgctttttgaatgttatt

SEQ ID NO: 1131183 - DNA, 15 bp, Homo sapiens
ttgaatgggtccatt

SEQ ID NO: 1131184 - DNA, 20 bp, Homo sapiens
ttgaatgtatttgatttata

SEQ ID NO: 1131185 - DNA, 18 bp, Homo sapiens
ttgaatgtcacaaattga

SEQ ID NO: 1131186 - DNA, 17 bp, Homo sapiens
ttgaatgttaagaattg

SEQ ID NO: 1131187 - DNA, 12 bp, Homo sapiens
ttgaattagaaa

SEQ ID NO: 1131188 - DNA, 15 bp, Homo sapiens
ttgaattagaaaatt

SEQ ID NO: 1131189 - DNA, 21 bp, Homo sapiens
ttgaattaggctaaaaggtct

SEQ ID NO: 1131190 - DNA, 12 bp, Homo sapiens
ttgaattatcag

SEQ ID NO: 1131191 - DNA, 13 bp, Homo sapiens
ttgaattatcttg

SEQ ID NO: 1131192 - DNA, 20 bp, Homo sapiens
ttgaattatgttttgacaca

SEQ ID NO: 1131193 - DNA, 18 bp, Homo sapiens
ttgaattatttctttatt

SEQ ID NO: 1131194 - DNA, 21 bp, Homo sapiens
ttgaattcttggttgaggaaa

SEQ ID NO: 1131195 - DNA, 19 bp, Homo sapiens
ttgaattgtgtattgatgc

SEQ ID NO: 1131196 - DNA, 16 bp, Homo sapiens
ttgaattgttatgaaa

SEQ ID NO: 1131197 - DNA, 16 bp, Homo sapiens
ttgaatttaaataaag

SEQ ID NO: 1131198 - DNA, 20 bp, Homo sapiens
ttgaattttgttctctggga

SEQ ID NO: 1131199 - DNA, 22 bp, Homo sapiens
ttgaattttgtttttattttca

SEQ ID NO: 1131200 - DNA, 13 bp, Homo sapiens
ttgaatttttcct

SEQ ID NO: 1131201 - DNA, 18 bp, Homo sapiens
ttgacaaaattttctcat

SEQ ID NO: 1131202 - DNA, 17 bp, Homo sapiens
ttgacaacctagaatgt

SEQ ID NO: 1131203 - DNA, 18 bp, Homo sapiens
ttgacaacctagaatgtc

SEQ ID NO: 1131204 - DNA, 17 bp, Homo sapiens
ttgacaactaaaattag

SEQ ID NO: 1131205 - DNA, 22 bp, Homo sapiens
ttgacaagctgacttggcactt

SEQ ID NO: 1131206 - DNA, 18 bp, Homo sapiens
ttgacaaggtcaaattta

SEQ ID NO: 1131207 - DNA, 18 bp, Homo sapiens
ttgacaataaatgtgctt

SEQ ID NO: 1131208 - DNA, 18 bp, Homo sapiens
ttgacaatcaaagaaaag

SEQ ID NO: 1131209 - DNA, 19 bp, Homo sapiens
ttgacaatcaaagaaaaga

SEQ ID NO: 1131210 - DNA, 18 bp, Homo sapiens
ttgacaattactcaggtt

SEQ ID NO: 1131211 - DNA, 17 bp, Homo sapiens
ttgacaattctgcatgt

SEQ ID NO: 1131212 - DNA, 15 bp, Homo sapiens
ttgacaattctgggt

SEQ ID NO: 1131213 - DNA, 16 bp, Homo sapiens
ttgacaattctgggtg

SEQ ID NO: 1131214 - DNA, 17 bp, Homo sapiens
ttgacaattctgggtgc

SEQ ID NO: 1131215 - DNA, 14 bp, Homo sapiens
ttgacacaaagctt

SEQ ID NO: 1131216 - DNA, 23 bp, Homo sapiens
ttgacactagcccaatgaaatga

SEQ ID NO: 1131217 - DNA, 17 bp, Homo sapiens
ttgacactgaaagtttt

SEQ ID NO: 1131218 - DNA, 22 bp, Homo sapiens
ttgacactgaaagttttgtaaa

SEQ ID NO: 1131219 - DNA, 19 bp, Homo sapiens
ttgacactggtatcttatt

SEQ ID NO: 1131220 - DNA, 19 bp, Homo sapiens
ttgacactgttttccttac

SEQ ID NO: 1131221 - DNA, 20 bp, Homo sapiens
ttgacacttttaaaaaacaa

SEQ ID NO: 1131222 - DNA, 14 bp, Homo sapiens
ttgacactttttgt

SEQ ID NO: 1131223 - DNA, 18 bp, Homo sapiens
ttgacagatcaagctgtg

SEQ ID NO: 1131224 - DNA, 14 bp, Homo sapiens
ttgacagctttgct

SEQ ID NO: 1131225 - DNA, 14 bp, Homo sapiens
ttgacagtatatgt

SEQ ID NO: 1131226 - DNA, 19 bp, Homo sapiens
ttgacagtatatgtcatgc

SEQ ID NO: 1131227 - DNA, 12 bp, Homo sapiens
ttgacagtctga

SEQ ID NO: 1131228 - DNA, 19 bp, Homo sapiens
ttgacagtgttgaaaatgt

SEQ ID NO: 1131229 - DNA, 22 bp, Homo sapiens
ttgaggagaagggggtctctgt

SEQ ID NO: 1131230 - DNA, 16 bp, Homo sapiens
ttgaggagccccagct

SEQ ID NO: 1131231 - DNA, 17 bp, Homo sapiens
ttgaggagctgcactga

SEQ ID NO: 1131232 - DNA, 19 bp, Homo sapiens
ttgaggaggggcaggtaaa

SEQ ID NO: 1131233 - DNA, 18 bp, Homo sapiens
ttgaggatatattttcac

SEQ ID NO: 1131234 - DNA, 22 bp, Homo sapiens
ttgaggatatattttcactttg

SEQ ID NO: 1131235 - DNA, 22 bp, Homo sapiens
ttgaggatcagggctcctaggc

SEQ ID NO: 1131236 - DNA, 18 bp, Homo sapiens
ttgaggcaagtgtgggcc

SEQ ID NO: 1131237 - DNA, 20 bp, Homo sapiens
ttgaggccaagaatattgca

SEQ ID NO: 1131238 - DNA, 13 bp, Homo sapiens
ttgaggccaggag

SEQ ID NO: 1131239 - DNA, 19 bp, Homo sapiens
ttgaggcctgccctcaggg

SEQ ID NO: 1131240 - DNA, 20 bp, Homo sapiens
ttgaggctctgtcactgagc

SEQ ID NO: 1131241 - DNA, 22 bp, Homo sapiens
ttgagggacaagttgtttatgt

SEQ ID NO: 1131242 - DNA, 11 bp, Homo sapiens
ttgagggacca

SEQ ID NO: 1131243 - DNA, 21 bp, Homo sapiens
ttgagggacgctttgtctgtc

SEQ ID NO: 1131244 - DNA, 17 bp, Homo sapiens
ttgagggccagtgatga

SEQ ID NO: 1131245 - DNA, 22 bp, Homo sapiens
ttgagggctgatagctctgcct

SEQ ID NO: 1131246 - DNA, 13 bp, Homo sapiens
ttgagggctgcag

SEQ ID NO: 1131247 - DNA, 20 bp, Homo sapiens
ttgaggggattaatatgaaa

SEQ ID NO: 1131248 - DNA, 19 bp, Homo sapiens
ttgaggggccaggggcagg

SEQ ID NO: 1131249 - DNA, 22 bp, Homo sapiens
ttgaggggctggccttcctgcc

SEQ ID NO: 1131250 - DNA, 16 bp, Homo sapiens
ttgaggggttcttctg

SEQ ID NO: 1131251 - DNA, 22 bp, Homo sapiens
ttgaggtcaagtaagaagacat

SEQ ID NO: 1131252 - DNA, 21 bp, Homo sapiens
ttgaggtctttctcctcagga

SEQ ID NO: 1131253 - DNA, 18 bp, Homo sapiens
ttgaggtcttttgacatg

SEQ ID NO: 1131254 - DNA, 19 bp, Homo sapiens
ttgaggtcttttgacatgt

SEQ ID NO: 1131255 - DNA, 14 bp, Homo sapiens
ttgaggtgaaatgg

SEQ ID NO: 1131256 - DNA, 14 bp, Homo sapiens
ttgaggtgcaagga

SEQ ID NO: 1131257 - DNA, 11 bp, Homo sapiens
ttgaggtggct

SEQ ID NO: 1131258 - DNA, 19 bp, Homo sapiens
ttgaggtgtcagagaaaat

SEQ ID NO: 1131259 - DNA, 12 bp, Homo sapiens
ttgagtaatggt

SEQ ID NO: 1131260 - DNA, 21 bp, Homo sapiens
ttgagtaggtaccttgtagca

SEQ ID NO: 1131261 - DNA, 21 bp, Homo sapiens
ttgagtcaaaagcctgggtga

SEQ ID NO: 1131262 - DNA, 21 bp, Homo sapiens
ttgagtcaggagcttattaca

SEQ ID NO: 1131263 - DNA, 13 bp, Homo sapiens
ttgagtccctgct

SEQ ID NO: 1131264 - DNA, 19 bp, Homo sapiens
ttgagtcctaggacttaaa

SEQ ID NO: 1131265 - DNA, 21 bp, Homo sapiens
ttgagtctcttttttattctg

SEQ ID NO: 1131266 - DNA, 23 bp, Homo sapiens
ttgagtcttaactgtatttcagt

SEQ ID NO: 1131267 - DNA, 12 bp, Homo sapiens
ttgagtgagaag

SEQ ID NO: 1131268 - DNA, 14 bp, Homo sapiens
ttgagtgagaagag

SEQ ID NO: 1131269 - DNA, 21 bp, Homo sapiens
ttgagtgagaagagcttgcac

SEQ ID NO: 1131270 - DNA, 18 bp, Homo sapiens
ttgagtgcactgactgtg

SEQ ID NO: 1131271 - DNA, 15 bp, Homo sapiens
ttgagtgctctgatc

SEQ ID NO: 1131272 - DNA, 18 bp, Homo sapiens
ttgagtgttcctttttaa

SEQ ID NO: 1131273 - DNA, 21 bp, Homo sapiens
ttgagtgttcctttttaaatg

SEQ ID NO: 1131274 - DNA, 17 bp, Homo sapiens
ttgagtgttttaagata

SEQ ID NO: 1131275 - DNA, 14 bp, Homo sapiens
ttgagttcctctgc

SEQ ID NO: 1131276 - DNA, 20 bp, Homo sapiens
ttgagttggttacttcatat

SEQ ID NO: 1131277 - DNA, 11 bp, Homo sapiens
ttgagtttgtc

SEQ ID NO: 1131278 - DNA, 16 bp, Homo sapiens
ttgagttttatttatt

SEQ ID NO: 1131279 - DNA, 19 bp, Homo sapiens
ttgagttttcagtggggca

SEQ ID NO: 1131280 - DNA, 16 bp, Homo sapiens
ttgagtttttcctccc

SEQ ID NO: 1131281 - DNA, 21 bp, Homo sapiens
ttgagtttttcctcccagtga

SEQ ID NO: 1131282 - DNA, 19 bp, Homo sapiens
ttgataaattccactggac

SEQ ID NO: 1131283 - DNA, 13 bp, Homo sapiens
ttgataagaggaa

SEQ ID NO: 1131284 - DNA, 15 bp, Homo sapiens
ttgataagcacatta

SEQ ID NO: 1131285 - DNA, 15 bp, Homo sapiens
ttgataatacttgac

SEQ ID NO: 1131286 - DNA, 17 bp, Homo sapiens
ttgataatatataaaca

SEQ ID NO: 1131287 - DNA, 16 bp, Homo sapiens
ttgataatattagtga

SEQ ID NO: 1131288 - DNA, 22 bp, Homo sapiens
ttgataatattagtgattctga

SEQ ID NO: 1131289 - DNA, 16 bp, Homo sapiens
ttgataatcttcaggt

SEQ ID NO: 1131290 - DNA, 23 bp, Homo sapiens
ttgataatgctttcacaacattt

SEQ ID NO: 1131291 - DNA, 15 bp, Homo sapiens
ttgataatttcaggg

SEQ ID NO: 1131292 - DNA, 13 bp, Homo sapiens
ttgatacaaacca

SEQ ID NO: 1131293 - DNA, 20 bp, Homo sapiens
ttgatacaaatgtttataac

SEQ ID NO: 1131294 - DNA, 23 bp, Homo sapiens
ttgatacataataaaaaattatg

SEQ ID NO: 1131295 - DNA, 15 bp, Homo sapiens
ttgatacattcaaat

SEQ ID NO: 1131296 - DNA, 18 bp, Homo sapiens
ttgatacattcaaatttg

SEQ ID NO: 1131297 - DNA, 21 bp, Homo sapiens
ttgatacattcaaatttgtct

SEQ ID NO: 1131298 - DNA, 15 bp, Homo sapiens
ttgatacccccctct

SEQ ID NO: 1131299 - DNA, 15 bp, Homo sapiens
ttgatactacagttt

SEQ ID NO: 1131300 - DNA, 13 bp, Homo sapiens
ttgatagaaccat

SEQ ID NO: 1131301 - DNA, 15 bp, Homo sapiens
ttgatagaagaatat

SEQ ID NO: 1131302 - DNA, 18 bp, Homo sapiens
ttgatagctgtcccatct

SEQ ID NO: 1131303 - DNA, 19 bp, Homo sapiens
ttgatagctttatttttta

SEQ ID NO: 1131304 - DNA, 16 bp, Homo sapiens
ttgataggaactgtct

SEQ ID NO: 1131305 - DNA, 17 bp, Homo sapiens
ttgataggaactgtctc

SEQ ID NO: 1131306 - DNA, 23 bp, Homo sapiens
ttgataggccgttggttgtctga

SEQ ID NO: 1131307 - DNA, 16 bp, Homo sapiens
ttgatagggaactggg

SEQ ID NO: 1131308 - DNA, 18 bp, Homo sapiens
ttgatagttctataagaa

SEQ ID NO: 1131309 - DNA, 21 bp, Homo sapiens
ttgatataatttccatagtgt

SEQ ID NO: 1131310 - DNA, 19 bp, Homo sapiens
ttgatatacattgtgtgaa

SEQ ID NO: 1131311 - DNA, 15 bp, Homo sapiens
ttgatatagaaagct

SEQ ID NO: 1131312 - DNA, 15 bp, Homo sapiens
ttgatattctaagaa

SEQ ID NO: 1131313 - DNA, 18 bp, Homo sapiens
ttgatattctaagaaata

SEQ ID NO: 1131314 - DNA, 22 bp, Homo sapiens
ttgatattctaagaaatatctg

SEQ ID NO: 1131315 - DNA, 23 bp, Homo sapiens
ttgatattctaagaaatatctgt

SEQ ID NO: 1131316 - DNA, 20 bp, Homo sapiens
ttgatattgtttgctgttgg

SEQ ID NO: 1131317 - DNA, 15 bp, Homo sapiens
ttgatatttctagct

SEQ ID NO: 1131318 - DNA, 17 bp, Homo sapiens
ttgatattttttctctc

SEQ ID NO: 1131319 - DNA, 21 bp, Homo sapiens
ttgatcaaatatagaaagttg

SEQ ID NO: 1131320 - DNA, 15 bp, Homo sapiens
ttgatcacacagtgt

SEQ ID NO: 1131321 - DNA, 16 bp, Homo sapiens
ttgatcacacagtgtt

SEQ ID NO: 1131322 - DNA, 13 bp, Homo sapiens
ttgatcagaatcc

SEQ ID NO: 1131323 - DNA, 13 bp, Homo sapiens
ttgatcagacagc

SEQ ID NO: 1131324 - DNA, 18 bp, Homo sapiens
ttgatcagttaagaaatt

SEQ ID NO: 1131325 - DNA, 15 bp, Homo sapiens
ttgatcatgtacttt

SEQ ID NO: 1131326 - DNA, 17 bp, Homo sapiens
ttgatcatgtacttttt

SEQ ID NO: 1131327 - DNA, 15 bp, Homo sapiens
ttgatcatttctgcc

SEQ ID NO: 1131328 - DNA, 12 bp, Homo sapiens
ttgatcccacat

SEQ ID NO: 1131329 - DNA, 18 bp, Homo sapiens
ttgatcccacttcactgt

SEQ ID NO: 1131330 - DNA, 23 bp, Homo sapiens
ttgatccctaaccctacaaagag

SEQ ID NO: 1131331 - DNA, 21 bp, Homo sapiens
ttgatcccttctcctgccctt

SEQ ID NO: 1131332 - DNA, 20 bp, Homo sapiens
ttgatccttaaccaataatg

SEQ ID NO: 1131333 - DNA, 19 bp, Homo sapiens
ttgatccttctgagctcca

SEQ ID NO: 1131334 - DNA, 20 bp, Homo sapiens
ttgatctacccgtgcctggg

SEQ ID NO: 1131335 - DNA, 13 bp, Homo sapiens
ttgatctctgctt

SEQ ID NO: 1131336 - DNA, 17 bp, Homo sapiens
ttgatctgcatatttct

SEQ ID NO: 1131337 - DNA, 21 bp, Homo sapiens
ttgatctgcatatttctgtat

SEQ ID NO: 1131338 - DNA, 23 bp, Homo sapiens
ttgatctgcatatttctgtatat

SEQ ID NO: 1131339 - DNA, 17 bp, Homo sapiens
ttgatctgtgatttctt

SEQ ID NO: 1131340 - DNA, 14 bp, Homo sapiens
ttgatcttaaagat

SEQ ID NO: 1131341 - DNA, 16 bp, Homo sapiens
ttgatctttgtttaaa

SEQ ID NO: 1131342 - DNA, 18 bp, Homo sapiens
ttgatctttgtttaaatg

SEQ ID NO: 1131343 - DNA, 15 bp, Homo sapiens
ttgatgaaagctgat

SEQ ID NO: 1131344 - DNA, 16 bp, Homo sapiens
ttgatgaagcaaggaa

SEQ ID NO: 1131345 - DNA, 20 bp, Homo sapiens
ttgatgactcgaaactgaca

SEQ ID NO: 1131346 - DNA, 23 bp, Homo sapiens
ttgatgactcgaaactgacagta

SEQ ID NO: 1131347 - DNA, 17 bp, Homo sapiens
ttgatgacttcagtgaa

SEQ ID NO: 1131348 - DNA, 20 bp, Homo sapiens
ttgatgatgtctacagaaaa

SEQ ID NO: 1131349 - DNA, 11 bp, Homo sapiens
ttgatgatgtg

SEQ ID NO: 1131350 - DNA, 12 bp, Homo sapiens
ttgcacattgtt

SEQ ID NO: 1131351 - DNA, 23 bp, Homo sapiens
ttgcacattgttgtttttttaat

SEQ ID NO: 1131352 - DNA, 21 bp, Homo sapiens
ttgcaccactgcactccagcc

SEQ ID NO: 1131353 - DNA, 22 bp, Homo sapiens
ttgcaccccaaagctttcctgc

SEQ ID NO: 1131354 - DNA, 16 bp, Homo sapiens
ttgcacccctcccatt

SEQ ID NO: 1131355 - DNA, 23 bp, Homo sapiens
ttgcacccctttcctccccatac

SEQ ID NO: 1131356 - DNA, 17 bp, Homo sapiens
ttgcaccgtcctcagca

SEQ ID NO: 1131357 - DNA, 22 bp, Homo sapiens
ttgcacctacgggggcatctga

SEQ ID NO: 1131358 - DNA, 18 bp, Homo sapiens
ttgcacctatctcagcca

SEQ ID NO: 1131359 - DNA, 14 bp, Homo sapiens
ttgcacctgctctc

SEQ ID NO: 1131360 - DNA, 19 bp, Homo sapiens
ttgcacgacgccctctccc

SEQ ID NO: 1131361 - DNA, 20 bp, Homo sapiens
ttgcacgcccatgtgtgagt

SEQ ID NO: 1131362 - DNA, 13 bp, Homo sapiens
ttgcacggctgct

SEQ ID NO: 1131363 - DNA, 17 bp, Homo sapiens
ttgcacggtttgtgaga

SEQ ID NO: 1131364 - DNA, 18 bp, Homo sapiens
ttgcacgtcttgctattt

SEQ ID NO: 1131365 - DNA, 14 bp, Homo sapiens
ttgcactaggaatt

SEQ ID NO: 1131366 - DNA, 15 bp, Homo sapiens
ttgcactaggaattc

SEQ ID NO: 1131367 - DNA, 16 bp, Homo sapiens
ttgcactcctcacaca

SEQ ID NO: 1131368 - DNA, 17 bp, Homo sapiens
ttgcactccttccctaa

SEQ ID NO: 1131369 - DNA, 17 bp, Homo sapiens
ttgcactgaatatataa

SEQ ID NO: 1131370 - DNA, 21 bp, Homo sapiens
ttgcactgaatatataaacac

SEQ ID NO: 1131371 - DNA, 21 bp, Homo sapiens
ttgcactgagggccacactat

SEQ ID NO: 1131372 - DNA, 22 bp, Homo sapiens
ttgcactgccccctgcttggcc

SEQ ID NO: 1131373 - DNA, 17 bp, Homo sapiens
ttgcactggagttctat

SEQ ID NO: 1131374 - DNA, 22 bp, Homo sapiens
ttgcacttaatggctgttgagg

SEQ ID NO: 1131375 - DNA, 19 bp, Homo sapiens
ttgcacttgttatattata

SEQ ID NO: 1131376 - DNA, 17 bp, Homo sapiens
ttgcagaaaagcacctg

SEQ ID NO: 1131377 - DNA, 18 bp, Homo sapiens
ttgcagaaaagcacctgc

SEQ ID NO: 1131378 - DNA, 21 bp, Homo sapiens
ttgcagaaaagcacctgccga

SEQ ID NO: 1131379 - DNA, 15 bp, Homo sapiens
ttgcagaaacatttt

SEQ ID NO: 1131380 - DNA, 14 bp, Homo sapiens
ttgcagaactgcca

SEQ ID NO: 1131381 - DNA, 16 bp, Homo sapiens
ttgcagaactgccatt

SEQ ID NO: 1131382 - DNA, 15 bp, Homo sapiens
ttgcagaagagggtg

SEQ ID NO: 1131383 - DNA, 16 bp, Homo sapiens
ttgcagaagagggtgt

SEQ ID NO: 1131384 - DNA, 21 bp, Homo sapiens
ttgcagaagagggtgtgtttg

SEQ ID NO: 1131385 - DNA, 13 bp, Homo sapiens
ttgcagactagaa

SEQ ID NO: 1131386 - DNA, 19 bp, Homo sapiens
ttgcagactcagtttgtca

SEQ ID NO: 1131387 - DNA, 14 bp, Homo sapiens
ttgcagagacagga

SEQ ID NO: 1131388 - DNA, 19 bp, Homo sapiens
ttgcagagatttcctccat

SEQ ID NO: 1131389 - DNA, 12 bp, Homo sapiens
ttgcagaggagc

SEQ ID NO: 1131390 - DNA, 17 bp, Homo sapiens
ttgcagaggagcccagt

SEQ ID NO: 1131391 - DNA, 19 bp, Homo sapiens
ttgcagaggagcccagtgg

SEQ ID NO: 1131392 - DNA, 19 bp, Homo sapiens
ttgcagaggtccaaatgat

SEQ ID NO: 1131393 - DNA, 17 bp, Homo sapiens
ttgcagataattctgga

SEQ ID NO: 1131394 - DNA, 20 bp, Homo sapiens
ttgcagatgtattgactgta

SEQ ID NO: 1131395 - DNA, 18 bp, Homo sapiens
ttgcagcactcacacagg

SEQ ID NO: 1131396 - DNA, 21 bp, Homo sapiens
ttgcagcactgcccatcagtg

SEQ ID NO: 1131397 - DNA, 12 bp, Homo sapiens
ttgcagcagagg

SEQ ID NO: 1131398 - DNA, 13 bp, Homo sapiens
ttgcagccaggag

SEQ ID NO: 1131399 - DNA, 23 bp, Homo sapiens
ttgcagcctgctctagtgggaca

SEQ ID NO: 1131400 - DNA, 15 bp, Homo sapiens
ttgcagcctggtcac

SEQ ID NO: 1131401 - DNA, 21 bp, Homo sapiens
ttgcagccttgcgctgtccca

SEQ ID NO: 1131402 - DNA, 17 bp, Homo sapiens
ttgcagctgttttgttg

SEQ ID NO: 1131403 - DNA, 20 bp, Homo sapiens
ttgcagctgttttgttgaca

SEQ ID NO: 1131404 - DNA, 18 bp, Homo sapiens
ttgcagctttatgttcat

SEQ ID NO: 1131405 - DNA, 23 bp, Homo sapiens
ttgcaggaccttgggcacatctg

SEQ ID NO: 1131406 - DNA, 23 bp, Homo sapiens
ttgcaggagcagtatcatgaagc

SEQ ID NO: 1131407 - DNA, 16 bp, Homo sapiens
ttgcaggattcccttc

SEQ ID NO: 1131408 - DNA, 17 bp, Homo sapiens
ttgcaggctgagtccct

SEQ ID NO: 1131409 - DNA, 19 bp, Homo sapiens
ttgcaggctgtaaggcatg

SEQ ID NO: 1131410 - DNA, 17 bp, Homo sapiens
ttgcaggggtccctgct

SEQ ID NO: 1131411 - DNA, 12 bp, Homo sapiens
ttgcaggtcagc

SEQ ID NO: 1131412 - DNA, 13 bp, Homo sapiens
ttgcaggtcagcc

SEQ ID NO: 1131413 - DNA, 20 bp, Homo sapiens
ttgcagtatttttaaatatg

SEQ ID NO: 1131414 - DNA, 16 bp, Homo sapiens
ttgcagttcaaatcct

SEQ ID NO: 1131415 - DNA, 21 bp, Homo sapiens
ttgcagttcccacattaaaga

SEQ ID NO: 1131416 - DNA, 19 bp, Homo sapiens
ttgcagttggactctcagg

SEQ ID NO: 1131417 - DNA, 21 bp, Homo sapiens
ttgcagttggactctcaggga

SEQ ID NO: 1131418 - DNA, 18 bp, Homo sapiens
ttgcagtttatcattcaa

SEQ ID NO: 1131419 - DNA, 20 bp, Homo sapiens
ttgcagtttatcattcaagt

SEQ ID NO: 1131420 - DNA, 22 bp, Homo sapiens
ttgcagttttgtaagccctctt

SEQ ID NO: 1131421 - DNA, 15 bp, Homo sapiens
ttgcagtttttcatt

SEQ ID NO: 1131422 - DNA, 12 bp, Homo sapiens
ttgcataaatta

SEQ ID NO: 1131423 - DNA, 19 bp, Homo sapiens
ttgcataacaattcctcta

SEQ ID NO: 1131424 - DNA, 23 bp, Homo sapiens
ttgcataagattaaaggaaggaa

SEQ ID NO: 1131425 - DNA, 16 bp, Homo sapiens
ttgcatacaccactgc

SEQ ID NO: 1131426 - DNA, 22 bp, Homo sapiens
ttgcatagtaccaatcatttta

SEQ ID NO: 1131427 - DNA, 17 bp, Homo sapiens
ttgcatataacttatat

SEQ ID NO: 1131428 - DNA, 22 bp, Homo sapiens
ttgcatataacttatattgtaa

SEQ ID NO: 1131429 - DNA, 16 bp, Homo sapiens
ttgcatatgagccgtg

SEQ ID NO: 1131430 - DNA, 22 bp, Homo sapiens
ttgcatcacttaacggaccaaa

SEQ ID NO: 1131431 - DNA, 14 bp, Homo sapiens
ttgcatccattgtt

SEQ ID NO: 1131432 - DNA, 20 bp, Homo sapiens
ttgcatccattgttgtgtct

SEQ ID NO: 1131433 - DNA, 15 bp, Homo sapiens
ttgcatcctatttgg

SEQ ID NO: 1131434 - DNA, 14 bp, Homo sapiens
ttgcatcctgctgg

SEQ ID NO: 1131435 - DNA, 18 bp, Homo sapiens
ttgcatctcaaaattatt

SEQ ID NO: 1131436 - DNA, 21 bp, Homo sapiens
ttgcatctgggtagctgtaag

SEQ ID NO: 1131437 - DNA, 13 bp, Homo sapiens
ttgcatgaaacta

SEQ ID NO: 1131438 - DNA, 23 bp, Homo sapiens
ttgcatgaaattgtatctcagtc

SEQ ID NO: 1131439 - DNA, 18 bp, Homo sapiens
ttgcatgaagagaagcaa

SEQ ID NO: 1131440 - DNA, 17 bp, Homo sapiens
ttgcatgatatcttcaa

SEQ ID NO: 1131441 - DNA, 15 bp, Homo sapiens
ttgcatgattcttct

SEQ ID NO: 1131442 - DNA, 17 bp, Homo sapiens
ttgcatgattcttctct

SEQ ID NO: 1131443 - DNA, 19 bp, Homo sapiens
ttgcatgctgataatcatt

SEQ ID NO: 1131444 - DNA, 21 bp, Homo sapiens
ttgcatggaaatcagccaagt

SEQ ID NO: 1131445 - DNA, 19 bp, Homo sapiens
ttgcatggctccagaaatg

SEQ ID NO: 1131446 - DNA, 22 bp, Homo sapiens
ttgcatgggctaatgaagatca

SEQ ID NO: 1131447 - DNA, 21 bp, Homo sapiens
ttgcatgtagtaacactaata

SEQ ID NO: 1131448 - DNA, 22 bp, Homo sapiens
ttgcatgtattagctcactgaa

SEQ ID NO: 1131449 - DNA, 17 bp, Homo sapiens
ttgcatgtcgcacaatg

SEQ ID NO: 1131450 - DNA, 13 bp, Homo sapiens
ttgcatgtttgaa

SEQ ID NO: 1131451 - DNA, 16 bp, Homo sapiens
ttgcatttacttttaa

SEQ ID NO: 1131452 - DNA, 15 bp, Homo sapiens
ttgcatttatatgta

SEQ ID NO: 1131453 - DNA, 15 bp, Homo sapiens
ttgcatttatggtca

SEQ ID NO: 1131454 - DNA, 22 bp, Homo sapiens
ttgcatttcctgtgtttgtcct

SEQ ID NO: 1131455 - DNA, 14 bp, Homo sapiens
ttgcatttctgctc

SEQ ID NO: 1131456 - DNA, 21 bp, Homo sapiens
ttgcatttggattggggtccc

SEQ ID NO: 1131457 - DNA, 23 bp, Homo sapiens
ttgcatttgtaaaaatgagactt

SEQ ID NO: 1131458 - DNA, 14 bp, Homo sapiens
ttgcatttgtttat

SEQ ID NO: 1131459 - DNA, 20 bp, Homo sapiens
ttgcatttgtttatgtaatt

SEQ ID NO: 1131460 - DNA, 12 bp, Homo sapiens
ttgcatttttgc

SEQ ID NO: 1131461 - DNA, 17 bp, Homo sapiens
ttgcatttttgttttga

SEQ ID NO: 1131462 - DNA, 20 bp, Homo sapiens
ttgcatttttgttttgaaag

SEQ ID NO: 1131463 - DNA, 19 bp, Homo sapiens
ttgccaaaatcctgaactt

SEQ ID NO: 1131464 - DNA, 11 bp, Homo sapiens
ttgccaaagct

SEQ ID NO: 1131465 - DNA, 21 bp, Homo sapiens
ttgccaaagtacagaatttga

SEQ ID NO: 1131466 - DNA, 15 bp, Homo sapiens
ttgccaacagttgta

SEQ ID NO: 1131467 - DNA, 16 bp, Homo sapiens
ttgccaactaagccct

SEQ ID NO: 1131468 - DNA, 12 bp, Homo sapiens
ttgccaagacaa

SEQ ID NO: 1131469 - DNA, 13 bp, Homo sapiens
ttgccaagacaaa

SEQ ID NO: 1131470 - DNA, 16 bp, Homo sapiens
ttgccaagacaaatca

SEQ ID NO: 1131471 - DNA, 17 bp, Homo sapiens
ttgctggtttgaaagat

SEQ ID NO: 1131472 - DNA, 17 bp, Homo sapiens
ttgctgtacaaaagcaa

SEQ ID NO: 1131473 - DNA, 21 bp, Homo sapiens
ttgctgtaccagcccagatgt

SEQ ID NO: 1131474 - DNA, 23 bp, Homo sapiens
ttgctgtaccagcccagatgttt

SEQ ID NO: 1131475 - DNA, 11 bp, Homo sapiens
ttgctgtatat

SEQ ID NO: 1131476 - DNA, 18 bp, Homo sapiens
ttgctgtatgctgatcat

SEQ ID NO: 1131477 - DNA, 17 bp, Homo sapiens
ttgctgtattgccccca

SEQ ID NO: 1131478 - DNA, 18 bp, Homo sapiens
ttgctgtattgcccccat

SEQ ID NO: 1131479 - DNA, 13 bp, Homo sapiens
ttgctgtcactgt

SEQ ID NO: 1131480 - DNA, 20 bp, Homo sapiens
ttgctgtcacttcttcacct

SEQ ID NO: 1131481 - DNA, 15 bp, Homo sapiens
ttgctgtccaggcag

SEQ ID NO: 1131482 - DNA, 16 bp, Homo sapiens
ttgctgtccaggcagc

SEQ ID NO: 1131483 - DNA, 15 bp, Homo sapiens
ttgctgtctctgctc

SEQ ID NO: 1131484 - DNA, 15 bp, Homo sapiens
ttgctgtctttctct

SEQ ID NO: 1131485 - DNA, 20 bp, Homo sapiens
ttgctgtgagcaagaagtca

SEQ ID NO: 1131486 - DNA, 14 bp, Homo sapiens
ttgctgtgaggctg

SEQ ID NO: 1131487 - DNA, 23 bp, Homo sapiens
ttgctgtgtctcctctcagagtg

SEQ ID NO: 1131488 - DNA, 18 bp, Homo sapiens
ttgctgtgtgaccctggg

SEQ ID NO: 1131489 - DNA, 20 bp, Homo sapiens
ttgctgtgtgaccctgggca

SEQ ID NO: 1131490 - DNA, 14 bp, Homo sapiens
ttgctgttactgct

SEQ ID NO: 1131491 - DNA, 20 bp, Homo sapiens
ttgctgttgacatatttaat

SEQ ID NO: 1131492 - DNA, 21 bp, Homo sapiens
ttgctgttgatgaggcctctt

SEQ ID NO: 1131493 - DNA, 19 bp, Homo sapiens
ttgctgttgtccctctgct

SEQ ID NO: 1131494 - DNA, 14 bp, Homo sapiens
ttgctgtttactcc

SEQ ID NO: 1131495 - DNA, 18 bp, Homo sapiens
ttgctgtttagcttcctc

SEQ ID NO: 1131496 - DNA, 15 bp, Homo sapiens
ttgctgtttatactt

SEQ ID NO: 1131497 - DNA, 14 bp, Homo sapiens
ttgctgttttcctc

SEQ ID NO: 1131498 - DNA, 18 bp, Homo sapiens
ttgctgttttcctccctt

SEQ ID NO: 1131499 - DNA, 20 bp, Homo sapiens
ttgctgttttcctcccttct

SEQ ID NO: 1131500 - DNA, 16 bp, Homo sapiens
ttgctgttttgttctg

SEQ ID NO: 1131501 - DNA, 17 bp, Homo sapiens
ttgcttaaaatatgtga

SEQ ID NO: 1131502 - DNA, 14 bp, Homo sapiens
ttgcttaaatttct

SEQ ID NO: 1131503 - DNA, 17 bp, Homo sapiens
ttgcttaccttttccta

SEQ ID NO: 1131504 - DNA, 23 bp, Homo sapiens
ttgcttaccttttcctattctgt

SEQ ID NO: 1131505 - DNA, 19 bp, Homo sapiens
ttgcttagagtgcccagca

SEQ ID NO: 1131506 - DNA, 22 bp, Homo sapiens
ttgcttagatgagggtgactgt

SEQ ID NO: 1131507 - DNA, 20 bp, Homo sapiens
ttgcttaggatgtgtgcatg

SEQ ID NO: 1131508 - DNA, 19 bp, Homo sapiens
ttgcttagtatggttctca

SEQ ID NO: 1131509 - DNA, 13 bp, Homo sapiens
ttgcttatgacat

SEQ ID NO: 1131510 - DNA, 16 bp, Homo sapiens
ttgcttattgttccaa

SEQ ID NO: 1131511 - DNA, 13 bp, Homo sapiens
ttgcttatttaat

SEQ ID NO: 1131512 - DNA, 16 bp, Homo sapiens
ttgcttatttaataaa

SEQ ID NO: 1131513 - DNA, 13 bp, Homo sapiens
ttgcttattttat

SEQ ID NO: 1131514 - DNA, 19 bp, Homo sapiens
ttgcttatttttataatta

SEQ ID NO: 1131515 - DNA, 23 bp, Homo sapiens
ttgcttatttttataattaaaga

SEQ ID NO: 1131516 - DNA, 18 bp, Homo sapiens
ttgcttcaaattggtctg

SEQ ID NO: 1131517 - DNA, 14 bp, Homo sapiens
ttgcttcaattaaa

SEQ ID NO: 1131518 - DNA, 15 bp, Homo sapiens
ttgcttcataaatga

SEQ ID NO: 1131519 - DNA, 20 bp, Homo sapiens
ttgcttccccttttgccaat

SEQ ID NO: 1131520 - DNA, 12 bp, Homo sapiens
ttgcttccgcca

SEQ ID NO: 1131521 - DNA, 15 bp, Homo sapiens
ttgcttccgccactc

SEQ ID NO: 1131522 - DNA, 16 bp, Homo sapiens
ttgcttctactttcat

SEQ ID NO: 1131523 - DNA, 23 bp, Homo sapiens
ttgcttctaggagtcaactggct

SEQ ID NO: 1131524 - DNA, 21 bp, Homo sapiens
ttgcttctcccatttcctgat

SEQ ID NO: 1131525 - DNA, 14 bp, Homo sapiens
ttgcttctcttctt

SEQ ID NO: 1131526 - DNA, 13 bp, Homo sapiens
ttgcttctgaatc

SEQ ID NO: 1131527 - DNA, 21 bp, Homo sapiens
ttgcttctgtagtactcctta

SEQ ID NO: 1131528 - DNA, 12 bp, Homo sapiens
ttgcttctgtgt

SEQ ID NO: 1131529 - DNA, 17 bp, Homo sapiens
ttgcttctttctagaaa

SEQ ID NO: 1131530 - DNA, 17 bp, Homo sapiens
ttgcttgagcccaggag

SEQ ID NO: 1131531 - DNA, 22 bp, Homo sapiens
ttgcttgagcctggctgtccaa

SEQ ID NO: 1131532 - DNA, 17 bp, Homo sapiens
ttgcttgatccagaaga

SEQ ID NO: 1131533 - DNA, 18 bp, Homo sapiens
ttgcttgcctgatataaa

SEQ ID NO: 1131534 - DNA, 21 bp, Homo sapiens
ttgcttgtattgtaaatgtgg

SEQ ID NO: 1131535 - DNA, 19 bp, Homo sapiens
ttgcttgttatattaagca

SEQ ID NO: 1131536 - DNA, 21 bp, Homo sapiens
ttgcttgttatattaagcaga

SEQ ID NO: 1131537 - DNA, 24 bp, Homo sapiens
ttgcttgttgggattcctgaccca

SEQ ID NO: 1131538 - DNA, 15 bp, Homo sapiens
ttgctttaaaacaag

SEQ ID NO: 1131539 - DNA, 16 bp, Homo sapiens
ttgctttagaaaacat

SEQ ID NO: 1131540 - DNA, 10 bp, Homo sapiens
ttgctttcct

SEQ ID NO: 1131541 - DNA, 14 bp, Homo sapiens
ttgctttgaagcag

SEQ ID NO: 1131542 - DNA, 19 bp, Homo sapiens
ttgctttgatttacagcaa

SEQ ID NO: 1131543 - DNA, 15 bp, Homo sapiens
ttgctttgccagagc

SEQ ID NO: 1131544 - DNA, 14 bp, Homo sapiens
ttgctttgcccaag

SEQ ID NO: 1131545 - DNA, 23 bp, Homo sapiens
ttgctttgctgcacagcaggacc

SEQ ID NO: 1131546 - DNA, 21 bp, Homo sapiens
ttgctttggggggtgtgctga

SEQ ID NO: 1131547 - DNA, 19 bp, Homo sapiens
ttgctttggttaaaaatgg

SEQ ID NO: 1131548 - DNA, 13 bp, Homo sapiens
ttgctttgtctgg

SEQ ID NO: 1131549 - DNA, 15 bp, Homo sapiens
ttgctttgtgatttt

SEQ ID NO: 1131550 - DNA, 16 bp, Homo sapiens
ttgcttttgcctctgc

SEQ ID NO: 1131551 - DNA, 13 bp, Homo sapiens
ttgcttttgtgaa

SEQ ID NO: 1131552 - DNA, 15 bp, Homo sapiens
ttgcttttgtttttt

SEQ ID NO: 1131553 - DNA, 19 bp, Homo sapiens
ttgcttttgtttttttcct

SEQ ID NO: 1131554 - DNA, 13 bp, Homo sapiens
ttgctttttgccc

SEQ ID NO: 1131555 - DNA, 18 bp, Homo sapiens
ttggaaaacaaaagtttt

SEQ ID NO: 1131556 - DNA, 15 bp, Homo sapiens
ttggaaaactacttt

SEQ ID NO: 1131557 - DNA, 16 bp, Homo sapiens
ttggaaacattttctt

SEQ ID NO: 1131558 - DNA, 22 bp, Homo sapiens
ttggaaacattttttaaaacaa

SEQ ID NO: 1131559 - DNA, 18 bp, Homo sapiens
ttggaaacctgccctgcc

SEQ ID NO: 1131560 - DNA, 14 bp, Homo sapiens
ttggaaagagacca

SEQ ID NO: 1131561 - DNA, 18 bp, Homo sapiens
ttggaaagagaccagcac

SEQ ID NO: 1131562 - DNA, 21 bp, Homo sapiens
ttggaaagatgttaagcattt

SEQ ID NO: 1131563 - DNA, 17 bp, Homo sapiens
ttggaaagtacactctg

SEQ ID NO: 1131564 - DNA, 14 bp, Homo sapiens
ttggaaagtcagaa

SEQ ID NO: 1131565 - DNA, 17 bp, Homo sapiens
ttggaaataaaccattg

SEQ ID NO: 1131566 - DNA, 20 bp, Homo sapiens
ttggaaatagaaagaagcca

SEQ ID NO: 1131567 - DNA, 22 bp, Homo sapiens
ttggaaatcctagtttcctctc

SEQ ID NO: 1131568 - DNA, 17 bp, Homo sapiens
ttggaaatgtctgctgg

SEQ ID NO: 1131569 - DNA, 23 bp, Homo sapiens
ttggaaattaggttgaaacatat

SEQ ID NO: 1131570 - DNA, 12 bp, Homo sapiens
ttggaaccaaag

SEQ ID NO: 1131571 - DNA, 20 bp, Homo sapiens
ttggaaccaaagtctaaact

SEQ ID NO: 1131572 - DNA, 15 bp, Homo sapiens
ttggaaccagactct

SEQ ID NO: 1131573 - DNA, 14 bp, Homo sapiens
ttggaaccagcccc

SEQ ID NO: 1131574 - DNA, 16 bp, Homo sapiens
ttggaaccagccccat

SEQ ID NO: 1131575 - DNA, 17 bp, Homo sapiens
ttggaaccatgccttcc

SEQ ID NO: 1131576 - DNA, 14 bp, Homo sapiens
ttggaaccttgttt

SEQ ID NO: 1131577 - DNA, 19 bp, Homo sapiens
ttggaaccttgttttggac

SEQ ID NO: 1131578 - DNA, 22 bp, Homo sapiens
ttggaactctactcaacccatt

SEQ ID NO: 1131579 - DNA, 19 bp, Homo sapiens
ttggaagagaggcacctgc

SEQ ID NO: 1131580 - DNA, 22 bp, Homo sapiens
ttggaagagaggcacctgctgg

SEQ ID NO: 1131581 - DNA, 23 bp, Homo sapiens
ttggaagagcccgccgtctgcag

SEQ ID NO: 1131582 - DNA, 15 bp, Homo sapiens
ttggaagcctgagca

SEQ ID NO: 1131583 - DNA, 21 bp, Homo sapiens
ttggaagctgtttggaaaaga

SEQ ID NO: 1131584 - DNA, 15 bp, Homo sapiens
ttggaaggagcagaa

SEQ ID NO: 1131585 - DNA, 13 bp, Homo sapiens
ttggaaggatctg

SEQ ID NO: 1131586 - DNA, 17 bp, Homo sapiens
ttggaaggatctgctga

SEQ ID NO: 1131587 - DNA, 21 bp, Homo sapiens
ttggaagtgttcaagaaataa

SEQ ID NO: 1131588 - DNA, 15 bp, Homo sapiens
ttggaataatttcta

SEQ ID NO: 1131589 - DNA, 14 bp, Homo sapiens
ttggaatatttgaa

SEQ ID NO: 1131590 - DNA, 19 bp, Homo sapiens
ttggaatattttatcctgt

SEQ ID NO: 1131591 - DNA, 20 bp, Homo sapiens
ttggaatcctccttaattta

SEQ ID NO: 1131592 - DNA, 19 bp, Homo sapiens
ttggaatcttcacctcaga

SEQ ID NO: 1131593 - DNA, 13 bp, Homo sapiens
ttggccagtgaga

SEQ ID NO: 1131594 - DNA, 17 bp, Homo sapiens
ttggccagtgagaagct

SEQ ID NO: 1131595 - DNA, 21 bp, Homo sapiens
ttggccatgatgtccttggac

SEQ ID NO: 1131596 - DNA, 23 bp, Homo sapiens
ttggccatgtattatgaaaaaga

SEQ ID NO: 1131597 - DNA, 19 bp, Homo sapiens
ttggcccaagactgggctg

SEQ ID NO: 1131598 - DNA, 12 bp, Homo sapiens
ttggcccaggag

SEQ ID NO: 1131599 - DNA, 14 bp, Homo sapiens
ttggcccaggagct

SEQ ID NO: 1131600 - DNA, 23 bp, Homo sapiens
ttggcccaggagctctgcgccag

SEQ ID NO: 1131601 - DNA, 20 bp, Homo sapiens
ttggccccactttgaagggc

SEQ ID NO: 1131602 - DNA, 11 bp, Homo sapiens
ttggcccctca

SEQ ID NO: 1131603 - DNA, 22 bp, Homo sapiens
ttggcccctcacatcctctcca

SEQ ID NO: 1131604 - DNA, 13 bp, Homo sapiens
ttggccctattta

SEQ ID NO: 1131605 - DNA, 19 bp, Homo sapiens
ttggccctcttgcgggcct

SEQ ID NO: 1131606 - DNA, 16 bp, Homo sapiens
ttggcccttgtctttt

SEQ ID NO: 1131607 - DNA, 19 bp, Homo sapiens
ttggccggctgtgctcaga

SEQ ID NO: 1131608 - DNA, 21 bp, Homo sapiens
ttggccggctgtgctcagaga

SEQ ID NO: 1131609 - DNA, 22 bp, Homo sapiens
ttggccgtggccatcagggtgg

SEQ ID NO: 1131610 - DNA, 20 bp, Homo sapiens
ttggcctccagctgttctta

SEQ ID NO: 1131611 - DNA, 22 bp, Homo sapiens
ttggcctctgcaaaggaaatac

SEQ ID NO: 1131612 - DNA, 17 bp, Homo sapiens
ttggcctgatcagacca

SEQ ID NO: 1131613 - DNA, 13 bp, Homo sapiens
ttggcctggagag

SEQ ID NO: 1131614 - DNA, 16 bp, Homo sapiens
ttggcctgtctcatcc

SEQ ID NO: 1131615 - DNA, 22 bp, Homo sapiens
ttggcctgtctcatccccaggg

SEQ ID NO: 1131616 - DNA, 23 bp, Homo sapiens
ttggcctgtctcatccccagggg

SEQ ID NO: 1131617 - DNA, 14 bp, Homo sapiens
ttggcctgtgggcc

SEQ ID NO: 1131618 - DNA, 15 bp, Homo sapiens
ttggccttgggccgg

SEQ ID NO: 1131619 - DNA, 14 bp, Homo sapiens
ttggcctttccttg

SEQ ID NO: 1131620 - DNA, 21 bp, Homo sapiens
ttggcgggggcacgtgtgggc

SEQ ID NO: 1131621 - DNA, 20 bp, Homo sapiens
ttggctaactatatttgctt

SEQ ID NO: 1131622 - DNA, 22 bp, Homo sapiens
ttggctagtactttgatgctcc

SEQ ID NO: 1131623 - DNA, 19 bp, Homo sapiens
ttggctatgaaaatgagcc

SEQ ID NO: 1131624 - DNA, 20 bp, Homo sapiens
ttggctatgatggtgacatg

SEQ ID NO: 1131625 - DNA, 13 bp, Homo sapiens
ttggctcagacat

SEQ ID NO: 1131626 - DNA, 17 bp, Homo sapiens
ttggctcagcccgctga

SEQ ID NO: 1131627 - DNA, 13 bp, Homo sapiens
ttggctcaggcag

SEQ ID NO: 1131628 - DNA, 17 bp, Homo sapiens
ttggctcgaatctctgt

SEQ ID NO: 1131629 - DNA, 13 bp, Homo sapiens
ttggctctcccac

SEQ ID NO: 1131630 - DNA, 19 bp, Homo sapiens
ttggctcttggcttccaga

SEQ ID NO: 1131631 - DNA, 11 bp, Homo sapiens
ttggctctttc

SEQ ID NO: 1131632 - DNA, 21 bp, Homo sapiens
ttggctgaaattctcctggag

SEQ ID NO: 1131633 - DNA, 23 bp, Homo sapiens
ttggctgagatatgaacatattg

SEQ ID NO: 1131634 - DNA, 20 bp, Homo sapiens
ttggctggatgaaattttct

SEQ ID NO: 1131635 - DNA, 23 bp, Homo sapiens
ttggctggatgaaattttctaga

SEQ ID NO: 1131636 - DNA, 11 bp, Homo sapiens
ttggctgggcc

SEQ ID NO: 1131637 - DNA, 17 bp, Homo sapiens
ttggctgggcccagaag

SEQ ID NO: 1131638 - DNA, 23 bp, Homo sapiens
ttggctggtagcagcaggctcag

SEQ ID NO: 1131639 - DNA, 17 bp, Homo sapiens
ttggctgtccttcccct

SEQ ID NO: 1131640 - DNA, 18 bp, Homo sapiens
ttggctgtgtctaaactg

SEQ ID NO: 1131641 - DNA, 21 bp, Homo sapiens
ttggctgtgtctaaactgcat

SEQ ID NO: 1131642 - DNA, 23 bp, Homo sapiens
ttggctgtgtctaaactgcatta

SEQ ID NO: 1131643 - DNA, 16 bp, Homo sapiens
ttggctgttccagact

SEQ ID NO: 1131644 - DNA, 14 bp, Homo sapiens
ttggcttataaaca

SEQ ID NO: 1131645 - DNA, 15 bp, Homo sapiens
ttggcttataaacac

SEQ ID NO: 1131646 - DNA, 20 bp, Homo sapiens
ttggcttataaacacattga

SEQ ID NO: 1131647 - DNA, 13 bp, Homo sapiens
ttggcttcatttc

SEQ ID NO: 1131648 - DNA, 21 bp, Homo sapiens
ttggcttcatttcaatcattg

SEQ ID NO: 1131649 - DNA, 18 bp, Homo sapiens
ttggcttccagaaggcag

SEQ ID NO: 1131650 - DNA, 16 bp, Homo sapiens
ttggcttcctccgtcc

SEQ ID NO: 1131651 - DNA, 19 bp, Homo sapiens
ttggcttctcaatagagtg

SEQ ID NO: 1131652 - DNA, 15 bp, Homo sapiens
ttggcttctcctgtg

SEQ ID NO: 1131653 - DNA, 16 bp, Homo sapiens
ttggcttctcctgtga

SEQ ID NO: 1131654 - DNA, 22 bp, Homo sapiens
ttggcttctgtgatgagctgat

SEQ ID NO: 1131655 - DNA, 14 bp, Homo sapiens
ttggcttgactcag

SEQ ID NO: 1131656 - DNA, 17 bp, Homo sapiens
ttggcttgttattgcct

SEQ ID NO: 1131657 - DNA, 23 bp, Homo sapiens
ttggctttgcccacccctcactc

SEQ ID NO: 1131658 - DNA, 21 bp, Homo sapiens
ttgggaaaagcccacaggcct

SEQ ID NO: 1131659 - DNA, 14 bp, Homo sapiens
ttgggaaagagaca

SEQ ID NO: 1131660 - DNA, 22 bp, Homo sapiens
ttgggaaagatggataaactga

SEQ ID NO: 1131661 - DNA, 16 bp, Homo sapiens
ttgggaagattctcta

SEQ ID NO: 1131662 - DNA, 17 bp, Homo sapiens
ttgggaaggaaatatat

SEQ ID NO: 1131663 - DNA, 14 bp, Homo sapiens
ttgggaaggacaca

SEQ ID NO: 1131664 - DNA, 22 bp, Homo sapiens
ttgggaaggacacagcagtatt

SEQ ID NO: 1131665 - DNA, 21 bp, Homo sapiens
ttgggaaggggtcctgcaggg

SEQ ID NO: 1131666 - DNA, 14 bp, Homo sapiens
ttgggaattttatt

SEQ ID NO: 1131667 - DNA, 14 bp, Homo sapiens
ttgggacaccaggg

SEQ ID NO: 1131668 - DNA, 16 bp, Homo sapiens
ttgggacagccagagc

SEQ ID NO: 1131669 - DNA, 22 bp, Homo sapiens
ttgggacccaaaacacaggaag

SEQ ID NO: 1131670 - DNA, 20 bp, Homo sapiens
ttgggacgtgtacagcacag

SEQ ID NO: 1131671 - DNA, 23 bp, Homo sapiens
ttgggactgggtttggaccccag

SEQ ID NO: 1131672 - DNA, 22 bp, Homo sapiens
ttgggagacaattagcagaatg

SEQ ID NO: 1131673 - DNA, 18 bp, Homo sapiens
ttgggagacatggaccag

SEQ ID NO: 1131674 - DNA, 14 bp, Homo sapiens
ttgggagacatgtg

SEQ ID NO: 1131675 - DNA, 16 bp, Homo sapiens
ttgggagcactggagt

SEQ ID NO: 1131676 - DNA, 22 bp, Homo sapiens
ttgggagcactggagtgcaggg

SEQ ID NO: 1131677 - DNA, 11 bp, Homo sapiens
ttgggagcctg

SEQ ID NO: 1131678 - DNA, 17 bp, Homo sapiens
ttgggaggccaaggcag

SEQ ID NO: 1131679 - DNA, 16 bp, Homo sapiens
ttgggaggccgaggcg

SEQ ID NO: 1131680 - DNA, 15 bp, Homo sapiens
ttgggaggctgaggc

SEQ ID NO: 1131681 - DNA, 17 bp, Homo sapiens
ttgggaggctgtggaga

SEQ ID NO: 1131682 - DNA, 20 bp, Homo sapiens
ttgggagtatgttgtcataa

SEQ ID NO: 1131683 - DNA, 18 bp, Homo sapiens
ttgggagtccaggcacag

SEQ ID NO: 1131684 - DNA, 15 bp, Homo sapiens
ttgggatcagcctcc

SEQ ID NO: 1131685 - DNA, 21 bp, Homo sapiens
ttgggatccttcagcacagga

SEQ ID NO: 1131686 - DNA, 16 bp, Homo sapiens
ttgggattgggggctg

SEQ ID NO: 1131687 - DNA, 14 bp, Homo sapiens
ttgggattgggggg

SEQ ID NO: 1131688 - DNA, 16 bp, Homo sapiens
ttgggcactatttatt

SEQ ID NO: 1131689 - DNA, 17 bp, Homo sapiens
ttgggcagagctggctc

SEQ ID NO: 1131690 - DNA, 18 bp, Homo sapiens
ttgggcagcaatttaaat

SEQ ID NO: 1131691 - DNA, 20 bp, Homo sapiens
ttgggcagtgccccagggag

SEQ ID NO: 1131692 - DNA, 14 bp, Homo sapiens
ttgggcagttggcc

SEQ ID NO: 1131693 - DNA, 20 bp, Homo sapiens
ttgggcatccacccagtgct

SEQ ID NO: 1131694 - DNA, 21 bp, Homo sapiens
ttgggcatccacccagtgctg

SEQ ID NO: 1131695 - DNA, 14 bp, Homo sapiens
ttgggccagaagta

SEQ ID NO: 1131696 - DNA, 21 bp, Homo sapiens
ttgggccagaagtaccagact

SEQ ID NO: 1131697 - DNA, 18 bp, Homo sapiens
ttgggccagcttttcaaa

SEQ ID NO: 1131698 - DNA, 18 bp, Homo sapiens
ttgggccattaccccata

SEQ ID NO: 1131699 - DNA, 18 bp, Homo sapiens
ttgggcccagctgggctc

SEQ ID NO: 1131700 - DNA, 22 bp, Homo sapiens
ttgggcccagctgggctctgcc

SEQ ID NO: 1131701 - DNA, 18 bp, Homo sapiens
ttgggccccagaccccag

SEQ ID NO: 1131702 - DNA, 22 bp, Homo sapiens
ttgggccccagaccccagggca

SEQ ID NO: 1131703 - DNA, 16 bp, Homo sapiens
ttgggcccctcagagc

SEQ ID NO: 1131704 - DNA, 17 bp, Homo sapiens
ttgggcctccatgcccc

SEQ ID NO: 1131705 - DNA, 22 bp, Homo sapiens
ttgggcctccatgccccagctc

SEQ ID NO: 1131706 - DNA, 18 bp, Homo sapiens
ttgggcctctcctgccct

SEQ ID NO: 1131707 - DNA, 11 bp, Homo sapiens
ttgggcctctt

SEQ ID NO: 1131708 - DNA, 18 bp, Homo sapiens
ttgggcgccgtgctgggc

SEQ ID NO: 1131709 - DNA, 19 bp, Homo sapiens
ttgggcgccgtgctgggca

SEQ ID NO: 1131710 - DNA, 16 bp, Homo sapiens
ttgggcggctgagagc

SEQ ID NO: 1131711 - DNA, 21 bp, Homo sapiens
ttgggcggctgagagccccag

SEQ ID NO: 1131712 - DNA, 14 bp, Homo sapiens
ttgggcgtctcccc

SEQ ID NO: 1131713 - DNA, 15 bp, Homo sapiens
ttgggctactggcag

SEQ ID NO: 1131714 - DNA, 12 bp, Homo sapiens
ttggtggttttt

SEQ ID NO: 1131715 - DNA, 14 bp, Homo sapiens
ttggtgtacagact

SEQ ID NO: 1131716 - DNA, 18 bp, Homo sapiens
ttggtgtattatcatttt

SEQ ID NO: 1131717 - DNA, 14 bp, Homo sapiens
ttggtgttcctgga

SEQ ID NO: 1131718 - DNA, 16 bp, Homo sapiens
ttggtgttcctggaag

SEQ ID NO: 1131719 - DNA, 19 bp, Homo sapiens
ttggtgttcctggaagcag

SEQ ID NO: 1131720 - DNA, 17 bp, Homo sapiens
ttggttaaaaaaaagaa

SEQ ID NO: 1131721 - DNA, 14 bp, Homo sapiens
ttggttcagttttt

SEQ ID NO: 1131722 - DNA, 14 bp, Homo sapiens
ttggttcataaatg

SEQ ID NO: 1131723 - DNA, 18 bp, Homo sapiens
ttggttcatcagtgttaa

SEQ ID NO: 1131724 - DNA, 20 bp, Homo sapiens
ttggttcattaattctataa

SEQ ID NO: 1131725 - DNA, 18 bp, Homo sapiens
ttggttcccccactgatc

SEQ ID NO: 1131726 - DNA, 12 bp, Homo sapiens
ttggttcctggg

SEQ ID NO: 1131727 - DNA, 16 bp, Homo sapiens
ttggttcctgggatgg

SEQ ID NO: 1131728 - DNA, 19 bp, Homo sapiens
ttggttctaatagaactca

SEQ ID NO: 1131729 - DNA, 23 bp, Homo sapiens
ttggttctgaagccatgtagcca

SEQ ID NO: 1131730 - DNA, 13 bp, Homo sapiens
ttggttctggcca

SEQ ID NO: 1131731 - DNA, 14 bp, Homo sapiens
ttggttctgtgaac

SEQ ID NO: 1131732 - DNA, 16 bp, Homo sapiens
ttggttgaataaacta

SEQ ID NO: 1131733 - DNA, 16 bp, Homo sapiens
ttggttgattgtttaa

SEQ ID NO: 1131734 - DNA, 20 bp, Homo sapiens
ttggttgctaagaagcctat

SEQ ID NO: 1131735 - DNA, 14 bp, Homo sapiens
ttggttggaagcta

SEQ ID NO: 1131736 - DNA, 15 bp, Homo sapiens
ttggttggtgtgaag

SEQ ID NO: 1131737 - DNA, 18 bp, Homo sapiens
ttggttgttttttccttt

SEQ ID NO: 1131738 - DNA, 17 bp, Homo sapiens
ttggtttcaccttccct

SEQ ID NO: 1131739 - DNA, 15 bp, Homo sapiens
ttggtttcccctgca

SEQ ID NO: 1131740 - DNA, 23 bp, Homo sapiens
ttggtttcccctgcactcccgac

SEQ ID NO: 1131741 - DNA, 16 bp, Homo sapiens
ttggtttctgcttctc

SEQ ID NO: 1131742 - DNA, 19 bp, Homo sapiens
ttggtttgggggcgccctc

SEQ ID NO: 1131743 - DNA, 14 bp, Homo sapiens
ttggtttgtaaatt

SEQ ID NO: 1131744 - DNA, 22 bp, Homo sapiens
ttggtttgtggcgtctccctcg

SEQ ID NO: 1131745 - DNA, 16 bp, Homo sapiens
ttggttttctctctgg

SEQ ID NO: 1131746 - DNA, 14 bp, Homo sapiens
ttgtaaaaaaagca

SEQ ID NO: 1131747 - DNA, 16 bp, Homo sapiens
ttgtaaaaaaagcaaa

SEQ ID NO: 1131748 - DNA, 21 bp, Homo sapiens
ttgtaaaaaaagcaaaaatga

SEQ ID NO: 1131749 - DNA, 21 bp, Homo sapiens
ttgtaaaaacagcattgcttt

SEQ ID NO: 1131750 - DNA, 18 bp, Homo sapiens
ttgtaaaacattcacacc

SEQ ID NO: 1131751 - DNA, 21 bp, Homo sapiens
ttgtaaaacctgtcaatgata

SEQ ID NO: 1131752 - DNA, 18 bp, Homo sapiens
ttgtaaaagaaatcatgt

SEQ ID NO: 1131753 - DNA, 20 bp, Homo sapiens
ttgtaaaagaacagtaaaca

SEQ ID NO: 1131754 - DNA, 17 bp, Homo sapiens
ttgtaaaagcattttgt

SEQ ID NO: 1131755 - DNA, 18 bp, Homo sapiens
ttgtaaaatagaaaaagt

SEQ ID NO: 1131756 - DNA, 15 bp, Homo sapiens
ttgtaaaatagcttg

SEQ ID NO: 1131757 - DNA, 21 bp, Homo sapiens
ttgtaaaatagcttgtatagt

SEQ ID NO: 1131758 - DNA, 18 bp, Homo sapiens
ttgtaaaatattatgttt

SEQ ID NO: 1131759 - DNA, 15 bp, Homo sapiens
ttgtaaacatgtgtt

SEQ ID NO: 1131760 - DNA, 18 bp, Homo sapiens
ttgtaaaccattgtaact

SEQ ID NO: 1131761 - DNA, 22 bp, Homo sapiens
ttgtaaactgtatcaaatctgt

SEQ ID NO: 1131762 - DNA, 14 bp, Homo sapiens
ttgtaaactgttgt

SEQ ID NO: 1131763 - DNA, 14 bp, Homo sapiens
ttgtaaactttttc

SEQ ID NO: 1131764 - DNA, 21 bp, Homo sapiens
ttgtaaactttttcaatggtt

SEQ ID NO: 1131765 - DNA, 12 bp, Homo sapiens
ttgtaaagaagg

SEQ ID NO: 1131766 - DNA, 13 bp, Homo sapiens
ttgtaaagactgg

SEQ ID NO: 1131767 - DNA, 21 bp, Homo sapiens
ttgtaaagactggttttctgc

SEQ ID NO: 1131768 - DNA, 17 bp, Homo sapiens
ttgtaaagtatgtgagt

SEQ ID NO: 1131769 - DNA, 14 bp, Homo sapiens
ttgtaaataagaga

SEQ ID NO: 1131770 - DNA, 15 bp, Homo sapiens
ttgtaaataagagat

SEQ ID NO: 1131771 - DNA, 17 bp, Homo sapiens
ttgtaaataattttcta

SEQ ID NO: 1131772 - DNA, 19 bp, Homo sapiens
ttgtaaataattttctaag

SEQ ID NO: 1131773 - DNA, 13 bp, Homo sapiens
ttgtaaatatata

SEQ ID NO: 1131774 - DNA, 14 bp, Homo sapiens
ttgtaaatattctt

SEQ ID NO: 1131775 - DNA, 13 bp, Homo sapiens
ttgtaaatattgt

SEQ ID NO: 1131776 - DNA, 12 bp, Homo sapiens
ttgtaaatattt

SEQ ID NO: 1131777 - DNA, 19 bp, Homo sapiens
ttgtaaatatttatgtaaa

SEQ ID NO: 1131778 - DNA, 17 bp, Homo sapiens
ttgtaaatctgaagaaa

SEQ ID NO: 1131779 - DNA, 11 bp, Homo sapiens
ttgtaaatgat

SEQ ID NO: 1131780 - DNA, 22 bp, Homo sapiens
ttgtaaatgtttcttttccctt

SEQ ID NO: 1131781 - DNA, 17 bp, Homo sapiens
ttgtaaattatatttgt

SEQ ID NO: 1131782 - DNA, 13 bp, Homo sapiens
ttgtaaattggca

SEQ ID NO: 1131783 - DNA, 15 bp, Homo sapiens
ttgtaaatttagtgt

SEQ ID NO: 1131784 - DNA, 16 bp, Homo sapiens
ttgtaaatttagtgtt

SEQ ID NO: 1131785 - DNA, 16 bp, Homo sapiens
ttgtaacccagatttt

SEQ ID NO: 1131786 - DNA, 18 bp, Homo sapiens
ttgtaacctcagctctgg

SEQ ID NO: 1131787 - DNA, 19 bp, Homo sapiens
ttgtaacctcagctctggg

SEQ ID NO: 1131788 - DNA, 17 bp, Homo sapiens
ttgtaacctgcattttt

SEQ ID NO: 1131789 - DNA, 18 bp, Homo sapiens
ttgtaactaaaataattt

SEQ ID NO: 1131790 - DNA, 22 bp, Homo sapiens
ttgtaactaaaataattttgta

SEQ ID NO: 1131791 - DNA, 21 bp, Homo sapiens
ttgtaactacaaagctttgct

SEQ ID NO: 1131792 - DNA, 20 bp, Homo sapiens
ttgtaactattaaccttttt

SEQ ID NO: 1131793 - DNA, 13 bp, Homo sapiens
ttgtaagaaatac

SEQ ID NO: 1131794 - DNA, 18 bp, Homo sapiens
ttgtaagacaaaggtttt

SEQ ID NO: 1131795 - DNA, 17 bp, Homo sapiens
ttgtaagatgctgggtt

SEQ ID NO: 1131796 - DNA, 13 bp, Homo sapiens
ttgtaagccctct

SEQ ID NO: 1131797 - DNA, 17 bp, Homo sapiens
ttgtaaggtctttgtaa

SEQ ID NO: 1131798 - DNA, 14 bp, Homo sapiens
ttgtaagtttgaat

SEQ ID NO: 1131799 - DNA, 14 bp, Homo sapiens
ttgtaataaaatgt

SEQ ID NO: 1131800 - DNA, 18 bp, Homo sapiens
ttgtaataaagtatataa

SEQ ID NO: 1131801 - DNA, 13 bp, Homo sapiens
ttgtaatacttta

SEQ ID NO: 1131802 - DNA, 14 bp, Homo sapiens
ttgtaatagtccat

SEQ ID NO: 1131803 - DNA, 21 bp, Homo sapiens
ttgtaatatagaaaaaaacat

SEQ ID NO: 1131804 - DNA, 20 bp, Homo sapiens
ttgtaatatttgaattttta

SEQ ID NO: 1131805 - DNA, 17 bp, Homo sapiens
ttgtaatctgaataaag

SEQ ID NO: 1131806 - DNA, 12 bp, Homo sapiens
ttgtaatgcact

SEQ ID NO: 1131807 - DNA, 22 bp, Homo sapiens
ttgtaatgcactgtttttaatc

SEQ ID NO: 1131808 - DNA, 14 bp, Homo sapiens
ttgtaatgctgcac

SEQ ID NO: 1131809 - DNA, 21 bp, Homo sapiens
ttgtaatgctgcacttcctgt

SEQ ID NO: 1131810 - DNA, 15 bp, Homo sapiens
ttgtaatgttactga

SEQ ID NO: 1131811 - DNA, 17 bp, Homo sapiens
ttgtaattaaaagcaaa

SEQ ID NO: 1131812 - DNA, 17 bp, Homo sapiens
ttgtaattcctgatctt

SEQ ID NO: 1131813 - DNA, 23 bp, Homo sapiens
ttgtaattctaaatgaatgttta

SEQ ID NO: 1131814 - DNA, 22 bp, Homo sapiens
ttgtaatttaaacaggcccagc

SEQ ID NO: 1131815 - DNA, 14 bp, Homo sapiens
ttgtaatttgaatt

SEQ ID NO: 1131816 - DNA, 17 bp, Homo sapiens
ttgtaatttgaattggg

SEQ ID NO: 1131817 - DNA, 13 bp, Homo sapiens
ttgtaattttgaa

SEQ ID NO: 1131818 - DNA, 23 bp, Homo sapiens
ttgtaatttttttaatttacaaa

SEQ ID NO: 1131819 - DNA, 22 bp, Homo sapiens
ttgtacaaaaaaaaagttttat

SEQ ID NO: 1131820 - DNA, 12 bp, Homo sapiens
ttgtacaaaata

SEQ ID NO: 1131821 - DNA, 14 bp, Homo sapiens
ttgtacaaaataaa

SEQ ID NO: 1131822 - DNA, 13 bp, Homo sapiens
ttgtacaaatgta

SEQ ID NO: 1131823 - DNA, 20 bp, Homo sapiens
ttgtacaagagtccctttga

SEQ ID NO: 1131824 - DNA, 15 bp, Homo sapiens
ttgtacacagtctgt

SEQ ID NO: 1131825 - DNA, 18 bp, Homo sapiens
ttgtacacgctgatgaga

SEQ ID NO: 1131826 - DNA, 19 bp, Homo sapiens
ttgtacagaatcattgctt

SEQ ID NO: 1131827 - DNA, 14 bp, Homo sapiens
ttgtacagactgtt

SEQ ID NO: 1131828 - DNA, 12 bp, Homo sapiens
ttgtacagtttt

SEQ ID NO: 1131829 - DNA, 13 bp, Homo sapiens
ttgtacagttttt

SEQ ID NO: 1131830 - DNA, 18 bp, Homo sapiens
ttgtacatatgtaaaata

SEQ ID NO: 1131831 - DNA, 15 bp, Homo sapiens
ttgtacatattgtta

SEQ ID NO: 1131832 - DNA, 15 bp, Homo sapiens
ttgtacatatttgtg

SEQ ID NO: 1131833 - DNA, 22 bp, Homo sapiens
ttgtacatttatttattactgt

SEQ ID NO: 1131834 - DNA, 21 bp, Homo sapiens
ttgtacattttgtaaaatatt

SEQ ID NO: 1131835 - DNA, 20 bp, Homo sapiens
ttgtaccacttttgcaaata

SEQ ID NO: 1131836 - DNA, 19 bp, Homo sapiens
ttgtaccatagaaaaatgt

SEQ ID NO: 1131837 - DNA, 19 bp, Homo sapiens
ttgtcaatattaaatacag

SEQ ID NO: 1131838 - DNA, 17 bp, Homo sapiens
ttgtcacagaaatcaga

SEQ ID NO: 1131839 - DNA, 17 bp, Homo sapiens
ttgtcaccattggacag

SEQ ID NO: 1131840 - DNA, 19 bp, Homo sapiens
ttgtcacccaaagcctgtc

SEQ ID NO: 1131841 - DNA, 16 bp, Homo sapiens
ttgtcacttgccacat

SEQ ID NO: 1131842 - DNA, 16 bp, Homo sapiens
ttgtcacttttccttt

SEQ ID NO: 1131843 - DNA, 14 bp, Homo sapiens
ttgtcactttttat

SEQ ID NO: 1131844 - DNA, 14 bp, Homo sapiens
ttgtcactttttct

SEQ ID NO: 1131845 - DNA, 17 bp, Homo sapiens
ttgtcagcaggcaggct

SEQ ID NO: 1131846 - DNA, 14 bp, Homo sapiens
ttgtcagtattttt

SEQ ID NO: 1131847 - DNA, 15 bp, Homo sapiens
ttgtcataaaatgca

SEQ ID NO: 1131848 - DNA, 13 bp, Homo sapiens
ttgtcataacatt

SEQ ID NO: 1131849 - DNA, 21 bp, Homo sapiens
ttgtcatataagattcatatt

SEQ ID NO: 1131850 - DNA, 21 bp, Homo sapiens
ttgtcatctttcttctatttt

SEQ ID NO: 1131851 - DNA, 18 bp, Homo sapiens
ttgtcatctttttctaga

SEQ ID NO: 1131852 - DNA, 23 bp, Homo sapiens
ttgtcatggaaaatgtcctgtgg

SEQ ID NO: 1131853 - DNA, 13 bp, Homo sapiens
ttgtcatgttact

SEQ ID NO: 1131854 - DNA, 12 bp, Homo sapiens
ttgtcattaaag

SEQ ID NO: 1131855 - DNA, 14 bp, Homo sapiens
ttgtcattaaaggt

SEQ ID NO: 1131856 - DNA, 14 bp, Homo sapiens
ttgtcattatgatt

SEQ ID NO: 1131857 - DNA, 20 bp, Homo sapiens
ttgtcattcaagcctgtgaa

SEQ ID NO: 1131858 - DNA, 18 bp, Homo sapiens
ttgtcattccagagtgct

SEQ ID NO: 1131859 - DNA, 19 bp, Homo sapiens
ttgtcattttaaaatctga

SEQ ID NO: 1131860 - DNA, 20 bp, Homo sapiens
ttgtccaacaataaacagga

SEQ ID NO: 1131861 - DNA, 19 bp, Homo sapiens
ttgtccaattgttgacagt

SEQ ID NO: 1131862 - DNA, 22 bp, Homo sapiens
ttgtccaattgttgacagttct

SEQ ID NO: 1131863 - DNA, 20 bp, Homo sapiens
ttgtccaggctggagtgcaa

SEQ ID NO: 1131864 - DNA, 11 bp, Homo sapiens
ttgtcccagac

SEQ ID NO: 1131865 - DNA, 14 bp, Homo sapiens
ttgtcccatctgcc

SEQ ID NO: 1131866 - DNA, 13 bp, Homo sapiens
ttgtccccagggc

SEQ ID NO: 1131867 - DNA, 11 bp, Homo sapiens
ttgtccccagt

SEQ ID NO: 1131868 - DNA, 18 bp, Homo sapiens
ttgtcccccaacttgaga

SEQ ID NO: 1131869 - DNA, 16 bp, Homo sapiens
ttgtccctctgcccca

SEQ ID NO: 1131870 - DNA, 16 bp, Homo sapiens
ttgtccctctgctacg

SEQ ID NO: 1131871 - DNA, 15 bp, Homo sapiens
ttgtccctgtgccta

SEQ ID NO: 1131872 - DNA, 14 bp, Homo sapiens
ttgtccctgtttca

SEQ ID NO: 1131873 - DNA, 15 bp, Homo sapiens
ttgtcccttggcaca

SEQ ID NO: 1131874 - DNA, 18 bp, Homo sapiens
ttgtcctaagaacaatgc

SEQ ID NO: 1131875 - DNA, 16 bp, Homo sapiens
ttgtcctcaaggccca

SEQ ID NO: 1131876 - DNA, 19 bp, Homo sapiens
ttgtcctgatgcttttgtc

SEQ ID NO: 1131877 - DNA, 16 bp, Homo sapiens
ttgtcctgatttctta

SEQ ID NO: 1131878 - DNA, 12 bp, Homo sapiens
ttgtcctgccag

SEQ ID NO: 1131879 - DNA, 13 bp, Homo sapiens
ttgtcctggccct

SEQ ID NO: 1131880 - DNA, 18 bp, Homo sapiens
ttgtcctggcccttcagt

SEQ ID NO: 1131881 - DNA, 16 bp, Homo sapiens
ttgtccttcctgtgcc

SEQ ID NO: 1131882 - DNA, 20 bp, Homo sapiens
ttgtcctttaaaaaagaaaa

SEQ ID NO: 1131883 - DNA, 15 bp, Homo sapiens
ttgtcctttatattt

SEQ ID NO: 1131884 - DNA, 17 bp, Homo sapiens
ttgtcgtaaagatttgg

SEQ ID NO: 1131885 - DNA, 17 bp, Homo sapiens
ttgtcgtggttcttaaa

SEQ ID NO: 1131886 - DNA, 13 bp, Homo sapiens
ttgtcgtttttat

SEQ ID NO: 1131887 - DNA, 22 bp, Homo sapiens
ttgtctaaaatgcctcagtgta

SEQ ID NO: 1131888 - DNA, 15 bp, Homo sapiens
ttgtctaaaatgtca

SEQ ID NO: 1131889 - DNA, 19 bp, Homo sapiens
ttgtctaactcagaattat

SEQ ID NO: 1131890 - DNA, 17 bp, Homo sapiens
ttgtctactcctagaag

SEQ ID NO: 1131891 - DNA, 19 bp, Homo sapiens
ttgtctactcctagaagaa

SEQ ID NO: 1131892 - DNA, 15 bp, Homo sapiens
ttgtctataaagcat

SEQ ID NO: 1131893 - DNA, 17 bp, Homo sapiens
ttgtctattctgagcct

SEQ ID NO: 1131894 - DNA, 13 bp, Homo sapiens
ttgtctcagggcc

SEQ ID NO: 1131895 - DNA, 22 bp, Homo sapiens
ttgtctcccctgttcccctctc

SEQ ID NO: 1131896 - DNA, 20 bp, Homo sapiens
ttgtctccctggttgcctct

SEQ ID NO: 1131897 - DNA, 19 bp, Homo sapiens
ttgtctcctacctgctgct

SEQ ID NO: 1131898 - DNA, 13 bp, Homo sapiens
ttgtctccttcca

SEQ ID NO: 1131899 - DNA, 13 bp, Homo sapiens
ttgtctctgatgc

SEQ ID NO: 1131900 - DNA, 14 bp, Homo sapiens
ttgtctctgatgca

SEQ ID NO: 1131901 - DNA, 13 bp, Homo sapiens
ttgtctcttagaa

SEQ ID NO: 1131902 - DNA, 17 bp, Homo sapiens
ttgtctgaaacatttca

SEQ ID NO: 1131903 - DNA, 21 bp, Homo sapiens
ttgtctgaagtcactgcacag

SEQ ID NO: 1131904 - DNA, 21 bp, Homo sapiens
ttgtctgaggcctcatccctc

SEQ ID NO: 1131905 - DNA, 20 bp, Homo sapiens
ttgtctggcaaggactttgt

SEQ ID NO: 1131906 - DNA, 21 bp, Homo sapiens
ttgtctggcaaggactttgta

SEQ ID NO: 1131907 - DNA, 16 bp, Homo sapiens
ttgtctgggaattgtg

SEQ ID NO: 1131908 - DNA, 17 bp, Homo sapiens
ttgtctgtaaaaaatgg

SEQ ID NO: 1131909 - DNA, 15 bp, Homo sapiens
ttgtctgtacatact

SEQ ID NO: 1131910 - DNA, 21 bp, Homo sapiens
ttgtctgtacatactggcctc

SEQ ID NO: 1131911 - DNA, 22 bp, Homo sapiens
ttgtctgtcaaatgtttcctta

SEQ ID NO: 1131912 - DNA, 21 bp, Homo sapiens
ttgtctgtctccctcccctct

SEQ ID NO: 1131913 - DNA, 20 bp, Homo sapiens
ttgtctgtttgtttcaagaa

SEQ ID NO: 1131914 - DNA, 17 bp, Homo sapiens
ttgtcttaaaaaatgtg

SEQ ID NO: 1131915 - DNA, 22 bp, Homo sapiens
ttgtcttaaaaagtggaaaaat

SEQ ID NO: 1131916 - DNA, 22 bp, Homo sapiens
ttgtcttaccacagtgttttat

SEQ ID NO: 1131917 - DNA, 15 bp, Homo sapiens
ttgtcttatatatat

SEQ ID NO: 1131918 - DNA, 13 bp, Homo sapiens
ttgtcttattctt

SEQ ID NO: 1131919 - DNA, 14 bp, Homo sapiens
ttgtcttcccccct

SEQ ID NO: 1131920 - DNA, 14 bp, Homo sapiens
ttgtcttgaaagat

SEQ ID NO: 1131921 - DNA, 22 bp, Homo sapiens
ttgtcttgaatgtcttttgaat

SEQ ID NO: 1131922 - DNA, 22 bp, Homo sapiens
ttgtcttggcttcccaccagct

SEQ ID NO: 1131923 - DNA, 14 bp, Homo sapiens
ttgtcttgtacttc

SEQ ID NO: 1131924 - DNA, 17 bp, Homo sapiens
ttgtcttgtacttctgt

SEQ ID NO: 1131925 - DNA, 18 bp, Homo sapiens
ttgtcttgtacttctgtg

SEQ ID NO: 1131926 - DNA, 22 bp, Homo sapiens
ttgtcttgtacttctgtgttca

SEQ ID NO: 1131927 - DNA, 23 bp, Homo sapiens
ttgtcttgtacttctgtgttcat

SEQ ID NO: 1131928 - DNA, 13 bp, Homo sapiens
ttgtcttgtggag

SEQ ID NO: 1131929 - DNA, 18 bp, Homo sapiens
ttgtcttgttatgtacaa

SEQ ID NO: 1131930 - DNA, 14 bp, Homo sapiens
ttgtctttaaacag

SEQ ID NO: 1131931 - DNA, 12 bp, Homo sapiens
ttgtctttgctg

SEQ ID NO: 1131932 - DNA, 19 bp, Homo sapiens
ttgtctttgctgtactctt

SEQ ID NO: 1131933 - DNA, 14 bp, Homo sapiens
ttgtctttgtaata

SEQ ID NO: 1131934 - DNA, 19 bp, Homo sapiens
ttgtcttttaatgcttcat

SEQ ID NO: 1131935 - DNA, 20 bp, Homo sapiens
ttgtcttttagacaactaga

SEQ ID NO: 1131936 - DNA, 20 bp, Homo sapiens
ttgtcttttcaagtaatttt

SEQ ID NO: 1131937 - DNA, 13 bp, Homo sapiens
ttgtcttttcaga

SEQ ID NO: 1131938 - DNA, 12 bp, Homo sapiens
ttgtctttttcc

SEQ ID NO: 1131939 - DNA, 14 bp, Homo sapiens
ttgtgaaagaatgt

SEQ ID NO: 1131940 - DNA, 21 bp, Homo sapiens
ttgtgaaataatttttaactt

SEQ ID NO: 1131941 - DNA, 17 bp, Homo sapiens
ttgtgaaatcagtatca

SEQ ID NO: 1131942 - DNA, 22 bp, Homo sapiens
ttgtgaaatcagtatcagaata

SEQ ID NO: 1131943 - DNA, 13 bp, Homo sapiens
ttgtgaaatgtaa

SEQ ID NO: 1131944 - DNA, 19 bp, Homo sapiens
ttgtgaacaagtccctgta

SEQ ID NO: 1131945 - DNA, 13 bp, Homo sapiens
ttgtgaaccaatg

SEQ ID NO: 1131946 - DNA, 11 bp, Homo sapiens
ttgtgaagaat

SEQ ID NO: 1131947 - DNA, 14 bp, Homo sapiens
ttgtgaagtacata

SEQ ID NO: 1131948 - DNA, 18 bp, Homo sapiens
ttgtgaattaggctgtaa

SEQ ID NO: 1131949 - DNA, 23 bp, Homo sapiens
ttgtgaattaggctgtaactact

SEQ ID NO: 1131950 - DNA, 12 bp, Homo sapiens
ttgtgacagtgc

SEQ ID NO: 1131951 - DNA, 21 bp, Homo sapiens
ttgtgacagtgcctcttccag

SEQ ID NO: 1131952 - DNA, 17 bp, Homo sapiens
ttgtgacccaattaagt

SEQ ID NO: 1131953 - DNA, 15 bp, Homo sapiens
ttgtgactatataga

SEQ ID NO: 1131954 - DNA, 23 bp, Homo sapiens
ttgtgacttacaatttgcacaat

SEQ ID NO: 1131955 - DNA, 14 bp, Homo sapiens
ttgtgacttcactg

SEQ ID NO: 1131956 - DNA, 13 bp, Homo sapiens
ttgtgacttggag

SEQ ID NO: 1131957 - DNA, 12 bp, Homo sapiens
ttgtgagatggg

SEQ ID NO: 1131958 - DNA, 12 bp, Homo sapiens
ttgtgagccctc

SEQ ID NO: 1131959 - DNA, 16 bp, Homo sapiens
ttgtgagccctctagg

SEQ ID NO: 1131960 - DNA, 12 bp, Homo sapiens
ttgttaaagctg

SEQ ID NO: 1131961 - DNA, 18 bp, Homo sapiens
ttgttaaatttagcagcc

SEQ ID NO: 1131962 - DNA, 18 bp, Homo sapiens
ttgttaactcttgtctat

SEQ ID NO: 1131963 - DNA, 20 bp, Homo sapiens
ttgttaatatcactcattaa

SEQ ID NO: 1131964 - DNA, 17 bp, Homo sapiens
ttgttaatggtgcaaat

SEQ ID NO: 1131965 - DNA, 17 bp, Homo sapiens
ttgttaatgtcattgct

SEQ ID NO: 1131966 - DNA, 19 bp, Homo sapiens
ttgttaatgtcattgctaa

SEQ ID NO: 1131967 - DNA, 20 bp, Homo sapiens
ttgttaatgtcattgctaaa

SEQ ID NO: 1131968 - DNA, 21 bp, Homo sapiens
ttgttaatttagaaaacttta

SEQ ID NO: 1131969 - DNA, 22 bp, Homo sapiens
ttgttaatttagaaaactttaa

SEQ ID NO: 1131970 - DNA, 22 bp, Homo sapiens
ttgttaatttttcctatattgc

SEQ ID NO: 1131971 - DNA, 22 bp, Homo sapiens
ttgttacacattaagtaatcaa

SEQ ID NO: 1131972 - DNA, 19 bp, Homo sapiens
ttgttaccatactgtctct

SEQ ID NO: 1131973 - DNA, 24 bp, Homo sapiens
ttgttaccatactgtctctggagt

SEQ ID NO: 1131974 - DNA, 17 bp, Homo sapiens
ttgttactctggttctt

SEQ ID NO: 1131975 - DNA, 9 bp, Homo sapiens
ttgttactg

SEQ ID NO: 1131976 - DNA, 15 bp, Homo sapiens
ttgttactgcctgga

SEQ ID NO: 1131977 - DNA, 17 bp, Homo sapiens
ttgttactgctgattct

SEQ ID NO: 1131978 - DNA, 17 bp, Homo sapiens
ttgttagaccagaaagt

SEQ ID NO: 1131979 - DNA, 16 bp, Homo sapiens
ttgttagatagctgca

SEQ ID NO: 1131980 - DNA, 13 bp, Homo sapiens
ttgttagggctgc

SEQ ID NO: 1131981 - DNA, 19 bp, Homo sapiens
ttgttagtatgaggcattt

SEQ ID NO: 1131982 - DNA, 15 bp, Homo sapiens
ttgttatacttcaaa

SEQ ID NO: 1131983 - DNA, 15 bp, Homo sapiens
ttgttatataattta

SEQ ID NO: 1131984 - DNA, 13 bp, Homo sapiens
ttgttatcagtaa

SEQ ID NO: 1131985 - DNA, 19 bp, Homo sapiens
ttgttatggcttaatgaca

SEQ ID NO: 1131986 - DNA, 19 bp, Homo sapiens
ttgttatgtacaaactagt

SEQ ID NO: 1131987 - DNA, 21 bp, Homo sapiens
ttgttattattagataatatt

SEQ ID NO: 1131988 - DNA, 23 bp, Homo sapiens
ttgttattgatgttgctgttatt

SEQ ID NO: 1131989 - DNA, 13 bp, Homo sapiens
ttgttattgtgaa

SEQ ID NO: 1131990 - DNA, 15 bp, Homo sapiens
ttgttcaaatgcatt

SEQ ID NO: 1131991 - DNA, 15 bp, Homo sapiens
ttgttcaatgttcca

SEQ ID NO: 1131992 - DNA, 13 bp, Homo sapiens
ttgttcaattaga

SEQ ID NO: 1131993 - DNA, 15 bp, Homo sapiens
ttgttcaattagaat

SEQ ID NO: 1131994 - DNA, 15 bp, Homo sapiens
ttgttcatgggacat

SEQ ID NO: 1131995 - DNA, 13 bp, Homo sapiens
ttgttcattttga

SEQ ID NO: 1131996 - DNA, 16 bp, Homo sapiens
ttgttccaagacattg

SEQ ID NO: 1131997 - DNA, 11 bp, Homo sapiens
ttgttcccagt

SEQ ID NO: 1131998 - DNA, 19 bp, Homo sapiens
ttgttcccttcctcttcct

SEQ ID NO: 1131999 - DNA, 11 bp, Homo sapiens
ttgttcctgga

SEQ ID NO: 1132000 - DNA, 16 bp, Homo sapiens
ttgttcgggtgtgcaa

SEQ ID NO: 1132001 - DNA, 15 bp, Homo sapiens
ttgttctagttttca

SEQ ID NO: 1132002 - DNA, 18 bp, Homo sapiens
ttgttctatttttcaatc

SEQ ID NO: 1132003 - DNA, 23 bp, Homo sapiens
ttgttctcagaatcccttaacag

SEQ ID NO: 1132004 - DNA, 13 bp, Homo sapiens
ttgttctctggga

SEQ ID NO: 1132005 - DNA, 21 bp, Homo sapiens
ttgttctctgggagaaaatca

SEQ ID NO: 1132006 - DNA, 21 bp, Homo sapiens
ttgttctgaaatgtcagttct

SEQ ID NO: 1132007 - DNA, 12 bp, Homo sapiens
ttgttctgagca

SEQ ID NO: 1132008 - DNA, 12 bp, Homo sapiens
ttgttctgcttt

SEQ ID NO: 1132009 - DNA, 16 bp, Homo sapiens
ttgttctgttaactga

SEQ ID NO: 1132010 - DNA, 15 bp, Homo sapiens
ttgttcttggttcct

SEQ ID NO: 1132011 - DNA, 15 bp, Homo sapiens
ttgttcttgtattta

SEQ ID NO: 1132012 - DNA, 12 bp, Homo sapiens
ttgttctttgtg

SEQ ID NO: 1132013 - DNA, 15 bp, Homo sapiens
ttgttctttgttctt

SEQ ID NO: 1132014 - DNA, 16 bp, Homo sapiens
ttgttgaacatacttc

SEQ ID NO: 1132015 - DNA, 19 bp, Homo sapiens
ttgttgaacatacttcaaa

SEQ ID NO: 1132016 - DNA, 17 bp, Homo sapiens
ttgttgactgtgattag

SEQ ID NO: 1132017 - DNA, 21 bp, Homo sapiens
ttgttgaggtggtctgaatgt

SEQ ID NO: 1132018 - DNA, 20 bp, Homo sapiens
ttgttgataaattccactgg

SEQ ID NO: 1132019 - DNA, 21 bp, Homo sapiens
ttgttgataaattccactgga

SEQ ID NO: 1132020 - DNA, 20 bp, Homo sapiens
ttgttgatacctctgctggg

SEQ ID NO: 1132021 - DNA, 15 bp, Homo sapiens
ttgttgataggaact

SEQ ID NO: 1132022 - DNA, 15 bp, Homo sapiens
ttgttgatattgttt

SEQ ID NO: 1132023 - DNA, 18 bp, Homo sapiens
ttgttgatattgtttgct

SEQ ID NO: 1132024 - DNA, 12 bp, Homo sapiens
ttgttgatattt

SEQ ID NO: 1132025 - DNA, 16 bp, Homo sapiens
ttgttgcaagatgtga

SEQ ID NO: 1132026 - DNA, 17 bp, Homo sapiens
ttgttgcaagatgtgaa

SEQ ID NO: 1132027 - DNA, 19 bp, Homo sapiens
ttgttgcaagatgtgaatt

SEQ ID NO: 1132028 - DNA, 17 bp, Homo sapiens
ttgttgcatcttttcta

SEQ ID NO: 1132029 - DNA, 17 bp, Homo sapiens
ttgttgcatgtttgaaa

SEQ ID NO: 1132030 - DNA, 20 bp, Homo sapiens
ttgttgccatgtgcaccttg

SEQ ID NO: 1132031 - DNA, 15 bp, Homo sapiens
ttgttggagcctgca

SEQ ID NO: 1132032 - DNA, 18 bp, Homo sapiens
ttgttggcccttccagtg

SEQ ID NO: 1132033 - DNA, 21 bp, Homo sapiens
ttgttggcctccggcctcccc

SEQ ID NO: 1132034 - DNA, 23 bp, Homo sapiens
ttgttggctttcccttatcaaac

SEQ ID NO: 1132035 - DNA, 20 bp, Homo sapiens
ttgttgggattcctgaccca

SEQ ID NO: 1132036 - DNA, 21 bp, Homo sapiens
ttgttgggattcctgacccag

SEQ ID NO: 1132037 - DNA, 14 bp, Homo sapiens
ttgttggtaccttt

SEQ ID NO: 1132038 - DNA, 15 bp, Homo sapiens
ttgttggtacctttc

SEQ ID NO: 1132039 - DNA, 20 bp, Homo sapiens
ttgttgtagattgattgtat

SEQ ID NO: 1132040 - DNA, 12 bp, Homo sapiens
ttgttgtgactt

SEQ ID NO: 1132041 - DNA, 18 bp, Homo sapiens
ttgttgtgtgtatatgta

SEQ ID NO: 1132042 - DNA, 13 bp, Homo sapiens
ttgttgttctgtt

SEQ ID NO: 1132043 - DNA, 14 bp, Homo sapiens
ttgttgttctgtta

SEQ ID NO: 1132044 - DNA, 23 bp, Homo sapiens
ttgtttaaaactcagaatataac

SEQ ID NO: 1132045 - DNA, 13 bp, Homo sapiens
ttgtttaaaattc

SEQ ID NO: 1132046 - DNA, 15 bp, Homo sapiens
ttgtttaaaattctc

SEQ ID NO: 1132047 - DNA, 18 bp, Homo sapiens
ttgtttaaagaataaagt

SEQ ID NO: 1132048 - DNA, 16 bp, Homo sapiens
ttgtttaaatgccaaa

SEQ ID NO: 1132049 - DNA, 22 bp, Homo sapiens
ttgtttaatttttatttcttcc

SEQ ID NO: 1132050 - DNA, 12 bp, Homo sapiens
ttgtttacaata

SEQ ID NO: 1132051 - DNA, 19 bp, Homo sapiens
ttgtttagaaacagaaata

SEQ ID NO: 1132052 - DNA, 20 bp, Homo sapiens
ttgtttagaaacagaaatag

SEQ ID NO: 1132053 - DNA, 16 bp, Homo sapiens
ttgtttatacacaact

SEQ ID NO: 1132054 - DNA, 21 bp, Homo sapiens
ttgtttatcagatacatcact

SEQ ID NO: 1132055 - DNA, 22 bp, Homo sapiens
ttgtttatcagatacatcactg

SEQ ID NO: 1132056 - DNA, 18 bp, Homo sapiens
ttgtttatgatatttctt

SEQ ID NO: 1132057 - DNA, 20 bp, Homo sapiens
ttgtttcaagaacctggaaa

SEQ ID NO: 1132058 - DNA, 19 bp, Homo sapiens
ttgtttcctcttccaaagt

SEQ ID NO: 1132059 - DNA, 14 bp, Homo sapiens
ttgtttctactttg

SEQ ID NO: 1132060 - DNA, 23 bp, Homo sapiens
ttgtttctactttgatatgactg

SEQ ID NO: 1132061 - DNA, 21 bp, Homo sapiens
ttgtttctgaaaattccagaa

SEQ ID NO: 1132062 - DNA, 14 bp, Homo sapiens
ttgtttctgaccca

SEQ ID NO: 1132063 - DNA, 20 bp, Homo sapiens
ttgtttctgggtccctgctc

SEQ ID NO: 1132064 - DNA, 15 bp, Homo sapiens
ttgtttctgttccaa

SEQ ID NO: 1132065 - DNA, 14 bp, Homo sapiens
ttgtttcttaaata

SEQ ID NO: 1132066 - DNA, 13 bp, Homo sapiens
ttgtttcttccaa

SEQ ID NO: 1132067 - DNA, 17 bp, Homo sapiens
ttgtttcttgacaagct

SEQ ID NO: 1132068 - DNA, 13 bp, Homo sapiens
ttgtttctttgtg

SEQ ID NO: 1132069 - DNA, 21 bp, Homo sapiens
ttgtttgaaacaaagaaggtt

SEQ ID NO: 1132070 - DNA, 17 bp, Homo sapiens
ttgtttgagacagggtc

SEQ ID NO: 1132071 - DNA, 21 bp, Homo sapiens
ttgtttgaggcaaattaactg

SEQ ID NO: 1132072 - DNA, 22 bp, Homo sapiens
ttgtttgatctacttcatagct

SEQ ID NO: 1132073 - DNA, 14 bp, Homo sapiens
ttgtttgatttcaa

SEQ ID NO: 1132074 - DNA, 11 bp, Homo sapiens
ttgtttgcttc

SEQ ID NO: 1132075 - DNA, 22 bp, Homo sapiens
ttgtttgtatgtataattcaaa

SEQ ID NO: 1132076 - DNA, 15 bp, Homo sapiens
ttgtttgtctgtttg

SEQ ID NO: 1132077 - DNA, 12 bp, Homo sapiens
ttgtttgtttca

SEQ ID NO: 1132078 - DNA, 13 bp, Homo sapiens
ttgtttgtttctt

SEQ ID NO: 1132079 - DNA, 20 bp, Homo sapiens
ttgtttgtttcttcttttcc

SEQ ID NO: 1132080 - DNA, 13 bp, Homo sapiens
ttgtttgtttgag

SEQ ID NO: 1132081 - DNA, 18 bp, Homo sapiens
ttgttttcacttgtattg

SEQ ID NO: 1132082 - DNA, 13 bp, Homo sapiens
ttgttttcagtgt

SEQ ID NO: 1132083 - DNA, 20 bp, Homo sapiens
tttaaagacccaacttgcca

SEQ ID NO: 1132084 - DNA, 18 bp, Homo sapiens
tttaaagccattctgatt

SEQ ID NO: 1132085 - DNA, 12 bp, Homo sapiens
tttaaagcctgg

SEQ ID NO: 1132086 - DNA, 16 bp, Homo sapiens
tttaaagctaaatttt

SEQ ID NO: 1132087 - DNA, 17 bp, Homo sapiens
tttaaaggaaaaaatgt

SEQ ID NO: 1132088 - DNA, 14 bp, Homo sapiens
tttaaaggaaacac

SEQ ID NO: 1132089 - DNA, 19 bp, Homo sapiens
tttaaaggggtctgttctg

SEQ ID NO: 1132090 - DNA, 21 bp, Homo sapiens
tttaaagggtgcccatttgtg

SEQ ID NO: 1132091 - DNA, 20 bp, Homo sapiens
tttaaaggtttttaaattgt

SEQ ID NO: 1132092 - DNA, 22 bp, Homo sapiens
tttaaaggtttttaaattgttt

SEQ ID NO: 1132093 - DNA, 18 bp, Homo sapiens
tttaaagtaaacttgtgt

SEQ ID NO: 1132094 - DNA, 17 bp, Homo sapiens
tttaaagtacctgtagt

SEQ ID NO: 1132095 - DNA, 17 bp, Homo sapiens
tttaaagtattctccat

SEQ ID NO: 1132096 - DNA, 18 bp, Homo sapiens
tttaaagtcacatccctg

SEQ ID NO: 1132097 - DNA, 23 bp, Homo sapiens
tttaaagtgcagtcatttgtggt

SEQ ID NO: 1132098 - DNA, 15 bp, Homo sapiens
tttaaagttcttatt

SEQ ID NO: 1132099 - DNA, 16 bp, Homo sapiens
tttaaagttcttattt

SEQ ID NO: 1132100 - DNA, 17 bp, Homo sapiens
tttaaagttcttatttt

SEQ ID NO: 1132101 - DNA, 17 bp, Homo sapiens
tttaaagttgtttgtgc

SEQ ID NO: 1132102 - DNA, 13 bp, Homo sapiens
tttaaagtttgtt

SEQ ID NO: 1132103 - DNA, 15 bp, Homo sapiens
tttaaagtttgttca

SEQ ID NO: 1132104 - DNA, 19 bp, Homo sapiens
tttaaagttttatatgcat

SEQ ID NO: 1132105 - DNA, 23 bp, Homo sapiens
tttaaataaaagaaaaaatatct

SEQ ID NO: 1132106 - DNA, 19 bp, Homo sapiens
tttaaataaagacctatgt

SEQ ID NO: 1132107 - DNA, 21 bp, Homo sapiens
tttaaataaattaagatccta

SEQ ID NO: 1132108 - DNA, 16 bp, Homo sapiens
tttaaatagcctaaat

SEQ ID NO: 1132109 - DNA, 14 bp, Homo sapiens
tttaaatataaata

SEQ ID NO: 1132110 - DNA, 19 bp, Homo sapiens
tttaaatataaatagctaa

SEQ ID NO: 1132111 - DNA, 18 bp, Homo sapiens
tttaaatataattctgta

SEQ ID NO: 1132112 - DNA, 17 bp, Homo sapiens
tttaaatattttctatt

SEQ ID NO: 1132113 - DNA, 14 bp, Homo sapiens
tttaaatcaaggaa

SEQ ID NO: 1132114 - DNA, 14 bp, Homo sapiens
tttaaatcatgtat

SEQ ID NO: 1132115 - DNA, 17 bp, Homo sapiens
tttaaatcatgtatgtt

SEQ ID NO: 1132116 - DNA, 20 bp, Homo sapiens
tttaaatcatgtatgttatg

SEQ ID NO: 1132117 - DNA, 19 bp, Homo sapiens
tttaaatcctgaagagcat

SEQ ID NO: 1132118 - DNA, 12 bp, Homo sapiens
tttaaatgattc

SEQ ID NO: 1132119 - DNA, 18 bp, Homo sapiens
tttaaatgattccaaata

SEQ ID NO: 1132120 - DNA, 18 bp, Homo sapiens
tttaaatgcataaatgca

SEQ ID NO: 1132121 - DNA, 23 bp, Homo sapiens
tttaaatgcatgtcttaaatgct

SEQ ID NO: 1132122 - DNA, 16 bp, Homo sapiens
tttaaatgtaaaacat

SEQ ID NO: 1132123 - DNA, 13 bp, Homo sapiens
tttaaatgtatac

SEQ ID NO: 1132124 - DNA, 16 bp, Homo sapiens
tttaaatgtgaatttt

SEQ ID NO: 1132125 - DNA, 24 bp, Homo sapiens
tttaaatgtgaatttttatttctt

SEQ ID NO: 1132126 - DNA, 17 bp, Homo sapiens
tttaaatgtgtacaatg

SEQ ID NO: 1132127 - DNA, 13 bp, Homo sapiens
tttaaattacaat

SEQ ID NO: 1132128 - DNA, 20 bp, Homo sapiens
tttaaattataacttaaaat

SEQ ID NO: 1132129 - DNA, 19 bp, Homo sapiens
tttaaattcacaatagaaa

SEQ ID NO: 1132130 - DNA, 14 bp, Homo sapiens
tttaaatttgttat

SEQ ID NO: 1132131 - DNA, 20 bp, Homo sapiens
tttaaattttaaaaagcagc

SEQ ID NO: 1132132 - DNA, 15 bp, Homo sapiens
tttaaattttgtaat

SEQ ID NO: 1132133 - DNA, 13 bp, Homo sapiens
tttaaatttttgt

SEQ ID NO: 1132134 - DNA, 13 bp, Homo sapiens
tttaacaaatcta

SEQ ID NO: 1132135 - DNA, 15 bp, Homo sapiens
tttaacaaatctaat

SEQ ID NO: 1132136 - DNA, 19 bp, Homo sapiens
tttaacaaatctaatctct

SEQ ID NO: 1132137 - DNA, 22 bp, Homo sapiens
tttaacaaatctaatctcttat

SEQ ID NO: 1132138 - DNA, 22 bp, Homo sapiens
tttaacaataactactgtgttc

SEQ ID NO: 1132139 - DNA, 16 bp, Homo sapiens
tttaacaattgtctta

SEQ ID NO: 1132140 - DNA, 23 bp, Homo sapiens
tttaacaatttcctttatattta

SEQ ID NO: 1132141 - DNA, 13 bp, Homo sapiens
tttaacactttgt

SEQ ID NO: 1132142 - DNA, 18 bp, Homo sapiens
tttaacagaaactttcaa

SEQ ID NO: 1132143 - DNA, 21 bp, Homo sapiens
tttaacagaaactttcaaaag

SEQ ID NO: 1132144 - DNA, 14 bp, Homo sapiens
tttaacagaaatgt

SEQ ID NO: 1132145 - DNA, 18 bp, Homo sapiens
tttaacagaaatgtacag

SEQ ID NO: 1132146 - DNA, 16 bp, Homo sapiens
tttaacagaaattgta

SEQ ID NO: 1132147 - DNA, 16 bp, Homo sapiens
tttaacagtcatttaa

SEQ ID NO: 1132148 - DNA, 19 bp, Homo sapiens
tttaacatacaagaaaatg

SEQ ID NO: 1132149 - DNA, 14 bp, Homo sapiens
tttaacatatatat

SEQ ID NO: 1132150 - DNA, 14 bp, Homo sapiens
tttaacatgtgtta

SEQ ID NO: 1132151 - DNA, 14 bp, Homo sapiens
tttaaccaaaacat

SEQ ID NO: 1132152 - DNA, 21 bp, Homo sapiens
tttaaccaaaggtgaaggaat

SEQ ID NO: 1132153 - DNA, 23 bp, Homo sapiens
tttaaccaaaggtgaaggaatat

SEQ ID NO: 1132154 - DNA, 18 bp, Homo sapiens
tttaaccaaggaggggcc

SEQ ID NO: 1132155 - DNA, 21 bp, Homo sapiens
tttaaccatggtgcttgttaa

SEQ ID NO: 1132156 - DNA, 18 bp, Homo sapiens
tttaacccccctgtacac

SEQ ID NO: 1132157 - DNA, 19 bp, Homo sapiens
tttaacccccctgtacaca

SEQ ID NO: 1132158 - DNA, 13 bp, Homo sapiens
tttaacgctgcct

SEQ ID NO: 1132159 - DNA, 14 bp, Homo sapiens
tttaacgtggcttg

SEQ ID NO: 1132160 - DNA, 18 bp, Homo sapiens
tttaacgttctgctgctt

SEQ ID NO: 1132161 - DNA, 17 bp, Homo sapiens
tttaactagaatttatt

SEQ ID NO: 1132162 - DNA, 23 bp, Homo sapiens
tttaactcgagaccttttcaact

SEQ ID NO: 1132163 - DNA, 13 bp, Homo sapiens
tttaactgaaaat

SEQ ID NO: 1132164 - DNA, 16 bp, Homo sapiens
tttaactgaaaatgta

SEQ ID NO: 1132165 - DNA, 18 bp, Homo sapiens
tttaactgaaaatgtaaa

SEQ ID NO: 1132166 - DNA, 14 bp, Homo sapiens
tttaactgacaagc

SEQ ID NO: 1132167 - DNA, 14 bp, Homo sapiens
tttaactgagaaat

SEQ ID NO: 1132168 - DNA, 21 bp, Homo sapiens
tttaactgattcttatgatta

SEQ ID NO: 1132169 - DNA, 12 bp, Homo sapiens
tttaactggcat

SEQ ID NO: 1132170 - DNA, 13 bp, Homo sapiens
tttaactggcatg

SEQ ID NO: 1132171 - DNA, 13 bp, Homo sapiens
tttaactggtgca

SEQ ID NO: 1132172 - DNA, 23 bp, Homo sapiens
tttaactggtgcactttgtaaat

SEQ ID NO: 1132173 - DNA, 18 bp, Homo sapiens
tttaacttccagtggctg

SEQ ID NO: 1132174 - DNA, 14 bp, Homo sapiens
tttaacttctttct

SEQ ID NO: 1132175 - DNA, 14 bp, Homo sapiens
tttaactttaagtt

SEQ ID NO: 1132176 - DNA, 23 bp, Homo sapiens
tttaactttaccatgctcaatga

SEQ ID NO: 1132177 - DNA, 14 bp, Homo sapiens
tttaactttctaga

SEQ ID NO: 1132178 - DNA, 22 bp, Homo sapiens
tttaacttttgaaaagaccaag

SEQ ID NO: 1132179 - DNA, 19 bp, Homo sapiens
tttaagaaaaatgaaaact

SEQ ID NO: 1132180 - DNA, 13 bp, Homo sapiens
tttaagaaaaatt

SEQ ID NO: 1132181 - DNA, 20 bp, Homo sapiens
tttaagaaaaattcacaagc

SEQ ID NO: 1132182 - DNA, 16 bp, Homo sapiens
tttaagaaaatacaat

SEQ ID NO: 1132183 - DNA, 20 bp, Homo sapiens
tttaagaaaatacaataaac

SEQ ID NO: 1132184 - DNA, 12 bp, Homo sapiens
tttaagaacttc

SEQ ID NO: 1132185 - DNA, 17 bp, Homo sapiens
tttaagaacttcatttt

SEQ ID NO: 1132186 - DNA, 20 bp, Homo sapiens
tttaagaattgagtaatggt

SEQ ID NO: 1132187 - DNA, 19 bp, Homo sapiens
tttaagacgtgtttgtgtt

SEQ ID NO: 1132188 - DNA, 17 bp, Homo sapiens
tttaagactgaatgttt

SEQ ID NO: 1132189 - DNA, 17 bp, Homo sapiens
tttaagagacagtttcg

SEQ ID NO: 1132190 - DNA, 20 bp, Homo sapiens
tttaagagactctttatttt

SEQ ID NO: 1132191 - DNA, 14 bp, Homo sapiens
tttaagagtgaagt

SEQ ID NO: 1132192 - DNA, 14 bp, Homo sapiens
tttaagatagtgta

SEQ ID NO: 1132193 - DNA, 18 bp, Homo sapiens
tttaagatatccatcttt

SEQ ID NO: 1132194 - DNA, 23 bp, Homo sapiens
tttaagatatccatctttttctt

SEQ ID NO: 1132195 - DNA, 15 bp, Homo sapiens
tttaagatttgtgtt

SEQ ID NO: 1132196 - DNA, 15 bp, Homo sapiens
tttaagcatttgtat

SEQ ID NO: 1132197 - DNA, 19 bp, Homo sapiens
tttaagcctcatatttaaa

SEQ ID NO: 1132198 - DNA, 20 bp, Homo sapiens
tttaagctgcaaatctgatg

SEQ ID NO: 1132199 - DNA, 12 bp, Homo sapiens
tttaagctgttt

SEQ ID NO: 1132200 - DNA, 13 bp, Homo sapiens
tttaagctgtttc

SEQ ID NO: 1132201 - DNA, 18 bp, Homo sapiens
tttaaggaatcaaatctt

SEQ ID NO: 1132202 - DNA, 11 bp, Homo sapiens
tttaaggactc

SEQ ID NO: 1132203 - DNA, 22 bp, Homo sapiens
tttaaggcagattttacagagc

SEQ ID NO: 1132204 - DNA, 20 bp, Homo sapiens
tttaagggtttgtggaaaat

SEQ ID NO: 1132205 - DNA, 15 bp, Homo sapiens
tttacagctgtgtta

SEQ ID NO: 1132206 - DNA, 20 bp, Homo sapiens
tttacagctttcatgattag

SEQ ID NO: 1132207 - DNA, 18 bp, Homo sapiens
tttacaggaacttcatca

SEQ ID NO: 1132208 - DNA, 22 bp, Homo sapiens
tttacaggccctgctcctgcag

SEQ ID NO: 1132209 - DNA, 13 bp, Homo sapiens
tttacagggtata

SEQ ID NO: 1132210 - DNA, 16 bp, Homo sapiens
tttacagtatccaaaa

SEQ ID NO: 1132211 - DNA, 20 bp, Homo sapiens
tttacagttagggttttgca

SEQ ID NO: 1132212 - DNA, 21 bp, Homo sapiens
tttacagttagggttttgcaa

SEQ ID NO: 1132213 - DNA, 22 bp, Homo sapiens
tttacagttagggttttgcaat

SEQ ID NO: 1132214 - DNA, 13 bp, Homo sapiens
tttacagtttgtg

SEQ ID NO: 1132215 - DNA, 18 bp, Homo sapiens
tttacataaagactgtgc

SEQ ID NO: 1132216 - DNA, 15 bp, Homo sapiens
tttacatactgctgt

SEQ ID NO: 1132217 - DNA, 13 bp, Homo sapiens
tttacatagtctg

SEQ ID NO: 1132218 - DNA, 19 bp, Homo sapiens
tttacatataaaatgtaat

SEQ ID NO: 1132219 - DNA, 23 bp, Homo sapiens
tttacatctgggatcatgataga

SEQ ID NO: 1132220 - DNA, 21 bp, Homo sapiens
tttacatgacagatattttat

SEQ ID NO: 1132221 - DNA, 22 bp, Homo sapiens
tttacatgacagatattttatc

SEQ ID NO: 1132222 - DNA, 21 bp, Homo sapiens
tttacatggcgccctgcctcc

SEQ ID NO: 1132223 - DNA, 16 bp, Homo sapiens
tttacattatgcaaat

SEQ ID NO: 1132224 - DNA, 16 bp, Homo sapiens
tttacattcatcaata

SEQ ID NO: 1132225 - DNA, 12 bp, Homo sapiens
tttacatttcta

SEQ ID NO: 1132226 - DNA, 12 bp, Homo sapiens
tttacattttaa

SEQ ID NO: 1132227 - DNA, 15 bp, Homo sapiens
tttacattttagggt

SEQ ID NO: 1132228 - DNA, 14 bp, Homo sapiens
tttaccaaaaattt

SEQ ID NO: 1132229 - DNA, 12 bp, Homo sapiens
tttaccaaagca

SEQ ID NO: 1132230 - DNA, 13 bp, Homo sapiens
tttaccaaagcat

SEQ ID NO: 1132231 - DNA, 14 bp, Homo sapiens
tttaccaaattgct

SEQ ID NO: 1132232 - DNA, 16 bp, Homo sapiens
tttaccaataaactga

SEQ ID NO: 1132233 - DNA, 20 bp, Homo sapiens
tttaccagttaattactcag

SEQ ID NO: 1132234 - DNA, 18 bp, Homo sapiens
tttacccaaaaactaaat

SEQ ID NO: 1132235 - DNA, 17 bp, Homo sapiens
tttacccagtgggacag

SEQ ID NO: 1132236 - DNA, 15 bp, Homo sapiens
tttacccatgaagat

SEQ ID NO: 1132237 - DNA, 15 bp, Homo sapiens
tttacccctgcacag

SEQ ID NO: 1132238 - DNA, 23 bp, Homo sapiens
tttaccggttgtttagaaacaga

SEQ ID NO: 1132239 - DNA, 18 bp, Homo sapiens
tttaccgtttcttccctg

SEQ ID NO: 1132240 - DNA, 18 bp, Homo sapiens
tttacctaccacagtgtc

SEQ ID NO: 1132241 - DNA, 21 bp, Homo sapiens
tttacctactgtgtcttggaa

SEQ ID NO: 1132242 - DNA, 21 bp, Homo sapiens
tttacctatggaagtggttct

SEQ ID NO: 1132243 - DNA, 15 bp, Homo sapiens
tttacctatgtaaca

SEQ ID NO: 1132244 - DNA, 13 bp, Homo sapiens
tttacctcccctt

SEQ ID NO: 1132245 - DNA, 16 bp, Homo sapiens
tttacctgagaccagt

SEQ ID NO: 1132246 - DNA, 16 bp, Homo sapiens
tttacctgcaaaaaat

SEQ ID NO: 1132247 - DNA, 14 bp, Homo sapiens
tttacctggtgctc

SEQ ID NO: 1132248 - DNA, 16 bp, Homo sapiens
tttaccttcaaacttt

SEQ ID NO: 1132249 - DNA, 13 bp, Homo sapiens
tttaccttgtata

SEQ ID NO: 1132250 - DNA, 19 bp, Homo sapiens
tttaccttttctataagtt

SEQ ID NO: 1132251 - DNA, 14 bp, Homo sapiens
tttaccttttttat

SEQ ID NO: 1132252 - DNA, 13 bp, Homo sapiens
tttacggacaccc

SEQ ID NO: 1132253 - DNA, 17 bp, Homo sapiens
tttacggacaccccctc

SEQ ID NO: 1132254 - DNA, 18 bp, Homo sapiens
tttacgtctgggagaaat

SEQ ID NO: 1132255 - DNA, 17 bp, Homo sapiens
tttacgttcatcacctg

SEQ ID NO: 1132256 - DNA, 15 bp, Homo sapiens
tttactaaagaaaga

SEQ ID NO: 1132257 - DNA, 16 bp, Homo sapiens
tttactaacactggct

SEQ ID NO: 1132258 - DNA, 19 bp, Homo sapiens
tttactaactaaataccat

SEQ ID NO: 1132259 - DNA, 21 bp, Homo sapiens
tttactaagccacaagaaatt

SEQ ID NO: 1132260 - DNA, 15 bp, Homo sapiens
tttactactgtggaa

SEQ ID NO: 1132261 - DNA, 23 bp, Homo sapiens
tttactataagactataaataaa

SEQ ID NO: 1132262 - DNA, 13 bp, Homo sapiens
tttactccagtgg

SEQ ID NO: 1132263 - DNA, 11 bp, Homo sapiens
tttactcctgg

SEQ ID NO: 1132264 - DNA, 12 bp, Homo sapiens
tttactctgcct

SEQ ID NO: 1132265 - DNA, 13 bp, Homo sapiens
tttactctgccta

SEQ ID NO: 1132266 - DNA, 14 bp, Homo sapiens
tttactctttgcaa

SEQ ID NO: 1132267 - DNA, 13 bp, Homo sapiens
tttactgaacaat

SEQ ID NO: 1132268 - DNA, 16 bp, Homo sapiens
tttactgacacttcct

SEQ ID NO: 1132269 - DNA, 22 bp, Homo sapiens
tttactgacacttcctgtcctt

SEQ ID NO: 1132270 - DNA, 18 bp, Homo sapiens
tttactgagcttctctgt

SEQ ID NO: 1132271 - DNA, 15 bp, Homo sapiens
tttactgatactaca

SEQ ID NO: 1132272 - DNA, 17 bp, Homo sapiens
tttactgcctgaataaa

SEQ ID NO: 1132273 - DNA, 19 bp, Homo sapiens
tttactgcttttcattagc

SEQ ID NO: 1132274 - DNA, 19 bp, Homo sapiens
tttactggttgcatggaaa

SEQ ID NO: 1132275 - DNA, 14 bp, Homo sapiens
tttactgtttgtta

SEQ ID NO: 1132276 - DNA, 20 bp, Homo sapiens
tttactgttttaattgtagt

SEQ ID NO: 1132277 - DNA, 22 bp, Homo sapiens
tttactgttttgaaatcaatgc

SEQ ID NO: 1132278 - DNA, 14 bp, Homo sapiens
tttacttaagactt

SEQ ID NO: 1132279 - DNA, 17 bp, Homo sapiens
tttacttatcttatgcc

SEQ ID NO: 1132280 - DNA, 13 bp, Homo sapiens
tttacttcttata

SEQ ID NO: 1132281 - DNA, 22 bp, Homo sapiens
tttacttcttatacatttgata

SEQ ID NO: 1132282 - DNA, 18 bp, Homo sapiens
tttacttgcattgaatat

SEQ ID NO: 1132283 - DNA, 13 bp, Homo sapiens
tttacttgtctgt

SEQ ID NO: 1132284 - DNA, 17 bp, Homo sapiens
tttactttcccttgctt

SEQ ID NO: 1132285 - DNA, 20 bp, Homo sapiens
tttactttcccttgcttttc

SEQ ID NO: 1132286 - DNA, 14 bp, Homo sapiens
tttactttgccaac

SEQ ID NO: 1132287 - DNA, 12 bp, Homo sapiens
tttactttggcc

SEQ ID NO: 1132288 - DNA, 15 bp, Homo sapiens
tttacttttaaactg

SEQ ID NO: 1132289 - DNA, 18 bp, Homo sapiens
tttacttttcacactgtc

SEQ ID NO: 1132290 - DNA, 19 bp, Homo sapiens
tttacttttcacactgtct

SEQ ID NO: 1132291 - DNA, 22 bp, Homo sapiens
tttacttttcacactgtcttcc

SEQ ID NO: 1132292 - DNA, 12 bp, Homo sapiens
tttagaaaacat

SEQ ID NO: 1132293 - DNA, 11 bp, Homo sapiens
tttagaaatat

SEQ ID NO: 1132294 - DNA, 14 bp, Homo sapiens
tttagaaatataat

SEQ ID NO: 1132295 - DNA, 13 bp, Homo sapiens
tttagaaatcatt

SEQ ID NO: 1132296 - DNA, 14 bp, Homo sapiens
tttagaacaggaga

SEQ ID NO: 1132297 - DNA, 21 bp, Homo sapiens
tttagaagcaaagatttcagt

SEQ ID NO: 1132298 - DNA, 23 bp, Homo sapiens
tttagaagcaaagatttcagtag

SEQ ID NO: 1132299 - DNA, 20 bp, Homo sapiens
tttagaataagaatttgcat

SEQ ID NO: 1132300 - DNA, 23 bp, Homo sapiens
tttagacaaagccttaagcaaat

SEQ ID NO: 1132301 - DNA, 20 bp, Homo sapiens
tttagacagtctcactttgt

SEQ ID NO: 1132302 - DNA, 22 bp, Homo sapiens
tttagactcatcaatcaaataa

SEQ ID NO: 1132303 - DNA, 17 bp, Homo sapiens
tttagagaatgtgtttc

SEQ ID NO: 1132304 - DNA, 21 bp, Homo sapiens
tttagagaatgtgtttcaaaa

SEQ ID NO: 1132305 - DNA, 16 bp, Homo sapiens
tttagagcttccaaat

SEQ ID NO: 1132306 - DNA, 15 bp, Homo sapiens
tttagaggcattgtt

SEQ ID NO: 1132307 - DNA, 18 bp, Homo sapiens
tttagagtagcatgagag

SEQ ID NO: 1132308 - DNA, 17 bp, Homo sapiens
tttagagtatttacact

SEQ ID NO: 1132309 - DNA, 23 bp, Homo sapiens
tttagagtgtaggtgaaatgaat

SEQ ID NO: 1132310 - DNA, 16 bp, Homo sapiens
tttagataatttgaaa

SEQ ID NO: 1132311 - DNA, 20 bp, Homo sapiens
tttagatagccctgtcctgg

SEQ ID NO: 1132312 - DNA, 21 bp, Homo sapiens
tttagatgataaagagacagt

SEQ ID NO: 1132313 - DNA, 11 bp, Homo sapiens
tttagatgctg

SEQ ID NO: 1132314 - DNA, 20 bp, Homo sapiens
tttagatgtgcaacctgtgg

SEQ ID NO: 1132315 - DNA, 18 bp, Homo sapiens
tttagattgagaaatgtg

SEQ ID NO: 1132316 - DNA, 19 bp, Homo sapiens
tttagattttcttttgcct

SEQ ID NO: 1132317 - DNA, 20 bp, Homo sapiens
tttagcaaactgatgctgag

SEQ ID NO: 1132318 - DNA, 22 bp, Homo sapiens
tttagcaaactgatgctgagga

SEQ ID NO: 1132319 - DNA, 14 bp, Homo sapiens
tttagcacaatttg

SEQ ID NO: 1132320 - DNA, 11 bp, Homo sapiens
tttagcagcac

SEQ ID NO: 1132321 - DNA, 18 bp, Homo sapiens
tttagcagtggctggtgc

SEQ ID NO: 1132322 - DNA, 20 bp, Homo sapiens
tttagcagtggctggtgccc

SEQ ID NO: 1132323 - DNA, 12 bp, Homo sapiens
tttagcatgtgt

SEQ ID NO: 1132324 - DNA, 19 bp, Homo sapiens
tttagcatttttatgcaga

SEQ ID NO: 1132325 - DNA, 15 bp, Homo sapiens
tttagccaaaccctt

SEQ ID NO: 1132326 - DNA, 15 bp, Homo sapiens
tttagcctcttccct

SEQ ID NO: 1132327 - DNA, 19 bp, Homo sapiens
tttagcctcttccctctga

SEQ ID NO: 1132328 - DNA, 12 bp, Homo sapiens
tttattcccaag

SEQ ID NO: 1132329 - DNA, 16 bp, Homo sapiens
tttattccctgcccaa

SEQ ID NO: 1132330 - DNA, 13 bp, Homo sapiens
tttattccttcca

SEQ ID NO: 1132331 - DNA, 12 bp, Homo sapiens
tttattctgtgg

SEQ ID NO: 1132332 - DNA, 13 bp, Homo sapiens
tttattctgtggt

SEQ ID NO: 1132333 - DNA, 15 bp, Homo sapiens
tttattctgtggttc

SEQ ID NO: 1132334 - DNA, 13 bp, Homo sapiens
tttattctgtttt

SEQ ID NO: 1132335 - DNA, 18 bp, Homo sapiens
tttattctgttttcttgt

SEQ ID NO: 1132336 - DNA, 16 bp, Homo sapiens
tttattgaacttgaaa

SEQ ID NO: 1132337 - DNA, 15 bp, Homo sapiens
tttattgacacagaa

SEQ ID NO: 1132338 - DNA, 16 bp, Homo sapiens
tttattgactgggcaa

SEQ ID NO: 1132339 - DNA, 22 bp, Homo sapiens
tttattgactttgacaattact

SEQ ID NO: 1132340 - DNA, 23 bp, Homo sapiens
tttattgcatctgggtagctgta

SEQ ID NO: 1132341 - DNA, 13 bp, Homo sapiens
tttattgcttgtt

SEQ ID NO: 1132342 - DNA, 13 bp, Homo sapiens
tttattgtacaga

SEQ ID NO: 1132343 - DNA, 18 bp, Homo sapiens
tttattgtacagactgtt

SEQ ID NO: 1132344 - DNA, 21 bp, Homo sapiens
tttattgtacagactgtttta

SEQ ID NO: 1132345 - DNA, 22 bp, Homo sapiens
tttattgtcagttttgttcact

SEQ ID NO: 1132346 - DNA, 22 bp, Homo sapiens
tttattgtgtaattgatttata

SEQ ID NO: 1132347 - DNA, 15 bp, Homo sapiens
tttattgttaaatta

SEQ ID NO: 1132348 - DNA, 17 bp, Homo sapiens
tttattgttaaattaca

SEQ ID NO: 1132349 - DNA, 17 bp, Homo sapiens
tttatttaatgttatgt

SEQ ID NO: 1132350 - DNA, 16 bp, Homo sapiens
tttatttacaaatgtt

SEQ ID NO: 1132351 - DNA, 18 bp, Homo sapiens
tttatttacattttatat

SEQ ID NO: 1132352 - DNA, 16 bp, Homo sapiens
tttatttaggaaacac

SEQ ID NO: 1132353 - DNA, 15 bp, Homo sapiens
tttatttataaacta

SEQ ID NO: 1132354 - DNA, 15 bp, Homo sapiens
tttatttatcagtga

SEQ ID NO: 1132355 - DNA, 20 bp, Homo sapiens
tttatttccaatgtttcaag

SEQ ID NO: 1132356 - DNA, 20 bp, Homo sapiens
tttatttccactattttcaa

SEQ ID NO: 1132357 - DNA, 21 bp, Homo sapiens
tttatttctctggcaaacttt

SEQ ID NO: 1132358 - DNA, 13 bp, Homo sapiens
tttatttctttta

SEQ ID NO: 1132359 - DNA, 18 bp, Homo sapiens
tttatttgcttattttta

SEQ ID NO: 1132360 - DNA, 16 bp, Homo sapiens
tttatttgtaaattta

SEQ ID NO: 1132361 - DNA, 17 bp, Homo sapiens
tttatttgttctttttc

SEQ ID NO: 1132362 - DNA, 18 bp, Homo sapiens
tttatttgttgagagtgt

SEQ ID NO: 1132363 - DNA, 14 bp, Homo sapiens
tttatttgtttttc

SEQ ID NO: 1132364 - DNA, 19 bp, Homo sapiens
tttattttacagctcatta

SEQ ID NO: 1132365 - DNA, 15 bp, Homo sapiens
tttattttagcagtt

SEQ ID NO: 1132366 - DNA, 11 bp, Homo sapiens
tttattttata

SEQ ID NO: 1132367 - DNA, 21 bp, Homo sapiens
tttattttatataataaagta

SEQ ID NO: 1132368 - DNA, 22 bp, Homo sapiens
tttattttcagtcccctctctc

SEQ ID NO: 1132369 - DNA, 23 bp, Homo sapiens
tttattttcagtcccctctctct

SEQ ID NO: 1132370 - DNA, 12 bp, Homo sapiens
tttattttccta

SEQ ID NO: 1132371 - DNA, 14 bp, Homo sapiens
tttattttgacata

SEQ ID NO: 1132372 - DNA, 14 bp, Homo sapiens
tttattttgctccc

SEQ ID NO: 1132373 - DNA, 16 bp, Homo sapiens
tttattttgctccctc

SEQ ID NO: 1132374 - DNA, 21 bp, Homo sapiens
tttatttttaagaaaaattca

SEQ ID NO: 1132375 - DNA, 17 bp, Homo sapiens
tttatttttcatattgt

SEQ ID NO: 1132376 - DNA, 20 bp, Homo sapiens
tttatttttcatattgtgcc

SEQ ID NO: 1132377 - DNA, 17 bp, Homo sapiens
tttatttttctaagtgt

SEQ ID NO: 1132378 - DNA, 14 bp, Homo sapiens
tttatttttgcaaa

SEQ ID NO: 1132379 - DNA, 17 bp, Homo sapiens
tttattttttaaatgta

SEQ ID NO: 1132380 - DNA, 15 bp, Homo sapiens
tttattttttacatt

SEQ ID NO: 1132381 - DNA, 13 bp, Homo sapiens
tttattttttggg

SEQ ID NO: 1132382 - DNA, 16 bp, Homo sapiens
tttattttttgggcca

SEQ ID NO: 1132383 - DNA, 21 bp, Homo sapiens
tttattttttgggccattacc

SEQ ID NO: 1132384 - DNA, 17 bp, Homo sapiens
tttattttttttggcct

SEQ ID NO: 1132385 - DNA, 22 bp, Homo sapiens
tttcaaaaaaaaaaaaaaagac

SEQ ID NO: 1132386 - DNA, 13 bp, Homo sapiens
tttcaaaaaccag

SEQ ID NO: 1132387 - DNA, 17 bp, Homo sapiens
tttcaaaaaccagccag

SEQ ID NO: 1132388 - DNA, 18 bp, Homo sapiens
tttcaaaaccttttgaaa

SEQ ID NO: 1132389 - DNA, 21 bp, Homo sapiens
tttcaaaagaagacatctgtg

SEQ ID NO: 1132390 - DNA, 19 bp, Homo sapiens
tttcaaaatacatttgtaa

SEQ ID NO: 1132391 - DNA, 19 bp, Homo sapiens
tttcaaaatagaaaagtta

SEQ ID NO: 1132392 - DNA, 20 bp, Homo sapiens
tttcaaaatagaaaagttat

SEQ ID NO: 1132393 - DNA, 21 bp, Homo sapiens
tttcaaaatagaaaagttatt

SEQ ID NO: 1132394 - DNA, 13 bp, Homo sapiens
tttcaaaattaat

SEQ ID NO: 1132395 - DNA, 19 bp, Homo sapiens
tttcaaaattaatagcttt

SEQ ID NO: 1132396 - DNA, 22 bp, Homo sapiens
tttcaaacttactattttgaca

SEQ ID NO: 1132397 - DNA, 15 bp, Homo sapiens
tttcaaactttacta

SEQ ID NO: 1132398 - DNA, 21 bp, Homo sapiens
tttcaaagaaatccaaatttc

SEQ ID NO: 1132399 - DNA, 19 bp, Homo sapiens
tttcaaagccctgcctctg

SEQ ID NO: 1132400 - DNA, 21 bp, Homo sapiens
tttcaaagccctgcctctgtg

SEQ ID NO: 1132401 - DNA, 17 bp, Homo sapiens
tttcaaagggattgctt

SEQ ID NO: 1132402 - DNA, 16 bp, Homo sapiens
tttcaaatcattcctt

SEQ ID NO: 1132403 - DNA, 12 bp, Homo sapiens
tttcaaatcctt

SEQ ID NO: 1132404 - DNA, 14 bp, Homo sapiens
tttcaaatgtgctg

SEQ ID NO: 1132405 - DNA, 16 bp, Homo sapiens
tttcaaattgagagaa

SEQ ID NO: 1132406 - DNA, 20 bp, Homo sapiens
tttcaaatttagaaactaat

SEQ ID NO: 1132407 - DNA, 23 bp, Homo sapiens
tttcaaatttagaaactaattga

SEQ ID NO: 1132408 - DNA, 22 bp, Homo sapiens
tttcaacatttttttttctcca

SEQ ID NO: 1132409 - DNA, 20 bp, Homo sapiens
tttcaaccaactatttttga

SEQ ID NO: 1132410 - DNA, 19 bp, Homo sapiens
tttcaaccataaaagaagt

SEQ ID NO: 1132411 - DNA, 15 bp, Homo sapiens
tttcaactaatgtgt

SEQ ID NO: 1132412 - DNA, 22 bp, Homo sapiens
tttcaactaatgtgtattatgt

SEQ ID NO: 1132413 - DNA, 13 bp, Homo sapiens
tttcaagaaaatc

SEQ ID NO: 1132414 - DNA, 15 bp, Homo sapiens
tttcaagaacctgga

SEQ ID NO: 1132415 - DNA, 21 bp, Homo sapiens
tttcaagagtctaatagtctt

SEQ ID NO: 1132416 - DNA, 22 bp, Homo sapiens
tttcaagagtctaatagtcttt

SEQ ID NO: 1132417 - DNA, 23 bp, Homo sapiens
tttcaagcagtcgtgcctgtgtc

SEQ ID NO: 1132418 - DNA, 22 bp, Homo sapiens
tttcaagcctgcctaggaattc

SEQ ID NO: 1132419 - DNA, 16 bp, Homo sapiens
tttcaagcggtgccta

SEQ ID NO: 1132420 - DNA, 15 bp, Homo sapiens
tttcaaggactattt

SEQ ID NO: 1132421 - DNA, 18 bp, Homo sapiens
tttcaaggatgtttttct

SEQ ID NO: 1132422 - DNA, 12 bp, Homo sapiens
tttcaaggcctt

SEQ ID NO: 1132423 - DNA, 23 bp, Homo sapiens
tttcaagtgcctttctgcagttt

SEQ ID NO: 1132424 - DNA, 14 bp, Homo sapiens
tttcaagttattca

SEQ ID NO: 1132425 - DNA, 18 bp, Homo sapiens
tttcaagttattcaaatt

SEQ ID NO: 1132426 - DNA, 22 bp, Homo sapiens
tttcaagttccaagttgctaat

SEQ ID NO: 1132427 - DNA, 11 bp, Homo sapiens
tttcaagttta

SEQ ID NO: 1132428 - DNA, 17 bp, Homo sapiens
tttcaagttttaaagtt

SEQ ID NO: 1132429 - DNA, 19 bp, Homo sapiens
tttcaataaagcatttata

SEQ ID NO: 1132430 - DNA, 22 bp, Homo sapiens
tttcaataaattgttttttaat

SEQ ID NO: 1132431 - DNA, 18 bp, Homo sapiens
tttcaataacaaagcaca

SEQ ID NO: 1132432 - DNA, 13 bp, Homo sapiens
tttcaatatgcaa

SEQ ID NO: 1132433 - DNA, 18 bp, Homo sapiens
tttcaatcaactttactg

SEQ ID NO: 1132434 - DNA, 20 bp, Homo sapiens
tttcaatcaactttactgta

SEQ ID NO: 1132435 - DNA, 22 bp, Homo sapiens
tttcaatcaactttactgtaat

SEQ ID NO: 1132436 - DNA, 13 bp, Homo sapiens
tttcaatcattga

SEQ ID NO: 1132437 - DNA, 16 bp, Homo sapiens
tttcaatgtagtctgt

SEQ ID NO: 1132438 - DNA, 14 bp, Homo sapiens
tttcaatgtgattc

SEQ ID NO: 1132439 - DNA, 19 bp, Homo sapiens
tttcaatgtgtataaattg

SEQ ID NO: 1132440 - DNA, 19 bp, Homo sapiens
tttcaattctgtaattaca

SEQ ID NO: 1132441 - DNA, 15 bp, Homo sapiens
tttcaattgacaaat

SEQ ID NO: 1132442 - DNA, 21 bp, Homo sapiens
tttcaatttggagcattaact

SEQ ID NO: 1132443 - DNA, 16 bp, Homo sapiens
tttcaatttgtcatgt

SEQ ID NO: 1132444 - DNA, 15 bp, Homo sapiens
tttcaattttaaaca

SEQ ID NO: 1132445 - DNA, 13 bp, Homo sapiens
tttcacaagcaac

SEQ ID NO: 1132446 - DNA, 16 bp, Homo sapiens
tttcacacaaacaagg

SEQ ID NO: 1132447 - DNA, 13 bp, Homo sapiens
tttcacactggat

SEQ ID NO: 1132448 - DNA, 21 bp, Homo sapiens
tttcacactggtaaatgttac

SEQ ID NO: 1132449 - DNA, 23 bp, Homo sapiens
tttcacagagcacgcctgccatc

SEQ ID NO: 1132450 - DNA, 12 bp, Homo sapiens
tttcatagatgt

SEQ ID NO: 1132451 - DNA, 21 bp, Homo sapiens
tttcatagtgcctttttcctt

SEQ ID NO: 1132452 - DNA, 21 bp, Homo sapiens
tttcatagtgtcaagaaggaa

SEQ ID NO: 1132453 - DNA, 15 bp, Homo sapiens
tttcatatagttagc

SEQ ID NO: 1132454 - DNA, 15 bp, Homo sapiens
tttcatatcatttct

SEQ ID NO: 1132455 - DNA, 12 bp, Homo sapiens
tttcatcactgg

SEQ ID NO: 1132456 - DNA, 13 bp, Homo sapiens
tttcatcatttca

SEQ ID NO: 1132457 - DNA, 15 bp, Homo sapiens
tttcatcatttcagc

SEQ ID NO: 1132458 - DNA, 19 bp, Homo sapiens
tttcatcatttcagccaaa

SEQ ID NO: 1132459 - DNA, 17 bp, Homo sapiens
tttcatccagtttgttc

SEQ ID NO: 1132460 - DNA, 22 bp, Homo sapiens
tttcatccagtttgttctccgg

SEQ ID NO: 1132461 - DNA, 16 bp, Homo sapiens
tttcatccataactga

SEQ ID NO: 1132462 - DNA, 20 bp, Homo sapiens
tttcatccataactgaacat

SEQ ID NO: 1132463 - DNA, 13 bp, Homo sapiens
tttcatcctggcc

SEQ ID NO: 1132464 - DNA, 14 bp, Homo sapiens
tttcatcctgtgtc

SEQ ID NO: 1132465 - DNA, 13 bp, Homo sapiens
tttcatctatttc

SEQ ID NO: 1132466 - DNA, 19 bp, Homo sapiens
tttcatctctctacctcca

SEQ ID NO: 1132467 - DNA, 18 bp, Homo sapiens
tttcatctgggaaagaca

SEQ ID NO: 1132468 - DNA, 12 bp, Homo sapiens
tttcatctgggt

SEQ ID NO: 1132469 - DNA, 18 bp, Homo sapiens
tttcatctgggtggtctg

SEQ ID NO: 1132470 - DNA, 18 bp, Homo sapiens
tttcatctgttgttctgt

SEQ ID NO: 1132471 - DNA, 15 bp, Homo sapiens
tttcatcttaaacta

SEQ ID NO: 1132472 - DNA, 17 bp, Homo sapiens
tttcatcttcagttgtc

SEQ ID NO: 1132473 - DNA, 22 bp, Homo sapiens
tttcatcttcagttgtctctga

SEQ ID NO: 1132474 - DNA, 23 bp, Homo sapiens
tttcatgaccactgggcctgcta

SEQ ID NO: 1132475 - DNA, 16 bp, Homo sapiens
tttcatgattagaaat

SEQ ID NO: 1132476 - DNA, 13 bp, Homo sapiens
tttcatggacact

SEQ ID NO: 1132477 - DNA, 20 bp, Homo sapiens
tttcatggtgaaaatgtact

SEQ ID NO: 1132478 - DNA, 18 bp, Homo sapiens
tttcatgtacaagatgaa

SEQ ID NO: 1132479 - DNA, 21 bp, Homo sapiens
tttcatgtagaactcagcagt

SEQ ID NO: 1132480 - DNA, 17 bp, Homo sapiens
tttcatgtcttgtcata

SEQ ID NO: 1132481 - DNA, 16 bp, Homo sapiens
tttcatgttttgtgac

SEQ ID NO: 1132482 - DNA, 16 bp, Homo sapiens
tttcattaaacttgaa

SEQ ID NO: 1132483 - DNA, 14 bp, Homo sapiens
tttcattaaataaa

SEQ ID NO: 1132484 - DNA, 18 bp, Homo sapiens
tttcattaaataaatttg

SEQ ID NO: 1132485 - DNA, 18 bp, Homo sapiens
tttcattagcagttgctc

SEQ ID NO: 1132486 - DNA, 22 bp, Homo sapiens
tttcattagcagttgctcacat

SEQ ID NO: 1132487 - DNA, 14 bp, Homo sapiens
tttcattaggcaaa

SEQ ID NO: 1132488 - DNA, 17 bp, Homo sapiens
tttcattaggcaaagta

SEQ ID NO: 1132489 - DNA, 20 bp, Homo sapiens
tttcattatgttcatgtaag

SEQ ID NO: 1132490 - DNA, 13 bp, Homo sapiens
tttcattattagt

SEQ ID NO: 1132491 - DNA, 21 bp, Homo sapiens
tttcattattagtactgctct

SEQ ID NO: 1132492 - DNA, 21 bp, Homo sapiens
tttcattcaaatcagtgatct

SEQ ID NO: 1132493 - DNA, 15 bp, Homo sapiens
tttcattcatcctga

SEQ ID NO: 1132494 - DNA, 12 bp, Homo sapiens
tttcattccatt

SEQ ID NO: 1132495 - DNA, 17 bp, Homo sapiens
tttcattccattgccta

SEQ ID NO: 1132496 - DNA, 12 bp, Homo sapiens
tttcattccctg

SEQ ID NO: 1132497 - DNA, 16 bp, Homo sapiens
tttcattcggtgtgaa

SEQ ID NO: 1132498 - DNA, 21 bp, Homo sapiens
tttcattcggtgtgaactttt

SEQ ID NO: 1132499 - DNA, 14 bp, Homo sapiens
tttcattcttctca

SEQ ID NO: 1132500 - DNA, 17 bp, Homo sapiens
tttcattgattatatgg

SEQ ID NO: 1132501 - DNA, 17 bp, Homo sapiens
tttcattgcctgtgtat

SEQ ID NO: 1132502 - DNA, 22 bp, Homo sapiens
tttcattgctgggcttgtctgt

SEQ ID NO: 1132503 - DNA, 20 bp, Homo sapiens
tttcattgtatgatgtgttg

SEQ ID NO: 1132504 - DNA, 13 bp, Homo sapiens
tttcattgtgatt

SEQ ID NO: 1132505 - DNA, 18 bp, Homo sapiens
tttcattgtgatttatat

SEQ ID NO: 1132506 - DNA, 22 bp, Homo sapiens
tttcattgtgatttatatataa

SEQ ID NO: 1132507 - DNA, 19 bp, Homo sapiens
tttcatttagtcatgtgac

SEQ ID NO: 1132508 - DNA, 17 bp, Homo sapiens
tttcatttatctataat

SEQ ID NO: 1132509 - DNA, 22 bp, Homo sapiens
tttcatttcttacgttctttca

SEQ ID NO: 1132510 - DNA, 11 bp, Homo sapiens
tttcatttgta

SEQ ID NO: 1132511 - DNA, 15 bp, Homo sapiens
tttcatttgtaaaaa

SEQ ID NO: 1132512 - DNA, 17 bp, Homo sapiens
tttcatttgtaaaaatg

SEQ ID NO: 1132513 - DNA, 16 bp, Homo sapiens
tttcatttgttttgct

SEQ ID NO: 1132514 - DNA, 17 bp, Homo sapiens
tttcattttaaaaagtc

SEQ ID NO: 1132515 - DNA, 16 bp, Homo sapiens
tttcattttgaaaagt

SEQ ID NO: 1132516 - DNA, 18 bp, Homo sapiens
tttcattttgaaaagtat

SEQ ID NO: 1132517 - DNA, 22 bp, Homo sapiens
tttccaaaacaaaaagatgtct

SEQ ID NO: 1132518 - DNA, 15 bp, Homo sapiens
tttccaaagtacact

SEQ ID NO: 1132519 - DNA, 23 bp, Homo sapiens
tttccaaatgatcctagtaattg

SEQ ID NO: 1132520 - DNA, 18 bp, Homo sapiens
tttccaaattattaattg

SEQ ID NO: 1132521 - DNA, 22 bp, Homo sapiens
tttccaaattatttcttaatta

SEQ ID NO: 1132522 - DNA, 15 bp, Homo sapiens
tttccaacaccacag

SEQ ID NO: 1132523 - DNA, 22 bp, Homo sapiens
tttccaacaccacagacacaca

SEQ ID NO: 1132524 - DNA, 11 bp, Homo sapiens
tttccaacagc

SEQ ID NO: 1132525 - DNA, 12 bp, Homo sapiens
tttccaactact

SEQ ID NO: 1132526 - DNA, 18 bp, Homo sapiens
tttccaactactaataga

SEQ ID NO: 1132527 - DNA, 16 bp, Homo sapiens
tttccaactggcactc

SEQ ID NO: 1132528 - DNA, 19 bp, Homo sapiens
tttccaagcctctctggca

SEQ ID NO: 1132529 - DNA, 23 bp, Homo sapiens
tttccaccacagccagcacctgg

SEQ ID NO: 1132530 - DNA, 13 bp, Homo sapiens
tttccactactgc

SEQ ID NO: 1132531 - DNA, 14 bp, Homo sapiens
tttccactactgct

SEQ ID NO: 1132532 - DNA, 19 bp, Homo sapiens
tttccactattttcaaaga

SEQ ID NO: 1132533 - DNA, 15 bp, Homo sapiens
tttccactccaagat

SEQ ID NO: 1132534 - DNA, 16 bp, Homo sapiens
tttccactccattgtc

SEQ ID NO: 1132535 - DNA, 23 bp, Homo sapiens
tttccactggcttttgcctgtaa

SEQ ID NO: 1132536 - DNA, 12 bp, Homo sapiens
tttccactttgt

SEQ ID NO: 1132537 - DNA, 23 bp, Homo sapiens
tttccactttgttctttaggaga

SEQ ID NO: 1132538 - DNA, 18 bp, Homo sapiens
tttccagagttgttgttt

SEQ ID NO: 1132539 - DNA, 17 bp, Homo sapiens
tttccagatttggggta

SEQ ID NO: 1132540 - DNA, 22 bp, Homo sapiens
tttccagcctcctgctggctct

SEQ ID NO: 1132541 - DNA, 17 bp, Homo sapiens
tttccaggaaaaaataa

SEQ ID NO: 1132542 - DNA, 21 bp, Homo sapiens
tttccaggaaaaaataaaaag

SEQ ID NO: 1132543 - DNA, 19 bp, Homo sapiens
tttccaggcccctgaggac

SEQ ID NO: 1132544 - DNA, 19 bp, Homo sapiens
tttccaggtttaagctgtt

SEQ ID NO: 1132545 - DNA, 15 bp, Homo sapiens
tttccagtattgaaa

SEQ ID NO: 1132546 - DNA, 21 bp, Homo sapiens
tttccagtattgaaaacttca

SEQ ID NO: 1132547 - DNA, 18 bp, Homo sapiens
tttccagtctcttgtaca

SEQ ID NO: 1132548 - DNA, 17 bp, Homo sapiens
tttccagttcctctttt

SEQ ID NO: 1132549 - DNA, 18 bp, Homo sapiens
tttccagttgctgtggac

SEQ ID NO: 1132550 - DNA, 24 bp, Homo sapiens
tttccataagcttggtgacaaaat

SEQ ID NO: 1132551 - DNA, 14 bp, Homo sapiens
tttccatatagtct

SEQ ID NO: 1132552 - DNA, 18 bp, Homo sapiens
tttccatatggattttct

SEQ ID NO: 1132553 - DNA, 22 bp, Homo sapiens
tttccatatggattttctattg

SEQ ID NO: 1132554 - DNA, 16 bp, Homo sapiens
tttccatcatgtctgt

SEQ ID NO: 1132555 - DNA, 11 bp, Homo sapiens
tttccatctta

SEQ ID NO: 1132556 - DNA, 21 bp, Homo sapiens
tttccatgcagactcctcaga

SEQ ID NO: 1132557 - DNA, 19 bp, Homo sapiens
tttccatggcaaatgggca

SEQ ID NO: 1132558 - DNA, 23 bp, Homo sapiens
tttccatgggcccgctgcctctt

SEQ ID NO: 1132559 - DNA, 14 bp, Homo sapiens
tttccatgttgctg

SEQ ID NO: 1132560 - DNA, 15 bp, Homo sapiens
tttccattagaacaa

SEQ ID NO: 1132561 - DNA, 14 bp, Homo sapiens
tttccattccataa

SEQ ID NO: 1132562 - DNA, 21 bp, Homo sapiens
tttccattggtttacctgtga

SEQ ID NO: 1132563 - DNA, 13 bp, Homo sapiens
tttccatttacta

SEQ ID NO: 1132564 - DNA, 13 bp, Homo sapiens
tttccatttattt

SEQ ID NO: 1132565 - DNA, 14 bp, Homo sapiens
tttccatttctcaa

SEQ ID NO: 1132566 - DNA, 13 bp, Homo sapiens
tttccatttctga

SEQ ID NO: 1132567 - DNA, 18 bp, Homo sapiens
tttccatttctgatgtct

SEQ ID NO: 1132568 - DNA, 14 bp, Homo sapiens
tttcccaaagcact

SEQ ID NO: 1132569 - DNA, 22 bp, Homo sapiens
tttcccaaagtcctctgctcca

SEQ ID NO: 1132570 - DNA, 12 bp, Homo sapiens
tttcccaattca

SEQ ID NO: 1132571 - DNA, 15 bp, Homo sapiens
tttcccagttaaaga

SEQ ID NO: 1132572 - DNA, 15 bp, Homo sapiens
tttctctgaacacat

SEQ ID NO: 1132573 - DNA, 11 bp, Homo sapiens
tttctctgaga

SEQ ID NO: 1132574 - DNA, 12 bp, Homo sapiens
tttctctgagca

SEQ ID NO: 1132575 - DNA, 13 bp, Homo sapiens
tttctctgcagaa

SEQ ID NO: 1132576 - DNA, 17 bp, Homo sapiens
tttctctgcctctgggc

SEQ ID NO: 1132577 - DNA, 13 bp, Homo sapiens
tttctctgctctt

SEQ ID NO: 1132578 - DNA, 21 bp, Homo sapiens
tttctctgctcttgtttcact

SEQ ID NO: 1132579 - DNA, 9 bp, Homo sapiens
tttctctgg

SEQ ID NO: 1132580 - DNA, 20 bp, Homo sapiens
tttctctggtggtcttcctt

SEQ ID NO: 1132581 - DNA, 16 bp, Homo sapiens
tttctctgtacttttc

SEQ ID NO: 1132582 - DNA, 16 bp, Homo sapiens
tttctctgtgctctga

SEQ ID NO: 1132583 - DNA, 17 bp, Homo sapiens
tttctctgtgtttgttc

SEQ ID NO: 1132584 - DNA, 14 bp, Homo sapiens
tttctcttacctgt

SEQ ID NO: 1132585 - DNA, 21 bp, Homo sapiens
tttctcttctcagctcttcca

SEQ ID NO: 1132586 - DNA, 16 bp, Homo sapiens
tttctcttctgtccat

SEQ ID NO: 1132587 - DNA, 17 bp, Homo sapiens
tttctcttgagctggcc

SEQ ID NO: 1132588 - DNA, 11 bp, Homo sapiens
tttctcttggg

SEQ ID NO: 1132589 - DNA, 23 bp, Homo sapiens
tttctctttgtctgccttcccaa

SEQ ID NO: 1132590 - DNA, 16 bp, Homo sapiens
tttctcttttaaaata

SEQ ID NO: 1132591 - DNA, 21 bp, Homo sapiens
tttctcttttcccctttcctg

SEQ ID NO: 1132592 - DNA, 22 bp, Homo sapiens
tttctcttttcccctttcctgt

SEQ ID NO: 1132593 - DNA, 19 bp, Homo sapiens
tttctcttttgctttctgt

SEQ ID NO: 1132594 - DNA, 12 bp, Homo sapiens
tttctgaaaaca

SEQ ID NO: 1132595 - DNA, 16 bp, Homo sapiens
tttctgaaaatataac

SEQ ID NO: 1132596 - DNA, 21 bp, Homo sapiens
tttctgaaaatgtttaagtat

SEQ ID NO: 1132597 - DNA, 13 bp, Homo sapiens
tttctgaaacaca

SEQ ID NO: 1132598 - DNA, 18 bp, Homo sapiens
tttctgaaagtaaaacaa

SEQ ID NO: 1132599 - DNA, 18 bp, Homo sapiens
tttctgaagctttaccag

SEQ ID NO: 1132600 - DNA, 19 bp, Homo sapiens
tttctgaaggtagcattct

SEQ ID NO: 1132601 - DNA, 10 bp, Homo sapiens
tttctgaata

SEQ ID NO: 1132602 - DNA, 11 bp, Homo sapiens
tttctgaataa

SEQ ID NO: 1132603 - DNA, 21 bp, Homo sapiens
tttctgaataaaaaagattct

SEQ ID NO: 1132604 - DNA, 12 bp, Homo sapiens
tttctgaattgt

SEQ ID NO: 1132605 - DNA, 12 bp, Homo sapiens
tttctgacacaa

SEQ ID NO: 1132606 - DNA, 13 bp, Homo sapiens
tttctgacagttt

SEQ ID NO: 1132607 - DNA, 19 bp, Homo sapiens
tttctgacatcaaaacttg

SEQ ID NO: 1132608 - DNA, 16 bp, Homo sapiens
tttctgagaaggtcct

SEQ ID NO: 1132609 - DNA, 14 bp, Homo sapiens
tttctgagcgatta

SEQ ID NO: 1132610 - DNA, 19 bp, Homo sapiens
tttctgagcttttcatgga

SEQ ID NO: 1132611 - DNA, 24 bp, Homo sapiens
tttctgataaagttccttaagcat

SEQ ID NO: 1132612 - DNA, 12 bp, Homo sapiens
tttctgatgatg

SEQ ID NO: 1132613 - DNA, 13 bp, Homo sapiens
tttctgatgatgt

SEQ ID NO: 1132614 - DNA, 23 bp, Homo sapiens
tttctgatgtattacatgactgt

SEQ ID NO: 1132615 - DNA, 14 bp, Homo sapiens
tttctgatgtctcc

SEQ ID NO: 1132616 - DNA, 14 bp, Homo sapiens
tttctgattctttt

SEQ ID NO: 1132617 - DNA, 15 bp, Homo sapiens
tttctgattggtgat

SEQ ID NO: 1132618 - DNA, 17 bp, Homo sapiens
tttctgcaccccaattg

SEQ ID NO: 1132619 - DNA, 14 bp, Homo sapiens
tttctgcagaaaca

SEQ ID NO: 1132620 - DNA, 17 bp, Homo sapiens
tttctgcatatgttgaa

SEQ ID NO: 1132621 - DNA, 13 bp, Homo sapiens
tttctgcattttg

SEQ ID NO: 1132622 - DNA, 18 bp, Homo sapiens
tttctgcattttgctatt

SEQ ID NO: 1132623 - DNA, 16 bp, Homo sapiens
tttctgccagggagct

SEQ ID NO: 1132624 - DNA, 18 bp, Homo sapiens
tttctgccccccagggct

SEQ ID NO: 1132625 - DNA, 14 bp, Homo sapiens
tttctgccctggct

SEQ ID NO: 1132626 - DNA, 15 bp, Homo sapiens
tttctgccttagcct

SEQ ID NO: 1132627 - DNA, 19 bp, Homo sapiens
tttctgctcagcttctcct

SEQ ID NO: 1132628 - DNA, 22 bp, Homo sapiens
tttctgctctggaataaagttg

SEQ ID NO: 1132629 - DNA, 16 bp, Homo sapiens
tttctgctgtttaagg

SEQ ID NO: 1132630 - DNA, 20 bp, Homo sapiens
tttctggaaattttgtccat

SEQ ID NO: 1132631 - DNA, 13 bp, Homo sapiens
tttctggaagact

SEQ ID NO: 1132632 - DNA, 18 bp, Homo sapiens
tttctggaatgtaatcaa

SEQ ID NO: 1132633 - DNA, 17 bp, Homo sapiens
tttctggactctggact

SEQ ID NO: 1132634 - DNA, 23 bp, Homo sapiens
tttctggactgaagcctgcagga

SEQ ID NO: 1132635 - DNA, 15 bp, Homo sapiens
tttctggattctggg

SEQ ID NO: 1132636 - DNA, 21 bp, Homo sapiens
tttctggccaaaagcagtaaa

SEQ ID NO: 1132637 - DNA, 11 bp, Homo sapiens
tttctggcctg

SEQ ID NO: 1132638 - DNA, 22 bp, Homo sapiens
tttctggcgcccctgcctgtgc

SEQ ID NO: 1132639 - DNA, 19 bp, Homo sapiens
tttctggctatgcatttga

SEQ ID NO: 1132640 - DNA, 19 bp, Homo sapiens
tttctgggctttctcctgg

SEQ ID NO: 1132641 - DNA, 21 bp, Homo sapiens
tttctggggaattactttcct

SEQ ID NO: 1132642 - DNA, 14 bp, Homo sapiens
tttctggggcctag

SEQ ID NO: 1132643 - DNA, 20 bp, Homo sapiens
tttctggggggatatttcct

SEQ ID NO: 1132644 - DNA, 23 bp, Homo sapiens
tttctgggtctcccactttctgt

SEQ ID NO: 1132645 - DNA, 23 bp, Homo sapiens
tttctggtaggaagatggaggtt

SEQ ID NO: 1132646 - DNA, 15 bp, Homo sapiens
tttctggtccctctt

SEQ ID NO: 1132647 - DNA, 16 bp, Homo sapiens
tttctggtttggcatg

SEQ ID NO: 1132648 - DNA, 23 bp, Homo sapiens
tttctgtaattcaggtttttcct

SEQ ID NO: 1132649 - DNA, 21 bp, Homo sapiens
tttctgtatatgattctctgt

SEQ ID NO: 1132650 - DNA, 15 bp, Homo sapiens
tttctgtatatttgt

SEQ ID NO: 1132651 - DNA, 18 bp, Homo sapiens
tttctgtatatttgtcat

SEQ ID NO: 1132652 - DNA, 19 bp, Homo sapiens
tttctgtcacagtaaaaat

SEQ ID NO: 1132653 - DNA, 17 bp, Homo sapiens
tttctgtcagatgagaa

SEQ ID NO: 1132654 - DNA, 23 bp, Homo sapiens
tttctgtcagatgagaacaaagc

SEQ ID NO: 1132655 - DNA, 17 bp, Homo sapiens
tttctgtcagtaaaact

SEQ ID NO: 1132656 - DNA, 18 bp, Homo sapiens
tttctgtcagtaaaactc

SEQ ID NO: 1132657 - DNA, 19 bp, Homo sapiens
tttctgtcagtaaaactct

SEQ ID NO: 1132658 - DNA, 14 bp, Homo sapiens
tttctgtcctgtaa

SEQ ID NO: 1132659 - DNA, 15 bp, Homo sapiens
tttctgtgacattta

SEQ ID NO: 1132660 - DNA, 16 bp, Homo sapiens
tttctgtgacatttat

SEQ ID NO: 1132661 - DNA, 17 bp, Homo sapiens
tttctgtgcctgaatat

SEQ ID NO: 1132662 - DNA, 16 bp, Homo sapiens
tttctgtgcttggatt

SEQ ID NO: 1132663 - DNA, 18 bp, Homo sapiens
tttctgtgtagaaactgg

SEQ ID NO: 1132664 - DNA, 21 bp, Homo sapiens
tttctgttatttttaagcttt

SEQ ID NO: 1132665 - DNA, 12 bp, Homo sapiens
tttctgttccaa

SEQ ID NO: 1132666 - DNA, 15 bp, Homo sapiens
tttctgttccaaatt

SEQ ID NO: 1132667 - DNA, 19 bp, Homo sapiens
tttctgttcttacaaatgt

SEQ ID NO: 1132668 - DNA, 14 bp, Homo sapiens
tttctgttgccaca

SEQ ID NO: 1132669 - DNA, 17 bp, Homo sapiens
tttctgttgtcattgct

SEQ ID NO: 1132670 - DNA, 12 bp, Homo sapiens
tttctgtttata

SEQ ID NO: 1132671 - DNA, 21 bp, Homo sapiens
tttctgtttataattgtttat

SEQ ID NO: 1132672 - DNA, 16 bp, Homo sapiens
tttctgtttgattctt

SEQ ID NO: 1132673 - DNA, 14 bp, Homo sapiens
tttctgtttgtaaa

SEQ ID NO: 1132674 - DNA, 16 bp, Homo sapiens
tttctgtttgtaaatt

SEQ ID NO: 1132675 - DNA, 23 bp, Homo sapiens
tttctgtttgtttaagctgagcc

SEQ ID NO: 1132676 - DNA, 15 bp, Homo sapiens
tttcttaaaagtact

SEQ ID NO: 1132677 - DNA, 22 bp, Homo sapiens
tttcttaaaagtactttaaaaa

SEQ ID NO: 1132678 - DNA, 13 bp, Homo sapiens
tttcttaaagtgc

SEQ ID NO: 1132679 - DNA, 17 bp, Homo sapiens
tttcttaaagtgccagt

SEQ ID NO: 1132680 - DNA, 13 bp, Homo sapiens
tttcttaaataag

SEQ ID NO: 1132681 - DNA, 20 bp, Homo sapiens
tttcttaaataagaaacttt

SEQ ID NO: 1132682 - DNA, 21 bp, Homo sapiens
tttcttaaataagaaactttt

SEQ ID NO: 1132683 - DNA, 21 bp, Homo sapiens
tttcttaaataatgcttcaga

SEQ ID NO: 1132684 - DNA, 23 bp, Homo sapiens
tttcttaaataatgcttcagata

SEQ ID NO: 1132685 - DNA, 15 bp, Homo sapiens
tttcttaaccatctt

SEQ ID NO: 1132686 - DNA, 14 bp, Homo sapiens
tttcttaacttctt

SEQ ID NO: 1132687 - DNA, 18 bp, Homo sapiens
tttcttaacttcttgctt

SEQ ID NO: 1132688 - DNA, 18 bp, Homo sapiens
tttcttaaggaattttgt

SEQ ID NO: 1132689 - DNA, 21 bp, Homo sapiens
tttcttaagtaatgatactgt

SEQ ID NO: 1132690 - DNA, 21 bp, Homo sapiens
tttcttaattattataaaaat

SEQ ID NO: 1132691 - DNA, 23 bp, Homo sapiens
tttcttaattattataaaaatat

SEQ ID NO: 1132692 - DNA, 18 bp, Homo sapiens
tttcttacccaatttccc

SEQ ID NO: 1132693 - DNA, 17 bp, Homo sapiens
tttcttactcctcctct

SEQ ID NO: 1132694 - DNA, 12 bp, Homo sapiens
tttgatctctgc

SEQ ID NO: 1132695 - DNA, 16 bp, Homo sapiens
tttgatctttgtttaa

SEQ ID NO: 1132696 - DNA, 14 bp, Homo sapiens
tttgatctttttat

SEQ ID NO: 1132697 - DNA, 14 bp, Homo sapiens
tttgatgagaaaaa

SEQ ID NO: 1132698 - DNA, 21 bp, Homo sapiens
tttgatgaggtattttttcct

SEQ ID NO: 1132699 - DNA, 22 bp, Homo sapiens
tttgatgatgtctacagaaaat

SEQ ID NO: 1132700 - DNA, 22 bp, Homo sapiens
tttgatgattttcatttcatga

SEQ ID NO: 1132701 - DNA, 18 bp, Homo sapiens
tttgatgctatttatgca

SEQ ID NO: 1132702 - DNA, 16 bp, Homo sapiens
tttgatgctggagagg

SEQ ID NO: 1132703 - DNA, 20 bp, Homo sapiens
tttgatggagggtggaaata

SEQ ID NO: 1132704 - DNA, 14 bp, Homo sapiens
tttgatggggagaa

SEQ ID NO: 1132705 - DNA, 17 bp, Homo sapiens
tttgatggggagaaagg

SEQ ID NO: 1132706 - DNA, 12 bp, Homo sapiens
tttgatgtacat

SEQ ID NO: 1132707 - DNA, 10 bp, Homo sapiens
tttgatgtat

SEQ ID NO: 1132708 - DNA, 12 bp, Homo sapiens
tttgatgtatgt

SEQ ID NO: 1132709 - DNA, 21 bp, Homo sapiens
tttgatgtatgtgtgaaacaa

SEQ ID NO: 1132710 - DNA, 17 bp, Homo sapiens
tttgatgtttgtggcct

SEQ ID NO: 1132711 - DNA, 19 bp, Homo sapiens
tttgatgtttgtggcctca

SEQ ID NO: 1132712 - DNA, 20 bp, Homo sapiens
tttgattaagtggttacttt

SEQ ID NO: 1132713 - DNA, 22 bp, Homo sapiens
tttgattatttgcatgttatgt

SEQ ID NO: 1132714 - DNA, 22 bp, Homo sapiens
tttgattcaaaatatttaaaaa

SEQ ID NO: 1132715 - DNA, 17 bp, Homo sapiens
tttgattcagctcatta

SEQ ID NO: 1132716 - DNA, 22 bp, Homo sapiens
tttgattcagctcattatgaaa

SEQ ID NO: 1132717 - DNA, 19 bp, Homo sapiens
tttgattcattttcctgtt

SEQ ID NO: 1132718 - DNA, 20 bp, Homo sapiens
tttgattcattttcctgttc

SEQ ID NO: 1132719 - DNA, 15 bp, Homo sapiens
tttgattgatttgaa

SEQ ID NO: 1132720 - DNA, 19 bp, Homo sapiens
tttgattgctttgctgcac

SEQ ID NO: 1132721 - DNA, 14 bp, Homo sapiens
tttgatttcaacat

SEQ ID NO: 1132722 - DNA, 12 bp, Homo sapiens
tttgatttctaa

SEQ ID NO: 1132723 - DNA, 14 bp, Homo sapiens
tttgatttctaatt

SEQ ID NO: 1132724 - DNA, 17 bp, Homo sapiens
tttgatttgaatgtaaa

SEQ ID NO: 1132725 - DNA, 22 bp, Homo sapiens
tttgatttttttaaagtagttc

SEQ ID NO: 1132726 - DNA, 18 bp, Homo sapiens
tttgcaaaaaatgttttt

SEQ ID NO: 1132727 - DNA, 12 bp, Homo sapiens
tttgcaaaattt

SEQ ID NO: 1132728 - DNA, 17 bp, Homo sapiens
tttgcaaaccctttgta

SEQ ID NO: 1132729 - DNA, 18 bp, Homo sapiens
tttgcaaaccctttgtat

SEQ ID NO: 1132730 - DNA, 20 bp, Homo sapiens
tttgcaaaccctttgtatta

SEQ ID NO: 1132731 - DNA, 19 bp, Homo sapiens
tttgcaaagtattgtaaat

SEQ ID NO: 1132732 - DNA, 22 bp, Homo sapiens
tttgcaaagtattgtaaattat

SEQ ID NO: 1132733 - DNA, 16 bp, Homo sapiens
tttgcaaattatttat

SEQ ID NO: 1132734 - DNA, 19 bp, Homo sapiens
tttgcaacagtaatcagag

SEQ ID NO: 1132735 - DNA, 22 bp, Homo sapiens
tttgcaacagtaatcagagtta

SEQ ID NO: 1132736 - DNA, 14 bp, Homo sapiens
tttgcaaccaggaa

SEQ ID NO: 1132737 - DNA, 23 bp, Homo sapiens
tttgcaaccaggaacagcaaatg

SEQ ID NO: 1132738 - DNA, 20 bp, Homo sapiens
tttgcaactaggtatttcta

SEQ ID NO: 1132739 - DNA, 17 bp, Homo sapiens
tttgcaacttaatactc

SEQ ID NO: 1132740 - DNA, 13 bp, Homo sapiens
tttgcaagtgaag

SEQ ID NO: 1132741 - DNA, 22 bp, Homo sapiens
tttgcaagtgaaggtttacaat

SEQ ID NO: 1132742 - DNA, 16 bp, Homo sapiens
tttgcaataacagctg

SEQ ID NO: 1132743 - DNA, 17 bp, Homo sapiens
tttgcaataacagctgc

SEQ ID NO: 1132744 - DNA, 19 bp, Homo sapiens
tttgcaataacttctatat

SEQ ID NO: 1132745 - DNA, 14 bp, Homo sapiens
tttgcaattcatgt

SEQ ID NO: 1132746 - DNA, 19 bp, Homo sapiens
tttgcaattgctcttctcc

SEQ ID NO: 1132747 - DNA, 16 bp, Homo sapiens
tttgcacaatatttct

SEQ ID NO: 1132748 - DNA, 19 bp, Homo sapiens
tttgcacatgtttcctcta

SEQ ID NO: 1132749 - DNA, 15 bp, Homo sapiens
tttgcaccaaagaca

SEQ ID NO: 1132750 - DNA, 16 bp, Homo sapiens
tttgcaccaaagacat

SEQ ID NO: 1132751 - DNA, 15 bp, Homo sapiens
tttgcacccctccca

SEQ ID NO: 1132752 - DNA, 23 bp, Homo sapiens
tttgcacccctttcctccccata

SEQ ID NO: 1132753 - DNA, 13 bp, Homo sapiens
tttgcacctctgt

SEQ ID NO: 1132754 - DNA, 16 bp, Homo sapiens
tttgcacctttctagt

SEQ ID NO: 1132755 - DNA, 17 bp, Homo sapiens
tttgcacgacgccctct

SEQ ID NO: 1132756 - DNA, 19 bp, Homo sapiens
tttgcacgacgccctctcc

SEQ ID NO: 1132757 - DNA, 20 bp, Homo sapiens
tttgcacggtttggataatc

SEQ ID NO: 1132758 - DNA, 19 bp, Homo sapiens
tttgcactaaatcagagac

SEQ ID NO: 1132759 - DNA, 20 bp, Homo sapiens
tttgcactaaatcagagaca

SEQ ID NO: 1132760 - DNA, 21 bp, Homo sapiens
tttgcactaaatcagagacaa

SEQ ID NO: 1132761 - DNA, 16 bp, Homo sapiens
tttgcactaatgtgtt

SEQ ID NO: 1132762 - DNA, 10 bp, Homo sapiens
tttgcactga

SEQ ID NO: 1132763 - DNA, 18 bp, Homo sapiens
tttgcactgaggatattc

SEQ ID NO: 1132764 - DNA, 22 bp, Homo sapiens
tttgcactgagggccacactat

SEQ ID NO: 1132765 - DNA, 18 bp, Homo sapiens
tttgcactgatatatcat

SEQ ID NO: 1132766 - DNA, 19 bp, Homo sapiens
tttgcagaaaagcacctgc

SEQ ID NO: 1132767 - DNA, 15 bp, Homo sapiens
tttgcagaaggaaat

SEQ ID NO: 1132768 - DNA, 16 bp, Homo sapiens
tttgcagaaggaaatg

SEQ ID NO: 1132769 - DNA, 18 bp, Homo sapiens
tttgcagaaggaaatgat

SEQ ID NO: 1132770 - DNA, 20 bp, Homo sapiens
tttgcaggattcccttctgg

SEQ ID NO: 1132771 - DNA, 14 bp, Homo sapiens
tttgcaggctctgg

SEQ ID NO: 1132772 - DNA, 22 bp, Homo sapiens
tttgcagggtcctcttctgggc

SEQ ID NO: 1132773 - DNA, 18 bp, Homo sapiens
tttgcataacaattcctc

SEQ ID NO: 1132774 - DNA, 14 bp, Homo sapiens
tttgcatagctctc

SEQ ID NO: 1132775 - DNA, 15 bp, Homo sapiens
tttgcatagctttca

SEQ ID NO: 1132776 - DNA, 12 bp, Homo sapiens
tttgcatgaaat

SEQ ID NO: 1132777 - DNA, 16 bp, Homo sapiens
tttgcatgagaaaagt

SEQ ID NO: 1132778 - DNA, 19 bp, Homo sapiens
tttgcatgatatcttcaag

SEQ ID NO: 1132779 - DNA, 16 bp, Homo sapiens
tttgcatgtcgcacaa

SEQ ID NO: 1132780 - DNA, 17 bp, Homo sapiens
tttgcatgtcgcacaat

SEQ ID NO: 1132781 - DNA, 17 bp, Homo sapiens
tttgcatgttatgttta

SEQ ID NO: 1132782 - DNA, 18 bp, Homo sapiens
tttgcatgttatgtttaa

SEQ ID NO: 1132783 - DNA, 17 bp, Homo sapiens
tttgcattaaattcaca

SEQ ID NO: 1132784 - DNA, 16 bp, Homo sapiens
tttgcattactctggt

SEQ ID NO: 1132785 - DNA, 21 bp, Homo sapiens
tttgcattatgtatttataat

SEQ ID NO: 1132786 - DNA, 13 bp, Homo sapiens
tttgcattcaaat

SEQ ID NO: 1132787 - DNA, 14 bp, Homo sapiens
tttgcattccagaa

SEQ ID NO: 1132788 - DNA, 19 bp, Homo sapiens
tttgcattgaacacaaact

SEQ ID NO: 1132789 - DNA, 13 bp, Homo sapiens
tttgcattgtctg

SEQ ID NO: 1132790 - DNA, 17 bp, Homo sapiens
tttgcatttaaaacaga

SEQ ID NO: 1132791 - DNA, 21 bp, Homo sapiens
tttgcatttaaaacagacact

SEQ ID NO: 1132792 - DNA, 15 bp, Homo sapiens
tttgcattttcacaa

SEQ ID NO: 1132793 - DNA, 14 bp, Homo sapiens
tttgccaagctgaa

SEQ ID NO: 1132794 - DNA, 17 bp, Homo sapiens
tttgccaaggcaaaaaa

SEQ ID NO: 1132795 - DNA, 13 bp, Homo sapiens
tttgccacagctt

SEQ ID NO: 1132796 - DNA, 16 bp, Homo sapiens
tttgccacagcttttg

SEQ ID NO: 1132797 - DNA, 13 bp, Homo sapiens
tttgccacataca

SEQ ID NO: 1132798 - DNA, 23 bp, Homo sapiens
tttgccacatacatagatcttca

SEQ ID NO: 1132799 - DNA, 18 bp, Homo sapiens
tttgccactaattttagt

SEQ ID NO: 1132800 - DNA, 10 bp, Homo sapiens
tttgccagca

SEQ ID NO: 1132801 - DNA, 16 bp, Homo sapiens
tttgccagctgctgct

SEQ ID NO: 1132802 - DNA, 23 bp, Homo sapiens
tttgccagtgaagacttcttggg

SEQ ID NO: 1132803 - DNA, 20 bp, Homo sapiens
tttgccatgacatttcatct

SEQ ID NO: 1132804 - DNA, 21 bp, Homo sapiens
tttgccatgacatttcatctg

SEQ ID NO: 1132805 - DNA, 19 bp, Homo sapiens
tttgccatgggcctgctgc

SEQ ID NO: 1132806 - DNA, 14 bp, Homo sapiens
tttgccattgtgaa

SEQ ID NO: 1132807 - DNA, 17 bp, Homo sapiens
tttgccattgtgaacca

SEQ ID NO: 1132808 - DNA, 23 bp, Homo sapiens
tttgccatttttattagaaattt

SEQ ID NO: 1132809 - DNA, 18 bp, Homo sapiens
tttgccatttttctataa

SEQ ID NO: 1132810 - DNA, 17 bp, Homo sapiens
tttgccccgggatatta

SEQ ID NO: 1132811 - DNA, 14 bp, Homo sapiens
tttgccccttgagc

SEQ ID NO: 1132812 - DNA, 15 bp, Homo sapiens
tttgccctcctgccc

SEQ ID NO: 1132813 - DNA, 15 bp, Homo sapiens
tttgcccttaaggac

SEQ ID NO: 1132814 - DNA, 12 bp, Homo sapiens
tttgccctttga

SEQ ID NO: 1132815 - DNA, 14 bp, Homo sapiens
tttgcctatcttta

SEQ ID NO: 1132816 - DNA, 17 bp, Homo sapiens
tttgtattacttaggtt

SEQ ID NO: 1132817 - DNA, 23 bp, Homo sapiens
tttgtattataattgttgatatt

SEQ ID NO: 1132818 - DNA, 16 bp, Homo sapiens
tttgtattattacaaa

SEQ ID NO: 1132819 - DNA, 18 bp, Homo sapiens
tttgtattattacaaata

SEQ ID NO: 1132820 - DNA, 13 bp, Homo sapiens
tttgtattcatga

SEQ ID NO: 1132821 - DNA, 14 bp, Homo sapiens
tttgtattctctga

SEQ ID NO: 1132822 - DNA, 21 bp, Homo sapiens
tttgtattctttactaaagat

SEQ ID NO: 1132823 - DNA, 17 bp, Homo sapiens
tttgtattgagggccag

SEQ ID NO: 1132824 - DNA, 18 bp, Homo sapiens
tttgtattgagggccagt

SEQ ID NO: 1132825 - DNA, 22 bp, Homo sapiens
tttgtatttagtagttatttgt

SEQ ID NO: 1132826 - DNA, 20 bp, Homo sapiens
tttgtatttctcttgtcctt

SEQ ID NO: 1132827 - DNA, 21 bp, Homo sapiens
tttgtatttggaatatttgaa

SEQ ID NO: 1132828 - DNA, 17 bp, Homo sapiens
tttgtattttgcatact

SEQ ID NO: 1132829 - DNA, 23 bp, Homo sapiens
tttgtattttgtgtgaccaactg

SEQ ID NO: 1132830 - DNA, 20 bp, Homo sapiens
tttgtattttttatttacat

SEQ ID NO: 1132831 - DNA, 15 bp, Homo sapiens
tttgtattttttcct

SEQ ID NO: 1132832 - DNA, 14 bp, Homo sapiens
tttgtcaaactgta

SEQ ID NO: 1132833 - DNA, 16 bp, Homo sapiens
tttgtcaaactgtaga

SEQ ID NO: 1132834 - DNA, 23 bp, Homo sapiens
tttgtcaaactgtagaaatgatg

SEQ ID NO: 1132835 - DNA, 11 bp, Homo sapiens
tttgtcaatga

SEQ ID NO: 1132836 - DNA, 19 bp, Homo sapiens
tttgtcaatttatgaatat

SEQ ID NO: 1132837 - DNA, 17 bp, Homo sapiens
tttgtcacattatttat

SEQ ID NO: 1132838 - DNA, 21 bp, Homo sapiens
tttgtcacattatttattaaa

SEQ ID NO: 1132839 - DNA, 14 bp, Homo sapiens
tttgtcagttcttg

SEQ ID NO: 1132840 - DNA, 17 bp, Homo sapiens
tttgtcatcagccacca

SEQ ID NO: 1132841 - DNA, 14 bp, Homo sapiens
tttgtcatgacagt

SEQ ID NO: 1132842 - DNA, 18 bp, Homo sapiens
tttgtcatgacagtgctt

SEQ ID NO: 1132843 - DNA, 21 bp, Homo sapiens
tttgtcatgacagtgcttgca

SEQ ID NO: 1132844 - DNA, 21 bp, Homo sapiens
tttgtcattttaaaatctgat

SEQ ID NO: 1132845 - DNA, 18 bp, Homo sapiens
tttgtcattttatgaata

SEQ ID NO: 1132846 - DNA, 19 bp, Homo sapiens
tttgtccattttaaaaacc

SEQ ID NO: 1132847 - DNA, 11 bp, Homo sapiens
tttgtcccaga

SEQ ID NO: 1132848 - DNA, 12 bp, Homo sapiens
tttgtcccaggt

SEQ ID NO: 1132849 - DNA, 16 bp, Homo sapiens
tttgtccccagggccc

SEQ ID NO: 1132850 - DNA, 15 bp, Homo sapiens
tttgtcccccaactt

SEQ ID NO: 1132851 - DNA, 17 bp, Homo sapiens
tttgtcccccaacttga

SEQ ID NO: 1132852 - DNA, 18 bp, Homo sapiens
tttgtcccccaacttgag

SEQ ID NO: 1132853 - DNA, 13 bp, Homo sapiens
tttgtcccttcta

SEQ ID NO: 1132854 - DNA, 17 bp, Homo sapiens
tttgtcctaaaacacct

SEQ ID NO: 1132855 - DNA, 22 bp, Homo sapiens
tttgtcctaagagatttatctt

SEQ ID NO: 1132856 - DNA, 23 bp, Homo sapiens
tttgtcctaagagatttatcttt

SEQ ID NO: 1132857 - DNA, 13 bp, Homo sapiens
tttgtcctgcctc

SEQ ID NO: 1132858 - DNA, 22 bp, Homo sapiens
tttgtcctttttcactttgaaa

SEQ ID NO: 1132859 - DNA, 21 bp, Homo sapiens
tttgtcgggcaccagccagcg

SEQ ID NO: 1132860 - DNA, 18 bp, Homo sapiens
tttgtcgtggttcttaaa

SEQ ID NO: 1132861 - DNA, 15 bp, Homo sapiens
tttgtctatgaagtt

SEQ ID NO: 1132862 - DNA, 14 bp, Homo sapiens
tttgtctcatccca

SEQ ID NO: 1132863 - DNA, 19 bp, Homo sapiens
tttgtctcatcccattctg

SEQ ID NO: 1132864 - DNA, 14 bp, Homo sapiens
tttgtctcctacct

SEQ ID NO: 1132865 - DNA, 19 bp, Homo sapiens
tttgtctcctactctgtgt

SEQ ID NO: 1132866 - DNA, 20 bp, Homo sapiens
tttgtctcctactctgtgta

SEQ ID NO: 1132867 - DNA, 16 bp, Homo sapiens
tttgtctctgtcacat

SEQ ID NO: 1132868 - DNA, 23 bp, Homo sapiens
tttgtctgtacatactggcctct

SEQ ID NO: 1132869 - DNA, 13 bp, Homo sapiens
tttgtctgtcgtg

SEQ ID NO: 1132870 - DNA, 19 bp, Homo sapiens
tttgtcttatatatatttc

SEQ ID NO: 1132871 - DNA, 20 bp, Homo sapiens
tttgtcttatatatatttct

SEQ ID NO: 1132872 - DNA, 20 bp, Homo sapiens
tttgtcttatcccccccagc

SEQ ID NO: 1132873 - DNA, 15 bp, Homo sapiens
tttgtcttattctta

SEQ ID NO: 1132874 - DNA, 13 bp, Homo sapiens
tttgtcttctata

SEQ ID NO: 1132875 - DNA, 14 bp, Homo sapiens
tttgtctttaaaca

SEQ ID NO: 1132876 - DNA, 20 bp, Homo sapiens
tttgtctttctctcccttct

SEQ ID NO: 1132877 - DNA, 13 bp, Homo sapiens
tttgtctttgaat

SEQ ID NO: 1132878 - DNA, 17 bp, Homo sapiens
tttgtcttttaatgctt

SEQ ID NO: 1132879 - DNA, 13 bp, Homo sapiens
tttgtctttttgt

SEQ ID NO: 1132880 - DNA, 16 bp, Homo sapiens
tttgtgaaatcagtat

SEQ ID NO: 1132881 - DNA, 23 bp, Homo sapiens
tttgtgaaatcagtatcagaata

SEQ ID NO: 1132882 - DNA, 21 bp, Homo sapiens
tttgtgaacgctgtgatgctg

SEQ ID NO: 1132883 - DNA, 13 bp, Homo sapiens
tttgtgaattaac

SEQ ID NO: 1132884 - DNA, 18 bp, Homo sapiens
tttgtgaattaacacagt

SEQ ID NO: 1132885 - DNA, 22 bp, Homo sapiens
tttgtgaattaggctgtaacta

SEQ ID NO: 1132886 - DNA, 21 bp, Homo sapiens
tttgtgaatttgcaacagtaa

SEQ ID NO: 1132887 - DNA, 23 bp, Homo sapiens
tttgtgactatatagagatgttt

SEQ ID NO: 1132888 - DNA, 22 bp, Homo sapiens
tttgtgagcatgggtgtgccct

SEQ ID NO: 1132889 - DNA, 22 bp, Homo sapiens
tttgtgatacaatgctgtgccc

SEQ ID NO: 1132890 - DNA, 14 bp, Homo sapiens
tttgtgatgatgct

SEQ ID NO: 1132891 - DNA, 18 bp, Homo sapiens
tttgtgatgatgctgtga

SEQ ID NO: 1132892 - DNA, 19 bp, Homo sapiens
tttgtgatggagtgctgtt

SEQ ID NO: 1132893 - DNA, 21 bp, Homo sapiens
tttgtgatggagtgctgtttt

SEQ ID NO: 1132894 - DNA, 15 bp, Homo sapiens
tttgtgattcaatct

SEQ ID NO: 1132895 - DNA, 11 bp, Homo sapiens
tttgtgcacag

SEQ ID NO: 1132896 - DNA, 19 bp, Homo sapiens
tttgtgcattatctagata

SEQ ID NO: 1132897 - DNA, 11 bp, Homo sapiens
tttgtgcattc

SEQ ID NO: 1132898 - DNA, 18 bp, Homo sapiens
tttgtgcattctttggta

SEQ ID NO: 1132899 - DNA, 23 bp, Homo sapiens
tttgtgcattctttggtaatttt

SEQ ID NO: 1132900 - DNA, 21 bp, Homo sapiens
tttgtgccattatatttgcat

SEQ ID NO: 1132901 - DNA, 22 bp, Homo sapiens
tttgtgccattatatttgcatt

SEQ ID NO: 1132902 - DNA, 20 bp, Homo sapiens
tttgtgctatagtatttgat

SEQ ID NO: 1132903 - DNA, 14 bp, Homo sapiens
tttgtgctcattta

SEQ ID NO: 1132904 - DNA, 21 bp, Homo sapiens
tttgtgctccattttttcttc

SEQ ID NO: 1132905 - DNA, 12 bp, Homo sapiens
tttgtggaataa

SEQ ID NO: 1132906 - DNA, 21 bp, Homo sapiens
tttgtggagtttgacacctta

SEQ ID NO: 1132907 - DNA, 17 bp, Homo sapiens
tttgtggagtttgtatt

SEQ ID NO: 1132908 - DNA, 22 bp, Homo sapiens
tttgtggccaaggagctgctat

SEQ ID NO: 1132909 - DNA, 12 bp, Homo sapiens
tttgtgggactg

SEQ ID NO: 1132910 - DNA, 16 bp, Homo sapiens
tttgtggtataaaaag

SEQ ID NO: 1132911 - DNA, 14 bp, Homo sapiens
tttgtggtcacagc

SEQ ID NO: 1132912 - DNA, 16 bp, Homo sapiens
tttgtggtttggaata

SEQ ID NO: 1132913 - DNA, 14 bp, Homo sapiens
tttgtgtacagtgt

SEQ ID NO: 1132914 - DNA, 12 bp, Homo sapiens
tttgtgtatgta

SEQ ID NO: 1132915 - DNA, 14 bp, Homo sapiens
tttgtgtatgtact

SEQ ID NO: 1132916 - DNA, 12 bp, Homo sapiens
tttgtgtatgtt

SEQ ID NO: 1132917 - DNA, 17 bp, Homo sapiens
tttgtgtccgctaaata

SEQ ID NO: 1132918 - DNA, 11 bp, Homo sapiens
tttgtgtcttt

SEQ ID NO: 1132919 - DNA, 21 bp, Homo sapiens
tttgtgtgatgcgccttgctg

SEQ ID NO: 1132920 - DNA, 15 bp, Homo sapiens
tttgtgtgatttcct

SEQ ID NO: 1132921 - DNA, 22 bp, Homo sapiens
tttgtgtgatttcctaaacata

SEQ ID NO: 1132922 - DNA, 12 bp, Homo sapiens
tttgtgtggctc

SEQ ID NO: 1132923 - DNA, 14 bp, Homo sapiens
tttgtgtgtatttg

SEQ ID NO: 1132924 - DNA, 20 bp, Homo sapiens
tttgtgtgtatttgtattaa

SEQ ID NO: 1132925 - DNA, 19 bp, Homo sapiens
tttgtgtgttatattccaa

SEQ ID NO: 1132926 - DNA, 14 bp, Homo sapiens
tttgtgtgttggca

SEQ ID NO: 1132927 - DNA, 19 bp, Homo sapiens
tttgtgttctgtttgttaa

SEQ ID NO: 1132928 - DNA, 23 bp, Homo sapiens
tttgtgttgtcttttttatgtta

SEQ ID NO: 1132929 - DNA, 14 bp, Homo sapiens
tttgtgttttcttg

SEQ ID NO: 1132930 - DNA, 13 bp, Homo sapiens
tttgttaaaatct

SEQ ID NO: 1132931 - DNA, 22 bp, Homo sapiens
tttgttaaaattatcaatatct

SEQ ID NO: 1132932 - DNA, 12 bp, Homo sapiens
tttgttaaagct

SEQ ID NO: 1132933 - DNA, 21 bp, Homo sapiens
tttgttaaagctggaacattt

SEQ ID NO: 1132934 - DNA, 18 bp, Homo sapiens
tttgttaaggtcctgaaa

SEQ ID NO: 1132935 - DNA, 22 bp, Homo sapiens
tttgttaatttagaaaacttta

SEQ ID NO: 1132936 - DNA, 22 bp, Homo sapiens
tttgttacataaggatgacttt

SEQ ID NO: 1132937 - DNA, 13 bp, Homo sapiens
tttgttaccttta

SEQ ID NO: 1132938 - DNA, 20 bp, Homo sapiens
ttttaggaataataaattca

SEQ ID NO: 1132939 - DNA, 19 bp, Homo sapiens
ttttaggcactgttcaata

SEQ ID NO: 1132940 - DNA, 17 bp, Homo sapiens
ttttagggagctggtct

SEQ ID NO: 1132941 - DNA, 23 bp, Homo sapiens
ttttaggtcaagggcttactatt

SEQ ID NO: 1132942 - DNA, 16 bp, Homo sapiens
ttttaggtgttgattt

SEQ ID NO: 1132943 - DNA, 22 bp, Homo sapiens
ttttaggtgttgattttctgtt

SEQ ID NO: 1132944 - DNA, 15 bp, Homo sapiens
ttttaggttgttacc

SEQ ID NO: 1132945 - DNA, 18 bp, Homo sapiens
ttttagtaagttaatgta

SEQ ID NO: 1132946 - DNA, 14 bp, Homo sapiens
ttttagtaatttct

SEQ ID NO: 1132947 - DNA, 22 bp, Homo sapiens
ttttagtagagatggggtttca

SEQ ID NO: 1132948 - DNA, 19 bp, Homo sapiens
ttttagtgtattaatcata

SEQ ID NO: 1132949 - DNA, 22 bp, Homo sapiens
ttttagtttttcattaaataaa

SEQ ID NO: 1132950 - DNA, 17 bp, Homo sapiens
ttttataaaattttgct

SEQ ID NO: 1132951 - DNA, 13 bp, Homo sapiens
ttttataaattaa

SEQ ID NO: 1132952 - DNA, 17 bp, Homo sapiens
ttttataagaaaaactt

SEQ ID NO: 1132953 - DNA, 23 bp, Homo sapiens
ttttataataaaaggaaaagcaa

SEQ ID NO: 1132954 - DNA, 14 bp, Homo sapiens
ttttataatgattc

SEQ ID NO: 1132955 - DNA, 15 bp, Homo sapiens
ttttataatgattca

SEQ ID NO: 1132956 - DNA, 21 bp, Homo sapiens
ttttataatgttattcatttg

SEQ ID NO: 1132957 - DNA, 19 bp, Homo sapiens
ttttataattctcattaaa

SEQ ID NO: 1132958 - DNA, 12 bp, Homo sapiens
ttttataattgg

SEQ ID NO: 1132959 - DNA, 18 bp, Homo sapiens
ttttatactctttctgta

SEQ ID NO: 1132960 - DNA, 19 bp, Homo sapiens
ttttatactctttctgtat

SEQ ID NO: 1132961 - DNA, 23 bp, Homo sapiens
ttttatagtagatttttaacaaa

SEQ ID NO: 1132962 - DNA, 14 bp, Homo sapiens
ttttatataaatat

SEQ ID NO: 1132963 - DNA, 22 bp, Homo sapiens
ttttatataataaagtattcca

SEQ ID NO: 1132964 - DNA, 20 bp, Homo sapiens
ttttatatgatgggggaaaa

SEQ ID NO: 1132965 - DNA, 17 bp, Homo sapiens
ttttatatgttcatatt

SEQ ID NO: 1132966 - DNA, 17 bp, Homo sapiens
ttttatattacttttgt

SEQ ID NO: 1132967 - DNA, 21 bp, Homo sapiens
ttttatattacttttgtaaat

SEQ ID NO: 1132968 - DNA, 19 bp, Homo sapiens
ttttatattcagtgaaaag

SEQ ID NO: 1132969 - DNA, 14 bp, Homo sapiens
ttttatatttcctt

SEQ ID NO: 1132970 - DNA, 20 bp, Homo sapiens
ttttatatttcctttatgtg

SEQ ID NO: 1132971 - DNA, 13 bp, Homo sapiens
ttttatatttgta

SEQ ID NO: 1132972 - DNA, 14 bp, Homo sapiens
ttttatcatgaatt

SEQ ID NO: 1132973 - DNA, 17 bp, Homo sapiens
ttttatcatgacatgtt

SEQ ID NO: 1132974 - DNA, 12 bp, Homo sapiens
ttttatcctgta

SEQ ID NO: 1132975 - DNA, 13 bp, Homo sapiens
ttttatctcagat

SEQ ID NO: 1132976 - DNA, 23 bp, Homo sapiens
ttttatctgaatttttaaacaag

SEQ ID NO: 1132977 - DNA, 12 bp, Homo sapiens
ttttatgaagaa

SEQ ID NO: 1132978 - DNA, 15 bp, Homo sapiens
ttttatgcacagcct

SEQ ID NO: 1132979 - DNA, 15 bp, Homo sapiens
ttttatggcatgatt

SEQ ID NO: 1132980 - DNA, 22 bp, Homo sapiens
ttttatggtggaaaagaactgt

SEQ ID NO: 1132981 - DNA, 18 bp, Homo sapiens
ttttatgtacaaccctga

SEQ ID NO: 1132982 - DNA, 21 bp, Homo sapiens
ttttatgtattctttctgcct

SEQ ID NO: 1132983 - DNA, 15 bp, Homo sapiens
ttttatgtgatgcca

SEQ ID NO: 1132984 - DNA, 20 bp, Homo sapiens
ttttatgttttctttctcac

SEQ ID NO: 1132985 - DNA, 14 bp, Homo sapiens
ttttattaaatgta

SEQ ID NO: 1132986 - DNA, 12 bp, Homo sapiens
ttttattaaatt

SEQ ID NO: 1132987 - DNA, 23 bp, Homo sapiens
ttttattaagccaggaaacatga

SEQ ID NO: 1132988 - DNA, 14 bp, Homo sapiens
ttttattaatgcac

SEQ ID NO: 1132989 - DNA, 13 bp, Homo sapiens
ttttattaattta

SEQ ID NO: 1132990 - DNA, 19 bp, Homo sapiens
ttttattaattttagtttt

SEQ ID NO: 1132991 - DNA, 15 bp, Homo sapiens
ttttattagtattgt

SEQ ID NO: 1132992 - DNA, 13 bp, Homo sapiens
ttttattataaag

SEQ ID NO: 1132993 - DNA, 14 bp, Homo sapiens
ttttattatgcatt

SEQ ID NO: 1132994 - DNA, 16 bp, Homo sapiens
ttttattcctttgaat

SEQ ID NO: 1132995 - DNA, 17 bp, Homo sapiens
ttttattcctttgaata

SEQ ID NO: 1132996 - DNA, 21 bp, Homo sapiens
ttttattcgtcctttgacaaa

SEQ ID NO: 1132997 - DNA, 18 bp, Homo sapiens
ttttattctgttttcttg

SEQ ID NO: 1132998 - DNA, 22 bp, Homo sapiens
ttttattgctcgcccagacacc

SEQ ID NO: 1132999 - DNA, 20 bp, Homo sapiens
ttttattgtataaactatca

SEQ ID NO: 1133000 - DNA, 13 bp, Homo sapiens
ttttatttaaaaa

SEQ ID NO: 1133001 - DNA, 15 bp, Homo sapiens
ttttatttattttat

SEQ ID NO: 1133002 - DNA, 22 bp, Homo sapiens
ttttatttcattggttaatttt

SEQ ID NO: 1133003 - DNA, 13 bp, Homo sapiens
ttttatttctcgg

SEQ ID NO: 1133004 - DNA, 21 bp, Homo sapiens
ttttatttctcgggtgcattt

SEQ ID NO: 1133005 - DNA, 20 bp, Homo sapiens
ttttatttctgatttcataa

SEQ ID NO: 1133006 - DNA, 15 bp, Homo sapiens
ttttatttgacaaaa

SEQ ID NO: 1133007 - DNA, 19 bp, Homo sapiens
ttttatttgagaattttgt

SEQ ID NO: 1133008 - DNA, 11 bp, Homo sapiens
ttttattttac

SEQ ID NO: 1133009 - DNA, 15 bp, Homo sapiens
ttttattttactatt

SEQ ID NO: 1133010 - DNA, 16 bp, Homo sapiens
ttttattttactttta

SEQ ID NO: 1133011 - DNA, 14 bp, Homo sapiens
ttttattttcaaga

SEQ ID NO: 1133012 - DNA, 15 bp, Homo sapiens
ttttattttcattgt

SEQ ID NO: 1133013 - DNA, 12 bp, Homo sapiens
ttttattttgct

SEQ ID NO: 1133014 - DNA, 14 bp, Homo sapiens
ttttattttgctga

SEQ ID NO: 1133015 - DNA, 20 bp, Homo sapiens
ttttattttgctgagttgtt

SEQ ID NO: 1133016 - DNA, 13 bp, Homo sapiens
ttttatttttcta

SEQ ID NO: 1133017 - DNA, 18 bp, Homo sapiens
ttttattttttccctcct

SEQ ID NO: 1133018 - DNA, 14 bp, Homo sapiens
ttttcaaaaaccag

SEQ ID NO: 1133019 - DNA, 14 bp, Homo sapiens
ttttcaaaatggag

SEQ ID NO: 1133020 - DNA, 20 bp, Homo sapiens
ttttcaaactgctgcatact

SEQ ID NO: 1133021 - DNA, 12 bp, Homo sapiens
ttttcaaagcaa

SEQ ID NO: 1133022 - DNA, 13 bp, Homo sapiens
ttttcaaagcaat

SEQ ID NO: 1133023 - DNA, 13 bp, Homo sapiens
ttttcaaatcctt

SEQ ID NO: 1133024 - DNA, 14 bp, Homo sapiens
ttttcaaattgtat

SEQ ID NO: 1133025 - DNA, 14 bp, Homo sapiens
ttttcaagaaaaga

SEQ ID NO: 1133026 - DNA, 13 bp, Homo sapiens
ttttcaagaaatg

SEQ ID NO: 1133027 - DNA, 13 bp, Homo sapiens
ttttcaaggaagg

SEQ ID NO: 1133028 - DNA, 14 bp, Homo sapiens
ttttcaaggcattt

SEQ ID NO: 1133029 - DNA, 17 bp, Homo sapiens
ttttcaaggccttcagt

SEQ ID NO: 1133030 - DNA, 13 bp, Homo sapiens
ttttcaagttgta

SEQ ID NO: 1133031 - DNA, 23 bp, Homo sapiens
ttttcaatcaactttactgtaat

SEQ ID NO: 1133032 - DNA, 17 bp, Homo sapiens
ttttcaatgtgaaacac

SEQ ID NO: 1133033 - DNA, 11 bp, Homo sapiens
ttttcaccaat

SEQ ID NO: 1133034 - DNA, 19 bp, Homo sapiens
ttttcaccagatttgctaa

SEQ ID NO: 1133035 - DNA, 15 bp, Homo sapiens
ttttcacggaagttt

SEQ ID NO: 1133036 - DNA, 18 bp, Homo sapiens
ttttcacggaagttttca

SEQ ID NO: 1133037 - DNA, 19 bp, Homo sapiens
ttttcactctaagtcatgt

SEQ ID NO: 1133038 - DNA, 21 bp, Homo sapiens
ttttcactctaagtcatgtat

SEQ ID NO: 1133039 - DNA, 13 bp, Homo sapiens
ttttcactgcctg

SEQ ID NO: 1133040 - DNA, 21 bp, Homo sapiens
ttttcactggagttacattaa

SEQ ID NO: 1133041 - DNA, 16 bp, Homo sapiens
ttttcactgtagaatg

SEQ ID NO: 1133042 - DNA, 18 bp, Homo sapiens
ttttcagaaaaagaaatg

SEQ ID NO: 1133043 - DNA, 20 bp, Homo sapiens
ttttcagaaacagggcagca

SEQ ID NO: 1133044 - DNA, 21 bp, Homo sapiens
ttttcagaaggttattttctt

SEQ ID NO: 1133045 - DNA, 14 bp, Homo sapiens
ttttcagactcaga

SEQ ID NO: 1133046 - DNA, 16 bp, Homo sapiens
ttttcagacttgtcaa

SEQ ID NO: 1133047 - DNA, 21 bp, Homo sapiens
ttttcagcacccccacccacc

SEQ ID NO: 1133048 - DNA, 19 bp, Homo sapiens
ttttcagccaatttgtctc

SEQ ID NO: 1133049 - DNA, 23 bp, Homo sapiens
ttttcaggaccttagttccagca

SEQ ID NO: 1133050 - DNA, 22 bp, Homo sapiens
ttttcagggctggctcctgatc

SEQ ID NO: 1133051 - DNA, 22 bp, Homo sapiens
ttttcaggtaggcccttgtcct

SEQ ID NO: 1133052 - DNA, 23 bp, Homo sapiens
ttttcagtagggctacaaaacct

SEQ ID NO: 1133053 - DNA, 15 bp, Homo sapiens
ttttcagtcatataa

SEQ ID NO: 1133054 - DNA, 16 bp, Homo sapiens
ttttcagtggaactct

SEQ ID NO: 1133055 - DNA, 14 bp, Homo sapiens
ttttcagtgtacat

SEQ ID NO: 1133056 - DNA, 12 bp, Homo sapiens
ttttcagttgtt

SEQ ID NO: 1133057 - DNA, 17 bp, Homo sapiens
ttttcataacttgctga

SEQ ID NO: 1133058 - DNA, 19 bp, Homo sapiens
ttttcatagtatccatatt

SEQ ID NO: 1133059 - DNA, 19 bp, Homo sapiens
ttttcatattgtgccaata

SEQ ID NO: 1133060 - DNA, 22 bp, Homo sapiens
ttttcatcaaaaagccttattt

SEQ ID NO: 1133061 - DNA, 20 bp, Homo sapiens
ttttggctagagtttccact

SEQ ID NO: 1133062 - DNA, 19 bp, Homo sapiens
ttttggctctcccaccccg

SEQ ID NO: 1133063 - DNA, 19 bp, Homo sapiens
ttttggctgtgacctcttc

SEQ ID NO: 1133064 - DNA, 21 bp, Homo sapiens
ttttggctgtgacctcttcaa

SEQ ID NO: 1133065 - DNA, 14 bp, Homo sapiens
ttttggctttctcc

SEQ ID NO: 1133066 - DNA, 22 bp, Homo sapiens
ttttgggctcctttttctccct

SEQ ID NO: 1133067 - DNA, 22 bp, Homo sapiens
ttttggggagggaggggaaatg

SEQ ID NO: 1133068 - DNA, 18 bp, Homo sapiens
ttttggggcatcctggat

SEQ ID NO: 1133069 - DNA, 18 bp, Homo sapiens
ttttggggggtaatcagc

SEQ ID NO: 1133070 - DNA, 13 bp, Homo sapiens
ttttggggtgggc

SEQ ID NO: 1133071 - DNA, 19 bp, Homo sapiens
ttttggtaaagactggctt

SEQ ID NO: 1133072 - DNA, 16 bp, Homo sapiens
ttttggtaataacaaa

SEQ ID NO: 1133073 - DNA, 14 bp, Homo sapiens
ttttggtacaaaaa

SEQ ID NO: 1133074 - DNA, 16 bp, Homo sapiens
ttttggtacaaaaata

SEQ ID NO: 1133075 - DNA, 14 bp, Homo sapiens
ttttggtatttatg

SEQ ID NO: 1133076 - DNA, 21 bp, Homo sapiens
ttttggtccaagttgtgctta

SEQ ID NO: 1133077 - DNA, 21 bp, Homo sapiens
ttttggtcttcagcctccctc

SEQ ID NO: 1133078 - DNA, 12 bp, Homo sapiens
ttttggtgtatt

SEQ ID NO: 1133079 - DNA, 17 bp, Homo sapiens
ttttggttatggagtct

SEQ ID NO: 1133080 - DNA, 20 bp, Homo sapiens
ttttggttgaataaactaga

SEQ ID NO: 1133081 - DNA, 16 bp, Homo sapiens
ttttggtttatgactt

SEQ ID NO: 1133082 - DNA, 11 bp, Homo sapiens
ttttggtttca

SEQ ID NO: 1133083 - DNA, 14 bp, Homo sapiens
ttttggtttcacct

SEQ ID NO: 1133084 - DNA, 12 bp, Homo sapiens
ttttggtttctg

SEQ ID NO: 1133085 - DNA, 22 bp, Homo sapiens
ttttgtaaaaactgaagaattt

SEQ ID NO: 1133086 - DNA, 23 bp, Homo sapiens
ttttgtaaaaactgaagaatttt

SEQ ID NO: 1133087 - DNA, 15 bp, Homo sapiens
ttttgtaaaagaaat

SEQ ID NO: 1133088 - DNA, 13 bp, Homo sapiens
ttttgtaaaatat

SEQ ID NO: 1133089 - DNA, 18 bp, Homo sapiens
ttttgtaaaatgtattat

SEQ ID NO: 1133090 - DNA, 13 bp, Homo sapiens
ttttgtaaacatt

SEQ ID NO: 1133091 - DNA, 17 bp, Homo sapiens
ttttgtaaacatttatt

SEQ ID NO: 1133092 - DNA, 19 bp, Homo sapiens
ttttgtaaacgacaagaat

SEQ ID NO: 1133093 - DNA, 21 bp, Homo sapiens
ttttgtaaacgacaagaataa

SEQ ID NO: 1133094 - DNA, 21 bp, Homo sapiens
ttttgtaaactgtatcaaatc

SEQ ID NO: 1133095 - DNA, 13 bp, Homo sapiens
ttttgtaaattat

SEQ ID NO: 1133096 - DNA, 11 bp, Homo sapiens
ttttgtaacta

SEQ ID NO: 1133097 - DNA, 12 bp, Homo sapiens
ttttgtaactac

SEQ ID NO: 1133098 - DNA, 14 bp, Homo sapiens
ttttgtaagacaaa

SEQ ID NO: 1133099 - DNA, 13 bp, Homo sapiens
ttttgtaagataa

SEQ ID NO: 1133100 - DNA, 17 bp, Homo sapiens
ttttgtaataataaaga

SEQ ID NO: 1133101 - DNA, 19 bp, Homo sapiens
ttttgtaataataaagaat

SEQ ID NO: 1133102 - DNA, 14 bp, Homo sapiens
ttttgtaattgtgt

SEQ ID NO: 1133103 - DNA, 20 bp, Homo sapiens
ttttgtaatttgaattgggt

SEQ ID NO: 1133104 - DNA, 19 bp, Homo sapiens
ttttgtacatactgtattt

SEQ ID NO: 1133105 - DNA, 19 bp, Homo sapiens
ttttgtaccctgaagtgtt

SEQ ID NO: 1133106 - DNA, 15 bp, Homo sapiens
ttttgtactgaattt

SEQ ID NO: 1133107 - DNA, 22 bp, Homo sapiens
ttttgtagatgaacttgagctc

SEQ ID NO: 1133108 - DNA, 22 bp, Homo sapiens
ttttgtaggggtcaaagaaatg

SEQ ID NO: 1133109 - DNA, 12 bp, Homo sapiens
ttttgtataaaa

SEQ ID NO: 1133110 - DNA, 16 bp, Homo sapiens
ttttgtataaaaagga

SEQ ID NO: 1133111 - DNA, 23 bp, Homo sapiens
ttttgtataaatgacaaagtgtt

SEQ ID NO: 1133112 - DNA, 20 bp, Homo sapiens
ttttgtatagtattggaaaa

SEQ ID NO: 1133113 - DNA, 13 bp, Homo sapiens
ttttgtatatatc

SEQ ID NO: 1133114 - DNA, 14 bp, Homo sapiens
ttttgtatgtaaat

SEQ ID NO: 1133115 - DNA, 20 bp, Homo sapiens
ttttgtattacatctaatgc

SEQ ID NO: 1133116 - DNA, 18 bp, Homo sapiens
ttttgtattctttactaa

SEQ ID NO: 1133117 - DNA, 12 bp, Homo sapiens
ttttgtatttag

SEQ ID NO: 1133118 - DNA, 15 bp, Homo sapiens
ttttgtatttttaat

SEQ ID NO: 1133119 - DNA, 16 bp, Homo sapiens
ttttgtattttttcct

SEQ ID NO: 1133120 - DNA, 16 bp, Homo sapiens
ttttgtcacattattt

SEQ ID NO: 1133121 - DNA, 23 bp, Homo sapiens
ttttgtcacattatttattaaaa

SEQ ID NO: 1133122 - DNA, 23 bp, Homo sapiens
ttttgtcccattttccccttcct

SEQ ID NO: 1133123 - DNA, 10 bp, Homo sapiens
ttttgtctgt

SEQ ID NO: 1133124 - DNA, 13 bp, Homo sapiens
ttttgtcttatat

SEQ ID NO: 1133125 - DNA, 12 bp, Homo sapiens
ttttgtcttgaa

SEQ ID NO: 1133126 - DNA, 18 bp, Homo sapiens
ttttgtgaaaatgtcaaa

SEQ ID NO: 1133127 - DNA, 13 bp, Homo sapiens
ttttgtgaaatca

SEQ ID NO: 1133128 - DNA, 22 bp, Homo sapiens
ttttgtgaaatgaaaacatgta

SEQ ID NO: 1133129 - DNA, 13 bp, Homo sapiens
ttttgtgagatgt

SEQ ID NO: 1133130 - DNA, 22 bp, Homo sapiens
ttttgtgagcctctttgtaata

SEQ ID NO: 1133131 - DNA, 12 bp, Homo sapiens
ttttgtgatgaa

SEQ ID NO: 1133132 - DNA, 19 bp, Homo sapiens
ttttgtgatgatgctgtga

SEQ ID NO: 1133133 - DNA, 21 bp, Homo sapiens
ttttgtgatgtcccaacttgt

SEQ ID NO: 1133134 - DNA, 19 bp, Homo sapiens
ttttgtgatttagaactgt

SEQ ID NO: 1133135 - DNA, 12 bp, Homo sapiens
ttttgtgcattt

SEQ ID NO: 1133136 - DNA, 13 bp, Homo sapiens
ttttgtgcatttg

SEQ ID NO: 1133137 - DNA, 22 bp, Homo sapiens
ttttgtgcatttgtaaatgctg

SEQ ID NO: 1133138 - DNA, 17 bp, Homo sapiens
ttttgtgtaatgaaaat

SEQ ID NO: 1133139 - DNA, 11 bp, Homo sapiens
ttttgtgtata

SEQ ID NO: 1133140 - DNA, 12 bp, Homo sapiens
ttttgtgtatgt

SEQ ID NO: 1133141 - DNA, 22 bp, Homo sapiens
ttttgtgtgcctggtagaaact

SEQ ID NO: 1133142 - DNA, 14 bp, Homo sapiens
ttttgtgtgtatat

SEQ ID NO: 1133143 - DNA, 21 bp, Homo sapiens
ttttgtgttcctatggaaaca

SEQ ID NO: 1133144 - DNA, 20 bp, Homo sapiens
ttttgtgttttcttgtaaat

SEQ ID NO: 1133145 - DNA, 13 bp, Homo sapiens
ttttgttaacagt

SEQ ID NO: 1133146 - DNA, 15 bp, Homo sapiens
ttttgttagcaaaga

SEQ ID NO: 1133147 - DNA, 12 bp, Homo sapiens
ttttgttataga

SEQ ID NO: 1133148 - DNA, 16 bp, Homo sapiens
ttttgttatagaatac

SEQ ID NO: 1133149 - DNA, 15 bp, Homo sapiens
ttttgttattaaaca

SEQ ID NO: 1133150 - DNA, 16 bp, Homo sapiens
ttttgttcaaagccag

SEQ ID NO: 1133151 - DNA, 15 bp, Homo sapiens
ttttgttcacaacct

SEQ ID NO: 1133152 - DNA, 20 bp, Homo sapiens
ttttgttccaatgtcaatgt

SEQ ID NO: 1133153 - DNA, 14 bp, Homo sapiens
ttttgttctagact

SEQ ID NO: 1133154 - DNA, 17 bp, Homo sapiens
ttttgttctctgggaga

SEQ ID NO: 1133155 - DNA, 23 bp, Homo sapiens
ttttgttgaaatagctttactgt

SEQ ID NO: 1133156 - DNA, 13 bp, Homo sapiens
ttttgttgaccat

SEQ ID NO: 1133157 - DNA, 16 bp, Homo sapiens
ttttgttgtgttctgt

SEQ ID NO: 1133158 - DNA, 14 bp, Homo sapiens
ttttgtttccatgg

SEQ ID NO: 1133159 - DNA, 22 bp, Homo sapiens
ttttgtttccttttttcccata

SEQ ID NO: 1133160 - DNA, 15 bp, Homo sapiens
ttttgtttgtggcat

SEQ ID NO: 1133161 - DNA, 16 bp, Homo sapiens
ttttgtttgtttcttt

SEQ ID NO: 1133162 - DNA, 13 bp, Homo sapiens
ttttgttttacaa

SEQ ID NO: 1133163 - DNA, 15 bp, Homo sapiens
ttttgttttctaaga

SEQ ID NO: 1133164 - DNA, 15 bp, Homo sapiens
ttttgttttgttgga

SEQ ID NO: 1133165 - DNA, 19 bp, Homo sapiens
ttttgtttttgtaatgcac

SEQ ID NO: 1133166 - DNA, 22 bp, Homo sapiens
tttttaaaaaagcttaaaactt

SEQ ID NO: 1133167 - DNA, 23 bp, Homo sapiens
tttttaaaaaataccattgaaat

SEQ ID NO: 1133168 - DNA, 20 bp, Homo sapiens
tttttaaaaaggtaaatggt

SEQ ID NO: 1133169 - DNA, 21 bp, Homo sapiens
tttttaaaaatgtgtcaaaat

SEQ ID NO: 1133170 - DNA, 16 bp, Homo sapiens
tttttaaaacaaaaga

SEQ ID NO: 1133171 - DNA, 19 bp, Homo sapiens
tttttaaaagtttcaatgt

SEQ ID NO: 1133172 - DNA, 13 bp, Homo sapiens
tttttaaaatact

SEQ ID NO: 1133173 - DNA, 14 bp, Homo sapiens
tttttaaaatactt

SEQ ID NO: 1133174 - DNA, 23 bp, Homo sapiens
tttttaaaatagaaattttgtaa

SEQ ID NO: 1133175 - DNA, 18 bp, Homo sapiens
tttttaaaatatatgtat

SEQ ID NO: 1133176 - DNA, 19 bp, Homo sapiens
tttttaaaatatattgctg

SEQ ID NO: 1133177 - DNA, 13 bp, Homo sapiens
tttttaaaatatt

SEQ ID NO: 1133178 - DNA, 16 bp, Homo sapiens
tttttaaaatatttat

SEQ ID NO: 1133179 - DNA, 13 bp, Homo sapiens
tttttaaaattga

SEQ ID NO: 1133180 - DNA, 14 bp, Homo sapiens
tttttaaaattttg

SEQ ID NO: 1133181 - DNA, 15 bp, Homo sapiens
tttttaaacagggtc

SEQ ID NO: 1133182 - DNA, 21 bp, Homo sapiens
tttttaaactaagatctgtta

SEQ ID NO: 1133183 - DNA, 16 bp, Homo sapiens
tttttaaactgtacag

SEQ ID NO: 1133184 - DNA, 17 bp, Homo sapiens
tttttaaacttgtaaag

SEQ ID NO: 1133185 - DNA, 14 bp, Homo sapiens
tttttaaagaatgt

SEQ ID NO: 1133186 - DNA, 15 bp, Homo sapiens
tttttaaagaatgtt

SEQ ID NO: 1133187 - DNA, 16 bp, Homo sapiens
tttttaaagcaagtca

SEQ ID NO: 1133188 - DNA, 21 bp, Homo sapiens
tttttaaagcctggcttctta

SEQ ID NO: 1133189 - DNA, 21 bp, Homo sapiens
tttttaaaggggtctgttctg

SEQ ID NO: 1133190 - DNA, 19 bp, Homo sapiens
tttttaaagtaaacttgtg

SEQ ID NO: 1133191 - DNA, 22 bp, Homo sapiens
tttttaaagtaaacttgtgtat

SEQ ID NO: 1133192 - DNA, 16 bp, Homo sapiens
tttttaaataaaagca

SEQ ID NO: 1133193 - DNA, 19 bp, Homo sapiens
tttttaaatgatcatgaaa

SEQ ID NO: 1133194 - DNA, 16 bp, Homo sapiens
tttttaaatgattcca

SEQ ID NO: 1133195 - DNA, 14 bp, Homo sapiens
tttttaacagcatg

SEQ ID NO: 1133196 - DNA, 18 bp, Homo sapiens
tttttaacatgtgttaaa

SEQ ID NO: 1133197 - DNA, 14 bp, Homo sapiens
tttttaacctgttt

SEQ ID NO: 1133198 - DNA, 23 bp, Homo sapiens
tttttaaccttccaagactgaag

SEQ ID NO: 1133199 - DNA, 21 bp, Homo sapiens
tttttaacgtggcttgtagaa

SEQ ID NO: 1133200 - DNA, 20 bp, Homo sapiens
tttttaagaaaaattcacaa

SEQ ID NO: 1133201 - DNA, 16 bp, Homo sapiens
tttttaagaatatctg

SEQ ID NO: 1133202 - DNA, 13 bp, Homo sapiens
tttttaagaattg

SEQ ID NO: 1133203 - DNA, 16 bp, Homo sapiens
tttttaagacagggtc

SEQ ID NO: 1133204 - DNA, 20 bp, Homo sapiens
tttttaagctccatgtgcat

SEQ ID NO: 1133205 - DNA, 18 bp, Homo sapiens
tttttaagctgtttccat

SEQ ID NO: 1133206 - DNA, 12 bp, Homo sapiens
tttttaaggact

SEQ ID NO: 1133207 - DNA, 18 bp, Homo sapiens
tttttaaggactcagctg

SEQ ID NO: 1133208 - DNA, 23 bp, Homo sapiens
tttttaagggttatcttagatgt

SEQ ID NO: 1133209 - DNA, 13 bp, Homo sapiens
tttttaagtgcaa

SEQ ID NO: 1133210 - DNA, 17 bp, Homo sapiens
tttttaagtgctgcatt

SEQ ID NO: 1133211 - DNA, 19 bp, Homo sapiens
tttttaagtgctgcattta

SEQ ID NO: 1133212 - DNA, 22 bp, Homo sapiens
tttttaagtgctgcatttaaaa

SEQ ID NO: 1133213 - DNA, 23 bp, Homo sapiens
tttttaagtgctgcatttaaaag

SEQ ID NO: 1133214 - DNA, 22 bp, Homo sapiens
tttttaagttgtcaaagaagct

SEQ ID NO: 1133215 - DNA, 19 bp, Homo sapiens
tttttaagttgtctgtctg

SEQ ID NO: 1133216 - DNA, 12 bp, Homo sapiens
tttttaataaac

SEQ ID NO: 1133217 - DNA, 23 bp, Homo sapiens
tttttaatagtcattccaaatat

SEQ ID NO: 1133218 - DNA, 22 bp, Homo sapiens
tttttaatctagacaatataca

SEQ ID NO: 1133219 - DNA, 15 bp, Homo sapiens
tttttaatgaccaat

SEQ ID NO: 1133220 - DNA, 14 bp, Homo sapiens
tttttaatgtattc

SEQ ID NO: 1133221 - DNA, 13 bp, Homo sapiens
tttttaatgtttt

SEQ ID NO: 1133222 - DNA, 19 bp, Homo sapiens
tttttaattcaccaaagta

SEQ ID NO: 1133223 - DNA, 16 bp, Homo sapiens
tttttaatttatttat

SEQ ID NO: 1133224 - DNA, 16 bp, Homo sapiens
tttttaatttctaaga

SEQ ID NO: 1133225 - DNA, 17 bp, Homo sapiens
tttttaatttgatgaaa

SEQ ID NO: 1133226 - DNA, 20 bp, Homo sapiens
tttttaatttgatgaaagct

SEQ ID NO: 1133227 - DNA, 15 bp, Homo sapiens
tttttacaaagccct

SEQ ID NO: 1133228 - DNA, 13 bp, Homo sapiens
tttttacaataaa

SEQ ID NO: 1133229 - DNA, 21 bp, Homo sapiens
tttttacagcattgtctttgc

SEQ ID NO: 1133230 - DNA, 22 bp, Homo sapiens
tttttacagcattgtctttgct

SEQ ID NO: 1133231 - DNA, 20 bp, Homo sapiens
tttttacattatgcaaataa

SEQ ID NO: 1133232 - DNA, 19 bp, Homo sapiens
tttttaccgtttcttccct

SEQ ID NO: 1133233 - DNA, 15 bp, Homo sapiens
tttttactgctctga

SEQ ID NO: 1133234 - DNA, 21 bp, Homo sapiens
tttttacttttcacactgtct

SEQ ID NO: 1133235 - DNA, 18 bp, Homo sapiens
tttttagaataagaattt

SEQ ID NO: 1133236 - DNA, 22 bp, Homo sapiens
tttttagaataagaatttgcat

SEQ ID NO: 1133237 - DNA, 15 bp, Homo sapiens
tttttagatcaaata

SEQ ID NO: 1133238 - DNA, 20 bp, Homo sapiens
tttttagattgagaaatgtg

SEQ ID NO: 1133239 - DNA, 23 bp, Homo sapiens
tttttagctttgtgtttactttt

SEQ ID NO: 1133240 - DNA, 22 bp, Homo sapiens
tttttagtaagttaatgtatat

SEQ ID NO: 1133241 - DNA, 13 bp, Homo sapiens
tttttagttcaat

SEQ ID NO: 1133242 - DNA, 18 bp, Homo sapiens
tttttataaaatggctgt

SEQ ID NO: 1133243 - DNA, 13 bp, Homo sapiens
tttttataataga

SEQ ID NO: 1133244 - DNA, 18 bp, Homo sapiens
tttttataatgttattca

SEQ ID NO: 1133245 - DNA, 12 bp, Homo sapiens
tttttataatta

SEQ ID NO: 1133246 - DNA, 20 bp, Homo sapiens
tttttatacaaacctaccaa

SEQ ID NO: 1133247 - DNA, 12 bp, Homo sapiens
tttttatactgc

SEQ ID NO: 1133248 - DNA, 23 bp, Homo sapiens
tttttatactgcacagtggcaca

SEQ ID NO: 1133249 - DNA, 18 bp, Homo sapiens
tttttatagcaacaacaa

SEQ ID NO: 1133250 - DNA, 16 bp, Homo sapiens
tttttatatgaaataa

SEQ ID NO: 1133251 - DNA, 15 bp, Homo sapiens
tttttatattaatgt

SEQ ID NO: 1133252 - DNA, 15 bp, Homo sapiens
tttttatatttcctt

SEQ ID NO: 1133253 - DNA, 20 bp, Homo sapiens
tttttatcgtcactgcttaa

SEQ ID NO: 1133254 - DNA, 19 bp, Homo sapiens
tttttatgaagaaaaagta

SEQ ID NO: 1133255 - DNA, 17 bp, Homo sapiens
tttttatgcaaaagtca

SEQ ID NO: 1133256 - DNA, 22 bp, Homo sapiens
tttttatggcttttgtgcatta

SEQ ID NO: 1133257 - DNA, 16 bp, Homo sapiens
tttttatgtgatcaat

SEQ ID NO: 1133258 - DNA, 21 bp, Homo sapiens
tttttatgtgatgccaaagat

SEQ ID NO: 1133259 - DNA, 14 bp, Homo sapiens
tttttattaattta

SEQ ID NO: 1133260 - DNA, 23 bp, Homo sapiens
tttttattaattttagtttttca

SEQ ID NO: 1133261 - DNA, 13 bp, Homo sapiens
tttttattctgtt

SEQ ID NO: 1133262 - DNA, 13 bp, Homo sapiens
tttttatttaaaa

SEQ ID NO: 1133263 - DNA, 13 bp, Homo sapiens
tttttatttaatt

SEQ ID NO: 1133264 - DNA, 18 bp, Homo sapiens
tttttattttaggcactg

SEQ ID NO: 1133265 - DNA, 15 bp, Homo sapiens
tttttcaaaatagaa

SEQ ID NO: 1133266 - DNA, 19 bp, Homo sapiens
tttttcaagttgtaaataa

SEQ ID NO: 1133267 - DNA, 21 bp, Homo sapiens
tttttcaagttgtaaataatt

SEQ ID NO: 1133268 - DNA, 17 bp, Homo sapiens
tttttcaatatattgaa

SEQ ID NO: 1133269 - DNA, 19 bp, Homo sapiens
tttttcaatatattgaact

SEQ ID NO: 1133270 - DNA, 16 bp, Homo sapiens
tttttcaatatttatt

SEQ ID NO: 1133271 - DNA, 15 bp, Homo sapiens
tttttcacacatcgt

SEQ ID NO: 1133272 - DNA, 22 bp, Homo sapiens
tttttcacggaagttttcaatg

SEQ ID NO: 1133273 - DNA, 20 bp, Homo sapiens
tttttcactttgtgtattaa

SEQ ID NO: 1133274 - DNA, 21 bp, Homo sapiens
tttttcagttcatatgcagaa

SEQ ID NO: 1133275 - DNA, 17 bp, Homo sapiens
tttttcagttccaagaa

SEQ ID NO: 1133276 - DNA, 21 bp, Homo sapiens
tttttcagttccaagaaagat

SEQ ID NO: 1133277 - DNA, 20 bp, Homo sapiens
tttttcagttgttcttttta

SEQ ID NO: 1133278 - DNA, 15 bp, Homo sapiens
tttttcagttttcag

SEQ ID NO: 1133279 - DNA, 20 bp, Homo sapiens
tttttcatcttcagttgtct

SEQ ID NO: 1133280 - DNA, 20 bp, Homo sapiens
tttttcattaaataaatttg

SEQ ID NO: 1133281 - DNA, 23 bp, Homo sapiens
tttttcattcatcccattaatca

SEQ ID NO: 1133282 - DNA, 13 bp, Homo sapiens
tttttcatttctt

SEQ ID NO: 1133283 - DNA, 12 bp, Homo sapiens
tttttcattttt

SEQ ID NO: 1133284 - DNA, 20 bp, Homo sapiens
tttttcatttttttctctct

SEQ ID NO: 1133285 - DNA, 21 bp, Homo sapiens
tttttccaaattattaattgt

SEQ ID NO: 1133286 - DNA, 21 bp, Homo sapiens
tttttccacaaggaataaatg

SEQ ID NO: 1133287 - DNA, 14 bp, Homo sapiens
tttttccactttgt

SEQ ID NO: 1133288 - DNA, 20 bp, Homo sapiens
tttttccactttgttcttta

SEQ ID NO: 1133289 - DNA, 14 bp, Homo sapiens
tttttccaggactc

SEQ ID NO: 1133290 - DNA, 13 bp, Homo sapiens
tttttccatcttt

SEQ ID NO: 1133291 - DNA, 12 bp, Homo sapiens
tttttccccctt

SEQ ID NO: 1133292 - DNA, 15 bp, Homo sapiens
tttttccctccccag

SEQ ID NO: 1133293 - DNA, 13 bp, Homo sapiens
tttttcctaagtt

SEQ ID NO: 1133294 - DNA, 17 bp, Homo sapiens
tttttcctatgctattg

SEQ ID NO: 1133295 - DNA, 18 bp, Homo sapiens
tttttcctcatgtaacat

SEQ ID NO: 1133296 - DNA, 13 bp, Homo sapiens
tttttcctcccag

SEQ ID NO: 1133297 - DNA, 23 bp, Homo sapiens
tttttcctcttcagaacttgtca

SEQ ID NO: 1133298 - DNA, 18 bp, Homo sapiens
tttttcctgcatgttctg

SEQ ID NO: 1133299 - DNA, 17 bp, Homo sapiens
tttttccttgtatttaa

SEQ ID NO: 1133300 - DNA, 16 bp, Homo sapiens
tttttctaagagaagt

SEQ ID NO: 1133301 - DNA, 23 bp, Homo sapiens
tttttctaagtgtaacctcagta

SEQ ID NO: 1133302 - DNA, 22 bp, Homo sapiens
tttttctacacagtaaaaactt

SEQ ID NO: 1133303 - DNA, 15 bp, Homo sapiens
tttttctataaatca

SEQ ID NO: 1133304 - DNA, 11 bp, Homo sapiens
tttttctatga

SEQ ID NO: 1133305 - DNA, 13 bp, Homo sapiens
aaaagtgaacttt

SEQ ID NO: 1133306 - DNA, 22 bp, Homo sapiens
aaaagtgaacttttgtaatttg

SEQ ID NO: 1133307 - DNA, 14 bp, Homo sapiens
aaaagtgacacagc

SEQ ID NO: 1133308 - DNA, 16 bp, Homo sapiens
aaaagtgatgtatttt

SEQ ID NO: 1133309 - DNA, 19 bp, Homo sapiens
aaaagtgggctgcagcagc

SEQ ID NO: 1133310 - DNA, 15 bp, Homo sapiens
aaaagtggtctctgc

SEQ ID NO: 1133311 - DNA, 19 bp, Homo sapiens
aaaagtgttgattacataa

SEQ ID NO: 1133312 - DNA, 19 bp, Homo sapiens
aaaagttacatgtttgcac

SEQ ID NO: 1133313 - DNA, 15 bp, Homo sapiens
aaaagttataataac

SEQ ID NO: 1133314 - DNA, 21 bp, Homo sapiens
aaaagttcaatactcttgaaa

SEQ ID NO: 1133315 - DNA, 13 bp, Homo sapiens
aaaagttcagagt

SEQ ID NO: 1133316 - DNA, 19 bp, Homo sapiens
aaaagttcctctcccttcc

SEQ ID NO: 1133317 - DNA, 16 bp, Homo sapiens
aaaagttcgaaagaaa

SEQ ID NO: 1133318 - DNA, 12 bp, Homo sapiens
aaaagttgaaat

SEQ ID NO: 1133319 - DNA, 14 bp, Homo sapiens
aaaagttgaaatta

SEQ ID NO: 1133320 - DNA, 22 bp, Homo sapiens
aaaagttggaaggatctgctga

SEQ ID NO: 1133321 - DNA, 13 bp, Homo sapiens
aaaagtttacaac

SEQ ID NO: 1133322 - DNA, 22 bp, Homo sapiens
aaaagtttacaagtgtatatca

SEQ ID NO: 1133323 - DNA, 17 bp, Homo sapiens
aaaagtttattgtttga

SEQ ID NO: 1133324 - DNA, 20 bp, Homo sapiens
aaaagttttgaaggaaacct

SEQ ID NO: 1133325 - DNA, 21 bp, Homo sapiens
aaaagttttgatatttatttt

SEQ ID NO: 1133326 - DNA, 21 bp, Homo sapiens
aaaataaaaaaaagaaaaaag

SEQ ID NO: 1133327 - DNA, 17 bp, Homo sapiens
aaaataaaaagtgacac

SEQ ID NO: 1133328 - DNA, 21 bp, Homo sapiens
aaaataaaaagtgacacagca

SEQ ID NO: 1133329 - DNA, 22 bp, Homo sapiens
aaaataaaaagtgacacagcag

SEQ ID NO: 1133330 - DNA, 13 bp, Homo sapiens
aaaataaaaatgg

SEQ ID NO: 1133331 - DNA, 12 bp, Homo sapiens
aaaataaaacaa

SEQ ID NO: 1133332 - DNA, 19 bp, Homo sapiens
aaaataaaacaagccttaa

SEQ ID NO: 1133333 - DNA, 13 bp, Homo sapiens
aaaataaaacaca

SEQ ID NO: 1133334 - DNA, 15 bp, Homo sapiens
aaaataaaacacatt

SEQ ID NO: 1133335 - DNA, 14 bp, Homo sapiens
aaaataaaactaag

SEQ ID NO: 1133336 - DNA, 13 bp, Homo sapiens
aaaataaaatgaa

SEQ ID NO: 1133337 - DNA, 12 bp, Homo sapiens
aaaataaaatta

SEQ ID NO: 1133338 - DNA, 12 bp, Homo sapiens
aaaataaacaaa

SEQ ID NO: 1133339 - DNA, 12 bp, Homo sapiens
aaaataaacatc

SEQ ID NO: 1133340 - DNA, 17 bp, Homo sapiens
aaaataaacgtggattt

SEQ ID NO: 1133341 - DNA, 11 bp, Homo sapiens
aaaataaactt

SEQ ID NO: 1133342 - DNA, 12 bp, Homo sapiens
aaaataaacttc

SEQ ID NO: 1133343 - DNA, 14 bp, Homo sapiens
aaaataaatatata

SEQ ID NO: 1133344 - DNA, 18 bp, Homo sapiens
aaaataaatgtcactgcc

SEQ ID NO: 1133345 - DNA, 19 bp, Homo sapiens
aaaataaatgtcactgcca

SEQ ID NO: 1133346 - DNA, 13 bp, Homo sapiens
aaaataaattaat

SEQ ID NO: 1133347 - DNA, 13 bp, Homo sapiens
aaaataaatttaa

SEQ ID NO: 1133348 - DNA, 16 bp, Homo sapiens
aaaataacactgttgg

SEQ ID NO: 1133349 - DNA, 18 bp, Homo sapiens
aaaataacctaattaata

SEQ ID NO: 1133350 - DNA, 12 bp, Homo sapiens
aaaataagaaaa

SEQ ID NO: 1133351 - DNA, 15 bp, Homo sapiens
aaaataagaaaagat

SEQ ID NO: 1133352 - DNA, 16 bp, Homo sapiens
aaaataagaatagaaa

SEQ ID NO: 1133353 - DNA, 14 bp, Homo sapiens
aaaataagcaggtg

SEQ ID NO: 1133354 - DNA, 14 bp, Homo sapiens
aaaataagtcaaca

SEQ ID NO: 1133355 - DNA, 16 bp, Homo sapiens
aaaataatgtaatgat

SEQ ID NO: 1133356 - DNA, 20 bp, Homo sapiens
aaaataattatataactgta

SEQ ID NO: 1133357 - DNA, 19 bp, Homo sapiens
aaaataattatttattaca

SEQ ID NO: 1133358 - DNA, 19 bp, Homo sapiens
aaaataattgagatcacat

SEQ ID NO: 1133359 - DNA, 16 bp, Homo sapiens
aaaataattgatttca

SEQ ID NO: 1133360 - DNA, 19 bp, Homo sapiens
aaaataattttaaacaaag

SEQ ID NO: 1133361 - DNA, 14 bp, Homo sapiens
aaaataattttgta

SEQ ID NO: 1133362 - DNA, 19 bp, Homo sapiens
aaaatacaatcctgtttat

SEQ ID NO: 1133363 - DNA, 13 bp, Homo sapiens
aaaatacaatgtt

SEQ ID NO: 1133364 - DNA, 21 bp, Homo sapiens
aaaatacacgtttatcttaca

SEQ ID NO: 1133365 - DNA, 17 bp, Homo sapiens
aaaatacataagaccat

SEQ ID NO: 1133366 - DNA, 12 bp, Homo sapiens
aaaatacattgt

SEQ ID NO: 1133367 - DNA, 18 bp, Homo sapiens
aaaataccaaatgcctgt

SEQ ID NO: 1133368 - DNA, 22 bp, Homo sapiens
aaaataccaaatgcctgttgta

SEQ ID NO: 1133369 - DNA, 17 bp, Homo sapiens
aaaataccattgaaatc

SEQ ID NO: 1133370 - DNA, 20 bp, Homo sapiens
aaaatacgatcggtttcata

SEQ ID NO: 1133371 - DNA, 20 bp, Homo sapiens
aaaatacgttttgtgtatat

SEQ ID NO: 1133372 - DNA, 13 bp, Homo sapiens
aaaatactaccta

SEQ ID NO: 1133373 - DNA, 22 bp, Homo sapiens
aaaatactacctataggaaagt

SEQ ID NO: 1133374 - DNA, 15 bp, Homo sapiens
aaaatactctagcct

SEQ ID NO: 1133375 - DNA, 9 bp, Homo sapiens
aaaatactt

SEQ ID NO: 1133376 - DNA, 13 bp, Homo sapiens
aaaatacttctat

SEQ ID NO: 1133377 - DNA, 12 bp, Homo sapiens
aaaatactttga

SEQ ID NO: 1133378 - DNA, 15 bp, Homo sapiens
aaaatactttgattt

SEQ ID NO: 1133379 - DNA, 18 bp, Homo sapiens
aaaatactttgattttta

SEQ ID NO: 1133380 - DNA, 11 bp, Homo sapiens
aaaatactttt

SEQ ID NO: 1133381 - DNA, 22 bp, Homo sapiens
aaaatacttttactctgcctac

SEQ ID NO: 1133382 - DNA, 19 bp, Homo sapiens
aaaatactttttctaatga

SEQ ID NO: 1133383 - DNA, 15 bp, Homo sapiens
aaaatagaaaagtta

SEQ ID NO: 1133384 - DNA, 13 bp, Homo sapiens
aaaatagaaagtt

SEQ ID NO: 1133385 - DNA, 17 bp, Homo sapiens
aaaatagaaattttgta

SEQ ID NO: 1133386 - DNA, 20 bp, Homo sapiens
aaaatagaaattttgtaaga

SEQ ID NO: 1133387 - DNA, 21 bp, Homo sapiens
aaaatagactaacttcagtag

SEQ ID NO: 1133388 - DNA, 16 bp, Homo sapiens
aaaatagagcttttaa

SEQ ID NO: 1133389 - DNA, 22 bp, Homo sapiens
aaaatagataagagtagaaact

SEQ ID NO: 1133390 - DNA, 17 bp, Homo sapiens
aaaatagcaaaagaaga

SEQ ID NO: 1133391 - DNA, 21 bp, Homo sapiens
aaaatagcaacactctatatt

SEQ ID NO: 1133392 - DNA, 13 bp, Homo sapiens
aaaatagcatact

SEQ ID NO: 1133393 - DNA, 18 bp, Homo sapiens
aaaatagcggtacaagtt

SEQ ID NO: 1133394 - DNA, 16 bp, Homo sapiens
aaaatagcgttcttgt

SEQ ID NO: 1133395 - DNA, 18 bp, Homo sapiens
aaaatagcttattataga

SEQ ID NO: 1133396 - DNA, 12 bp, Homo sapiens
aaaatagcttgt

SEQ ID NO: 1133397 - DNA, 22 bp, Homo sapiens
aaaataggattgcttcaattaa

SEQ ID NO: 1133398 - DNA, 17 bp, Homo sapiens
aaaataggctttttaat

SEQ ID NO: 1133399 - DNA, 18 bp, Homo sapiens
aaaataggggatatttaa

SEQ ID NO: 1133400 - DNA, 21 bp, Homo sapiens
aaaatagtcatttttagcact

SEQ ID NO: 1133401 - DNA, 20 bp, Homo sapiens
aaaatagtgtaagaactgta

SEQ ID NO: 1133402 - DNA, 23 bp, Homo sapiens
aaaatagttaagacatgatttcc

SEQ ID NO: 1133403 - DNA, 16 bp, Homo sapiens
aaaatataaattgtac

SEQ ID NO: 1133404 - DNA, 10 bp, Homo sapiens
aaaatataac

SEQ ID NO: 1133405 - DNA, 19 bp, Homo sapiens
aaaatataaccattacatg

SEQ ID NO: 1133406 - DNA, 24 bp, Homo sapiens
aaaatataattttttagagagctg

SEQ ID NO: 1133407 - DNA, 13 bp, Homo sapiens
aaaatatagcaaa

SEQ ID NO: 1133408 - DNA, 21 bp, Homo sapiens
aaaatatagctgtacaaatat

SEQ ID NO: 1133409 - DNA, 10 bp, Homo sapiens
aaaatatata

SEQ ID NO: 1133410 - DNA, 13 bp, Homo sapiens
aaaatatatacta

SEQ ID NO: 1133411 - DNA, 17 bp, Homo sapiens
aaaatatatactaaaca

SEQ ID NO: 1133412 - DNA, 14 bp, Homo sapiens
aaaatatatgttct

SEQ ID NO: 1133413 - DNA, 16 bp, Homo sapiens
aaaatatatgttctgc

SEQ ID NO: 1133414 - DNA, 16 bp, Homo sapiens
aaaatatcataaagca

SEQ ID NO: 1133415 - DNA, 23 bp, Homo sapiens
aaaatatcctgtaactacaatga

SEQ ID NO: 1133416 - DNA, 21 bp, Homo sapiens
aaaatatgaacctattttcat

SEQ ID NO: 1133417 - DNA, 23 bp, Homo sapiens
aaaatatgaacctattttcattt

SEQ ID NO: 1133418 - DNA, 13 bp, Homo sapiens
aaaatatgatact

SEQ ID NO: 1133419 - DNA, 20 bp, Homo sapiens
aaaatatgggttgcatttgg

SEQ ID NO: 1133420 - DNA, 15 bp, Homo sapiens
aaaatatggtttggt

SEQ ID NO: 1133421 - DNA, 15 bp, Homo sapiens
aaaatatgtaatttc

SEQ ID NO: 1133422 - DNA, 14 bp, Homo sapiens
aaaatatgtatgtc

SEQ ID NO: 1133423 - DNA, 14 bp, Homo sapiens
aaaatatgttcttt

SEQ ID NO: 1133424 - DNA, 16 bp, Homo sapiens
aaaatattataactta

SEQ ID NO: 1133425 - DNA, 16 bp, Homo sapiens
aaaccacttctctgct

SEQ ID NO: 1133426 - DNA, 18 bp, Homo sapiens
aaaccagagaatcttaag

SEQ ID NO: 1133427 - DNA, 13 bp, Homo sapiens
aaaccagcaggtg

SEQ ID NO: 1133428 - DNA, 13 bp, Homo sapiens
aaaccagccaggc

SEQ ID NO: 1133429 - DNA, 18 bp, Homo sapiens
aaaccaggaaaaaataaa

SEQ ID NO: 1133430 - DNA, 19 bp, Homo sapiens
aaaccagtgttagggaagg

SEQ ID NO: 1133431 - DNA, 18 bp, Homo sapiens
aaaccagtttattctgtg

SEQ ID NO: 1133432 - DNA, 23 bp, Homo sapiens
aaaccatccagtgacaaaccatc

SEQ ID NO: 1133433 - DNA, 12 bp, Homo sapiens
aaaccatgacaa

SEQ ID NO: 1133434 - DNA, 15 bp, Homo sapiens
aaaccatgagaattt

SEQ ID NO: 1133435 - DNA, 21 bp, Homo sapiens
aaaccatgagaatttgcaaca

SEQ ID NO: 1133436 - DNA, 21 bp, Homo sapiens
aaaccatgcctggtattttca

SEQ ID NO: 1133437 - DNA, 17 bp, Homo sapiens
aaaccattgcttcacta

SEQ ID NO: 1133438 - DNA, 12 bp, Homo sapiens
aaaccattggac

SEQ ID NO: 1133439 - DNA, 21 bp, Homo sapiens
aaaccattggacagatttcag

SEQ ID NO: 1133440 - DNA, 15 bp, Homo sapiens
aaaccattgtaacta

SEQ ID NO: 1133441 - DNA, 19 bp, Homo sapiens
aaaccattttattttttgg

SEQ ID NO: 1133442 - DNA, 20 bp, Homo sapiens
aaaccattttattttttggg

SEQ ID NO: 1133443 - DNA, 21 bp, Homo sapiens
aaaccattttattttttgggc

SEQ ID NO: 1133444 - DNA, 17 bp, Homo sapiens
aaaccatttttaaagta

SEQ ID NO: 1133445 - DNA, 16 bp, Homo sapiens
aaacccaaagccctgg

SEQ ID NO: 1133446 - DNA, 13 bp, Homo sapiens
aaacccaagtccc

SEQ ID NO: 1133447 - DNA, 14 bp, Homo sapiens
aaacccaagtgctg

SEQ ID NO: 1133448 - DNA, 20 bp, Homo sapiens
aaacccaatacttttgtcca

SEQ ID NO: 1133449 - DNA, 18 bp, Homo sapiens
aaacccacctgctagtgt

SEQ ID NO: 1133450 - DNA, 23 bp, Homo sapiens
aaacccaccttgttggagcctgc

SEQ ID NO: 1133451 - DNA, 23 bp, Homo sapiens
aaacccacttctggcctccagcc

SEQ ID NO: 1133452 - DNA, 20 bp, Homo sapiens
aaacccagaaagattttctc

SEQ ID NO: 1133453 - DNA, 18 bp, Homo sapiens
aaacccagacaaccaaaa

SEQ ID NO: 1133454 - DNA, 13 bp, Homo sapiens
aaacccagaggtg

SEQ ID NO: 1133455 - DNA, 13 bp, Homo sapiens
aaacccagggcaa

SEQ ID NO: 1133456 - DNA, 16 bp, Homo sapiens
aaacccatacaatgta

SEQ ID NO: 1133457 - DNA, 19 bp, Homo sapiens
aaacccatacaatgtatgt

SEQ ID NO: 1133458 - DNA, 22 bp, Homo sapiens
aaacccatacaatgtatgtaca

SEQ ID NO: 1133459 - DNA, 15 bp, Homo sapiens
aaacccgagggacag

SEQ ID NO: 1133460 - DNA, 21 bp, Homo sapiens
aaacccgtctctactaaaaat

SEQ ID NO: 1133461 - DNA, 13 bp, Homo sapiens
aaaccctagcctt

SEQ ID NO: 1133462 - DNA, 14 bp, Homo sapiens
aaaccctagccttg

SEQ ID NO: 1133463 - DNA, 11 bp, Homo sapiens
aaaccctaggt

SEQ ID NO: 1133464 - DNA, 21 bp, Homo sapiens
aaaccctaggttcccggtccc

SEQ ID NO: 1133465 - DNA, 15 bp, Homo sapiens
aaaccctgctgaaca

SEQ ID NO: 1133466 - DNA, 22 bp, Homo sapiens
aaaccctggtggtattttattt

SEQ ID NO: 1133467 - DNA, 21 bp, Homo sapiens
aaaccctgtggggcctgatgg

SEQ ID NO: 1133468 - DNA, 16 bp, Homo sapiens
aaacccttgctttcct

SEQ ID NO: 1133469 - DNA, 16 bp, Homo sapiens
aaaccctttagtgctt

SEQ ID NO: 1133470 - DNA, 15 bp, Homo sapiens
aaaccgctaaaagaa

SEQ ID NO: 1133471 - DNA, 17 bp, Homo sapiens
aaaccgtgtgtccagca

SEQ ID NO: 1133472 - DNA, 20 bp, Homo sapiens
aaacctaagtcctttatgtg

SEQ ID NO: 1133473 - DNA, 22 bp, Homo sapiens
aaacctagcttttaaaaaatat

SEQ ID NO: 1133474 - DNA, 18 bp, Homo sapiens
aaacctatcctcactgcc

SEQ ID NO: 1133475 - DNA, 19 bp, Homo sapiens
aaacctatctcagggaggg

SEQ ID NO: 1133476 - DNA, 12 bp, Homo sapiens
aaacctccagcc

SEQ ID NO: 1133477 - DNA, 14 bp, Homo sapiens
aaacctcctgctgt

SEQ ID NO: 1133478 - DNA, 16 bp, Homo sapiens
aaacctctactaaaaa

SEQ ID NO: 1133479 - DNA, 17 bp, Homo sapiens
aaacctctcctgacccc

SEQ ID NO: 1133480 - DNA, 18 bp, Homo sapiens
aaacctctcctgacccct

SEQ ID NO: 1133481 - DNA, 21 bp, Homo sapiens
aaacctgaactcagaccactt

SEQ ID NO: 1133482 - DNA, 18 bp, Homo sapiens
aaacctgaagactgagga

SEQ ID NO: 1133483 - DNA, 19 bp, Homo sapiens
aaacctgatgttaaaattc

SEQ ID NO: 1133484 - DNA, 15 bp, Homo sapiens
aaacctgcttccttc

SEQ ID NO: 1133485 - DNA, 23 bp, Homo sapiens
aaacctggattttttatgtacaa

SEQ ID NO: 1133486 - DNA, 18 bp, Homo sapiens
aaacctgggattcaggaa

SEQ ID NO: 1133487 - DNA, 19 bp, Homo sapiens
aaacctgttgaagattatt

SEQ ID NO: 1133488 - DNA, 19 bp, Homo sapiens
aaaccttaaaaaatgtttc

SEQ ID NO: 1133489 - DNA, 13 bp, Homo sapiens
aaaccttaatatt

SEQ ID NO: 1133490 - DNA, 14 bp, Homo sapiens
aaaccttaatattt

SEQ ID NO: 1133491 - DNA, 15 bp, Homo sapiens
aaaccttaatatttc

SEQ ID NO: 1133492 - DNA, 13 bp, Homo sapiens
aaaccttagtttc

SEQ ID NO: 1133493 - DNA, 16 bp, Homo sapiens
aaaccttattgtacct

SEQ ID NO: 1133494 - DNA, 18 bp, Homo sapiens
aaaccttattgtacctct

SEQ ID NO: 1133495 - DNA, 12 bp, Homo sapiens
aaaccttgaaca

SEQ ID NO: 1133496 - DNA, 15 bp, Homo sapiens
aaaccttgaacagtg

SEQ ID NO: 1133497 - DNA, 22 bp, Homo sapiens
aaaccttgggccctggaagagt

SEQ ID NO: 1133498 - DNA, 16 bp, Homo sapiens
aaaccttgttctattt

SEQ ID NO: 1133499 - DNA, 11 bp, Homo sapiens
aaacctttcaa

SEQ ID NO: 1133500 - DNA, 19 bp, Homo sapiens
aaacctttcaaatttcaca

SEQ ID NO: 1133501 - DNA, 15 bp, Homo sapiens
aaacctttcataatt

SEQ ID NO: 1133502 - DNA, 21 bp, Homo sapiens
aaacgacactctctggaagcc

SEQ ID NO: 1133503 - DNA, 17 bp, Homo sapiens
aaacgagactttccatt

SEQ ID NO: 1133504 - DNA, 14 bp, Homo sapiens
aaacgagataatgt

SEQ ID NO: 1133505 - DNA, 19 bp, Homo sapiens
aaacgagggctgatggagg

SEQ ID NO: 1133506 - DNA, 19 bp, Homo sapiens
aaacgcaaagggctgaaag

SEQ ID NO: 1133507 - DNA, 15 bp, Homo sapiens
aaacgcacttacaag

SEQ ID NO: 1133508 - DNA, 22 bp, Homo sapiens
aaacgcctcttttccctctcta

SEQ ID NO: 1133509 - DNA, 12 bp, Homo sapiens
aaacgccttgca

SEQ ID NO: 1133510 - DNA, 20 bp, Homo sapiens
aaacgcgtgatgaagacaga

SEQ ID NO: 1133511 - DNA, 18 bp, Homo sapiens
aaacgctacctctctgtc

SEQ ID NO: 1133512 - DNA, 16 bp, Homo sapiens
aaacggatgagttatt

SEQ ID NO: 1133513 - DNA, 20 bp, Homo sapiens
aaacggcaacgtagcctggg

SEQ ID NO: 1133514 - DNA, 21 bp, Homo sapiens
aaacggcaacgtagcctgggc

SEQ ID NO: 1133515 - DNA, 18 bp, Homo sapiens
aaacgggcagtctgctct

SEQ ID NO: 1133516 - DNA, 23 bp, Homo sapiens
aaacggtatcctccctgcccatc

SEQ ID NO: 1133517 - DNA, 16 bp, Homo sapiens
aaacggtgcccatcct

SEQ ID NO: 1133518 - DNA, 17 bp, Homo sapiens
aaacggttcagtttctt

SEQ ID NO: 1133519 - DNA, 16 bp, Homo sapiens
aaacgtattcagagtt

SEQ ID NO: 1133520 - DNA, 20 bp, Homo sapiens
aaacgtctattttgtatatt

SEQ ID NO: 1133521 - DNA, 21 bp, Homo sapiens
aaacgtggtcaccttcgagta

SEQ ID NO: 1133522 - DNA, 13 bp, Homo sapiens
aaacgtgtaaatt

SEQ ID NO: 1133523 - DNA, 17 bp, Homo sapiens
aaacgtgtaaattgcac

SEQ ID NO: 1133524 - DNA, 18 bp, Homo sapiens
aaacgtgttcgaaagtct

SEQ ID NO: 1133525 - DNA, 17 bp, Homo sapiens
aaacgtgttgccttgaa

SEQ ID NO: 1133526 - DNA, 22 bp, Homo sapiens
aaacgtgttgtatctacagtaa

SEQ ID NO: 1133527 - DNA, 22 bp, Homo sapiens
aaaagagccctggctctgcccc

SEQ ID NO: 1133528 - DNA, 23 bp, Homo sapiens
aaaagagccctggctctgcccct

SEQ ID NO: 1133529 - DNA, 13 bp, Homo sapiens
aaaagagctactc

SEQ ID NO: 1133530 - DNA, 15 bp, Homo sapiens
aaaagagctgtctga

SEQ ID NO: 1133531 - DNA, 13 bp, Homo sapiens
aaaagagctttat

SEQ ID NO: 1133532 - DNA, 20 bp, Homo sapiens
aaaagaggtttaagtttgtt

SEQ ID NO: 1133533 - DNA, 15 bp, Homo sapiens
aaaagagtcagccct

SEQ ID NO: 1133534 - DNA, 19 bp, Homo sapiens
aaaagataatattttacat

SEQ ID NO: 1133535 - DNA, 20 bp, Homo sapiens
aaaagatacgactttatttt

SEQ ID NO: 1133536 - DNA, 13 bp, Homo sapiens
aaaagatgcttct

SEQ ID NO: 1133537 - DNA, 21 bp, Homo sapiens
aaaagatggcttatgtcatca

SEQ ID NO: 1133538 - DNA, 22 bp, Homo sapiens
aaaagatggtaaaccagatctg

SEQ ID NO: 1133539 - DNA, 22 bp, Homo sapiens
aaaagatgtagatttatttcat

SEQ ID NO: 1133540 - DNA, 23 bp, Homo sapiens
aaaagatgtatatttgcatattt

SEQ ID NO: 1133541 - DNA, 11 bp, Homo sapiens
aaaagattcta

SEQ ID NO: 1133542 - DNA, 18 bp, Homo sapiens
aaaagattgctgaaattt

SEQ ID NO: 1133543 - DNA, 21 bp, Homo sapiens
aaaagattgctgaaattttat

SEQ ID NO: 1133544 - DNA, 16 bp, Homo sapiens
aaaagattggagctga

SEQ ID NO: 1133545 - DNA, 18 bp, Homo sapiens
aaaagcaaaaagatgtat

SEQ ID NO: 1133546 - DNA, 16 bp, Homo sapiens
aaaagcaaaaagcaag

SEQ ID NO: 1133547 - DNA, 12 bp, Homo sapiens
aaaagcaaaatc

SEQ ID NO: 1133548 - DNA, 14 bp, Homo sapiens
aaaagcaaatgaga

SEQ ID NO: 1133549 - DNA, 14 bp, Homo sapiens
aaaagcaaatggaa

SEQ ID NO: 1133550 - DNA, 14 bp, Homo sapiens
aaaagcaagactgt

SEQ ID NO: 1133551 - DNA, 18 bp, Homo sapiens
aaaagcaagggagaaaag

SEQ ID NO: 1133552 - DNA, 15 bp, Homo sapiens
aaaagcaatattgta

SEQ ID NO: 1133553 - DNA, 15 bp, Homo sapiens
aaaagcaatggttga

SEQ ID NO: 1133554 - DNA, 22 bp, Homo sapiens
aaaagcacaaagttctcagagc

SEQ ID NO: 1133555 - DNA, 21 bp, Homo sapiens
aaaagcacactcatcccctca

SEQ ID NO: 1133556 - DNA, 13 bp, Homo sapiens
aaaagcactttga

SEQ ID NO: 1133557 - DNA, 23 bp, Homo sapiens
aaaagcagacgcagcagctggga

SEQ ID NO: 1133558 - DNA, 18 bp, Homo sapiens
aaaagcagagtggactgc

SEQ ID NO: 1133559 - DNA, 17 bp, Homo sapiens
aaaagcagctctcccct

SEQ ID NO: 1133560 - DNA, 19 bp, Homo sapiens
aaaagcagtaaatttgcta

SEQ ID NO: 1133561 - DNA, 18 bp, Homo sapiens
aaaagcagtcccattcat

SEQ ID NO: 1133562 - DNA, 15 bp, Homo sapiens
aaaagcatgaaacat

SEQ ID NO: 1133563 - DNA, 19 bp, Homo sapiens
aaaagcatgatgggaaaat

SEQ ID NO: 1133564 - DNA, 14 bp, Homo sapiens
aaaagcattttgta

SEQ ID NO: 1133565 - DNA, 11 bp, Homo sapiens
aaaagccatgt

SEQ ID NO: 1133566 - DNA, 17 bp, Homo sapiens
aaaagccatgtataacc

SEQ ID NO: 1133567 - DNA, 24 bp, Homo sapiens
aaaagccatgtatttcagggacct

SEQ ID NO: 1133568 - DNA, 17 bp, Homo sapiens
aaaagccattattatga

SEQ ID NO: 1133569 - DNA, 10 bp, Homo sapiens
aaaagcccac

SEQ ID NO: 1133570 - DNA, 21 bp, Homo sapiens
aaaagcccacctgaaagcctg

SEQ ID NO: 1133571 - DNA, 21 bp, Homo sapiens
aaaagccctcatcttctcttt

SEQ ID NO: 1133572 - DNA, 11 bp, Homo sapiens
aaaagcctgct

SEQ ID NO: 1133573 - DNA, 21 bp, Homo sapiens
aaaagcgtgagcttaaaatac

SEQ ID NO: 1133574 - DNA, 20 bp, Homo sapiens
aaaagctatttaaagcatct

SEQ ID NO: 1133575 - DNA, 14 bp, Homo sapiens
aaaagctcatattt

SEQ ID NO: 1133576 - DNA, 12 bp, Homo sapiens
aaaagctcctgt

SEQ ID NO: 1133577 - DNA, 13 bp, Homo sapiens
aaaagctctttta

SEQ ID NO: 1133578 - DNA, 17 bp, Homo sapiens
aaaagctgactgttttt

SEQ ID NO: 1133579 - DNA, 19 bp, Homo sapiens
aaaagcttaataaattcca

SEQ ID NO: 1133580 - DNA, 14 bp, Homo sapiens
aaaagcttccatga

SEQ ID NO: 1133581 - DNA, 13 bp, Homo sapiens
aaaagctttcatg

SEQ ID NO: 1133582 - DNA, 11 bp, Homo sapiens
aaaaggaaaaa

SEQ ID NO: 1133583 - DNA, 13 bp, Homo sapiens
aaaaggaaaaaaa

SEQ ID NO: 1133584 - DNA, 20 bp, Homo sapiens
aaaaggaaaaaaaacacaaa

SEQ ID NO: 1133585 - DNA, 14 bp, Homo sapiens
aaaaggaaacttcc

SEQ ID NO: 1133586 - DNA, 13 bp, Homo sapiens
aaaaggaaagtca

SEQ ID NO: 1133587 - DNA, 15 bp, Homo sapiens
aaaaggaaattagtc

SEQ ID NO: 1133588 - DNA, 15 bp, Homo sapiens
aaaaggaaatttgtt

SEQ ID NO: 1133589 - DNA, 17 bp, Homo sapiens
aaaaggaaatttgtttg

SEQ ID NO: 1133590 - DNA, 11 bp, Homo sapiens
aaaaggaagga

SEQ ID NO: 1133591 - DNA, 20 bp, Homo sapiens
aaaaggacgtaaaatttaca

SEQ ID NO: 1133592 - DNA, 13 bp, Homo sapiens
aaaaggagagaag

SEQ ID NO: 1133593 - DNA, 18 bp, Homo sapiens
aaaaggagcgggcagggc

SEQ ID NO: 1133594 - DNA, 19 bp, Homo sapiens
aaaaggatctttgtggcca

SEQ ID NO: 1133595 - DNA, 20 bp, Homo sapiens
aaaaggatctttgtggccaa

SEQ ID NO: 1133596 - DNA, 22 bp, Homo sapiens
aaaaggatgttacaagtttgct

SEQ ID NO: 1133597 - DNA, 16 bp, Homo sapiens
aaaaggcaaaagactg

SEQ ID NO: 1133598 - DNA, 11 bp, Homo sapiens
aaaaggcagga

SEQ ID NO: 1133599 - DNA, 15 bp, Homo sapiens
aaaaggcatctgaac

SEQ ID NO: 1133600 - DNA, 14 bp, Homo sapiens
aaaaggccctgtgg

SEQ ID NO: 1133601 - DNA, 15 bp, Homo sapiens
aaaaggcctcttgta

SEQ ID NO: 1133602 - DNA, 15 bp, Homo sapiens
aaaaggcgcatctaa

SEQ ID NO: 1133603 - DNA, 11 bp, Homo sapiens
aaaaggctgga

SEQ ID NO: 1133604 - DNA, 16 bp, Homo sapiens
aaaaggctgtgctgcc

SEQ ID NO: 1133605 - DNA, 14 bp, Homo sapiens
aaaagggaaaaaag

SEQ ID NO: 1133606 - DNA, 18 bp, Homo sapiens
aaaagggaactgaacatt

SEQ ID NO: 1133607 - DNA, 13 bp, Homo sapiens
aaaagggacagca

SEQ ID NO: 1133608 - DNA, 19 bp, Homo sapiens
aaaagggagtttaaaaatg

SEQ ID NO: 1133609 - DNA, 11 bp, Homo sapiens
aaaaggggccc

SEQ ID NO: 1133610 - DNA, 19 bp, Homo sapiens
aaaagggtcttgggaaata

SEQ ID NO: 1133611 - DNA, 15 bp, Homo sapiens
aaaagggtgtatagt

SEQ ID NO: 1133612 - DNA, 20 bp, Homo sapiens
aaaagggtgtatagtgttca

SEQ ID NO: 1133613 - DNA, 16 bp, Homo sapiens
aaaaggtaactaactg

SEQ ID NO: 1133614 - DNA, 19 bp, Homo sapiens
aaaaggtatgcaatcaaat

SEQ ID NO: 1133615 - DNA, 21 bp, Homo sapiens
aaaaggtattttgaataccat

SEQ ID NO: 1133616 - DNA, 23 bp, Homo sapiens
aaaaggtcctacgaaaacggaat

SEQ ID NO: 1133617 - DNA, 13 bp, Homo sapiens
aaaaggtgaaaat

SEQ ID NO: 1133618 - DNA, 17 bp, Homo sapiens
aaaaggttaataaagta

SEQ ID NO: 1133619 - DNA, 19 bp, Homo sapiens
aaaaggttcactaaagcag

SEQ ID NO: 1133620 - DNA, 20 bp, Homo sapiens
aaaaggtttatgaaaaagaa

SEQ ID NO: 1133621 - DNA, 23 bp, Homo sapiens
aaaaggtttatgaaaaagaagaa

SEQ ID NO: 1133622 - DNA, 23 bp, Homo sapiens
aaaaggtttctttttttttcctt

SEQ ID NO: 1133623 - DNA, 12 bp, Homo sapiens
aaaagtaaaatg

SEQ ID NO: 1133624 - DNA, 13 bp, Homo sapiens
aaaagtaaaatgt

SEQ ID NO: 1133625 - DNA, 11 bp, Homo sapiens
aaaagtaaatg

SEQ ID NO: 1133626 - DNA, 12 bp, Homo sapiens
aaaagtaaatgg

SEQ ID NO: 1133627 - DNA, 22 bp, Homo sapiens
aaaagtaagtaccactcaggcc

SEQ ID NO: 1133628 - DNA, 22 bp, Homo sapiens
aaaagtaatgacttagaaactg

SEQ ID NO: 1133629 - DNA, 13 bp, Homo sapiens
aaaagtaattttg

SEQ ID NO: 1133630 - DNA, 21 bp, Homo sapiens
aaaagtaattttgtcacatta

SEQ ID NO: 1133631 - DNA, 20 bp, Homo sapiens
aaaagtacaatgaactgctt

SEQ ID NO: 1133632 - DNA, 14 bp, Homo sapiens
aaaagtacattgct

SEQ ID NO: 1133633 - DNA, 13 bp, Homo sapiens
aaaagtacattta

SEQ ID NO: 1133634 - DNA, 17 bp, Homo sapiens
aaaagtacatttaatac

SEQ ID NO: 1133635 - DNA, 13 bp, Homo sapiens
aaaagtatatgtt

SEQ ID NO: 1133636 - DNA, 23 bp, Homo sapiens
aaaagtatctttaacaattgtct

SEQ ID NO: 1133637 - DNA, 23 bp, Homo sapiens
aaaagtatgttctaacctttaca

SEQ ID NO: 1133638 - DNA, 14 bp, Homo sapiens
aaaagtatgttgta

SEQ ID NO: 1133639 - DNA, 15 bp, Homo sapiens
aaaagtattctcaaa

SEQ ID NO: 1133640 - DNA, 19 bp, Homo sapiens
aaaagtattgaaagccaac

SEQ ID NO: 1133641 - DNA, 19 bp, Homo sapiens
aaaagtattttttcaagtt

SEQ ID NO: 1133642 - DNA, 21 bp, Homo sapiens
aaaaataaatttggttctaat

SEQ ID NO: 1133643 - DNA, 12 bp, Homo sapiens
aaaaataataat

SEQ ID NO: 1133644 - DNA, 18 bp, Homo sapiens
aaaaataatcaaaagcta

SEQ ID NO: 1133645 - DNA, 18 bp, Homo sapiens
aaaaataatcaagatttt

SEQ ID NO: 1133646 - DNA, 19 bp, Homo sapiens
aaaaataatcaagatttta

SEQ ID NO: 1133647 - DNA, 19 bp, Homo sapiens
aaaaatacgttttgtgtat

SEQ ID NO: 1133648 - DNA, 13 bp, Homo sapiens
aaaaatactacct

SEQ ID NO: 1133649 - DNA, 15 bp, Homo sapiens
aaaaatacttgtcaa

SEQ ID NO: 1133650 - DNA, 12 bp, Homo sapiens
aaaaatagacag

SEQ ID NO: 1133651 - DNA, 15 bp, Homo sapiens
aaaaatagagagaga

SEQ ID NO: 1133652 - DNA, 11 bp, Homo sapiens
aaaaatatatt

SEQ ID NO: 1133653 - DNA, 12 bp, Homo sapiens
aaaaatatgtat

SEQ ID NO: 1133654 - DNA, 14 bp, Homo sapiens
aaaaatatgtcatc

SEQ ID NO: 1133655 - DNA, 10 bp, Homo sapiens
aaaaatatta

SEQ ID NO: 1133656 - DNA, 15 bp, Homo sapiens
aaaaatattgctaaa

SEQ ID NO: 1133657 - DNA, 11 bp, Homo sapiens
aaaaatattta

SEQ ID NO: 1133658 - DNA, 13 bp, Homo sapiens
aaaaatattttaa

SEQ ID NO: 1133659 - DNA, 14 bp, Homo sapiens
aaaaatcacaaaaa

SEQ ID NO: 1133660 - DNA, 19 bp, Homo sapiens
aaaaatcatgggccagagc

SEQ ID NO: 1133661 - DNA, 12 bp, Homo sapiens
aaaaatccaaaa

SEQ ID NO: 1133662 - DNA, 18 bp, Homo sapiens
aaaaatcccttgttctca

SEQ ID NO: 1133663 - DNA, 15 bp, Homo sapiens
aaaaatcctcttcct

SEQ ID NO: 1133664 - DNA, 15 bp, Homo sapiens
aaaaatccttttgaa

SEQ ID NO: 1133665 - DNA, 23 bp, Homo sapiens
aaaaatcgatgagcgccacctct

SEQ ID NO: 1133666 - DNA, 19 bp, Homo sapiens
aaaaatctcaaatttctaa

SEQ ID NO: 1133667 - DNA, 13 bp, Homo sapiens
aaaaatcttgtgc

SEQ ID NO: 1133668 - DNA, 19 bp, Homo sapiens
aaaaatgacaacagaaaaa

SEQ ID NO: 1133669 - DNA, 17 bp, Homo sapiens
aaaaatgacagatgttg

SEQ ID NO: 1133670 - DNA, 20 bp, Homo sapiens
aaaaatgagagctgtaactg

SEQ ID NO: 1133671 - DNA, 14 bp, Homo sapiens
aaaaatgatctaaa

SEQ ID NO: 1133672 - DNA, 11 bp, Homo sapiens
aaaaatgatgc

SEQ ID NO: 1133673 - DNA, 18 bp, Homo sapiens
aaaaatgccatcaaatga

SEQ ID NO: 1133674 - DNA, 19 bp, Homo sapiens
aaaaatgctgaacattgca

SEQ ID NO: 1133675 - DNA, 14 bp, Homo sapiens
aaaaatgctgctct

SEQ ID NO: 1133676 - DNA, 15 bp, Homo sapiens
aaaaatggatattat

SEQ ID NO: 1133677 - DNA, 20 bp, Homo sapiens
aaaaatgggagacagcctct

SEQ ID NO: 1133678 - DNA, 22 bp, Homo sapiens
aaaaatgggagacagcctctta

SEQ ID NO: 1133679 - DNA, 13 bp, Homo sapiens
aaaaatggtaatt

SEQ ID NO: 1133680 - DNA, 16 bp, Homo sapiens
aaaaatgtaaaacaca

SEQ ID NO: 1133681 - DNA, 12 bp, Homo sapiens
aaaaatgtaaat

SEQ ID NO: 1133682 - DNA, 13 bp, Homo sapiens
aaaaatgtaaata

SEQ ID NO: 1133683 - DNA, 16 bp, Homo sapiens
aaaaatgtaatttaga

SEQ ID NO: 1133684 - DNA, 21 bp, Homo sapiens
aaaaatgtcttgctgttgaca

SEQ ID NO: 1133685 - DNA, 13 bp, Homo sapiens
aaaaatgtgaaat

SEQ ID NO: 1133686 - DNA, 23 bp, Homo sapiens
aaaaatgtgaaatgcttttatat

SEQ ID NO: 1133687 - DNA, 16 bp, Homo sapiens
aaaaatgttgagaagc

SEQ ID NO: 1133688 - DNA, 20 bp, Homo sapiens
aaaaatgttggatttataaa

SEQ ID NO: 1133689 - DNA, 16 bp, Homo sapiens
aaaaatgtttccactg

SEQ ID NO: 1133690 - DNA, 20 bp, Homo sapiens
aaaaattaaaccaagcagct

SEQ ID NO: 1133691 - DNA, 14 bp, Homo sapiens
aaaaattaaagccc

SEQ ID NO: 1133692 - DNA, 12 bp, Homo sapiens
aaaaattaactg

SEQ ID NO: 1133693 - DNA, 15 bp, Homo sapiens
aaaaattaacttttt

SEQ ID NO: 1133694 - DNA, 23 bp, Homo sapiens
aaaaattacagcttcaccctgtc

SEQ ID NO: 1133695 - DNA, 22 bp, Homo sapiens
aaaaattacatatataaaacta

SEQ ID NO: 1133696 - DNA, 18 bp, Homo sapiens
aaaaattactaattttac

SEQ ID NO: 1133697 - DNA, 13 bp, Homo sapiens
aaaaattagctga

SEQ ID NO: 1133698 - DNA, 22 bp, Homo sapiens
aaaaattcagcaaaccattttt

SEQ ID NO: 1133699 - DNA, 19 bp, Homo sapiens
aaaaattcctttgtgtttc

SEQ ID NO: 1133700 - DNA, 20 bp, Homo sapiens
aaaaattctgttgttccatt

SEQ ID NO: 1133701 - DNA, 14 bp, Homo sapiens
aaaaattgaaagaa

SEQ ID NO: 1133702 - DNA, 21 bp, Homo sapiens
aaaaattgttaatttttccta

SEQ ID NO: 1133703 - DNA, 13 bp, Homo sapiens
aaaaattgtttct

SEQ ID NO: 1133704 - DNA, 11 bp, Homo sapiens
aaaaatttaaa

SEQ ID NO: 1133705 - DNA, 21 bp, Homo sapiens
aaaaatttaaagggtgtactt

SEQ ID NO: 1133706 - DNA, 16 bp, Homo sapiens
aaaaatttaagcattg

SEQ ID NO: 1133707 - DNA, 20 bp, Homo sapiens
aaaaatttttgacacttttt

SEQ ID NO: 1133708 - DNA, 11 bp, Homo sapiens
aaaacaaaaaa

SEQ ID NO: 1133709 - DNA, 17 bp, Homo sapiens
aaaacaaaaaaagacaa

SEQ ID NO: 1133710 - DNA, 16 bp, Homo sapiens
aaaacaaaaagaacaa

SEQ ID NO: 1133711 - DNA, 15 bp, Homo sapiens
aaaacaaaaagatgt

SEQ ID NO: 1133712 - DNA, 12 bp, Homo sapiens
aaaacaaaagag

SEQ ID NO: 1133713 - DNA, 16 bp, Homo sapiens
aaaacaaaagagagaa

SEQ ID NO: 1133714 - DNA, 15 bp, Homo sapiens
aaaacaaaatctaaa

SEQ ID NO: 1133715 - DNA, 18 bp, Homo sapiens
aaaacaaaatctgaactc

SEQ ID NO: 1133716 - DNA, 12 bp, Homo sapiens
aaaacaaaattt

SEQ ID NO: 1133717 - DNA, 23 bp, Homo sapiens
aaaacaaaggagcattaagccca

SEQ ID NO: 1133718 - DNA, 16 bp, Homo sapiens
aaaacaaatctataaa

SEQ ID NO: 1133719 - DNA, 23 bp, Homo sapiens
aaaacaaccaacagaaaacatcc

SEQ ID NO: 1133720 - DNA, 22 bp, Homo sapiens
aaaacaactatggatcagaata

SEQ ID NO: 1133721 - DNA, 14 bp, Homo sapiens
aaaacaactctgat

SEQ ID NO: 1133722 - DNA, 16 bp, Homo sapiens
aaaacaacttggcatt

SEQ ID NO: 1133723 - DNA, 22 bp, Homo sapiens
aaaacaagtatataatttactt

SEQ ID NO: 1133724 - DNA, 16 bp, Homo sapiens
aaaacaagttttagaa

SEQ ID NO: 1133725 - DNA, 18 bp, Homo sapiens
aaaacaatattgtttcta

SEQ ID NO: 1133726 - DNA, 19 bp, Homo sapiens
aaaacaatctggaagaaaa

SEQ ID NO: 1133727 - DNA, 16 bp, Homo sapiens
aaaacaattcagtggt

SEQ ID NO: 1133728 - DNA, 18 bp, Homo sapiens
aaaacaattgcaacagaa

SEQ ID NO: 1133729 - DNA, 13 bp, Homo sapiens
aaaacacacaggt

SEQ ID NO: 1133730 - DNA, 14 bp, Homo sapiens
aaaacacacataaa

SEQ ID NO: 1133731 - DNA, 19 bp, Homo sapiens
aaaacacatacaaaagaat

SEQ ID NO: 1133732 - DNA, 15 bp, Homo sapiens
aaaacacatttttct

SEQ ID NO: 1133733 - DNA, 22 bp, Homo sapiens
aaaacacctagctttattcttc

SEQ ID NO: 1133734 - DNA, 20 bp, Homo sapiens
aaaacacgcacaccctgccc

SEQ ID NO: 1133735 - DNA, 21 bp, Homo sapiens
aaaacactgaaaaatattcca

SEQ ID NO: 1133736 - DNA, 13 bp, Homo sapiens
aaaacactgtgga

SEQ ID NO: 1133737 - DNA, 16 bp, Homo sapiens
aaaacagaatttgaga

SEQ ID NO: 1133738 - DNA, 17 bp, Homo sapiens
aaaacagaatttgagaa

SEQ ID NO: 1133739 - DNA, 14 bp, Homo sapiens
aaaacagattctga

SEQ ID NO: 1133740 - DNA, 18 bp, Homo sapiens
aaaacagcaggccatctt

SEQ ID NO: 1133741 - DNA, 16 bp, Homo sapiens
aaaacagcagtttgtg

SEQ ID NO: 1133742 - DNA, 21 bp, Homo sapiens
aaaacagccaccgtttcttcc

SEQ ID NO: 1133743 - DNA, 14 bp, Homo sapiens
aaaacagcccccac

SEQ ID NO: 1133744 - DNA, 18 bp, Homo sapiens
aaaacagcctcacagaag

SEQ ID NO: 1133745 - DNA, 19 bp, Homo sapiens
aaatacccaaatgtccctg

SEQ ID NO: 1133746 - DNA, 18 bp, Homo sapiens
aaatacctaattgtggat

SEQ ID NO: 1133747 - DNA, 16 bp, Homo sapiens
aaatacctcaattttt

SEQ ID NO: 1133748 - DNA, 19 bp, Homo sapiens
aaataccttctatgtatta

SEQ ID NO: 1133749 - DNA, 15 bp, Homo sapiens
aaataccttttctca

SEQ ID NO: 1133750 - DNA, 17 bp, Homo sapiens
aaatacgttttgtgtat

SEQ ID NO: 1133751 - DNA, 13 bp, Homo sapiens
aaatactacctat

SEQ ID NO: 1133752 - DNA, 15 bp, Homo sapiens
aaatactcatgtgca

SEQ ID NO: 1133753 - DNA, 20 bp, Homo sapiens
aaatactctttcaataaatg

SEQ ID NO: 1133754 - DNA, 17 bp, Homo sapiens
aaatactgcaagaaaat

SEQ ID NO: 1133755 - DNA, 21 bp, Homo sapiens
aaatactggactcaggaactt

SEQ ID NO: 1133756 - DNA, 15 bp, Homo sapiens
aaatactgtacaatg

SEQ ID NO: 1133757 - DNA, 18 bp, Homo sapiens
aaatactgtcaaacaata

SEQ ID NO: 1133758 - DNA, 15 bp, Homo sapiens
aaatacttgcagttg

SEQ ID NO: 1133759 - DNA, 20 bp, Homo sapiens
aaatacttgtcaatatttaa

SEQ ID NO: 1133760 - DNA, 19 bp, Homo sapiens
aaatactttttaacaaaaa

SEQ ID NO: 1133761 - DNA, 15 bp, Homo sapiens
aaatactttttcagt

SEQ ID NO: 1133762 - DNA, 16 bp, Homo sapiens
aaatactttttctaat

SEQ ID NO: 1133763 - DNA, 18 bp, Homo sapiens
aaatagaaaacaggaaaa

SEQ ID NO: 1133764 - DNA, 14 bp, Homo sapiens
aaatagaaaagtta

SEQ ID NO: 1133765 - DNA, 15 bp, Homo sapiens
aaatagaaaagttat

SEQ ID NO: 1133766 - DNA, 16 bp, Homo sapiens
aaatagaaagaagcca

SEQ ID NO: 1133767 - DNA, 23 bp, Homo sapiens
aaatagaaagagttctatggaga

SEQ ID NO: 1133768 - DNA, 22 bp, Homo sapiens
aaatagaaagttgcaaggcaaa

SEQ ID NO: 1133769 - DNA, 19 bp, Homo sapiens
aaatagaaattttgtaaga

SEQ ID NO: 1133770 - DNA, 21 bp, Homo sapiens
aaatagaacactgcctctgag

SEQ ID NO: 1133771 - DNA, 24 bp, Homo sapiens
aaatagaactatctgcattatcta

SEQ ID NO: 1133772 - DNA, 16 bp, Homo sapiens
aaatagaagagagagg

SEQ ID NO: 1133773 - DNA, 20 bp, Homo sapiens
aaatagaattgacattgaaa

SEQ ID NO: 1133774 - DNA, 15 bp, Homo sapiens
aaatagacaaataga

SEQ ID NO: 1133775 - DNA, 17 bp, Homo sapiens
aaatagacagcatgaga

SEQ ID NO: 1133776 - DNA, 16 bp, Homo sapiens
aaatagacagtatatt

SEQ ID NO: 1133777 - DNA, 15 bp, Homo sapiens
aaatagagagagagg

SEQ ID NO: 1133778 - DNA, 18 bp, Homo sapiens
aaatagagcaaaatcaac

SEQ ID NO: 1133779 - DNA, 23 bp, Homo sapiens
aaatagagcaaaatcaacatgac

SEQ ID NO: 1133780 - DNA, 20 bp, Homo sapiens
aaatagagccaactgatttt

SEQ ID NO: 1133781 - DNA, 19 bp, Homo sapiens
aaatagagtttgctattag

SEQ ID NO: 1133782 - DNA, 20 bp, Homo sapiens
aaatagatggatttgtatca

SEQ ID NO: 1133783 - DNA, 13 bp, Homo sapiens
aaatagatttaaa

SEQ ID NO: 1133784 - DNA, 21 bp, Homo sapiens
aaatagatttttgattcagct

SEQ ID NO: 1133785 - DNA, 17 bp, Homo sapiens
aaatagcaaaagaagaa

SEQ ID NO: 1133786 - DNA, 13 bp, Homo sapiens
aaatagcagagcc

SEQ ID NO: 1133787 - DNA, 18 bp, Homo sapiens
aaatagcatactgtgtat

SEQ ID NO: 1133788 - DNA, 18 bp, Homo sapiens
aaatagccaaaaaggcaa

SEQ ID NO: 1133789 - DNA, 21 bp, Homo sapiens
aaatagccgggcatggtggcg

SEQ ID NO: 1133790 - DNA, 15 bp, Homo sapiens
aaatagcctaaatga

SEQ ID NO: 1133791 - DNA, 18 bp, Homo sapiens
aaatagcgctgtttttgt

SEQ ID NO: 1133792 - DNA, 20 bp, Homo sapiens
aaatagcgttcttgtaattt

SEQ ID NO: 1133793 - DNA, 16 bp, Homo sapiens
aaatagcttgtatagt

SEQ ID NO: 1133794 - DNA, 13 bp, Homo sapiens
aaataggaggaaa

SEQ ID NO: 1133795 - DNA, 17 bp, Homo sapiens
aaataggattaaacaca

SEQ ID NO: 1133796 - DNA, 19 bp, Homo sapiens
aaataggattaaacacaca

SEQ ID NO: 1133797 - DNA, 14 bp, Homo sapiens
aaataggcagaatg

SEQ ID NO: 1133798 - DNA, 14 bp, Homo sapiens
aaataggcaggaag

SEQ ID NO: 1133799 - DNA, 19 bp, Homo sapiens
aaataggctattaaaaaag

SEQ ID NO: 1133800 - DNA, 17 bp, Homo sapiens
aaataggggatatttaa

SEQ ID NO: 1133801 - DNA, 16 bp, Homo sapiens
aaataggtcatcatga

SEQ ID NO: 1133802 - DNA, 20 bp, Homo sapiens
aaatagtcatttttagcact

SEQ ID NO: 1133803 - DNA, 23 bp, Homo sapiens
aaatagtctctttaaaaggaaag

SEQ ID NO: 1133804 - DNA, 12 bp, Homo sapiens
aaatagtgtaag

SEQ ID NO: 1133805 - DNA, 15 bp, Homo sapiens
aaatagtgtaagaac

SEQ ID NO: 1133806 - DNA, 20 bp, Homo sapiens
aaatagtgtaagaactgtac

SEQ ID NO: 1133807 - DNA, 22 bp, Homo sapiens
aaatagtgtaagaactgtacat

SEQ ID NO: 1133808 - DNA, 20 bp, Homo sapiens
aaatagtgtggaaattaaga

SEQ ID NO: 1133809 - DNA, 14 bp, Homo sapiens
aaatagtttggata

SEQ ID NO: 1133810 - DNA, 12 bp, Homo sapiens
aaatataaaact

SEQ ID NO: 1133811 - DNA, 18 bp, Homo sapiens
aaatataaaactgaaata

SEQ ID NO: 1133812 - DNA, 23 bp, Homo sapiens
aaatataacaggtgcttctttgt

SEQ ID NO: 1133813 - DNA, 19 bp, Homo sapiens
aaatataaccattacatgt

SEQ ID NO: 1133814 - DNA, 23 bp, Homo sapiens
aaatataaccattacatgtttaa

SEQ ID NO: 1133815 - DNA, 20 bp, Homo sapiens
aaatataaggactttttgat

SEQ ID NO: 1133816 - DNA, 14 bp, Homo sapiens
aaatataatcagac

SEQ ID NO: 1133817 - DNA, 19 bp, Homo sapiens
aaatataattctgtaaatg

SEQ ID NO: 1133818 - DNA, 13 bp, Homo sapiens
aaatataattgta

SEQ ID NO: 1133819 - DNA, 15 bp, Homo sapiens
aaatatacaaaactt

SEQ ID NO: 1133820 - DNA, 15 bp, Homo sapiens
aaatatacagtttga

SEQ ID NO: 1133821 - DNA, 18 bp, Homo sapiens
aaatatacagtttgactt

SEQ ID NO: 1133822 - DNA, 15 bp, Homo sapiens
aaatatacattttct

SEQ ID NO: 1133823 - DNA, 20 bp, Homo sapiens
aaatatacattttctaaata

SEQ ID NO: 1133824 - DNA, 14 bp, Homo sapiens
aaactacttcattt

SEQ ID NO: 1133825 - DNA, 18 bp, Homo sapiens
aaactagggccaagccca

SEQ ID NO: 1133826 - DNA, 22 bp, Homo sapiens
aaactataaaaaagaaagaatt

SEQ ID NO: 1133827 - DNA, 15 bp, Homo sapiens
aaactataaacttaa

SEQ ID NO: 1133828 - DNA, 22 bp, Homo sapiens
aaactataagcaagaaggcaaa

SEQ ID NO: 1133829 - DNA, 14 bp, Homo sapiens
aaactatcttgtgt

SEQ ID NO: 1133830 - DNA, 16 bp, Homo sapiens
aaactatggttcccaa

SEQ ID NO: 1133831 - DNA, 18 bp, Homo sapiens
aaactatggttcccaata

SEQ ID NO: 1133832 - DNA, 21 bp, Homo sapiens
aaactatggttcccaataaaa

SEQ ID NO: 1133833 - DNA, 17 bp, Homo sapiens
aaactatgtgtttttct

SEQ ID NO: 1133834 - DNA, 21 bp, Homo sapiens
aaactatgtgtttttctcata

SEQ ID NO: 1133835 - DNA, 14 bp, Homo sapiens
aaactatgttccta

SEQ ID NO: 1133836 - DNA, 15 bp, Homo sapiens
aaactatgttcctaa

SEQ ID NO: 1133837 - DNA, 20 bp, Homo sapiens
aaactattgagccttgcatg

SEQ ID NO: 1133838 - DNA, 20 bp, Homo sapiens
aaactattggaaagtactcc

SEQ ID NO: 1133839 - DNA, 17 bp, Homo sapiens
aaactatttaaaattgg

SEQ ID NO: 1133840 - DNA, 22 bp, Homo sapiens
aaactatttatctgtgtttttg

SEQ ID NO: 1133841 - DNA, 13 bp, Homo sapiens
aaactcaaaatat

SEQ ID NO: 1133842 - DNA, 13 bp, Homo sapiens
aaactcaagacaa

SEQ ID NO: 1133843 - DNA, 23 bp, Homo sapiens
aaactcaaggaggtggtgaattt

SEQ ID NO: 1133844 - DNA, 14 bp, Homo sapiens
aaactcaatgcttt

SEQ ID NO: 1133845 - DNA, 18 bp, Homo sapiens
aaactcaccatgtaaaag

SEQ ID NO: 1133846 - DNA, 20 bp, Homo sapiens
aaactcacctgctggcccct

SEQ ID NO: 1133847 - DNA, 22 bp, Homo sapiens
aaactcacctgctggcccctca

SEQ ID NO: 1133848 - DNA, 16 bp, Homo sapiens
aaactcactgctcaag

SEQ ID NO: 1133849 - DNA, 20 bp, Homo sapiens
aaactcactgctcaagaaga

SEQ ID NO: 1133850 - DNA, 19 bp, Homo sapiens
aaactcagaatataacatg

SEQ ID NO: 1133851 - DNA, 14 bp, Homo sapiens
aaactcagatctga

SEQ ID NO: 1133852 - DNA, 13 bp, Homo sapiens
aaactcagatgtc

SEQ ID NO: 1133853 - DNA, 17 bp, Homo sapiens
aaactcaggcaaagaaa

SEQ ID NO: 1133854 - DNA, 18 bp, Homo sapiens
aaactcagggacagagcc

SEQ ID NO: 1133855 - DNA, 17 bp, Homo sapiens
aaactcatattacaaaa

SEQ ID NO: 1133856 - DNA, 14 bp, Homo sapiens
aaactcatcatttt

SEQ ID NO: 1133857 - DNA, 21 bp, Homo sapiens
aaactcattcattagtcatgt

SEQ ID NO: 1133858 - DNA, 14 bp, Homo sapiens
aaactcatttatct

SEQ ID NO: 1133859 - DNA, 15 bp, Homo sapiens
aaactcatttcctat

SEQ ID NO: 1133860 - DNA, 16 bp, Homo sapiens
aaactccacatctgcc

SEQ ID NO: 1133861 - DNA, 17 bp, Homo sapiens
aaactccacatctgcct

SEQ ID NO: 1133862 - DNA, 22 bp, Homo sapiens
aaactccagatgccacaatgga

SEQ ID NO: 1133863 - DNA, 23 bp, Homo sapiens
aaactccagggtcccctgccacc

SEQ ID NO: 1133864 - DNA, 15 bp, Homo sapiens
aaactcccaatggat

SEQ ID NO: 1133865 - DNA, 13 bp, Homo sapiens
aaactccccttcc

SEQ ID NO: 1133866 - DNA, 14 bp, Homo sapiens
aaactccccttccc

SEQ ID NO: 1133867 - DNA, 23 bp, Homo sapiens
aaactccccttccctggggagcc

SEQ ID NO: 1133868 - DNA, 14 bp, Homo sapiens
aaactctaccctga

SEQ ID NO: 1133869 - DNA, 21 bp, Homo sapiens
aaactctccttttccttacca

SEQ ID NO: 1133870 - DNA, 15 bp, Homo sapiens
aaactctctagctta

SEQ ID NO: 1133871 - DNA, 17 bp, Homo sapiens
aaactctctttgggaat

SEQ ID NO: 1133872 - DNA, 16 bp, Homo sapiens
aaactctgaaggagag

SEQ ID NO: 1133873 - DNA, 17 bp, Homo sapiens
aaactctgcatccagag

SEQ ID NO: 1133874 - DNA, 11 bp, Homo sapiens
aaactctgcca

SEQ ID NO: 1133875 - DNA, 12 bp, Homo sapiens
aaactctgctgt

SEQ ID NO: 1133876 - DNA, 18 bp, Homo sapiens
aaactctggctcagcctg

SEQ ID NO: 1133877 - DNA, 13 bp, Homo sapiens
aaactctgggtct

SEQ ID NO: 1133878 - DNA, 16 bp, Homo sapiens
aaactctgggtcttgg

SEQ ID NO: 1133879 - DNA, 22 bp, Homo sapiens
aaactctgttacactttttgga

SEQ ID NO: 1133880 - DNA, 11 bp, Homo sapiens
aaactcttcag

SEQ ID NO: 1133881 - DNA, 14 bp, Homo sapiens
aaactcttcagtgc

SEQ ID NO: 1133882 - DNA, 21 bp, Homo sapiens
aaactcttcagttaattctta

SEQ ID NO: 1133883 - DNA, 13 bp, Homo sapiens
aaactctttcatt

SEQ ID NO: 1133884 - DNA, 14 bp, Homo sapiens
aaactgaaaatcta

SEQ ID NO: 1133885 - DNA, 14 bp, Homo sapiens
aaactgaaagtgtt

SEQ ID NO: 1133886 - DNA, 11 bp, Homo sapiens
aaactgaagaa

SEQ ID NO: 1133887 - DNA, 14 bp, Homo sapiens
aaactgaagcaact

SEQ ID NO: 1133888 - DNA, 13 bp, Homo sapiens
aaactgaatattt

SEQ ID NO: 1133889 - DNA, 13 bp, Homo sapiens
aaactgacagtat

SEQ ID NO: 1133890 - DNA, 22 bp, Homo sapiens
aaactgacatgccctcccttct

SEQ ID NO: 1133891 - DNA, 18 bp, Homo sapiens
aaactgagcctcacttgc

SEQ ID NO: 1133892 - DNA, 14 bp, Homo sapiens
aaactgaggaattt

SEQ ID NO: 1133893 - DNA, 19 bp, Homo sapiens
aaactgaggaattttcttt

SEQ ID NO: 1133894 - DNA, 15 bp, Homo sapiens
aaactgatgctgagg

SEQ ID NO: 1133895 - DNA, 22 bp, Homo sapiens
aaactgatgctgaggatgattg

SEQ ID NO: 1133896 - DNA, 18 bp, Homo sapiens
aaactgcaatagagactg

SEQ ID NO: 1133897 - DNA, 16 bp, Homo sapiens
aaactgcacagtgctg

SEQ ID NO: 1133898 - DNA, 15 bp, Homo sapiens
aaactgcacatctac

SEQ ID NO: 1133899 - DNA, 17 bp, Homo sapiens
aaactgcagcctctctg

SEQ ID NO: 1133900 - DNA, 14 bp, Homo sapiens
aaactgcattagaa

SEQ ID NO: 1133901 - DNA, 12 bp, Homo sapiens
aaactgcatttg

SEQ ID NO: 1133902 - DNA, 14 bp, Homo sapiens
aaactgcatttgtg

SEQ ID NO: 1133903 - DNA, 20 bp, Homo sapiens
aaactgcctttgatacaggc

SEQ ID NO: 1133904 - DNA, 15 bp, Homo sapiens
aaactgctaaattct

SEQ ID NO: 1133905 - DNA, 14 bp, Homo sapiens
aaactgctgtcaat

SEQ ID NO: 1133906 - DNA, 19 bp, Homo sapiens
aaactggaacggtgaaggt

SEQ ID NO: 1133907 - DNA, 11 bp, Homo sapiens
aaactggaagc

SEQ ID NO: 1133908 - DNA, 16 bp, Homo sapiens
aaactggattaaaaca

SEQ ID NO: 1133909 - DNA, 15 bp, Homo sapiens
aaactggattatcac

SEQ ID NO: 1133910 - DNA, 9 bp, Homo sapiens
aaactggct

SEQ ID NO: 1133911 - DNA, 20 bp, Homo sapiens
aaactggggcctccagaact

SEQ ID NO: 1133912 - DNA, 20 bp, Homo sapiens
aaactgtaaataaaatgtgt

SEQ ID NO: 1133913 - DNA, 23 bp, Homo sapiens
aaactgtaaataaaatgtgtaca

SEQ ID NO: 1133914 - DNA, 13 bp, Homo sapiens
aaactgtacagtg

SEQ ID NO: 1133915 - DNA, 15 bp, Homo sapiens
aaactgtacatttaa

SEQ ID NO: 1133916 - DNA, 14 bp, Homo sapiens
aaactgtactgtgt

SEQ ID NO: 1133917 - DNA, 15 bp, Homo sapiens
aaactgtagaaatga

SEQ ID NO: 1133918 - DNA, 14 bp, Homo sapiens
aaactgtagcaaga

SEQ ID NO: 1133919 - DNA, 19 bp, Homo sapiens
aaactgtattaaatcttaa

SEQ ID NO: 1133920 - DNA, 22 bp, Homo sapiens
aaactgtattaaatcttaaaca

SEQ ID NO: 1133921 - DNA, 14 bp, Homo sapiens
aaactgtcactgtt

SEQ ID NO: 1133922 - DNA, 20 bp, Homo sapiens
aaaggctctgaaagccagct

SEQ ID NO: 1133923 - DNA, 18 bp, Homo sapiens
aaaggctgtgctgccctg

SEQ ID NO: 1133924 - DNA, 23 bp, Homo sapiens
aaaggctgtgctgccctgaagaa

SEQ ID NO: 1133925 - DNA, 18 bp, Homo sapiens
aaaggctgttaaatacag

SEQ ID NO: 1133926 - DNA, 22 bp, Homo sapiens
aaaggctgttaaatacaggaaa

SEQ ID NO: 1133927 - DNA, 15 bp, Homo sapiens
aaagggaaactggct

SEQ ID NO: 1133928 - DNA, 13 bp, Homo sapiens
aaagggaacacaa

SEQ ID NO: 1133929 - DNA, 11 bp, Homo sapiens
aaagggaagta

SEQ ID NO: 1133930 - DNA, 21 bp, Homo sapiens
aaagggaattcgatgcccccc

SEQ ID NO: 1133931 - DNA, 22 bp, Homo sapiens
aaagggacagcatgccccttgg

SEQ ID NO: 1133932 - DNA, 19 bp, Homo sapiens
aaagggagaaagaaaactg

SEQ ID NO: 1133933 - DNA, 17 bp, Homo sapiens
aaagggagaaatgccag

SEQ ID NO: 1133934 - DNA, 15 bp, Homo sapiens
aaagggagaaggaag

SEQ ID NO: 1133935 - DNA, 16 bp, Homo sapiens
aaagggagaatggtgc

SEQ ID NO: 1133936 - DNA, 15 bp, Homo sapiens
aaagggaggaacact

SEQ ID NO: 1133937 - DNA, 14 bp, Homo sapiens
aaagggagtttttg

SEQ ID NO: 1133938 - DNA, 16 bp, Homo sapiens
aaagggcagaggaaga

SEQ ID NO: 1133939 - DNA, 12 bp, Homo sapiens
aaagggcagggc

SEQ ID NO: 1133940 - DNA, 20 bp, Homo sapiens
aaagggcagggcatctcctg

SEQ ID NO: 1133941 - DNA, 15 bp, Homo sapiens
aaagggcagggccca

SEQ ID NO: 1133942 - DNA, 21 bp, Homo sapiens
aaagggcataccttgtgcatt

SEQ ID NO: 1133943 - DNA, 13 bp, Homo sapiens
aaagggccaggtg

SEQ ID NO: 1133944 - DNA, 19 bp, Homo sapiens
aaagggcccaatgaattat

SEQ ID NO: 1133945 - DNA, 23 bp, Homo sapiens
aaagggcccacagtgacttttgc

SEQ ID NO: 1133946 - DNA, 15 bp, Homo sapiens
aaagggcctggccag

SEQ ID NO: 1133947 - DNA, 13 bp, Homo sapiens
aaagggctgagag

SEQ ID NO: 1133948 - DNA, 20 bp, Homo sapiens
aaagggcttgaggtgaattt

SEQ ID NO: 1133949 - DNA, 20 bp, Homo sapiens
aaaggggacacctgtacatt

SEQ ID NO: 1133950 - DNA, 16 bp, Homo sapiens
aaaggggacaggcctc

SEQ ID NO: 1133951 - DNA, 15 bp, Homo sapiens
aaaggggacccaaga

SEQ ID NO: 1133952 - DNA, 14 bp, Homo sapiens
aaaggggagagcct

SEQ ID NO: 1133953 - DNA, 21 bp, Homo sapiens
aaaggggcccaagccccatct

SEQ ID NO: 1133954 - DNA, 19 bp, Homo sapiens
aaaggggctgctggggcat

SEQ ID NO: 1133955 - DNA, 16 bp, Homo sapiens
aaagggggtcccagtg

SEQ ID NO: 1133956 - DNA, 23 bp, Homo sapiens
aaaggggtcggctgaccatgctc

SEQ ID NO: 1133957 - DNA, 14 bp, Homo sapiens
aaagggtgaagcta

SEQ ID NO: 1133958 - DNA, 19 bp, Homo sapiens
aaagggtgaagctatttat

SEQ ID NO: 1133959 - DNA, 21 bp, Homo sapiens
aaagggtgtaggggccacctc

SEQ ID NO: 1133960 - DNA, 19 bp, Homo sapiens
aaagggtgtatagtgttca

SEQ ID NO: 1133961 - DNA, 16 bp, Homo sapiens
aaagggtgtttttctg

SEQ ID NO: 1133962 - DNA, 15 bp, Homo sapiens
aaagggttgaaaatg

SEQ ID NO: 1133963 - DNA, 20 bp, Homo sapiens
aaagggttgaaaatgtgttt

SEQ ID NO: 1133964 - DNA, 20 bp, Homo sapiens
aaagggtttgatatggagaa

SEQ ID NO: 1133965 - DNA, 19 bp, Homo sapiens
aaaggtaaaatcacttcag

SEQ ID NO: 1133966 - DNA, 20 bp, Homo sapiens
aaaggtaaaatcacttcaga

SEQ ID NO: 1133967 - DNA, 21 bp, Homo sapiens
aaaggtaaaatcacttcagat

SEQ ID NO: 1133968 - DNA, 16 bp, Homo sapiens
aaaggtaaatggttaa

SEQ ID NO: 1133969 - DNA, 22 bp, Homo sapiens
aaaggtacactggtatttatat

SEQ ID NO: 1133970 - DNA, 16 bp, Homo sapiens
aaaggtaccaaacaag

SEQ ID NO: 1133971 - DNA, 22 bp, Homo sapiens
aaaggtacgattatacttgaga

SEQ ID NO: 1133972 - DNA, 15 bp, Homo sapiens
aaaggtagactttta

SEQ ID NO: 1133973 - DNA, 14 bp, Homo sapiens
aaaggtataatttt

SEQ ID NO: 1133974 - DNA, 16 bp, Homo sapiens
aaaggtataattttat

SEQ ID NO: 1133975 - DNA, 14 bp, Homo sapiens
aaaggtatattgtg

SEQ ID NO: 1133976 - DNA, 15 bp, Homo sapiens
aaaggtatattgtga

SEQ ID NO: 1133977 - DNA, 18 bp, Homo sapiens
aaagtgcagtcatttgtg

SEQ ID NO: 1133978 - DNA, 19 bp, Homo sapiens
aaagtgccagtattttaaa

SEQ ID NO: 1133979 - DNA, 19 bp, Homo sapiens
aaagtgccattaacaaatg

SEQ ID NO: 1133980 - DNA, 13 bp, Homo sapiens
aaagtgcctggga

SEQ ID NO: 1133981 - DNA, 12 bp, Homo sapiens
aaagtgccttct

SEQ ID NO: 1133982 - DNA, 21 bp, Homo sapiens
aaagtgcctttatctcagcca

SEQ ID NO: 1133983 - DNA, 15 bp, Homo sapiens
aaagtgcgttctccc

SEQ ID NO: 1133984 - DNA, 11 bp, Homo sapiens
aaagtgctggg

SEQ ID NO: 1133985 - DNA, 12 bp, Homo sapiens
aaagtgctggga

SEQ ID NO: 1133986 - DNA, 14 bp, Homo sapiens
aaagtggaaaacat

SEQ ID NO: 1133987 - DNA, 20 bp, Homo sapiens
aaagtggaacgaaaatgaaa

SEQ ID NO: 1133988 - DNA, 15 bp, Homo sapiens
aaagtggaagtatgt

SEQ ID NO: 1133989 - DNA, 18 bp, Homo sapiens
aaagtggcaatttcttta

SEQ ID NO: 1133990 - DNA, 17 bp, Homo sapiens
aaagtgggctgcagcag

SEQ ID NO: 1133991 - DNA, 17 bp, Homo sapiens
aaagtgggcttgattct

SEQ ID NO: 1133992 - DNA, 14 bp, Homo sapiens
aaagtgggcttgga

SEQ ID NO: 1133993 - DNA, 13 bp, Homo sapiens
aaagtggtaaata

SEQ ID NO: 1133994 - DNA, 17 bp, Homo sapiens
aaagtggtaaatactgt

SEQ ID NO: 1133995 - DNA, 17 bp, Homo sapiens
aaagtggtacaggaagg

SEQ ID NO: 1133996 - DNA, 14 bp, Homo sapiens
aaagtggtctctgc

SEQ ID NO: 1133997 - DNA, 17 bp, Homo sapiens
aaagtggttttgtttgt

SEQ ID NO: 1133998 - DNA, 20 bp, Homo sapiens
aaagtgtatatttattcata

SEQ ID NO: 1133999 - DNA, 18 bp, Homo sapiens
aaagtgtcaactctttgt

SEQ ID NO: 1134000 - DNA, 17 bp, Homo sapiens
aaagtgtctagacatat

SEQ ID NO: 1134001 - DNA, 18 bp, Homo sapiens
aaagtgtctcaaaggagc

SEQ ID NO: 1134002 - DNA, 20 bp, Homo sapiens
aaagtgtcttttgacatttt

SEQ ID NO: 1134003 - DNA, 14 bp, Homo sapiens
aaagtgtgagcagt

SEQ ID NO: 1134004 - DNA, 14 bp, Homo sapiens
aaagtgtgtattaa

SEQ ID NO: 1134005 - DNA, 17 bp, Homo sapiens
aaagtgtgtattaaaaa

SEQ ID NO: 1134006 - DNA, 16 bp, Homo sapiens
aaagtgtgtgtgttct

SEQ ID NO: 1134007 - DNA, 19 bp, Homo sapiens
aaagtgtgtgtgttctgta

SEQ ID NO: 1134008 - DNA, 17 bp, Homo sapiens
aaagtgtgttgttgctt

SEQ ID NO: 1134009 - DNA, 20 bp, Homo sapiens
aaagtgtgttgttgctttag

SEQ ID NO: 1134010 - DNA, 13 bp, Homo sapiens
aaagtgttacttt

SEQ ID NO: 1134011 - DNA, 9 bp, Homo sapiens
aaagtgttg

SEQ ID NO: 1134012 - DNA, 13 bp, Homo sapiens
aaagtgttgtatc

SEQ ID NO: 1134013 - DNA, 16 bp, Homo sapiens
aaagtgttgtgttcct

SEQ ID NO: 1134014 - DNA, 23 bp, Homo sapiens
aaagtgttgtgttcctggctgat

SEQ ID NO: 1134015 - DNA, 17 bp, Homo sapiens
aaagtgtttatttttca

SEQ ID NO: 1134016 - DNA, 18 bp, Homo sapiens
aaagtgtttatttttcat

SEQ ID NO: 1134017 - DNA, 13 bp, Homo sapiens
aaagtgtttgcct

SEQ ID NO: 1134018 - DNA, 17 bp, Homo sapiens
aaagtgttttctctgaa

SEQ ID NO: 1134019 - DNA, 13 bp, Homo sapiens
aaagtgttttttc

SEQ ID NO: 1134020 - DNA, 16 bp, Homo sapiens
aaagttaaacattgaa

SEQ ID NO: 1134021 - DNA, 16 bp, Homo sapiens
aaagttaacagatttt

SEQ ID NO: 1134022 - DNA, 20 bp, Homo sapiens
aaagttaaggcttgatacca

SEQ ID NO: 1134023 - DNA, 20 bp, Homo sapiens
aaagttaattcacctatgtt

SEQ ID NO: 1134024 - DNA, 21 bp, Homo sapiens
aaagttacctggaatcaaata

SEQ ID NO: 1134025 - DNA, 19 bp, Homo sapiens
aaagttactacctgtcaag

SEQ ID NO: 1134026 - DNA, 17 bp, Homo sapiens
aaagttactactgattt

SEQ ID NO: 1134027 - DNA, 18 bp, Homo sapiens
aaagttactactgatttt

SEQ ID NO: 1134028 - DNA, 12 bp, Homo sapiens
aaagttactagg

SEQ ID NO: 1134029 - DNA, 22 bp, Homo sapiens
aaagttacttgaatttcaaaca

SEQ ID NO: 1134030 - DNA, 16 bp, Homo sapiens
aaagttagggggttct

SEQ ID NO: 1134031 - DNA, 20 bp, Homo sapiens
aaagttagtatcttttgata

SEQ ID NO: 1134032 - DNA, 17 bp, Homo sapiens
aaagttataataactga

SEQ ID NO: 1134033 - DNA, 24 bp, Homo sapiens
aaagttataataactgaactgttt

SEQ ID NO: 1134034 - DNA, 14 bp, Homo sapiens
aaagttatatttca

SEQ ID NO: 1134035 - DNA, 22 bp, Homo sapiens
aaagttatatttcagatgtaat

SEQ ID NO: 1134036 - DNA, 24 bp, Homo sapiens
aaagttatatttcagatgtaatgt

SEQ ID NO: 1134037 - DNA, 22 bp, Homo sapiens
aaagttattgctggtgcaaaga

SEQ ID NO: 1134038 - DNA, 20 bp, Homo sapiens
aaagttcaatactcttgaaa

SEQ ID NO: 1134039 - DNA, 18 bp, Homo sapiens
aaagttcacaatgtggcc

SEQ ID NO: 1134040 - DNA, 21 bp, Homo sapiens
aaagttccctacttcctgtga

SEQ ID NO: 1134041 - DNA, 15 bp, Homo sapiens
aaagttcctctccct

SEQ ID NO: 1134042 - DNA, 16 bp, Homo sapiens
aaagttcctctccctt

SEQ ID NO: 1134043 - DNA, 18 bp, Homo sapiens
aaagttcctctcccttcc

SEQ ID NO: 1134044 - DNA, 14 bp, Homo sapiens
aaagttctcagagc

SEQ ID NO: 1134045 - DNA, 18 bp, Homo sapiens
aaagttcttattttagta

SEQ ID NO: 1134046 - DNA, 16 bp, Homo sapiens
aaagttgagtttccaa

SEQ ID NO: 1134047 - DNA, 18 bp, Homo sapiens
aaagttgataaagatttt

SEQ ID NO: 1134048 - DNA, 23 bp, Homo sapiens
aaagttgataaagattttttaat

SEQ ID NO: 1134049 - DNA, 13 bp, Homo sapiens
aaagttgcatttg

SEQ ID NO: 1134050 - DNA, 17 bp, Homo sapiens
aaatcttggcacagaaa

SEQ ID NO: 1134051 - DNA, 22 bp, Homo sapiens
aaatcttggttgatgccaaaaa

SEQ ID NO: 1134052 - DNA, 14 bp, Homo sapiens
aaatcttgttaatg

SEQ ID NO: 1134053 - DNA, 22 bp, Homo sapiens
aaatcttgttattgaagtgttc

SEQ ID NO: 1134054 - DNA, 14 bp, Homo sapiens
aaatctttaagaat

SEQ ID NO: 1134055 - DNA, 18 bp, Homo sapiens
aaatctttctgtaaacag

SEQ ID NO: 1134056 - DNA, 13 bp, Homo sapiens
aaatctttctttc

SEQ ID NO: 1134057 - DNA, 22 bp, Homo sapiens
aaatcttttaaaaattcaaatg

SEQ ID NO: 1134058 - DNA, 11 bp, Homo sapiens
aaatcttttac

SEQ ID NO: 1134059 - DNA, 22 bp, Homo sapiens
aaatctttttgataagcacatt

SEQ ID NO: 1134060 - DNA, 15 bp, Homo sapiens
aaatctttttgcttc

SEQ ID NO: 1134061 - DNA, 16 bp, Homo sapiens
aaatctttttgcttct

SEQ ID NO: 1134062 - DNA, 18 bp, Homo sapiens
aaatgaaaacatgtaata

SEQ ID NO: 1134063 - DNA, 14 bp, Homo sapiens
aaatgaaaactttt

SEQ ID NO: 1134064 - DNA, 13 bp, Homo sapiens
aaatgaaaagcaa

SEQ ID NO: 1134065 - DNA, 15 bp, Homo sapiens
aaatgaaaatgtctt

SEQ ID NO: 1134066 - DNA, 11 bp, Homo sapiens
aaatgaaaatt

SEQ ID NO: 1134067 - DNA, 18 bp, Homo sapiens
aaatgaaactctttcatt

SEQ ID NO: 1134068 - DNA, 20 bp, Homo sapiens
aaatgaaactctttcattct

SEQ ID NO: 1134069 - DNA, 16 bp, Homo sapiens
aaatgaaacttggcca

SEQ ID NO: 1134070 - DNA, 18 bp, Homo sapiens
aaatgaaagcatgtctca

SEQ ID NO: 1134071 - DNA, 12 bp, Homo sapiens
aaatgaaaggag

SEQ ID NO: 1134072 - DNA, 13 bp, Homo sapiens
aaatgaaaggagt

SEQ ID NO: 1134073 - DNA, 18 bp, Homo sapiens
aaatgaaagtattggcat

SEQ ID NO: 1134074 - DNA, 15 bp, Homo sapiens
aaatgaaagtgactt

SEQ ID NO: 1134075 - DNA, 13 bp, Homo sapiens
aaatgaaatattt

SEQ ID NO: 1134076 - DNA, 12 bp, Homo sapiens
aaatgaaatgca

SEQ ID NO: 1134077 - DNA, 15 bp, Homo sapiens
aaatgaaatgcatat

SEQ ID NO: 1134078 - DNA, 15 bp, Homo sapiens
aaatgaaattgtaaa

SEQ ID NO: 1134079 - DNA, 16 bp, Homo sapiens
aaatgctgcctgcctg

SEQ ID NO: 1134080 - DNA, 14 bp, Homo sapiens
aaatgctgctttgt

SEQ ID NO: 1134081 - DNA, 24 bp, Homo sapiens
aaatgcttatgcttgtgtatatgt

SEQ ID NO: 1134082 - DNA, 16 bp, Homo sapiens
aaatgcttcatttgta

SEQ ID NO: 1134083 - DNA, 18 bp, Homo sapiens
aaatgcttgggtacactt

SEQ ID NO: 1134084 - DNA, 20 bp, Homo sapiens
aaatgcttttatattctaat

SEQ ID NO: 1134085 - DNA, 13 bp, Homo sapiens
aaatgcttttcac

SEQ ID NO: 1134086 - DNA, 20 bp, Homo sapiens
aaatgctttttatttctgca

SEQ ID NO: 1134087 - DNA, 12 bp, Homo sapiens
aaatggaaattt

SEQ ID NO: 1134088 - DNA, 17 bp, Homo sapiens
aaatggaagtggcaata

SEQ ID NO: 1134089 - DNA, 16 bp, Homo sapiens
aaatggaattattttg

SEQ ID NO: 1134090 - DNA, 22 bp, Homo sapiens
aaatggaattcgtgttatgaat

SEQ ID NO: 1134091 - DNA, 21 bp, Homo sapiens
aaatggacacaaattttcaag

SEQ ID NO: 1134092 - DNA, 13 bp, Homo sapiens
aaatggacatttt

SEQ ID NO: 1134093 - DNA, 14 bp, Homo sapiens
aaatggacattttc

SEQ ID NO: 1134094 - DNA, 16 bp, Homo sapiens
aaatggagaagctgca

SEQ ID NO: 1134095 - DNA, 18 bp, Homo sapiens
aaatggagaagctgcagg

SEQ ID NO: 1134096 - DNA, 22 bp, Homo sapiens
aaatggaggatctctaaagagc

SEQ ID NO: 1134097 - DNA, 17 bp, Homo sapiens
aaatggaggcttttcac

SEQ ID NO: 1134098 - DNA, 19 bp, Homo sapiens
aaatggaggcttttcactg

SEQ ID NO: 1134099 - DNA, 15 bp, Homo sapiens
aaatggatactacat

SEQ ID NO: 1134100 - DNA, 20 bp, Homo sapiens
aaatggccagttttctggta

SEQ ID NO: 1134101 - DNA, 13 bp, Homo sapiens
aaatggccatttg

SEQ ID NO: 1134102 - DNA, 16 bp, Homo sapiens
aaatggccatttgctt

SEQ ID NO: 1134103 - DNA, 19 bp, Homo sapiens
aaatggccatttgcttttt

SEQ ID NO: 1134104 - DNA, 22 bp, Homo sapiens
aaatggccatttgctttttcac

SEQ ID NO: 1134105 - DNA, 16 bp, Homo sapiens
aaatggcgtctgctct

SEQ ID NO: 1134106 - DNA, 19 bp, Homo sapiens
aaatggctaactgatgaat

SEQ ID NO: 1134107 - DNA, 17 bp, Homo sapiens
aaatggctaataaactg

SEQ ID NO: 1134108 - DNA, 18 bp, Homo sapiens
aaatggctaataaactgt

SEQ ID NO: 1134109 - DNA, 21 bp, Homo sapiens
aaatggctaataaactgtatt

SEQ ID NO: 1134110 - DNA, 17 bp, Homo sapiens
aaatggctatgaacaga

SEQ ID NO: 1134111 - DNA, 23 bp, Homo sapiens
aaatggctgcatcccccccacct

SEQ ID NO: 1134112 - DNA, 11 bp, Homo sapiens
aaatggctgct

SEQ ID NO: 1134113 - DNA, 21 bp, Homo sapiens
aaatggctgtaatcatttgtt

SEQ ID NO: 1134114 - DNA, 21 bp, Homo sapiens
aaatggcttcggacaaaatat

SEQ ID NO: 1134115 - DNA, 15 bp, Homo sapiens
aaatgggaattctca

SEQ ID NO: 1134116 - DNA, 17 bp, Homo sapiens
aaatgggagacagcctc

SEQ ID NO: 1134117 - DNA, 19 bp, Homo sapiens
aaatgggatctaattaaac

SEQ ID NO: 1134118 - DNA, 24 bp, Homo sapiens
aaatgggcagttctcccagggagt

SEQ ID NO: 1134119 - DNA, 20 bp, Homo sapiens
aaatgggcatttattttata

SEQ ID NO: 1134120 - DNA, 22 bp, Homo sapiens
aaatgggcatttattttataac

SEQ ID NO: 1134121 - DNA, 14 bp, Homo sapiens
aaatgggcctgcct

SEQ ID NO: 1134122 - DNA, 19 bp, Homo sapiens
aaatgggcctgcctgcctc

SEQ ID NO: 1134123 - DNA, 20 bp, Homo sapiens
aaatgggcgcccccccctcc

SEQ ID NO: 1134124 - DNA, 21 bp, Homo sapiens
aaatggggacattcactataa

SEQ ID NO: 1134125 - DNA, 21 bp, Homo sapiens
aaatggggataataatactga

SEQ ID NO: 1134126 - DNA, 15 bp, Homo sapiens
aaatgggggtgcatt

SEQ ID NO: 1134127 - DNA, 16 bp, Homo sapiens
aaatgggggtgcattt

SEQ ID NO: 1134128 - DNA, 20 bp, Homo sapiens
aaatgggtgtatataatttt

SEQ ID NO: 1134129 - DNA, 20 bp, Homo sapiens
aaatgggttggtgcttctaa

SEQ ID NO: 1134130 - DNA, 22 bp, Homo sapiens
aaatgggttggtgcttctaacc

SEQ ID NO: 1134131 - DNA, 16 bp, Homo sapiens
aaatggtagcatttta

SEQ ID NO: 1134132 - DNA, 20 bp, Homo sapiens
aaatggtagcattttaaaca

SEQ ID NO: 1134133 - DNA, 19 bp, Homo sapiens
aaatggtaggcatttccta

SEQ ID NO: 1134134 - DNA, 17 bp, Homo sapiens
aaatggtatcaaaatta

SEQ ID NO: 1134135 - DNA, 16 bp, Homo sapiens
aaatggtatcttttgg

SEQ ID NO: 1134136 - DNA, 16 bp, Homo sapiens
aaatggtcgcccagga

SEQ ID NO: 1134137 - DNA, 20 bp, Homo sapiens
aaatggtctctaacatttcc

SEQ ID NO: 1134138 - DNA, 16 bp, Homo sapiens
aaatggtgttacatta

SEQ ID NO: 1134139 - DNA, 18 bp, Homo sapiens
aaatggtgttttcatgta

SEQ ID NO: 1134140 - DNA, 14 bp, Homo sapiens
aaatggtgtttttt

SEQ ID NO: 1134141 - DNA, 16 bp, Homo sapiens
aaatggttaaatttta

SEQ ID NO: 1134142 - DNA, 19 bp, Homo sapiens
aaatggttaaattttacat

SEQ ID NO: 1134143 - DNA, 16 bp, Homo sapiens
aaatggttatgtgcat

SEQ ID NO: 1134144 - DNA, 14 bp, Homo sapiens
aaatggttgatgga

SEQ ID NO: 1134145 - DNA, 15 bp, Homo sapiens
aaatggttgatggaa

SEQ ID NO: 1134146 - DNA, 21 bp, Homo sapiens
aaatggttgatggaaaataaa

SEQ ID NO: 1134147 - DNA, 23 bp, Homo sapiens
aaatggttgatggaaaataaaca

SEQ ID NO: 1134148 - DNA, 20 bp, Homo sapiens
aaatggtttggtgcttttta

SEQ ID NO: 1134149 - DNA, 15 bp, Homo sapiens
aaatgtaaaaatgaa

SEQ ID NO: 1134150 - DNA, 21 bp, Homo sapiens
aaatgtaaaaatgaaggaatt

SEQ ID NO: 1134151 - DNA, 22 bp, Homo sapiens
aaatgtaaagatatttttatct

SEQ ID NO: 1134152 - DNA, 17 bp, Homo sapiens
aaatgtaaatattctat

SEQ ID NO: 1134153 - DNA, 17 bp, Homo sapiens
aaatgtaaatttataaa

SEQ ID NO: 1134154 - DNA, 18 bp, Homo sapiens
aaatgtaaatttataaat

SEQ ID NO: 1134155 - DNA, 15 bp, Homo sapiens
aaatgtaacatgaag

SEQ ID NO: 1134156 - DNA, 14 bp, Homo sapiens
aaatgtaagatcgt

SEQ ID NO: 1134157 - DNA, 13 bp, Homo sapiens
aaatgtaagcaaa

SEQ ID NO: 1134158 - DNA, 14 bp, Homo sapiens
aaatgtaagcaaag

SEQ ID NO: 1134159 - DNA, 13 bp, Homo sapiens
aaatgtaaggcaa

SEQ ID NO: 1134160 - DNA, 18 bp, Homo sapiens
aaatgtaatgtcagactt

SEQ ID NO: 1134161 - DNA, 17 bp, Homo sapiens
aaatgtacagacatatt

SEQ ID NO: 1134162 - DNA, 16 bp, Homo sapiens
aaatgtacatttattc

SEQ ID NO: 1134163 - DNA, 19 bp, Homo sapiens
aaatgtacatttccaaatg

SEQ ID NO: 1134164 - DNA, 21 bp, Homo sapiens
aaatgtacatttccaaatgaa

SEQ ID NO: 1134165 - DNA, 20 bp, Homo sapiens
aaatgtaccttcagaataag

SEQ ID NO: 1134166 - DNA, 17 bp, Homo sapiens
aaatgtaccttctttca

SEQ ID NO: 1134167 - DNA, 15 bp, Homo sapiens
aaatgtacttaaatg

SEQ ID NO: 1134168 - DNA, 13 bp, Homo sapiens
aaatgtacttttg

SEQ ID NO: 1134169 - DNA, 15 bp, Homo sapiens
aaatgtacttttgga

SEQ ID NO: 1134170 - DNA, 21 bp, Homo sapiens
aaatgtagaattgaaaatgca

SEQ ID NO: 1134171 - DNA, 22 bp, Homo sapiens
aaatgtagcttcagtcattaaa

SEQ ID NO: 1134172 - DNA, 16 bp, Homo sapiens
aaatgtaggtatgaat

SEQ ID NO: 1134173 - DNA, 15 bp, Homo sapiens
aaatgtagttttgta

SEQ ID NO: 1134174 - DNA, 20 bp, Homo sapiens
aaatgtagttttgtatacag

SEQ ID NO: 1134175 - DNA, 19 bp, Homo sapiens
aaatgtataaaaattatca

SEQ ID NO: 1134176 - DNA, 13 bp, Homo sapiens
aaatgtataaatt

SEQ ID NO: 1134177 - DNA, 18 bp, Homo sapiens
aaatgtataattaactta

SEQ ID NO: 1134178 - DNA, 15 bp, Homo sapiens
aaatgtatatgcact

SEQ ID NO: 1134179 - DNA, 20 bp, Homo sapiens
aaatgtatcctgataaacat

SEQ ID NO: 1134180 - DNA, 11 bp, Homo sapiens
aaatgtattat

SEQ ID NO: 1134181 - DNA, 18 bp, Homo sapiens
aaatatgaaattccagca

SEQ ID NO: 1134182 - DNA, 20 bp, Homo sapiens
aaatatgaagacataaaccc

SEQ ID NO: 1134183 - DNA, 23 bp, Homo sapiens
aaatatgagtggttattgaaaat

SEQ ID NO: 1134184 - DNA, 12 bp, Homo sapiens
aaatatgatact

SEQ ID NO: 1134185 - DNA, 22 bp, Homo sapiens
aaatatgatactctcagatttt

SEQ ID NO: 1134186 - DNA, 21 bp, Homo sapiens
aaatatgatgttaaaaaaata

SEQ ID NO: 1134187 - DNA, 19 bp, Homo sapiens
aaatatgattttatttgac

SEQ ID NO: 1134188 - DNA, 20 bp, Homo sapiens
aaatatgattttatttgaca

SEQ ID NO: 1134189 - DNA, 13 bp, Homo sapiens
aaatatgcacttt

SEQ ID NO: 1134190 - DNA, 14 bp, Homo sapiens
aaatatgcactttc

SEQ ID NO: 1134191 - DNA, 20 bp, Homo sapiens
aaatatgcactttccctaga

SEQ ID NO: 1134192 - DNA, 15 bp, Homo sapiens
aaatatgcatactaa

SEQ ID NO: 1134193 - DNA, 13 bp, Homo sapiens
aaatatggaactt

SEQ ID NO: 1134194 - DNA, 17 bp, Homo sapiens
aaatatggaacttctaa

SEQ ID NO: 1134195 - DNA, 15 bp, Homo sapiens
aaatatggacactta

SEQ ID NO: 1134196 - DNA, 18 bp, Homo sapiens
aaatatggactgctcagg

SEQ ID NO: 1134197 - DNA, 21 bp, Homo sapiens
aaatatgtaatataaatttaa

SEQ ID NO: 1134198 - DNA, 19 bp, Homo sapiens
aaatatgtaatttcaaaat

SEQ ID NO: 1134199 - DNA, 18 bp, Homo sapiens
aaatatgtatatgacatt

SEQ ID NO: 1134200 - DNA, 15 bp, Homo sapiens
aaatatgtcagatgt

SEQ ID NO: 1134201 - DNA, 21 bp, Homo sapiens
aaatatgtcatcatgcttatg

SEQ ID NO: 1134202 - DNA, 13 bp, Homo sapiens
aaatatgtgaaga

SEQ ID NO: 1134203 - DNA, 17 bp, Homo sapiens
aaatatgtgaagttttc

SEQ ID NO: 1134204 - DNA, 14 bp, Homo sapiens
aaatatgtttcaca

SEQ ID NO: 1134205 - DNA, 23 bp, Homo sapiens
aaatatgttttttagatcaaata

SEQ ID NO: 1134206 - DNA, 12 bp, Homo sapiens
aaatattaacat

SEQ ID NO: 1134207 - DNA, 13 bp, Homo sapiens
aaatattattgaa

SEQ ID NO: 1134208 - DNA, 19 bp, Homo sapiens
aaatattatttgatatctg

SEQ ID NO: 1134209 - DNA, 13 bp, Homo sapiens
aaatattatttgt

SEQ ID NO: 1134210 - DNA, 16 bp, Homo sapiens
aaatattatttgtgtt

SEQ ID NO: 1134211 - DNA, 20 bp, Homo sapiens
aaatattattttatgaaagg

SEQ ID NO: 1134212 - DNA, 17 bp, Homo sapiens
aaatattcagaatcttt

SEQ ID NO: 1134213 - DNA, 20 bp, Homo sapiens
aaatattcctgcatttgtga

SEQ ID NO: 1134214 - DNA, 19 bp, Homo sapiens
aaatattcctttgcatatt

SEQ ID NO: 1134215 - DNA, 15 bp, Homo sapiens
aaatattctctattt

SEQ ID NO: 1134216 - DNA, 15 bp, Homo sapiens
aaatattctttctca

SEQ ID NO: 1134217 - DNA, 12 bp, Homo sapiens
aaatattgctaa

SEQ ID NO: 1134218 - DNA, 14 bp, Homo sapiens
aaatattgtcatct

SEQ ID NO: 1134219 - DNA, 15 bp, Homo sapiens
aaatattgtttctgc

SEQ ID NO: 1134220 - DNA, 15 bp, Homo sapiens
aaatatttaactttt

SEQ ID NO: 1134221 - DNA, 19 bp, Homo sapiens
aaatatttaagtatatagt

SEQ ID NO: 1134222 - DNA, 21 bp, Homo sapiens
aaatatttaagtgaaggagaa

SEQ ID NO: 1134223 - DNA, 17 bp, Homo sapiens
aaatatttaccttgaaa

SEQ ID NO: 1134224 - DNA, 16 bp, Homo sapiens
aaatatttactctttg

SEQ ID NO: 1134225 - DNA, 20 bp, Homo sapiens
aaatatttactctttgcaaa

SEQ ID NO: 1134226 - DNA, 12 bp, Homo sapiens
aaatatttatgc

SEQ ID NO: 1134227 - DNA, 13 bp, Homo sapiens
aaatatttatgct

SEQ ID NO: 1134228 - DNA, 23 bp, Homo sapiens
aaatatttatgcttaaaatatgt

SEQ ID NO: 1134229 - DNA, 16 bp, Homo sapiens
aaatatttcagatatc

SEQ ID NO: 1134230 - DNA, 21 bp, Homo sapiens
aaatatttcctgacttgagtg

SEQ ID NO: 1134231 - DNA, 19 bp, Homo sapiens
aaatatttctatgtaaatt

SEQ ID NO: 1134232 - DNA, 21 bp, Homo sapiens
aaatatttctatgtaaattat

SEQ ID NO: 1134233 - DNA, 20 bp, Homo sapiens
aaatatttgtctttaaacag

SEQ ID NO: 1134234 - DNA, 22 bp, Homo sapiens
aaatatttgttacttttagttc

SEQ ID NO: 1134235 - DNA, 19 bp, Homo sapiens
aaatattttaaaatcagct

SEQ ID NO: 1134236 - DNA, 18 bp, Homo sapiens
aaatattttaaagaattg

SEQ ID NO: 1134237 - DNA, 14 bp, Homo sapiens
aaatattttaagaa

SEQ ID NO: 1134238 - DNA, 15 bp, Homo sapiens
aaatattttaagaaa

SEQ ID NO: 1134239 - DNA, 18 bp, Homo sapiens
aaatattttaagaaagag

SEQ ID NO: 1134240 - DNA, 17 bp, Homo sapiens
aaatattttagatgtta

SEQ ID NO: 1134241 - DNA, 15 bp, Homo sapiens
aaatattttcaaaga

SEQ ID NO: 1134242 - DNA, 20 bp, Homo sapiens
aaatattttcaaagagatgg

SEQ ID NO: 1134243 - DNA, 11 bp, Homo sapiens
aaatattttct

SEQ ID NO: 1134244 - DNA, 17 bp, Homo sapiens
aaatattttctatttta

SEQ ID NO: 1134245 - DNA, 12 bp, Homo sapiens
aaatattttctc

SEQ ID NO: 1134246 - DNA, 22 bp, Homo sapiens
aaatattttgaatcaataatat

SEQ ID NO: 1134247 - DNA, 16 bp, Homo sapiens
aaatattttgtctaaa

SEQ ID NO: 1134248 - DNA, 22 bp, Homo sapiens
aaatattttttatatatacagt

SEQ ID NO: 1134249 - DNA, 19 bp, Homo sapiens
aaatattttttccttttgt

SEQ ID NO: 1134250 - DNA, 15 bp, Homo sapiens
aaatcaaaagaatct

SEQ ID NO: 1134251 - DNA, 15 bp, Homo sapiens
aaatcaaagaacaga

SEQ ID NO: 1134252 - DNA, 13 bp, Homo sapiens
aaatcaaagatga

SEQ ID NO: 1134253 - DNA, 18 bp, Homo sapiens
aaatcaacagaagcattt

SEQ ID NO: 1134254 - DNA, 16 bp, Homo sapiens
aaatcaactgaataaa

SEQ ID NO: 1134255 - DNA, 19 bp, Homo sapiens
aaatcaacttgtgtactga

SEQ ID NO: 1134256 - DNA, 17 bp, Homo sapiens
aaatcaaggaaaggctc

SEQ ID NO: 1134257 - DNA, 18 bp, Homo sapiens
aaatcaagtatttgggaa

SEQ ID NO: 1134258 - DNA, 23 bp, Homo sapiens
aaatcaagtatttgggaagtgaa

SEQ ID NO: 1134259 - DNA, 12 bp, Homo sapiens
aaatcaagtttt

SEQ ID NO: 1134260 - DNA, 22 bp, Homo sapiens
aaatcaatacactagttgtttc

SEQ ID NO: 1134261 - DNA, 17 bp, Homo sapiens
aaatcaatagttgaatt

SEQ ID NO: 1134262 - DNA, 16 bp, Homo sapiens
aaatcacaaaaacaaa

SEQ ID NO: 1134263 - DNA, 22 bp, Homo sapiens
aaatcacaaaaatttgaacact

SEQ ID NO: 1134264 - DNA, 13 bp, Homo sapiens
aaatcacatttta

SEQ ID NO: 1134265 - DNA, 15 bp, Homo sapiens
aaatcacattttaag

SEQ ID NO: 1134266 - DNA, 23 bp, Homo sapiens
aaatcacattttaagtgcttcac

SEQ ID NO: 1134267 - DNA, 17 bp, Homo sapiens
aacaggagacaggtcag

SEQ ID NO: 1134268 - DNA, 17 bp, Homo sapiens
aacaggccattgtgaac

SEQ ID NO: 1134269 - DNA, 11 bp, Homo sapiens
aacaggcccag

SEQ ID NO: 1134270 - DNA, 19 bp, Homo sapiens
aacaggccccacgccctct

SEQ ID NO: 1134271 - DNA, 20 bp, Homo sapiens
aacaggccctctgtggcctg

SEQ ID NO: 1134272 - DNA, 18 bp, Homo sapiens
aacagggagaagtagcta

SEQ ID NO: 1134273 - DNA, 19 bp, Homo sapiens
aacagggagaagtagctag

SEQ ID NO: 1134274 - DNA, 12 bp, Homo sapiens
aacagggcagca

SEQ ID NO: 1134275 - DNA, 19 bp, Homo sapiens
aacagggcagcagtggggt

SEQ ID NO: 1134276 - DNA, 20 bp, Homo sapiens
aacagggccacatagatgct

SEQ ID NO: 1134277 - DNA, 19 bp, Homo sapiens
aacagggcccaggcctgga

SEQ ID NO: 1134278 - DNA, 17 bp, Homo sapiens
aacaggggaggaaaaaa

SEQ ID NO: 1134279 - DNA, 21 bp, Homo sapiens
aacaggggaggaaaaaagaac

SEQ ID NO: 1134280 - DNA, 20 bp, Homo sapiens
aacagggtagatttctcttg

SEQ ID NO: 1134281 - DNA, 13 bp, Homo sapiens
aacagggtctcta

SEQ ID NO: 1134282 - DNA, 18 bp, Homo sapiens
aacagggtctctagtgct

SEQ ID NO: 1134283 - DNA, 23 bp, Homo sapiens
aacagggtctctagtgctgtgaa

SEQ ID NO: 1134284 - DNA, 15 bp, Homo sapiens
aacaggtaatataaa

SEQ ID NO: 1134285 - DNA, 23 bp, Homo sapiens
aacaggtagtattacaccaccgg

SEQ ID NO: 1134286 - DNA, 20 bp, Homo sapiens
aacaggtatttttttaaatc

SEQ ID NO: 1134287 - DNA, 18 bp, Homo sapiens
aacaggtctcctcttaaa

SEQ ID NO: 1134288 - DNA, 21 bp, Homo sapiens
aacaggtggcaggaccaggac

SEQ ID NO: 1134289 - DNA, 23 bp, Homo sapiens
aacaggtggcaggaccaggacta

SEQ ID NO: 1134290 - DNA, 19 bp, Homo sapiens
aacaggttataacagtgtt

SEQ ID NO: 1134291 - DNA, 23 bp, Homo sapiens
aacaggttcctgtggagacactg

SEQ ID NO: 1134292 - DNA, 16 bp, Homo sapiens
aacagtaaaccactga

SEQ ID NO: 1134293 - DNA, 14 bp, Homo sapiens
aacagtaaatgtgc

SEQ ID NO: 1134294 - DNA, 15 bp, Homo sapiens
aacagtagtttctca

SEQ ID NO: 1134295 - DNA, 15 bp, Homo sapiens
aacagtcacccttct

SEQ ID NO: 1134296 - DNA, 19 bp, Homo sapiens
aacagtcacccttctgggc

SEQ ID NO: 1134297 - DNA, 19 bp, Homo sapiens
aacagtcatgtatgcaagt

SEQ ID NO: 1134298 - DNA, 16 bp, Homo sapiens
aacagtctaaagaaga

SEQ ID NO: 1134299 - DNA, 23 bp, Homo sapiens
aacagtgagagactccatagttt

SEQ ID NO: 1134300 - DNA, 15 bp, Homo sapiens
aacagtgagcatatc

SEQ ID NO: 1134301 - DNA, 17 bp, Homo sapiens
aacagtgctttgtaaat

SEQ ID NO: 1134302 - DNA, 15 bp, Homo sapiens
aacagtggaatataa

SEQ ID NO: 1134303 - DNA, 14 bp, Homo sapiens
aacagtggatcaca

SEQ ID NO: 1134304 - DNA, 14 bp, Homo sapiens
aacagtggctgggt

SEQ ID NO: 1134305 - DNA, 17 bp, Homo sapiens
aacagtggctgggtggg

SEQ ID NO: 1134306 - DNA, 20 bp, Homo sapiens
aacagtgggagccctgacct

SEQ ID NO: 1134307 - DNA, 22 bp, Homo sapiens
aacagtgggagccctgaccttg

SEQ ID NO: 1134308 - DNA, 19 bp, Homo sapiens
aacagtgtttcccataatt

SEQ ID NO: 1134309 - DNA, 13 bp, Homo sapiens
aacagtgttttca

SEQ ID NO: 1134310 - DNA, 15 bp, Homo sapiens
aacagttctcactgg

SEQ ID NO: 1134311 - DNA, 14 bp, Homo sapiens
aacagttgctgtga

SEQ ID NO: 1134312 - DNA, 16 bp, Homo sapiens
aacagttgctgttctt

SEQ ID NO: 1134313 - DNA, 13 bp, Homo sapiens
aacagttgtattt

SEQ ID NO: 1134314 - DNA, 23 bp, Homo sapiens
aacagttgtatttaacagaaatt

SEQ ID NO: 1134315 - DNA, 15 bp, Homo sapiens
aacagttgttactta

SEQ ID NO: 1134316 - DNA, 18 bp, Homo sapiens
aacagttgttacttagca

SEQ ID NO: 1134317 - DNA, 16 bp, Homo sapiens
aacagtttgcctgctg

SEQ ID NO: 1134318 - DNA, 17 bp, Homo sapiens
aacagttttccatgaaa

SEQ ID NO: 1134319 - DNA, 23 bp, Homo sapiens
aacataaaaagcagaattttaat

SEQ ID NO: 1134320 - DNA, 16 bp, Homo sapiens
aacataaaacaaaacc

SEQ ID NO: 1134321 - DNA, 14 bp, Homo sapiens
aacataaaatctgt

SEQ ID NO: 1134322 - DNA, 14 bp, Homo sapiens
aacataaagcaaat

SEQ ID NO: 1134323 - DNA, 18 bp, Homo sapiens
aacataacactaaatgct

SEQ ID NO: 1134324 - DNA, 17 bp, Homo sapiens
aacataactgcttcttg

SEQ ID NO: 1134325 - DNA, 15 bp, Homo sapiens
aacataataataatg

SEQ ID NO: 1134326 - DNA, 16 bp, Homo sapiens
aacataatctagttta

SEQ ID NO: 1134327 - DNA, 17 bp, Homo sapiens
aacataatggttgtgaa

SEQ ID NO: 1134328 - DNA, 18 bp, Homo sapiens
aacataatggttgtgaaa

SEQ ID NO: 1134329 - DNA, 14 bp, Homo sapiens
aacatacagacaca

SEQ ID NO: 1134330 - DNA, 13 bp, Homo sapiens
aacatagaaaaat

SEQ ID NO: 1134331 - DNA, 16 bp, Homo sapiens
aacatagaaactcggg

SEQ ID NO: 1134332 - DNA, 21 bp, Homo sapiens
aacatagcagatctgttttgt

SEQ ID NO: 1134333 - DNA, 21 bp, Homo sapiens
aacatagtgagacccctgtct

SEQ ID NO: 1134334 - DNA, 19 bp, Homo sapiens
aacatagtgagattctgtt

SEQ ID NO: 1134335 - DNA, 21 bp, Homo sapiens
aacatataatgttgttattta

SEQ ID NO: 1134336 - DNA, 22 bp, Homo sapiens
aacatataatgttgttatttaa

SEQ ID NO: 1134337 - DNA, 11 bp, Homo sapiens
aacatatatat

SEQ ID NO: 1134338 - DNA, 20 bp, Homo sapiens
aacatatcatttgtgaagaa

SEQ ID NO: 1134339 - DNA, 13 bp, Homo sapiens
aacatatgtatta

SEQ ID NO: 1134340 - DNA, 22 bp, Homo sapiens
aacatattcatgaaatgtggaa

SEQ ID NO: 1134341 - DNA, 14 bp, Homo sapiens
aacatattgttgaa

SEQ ID NO: 1134342 - DNA, 17 bp, Homo sapiens
aacatcaaataaatttc

SEQ ID NO: 1134343 - DNA, 20 bp, Homo sapiens
aacatcaaataaatttctgg

SEQ ID NO: 1134344 - DNA, 19 bp, Homo sapiens
aacatcaatgttcattgta

SEQ ID NO: 1134345 - DNA, 13 bp, Homo sapiens
aacatcacacaca

SEQ ID NO: 1134346 - DNA, 16 bp, Homo sapiens
aacatcacacctgccc

SEQ ID NO: 1134347 - DNA, 21 bp, Homo sapiens
aacatcaccctatatataatt

SEQ ID NO: 1134348 - DNA, 15 bp, Homo sapiens
aacatcagacctgtc

SEQ ID NO: 1134349 - DNA, 21 bp, Homo sapiens
aacatcagtgtctgtttcaga

SEQ ID NO: 1134350 - DNA, 22 bp, Homo sapiens
aacatcagtgtctgtttcagaa

SEQ ID NO: 1134351 - DNA, 18 bp, Homo sapiens
aacatcagttactctgaa

SEQ ID NO: 1134352 - DNA, 21 bp, Homo sapiens
aacatcagttactctgaaggg

SEQ ID NO: 1134353 - DNA, 16 bp, Homo sapiens
aacatcataattacat

SEQ ID NO: 1134354 - DNA, 22 bp, Homo sapiens
aacatccaagtctttcttcttt

SEQ ID NO: 1134355 - DNA, 15 bp, Homo sapiens
aacatccaatatttt

SEQ ID NO: 1134356 - DNA, 18 bp, Homo sapiens
aacatcccattgccctgg

SEQ ID NO: 1134357 - DNA, 17 bp, Homo sapiens
aacatccctttttcaat

SEQ ID NO: 1134358 - DNA, 22 bp, Homo sapiens
aacatcctacaagacacagtga

SEQ ID NO: 1134359 - DNA, 19 bp, Homo sapiens
aacatcgatatgtatatca

SEQ ID NO: 1134360 - DNA, 14 bp, Homo sapiens
aacatctcgagccc

SEQ ID NO: 1134361 - DNA, 16 bp, Homo sapiens
aacatctgaaagccac

SEQ ID NO: 1134362 - DNA, 16 bp, Homo sapiens
aacatctgagtcctgg

SEQ ID NO: 1134363 - DNA, 12 bp, Homo sapiens
aacatctttaag

SEQ ID NO: 1134364 - DNA, 18 bp, Homo sapiens
aacatctttacgtactgt

SEQ ID NO: 1134365 - DNA, 19 bp, Homo sapiens
aacatctttattgaaattc

SEQ ID NO: 1134366 - DNA, 19 bp, Homo sapiens
aacatctttgcgaaaagat

SEQ ID NO: 1134367 - DNA, 20 bp, Homo sapiens
aacatgaaagtctagaaata

SEQ ID NO: 1134368 - DNA, 14 bp, Homo sapiens
aacatgaagaatgc

SEQ ID NO: 1134369 - DNA, 18 bp, Homo sapiens
aacatgaagcataatttg

SEQ ID NO: 1134370 - DNA, 20 bp, Homo sapiens
aaccaattcaccaacacagt

SEQ ID NO: 1134371 - DNA, 23 bp, Homo sapiens
aaccacaaggtccactccctgct

SEQ ID NO: 1134372 - DNA, 13 bp, Homo sapiens
aaccacaccacat

SEQ ID NO: 1134373 - DNA, 17 bp, Homo sapiens
aaccacacttcttgaaa

SEQ ID NO: 1134374 - DNA, 15 bp, Homo sapiens
aaccacagatttgtg

SEQ ID NO: 1134375 - DNA, 14 bp, Homo sapiens
aaccacatgggctg

SEQ ID NO: 1134376 - DNA, 20 bp, Homo sapiens
aaccacatgggctgggggcc

SEQ ID NO: 1134377 - DNA, 14 bp, Homo sapiens
aaccacatgtccca

SEQ ID NO: 1134378 - DNA, 15 bp, Homo sapiens
aaccacatgtcccag

SEQ ID NO: 1134379 - DNA, 21 bp, Homo sapiens
aaccaccagcgttcccttctc

SEQ ID NO: 1134380 - DNA, 16 bp, Homo sapiens
aaccacccaaaacacg

SEQ ID NO: 1134381 - DNA, 16 bp, Homo sapiens
aaccaccctctgggga

SEQ ID NO: 1134382 - DNA, 18 bp, Homo sapiens
aaccaccgcatatgcatg

SEQ ID NO: 1134383 - DNA, 22 bp, Homo sapiens
aaccaccgcatatgcatgccag

SEQ ID NO: 1134384 - DNA, 15 bp, Homo sapiens
aaccaccgctcccca

SEQ ID NO: 1134385 - DNA, 17 bp, Homo sapiens
aaccaccgctccccagc

SEQ ID NO: 1134386 - DNA, 16 bp, Homo sapiens
aaccacctatttttga

SEQ ID NO: 1134387 - DNA, 14 bp, Homo sapiens
aaccacggaaaaga

SEQ ID NO: 1134388 - DNA, 22 bp, Homo sapiens
aaccactctatcaagtattata

SEQ ID NO: 1134389 - DNA, 15 bp, Homo sapiens
aaccactgaaaaaat

SEQ ID NO: 1134390 - DNA, 20 bp, Homo sapiens
aaccactgaaaaaatatatg

SEQ ID NO: 1134391 - DNA, 19 bp, Homo sapiens
aaccactgcaatatcttcg

SEQ ID NO: 1134392 - DNA, 17 bp, Homo sapiens
aaccactgcttctcttt

SEQ ID NO: 1134393 - DNA, 21 bp, Homo sapiens
aaccacttccctcatctctcc

SEQ ID NO: 1134394 - DNA, 15 bp, Homo sapiens
aaccagaaaagcaat

SEQ ID NO: 1134395 - DNA, 19 bp, Homo sapiens
aacacccccgacggcctcc

SEQ ID NO: 1134396 - DNA, 20 bp, Homo sapiens
aacacccccgacggcctcca

SEQ ID NO: 1134397 - DNA, 16 bp, Homo sapiens
aacaccctatattttg

SEQ ID NO: 1134398 - DNA, 15 bp, Homo sapiens
aacaccctgcttctc

SEQ ID NO: 1134399 - DNA, 13 bp, Homo sapiens
aacacccttagaa

SEQ ID NO: 1134400 - DNA, 22 bp, Homo sapiens
aacacctcctcccgaaaaatgt

SEQ ID NO: 1134401 - DNA, 15 bp, Homo sapiens
aacacctgccttcta

SEQ ID NO: 1134402 - DNA, 12 bp, Homo sapiens
aacacctgctgc

SEQ ID NO: 1134403 - DNA, 22 bp, Homo sapiens
aacaccttcagaggctgaggtg

SEQ ID NO: 1134404 - DNA, 17 bp, Homo sapiens
aacaccttcatccagat

SEQ ID NO: 1134405 - DNA, 17 bp, Homo sapiens
aacaccttccagctcct

SEQ ID NO: 1134406 - DNA, 19 bp, Homo sapiens
aacaccttcctcctgcaga

SEQ ID NO: 1134407 - DNA, 21 bp, Homo sapiens
aactaagagacagttctctgt

SEQ ID NO: 1134408 - DNA, 14 bp, Homo sapiens
aactaagatctgtt

SEQ ID NO: 1134409 - DNA, 17 bp, Homo sapiens
aactaagattcttttaa

SEQ ID NO: 1134410 - DNA, 13 bp, Homo sapiens
aactaagccctcg

SEQ ID NO: 1134411 - DNA, 15 bp, Homo sapiens
aactaaggacaaatt

SEQ ID NO: 1134412 - DNA, 17 bp, Homo sapiens
aactaaggacaaattag

SEQ ID NO: 1134413 - DNA, 19 bp, Homo sapiens
aactaaggacaaattagca

SEQ ID NO: 1134414 - DNA, 21 bp, Homo sapiens
aactaaggacaaattagcatg

SEQ ID NO: 1134415 - DNA, 20 bp, Homo sapiens
aactaagttttgtgtgtata

SEQ ID NO: 1134416 - DNA, 21 bp, Homo sapiens
aactaagttttgtgtgtatat

SEQ ID NO: 1134417 - DNA, 14 bp, Homo sapiens
aactaataaaagca

SEQ ID NO: 1134418 - DNA, 14 bp, Homo sapiens
aactaataattgca

SEQ ID NO: 1134419 - DNA, 19 bp, Homo sapiens
aactaatacgtgccagata

SEQ ID NO: 1134420 - DNA, 20 bp, Homo sapiens
aactaatctattgggttcat

SEQ ID NO: 1134421 - DNA, 15 bp, Homo sapiens
aactaatgagtatga

SEQ ID NO: 1134422 - DNA, 12 bp, Homo sapiens
aactaatgtact

SEQ ID NO: 1134423 - DNA, 19 bp, Homo sapiens
aactaatgtactgtacata

SEQ ID NO: 1134424 - DNA, 14 bp, Homo sapiens
aactaatgtttgaa

SEQ ID NO: 1134425 - DNA, 23 bp, Homo sapiens
aactaatttgaatgtggttactt

SEQ ID NO: 1134426 - DNA, 20 bp, Homo sapiens
aactacaaagctttgctaca

SEQ ID NO: 1134427 - DNA, 18 bp, Homo sapiens
aactacaaagtaaaatga

SEQ ID NO: 1134428 - DNA, 14 bp, Homo sapiens
aactacaacttctc

SEQ ID NO: 1134429 - DNA, 20 bp, Homo sapiens
aactacatacgcaaaaactt

SEQ ID NO: 1134430 - DNA, 22 bp, Homo sapiens
aactacatgagaacaaacagat

SEQ ID NO: 1134431 - DNA, 17 bp, Homo sapiens
aactacatttctactat

SEQ ID NO: 1134432 - DNA, 15 bp, Homo sapiens
aactacccctcctca

SEQ ID NO: 1134433 - DNA, 20 bp, Homo sapiens
aactactagctacaaaaaat

SEQ ID NO: 1134434 - DNA, 19 bp, Homo sapiens
aactactccggagacaggg

SEQ ID NO: 1134435 - DNA, 18 bp, Homo sapiens
aactactgaataatgcta

SEQ ID NO: 1134436 - DNA, 19 bp, Homo sapiens
aactactgaatgaagcagt

SEQ ID NO: 1134437 - DNA, 21 bp, Homo sapiens
aactactgaatgaagcagtat

SEQ ID NO: 1134438 - DNA, 23 bp, Homo sapiens
aactactgaatgaagcagtattt

SEQ ID NO: 1134439 - DNA, 19 bp, Homo sapiens
aactactgcctttagaaaa

SEQ ID NO: 1134440 - DNA, 18 bp, Homo sapiens
aactactgctaatgttga

SEQ ID NO: 1134441 - DNA, 12 bp, Homo sapiens
aactactgtact

SEQ ID NO: 1134442 - DNA, 19 bp, Homo sapiens
aactactttactaaattaa

SEQ ID NO: 1134443 - DNA, 13 bp, Homo sapiens
aactactttataa

SEQ ID NO: 1134444 - DNA, 16 bp, Homo sapiens
aactacttttctaaaa

SEQ ID NO: 1134445 - DNA, 16 bp, Homo sapiens
aactactttttatact

SEQ ID NO: 1134446 - DNA, 18 bp, Homo sapiens
aactactttttatactcc

SEQ ID NO: 1134447 - DNA, 16 bp, Homo sapiens
aactagaaaattctaa

SEQ ID NO: 1134448 - DNA, 16 bp, Homo sapiens
aactagaaagaaggac

SEQ ID NO: 1134449 - DNA, 16 bp, Homo sapiens
aactagaaatctgcca

SEQ ID NO: 1134450 - DNA, 12 bp, Homo sapiens
aactagaattag

SEQ ID NO: 1134451 - DNA, 13 bp, Homo sapiens
aactagaattagt

SEQ ID NO: 1134452 - DNA, 21 bp, Homo sapiens
aactagaattagtatgtctgt

SEQ ID NO: 1134453 - DNA, 22 bp, Homo sapiens
aactagaatttattcaattcct

SEQ ID NO: 1134454 - DNA, 21 bp, Homo sapiens
aactagaggtgagaaatttaa

SEQ ID NO: 1134455 - DNA, 22 bp, Homo sapiens
aactagaggtgagaaatttaaa

SEQ ID NO: 1134456 - DNA, 20 bp, Homo sapiens
aactagattacattcagttg

SEQ ID NO: 1134457 - DNA, 18 bp, Homo sapiens
aactagccaaaccaggac

SEQ ID NO: 1134458 - DNA, 21 bp, Homo sapiens
aactagccaaaccaggaccct

SEQ ID NO: 1134459 - DNA, 14 bp, Homo sapiens
aactagccaaggct

SEQ ID NO: 1134460 - DNA, 13 bp, Homo sapiens
aactaggctctta

SEQ ID NO: 1134461 - DNA, 22 bp, Homo sapiens
aactagtctacttcttaaaatt

SEQ ID NO: 1134462 - DNA, 24 bp, Homo sapiens
aactagttcaaatgatgaagacca

SEQ ID NO: 1134463 - DNA, 15 bp, Homo sapiens
aactagtttttatag

SEQ ID NO: 1134464 - DNA, 23 bp, Homo sapiens
aactagtttttcctatcatgtta

SEQ ID NO: 1134465 - DNA, 14 bp, Homo sapiens
aactataaacttaa

SEQ ID NO: 1134466 - DNA, 17 bp, Homo sapiens
aactataaggtgcctca

SEQ ID NO: 1134467 - DNA, 23 bp, Homo sapiens
aactataaggtgcctcagttttc

SEQ ID NO: 1134468 - DNA, 16 bp, Homo sapiens
aactatacccgggacc

SEQ ID NO: 1134469 - DNA, 13 bp, Homo sapiens
aactatatgtaca

SEQ ID NO: 1134470 - DNA, 14 bp, Homo sapiens
aactatatgtgaat

SEQ ID NO: 1134471 - DNA, 22 bp, Homo sapiens
aactatcaattcttgagaccca

SEQ ID NO: 1134472 - DNA, 14 bp, Homo sapiens
aactatcattttta

SEQ ID NO: 1134473 - DNA, 17 bp, Homo sapiens
aactatccaagtgttat

SEQ ID NO: 1134474 - DNA, 21 bp, Homo sapiens
aactatcctgcgggttttaat

SEQ ID NO: 1134475 - DNA, 22 bp, Homo sapiens
aactatctgcattatctatgca

SEQ ID NO: 1134476 - DNA, 13 bp, Homo sapiens
aactatcttgtgt

SEQ ID NO: 1134477 - DNA, 15 bp, Homo sapiens
aactatgaacactgt

SEQ ID NO: 1134478 - DNA, 17 bp, Homo sapiens
aactatgaacactgtca

SEQ ID NO: 1134479 - DNA, 22 bp, Homo sapiens
aactatgactggagtaaaccat

SEQ ID NO: 1134480 - DNA, 18 bp, Homo sapiens
aactatgatcacagtgac

SEQ ID NO: 1134481 - DNA, 18 bp, Homo sapiens
aactatggatcagaatag

SEQ ID NO: 1134482 - DNA, 18 bp, Homo sapiens
aactatggcaaggaactt

SEQ ID NO: 1134483 - DNA, 16 bp, Homo sapiens
aactatgggttatttt

SEQ ID NO: 1134484 - DNA, 19 bp, Homo sapiens
aactgaaacttttctaaag

SEQ ID NO: 1134485 - DNA, 16 bp, Homo sapiens
aactgaaagtgtttta

SEQ ID NO: 1134486 - DNA, 11 bp, Homo sapiens
aactgaaataa

SEQ ID NO: 1134487 - DNA, 12 bp, Homo sapiens
aactgaaataaa

SEQ ID NO: 1134488 - DNA, 14 bp, Homo sapiens
aactgaaataaacc

SEQ ID NO: 1134489 - DNA, 23 bp, Homo sapiens
aactgaacaccattgaaggctta

SEQ ID NO: 1134490 - DNA, 15 bp, Homo sapiens
aactgaacattccag

SEQ ID NO: 1134491 - DNA, 12 bp, Homo sapiens
aactgaactgtt

SEQ ID NO: 1134492 - DNA, 22 bp, Homo sapiens
aactgaagaattttgagtgaat

SEQ ID NO: 1134493 - DNA, 17 bp, Homo sapiens
aactgaagacctccaca

SEQ ID NO: 1134494 - DNA, 16 bp, Homo sapiens
aactgaagccacttgg

SEQ ID NO: 1134495 - DNA, 18 bp, Homo sapiens
aactgaagccttcttctg

SEQ ID NO: 1134496 - DNA, 15 bp, Homo sapiens
aactgaaggagaagg

SEQ ID NO: 1134497 - DNA, 22 bp, Homo sapiens
aactgaaggagatcaatggttt

SEQ ID NO: 1134498 - DNA, 22 bp, Homo sapiens
aactgaaggttttttttttaag

SEQ ID NO: 1134499 - DNA, 23 bp, Homo sapiens
aactgaaggttttttttttaagt

SEQ ID NO: 1134500 - DNA, 19 bp, Homo sapiens
aactgaataaattcagtat

SEQ ID NO: 1134501 - DNA, 14 bp, Homo sapiens
aactgaataccact

SEQ ID NO: 1134502 - DNA, 18 bp, Homo sapiens
aactgaataccactctgt

SEQ ID NO: 1134503 - DNA, 12 bp, Homo sapiens
aactgaatgaat

SEQ ID NO: 1134504 - DNA, 20 bp, Homo sapiens
aactgacaaaggagccttga

SEQ ID NO: 1134505 - DNA, 21 bp, Homo sapiens
aactgacaaaggagccttgat

SEQ ID NO: 1134506 - DNA, 17 bp, Homo sapiens
aactgacaagccatctt

SEQ ID NO: 1134507 - DNA, 16 bp, Homo sapiens
aactgacaatgaaggg

SEQ ID NO: 1134508 - DNA, 18 bp, Homo sapiens
aactgacagtattaaggg

SEQ ID NO: 1134509 - DNA, 23 bp, Homo sapiens
aactgacatgccctcccttctcc

SEQ ID NO: 1134510 - DNA, 19 bp, Homo sapiens
aactgaccagcctccatgc

SEQ ID NO: 1134511 - DNA, 16 bp, Homo sapiens
aactgactctgttatt

SEQ ID NO: 1134512 - DNA, 19 bp, Homo sapiens
aactgacttcatttgtgcc

SEQ ID NO: 1134513 - DNA, 13 bp, Homo sapiens
aactgactttctc

SEQ ID NO: 1134514 - DNA, 14 bp, Homo sapiens
aactgagagaaaga

SEQ ID NO: 1134515 - DNA, 18 bp, Homo sapiens
aactgagagtcatataca

SEQ ID NO: 1134516 - DNA, 10 bp, Homo sapiens
aactgagcct

SEQ ID NO: 1134517 - DNA, 19 bp, Homo sapiens
aactgaggagatgaccagg

SEQ ID NO: 1134518 - DNA, 20 bp, Homo sapiens
aactgaggagatgaccaggg

SEQ ID NO: 1134519 - DNA, 22 bp, Homo sapiens
aactgaggagatgaccagggat

SEQ ID NO: 1134520 - DNA, 20 bp, Homo sapiens
aactgaggcagacagcagct

SEQ ID NO: 1134521 - DNA, 20 bp, Homo sapiens
aactgagggctctgtttgtg

SEQ ID NO: 1134522 - DNA, 22 bp, Homo sapiens
aactgagtaaattggaaacatt

SEQ ID NO: 1134523 - DNA, 17 bp, Homo sapiens
aactgagtccatgaaaa

SEQ ID NO: 1134524 - DNA, 14 bp, Homo sapiens
aactgatcatgttt

SEQ ID NO: 1134525 - DNA, 16 bp, Homo sapiens
aactgatcatgtttat

SEQ ID NO: 1134526 - DNA, 15 bp, Homo sapiens
aactgatggaccggg

SEQ ID NO: 1134527 - DNA, 17 bp, Homo sapiens
aactgatggaccgggtg

SEQ ID NO: 1134528 - DNA, 22 bp, Homo sapiens
aactgatggaccgggtgggcct

SEQ ID NO: 1134529 - DNA, 16 bp, Homo sapiens
aactgattaaaaatac

SEQ ID NO: 1134530 - DNA, 20 bp, Homo sapiens
aactgattagtattcaggca

SEQ ID NO: 1134531 - DNA, 18 bp, Homo sapiens
aactgattattacttctg

SEQ ID NO: 1134532 - DNA, 13 bp, Homo sapiens
aactgattcataa

SEQ ID NO: 1134533 - DNA, 19 bp, Homo sapiens
aactgattcttatgattac

SEQ ID NO: 1134534 - DNA, 17 bp, Homo sapiens
aactgatttaacacttt

SEQ ID NO: 1134535 - DNA, 15 bp, Homo sapiens
aaccctatctcctga

SEQ ID NO: 1134536 - DNA, 19 bp, Homo sapiens
aaccctcagagccacccct

SEQ ID NO: 1134537 - DNA, 21 bp, Homo sapiens
aaccctcattgctgtcttgcc

SEQ ID NO: 1134538 - DNA, 13 bp, Homo sapiens
aaccctcccagaa

SEQ ID NO: 1134539 - DNA, 20 bp, Homo sapiens
aaccctcccagaaacatctc

SEQ ID NO: 1134540 - DNA, 17 bp, Homo sapiens
aaccctccctcagcccc

SEQ ID NO: 1134541 - DNA, 18 bp, Homo sapiens
aaccctccctcagcccct

SEQ ID NO: 1134542 - DNA, 20 bp, Homo sapiens
aaccctccctcagcccctct

SEQ ID NO: 1134543 - DNA, 21 bp, Homo sapiens
aaccctcctatcacctcccct

SEQ ID NO: 1134544 - DNA, 13 bp, Homo sapiens
aaccctcctcctt

SEQ ID NO: 1134545 - DNA, 23 bp, Homo sapiens
aaccctctcttccctattatttc

SEQ ID NO: 1134546 - DNA, 16 bp, Homo sapiens
aaccctcttgccatcc

SEQ ID NO: 1134547 - DNA, 21 bp, Homo sapiens
aaccctgacaaattttaatta

SEQ ID NO: 1134548 - DNA, 20 bp, Homo sapiens
aaccctgattcatactcctt

SEQ ID NO: 1134549 - DNA, 17 bp, Homo sapiens
aaccctgcaaaggactg

SEQ ID NO: 1134550 - DNA, 19 bp, Homo sapiens
aaccctgccagtgccaggg

SEQ ID NO: 1134551 - DNA, 21 bp, Homo sapiens
aaccctgccagtgccagggtg

SEQ ID NO: 1134552 - DNA, 18 bp, Homo sapiens
aaccctgccgtcaccacc

SEQ ID NO: 1134553 - DNA, 21 bp, Homo sapiens
aaccctgccgtcaccaccacc

SEQ ID NO: 1134554 - DNA, 16 bp, Homo sapiens
aaccctgcctgtcacc

SEQ ID NO: 1134555 - DNA, 22 bp, Homo sapiens
aaccctgcctgtcacctgggag

SEQ ID NO: 1134556 - DNA, 16 bp, Homo sapiens
aaccctggagccatcc

SEQ ID NO: 1134557 - DNA, 13 bp, Homo sapiens
aaccctggcctca

SEQ ID NO: 1134558 - DNA, 22 bp, Homo sapiens
aaccctgggctggggaggagga

SEQ ID NO: 1134559 - DNA, 18 bp, Homo sapiens
aaccctggggcctgactg

SEQ ID NO: 1134560 - DNA, 22 bp, Homo sapiens
aaccctgtctggatcctatcct

SEQ ID NO: 1134561 - DNA, 12 bp, Homo sapiens
aaccctgtggaa

SEQ ID NO: 1134562 - DNA, 18 bp, Homo sapiens
aaccctgtggaagcatgg

SEQ ID NO: 1134563 - DNA, 20 bp, Homo sapiens
aaccctgttttatactgtac

SEQ ID NO: 1134564 - DNA, 15 bp, Homo sapiens
aacccttaactgaca

SEQ ID NO: 1134565 - DNA, 18 bp, Homo sapiens
aacccttcaactcctggc

SEQ ID NO: 1134566 - DNA, 18 bp, Homo sapiens
aacccttctcctcttgta

SEQ ID NO: 1134567 - DNA, 21 bp, Homo sapiens
aacccttctcctcttgtaaat

SEQ ID NO: 1134568 - DNA, 13 bp, Homo sapiens
aacccttgctgct

SEQ ID NO: 1134569 - DNA, 20 bp, Homo sapiens
aacccttgctttcctgggcc

SEQ ID NO: 1134570 - DNA, 21 bp, Homo sapiens
aacccttggagccaatggaga

SEQ ID NO: 1134571 - DNA, 15 bp, Homo sapiens
aacccttgggccaga

SEQ ID NO: 1134572 - DNA, 13 bp, Homo sapiens
aacccttgtcagt

SEQ ID NO: 1134573 - DNA, 23 bp, Homo sapiens
aaccctttgtattataattgttg

SEQ ID NO: 1134574 - DNA, 16 bp, Homo sapiens
aacccttttggccccc

SEQ ID NO: 1134575 - DNA, 22 bp, Homo sapiens
aaccgaacatatcatttgtgaa

SEQ ID NO: 1134576 - DNA, 17 bp, Homo sapiens
aaccgagataggggagg

SEQ ID NO: 1134577 - DNA, 15 bp, Homo sapiens
aaccgagccagcagc

SEQ ID NO: 1134578 - DNA, 19 bp, Homo sapiens
aaccgagccagcagctgaa

SEQ ID NO: 1134579 - DNA, 19 bp, Homo sapiens
aaccgctcacctagagcca

SEQ ID NO: 1134580 - DNA, 16 bp, Homo sapiens
aaccgtcctgctgtcc

SEQ ID NO: 1134581 - DNA, 19 bp, Homo sapiens
aaccgtcctgctgtccctg

SEQ ID NO: 1134582 - DNA, 18 bp, Homo sapiens
aaccgtctgttatgctgt

SEQ ID NO: 1134583 - DNA, 22 bp, Homo sapiens
aaccgtctgttatgctgtgaca

SEQ ID NO: 1134584 - DNA, 17 bp, Homo sapiens
aaccgttttgaagctac

SEQ ID NO: 1134585 - DNA, 17 bp, Homo sapiens
aacctaaaagtattatt

SEQ ID NO: 1134586 - DNA, 13 bp, Homo sapiens
aacctaaatactg

SEQ ID NO: 1134587 - DNA, 15 bp, Homo sapiens
aacctaactgcaatg

SEQ ID NO: 1134588 - DNA, 21 bp, Homo sapiens
aacctaatcaccatgtaagca

SEQ ID NO: 1134589 - DNA, 20 bp, Homo sapiens
aacctacagttttaactgtg

SEQ ID NO: 1134590 - DNA, 18 bp, Homo sapiens
aacctaccaccccttcct

SEQ ID NO: 1134591 - DNA, 20 bp, Homo sapiens
aacctaccaccccttcctgt

SEQ ID NO: 1134592 - DNA, 13 bp, Homo sapiens
aacctaccagcca

SEQ ID NO: 1134593 - DNA, 22 bp, Homo sapiens
aacctacctcccacactcccaa

SEQ ID NO: 1134594 - DNA, 21 bp, Homo sapiens
aacctaccttcatttcaggag

SEQ ID NO: 1134595 - DNA, 15 bp, Homo sapiens
aacctactaggccat

SEQ ID NO: 1134596 - DNA, 14 bp, Homo sapiens
aacctactgcccac

SEQ ID NO: 1134597 - DNA, 16 bp, Homo sapiens
aacctagaatgtcaga

SEQ ID NO: 1134598 - DNA, 14 bp, Homo sapiens
aacctagcacacct

SEQ ID NO: 1134599 - DNA, 17 bp, Homo sapiens
aacctagcttttaaaaa

SEQ ID NO: 1134600 - DNA, 13 bp, Homo sapiens
aacctagtactct

SEQ ID NO: 1134601 - DNA, 20 bp, Homo sapiens
aacctagtactctctgctct

SEQ ID NO: 1134602 - DNA, 21 bp, Homo sapiens
aacctatctatgaacaacagt

SEQ ID NO: 1134603 - DNA, 21 bp, Homo sapiens
aacctattttcatttgtacaa

SEQ ID NO: 1134604 - DNA, 14 bp, Homo sapiens
aacctattttgtgt

SEQ ID NO: 1134605 - DNA, 13 bp, Homo sapiens
aacctcaaactct

SEQ ID NO: 1134606 - DNA, 16 bp, Homo sapiens
aacctcaatgccctgc

SEQ ID NO: 1134607 - DNA, 18 bp, Homo sapiens
aacctcaatgccctgcca

SEQ ID NO: 1134608 - DNA, 13 bp, Homo sapiens
aacctcaccaaac

SEQ ID NO: 1134609 - DNA, 14 bp, Homo sapiens
aacctcaccttcct

SEQ ID NO: 1134610 - DNA, 11 bp, Homo sapiens
aacctcactgg

SEQ ID NO: 1134611 - DNA, 14 bp, Homo sapiens
aacctcagctctgg

SEQ ID NO: 1134612 - DNA, 16 bp, Homo sapiens
aacctcagctctggga

SEQ ID NO: 1134613 - DNA, 18 bp, Homo sapiens
aacctcaggcttccttgg

SEQ ID NO: 1134614 - DNA, 18 bp, Homo sapiens
aacctcagggctcccagg

SEQ ID NO: 1134615 - DNA, 19 bp, Homo sapiens
aacctcagggctgtcccag

SEQ ID NO: 1134616 - DNA, 13 bp, Homo sapiens
aacctcagtgtca

SEQ ID NO: 1134617 - DNA, 19 bp, Homo sapiens
aacctcagtgtcatttatg

SEQ ID NO: 1134618 - DNA, 16 bp, Homo sapiens
aacctcattgacaaga

SEQ ID NO: 1134619 - DNA, 21 bp, Homo sapiens
aacctcattgacaagaactga

SEQ ID NO: 1134620 - DNA, 14 bp, Homo sapiens
aacctccagcctcc

SEQ ID NO: 1134621 - DNA, 18 bp, Homo sapiens
aacctccagcctccctgt

SEQ ID NO: 1134622 - DNA, 22 bp, Homo sapiens
aacctcccactttgtctgtaca

SEQ ID NO: 1134623 - DNA, 23 bp, Homo sapiens
aacctcccactttgtctgtacat

SEQ ID NO: 1134624 - DNA, 19 bp, Homo sapiens
aagcctctctctccctccc

SEQ ID NO: 1134625 - DNA, 13 bp, Homo sapiens
aagcctctgccct

SEQ ID NO: 1134626 - DNA, 21 bp, Homo sapiens
aagcctctgccctgcctccct

SEQ ID NO: 1134627 - DNA, 12 bp, Homo sapiens
aagcctctggct

SEQ ID NO: 1134628 - DNA, 16 bp, Homo sapiens
aagcctcttatttttc

SEQ ID NO: 1134629 - DNA, 16 bp, Homo sapiens
aagcctgaactgaggc

SEQ ID NO: 1134630 - DNA, 18 bp, Homo sapiens
aagcctgaactgaggcct

SEQ ID NO: 1134631 - DNA, 15 bp, Homo sapiens
aagcctgaggctggg

SEQ ID NO: 1134632 - DNA, 23 bp, Homo sapiens
aagcctgatactttagccatcat

SEQ ID NO: 1134633 - DNA, 16 bp, Homo sapiens
aagcctgatccagcct

SEQ ID NO: 1134634 - DNA, 15 bp, Homo sapiens
aagcctgcaggagaa

SEQ ID NO: 1134635 - DNA, 15 bp, Homo sapiens
aagcctgcattctta

SEQ ID NO: 1134636 - DNA, 22 bp, Homo sapiens
aagcctgcgttggtccagagcg

SEQ ID NO: 1134637 - DNA, 20 bp, Homo sapiens
aagcctgctgattgattttt

SEQ ID NO: 1134638 - DNA, 14 bp, Homo sapiens
aagcctggactctg

SEQ ID NO: 1134639 - DNA, 17 bp, Homo sapiens
aagcctggactctgccc

SEQ ID NO: 1134640 - DNA, 20 bp, Homo sapiens
aagcctggattccagcagtg

SEQ ID NO: 1134641 - DNA, 15 bp, Homo sapiens
aagcctggcacccac

SEQ ID NO: 1134642 - DNA, 16 bp, Homo sapiens
aagcctggcacccacc

SEQ ID NO: 1134643 - DNA, 16 bp, Homo sapiens
aagcctggcttcttat

SEQ ID NO: 1134644 - DNA, 16 bp, Homo sapiens
aagcctgggcttgagc

SEQ ID NO: 1134645 - DNA, 21 bp, Homo sapiens
aagcctgtattctcaaacaca

SEQ ID NO: 1134646 - DNA, 15 bp, Homo sapiens
aagcctgtccccaga

SEQ ID NO: 1134647 - DNA, 17 bp, Homo sapiens
aagcctgtctctttcca

SEQ ID NO: 1134648 - DNA, 18 bp, Homo sapiens
aagcctgtgcaaaaaaat

SEQ ID NO: 1134649 - DNA, 16 bp, Homo sapiens
aagcctgttcccctca

SEQ ID NO: 1134650 - DNA, 15 bp, Homo sapiens
aagcctgttgtttaa

SEQ ID NO: 1134651 - DNA, 19 bp, Homo sapiens
aagcctgttttgttggaag

SEQ ID NO: 1134652 - DNA, 18 bp, Homo sapiens
aagccttaactaagactc

SEQ ID NO: 1134653 - DNA, 14 bp, Homo sapiens
aagccttaagccat

SEQ ID NO: 1134654 - DNA, 18 bp, Homo sapiens
aagccttaatttgcacag

SEQ ID NO: 1134655 - DNA, 22 bp, Homo sapiens
aagccttatcaagtgtcttcca

SEQ ID NO: 1134656 - DNA, 12 bp, Homo sapiens
aagccttcattt

SEQ ID NO: 1134657 - DNA, 13 bp, Homo sapiens
aagccttcttctg

SEQ ID NO: 1134658 - DNA, 13 bp, Homo sapiens
aagccttgctcat

SEQ ID NO: 1134659 - DNA, 21 bp, Homo sapiens
aagcctttggtgaattccttc

SEQ ID NO: 1134660 - DNA, 10 bp, Homo sapiens
aagccttttt

SEQ ID NO: 1134661 - DNA, 15 bp, Homo sapiens
aagcgaaaaaatcag

SEQ ID NO: 1134662 - DNA, 14 bp, Homo sapiens
aagcgactctcctg

SEQ ID NO: 1134663 - DNA, 21 bp, Homo sapiens
aagcgatgaatttggagactc

SEQ ID NO: 1134664 - DNA, 15 bp, Homo sapiens
aagcgatttgaaaca

SEQ ID NO: 1134665 - DNA, 17 bp, Homo sapiens
aagcgatttgaaacact

SEQ ID NO: 1134666 - DNA, 13 bp, Homo sapiens
aagcgccaggctg

SEQ ID NO: 1134667 - DNA, 17 bp, Homo sapiens
aagcgcccacccaggtc

SEQ ID NO: 1134668 - DNA, 12 bp, Homo sapiens
aagcgccctcac

SEQ ID NO: 1134669 - DNA, 16 bp, Homo sapiens
aagcgcctcagttaca

SEQ ID NO: 1134670 - DNA, 22 bp, Homo sapiens
aagcgcctggctgctgcttctt

SEQ ID NO: 1134671 - DNA, 17 bp, Homo sapiens
aagcgcggctaacttat

SEQ ID NO: 1134672 - DNA, 12 bp, Homo sapiens
aagcgctccagg

SEQ ID NO: 1134673 - DNA, 21 bp, Homo sapiens
aagcggagttcctaacaggat

SEQ ID NO: 1134674 - DNA, 20 bp, Homo sapiens
aagcggccctaagggagtgt

SEQ ID NO: 1134675 - DNA, 21 bp, Homo sapiens
aagcggccctaagggagtgtc

SEQ ID NO: 1134676 - DNA, 15 bp, Homo sapiens
aagcgggcagccccg

SEQ ID NO: 1134677 - DNA, 19 bp, Homo sapiens
aagcgggggcgtggctggc

SEQ ID NO: 1134678 - DNA, 22 bp, Homo sapiens
aagcgggggcgtggctggcctt

SEQ ID NO: 1134679 - DNA, 13 bp, Homo sapiens
aagcggtggagga

SEQ ID NO: 1134680 - DNA, 22 bp, Homo sapiens
aagcggtggataactagccaga

SEQ ID NO: 1134681 - DNA, 22 bp, Homo sapiens
aagcgtcacttctcctgctgct

SEQ ID NO: 1134682 - DNA, 17 bp, Homo sapiens
aagcgtcgccccagtgg

SEQ ID NO: 1134683 - DNA, 20 bp, Homo sapiens
aagcgtcgccccagtggcac

SEQ ID NO: 1134684 - DNA, 18 bp, Homo sapiens
aagcgtgctgacatcaga

SEQ ID NO: 1134685 - DNA, 22 bp, Homo sapiens
aagcgttcatatgctctgcttt

SEQ ID NO: 1134686 - DNA, 12 bp, Homo sapiens
aagctaaaagga

SEQ ID NO: 1134687 - DNA, 15 bp, Homo sapiens
aagctaaaaggaaaa

SEQ ID NO: 1134688 - DNA, 16 bp, Homo sapiens
aagctaaaaggaaaag

SEQ ID NO: 1134689 - DNA, 15 bp, Homo sapiens
aagctaaaataaaga

SEQ ID NO: 1134690 - DNA, 16 bp, Homo sapiens
aagctaaaataaagaa

SEQ ID NO: 1134691 - DNA, 21 bp, Homo sapiens
aagctaaatcctttactgtta

SEQ ID NO: 1134692 - DNA, 17 bp, Homo sapiens
aagctaacatctttacg

SEQ ID NO: 1134693 - DNA, 17 bp, Homo sapiens
aagctaaggtttagata

SEQ ID NO: 1134694 - DNA, 23 bp, Homo sapiens
aagctaatgacgaggaaccgaaa

SEQ ID NO: 1134695 - DNA, 13 bp, Homo sapiens
aagctaatgtcac

SEQ ID NO: 1134696 - DNA, 14 bp, Homo sapiens
aagctaatgtgcag

SEQ ID NO: 1134697 - DNA, 21 bp, Homo sapiens
aagctaatgtgcagggatatt

SEQ ID NO: 1134698 - DNA, 23 bp, Homo sapiens
aagctaattgtactaatctgaga

SEQ ID NO: 1134699 - DNA, 13 bp, Homo sapiens
aagctacaggact

SEQ ID NO: 1134700 - DNA, 14 bp, Homo sapiens
aagctacaggactg

SEQ ID NO: 1134701 - DNA, 18 bp, Homo sapiens
aagctacaggttgtgaaa

SEQ ID NO: 1134702 - DNA, 22 bp, Homo sapiens
aagctaccattttacatttcta

SEQ ID NO: 1134703 - DNA, 17 bp, Homo sapiens
aagctagaaggccacat

SEQ ID NO: 1134704 - DNA, 15 bp, Homo sapiens
aagctagacacatga

SEQ ID NO: 1134705 - DNA, 17 bp, Homo sapiens
aagctagacacatgaag

SEQ ID NO: 1134706 - DNA, 20 bp, Homo sapiens
aagctagacacatgaaggta

SEQ ID NO: 1134707 - DNA, 14 bp, Homo sapiens
aagctagagatatg

SEQ ID NO: 1134708 - DNA, 17 bp, Homo sapiens
aagctagatatgcctta

SEQ ID NO: 1134709 - DNA, 18 bp, Homo sapiens
aagctagccagagggtgg

SEQ ID NO: 1134710 - DNA, 19 bp, Homo sapiens
aagctagggtggcccttgc

SEQ ID NO: 1134711 - DNA, 22 bp, Homo sapiens
aagctagggtggcccttgcagt

SEQ ID NO: 1134712 - DNA, 15 bp, Homo sapiens
aagctagtcttttgc

SEQ ID NO: 1134713 - DNA, 12 bp, Homo sapiens
aagctagtgttt

SEQ ID NO: 1134714 - DNA, 15 bp, Homo sapiens
aagctagtgtttcta

SEQ ID NO: 1134715 - DNA, 13 bp, Homo sapiens
aagctataaagca

SEQ ID NO: 1134716 - DNA, 18 bp, Homo sapiens
aagctataaattcctctt

SEQ ID NO: 1134717 - DNA, 15 bp, Homo sapiens
aagctatattagctg

SEQ ID NO: 1134718 - DNA, 17 bp, Homo sapiens
aagctatattagctgaa

SEQ ID NO: 1134719 - DNA, 21 bp, Homo sapiens
aagctatcacctagcagcctc

SEQ ID NO: 1134720 - DNA, 13 bp, Homo sapiens
aagctatcagcaa

SEQ ID NO: 1134721 - DNA, 15 bp, Homo sapiens
aagctatcagcaata

SEQ ID NO: 1134722 - DNA, 12 bp, Homo sapiens
aagctatggtga

SEQ ID NO: 1134723 - DNA, 21 bp, Homo sapiens
aagctattcctttcccttcct

SEQ ID NO: 1134724 - DNA, 15 bp, Homo sapiens
aagctattgtctgta

SEQ ID NO: 1134725 - DNA, 17 bp, Homo sapiens
aagctatttgatatgca

SEQ ID NO: 1134726 - DNA, 21 bp, Homo sapiens
aagctcaaaggtttggaagga

SEQ ID NO: 1134727 - DNA, 17 bp, Homo sapiens
aagctcaaatgaaatgt

SEQ ID NO: 1134728 - DNA, 18 bp, Homo sapiens
aagctcaaatgaaatgta

SEQ ID NO: 1134729 - DNA, 16 bp, Homo sapiens
aagctcaattcaagtg

SEQ ID NO: 1134730 - DNA, 23 bp, Homo sapiens
aagctcacagttcctcgccctgg

SEQ ID NO: 1134731 - DNA, 17 bp, Homo sapiens
aagctcacgtcctgaga

SEQ ID NO: 1134732 - DNA, 12 bp, Homo sapiens
aagctcagaatc

SEQ ID NO: 1134733 - DNA, 11 bp, Homo sapiens
aagctcagagt

SEQ ID NO: 1134734 - DNA, 15 bp, Homo sapiens
aagctcagctgcatt

SEQ ID NO: 1134735 - DNA, 23 bp, Homo sapiens
aagctcaggagggtgacgcccag

SEQ ID NO: 1134736 - DNA, 22 bp, Homo sapiens
aagccaaagaaacaagctgtgc

SEQ ID NO: 1134737 - DNA, 12 bp, Homo sapiens
aagccaaagagt

SEQ ID NO: 1134738 - DNA, 23 bp, Homo sapiens
aagccaaagttttcaaactgctg

SEQ ID NO: 1134739 - DNA, 16 bp, Homo sapiens
aagccaacaactctgc

SEQ ID NO: 1134740 - DNA, 14 bp, Homo sapiens
aagccaaccagcct

SEQ ID NO: 1134741 - DNA, 15 bp, Homo sapiens
aagccaaccagcctt

SEQ ID NO: 1134742 - DNA, 17 bp, Homo sapiens
aagccaacttgtaaata

SEQ ID NO: 1134743 - DNA, 20 bp, Homo sapiens
aagccaagcaaaccaatggt

SEQ ID NO: 1134744 - DNA, 13 bp, Homo sapiens
aagccaagggaaa

SEQ ID NO: 1134745 - DNA, 23 bp, Homo sapiens
aagccaagggaaaggggtgcttt

SEQ ID NO: 1134746 - DNA, 19 bp, Homo sapiens
aagccaatcccctccttgg

SEQ ID NO: 1134747 - DNA, 18 bp, Homo sapiens
aagccacaaggctggcca

SEQ ID NO: 1134748 - DNA, 13 bp, Homo sapiens
aagccacaggaag

SEQ ID NO: 1134749 - DNA, 12 bp, Homo sapiens
aagccacatctt

SEQ ID NO: 1134750 - DNA, 16 bp, Homo sapiens
aagccacatcttgctc

SEQ ID NO: 1134751 - DNA, 18 bp, Homo sapiens
aagccacatcttgctctg

SEQ ID NO: 1134752 - DNA, 19 bp, Homo sapiens
aagccaccttgttacaaat

SEQ ID NO: 1134753 - DNA, 19 bp, Homo sapiens
aagccactctgtcccttcc

SEQ ID NO: 1134754 - DNA, 13 bp, Homo sapiens
aagccactgaagc

SEQ ID NO: 1134755 - DNA, 16 bp, Homo sapiens
aagccacttggcccag

SEQ ID NO: 1134756 - DNA, 18 bp, Homo sapiens
aagccacttggcccagaa

SEQ ID NO: 1134757 - DNA, 17 bp, Homo sapiens
aagccagacaacttctg

SEQ ID NO: 1134758 - DNA, 20 bp, Homo sapiens
aagccagacctagcaggctg

SEQ ID NO: 1134759 - DNA, 12 bp, Homo sapiens
aagccagagcct

SEQ ID NO: 1134760 - DNA, 14 bp, Homo sapiens
aagccagagcctgg

SEQ ID NO: 1134761 - DNA, 14 bp, Homo sapiens
aagccagaggagaa

SEQ ID NO: 1134762 - DNA, 15 bp, Homo sapiens
aagccagaggctggg

SEQ ID NO: 1134763 - DNA, 14 bp, Homo sapiens
aagccagagtgtat

SEQ ID NO: 1134764 - DNA, 20 bp, Homo sapiens
aagccagccaagctttaaat

SEQ ID NO: 1134765 - DNA, 20 bp, Homo sapiens
aagccagccccctccagctc

SEQ ID NO: 1134766 - DNA, 22 bp, Homo sapiens
aagccagccccctccagctcat

SEQ ID NO: 1134767 - DNA, 13 bp, Homo sapiens
aagccagcctggt

SEQ ID NO: 1134768 - DNA, 17 bp, Homo sapiens
aagccagcgtcctcctc

SEQ ID NO: 1134769 - DNA, 16 bp, Homo sapiens
aagccagctgccctat

SEQ ID NO: 1134770 - DNA, 21 bp, Homo sapiens
aagccagctgccgaccagagc

SEQ ID NO: 1134771 - DNA, 23 bp, Homo sapiens
aagccagctgccgaccagagccc

SEQ ID NO: 1134772 - DNA, 12 bp, Homo sapiens
aagccagctttc

SEQ ID NO: 1134773 - DNA, 14 bp, Homo sapiens
aagccagctttccc

SEQ ID NO: 1134774 - DNA, 18 bp, Homo sapiens
aagccaggagcaaatgtt

SEQ ID NO: 1134775 - DNA, 11 bp, Homo sapiens
aagccagggcc

SEQ ID NO: 1134776 - DNA, 18 bp, Homo sapiens
aagccagggcccagagcc

SEQ ID NO: 1134777 - DNA, 19 bp, Homo sapiens
aagccagggtctctccctc

SEQ ID NO: 1134778 - DNA, 23 bp, Homo sapiens
aagccaggttccacagaggacac

SEQ ID NO: 1134779 - DNA, 20 bp, Homo sapiens
aagccagtcaccttctgggc

SEQ ID NO: 1134780 - DNA, 16 bp, Homo sapiens
aagccagttttcattt

SEQ ID NO: 1134781 - DNA, 23 bp, Homo sapiens
aagccatagaccctgaggccctg

SEQ ID NO: 1134782 - DNA, 14 bp, Homo sapiens
aagccataggccca

SEQ ID NO: 1134783 - DNA, 16 bp, Homo sapiens
aagccataggcccagg

SEQ ID NO: 1134784 - DNA, 17 bp, Homo sapiens
aagccataggcccagga

SEQ ID NO: 1134785 - DNA, 18 bp, Homo sapiens
aagccataggcccaggat

SEQ ID NO: 1134786 - DNA, 17 bp, Homo sapiens
aagccatagggggctgc

SEQ ID NO: 1134787 - DNA, 23 bp, Homo sapiens
aagccatatatgaccagaagcct

SEQ ID NO: 1134788 - DNA, 12 bp, Homo sapiens
aagccatattcc

SEQ ID NO: 1134789 - DNA, 19 bp, Homo sapiens
aagccatattccagcagtg

SEQ ID NO: 1134790 - DNA, 20 bp, Homo sapiens
aagccatcacttctccccgc

SEQ ID NO: 1134791 - DNA, 21 bp, Homo sapiens
aagccatcacttctccccgca

SEQ ID NO: 1134792 - DNA, 12 bp, Homo sapiens
aagccatctcag

SEQ ID NO: 1134793 - DNA, 21 bp, Homo sapiens
aagccatgggacctcctccct

SEQ ID NO: 1134794 - DNA, 22 bp, Homo sapiens
aagccatgggacctcctccctc

SEQ ID NO: 1134795 - DNA, 22 bp, Homo sapiens
aagccatgtgctttagcataaa

SEQ ID NO: 1134796 - DNA, 19 bp, Homo sapiens
aagccatgttaaatgactt

SEQ ID NO: 1134797 - DNA, 22 bp, Homo sapiens
aagccattctcctgcctcagcc

SEQ ID NO: 1134798 - DNA, 15 bp, Homo sapiens
aagccattcttttaa

SEQ ID NO: 1134799 - DNA, 12 bp, Homo sapiens
aagcccaactgg

SEQ ID NO: 1134800 - DNA, 20 bp, Homo sapiens
aagcccacaggcctgttccc

SEQ ID NO: 1134801 - DNA, 16 bp, Homo sapiens
aagcccacctgggctg

SEQ ID NO: 1134802 - DNA, 18 bp, Homo sapiens
aagcccacctgggctggg

SEQ ID NO: 1134803 - DNA, 20 bp, Homo sapiens
aagcccagcactgcttgagg

SEQ ID NO: 1134804 - DNA, 11 bp, Homo sapiens
aagcccagctc

SEQ ID NO: 1134805 - DNA, 13 bp, Homo sapiens
aagcccagcttga

SEQ ID NO: 1134806 - DNA, 12 bp, Homo sapiens
aagcccaggctc

SEQ ID NO: 1134807 - DNA, 16 bp, Homo sapiens
aagcccagtggtgagg

SEQ ID NO: 1134808 - DNA, 14 bp, Homo sapiens
aagcccatcctgac

SEQ ID NO: 1134809 - DNA, 21 bp, Homo sapiens
aagcccatgtcttctgctgtt

SEQ ID NO: 1134810 - DNA, 22 bp, Homo sapiens
aagcccattttcaactgctttg

SEQ ID NO: 1134811 - DNA, 14 bp, Homo sapiens
aagccccagggcct

SEQ ID NO: 1134812 - DNA, 17 bp, Homo sapiens
aagccccatctcatcct

SEQ ID NO: 1134813 - DNA, 15 bp, Homo sapiens
aagccccatttcctc

SEQ ID NO: 1134814 - DNA, 16 bp, Homo sapiens
aagccccatttcctca

SEQ ID NO: 1134815 - DNA, 12 bp, Homo sapiens
aagcccccaggg

SEQ ID NO: 1134816 - DNA, 15 bp, Homo sapiens
aagcccccagggcct

SEQ ID NO: 1134817 - DNA, 19 bp, Homo sapiens
aagcccccagggcctccag

SEQ ID NO: 1134818 - DNA, 21 bp, Homo sapiens
aagcccccagggcctccaggg

SEQ ID NO: 1134819 - DNA, 16 bp, Homo sapiens
aagcccccccttccac

SEQ ID NO: 1134820 - DNA, 14 bp, Homo sapiens
aagcccccctttgg

SEQ ID NO: 1134821 - DNA, 17 bp, Homo sapiens
aagccccctcttcctcc

SEQ ID NO: 1134822 - DNA, 13 bp, Homo sapiens
aagccccgacaca

SEQ ID NO: 1134823 - DNA, 20 bp, Homo sapiens
aagcccctcagcccttgccc

SEQ ID NO: 1134824 - DNA, 19 bp, Homo sapiens
aagcccgcctgacagaaac

SEQ ID NO: 1134825 - DNA, 12 bp, Homo sapiens
aagccctccttc

SEQ ID NO: 1134826 - DNA, 11 bp, Homo sapiens
aagccctggca

SEQ ID NO: 1134827 - DNA, 23 bp, Homo sapiens
aagcccttccatgtcgcctctgc

SEQ ID NO: 1134828 - DNA, 18 bp, Homo sapiens
aagcccttcggtcacctg

SEQ ID NO: 1134829 - DNA, 14 bp, Homo sapiens
aagccctttgccat

SEQ ID NO: 1134830 - DNA, 14 bp, Homo sapiens
aagccctttgctct

SEQ ID NO: 1134831 - DNA, 16 bp, Homo sapiens
aagccctttgctctgg

SEQ ID NO: 1134832 - DNA, 17 bp, Homo sapiens
aagccgactctggccct

SEQ ID NO: 1134833 - DNA, 19 bp, Homo sapiens
aagccgccagttcatcttt

SEQ ID NO: 1134834 - DNA, 13 bp, Homo sapiens
aagccggcggccc

SEQ ID NO: 1134835 - DNA, 14 bp, Homo sapiens
aagccgggggaggg

SEQ ID NO: 1134836 - DNA, 20 bp, Homo sapiens
aagccgggggaggggccctc

SEQ ID NO: 1134837 - DNA, 22 bp, Homo sapiens
aagccggggtgtaacttcctgc

SEQ ID NO: 1134838 - DNA, 23 bp, Homo sapiens
aagccggggtgtaacttcctgct

SEQ ID NO: 1134839 - DNA, 13 bp, Homo sapiens
aagccgtcctggc

SEQ ID NO: 1134840 - DNA, 16 bp, Homo sapiens
aagccgtctgactcca

SEQ ID NO: 1134841 - DNA, 21 bp, Homo sapiens
aagccgtgattttcattgctg

SEQ ID NO: 1134842 - DNA, 15 bp, Homo sapiens
aagccgtggcttccc

SEQ ID NO: 1134843 - DNA, 16 bp, Homo sapiens
aagcctaaatgcctta

SEQ ID NO: 1134844 - DNA, 17 bp, Homo sapiens
aactggcagttttccat

SEQ ID NO: 1134845 - DNA, 20 bp, Homo sapiens
aactggcatctgacacaaaa

SEQ ID NO: 1134846 - DNA, 21 bp, Homo sapiens
aactggccccggatcagagca

SEQ ID NO: 1134847 - DNA, 18 bp, Homo sapiens
aactggcccgtggagact

SEQ ID NO: 1134848 - DNA, 18 bp, Homo sapiens
aactggccctatttagat

SEQ ID NO: 1134849 - DNA, 18 bp, Homo sapiens
aactggcctaaatttctt

SEQ ID NO: 1134850 - DNA, 13 bp, Homo sapiens
aactggctggcca

SEQ ID NO: 1134851 - DNA, 23 bp, Homo sapiens
aactggctgggcccctggggaca

SEQ ID NO: 1134852 - DNA, 19 bp, Homo sapiens
aactggcttcattttagga

SEQ ID NO: 1134853 - DNA, 17 bp, Homo sapiens
aactgggcacagattga

SEQ ID NO: 1134854 - DNA, 18 bp, Homo sapiens
aactgggcacagattgaa

SEQ ID NO: 1134855 - DNA, 21 bp, Homo sapiens
aactgggcacagattgaagaa

SEQ ID NO: 1134856 - DNA, 22 bp, Homo sapiens
aactgggctggcgcttggatct

SEQ ID NO: 1134857 - DNA, 22 bp, Homo sapiens
aactgggggagggtgaagtgaa

SEQ ID NO: 1134858 - DNA, 15 bp, Homo sapiens
aactggggggccacc

SEQ ID NO: 1134859 - DNA, 16 bp, Homo sapiens
aactggggggccacca

SEQ ID NO: 1134860 - DNA, 18 bp, Homo sapiens
aactggggggccaccatg

SEQ ID NO: 1134861 - DNA, 21 bp, Homo sapiens
aactgggttgagggatgctgg

SEQ ID NO: 1134862 - DNA, 20 bp, Homo sapiens
aactggtaaaaagatccagg

SEQ ID NO: 1134863 - DNA, 14 bp, Homo sapiens
aactggtattgttt

SEQ ID NO: 1134864 - DNA, 20 bp, Homo sapiens
aactggtgcactttgtaaat

SEQ ID NO: 1134865 - DNA, 21 bp, Homo sapiens
aactggtgcactttgtaaatt

SEQ ID NO: 1134866 - DNA, 15 bp, Homo sapiens
aactggttagtgtga

SEQ ID NO: 1134867 - DNA, 17 bp, Homo sapiens
aactggttagtgtgaaa

SEQ ID NO: 1134868 - DNA, 21 bp, Homo sapiens
aactggtttgttgcagccaaa

SEQ ID NO: 1134869 - DNA, 22 bp, Homo sapiens
aactgtaaacttggaatcaagg

SEQ ID NO: 1134870 - DNA, 14 bp, Homo sapiens
aactgtaaagcaaa

SEQ ID NO: 1134871 - DNA, 14 bp, Homo sapiens
aactgtaaataaaa

SEQ ID NO: 1134872 - DNA, 22 bp, Homo sapiens
aactgtaaataaaatgtgtaca

SEQ ID NO: 1134873 - DNA, 11 bp, Homo sapiens
aactgtaaatc

SEQ ID NO: 1134874 - DNA, 12 bp, Homo sapiens
aactgtaaatca

SEQ ID NO: 1134875 - DNA, 16 bp, Homo sapiens
aactgtacagtgtctt

SEQ ID NO: 1134876 - DNA, 11 bp, Homo sapiens
aactgtacatt

SEQ ID NO: 1134877 - DNA, 16 bp, Homo sapiens
aactgtacattgtgag

SEQ ID NO: 1134878 - DNA, 13 bp, Homo sapiens
aactgtactgtgt

SEQ ID NO: 1134879 - DNA, 13 bp, Homo sapiens
aactgtacttcac

SEQ ID NO: 1134880 - DNA, 18 bp, Homo sapiens
aactgtacttttaaggca

SEQ ID NO: 1134881 - DNA, 15 bp, Homo sapiens
aactgtagaaatgat

SEQ ID NO: 1134882 - DNA, 17 bp, Homo sapiens
aactgtagaaatgatga

SEQ ID NO: 1134883 - DNA, 19 bp, Homo sapiens
aactgtagaaatgatgatg

SEQ ID NO: 1134884 - DNA, 14 bp, Homo sapiens
aactgtatatttgt

SEQ ID NO: 1134885 - DNA, 16 bp, Homo sapiens
aactgtatatttgtat

SEQ ID NO: 1134886 - DNA, 19 bp, Homo sapiens
aactgtatgtgtgtaggtt

SEQ ID NO: 1134887 - DNA, 12 bp, Homo sapiens
aactgtatttca

SEQ ID NO: 1134888 - DNA, 17 bp, Homo sapiens
aactgtatttcagtatt

SEQ ID NO: 1134889 - DNA, 23 bp, Homo sapiens
aactgtcaaattttcaaataata

SEQ ID NO: 1134890 - DNA, 22 bp, Homo sapiens
aactgtcagtgtacacgtctgg

SEQ ID NO: 1134891 - DNA, 14 bp, Homo sapiens
aactgtccagagag

SEQ ID NO: 1134892 - DNA, 18 bp, Homo sapiens
aactgtccgtaagcagta

SEQ ID NO: 1134893 - DNA, 14 bp, Homo sapiens
aactgtcctgtcct

SEQ ID NO: 1134894 - DNA, 18 bp, Homo sapiens
aactgtcctgtcctgctc

SEQ ID NO: 1134895 - DNA, 14 bp, Homo sapiens
aactgtctcaaaag

SEQ ID NO: 1134896 - DNA, 20 bp, Homo sapiens
aactgtcttgtttcagtgag

SEQ ID NO: 1134897 - DNA, 16 bp, Homo sapiens
aactgtgaaaatagtg

SEQ ID NO: 1134898 - DNA, 17 bp, Homo sapiens
aactgtgaaaatagtgt

SEQ ID NO: 1134899 - DNA, 19 bp, Homo sapiens
aactgtgaaatttacaaat

SEQ ID NO: 1134900 - DNA, 22 bp, Homo sapiens
aacctgggaggcggagagtaca

SEQ ID NO: 1134901 - DNA, 17 bp, Homo sapiens
aacctgggattcaggaa

SEQ ID NO: 1134902 - DNA, 23 bp, Homo sapiens
aacctggggtgaatacttatttt

SEQ ID NO: 1134903 - DNA, 23 bp, Homo sapiens
aacctggtcacaggactctgcct

SEQ ID NO: 1134904 - DNA, 14 bp, Homo sapiens
aacctggtgctgga

SEQ ID NO: 1134905 - DNA, 19 bp, Homo sapiens
aacctgtcatgtgcggatc

SEQ ID NO: 1134906 - DNA, 15 bp, Homo sapiens
aacctgtcctaagga

SEQ ID NO: 1134907 - DNA, 18 bp, Homo sapiens
aacctgtctccactgtgc

SEQ ID NO: 1134908 - DNA, 19 bp, Homo sapiens
aacctgtcttggggccact

SEQ ID NO: 1134909 - DNA, 21 bp, Homo sapiens
aacctgtggcgctgcagcagg

SEQ ID NO: 1134910 - DNA, 21 bp, Homo sapiens
aacctgttacctactttgact

SEQ ID NO: 1134911 - DNA, 22 bp, Homo sapiens
aacctgttcttagagtgtagct

SEQ ID NO: 1134912 - DNA, 21 bp, Homo sapiens
aacctgttgatagcaagtgaa

SEQ ID NO: 1134913 - DNA, 19 bp, Homo sapiens
aacctgtttaatgttatga

SEQ ID NO: 1134914 - DNA, 13 bp, Homo sapiens
aaccttaatgaca

SEQ ID NO: 1134915 - DNA, 17 bp, Homo sapiens
aaccttaatgacaacac

SEQ ID NO: 1134916 - DNA, 17 bp, Homo sapiens
aaccttaatttattatt

SEQ ID NO: 1134917 - DNA, 22 bp, Homo sapiens
aaccttatcaaggattttcatg

SEQ ID NO: 1134918 - DNA, 18 bp, Homo sapiens
aaccttattgtacctctc

SEQ ID NO: 1134919 - DNA, 14 bp, Homo sapiens
aaccttcaacccag

SEQ ID NO: 1134920 - DNA, 19 bp, Homo sapiens
aaccttcacatctgtcacg

SEQ ID NO: 1134921 - DNA, 15 bp, Homo sapiens
aaccttcagaagcta

SEQ ID NO: 1134922 - DNA, 15 bp, Homo sapiens
aaccttcatgctttt

SEQ ID NO: 1134923 - DNA, 14 bp, Homo sapiens
aaccttcattttta

SEQ ID NO: 1134924 - DNA, 15 bp, Homo sapiens
aaccttcatttttaa

SEQ ID NO: 1134925 - DNA, 21 bp, Homo sapiens
aaccttcatttttaagactgt

SEQ ID NO: 1134926 - DNA, 12 bp, Homo sapiens
aaccttctggcc

SEQ ID NO: 1134927 - DNA, 13 bp, Homo sapiens
aaccttgaatgct

SEQ ID NO: 1134928 - DNA, 17 bp, Homo sapiens
aaccttgagtcagaaaa

SEQ ID NO: 1134929 - DNA, 16 bp, Homo sapiens
aaccttgcctggtaca

SEQ ID NO: 1134930 - DNA, 18 bp, Homo sapiens
aaccttgcctggtacagt

SEQ ID NO: 1134931 - DNA, 20 bp, Homo sapiens
aaccttggaccactcctgtc

SEQ ID NO: 1134932 - DNA, 17 bp, Homo sapiens
aaccttggagaggagag

SEQ ID NO: 1134933 - DNA, 22 bp, Homo sapiens
aaccttgtttgtggtgtcccct

SEQ ID NO: 1134934 - DNA, 12 bp, Homo sapiens
aacctttaatga

SEQ ID NO: 1134935 - DNA, 14 bp, Homo sapiens
aacctttaatgaga

SEQ ID NO: 1134936 - DNA, 20 bp, Homo sapiens
aacctttcacctttgtgtat

SEQ ID NO: 1134937 - DNA, 15 bp, Homo sapiens
aacctttccctcacc

SEQ ID NO: 1134938 - DNA, 18 bp, Homo sapiens
aacctttccctcaccccc

SEQ ID NO: 1134939 - DNA, 19 bp, Homo sapiens
aacctttgctatgtaaggg

SEQ ID NO: 1134940 - DNA, 13 bp, Homo sapiens
aaccttttactgg

SEQ ID NO: 1134941 - DNA, 12 bp, Homo sapiens
aacctttttaaa

SEQ ID NO: 1134942 - DNA, 16 bp, Homo sapiens
aacctttttgtaaata

SEQ ID NO: 1134943 - DNA, 17 bp, Homo sapiens
aacctttttttttgaaa

SEQ ID NO: 1134944 - DNA, 18 bp, Homo sapiens
aacctttttttttgaaac

SEQ ID NO: 1134945 - DNA, 14 bp, Homo sapiens
aacgaaagaaggca

SEQ ID NO: 1134946 - DNA, 13 bp, Homo sapiens
aacgaagaaaaaa

SEQ ID NO: 1134947 - DNA, 14 bp, Homo sapiens
aacgaagaaaaaaa

SEQ ID NO: 1134948 - DNA, 18 bp, Homo sapiens
aacgaatggtctttgctc

SEQ ID NO: 1134949 - DNA, 23 bp, Homo sapiens
aacgacaaagccaaactctgcca

SEQ ID NO: 1134950 - DNA, 20 bp, Homo sapiens
aacgaccttacaaatgagga

SEQ ID NO: 1134951 - DNA, 16 bp, Homo sapiens
aacgagcactggccag

SEQ ID NO: 1134952 - DNA, 20 bp, Homo sapiens
aacgagcctcctcagggggt

SEQ ID NO: 1134953 - DNA, 22 bp, Homo sapiens
aacgagggctgatggaggaaaa

SEQ ID NO: 1134954 - DNA, 16 bp, Homo sapiens
aacgagtcaatcccct

SEQ ID NO: 1134955 - DNA, 16 bp, Homo sapiens
aacgatgtgtctgtat

SEQ ID NO: 1134956 - DNA, 13 bp, Homo sapiens
aacgatttagaaa

SEQ ID NO: 1134957 - DNA, 12 bp, Homo sapiens
aacgcacttaca

SEQ ID NO: 1134958 - DNA, 14 bp, Homo sapiens
aacgcagaagaaag

SEQ ID NO: 1134959 - DNA, 15 bp, Homo sapiens
aacgcagacactgag

SEQ ID NO: 1134960 - DNA, 11 bp, Homo sapiens
aacgcagcctc

SEQ ID NO: 1134961 - DNA, 18 bp, Homo sapiens
aacgcatggagtgtgtat

SEQ ID NO: 1134962 - DNA, 21 bp, Homo sapiens
aacgcatggagtgtgtattgt

SEQ ID NO: 1134963 - DNA, 15 bp, Homo sapiens
aacgccagtctccca

SEQ ID NO: 1134964 - DNA, 22 bp, Homo sapiens
aacgccccagataccagcccct

SEQ ID NO: 1134965 - DNA, 11 bp, Homo sapiens
aacgcccctcc

SEQ ID NO: 1134966 - DNA, 22 bp, Homo sapiens
aacgcccctccaaacctccagc

SEQ ID NO: 1134967 - DNA, 14 bp, Homo sapiens
aacgcccctgtggc

SEQ ID NO: 1134968 - DNA, 15 bp, Homo sapiens
aacgcccctgtggcc

SEQ ID NO: 1134969 - DNA, 16 bp, Homo sapiens
aacgcccctgtggcca

SEQ ID NO: 1134970 - DNA, 16 bp, Homo sapiens
aacgccgagtgcactg

SEQ ID NO: 1134971 - DNA, 18 bp, Homo sapiens
aacgcctcccctgcccca

SEQ ID NO: 1134972 - DNA, 22 bp, Homo sapiens
aacgctaaagagcccttgcctc

SEQ ID NO: 1134973 - DNA, 15 bp, Homo sapiens
aacgctacctctctg

SEQ ID NO: 1134974 - DNA, 18 bp, Homo sapiens
aacgctgaactgacaatg

SEQ ID NO: 1134975 - DNA, 22 bp, Homo sapiens
aacgcttgtagaactcactctg

SEQ ID NO: 1134976 - DNA, 23 bp, Homo sapiens
aacgcttgtagaactcactctgg

SEQ ID NO: 1134977 - DNA, 21 bp, Homo sapiens
aacggaccaaagcaagaccct

SEQ ID NO: 1134978 - DNA, 20 bp, Homo sapiens
aacggagccccaggcctctg

SEQ ID NO: 1134979 - DNA, 16 bp, Homo sapiens
aacggaggcagatgga

SEQ ID NO: 1134980 - DNA, 20 bp, Homo sapiens
aacggcccatagccttgggg

SEQ ID NO: 1134981 - DNA, 14 bp, Homo sapiens
aacggctccaggat

SEQ ID NO: 1134982 - DNA, 11 bp, Homo sapiens
aacgggcagcc

SEQ ID NO: 1134983 - DNA, 19 bp, Homo sapiens
aacgggcagccacaggact

SEQ ID NO: 1134984 - DNA, 23 bp, Homo sapiens
aagagcaggcacatggaggagct

SEQ ID NO: 1134985 - DNA, 12 bp, Homo sapiens
aagagcaggtga

SEQ ID NO: 1134986 - DNA, 18 bp, Homo sapiens
aagagcatgatttgaaaa

SEQ ID NO: 1134987 - DNA, 12 bp, Homo sapiens
aagagccacctg

SEQ ID NO: 1134988 - DNA, 14 bp, Homo sapiens
aagagccacctgca

SEQ ID NO: 1134989 - DNA, 18 bp, Homo sapiens
aagagccacctgcaagat

SEQ ID NO: 1134990 - DNA, 9 bp, Homo sapiens
aagagccat

SEQ ID NO: 1134991 - DNA, 18 bp, Homo sapiens
aagagcccagtctgttga

SEQ ID NO: 1134992 - DNA, 20 bp, Homo sapiens
aagagcccgccgtctgcagg

SEQ ID NO: 1134993 - DNA, 18 bp, Homo sapiens
aagagccctaagtttgta

SEQ ID NO: 1134994 - DNA, 23 bp, Homo sapiens
aagagccctggctctgcccctca

SEQ ID NO: 1134995 - DNA, 19 bp, Homo sapiens
aagagccctgtggccgcca

SEQ ID NO: 1134996 - DNA, 23 bp, Homo sapiens
aagagccctgtggccgccacctg

SEQ ID NO: 1134997 - DNA, 13 bp, Homo sapiens
aagagcccttgcc

SEQ ID NO: 1134998 - DNA, 22 bp, Homo sapiens
aagagcctgaagctggcctgga

SEQ ID NO: 1134999 - DNA, 19 bp, Homo sapiens
aagagcctgatctcttcct

SEQ ID NO: 1135000 - DNA, 20 bp, Homo sapiens
aagagcctgatctcttcctg

SEQ ID NO: 1135001 - DNA, 21 bp, Homo sapiens
aagagcctgatctcttcctgt

SEQ ID NO: 1135002 - DNA, 16 bp, Homo sapiens
aagagcctggagaagc

SEQ ID NO: 1135003 - DNA, 21 bp, Homo sapiens
aagagcctggagaagctgatg

SEQ ID NO: 1135004 - DNA, 22 bp, Homo sapiens
aagagccttggtgtccacctgg

SEQ ID NO: 1135005 - DNA, 18 bp, Homo sapiens
aagagcgctcctctgcct

SEQ ID NO: 1135006 - DNA, 14 bp, Homo sapiens
aagagctacataat

SEQ ID NO: 1135007 - DNA, 16 bp, Homo sapiens
aagagctacataattt

SEQ ID NO: 1135008 - DNA, 18 bp, Homo sapiens
aagagctacgtatttaat

SEQ ID NO: 1135009 - DNA, 20 bp, Homo sapiens
aagagctagaaaaataaaat

SEQ ID NO: 1135010 - DNA, 23 bp, Homo sapiens
aagagctatttgtggttgttgag

SEQ ID NO: 1135011 - DNA, 21 bp, Homo sapiens
aagagctcttcggtttctgag

SEQ ID NO: 1135012 - DNA, 14 bp, Homo sapiens
aagagctgcacagc

SEQ ID NO: 1135013 - DNA, 11 bp, Homo sapiens
aagagctgctg

SEQ ID NO: 1135014 - DNA, 12 bp, Homo sapiens
aagagctgctgt

SEQ ID NO: 1135015 - DNA, 13 bp, Homo sapiens
aagagctgctgtc

SEQ ID NO: 1135016 - DNA, 11 bp, Homo sapiens
aagagctgtct

SEQ ID NO: 1135017 - DNA, 16 bp, Homo sapiens
aagagctgtctgactg

SEQ ID NO: 1135018 - DNA, 18 bp, Homo sapiens
aagagctgtcttcccctg

SEQ ID NO: 1135019 - DNA, 16 bp, Homo sapiens
aagagcttaacagtgt

SEQ ID NO: 1135020 - DNA, 14 bp, Homo sapiens
aagagcttaagaac

SEQ ID NO: 1135021 - DNA, 21 bp, Homo sapiens
aagagcttgtgtcctgtcctt

SEQ ID NO: 1135022 - DNA, 17 bp, Homo sapiens
aagaggaaaggcgcccc

SEQ ID NO: 1135023 - DNA, 18 bp, Homo sapiens
aagaggaagaaattcagg

SEQ ID NO: 1135024 - DNA, 19 bp, Homo sapiens
aagaggaagaaattcaggt

SEQ ID NO: 1135025 - DNA, 14 bp, Homo sapiens
aagaggaagcaaat

SEQ ID NO: 1135026 - DNA, 22 bp, Homo sapiens
aagaggaatctgtttctctgct

SEQ ID NO: 1135027 - DNA, 24 bp, Homo sapiens
aagaggaatctgtttctctgctgt

SEQ ID NO: 1135028 - DNA, 12 bp, Homo sapiens
aagaggacacaa

SEQ ID NO: 1135029 - DNA, 19 bp, Homo sapiens
aagaggactgtgtgagagg

SEQ ID NO: 1135030 - DNA, 18 bp, Homo sapiens
aagaggagaaggaaaaca

SEQ ID NO: 1135031 - DNA, 14 bp, Homo sapiens
aagaggagaccctg

SEQ ID NO: 1135032 - DNA, 15 bp, Homo sapiens
aagaggagaccctgg

SEQ ID NO: 1135033 - DNA, 16 bp, Homo sapiens
aagaggaggaggtggg

SEQ ID NO: 1135034 - DNA, 17 bp, Homo sapiens
aagaggaggggaagagg

SEQ ID NO: 1135035 - DNA, 21 bp, Homo sapiens
aagaggaggggaagaggcctg

SEQ ID NO: 1135036 - DNA, 21 bp, Homo sapiens
aagaggagtttcgaggtagag

SEQ ID NO: 1135037 - DNA, 19 bp, Homo sapiens
aagaggatgagcagaggga

SEQ ID NO: 1135038 - DNA, 22 bp, Homo sapiens
aagaggatgagcagagggagga

SEQ ID NO: 1135039 - DNA, 19 bp, Homo sapiens
aagaggcaagctgaaattt

SEQ ID NO: 1135040 - DNA, 13 bp, Homo sapiens
aagaggcagagtt

SEQ ID NO: 1135041 - DNA, 23 bp, Homo sapiens
aagaggccacttagggaaagatg

SEQ ID NO: 1135042 - DNA, 11 bp, Homo sapiens
aagaggcccac

SEQ ID NO: 1135043 - DNA, 23 bp, Homo sapiens
aagaggcccactagagggcccat

SEQ ID NO: 1135044 - DNA, 14 bp, Homo sapiens
aagaggcgggccag

SEQ ID NO: 1135045 - DNA, 21 bp, Homo sapiens
aagaggcgggccagccaggcg

SEQ ID NO: 1135046 - DNA, 22 bp, Homo sapiens
aagaggcgggccagccaggcgg

SEQ ID NO: 1135047 - DNA, 16 bp, Homo sapiens
aagaggctctggacag

SEQ ID NO: 1135048 - DNA, 14 bp, Homo sapiens
aagaggctgaggca

SEQ ID NO: 1135049 - DNA, 20 bp, Homo sapiens
aagaggctgaggcctggact

SEQ ID NO: 1135050 - DNA, 17 bp, Homo sapiens
aagaggctgcccctctc

SEQ ID NO: 1135051 - DNA, 21 bp, Homo sapiens
aagaggctggttttggcatct

SEQ ID NO: 1135052 - DNA, 14 bp, Homo sapiens
aagaggctgtgtgg

SEQ ID NO: 1135053 - DNA, 15 bp, Homo sapiens
aagagggaaaaagag

SEQ ID NO: 1135054 - DNA, 16 bp, Homo sapiens
aagagggaaaaagagc

SEQ ID NO: 1135055 - DNA, 19 bp, Homo sapiens
aagagggaaggtgaccgcc

SEQ ID NO: 1135056 - DNA, 20 bp, Homo sapiens
aagagggaggggacagaggc

SEQ ID NO: 1135057 - DNA, 23 bp, Homo sapiens
aagagggaggggacagaggccct

SEQ ID NO: 1135058 - DNA, 15 bp, Homo sapiens
aagagggcccagccc

SEQ ID NO: 1135059 - DNA, 17 bp, Homo sapiens
aagagggcccagcccag

SEQ ID NO: 1135060 - DNA, 21 bp, Homo sapiens
aagagggcccagcccagagcc

SEQ ID NO: 1135061 - DNA, 16 bp, Homo sapiens
aagagggctgagctga

SEQ ID NO: 1135062 - DNA, 19 bp, Homo sapiens
aagaggggaggggcctagg

SEQ ID NO: 1135063 - DNA, 16 bp, Homo sapiens
aagaggggcagccctt

SEQ ID NO: 1135064 - DNA, 14 bp, Homo sapiens
aagaggggcatact

SEQ ID NO: 1135065 - DNA, 13 bp, Homo sapiens
aagaggggcgctg

SEQ ID NO: 1135066 - DNA, 18 bp, Homo sapiens
aagaggggcgctgtcctg

SEQ ID NO: 1135067 - DNA, 18 bp, Homo sapiens
aagaggggcgggctcaga

SEQ ID NO: 1135068 - DNA, 23 bp, Homo sapiens
aagaggggcgggctcagagcttt

SEQ ID NO: 1135069 - DNA, 16 bp, Homo sapiens
aagaggggctggggca

SEQ ID NO: 1135070 - DNA, 23 bp, Homo sapiens
aagagggggctctgcccacctgg

SEQ ID NO: 1135071 - DNA, 19 bp, Homo sapiens
aagaggggtgcagaggctg

SEQ ID NO: 1135072 - DNA, 22 bp, Homo sapiens
aagaggggtgcagaggctgtgg

SEQ ID NO: 1135073 - DNA, 14 bp, Homo sapiens
aagaggggtggaga

SEQ ID NO: 1135074 - DNA, 19 bp, Homo sapiens
aagagggtcccagggctgc

SEQ ID NO: 1135075 - DNA, 13 bp, Homo sapiens
aagaggtctgagc

SEQ ID NO: 1135076 - DNA, 17 bp, Homo sapiens
aagaggtgaacattaaa

SEQ ID NO: 1135077 - DNA, 16 bp, Homo sapiens
aagaggtgtcatgctt

SEQ ID NO: 1135078 - DNA, 13 bp, Homo sapiens
aagaggtgttatt

SEQ ID NO: 1135079 - DNA, 13 bp, Homo sapiens
aagagtaacttta

SEQ ID NO: 1135080 - DNA, 13 bp, Homo sapiens
aagagtaatcaat

SEQ ID NO: 1135081 - DNA, 19 bp, Homo sapiens
aagagtactgggagaatca

SEQ ID NO: 1135082 - DNA, 22 bp, Homo sapiens
aagagtagttgatgttgcattt

SEQ ID NO: 1135083 - DNA, 23 bp, Homo sapiens
aagagtagttgatgttgcatttt

SEQ ID NO: 1135084 - DNA, 14 bp, Homo sapiens
aagagtatgtagtg

SEQ ID NO: 1135085 - DNA, 17 bp, Homo sapiens
aagagtccaactcactt

SEQ ID NO: 1135086 - DNA, 17 bp, Homo sapiens
aagagtccggatttcta

SEQ ID NO: 1135087 - DNA, 13 bp, Homo sapiens
aagagtctccagt

SEQ ID NO: 1135088 - DNA, 21 bp, Homo sapiens
aagagtgacttattttgtctt

SEQ ID NO: 1135089 - DNA, 21 bp, Homo sapiens
aagagtgagactccacctcaa

SEQ ID NO: 1135090 - DNA, 12 bp, Homo sapiens
aagagtggagga

SEQ ID NO: 1135091 - DNA, 16 bp, Homo sapiens
aagagtggaggaggag

SEQ ID NO: 1135092 - DNA, 19 bp, Homo sapiens
aagagtggcatataatttt

SEQ ID NO: 1135093 - DNA, 16 bp, Homo sapiens
aagagtgggctgcatc

SEQ ID NO: 1135094 - DNA, 24 bp, Homo sapiens
aagagtggggggaggaagcagagg

SEQ ID NO: 1135095 - DNA, 19 bp, Homo sapiens
aagagttattcaaatgaag

SEQ ID NO: 1135096 - DNA, 20 bp, Homo sapiens
aagagttctatggagacttt

SEQ ID NO: 1135097 - DNA, 23 bp, Homo sapiens
aagagttgctttgccagagcagg

SEQ ID NO: 1135098 - DNA, 18 bp, Homo sapiens
aagagtttaaagagaaaa

SEQ ID NO: 1135099 - DNA, 18 bp, Homo sapiens
aagagtttgttctgttct

SEQ ID NO: 1135100 - DNA, 22 bp, Homo sapiens
aagataaaaataataataaagt

SEQ ID NO: 1135101 - DNA, 16 bp, Homo sapiens
aagataaacacaaaat

SEQ ID NO: 1135102 - DNA, 22 bp, Homo sapiens
aagataaaccgtttttaacaca

SEQ ID NO: 1135103 - DNA, 17 bp, Homo sapiens
aagataaagatgatcta

SEQ ID NO: 1135104 - DNA, 13 bp, Homo sapiens
aagataaatgtgc

SEQ ID NO: 1135105 - DNA, 19 bp, Homo sapiens
aagcagaacaaatgtgttt

SEQ ID NO: 1135106 - DNA, 21 bp, Homo sapiens
aagcagaactgaagccacttg

SEQ ID NO: 1135107 - DNA, 14 bp, Homo sapiens
aagcagaatgtgat

SEQ ID NO: 1135108 - DNA, 14 bp, Homo sapiens
aagcagacagctcc

SEQ ID NO: 1135109 - DNA, 20 bp, Homo sapiens
aagcagactccagcccctgg

SEQ ID NO: 1135110 - DNA, 16 bp, Homo sapiens
aagcagacttttcaga

SEQ ID NO: 1135111 - DNA, 24 bp, Homo sapiens
aagcagacttttcagaagatggtg

SEQ ID NO: 1135112 - DNA, 15 bp, Homo sapiens
aagcagagccaaggc

SEQ ID NO: 1135113 - DNA, 15 bp, Homo sapiens
aagcagagcctcctg

SEQ ID NO: 1135114 - DNA, 14 bp, Homo sapiens
aagcagaggctttg

SEQ ID NO: 1135115 - DNA, 15 bp, Homo sapiens
aagcagagtggactg

SEQ ID NO: 1135116 - DNA, 21 bp, Homo sapiens
aagcagagtggactgcattta

SEQ ID NO: 1135117 - DNA, 14 bp, Homo sapiens
aagcagattacctc

SEQ ID NO: 1135118 - DNA, 16 bp, Homo sapiens
aagcagattacctctt

SEQ ID NO: 1135119 - DNA, 19 bp, Homo sapiens
aagcagatttctgcttcct

SEQ ID NO: 1135120 - DNA, 18 bp, Homo sapiens
aagcagcagctaggactg

SEQ ID NO: 1135121 - DNA, 14 bp, Homo sapiens
aagcagcatggaaa

SEQ ID NO: 1135122 - DNA, 15 bp, Homo sapiens
aagcagcatggaaaa

SEQ ID NO: 1135123 - DNA, 16 bp, Homo sapiens
aagcagcattctggag

SEQ ID NO: 1135124 - DNA, 10 bp, Homo sapiens
aagcagccag

SEQ ID NO: 1135125 - DNA, 17 bp, Homo sapiens
aagcagccagccagtct

SEQ ID NO: 1135126 - DNA, 15 bp, Homo sapiens
aagcagccaggaggg

SEQ ID NO: 1135127 - DNA, 20 bp, Homo sapiens
aagcagcccctcgaggccta

SEQ ID NO: 1135128 - DNA, 14 bp, Homo sapiens
aagcagccctctgc

SEQ ID NO: 1135129 - DNA, 17 bp, Homo sapiens
aagcagcctctccccag

SEQ ID NO: 1135130 - DNA, 19 bp, Homo sapiens
aagcagcgaccgccccctc

SEQ ID NO: 1135131 - DNA, 22 bp, Homo sapiens
aagcagcggtcagcagacaagg

SEQ ID NO: 1135132 - DNA, 22 bp, Homo sapiens
aagcagcgtttctatgacacat

SEQ ID NO: 1135133 - DNA, 16 bp, Homo sapiens
aagcagctaaattttc

SEQ ID NO: 1135134 - DNA, 19 bp, Homo sapiens
aagcagctgaagaaaaaat

SEQ ID NO: 1135135 - DNA, 14 bp, Homo sapiens
aagcaggaattatg

SEQ ID NO: 1135136 - DNA, 15 bp, Homo sapiens
aagcaggaattatgt

SEQ ID NO: 1135137 - DNA, 14 bp, Homo sapiens
aagcaggacagaca

SEQ ID NO: 1135138 - DNA, 23 bp, Homo sapiens
aagcaggactttgaggcaagtgt

SEQ ID NO: 1135139 - DNA, 18 bp, Homo sapiens
aagcagggaaagctccac

SEQ ID NO: 1135140 - DNA, 20 bp, Homo sapiens
aagcagggaaagctccacgg

SEQ ID NO: 1135141 - DNA, 22 bp, Homo sapiens
aagcagggacaccccccgcccc

SEQ ID NO: 1135142 - DNA, 17 bp, Homo sapiens
aagcaggtgctacaaca

SEQ ID NO: 1135143 - DNA, 19 bp, Homo sapiens
aagcaggtggatctatttc

SEQ ID NO: 1135144 - DNA, 15 bp, Homo sapiens
aagcaggttcttgat

SEQ ID NO: 1135145 - DNA, 17 bp, Homo sapiens
aagcaggtttgttttca

SEQ ID NO: 1135146 - DNA, 18 bp, Homo sapiens
aagcagtatataataact

SEQ ID NO: 1135147 - DNA, 15 bp, Homo sapiens
aagcagtattttggt

SEQ ID NO: 1135148 - DNA, 17 bp, Homo sapiens
aagcagtatttttcttg

SEQ ID NO: 1135149 - DNA, 15 bp, Homo sapiens
aagcagtcccattca

SEQ ID NO: 1135150 - DNA, 18 bp, Homo sapiens
aagcagtcgtgcctgtgt

SEQ ID NO: 1135151 - DNA, 19 bp, Homo sapiens
aagcagtctaccctgtcct

SEQ ID NO: 1135152 - DNA, 14 bp, Homo sapiens
aagcagtgcctcga

SEQ ID NO: 1135153 - DNA, 20 bp, Homo sapiens
aagcagtgcctcgaggcacc

SEQ ID NO: 1135154 - DNA, 18 bp, Homo sapiens
aagcagtgccttccataa

SEQ ID NO: 1135155 - DNA, 17 bp, Homo sapiens
aagcagtggatacgtgt

SEQ ID NO: 1135156 - DNA, 16 bp, Homo sapiens
aagcagttaatttata

SEQ ID NO: 1135157 - DNA, 22 bp, Homo sapiens
aagcagttatggtgatgactta

SEQ ID NO: 1135158 - DNA, 19 bp, Homo sapiens
aagcagttctcccaccagc

SEQ ID NO: 1135159 - DNA, 17 bp, Homo sapiens
aagcagttggggccctc

SEQ ID NO: 1135160 - DNA, 22 bp, Homo sapiens
aagcataaaaacattttaaaaa

SEQ ID NO: 1135161 - DNA, 15 bp, Homo sapiens
aagcataatttgttt

SEQ ID NO: 1135162 - DNA, 16 bp, Homo sapiens
aagcataatttgttta

SEQ ID NO: 1135163 - DNA, 20 bp, Homo sapiens
aagcataatttgtttaaaat

SEQ ID NO: 1135164 - DNA, 17 bp, Homo sapiens
aagcatactttgtaaat

SEQ ID NO: 1135165 - DNA, 21 bp, Homo sapiens
aagcatagctacaatttgttt

SEQ ID NO: 1135166 - DNA, 18 bp, Homo sapiens
aagcatatcgtaaagctg

SEQ ID NO: 1135167 - DNA, 13 bp, Homo sapiens
aagcatattggaa

SEQ ID NO: 1135168 - DNA, 14 bp, Homo sapiens
aagcatattggaaa

SEQ ID NO: 1135169 - DNA, 23 bp, Homo sapiens
aagcatattggaaagtgatttta

SEQ ID NO: 1135170 - DNA, 13 bp, Homo sapiens
aagcatatttgag

SEQ ID NO: 1135171 - DNA, 16 bp, Homo sapiens
aagcatcactgccttg

SEQ ID NO: 1135172 - DNA, 18 bp, Homo sapiens
aagcatcagggggaagaa

SEQ ID NO: 1135173 - DNA, 23 bp, Homo sapiens
aagcatcagggggaagaagcaga

SEQ ID NO: 1135174 - DNA, 22 bp, Homo sapiens
aagcatcattatttgcagagac

SEQ ID NO: 1135175 - DNA, 17 bp, Homo sapiens
aagcatccatgtgtgga

SEQ ID NO: 1135176 - DNA, 19 bp, Homo sapiens
aagcatccatgtgtggact

SEQ ID NO: 1135177 - DNA, 21 bp, Homo sapiens
aagcatccatgtgtggactca

SEQ ID NO: 1135178 - DNA, 16 bp, Homo sapiens
aagcatcctcagaagc

SEQ ID NO: 1135179 - DNA, 17 bp, Homo sapiens
aagcatctggctctaat

SEQ ID NO: 1135180 - DNA, 13 bp, Homo sapiens
aagcatgaaaaag

SEQ ID NO: 1135181 - DNA, 12 bp, Homo sapiens
aagcatgaaatg

SEQ ID NO: 1135182 - DNA, 20 bp, Homo sapiens
aagcatgaataacatttaaa

SEQ ID NO: 1135183 - DNA, 19 bp, Homo sapiens
aagcatgatcttgttactg

SEQ ID NO: 1135184 - DNA, 18 bp, Homo sapiens
aagcatgatgggaaaata

SEQ ID NO: 1135185 - DNA, 22 bp, Homo sapiens
aagcatgatgggaaaatatttc

SEQ ID NO: 1135186 - DNA, 16 bp, Homo sapiens
aagcatggattttccc

SEQ ID NO: 1135187 - DNA, 15 bp, Homo sapiens
aagcatggctatttt

SEQ ID NO: 1135188 - DNA, 15 bp, Homo sapiens
aagcatggctgtctg

SEQ ID NO: 1135189 - DNA, 17 bp, Homo sapiens
aagcatggctgtctgca

SEQ ID NO: 1135190 - DNA, 17 bp, Homo sapiens
aagcatgggattattag

SEQ ID NO: 1135191 - DNA, 15 bp, Homo sapiens
aagcatggtataatt

SEQ ID NO: 1135192 - DNA, 17 bp, Homo sapiens
aagcatggtataattga

SEQ ID NO: 1135193 - DNA, 21 bp, Homo sapiens
aagcatggtataattgaaact

SEQ ID NO: 1135194 - DNA, 21 bp, Homo sapiens
aagcatgtctctctgccaaga

SEQ ID NO: 1135195 - DNA, 15 bp, Homo sapiens
aagcatgtctctgct

SEQ ID NO: 1135196 - DNA, 19 bp, Homo sapiens
aagcatgtggcatgttcat

SEQ ID NO: 1135197 - DNA, 14 bp, Homo sapiens
aagcatgtttcatg

SEQ ID NO: 1135198 - DNA, 16 bp, Homo sapiens
aagcatgtttcatgtt

SEQ ID NO: 1135199 - DNA, 12 bp, Homo sapiens
aagcattcacaa

SEQ ID NO: 1135200 - DNA, 15 bp, Homo sapiens
aagcattcagaagaa

SEQ ID NO: 1135201 - DNA, 15 bp, Homo sapiens
aagcattcagagagc

SEQ ID NO: 1135202 - DNA, 18 bp, Homo sapiens
aagcattctgagctgggc

SEQ ID NO: 1135203 - DNA, 12 bp, Homo sapiens
aagcattgaatt

SEQ ID NO: 1135204 - DNA, 15 bp, Homo sapiens
aagcattgtctctct

SEQ ID NO: 1135205 - DNA, 14 bp, Homo sapiens
aagcattgtttgct

SEQ ID NO: 1135206 - DNA, 21 bp, Homo sapiens
aagcattgtttgcttattgtt

SEQ ID NO: 1135207 - DNA, 22 bp, Homo sapiens
aagcatttaacccccctgtaca

SEQ ID NO: 1135208 - DNA, 14 bp, Homo sapiens
aaggtctttgtaaa

SEQ ID NO: 1135209 - DNA, 19 bp, Homo sapiens
aaggtgaaaggcatgtctt

SEQ ID NO: 1135210 - DNA, 11 bp, Homo sapiens
aaggtgaagga

SEQ ID NO: 1135211 - DNA, 16 bp, Homo sapiens
aaggtgaaggaatata

SEQ ID NO: 1135212 - DNA, 17 bp, Homo sapiens
aaggtgactgtgtgtgt

SEQ ID NO: 1135213 - DNA, 17 bp, Homo sapiens
aaggtgagaattaagtt

SEQ ID NO: 1135214 - DNA, 17 bp, Homo sapiens
aaggtgagcataaatca

SEQ ID NO: 1135215 - DNA, 16 bp, Homo sapiens
aaggtgagtgtgactt

SEQ ID NO: 1135216 - DNA, 22 bp, Homo sapiens
aaggtgagtttgagctgccttc

SEQ ID NO: 1135217 - DNA, 23 bp, Homo sapiens
aaggtgatatataatttcctcac

SEQ ID NO: 1135218 - DNA, 13 bp, Homo sapiens
aaggtgatgttgt

SEQ ID NO: 1135219 - DNA, 14 bp, Homo sapiens
aaggtgcagttccc

SEQ ID NO: 1135220 - DNA, 18 bp, Homo sapiens
aaggtgcatatagaaaac

SEQ ID NO: 1135221 - DNA, 21 bp, Homo sapiens
aaggtgcatatagaaaacaaa

SEQ ID NO: 1135222 - DNA, 18 bp, Homo sapiens
aaggtgcatctttccctg

SEQ ID NO: 1135223 - DNA, 13 bp, Homo sapiens
aaggtgccacttt

SEQ ID NO: 1135224 - DNA, 15 bp, Homo sapiens
aaggtgccagaagga

SEQ ID NO: 1135225 - DNA, 18 bp, Homo sapiens
aaggtgccagaaggaagg

SEQ ID NO: 1135226 - DNA, 14 bp, Homo sapiens
aaggtgcctcagtt

SEQ ID NO: 1135227 - DNA, 20 bp, Homo sapiens
aaggtgcctcagttttcctt

SEQ ID NO: 1135228 - DNA, 21 bp, Homo sapiens
aaggtgcctcagttttccttc

SEQ ID NO: 1135229 - DNA, 13 bp, Homo sapiens
aaggtgcctggcc

SEQ ID NO: 1135230 - DNA, 14 bp, Homo sapiens
aaggtgcctggcca

SEQ ID NO: 1135231 - DNA, 13 bp, Homo sapiens
aaggtgctgagct

SEQ ID NO: 1135232 - DNA, 19 bp, Homo sapiens
aaggtgctggtgggtctga

SEQ ID NO: 1135233 - DNA, 21 bp, Homo sapiens
aaggtggagagggagatgtgt

SEQ ID NO: 1135234 - DNA, 23 bp, Homo sapiens
aaggtggagagggagatgtgtga

SEQ ID NO: 1135235 - DNA, 18 bp, Homo sapiens
aaggtggagtttctctgt

SEQ ID NO: 1135236 - DNA, 17 bp, Homo sapiens
aaggtggcctctgcctg

SEQ ID NO: 1135237 - DNA, 12 bp, Homo sapiens
aaggtgggcgga

SEQ ID NO: 1135238 - DNA, 16 bp, Homo sapiens
aaggtgggctgagccc

SEQ ID NO: 1135239 - DNA, 20 bp, Homo sapiens
aaggtggggacctgggggga

SEQ ID NO: 1135240 - DNA, 16 bp, Homo sapiens
aaggtggggccctgcc

SEQ ID NO: 1135241 - DNA, 22 bp, Homo sapiens
aaggtgggtccaggaaggcagc

SEQ ID NO: 1135242 - DNA, 21 bp, Homo sapiens
aaggtggtatggttgtataca

SEQ ID NO: 1135243 - DNA, 22 bp, Homo sapiens
aaggtggtatgtaatttatgca

SEQ ID NO: 1135244 - DNA, 23 bp, Homo sapiens
aaggtggtggggctgccggatct

SEQ ID NO: 1135245 - DNA, 16 bp, Homo sapiens
aaggtgtagaaaaggt

SEQ ID NO: 1135246 - DNA, 21 bp, Homo sapiens
aaggtgtatttaaactatctt

SEQ ID NO: 1135247 - DNA, 13 bp, Homo sapiens
aaggtgtccaggg

SEQ ID NO: 1135248 - DNA, 15 bp, Homo sapiens
aaggtgtccttttcc

SEQ ID NO: 1135249 - DNA, 15 bp, Homo sapiens
aaggtgtgagactgg

SEQ ID NO: 1135250 - DNA, 20 bp, Homo sapiens
aaggtgtgtccttgaactga

SEQ ID NO: 1135251 - DNA, 23 bp, Homo sapiens
aaggtgtgtccttgaactgaggc

SEQ ID NO: 1135252 - DNA, 15 bp, Homo sapiens
aaggttaataaagta

SEQ ID NO: 1135253 - DNA, 15 bp, Homo sapiens
aaggttataattttt

SEQ ID NO: 1135254 - DNA, 14 bp, Homo sapiens
aaggttatgaaaca

SEQ ID NO: 1135255 - DNA, 16 bp, Homo sapiens
aaggttatgaaacata

SEQ ID NO: 1135256 - DNA, 17 bp, Homo sapiens
aaggttatgaaacatat

SEQ ID NO: 1135257 - DNA, 17 bp, Homo sapiens
aaggttccagaggccct

SEQ ID NO: 1135258 - DNA, 15 bp, Homo sapiens
aaggttctcatttct

SEQ ID NO: 1135259 - DNA, 17 bp, Homo sapiens
aaggttctcatttctca

SEQ ID NO: 1135260 - DNA, 18 bp, Homo sapiens
aaggttggagcccagggc

SEQ ID NO: 1135261 - DNA, 16 bp, Homo sapiens
aaggttgggcagggtg

SEQ ID NO: 1135262 - DNA, 18 bp, Homo sapiens
aaggtttaaaactagtta

SEQ ID NO: 1135263 - DNA, 21 bp, Homo sapiens
aaggtttacaatttacaaagt

SEQ ID NO: 1135264 - DNA, 19 bp, Homo sapiens
aaggtttaggctggtggcc

SEQ ID NO: 1135265 - DNA, 17 bp, Homo sapiens
aaggtttatttttctgt

SEQ ID NO: 1135266 - DNA, 13 bp, Homo sapiens
aaggtttcaatgc

SEQ ID NO: 1135267 - DNA, 12 bp, Homo sapiens
aaggtttcagat

SEQ ID NO: 1135268 - DNA, 16 bp, Homo sapiens
aaggtttcagatgagg

SEQ ID NO: 1135269 - DNA, 21 bp, Homo sapiens
aaggtttcgtttctgtataca

SEQ ID NO: 1135270 - DNA, 16 bp, Homo sapiens
aaggtttctggagcag

SEQ ID NO: 1135271 - DNA, 18 bp, Homo sapiens
aaggtttggtccagcctg

SEQ ID NO: 1135272 - DNA, 13 bp, Homo sapiens
aaggttttctcca

SEQ ID NO: 1135273 - DNA, 17 bp, Homo sapiens
aaggttttgttgtgttc

SEQ ID NO: 1135274 - DNA, 11 bp, Homo sapiens
aaggttttttt

SEQ ID NO: 1135275 - DNA, 17 bp, Homo sapiens
aaggttttttttcagtt

SEQ ID NO: 1135276 - DNA, 17 bp, Homo sapiens
aaggttttttttttaag

SEQ ID NO: 1135277 - DNA, 14 bp, Homo sapiens
aagtaaaaaaacaa

SEQ ID NO: 1135278 - DNA, 11 bp, Homo sapiens
aagtaaaaaca

SEQ ID NO: 1135279 - DNA, 22 bp, Homo sapiens
aagtaaaaattgaactgtaaac

SEQ ID NO: 1135280 - DNA, 23 bp, Homo sapiens
aagtaaaaattgaactgtaaact

SEQ ID NO: 1135281 - DNA, 19 bp, Homo sapiens
aagtaaaagatcaggttat

SEQ ID NO: 1135282 - DNA, 20 bp, Homo sapiens
aagtaaaagtctacctgtgt

SEQ ID NO: 1135283 - DNA, 14 bp, Homo sapiens
aagtaaaatgtctt

SEQ ID NO: 1135284 - DNA, 13 bp, Homo sapiens
aagtaaacagatt

SEQ ID NO: 1135285 - DNA, 20 bp, Homo sapiens
aagtaaacctagtaaaacct

SEQ ID NO: 1135286 - DNA, 20 bp, Homo sapiens
aagtaaactttttgttctgg

SEQ ID NO: 1135287 - DNA, 16 bp, Homo sapiens
aagtaaagtgatgttt

SEQ ID NO: 1135288 - DNA, 18 bp, Homo sapiens
aagtaaatacatgcatat

SEQ ID NO: 1135289 - DNA, 12 bp, Homo sapiens
aagtaacaaaaa

SEQ ID NO: 1135290 - DNA, 13 bp, Homo sapiens
aagtaacaaaaat

SEQ ID NO: 1135291 - DNA, 15 bp, Homo sapiens
aagtaacaatatgta

SEQ ID NO: 1135292 - DNA, 21 bp, Homo sapiens
aagtaacactttaaaaccagt

SEQ ID NO: 1135293 - DNA, 18 bp, Homo sapiens
aagtaacatgcatacttt

SEQ ID NO: 1135294 - DNA, 16 bp, Homo sapiens
aagtaactcatttgtt

SEQ ID NO: 1135295 - DNA, 11 bp, Homo sapiens
aagtaagaaaa

SEQ ID NO: 1135296 - DNA, 14 bp, Homo sapiens
aagtaagaaaatat

SEQ ID NO: 1135297 - DNA, 18 bp, Homo sapiens
aagtaagaaagtgaagca

SEQ ID NO: 1135298 - DNA, 20 bp, Homo sapiens
aagtaagaaagtgaagcaaa

SEQ ID NO: 1135299 - DNA, 15 bp, Homo sapiens
aagtaagaagacatg

SEQ ID NO: 1135300 - DNA, 16 bp, Homo sapiens
aagtaagaatggccaa

SEQ ID NO: 1135301 - DNA, 23 bp, Homo sapiens
aagtaagactttctgaaaacact

SEQ ID NO: 1135302 - DNA, 20 bp, Homo sapiens
aagtaagagtactgggagaa

SEQ ID NO: 1135303 - DNA, 15 bp, Homo sapiens
aagtaaggtgcagtt

SEQ ID NO: 1135304 - DNA, 19 bp, Homo sapiens
aagtaagttaataatgtat

SEQ ID NO: 1135305 - DNA, 14 bp, Homo sapiens
aagtaataaaaaga

SEQ ID NO: 1135306 - DNA, 20 bp, Homo sapiens
aagtaataaaattcaacaaa

SEQ ID NO: 1135307 - DNA, 16 bp, Homo sapiens
aagtaataatgtgcaa

SEQ ID NO: 1135308 - DNA, 15 bp, Homo sapiens
aagtaataatttgta

SEQ ID NO: 1135309 - DNA, 17 bp, Homo sapiens
aagtaatatgcacacat

SEQ ID NO: 1135310 - DNA, 15 bp, Homo sapiens
aagtaatattattac

SEQ ID NO: 1135311 - DNA, 13 bp, Homo sapiens
aagtaatcttttt

SEQ ID NO: 1135312 - DNA, 17 bp, Homo sapiens
aagtaatgacttagaaa

SEQ ID NO: 1135313 - DNA, 12 bp, Homo sapiens
aagtaatgatga

SEQ ID NO: 1135314 - DNA, 21 bp, Homo sapiens
aagtaatgatgaaatctttct

SEQ ID NO: 1135315 - DNA, 15 bp, Homo sapiens
aagtaattgcctaca

SEQ ID NO: 1135316 - DNA, 17 bp, Homo sapiens
aagtaattttgtcacat

SEQ ID NO: 1135317 - DNA, 12 bp, Homo sapiens
aagtacaaaatt

SEQ ID NO: 1135318 - DNA, 13 bp, Homo sapiens
aagtacaaaattg

SEQ ID NO: 1135319 - DNA, 15 bp, Homo sapiens
aagtacaaaattgcc

SEQ ID NO: 1135320 - DNA, 13 bp, Homo sapiens
aagtacaaacatg

SEQ ID NO: 1135321 - DNA, 15 bp, Homo sapiens
aagtacaaacatgaa

SEQ ID NO: 1135322 - DNA, 16 bp, Homo sapiens
aagtacaaacatgaaa

SEQ ID NO: 1135323 - DNA, 17 bp, Homo sapiens
aagtacacaataagcaa

SEQ ID NO: 1135324 - DNA, 19 bp, Homo sapiens
aagtacactctgctgtttg

SEQ ID NO: 1135325 - DNA, 20 bp, Homo sapiens
aagtacactgtttcaaactt

SEQ ID NO: 1135326 - DNA, 22 bp, Homo sapiens
aagtacagaatagaatacattg

SEQ ID NO: 1135327 - DNA, 14 bp, Homo sapiens
aagtacagaatttg

SEQ ID NO: 1135328 - DNA, 13 bp, Homo sapiens
aagtacattgctt

SEQ ID NO: 1135329 - DNA, 24 bp, Homo sapiens
aagtaccaatgctgttgtaaacaa

SEQ ID NO: 1135330 - DNA, 18 bp, Homo sapiens
aagtaccaatgggaagca

SEQ ID NO: 1135331 - DNA, 19 bp, Homo sapiens
aagtaccaatgggaagcag

SEQ ID NO: 1135332 - DNA, 19 bp, Homo sapiens
aagtactagatgcatcact

SEQ ID NO: 1135333 - DNA, 15 bp, Homo sapiens
aagtactatgtatca

SEQ ID NO: 1135334 - DNA, 23 bp, Homo sapiens
aaggccacgtatagtcctagctg

SEQ ID NO: 1135335 - DNA, 24 bp, Homo sapiens
aaggccacgtatagtcctagctga

SEQ ID NO: 1135336 - DNA, 20 bp, Homo sapiens
aaggccagagtggcctggcc

SEQ ID NO: 1135337 - DNA, 21 bp, Homo sapiens
aaggccagagtggcctggcca

SEQ ID NO: 1135338 - DNA, 22 bp, Homo sapiens
aaggccagagtggcctggccag

SEQ ID NO: 1135339 - DNA, 21 bp, Homo sapiens
aaggccagtccccatttctgc

SEQ ID NO: 1135340 - DNA, 14 bp, Homo sapiens
aaggcccatgcccc

SEQ ID NO: 1135341 - DNA, 16 bp, Homo sapiens
aaggcccatgccccct

SEQ ID NO: 1135342 - DNA, 17 bp, Homo sapiens
aaggcccatgccccctt

SEQ ID NO: 1135343 - DNA, 18 bp, Homo sapiens
aaggccccaaggtttaca

SEQ ID NO: 1135344 - DNA, 15 bp, Homo sapiens
aaggccccagagaga

SEQ ID NO: 1135345 - DNA, 17 bp, Homo sapiens
aaggccccagggacaga

SEQ ID NO: 1135346 - DNA, 20 bp, Homo sapiens
aaggcccccaaacatagccc

SEQ ID NO: 1135347 - DNA, 14 bp, Homo sapiens
aaggcccctgcaat

SEQ ID NO: 1135348 - DNA, 14 bp, Homo sapiens
aaggccctcggagc

SEQ ID NO: 1135349 - DNA, 13 bp, Homo sapiens
aaggccctgctga

SEQ ID NO: 1135350 - DNA, 19 bp, Homo sapiens
aaggccgaagctctggctg

SEQ ID NO: 1135351 - DNA, 13 bp, Homo sapiens
aaggccgagggcc

SEQ ID NO: 1135352 - DNA, 20 bp, Homo sapiens
aaggccgagggccaggcaga

SEQ ID NO: 1135353 - DNA, 22 bp, Homo sapiens
aaggccgctgttcacccacagg

SEQ ID NO: 1135354 - DNA, 19 bp, Homo sapiens
aaggcctccctagccagca

SEQ ID NO: 1135355 - DNA, 15 bp, Homo sapiens
aaggcctcctggctg

SEQ ID NO: 1135356 - DNA, 17 bp, Homo sapiens
aaggcctcggcagaact

SEQ ID NO: 1135357 - DNA, 14 bp, Homo sapiens
aaggcctctggact

SEQ ID NO: 1135358 - DNA, 13 bp, Homo sapiens
aaggcctcttgta

SEQ ID NO: 1135359 - DNA, 13 bp, Homo sapiens
aaggcctgccctc

SEQ ID NO: 1135360 - DNA, 15 bp, Homo sapiens
aaggccttaatatgt

SEQ ID NO: 1135361 - DNA, 16 bp, Homo sapiens
aaggccttccctgtca

SEQ ID NO: 1135362 - DNA, 19 bp, Homo sapiens
aaggccttggtggagcagc

SEQ ID NO: 1135363 - DNA, 20 bp, Homo sapiens
aaggcctttagtaatgaatg

SEQ ID NO: 1135364 - DNA, 16 bp, Homo sapiens
aaggcctttcttctgt

SEQ ID NO: 1135365 - DNA, 23 bp, Homo sapiens
aaggccttttgcccgttgaggta

SEQ ID NO: 1135366 - DNA, 13 bp, Homo sapiens
aaggcgcccccgc

SEQ ID NO: 1135367 - DNA, 15 bp, Homo sapiens
aaggcgcccccgccc

SEQ ID NO: 1135368 - DNA, 21 bp, Homo sapiens
aaggcgcccccgccccaggct

SEQ ID NO: 1135369 - DNA, 12 bp, Homo sapiens
aaggcgctgaga

SEQ ID NO: 1135370 - DNA, 21 bp, Homo sapiens
aaggcggggtattcccactca

SEQ ID NO: 1135371 - DNA, 13 bp, Homo sapiens
aaggctacctttg

SEQ ID NO: 1135372 - DNA, 15 bp, Homo sapiens
aaggctacctttgta

SEQ ID NO: 1135373 - DNA, 18 bp, Homo sapiens
aaggctactggcattaat

SEQ ID NO: 1135374 - DNA, 15 bp, Homo sapiens
aaggctatgtgatta

SEQ ID NO: 1135375 - DNA, 16 bp, Homo sapiens
aaggctcagtctcagg

SEQ ID NO: 1135376 - DNA, 17 bp, Homo sapiens
aaggctcatttaaaaca

SEQ ID NO: 1135377 - DNA, 18 bp, Homo sapiens
aaggctcccattttcagt

SEQ ID NO: 1135378 - DNA, 15 bp, Homo sapiens
aaggctccccacccc

SEQ ID NO: 1135379 - DNA, 14 bp, Homo sapiens
aaggctctcacccc

SEQ ID NO: 1135380 - DNA, 17 bp, Homo sapiens
aaggctctcccctctcg

SEQ ID NO: 1135381 - DNA, 18 bp, Homo sapiens
aaggctctgaaagccagc

SEQ ID NO: 1135382 - DNA, 20 bp, Homo sapiens
aaggctctgtcactccaggc

SEQ ID NO: 1135383 - DNA, 23 bp, Homo sapiens
aaggctctgttatcagctgggca

SEQ ID NO: 1135384 - DNA, 18 bp, Homo sapiens
aaggctgaactcttcaga

SEQ ID NO: 1135385 - DNA, 15 bp, Homo sapiens
aaggctgaccaagag

SEQ ID NO: 1135386 - DNA, 16 bp, Homo sapiens
aaggctgaccaagaga

SEQ ID NO: 1135387 - DNA, 19 bp, Homo sapiens
aaggctgaccaagagagaa

SEQ ID NO: 1135388 - DNA, 23 bp, Homo sapiens
aaggctgcccactggagacgcct

SEQ ID NO: 1135389 - DNA, 21 bp, Homo sapiens
aaggctgctggcttcagggag

SEQ ID NO: 1135390 - DNA, 15 bp, Homo sapiens
aaggctgcttagaat

SEQ ID NO: 1135391 - DNA, 22 bp, Homo sapiens
aaggctggccagcaaggcaggt

SEQ ID NO: 1135392 - DNA, 14 bp, Homo sapiens
aaggctggggcatg

SEQ ID NO: 1135393 - DNA, 14 bp, Homo sapiens
aaggctgggggaag

SEQ ID NO: 1135394 - DNA, 16 bp, Homo sapiens
aaggctgggggaagaa

SEQ ID NO: 1135395 - DNA, 19 bp, Homo sapiens
aaggctgggggaagaagct

SEQ ID NO: 1135396 - DNA, 17 bp, Homo sapiens
aaggctgtatctatttt

SEQ ID NO: 1135397 - DNA, 21 bp, Homo sapiens
aaggctgtgctgccctgaaga

SEQ ID NO: 1135398 - DNA, 14 bp, Homo sapiens
aaggctgtgtaaga

SEQ ID NO: 1135399 - DNA, 13 bp, Homo sapiens
aaggctgttgcat

SEQ ID NO: 1135400 - DNA, 17 bp, Homo sapiens
aaggcttctctctgtgg

SEQ ID NO: 1135401 - DNA, 14 bp, Homo sapiens
aaggcttgggattt

SEQ ID NO: 1135402 - DNA, 21 bp, Homo sapiens
aaggctttaaaagtcattatt

SEQ ID NO: 1135403 - DNA, 18 bp, Homo sapiens
aaggctttaaagctgaga

SEQ ID NO: 1135404 - DNA, 20 bp, Homo sapiens
aaggctttgccatgggcctg

SEQ ID NO: 1135405 - DNA, 21 bp, Homo sapiens
aaggctttgccatgggcctgc

SEQ ID NO: 1135406 - DNA, 17 bp, Homo sapiens
aaggctttttcttccct

SEQ ID NO: 1135407 - DNA, 13 bp, Homo sapiens
aagggaaaaaaga

SEQ ID NO: 1135408 - DNA, 15 bp, Homo sapiens
aagggaaaaaagaaa

SEQ ID NO: 1135409 - DNA, 17 bp, Homo sapiens
aagggaaaaaagaaaga

SEQ ID NO: 1135410 - DNA, 16 bp, Homo sapiens
aagggaaaagtctctt

SEQ ID NO: 1135411 - DNA, 14 bp, Homo sapiens
aagggaaactggct

SEQ ID NO: 1135412 - DNA, 15 bp, Homo sapiens
aagggaaactggctg

SEQ ID NO: 1135413 - DNA, 17 bp, Homo sapiens
aagggaaagcgggcagc

SEQ ID NO: 1135414 - DNA, 20 bp, Homo sapiens
aagggaaagcgggcagcccc

SEQ ID NO: 1135415 - DNA, 13 bp, Homo sapiens
aagggaacacaaa

SEQ ID NO: 1135416 - DNA, 14 bp, Homo sapiens
aagggaacagaaag

SEQ ID NO: 1135417 - DNA, 22 bp, Homo sapiens
aagggaaggcaaaggcagagga

SEQ ID NO: 1135418 - DNA, 18 bp, Homo sapiens
aagggaaggggcctccct

SEQ ID NO: 1135419 - DNA, 22 bp, Homo sapiens
aagggaaggggcctccctccga

SEQ ID NO: 1135420 - DNA, 15 bp, Homo sapiens
aagggaagtgaggcc

SEQ ID NO: 1135421 - DNA, 12 bp, Homo sapiens
aagggaatcctc

SEQ ID NO: 1135422 - DNA, 12 bp, Homo sapiens
aagggacagcaa

SEQ ID NO: 1135423 - DNA, 19 bp, Homo sapiens
aagggacagcaagtgagca

SEQ ID NO: 1135424 - DNA, 15 bp, Homo sapiens
aagggacagcatgcc

SEQ ID NO: 1135425 - DNA, 21 bp, Homo sapiens
aagggaccaagcgaccaagga

SEQ ID NO: 1135426 - DNA, 22 bp, Homo sapiens
aagggaccaagcgaccaaggat

SEQ ID NO: 1135427 - DNA, 13 bp, Homo sapiens
aagggaccaaggc

SEQ ID NO: 1135428 - DNA, 13 bp, Homo sapiens
aagggaccccccc

SEQ ID NO: 1135429 - DNA, 15 bp, Homo sapiens
aagggaccctttgcc

SEQ ID NO: 1135430 - DNA, 13 bp, Homo sapiens
aagggactttgga

SEQ ID NO: 1135431 - DNA, 12 bp, Homo sapiens
aagggagaagaa

SEQ ID NO: 1135432 - DNA, 16 bp, Homo sapiens
aagggagaagaaaggt

SEQ ID NO: 1135433 - DNA, 21 bp, Homo sapiens
aagggagaaggaagggcagag

SEQ ID NO: 1135434 - DNA, 20 bp, Homo sapiens
aagggagaataaaattccta

SEQ ID NO: 1135435 - DNA, 13 bp, Homo sapiens
aagggagaatata

SEQ ID NO: 1135436 - DNA, 17 bp, Homo sapiens
aagggagagcggggcag

SEQ ID NO: 1135437 - DNA, 14 bp, Homo sapiens
aagggagagctgag

SEQ ID NO: 1135438 - DNA, 17 bp, Homo sapiens
aagggagaggaagagaa

SEQ ID NO: 1135439 - DNA, 22 bp, Homo sapiens
aagggagagttctttgctgccc

SEQ ID NO: 1135440 - DNA, 23 bp, Homo sapiens
aagggagagttctttgctgcccc

SEQ ID NO: 1135441 - DNA, 18 bp, Homo sapiens
aagggagctatcaggaac

SEQ ID NO: 1135442 - DNA, 15 bp, Homo sapiens
aagggaggaacacta

SEQ ID NO: 1135443 - DNA, 19 bp, Homo sapiens
aagggaggcccagccgcag

SEQ ID NO: 1135444 - DNA, 17 bp, Homo sapiens
aagggagggaagggcca

SEQ ID NO: 1135445 - DNA, 22 bp, Homo sapiens
aagggagggaagggccaccctg

SEQ ID NO: 1135446 - DNA, 17 bp, Homo sapiens
aaggaaaatatttcatt

SEQ ID NO: 1135447 - DNA, 17 bp, Homo sapiens
aaggaaaatctatattt

SEQ ID NO: 1135448 - DNA, 22 bp, Homo sapiens
aagtcactgcacagtgcatctc

SEQ ID NO: 1135449 - DNA, 15 bp, Homo sapiens
aagtcacttccagtg

SEQ ID NO: 1135450 - DNA, 18 bp, Homo sapiens
aagtcagaacagcagact

SEQ ID NO: 1135451 - DNA, 13 bp, Homo sapiens
aagtcagaagttt

SEQ ID NO: 1135452 - DNA, 16 bp, Homo sapiens
aagtcagactgctggg

SEQ ID NO: 1135453 - DNA, 17 bp, Homo sapiens
aagtcagactgctggga

SEQ ID NO: 1135454 - DNA, 14 bp, Homo sapiens
aagtcagagacaga

SEQ ID NO: 1135455 - DNA, 20 bp, Homo sapiens
aagtcagatggaaaattcat

SEQ ID NO: 1135456 - DNA, 16 bp, Homo sapiens
aagtcagccacactgg

SEQ ID NO: 1135457 - DNA, 17 bp, Homo sapiens
aagtcagccacactggg

SEQ ID NO: 1135458 - DNA, 20 bp, Homo sapiens
aagtcagccacactgggcct

SEQ ID NO: 1135459 - DNA, 16 bp, Homo sapiens
aagtcagcctacataa

SEQ ID NO: 1135460 - DNA, 22 bp, Homo sapiens
aagtcagcgtgacaatatactt

SEQ ID NO: 1135461 - DNA, 21 bp, Homo sapiens
aagtcagctactctagttctg

SEQ ID NO: 1135462 - DNA, 15 bp, Homo sapiens
aagtcagctccagct

SEQ ID NO: 1135463 - DNA, 16 bp, Homo sapiens
aagtcaggccaggtgg

SEQ ID NO: 1135464 - DNA, 15 bp, Homo sapiens
aagtcaggtccaatt

SEQ ID NO: 1135465 - DNA, 17 bp, Homo sapiens
aagtcagtacgatcaag

SEQ ID NO: 1135466 - DNA, 16 bp, Homo sapiens
aagtcagtatggtcta

SEQ ID NO: 1135467 - DNA, 20 bp, Homo sapiens
aagtcagtcacgtttccttt

SEQ ID NO: 1135468 - DNA, 22 bp, Homo sapiens
aagtcagttgctcaaaaagaaa

SEQ ID NO: 1135469 - DNA, 21 bp, Homo sapiens
aagtcatcattacttgggaaa

SEQ ID NO: 1135470 - DNA, 14 bp, Homo sapiens
aagtcatctactta

SEQ ID NO: 1135471 - DNA, 20 bp, Homo sapiens
aagtcatctacttaataaat

SEQ ID NO: 1135472 - DNA, 13 bp, Homo sapiens
aagtcatcttgct

SEQ ID NO: 1135473 - DNA, 17 bp, Homo sapiens
aagtcatgaagcccaag

SEQ ID NO: 1135474 - DNA, 17 bp, Homo sapiens
aagtcatgggaacgcag

SEQ ID NO: 1135475 - DNA, 14 bp, Homo sapiens
aagtcatgtgcatt

SEQ ID NO: 1135476 - DNA, 19 bp, Homo sapiens
aagggcagagaatggctgg

SEQ ID NO: 1135477 - DNA, 15 bp, Homo sapiens
aagggcagaggaaga

SEQ ID NO: 1135478 - DNA, 15 bp, Homo sapiens
aagggcagctgtgat

SEQ ID NO: 1135479 - DNA, 16 bp, Homo sapiens
aagggcagggcccacg

SEQ ID NO: 1135480 - DNA, 23 bp, Homo sapiens
aagggcaggtcttcatatttttg

SEQ ID NO: 1135481 - DNA, 14 bp, Homo sapiens
aagggcagtgccca

SEQ ID NO: 1135482 - DNA, 22 bp, Homo sapiens
aagggcagtgcccatgtgtaca

SEQ ID NO: 1135483 - DNA, 14 bp, Homo sapiens
aagggcataaagta

SEQ ID NO: 1135484 - DNA, 13 bp, Homo sapiens
aagggcattttta

SEQ ID NO: 1135485 - DNA, 21 bp, Homo sapiens
aagggccaaacccacttctgg

SEQ ID NO: 1135486 - DNA, 20 bp, Homo sapiens
aagggccaccctgctgcact

SEQ ID NO: 1135487 - DNA, 9 bp, Homo sapiens
aagggccag

SEQ ID NO: 1135488 - DNA, 11 bp, Homo sapiens
aagggccaggt

SEQ ID NO: 1135489 - DNA, 18 bp, Homo sapiens
aagggccaggtgcggcct

SEQ ID NO: 1135490 - DNA, 16 bp, Homo sapiens
aagggccagtcctgcc

SEQ ID NO: 1135491 - DNA, 18 bp, Homo sapiens
aagggccagtctgggctg

SEQ ID NO: 1135492 - DNA, 16 bp, Homo sapiens
aagggccatgctgaag

SEQ ID NO: 1135493 - DNA, 14 bp, Homo sapiens
aagggccccagggg

SEQ ID NO: 1135494 - DNA, 18 bp, Homo sapiens
aagggccccaggggcagc

SEQ ID NO: 1135495 - DNA, 17 bp, Homo sapiens
aagggccctgccctgta

SEQ ID NO: 1135496 - DNA, 18 bp, Homo sapiens
aagggcccttctctactg

SEQ ID NO: 1135497 - DNA, 23 bp, Homo sapiens
aagggcctgcccagttgcactca

SEQ ID NO: 1135498 - DNA, 19 bp, Homo sapiens
aagggcctgcctggcccct

SEQ ID NO: 1135499 - DNA, 11 bp, Homo sapiens
aagggcctgga

SEQ ID NO: 1135500 - DNA, 14 bp, Homo sapiens
aagggcctggccag

SEQ ID NO: 1135501 - DNA, 12 bp, Homo sapiens
aagggctccagc

SEQ ID NO: 1135502 - DNA, 21 bp, Homo sapiens
aagggcttacacgtggaggaa

SEQ ID NO: 1135503 - DNA, 15 bp, Homo sapiens
aagggcttactattt

SEQ ID NO: 1135504 - DNA, 23 bp, Homo sapiens
aagggcttcggccacaggcaggt

SEQ ID NO: 1135505 - DNA, 18 bp, Homo sapiens
aagggctttgagggtgga

SEQ ID NO: 1135506 - DNA, 16 bp, Homo sapiens
aaggggacagctgtgt

SEQ ID NO: 1135507 - DNA, 12 bp, Homo sapiens
aaggggagagcc

SEQ ID NO: 1135508 - DNA, 13 bp, Homo sapiens
aaggggagccaga

SEQ ID NO: 1135509 - DNA, 14 bp, Homo sapiens
aaggggaggcagcc

SEQ ID NO: 1135510 - DNA, 16 bp, Homo sapiens
aaggggaggcagccgg

SEQ ID NO: 1135511 - DNA, 19 bp, Homo sapiens
aaggggagtcaccttccct

SEQ ID NO: 1135512 - DNA, 22 bp, Homo sapiens
aaggggatggacacccccagct

SEQ ID NO: 1135513 - DNA, 12 bp, Homo sapiens
aaggggatggag

SEQ ID NO: 1135514 - DNA, 14 bp, Homo sapiens
aaggggatggaggc

SEQ ID NO: 1135515 - DNA, 17 bp, Homo sapiens
aaggggatggaggccag

SEQ ID NO: 1135516 - DNA, 19 bp, Homo sapiens
aaggggatggaggccagag

SEQ ID NO: 1135517 - DNA, 20 bp, Homo sapiens
aaggggatggaggccagagt

SEQ ID NO: 1135518 - DNA, 20 bp, Homo sapiens
aaggggatttttatgtctgg

SEQ ID NO: 1135519 - DNA, 15 bp, Homo sapiens
aaggggcagcaggag

SEQ ID NO: 1135520 - DNA, 16 bp, Homo sapiens
aaggggcagccctgag

SEQ ID NO: 1135521 - DNA, 14 bp, Homo sapiens
aaggggccctggtc

SEQ ID NO: 1135522 - DNA, 14 bp, Homo sapiens
aaggggcccttgga

SEQ ID NO: 1135523 - DNA, 23 bp, Homo sapiens
aaggggcctcaccgagtgggggc

SEQ ID NO: 1135524 - DNA, 18 bp, Homo sapiens
aaggggccttgctctgag

SEQ ID NO: 1135525 - DNA, 16 bp, Homo sapiens
aaggggcgagcaccca

SEQ ID NO: 1135526 - DNA, 11 bp, Homo sapiens
aagggggagga

SEQ ID NO: 1135527 - DNA, 16 bp, Homo sapiens
aagggggctctgcccc

SEQ ID NO: 1135528 - DNA, 19 bp, Homo sapiens
aagggggctctgccccagg

SEQ ID NO: 1135529 - DNA, 15 bp, Homo sapiens
aaggggggagctggg

SEQ ID NO: 1135530 - DNA, 16 bp, Homo sapiens
aaggggggagggggag

SEQ ID NO: 1135531 - DNA, 19 bp, Homo sapiens
aagggggtagaagtagttt

SEQ ID NO: 1135532 - DNA, 12 bp, Homo sapiens
aagggggtccca

SEQ ID NO: 1135533 - DNA, 16 bp, Homo sapiens
aagggggtgactggaa

SEQ ID NO: 1135534 - DNA, 23 bp, Homo sapiens
aagggggtgcaaagactctgagc

SEQ ID NO: 1135535 - DNA, 19 bp, Homo sapiens
aaggggtgcacccacctgt

SEQ ID NO: 1135536 - DNA, 20 bp, Homo sapiens
aaggggtgggtcagaacatg

SEQ ID NO: 1135537 - DNA, 22 bp, Homo sapiens
aaggggtgggtcagaacatgtt

SEQ ID NO: 1135538 - DNA, 14 bp, Homo sapiens
aaggggttcctcaa

SEQ ID NO: 1135539 - DNA, 18 bp, Homo sapiens
aaggggttcctcaaattt

SEQ ID NO: 1135540 - DNA, 15 bp, Homo sapiens
aaggggttggggtga

SEQ ID NO: 1135541 - DNA, 21 bp, Homo sapiens
aagggtaggatgttgcttctg

SEQ ID NO: 1135542 - DNA, 22 bp, Homo sapiens
aagggtaggatgttgcttctga

SEQ ID NO: 1135543 - DNA, 17 bp, Homo sapiens
aagggtcatagaaaggg

SEQ ID NO: 1135544 - DNA, 19 bp, Homo sapiens
aagggtccgtggaccagga

SEQ ID NO: 1135545 - DNA, 16 bp, Homo sapiens
aagggtctagggagag

SEQ ID NO: 1135546 - DNA, 14 bp, Homo sapiens
aagggtcttcttgg

SEQ ID NO: 1135547 - DNA, 15 bp, Homo sapiens
aagggtcttgggaaa

SEQ ID NO: 1135548 - DNA, 16 bp, Homo sapiens
aagggtcttgggaaat

SEQ ID NO: 1135549 - DNA, 17 bp, Homo sapiens
aagggtgcccatttgtg

SEQ ID NO: 1135550 - DNA, 20 bp, Homo sapiens
aagggtgctgcttccctctg

SEQ ID NO: 1135551 - DNA, 14 bp, Homo sapiens
aagggtggggagaa

SEQ ID NO: 1135552 - DNA, 18 bp, Homo sapiens
aagggtggtctgagcacc

SEQ ID NO: 1135553 - DNA, 20 bp, Homo sapiens
aagggtgtaggggccacctc

SEQ ID NO: 1135554 - DNA, 23 bp, Homo sapiens
aagggtgtaggggccacctcctc

SEQ ID NO: 1135555 - DNA, 12 bp, Homo sapiens
aagggtgtatag

SEQ ID NO: 1135556 - DNA, 15 bp, Homo sapiens
aagggttaaggcctg

SEQ ID NO: 1135557 - DNA, 16 bp, Homo sapiens
aagggttccctcaaga

SEQ ID NO: 1135558 - DNA, 21 bp, Homo sapiens
aagggttctgccctgcctgag

SEQ ID NO: 1135559 - DNA, 17 bp, Homo sapiens
aagggttctggctgccc

SEQ ID NO: 1135560 - DNA, 18 bp, Homo sapiens
aagggttgagagccagtg

SEQ ID NO: 1135561 - DNA, 22 bp, Homo sapiens
aagggttgagagccagtggcgg

SEQ ID NO: 1135562 - DNA, 20 bp, Homo sapiens
aagggttgcttctgagtggt

SEQ ID NO: 1135563 - DNA, 19 bp, Homo sapiens
aagggttggtgggctggcc

SEQ ID NO: 1135564 - DNA, 14 bp, Homo sapiens
aagggtttcgactg

SEQ ID NO: 1135565 - DNA, 18 bp, Homo sapiens
aagggtttcgactggtcc

SEQ ID NO: 1135566 - DNA, 17 bp, Homo sapiens
aagggtttgtggctggg

SEQ ID NO: 1135567 - DNA, 12 bp, Homo sapiens
aagggttttctt

SEQ ID NO: 1135568 - DNA, 17 bp, Homo sapiens
aaggtaaaaacccagcg

SEQ ID NO: 1135569 - DNA, 21 bp, Homo sapiens
aaggtaaaaacccagcggctt

SEQ ID NO: 1135570 - DNA, 12 bp, Homo sapiens
aaggtaaaattg

SEQ ID NO: 1135571 - DNA, 16 bp, Homo sapiens
aaggtaaataaaaaga

SEQ ID NO: 1135572 - DNA, 20 bp, Homo sapiens
aaggtaacatttatagaaga

SEQ ID NO: 1135573 - DNA, 21 bp, Homo sapiens
aaggtaatgtagggttatatt

SEQ ID NO: 1135574 - DNA, 19 bp, Homo sapiens
aaggtaattgttttttaaa

SEQ ID NO: 1135575 - DNA, 17 bp, Homo sapiens
aaggtactgaagcttta

SEQ ID NO: 1135576 - DNA, 22 bp, Homo sapiens
aaggtactttcatattttaaac

SEQ ID NO: 1135577 - DNA, 14 bp, Homo sapiens
aaggtagcattcat

SEQ ID NO: 1135578 - DNA, 18 bp, Homo sapiens
aaggtagcattctttgga

SEQ ID NO: 1135579 - DNA, 20 bp, Homo sapiens
aaggtagcattctttggagt

SEQ ID NO: 1135580 - DNA, 21 bp, Homo sapiens
aaggtatacacccagttctga

SEQ ID NO: 1135581 - DNA, 19 bp, Homo sapiens
aaggtatcagttatatgat

SEQ ID NO: 1135582 - DNA, 22 bp, Homo sapiens
aaggtatcagttatatgatatt

SEQ ID NO: 1135583 - DNA, 15 bp, Homo sapiens
aaggtattttgaata

SEQ ID NO: 1135584 - DNA, 19 bp, Homo sapiens
aagtgtatgagttgcattt

SEQ ID NO: 1135585 - DNA, 15 bp, Homo sapiens
aagtgtccgagaact

SEQ ID NO: 1135586 - DNA, 17 bp, Homo sapiens
aagtgtccgagaactaa

SEQ ID NO: 1135587 - DNA, 18 bp, Homo sapiens
aagtgtctacatgtgcca

SEQ ID NO: 1135588 - DNA, 23 bp, Homo sapiens
aagtgtctggcccgcaatactgt

SEQ ID NO: 1135589 - DNA, 14 bp, Homo sapiens
aagtgtctgtgtgc

SEQ ID NO: 1135590 - DNA, 14 bp, Homo sapiens
aagtgtcttctgtt

SEQ ID NO: 1135591 - DNA, 15 bp, Homo sapiens
aagtgtcttctgttc

SEQ ID NO: 1135592 - DNA, 19 bp, Homo sapiens
aagtgtcttctgttcccaa

SEQ ID NO: 1135593 - DNA, 17 bp, Homo sapiens
aagtgtcttttgacatt

SEQ ID NO: 1135594 - DNA, 13 bp, Homo sapiens
aagtgtgagcaaa

SEQ ID NO: 1135595 - DNA, 18 bp, Homo sapiens
aagtgtgagtaagagctg

SEQ ID NO: 1135596 - DNA, 20 bp, Homo sapiens
aagtgtgagtaagagctggt

SEQ ID NO: 1135597 - DNA, 20 bp, Homo sapiens
aagtgtggggattttcactg

SEQ ID NO: 1135598 - DNA, 20 bp, Homo sapiens
aagtgtgggtttggttagag

SEQ ID NO: 1135599 - DNA, 13 bp, Homo sapiens
aagtgtggtagag

SEQ ID NO: 1135600 - DNA, 22 bp, Homo sapiens
aagtgtgtatgtgcgtgtgtgc

SEQ ID NO: 1135601 - DNA, 17 bp, Homo sapiens
aagtgtgtccatcctga

SEQ ID NO: 1135602 - DNA, 18 bp, Homo sapiens
aagtgtgtggtagaaaca

SEQ ID NO: 1135603 - DNA, 23 bp, Homo sapiens
aagtgtgtggtcccaagttggaa

SEQ ID NO: 1135604 - DNA, 19 bp, Homo sapiens
aagtgtgtttcttcccctt

SEQ ID NO: 1135605 - DNA, 13 bp, Homo sapiens
aagtgtgtttgcc

SEQ ID NO: 1135606 - DNA, 18 bp, Homo sapiens
aagtgttacgttttattg

SEQ ID NO: 1135607 - DNA, 13 bp, Homo sapiens
aagtgttcaagaa

SEQ ID NO: 1135608 - DNA, 14 bp, Homo sapiens
aagtgttcattgtt

SEQ ID NO: 1135609 - DNA, 17 bp, Homo sapiens
aagtgttctcatgaagc

SEQ ID NO: 1135610 - DNA, 19 bp, Homo sapiens
aagtgttctcatgaagcag

SEQ ID NO: 1135611 - DNA, 20 bp, Homo sapiens
aagtgttctcatgaagcagg

SEQ ID NO: 1135612 - DNA, 15 bp, Homo sapiens
aagtgttctgagctg

SEQ ID NO: 1135613 - DNA, 16 bp, Homo sapiens
aagtgttgatcaacca

SEQ ID NO: 1135614 - DNA, 16 bp, Homo sapiens
aagtgttggaaaaaat

SEQ ID NO: 1135615 - DNA, 18 bp, Homo sapiens
aagtgttgtaaatattta

SEQ ID NO: 1135616 - DNA, 17 bp, Homo sapiens
aagtgttgtgttcctgg

SEQ ID NO: 1135617 - DNA, 15 bp, Homo sapiens
aagtgtttagctgtc

SEQ ID NO: 1135618 - DNA, 17 bp, Homo sapiens
aagtgtttatgtaatag

SEQ ID NO: 1135619 - DNA, 15 bp, Homo sapiens
aagtgtttatttttc

SEQ ID NO: 1135620 - DNA, 16 bp, Homo sapiens
aagtgtttatttttca

SEQ ID NO: 1135621 - DNA, 21 bp, Homo sapiens
aagtgtttatttttcatattg

SEQ ID NO: 1135622 - DNA, 16 bp, Homo sapiens
aagtgttttactcttt

SEQ ID NO: 1135623 - DNA, 18 bp, Homo sapiens
aagtgttttactcttttt

SEQ ID NO: 1135624 - DNA, 18 bp, Homo sapiens
aagtgttttggagaaaaa

SEQ ID NO: 1135625 - DNA, 23 bp, Homo sapiens
aagtgttttgttctttctggagt

SEQ ID NO: 1135626 - DNA, 22 bp, Homo sapiens
aagttaaaagtgttgattacat

SEQ ID NO: 1135627 - DNA, 22 bp, Homo sapiens
aagttaaaggcagtccagagct

SEQ ID NO: 1135628 - DNA, 13 bp, Homo sapiens
aagttaataatgt

SEQ ID NO: 1135629 - DNA, 16 bp, Homo sapiens
aagttaataatgtatt

SEQ ID NO: 1135630 - DNA, 19 bp, Homo sapiens
aagttaattcacctatgtt

SEQ ID NO: 1135631 - DNA, 16 bp, Homo sapiens
aagttaatttaaagtt

SEQ ID NO: 1135632 - DNA, 23 bp, Homo sapiens
aagttacacagaaatgctgctgg

SEQ ID NO: 1135633 - DNA, 20 bp, Homo sapiens
aagttacatgtttgcacctt

SEQ ID NO: 1135634 - DNA, 14 bp, Homo sapiens
aagttactactgat

SEQ ID NO: 1135635 - DNA, 15 bp, Homo sapiens
aagttactactgatt

SEQ ID NO: 1135636 - DNA, 20 bp, Homo sapiens
aagttactaggtaacttcat

SEQ ID NO: 1135637 - DNA, 17 bp, Homo sapiens
aagttactgggcattct

SEQ ID NO: 1135638 - DNA, 16 bp, Homo sapiens
aagttacttattctag

SEQ ID NO: 1135639 - DNA, 19 bp, Homo sapiens
aagttactttgtcagaggc

SEQ ID NO: 1135640 - DNA, 17 bp, Homo sapiens
aagttactttttgtaga

SEQ ID NO: 1135641 - DNA, 19 bp, Homo sapiens
aagttactttttgtagaga

SEQ ID NO: 1135642 - DNA, 22 bp, Homo sapiens
aagttagactcttcccctccct

SEQ ID NO: 1135643 - DNA, 14 bp, Homo sapiens
aagttagctcagga

SEQ ID NO: 1135644 - DNA, 19 bp, Homo sapiens
aagttagtatcttttgata

SEQ ID NO: 1135645 - DNA, 23 bp, Homo sapiens
aagttagtgcttgttctaagatt

SEQ ID NO: 1135646 - DNA, 19 bp, Homo sapiens
aagttagtggaaatctgaa

SEQ ID NO: 1135647 - DNA, 22 bp, Homo sapiens
aagttagtggaaatctgaacat

SEQ ID NO: 1135648 - DNA, 18 bp, Homo sapiens
aagttagttccactgaga

SEQ ID NO: 1135649 - DNA, 15 bp, Homo sapiens
aagttagtttgtata

SEQ ID NO: 1135650 - DNA, 18 bp, Homo sapiens
aagttataaatcaatgtc

SEQ ID NO: 1135651 - DNA, 17 bp, Homo sapiens
aagttataataactgaa

SEQ ID NO: 1135652 - DNA, 13 bp, Homo sapiens
aagttatatttca

SEQ ID NO: 1135653 - DNA, 14 bp, Homo sapiens
aagttatatttcag

SEQ ID NO: 1135654 - DNA, 13 bp, Homo sapiens
aagttatcaactt

SEQ ID NO: 1135655 - DNA, 13 bp, Homo sapiens
aagttatctttga

SEQ ID NO: 1135656 - DNA, 15 bp, Homo sapiens
aagttattaacttta

SEQ ID NO: 1135657 - DNA, 21 bp, Homo sapiens
aagttattaagaggtaagact

SEQ ID NO: 1135658 - DNA, 17 bp, Homo sapiens
aagttattacctctcca

SEQ ID NO: 1135659 - DNA, 22 bp, Homo sapiens
aagttattacctctccagttcc

SEQ ID NO: 1135660 - DNA, 17 bp, Homo sapiens
aagttattagtggttta

SEQ ID NO: 1135661 - DNA, 20 bp, Homo sapiens
aagttattagtggtttatca

SEQ ID NO: 1135662 - DNA, 21 bp, Homo sapiens
aagttattcaaatttgtacag

SEQ ID NO: 1135663 - DNA, 11 bp, Homo sapiens
aagttattgta

SEQ ID NO: 1135664 - DNA, 20 bp, Homo sapiens
aagttattgtacagctgttt

SEQ ID NO: 1135665 - DNA, 23 bp, Homo sapiens
aagttatttacttttaccactat

SEQ ID NO: 1135666 - DNA, 23 bp, Homo sapiens
aagttatttcataccattattat

SEQ ID NO: 1135667 - DNA, 17 bp, Homo sapiens
aagttattttatttgct

SEQ ID NO: 1135668 - DNA, 14 bp, Homo sapiens
aagttattttctac

SEQ ID NO: 1135669 - DNA, 15 bp, Homo sapiens
aagttattttcttgt

SEQ ID NO: 1135670 - DNA, 18 bp, Homo sapiens
aagttatttttcttttta

SEQ ID NO: 1135671 - DNA, 22 bp, Homo sapiens
aagttatttttctttttaagag

SEQ ID NO: 1135672 - DNA, 13 bp, Homo sapiens
aagttcacagtag

SEQ ID NO: 1135673 - DNA, 16 bp, Homo sapiens
aagttcagccaccctg

SEQ ID NO: 1135674 - DNA, 23 bp, Homo sapiens
aagttcaggctctgagacacacc

SEQ ID NO: 1135675 - DNA, 20 bp, Homo sapiens
aagttcagtttttactgagg

SEQ ID NO: 1135676 - DNA, 14 bp, Homo sapiens
aagttcatagggtc

SEQ ID NO: 1135677 - DNA, 21 bp, Homo sapiens
aagttcatattccatatttat

SEQ ID NO: 1135678 - DNA, 23 bp, Homo sapiens
aagttcatattccatatttattc

SEQ ID NO: 1135679 - DNA, 23 bp, Homo sapiens
aagttcatgttggccatggtgaa

SEQ ID NO: 1135680 - DNA, 19 bp, Homo sapiens
aagttccagtgttctctct

SEQ ID NO: 1135681 - DNA, 21 bp, Homo sapiens
aagttccccatccctgtcatt

SEQ ID NO: 1135682 - DNA, 14 bp, Homo sapiens
aagttccctacttc

SEQ ID NO: 1135683 - DNA, 18 bp, Homo sapiens
aagttcctctcccttccc

SEQ ID NO: 1135684 - DNA, 21 bp, Homo sapiens
aagttcctctcccttcccttc

SEQ ID NO: 1135685 - DNA, 12 bp, Homo sapiens
aagttccttaag

SEQ ID NO: 1135686 - DNA, 12 bp, Homo sapiens
aagttcgtctgt

SEQ ID NO: 1135687 - DNA, 15 bp, Homo sapiens
aagttcgtctgttgt

SEQ ID NO: 1135688 - DNA, 15 bp, Homo sapiens
aagttctaagttcat

SEQ ID NO: 1135689 - DNA, 16 bp, Homo sapiens
aagttctaagttcatg

SEQ ID NO: 1135690 - DNA, 18 bp, Homo sapiens
aagttctagagaagaggc

SEQ ID NO: 1135691 - DNA, 21 bp, Homo sapiens
aagttctagagaagaggctgg

SEQ ID NO: 1135692 - DNA, 17 bp, Homo sapiens
aagttctaggcccccca

SEQ ID NO: 1135693 - DNA, 14 bp, Homo sapiens
aagttctagtgttt

SEQ ID NO: 1135694 - DNA, 21 bp, Homo sapiens
aagttctagtgttttcaattt

SEQ ID NO: 1135695 - DNA, 16 bp, Homo sapiens
aagttctcaaagttaa

SEQ ID NO: 1135696 - DNA, 19 bp, Homo sapiens
aagttctcaaagttaattc

SEQ ID NO: 1135697 - DNA, 15 bp, Homo sapiens
aagttctgacttgac

SEQ ID NO: 1135698 - DNA, 19 bp, Homo sapiens
aagttctgtactcaaatgt

SEQ ID NO: 1135699 - DNA, 22 bp, Homo sapiens
aagttcttagttgctgtatgtc

SEQ ID NO: 1135700 - DNA, 18 bp, Homo sapiens
aagttcttattttagtat

SEQ ID NO: 1135701 - DNA, 13 bp, Homo sapiens
aagttcttcaaga

SEQ ID NO: 1135702 - DNA, 16 bp, Homo sapiens
aagttcttcaagagga

SEQ ID NO: 1135703 - DNA, 18 bp, Homo sapiens
aagttcttcaagaggaaa

SEQ ID NO: 1135704 - DNA, 15 bp, Homo sapiens
aagttcttctccaat

SEQ ID NO: 1135705 - DNA, 11 bp, Homo sapiens
agaaccaaaga

SEQ ID NO: 1135706 - DNA, 16 bp, Homo sapiens
agaaccaaatctggaa

SEQ ID NO: 1135707 - DNA, 18 bp, Homo sapiens
agaaccaaatctggaagc

SEQ ID NO: 1135708 - DNA, 14 bp, Homo sapiens
agaaccaacaaaac

SEQ ID NO: 1135709 - DNA, 19 bp, Homo sapiens
agaaccagagggcatgctg

SEQ ID NO: 1135710 - DNA, 16 bp, Homo sapiens
agaaccagcccagcct

SEQ ID NO: 1135711 - DNA, 18 bp, Homo sapiens
agaaccagccgtatttta

SEQ ID NO: 1135712 - DNA, 22 bp, Homo sapiens
agaaccatccctattttgtatt

SEQ ID NO: 1135713 - DNA, 13 bp, Homo sapiens
agaacccaagtgc

SEQ ID NO: 1135714 - DNA, 14 bp, Homo sapiens
agaacccaagtgcc

SEQ ID NO: 1135715 - DNA, 17 bp, Homo sapiens
agaacccacagtgagag

SEQ ID NO: 1135716 - DNA, 14 bp, Homo sapiens
agaacccagggctc

SEQ ID NO: 1135717 - DNA, 18 bp, Homo sapiens
agaacccagggctctgcc

SEQ ID NO: 1135718 - DNA, 20 bp, Homo sapiens
agaacccagggctctgcccc

SEQ ID NO: 1135719 - DNA, 21 bp, Homo sapiens
agaacccatggaaaaatgcca

SEQ ID NO: 1135720 - DNA, 14 bp, Homo sapiens
agaaccgagaaggg

SEQ ID NO: 1135721 - DNA, 15 bp, Homo sapiens
agaaccgagcaaaga

SEQ ID NO: 1135722 - DNA, 18 bp, Homo sapiens
agaaccgagcaaagatca

SEQ ID NO: 1135723 - DNA, 19 bp, Homo sapiens
agaacctaattcaattcaa

SEQ ID NO: 1135724 - DNA, 19 bp, Homo sapiens
agaacctactgttcctttc

SEQ ID NO: 1135725 - DNA, 18 bp, Homo sapiens
agaacctatctttaaagc

SEQ ID NO: 1135726 - DNA, 19 bp, Homo sapiens
agaacctcaggcttccttg

SEQ ID NO: 1135727 - DNA, 21 bp, Homo sapiens
agaacctcaggcttccttggc

SEQ ID NO: 1135728 - DNA, 21 bp, Homo sapiens
agaacctgagctattttcctc

SEQ ID NO: 1135729 - DNA, 13 bp, Homo sapiens
agaacctgagggc

SEQ ID NO: 1135730 - DNA, 23 bp, Homo sapiens
agaacctggaaaaattccagaag

SEQ ID NO: 1135731 - DNA, 22 bp, Homo sapiens
agaacctgtctcctactttgaa

SEQ ID NO: 1135732 - DNA, 15 bp, Homo sapiens
agaaccttaatgaca

SEQ ID NO: 1135733 - DNA, 14 bp, Homo sapiens
agaaccttggacca

SEQ ID NO: 1135734 - DNA, 15 bp, Homo sapiens
agaacgccagtctcc

SEQ ID NO: 1135735 - DNA, 20 bp, Homo sapiens
agaacgccagtctcccaggc

SEQ ID NO: 1135736 - DNA, 16 bp, Homo sapiens
agaacgctgatttaaa

SEQ ID NO: 1135737 - DNA, 18 bp, Homo sapiens
agaacggaggaggctgca

SEQ ID NO: 1135738 - DNA, 14 bp, Homo sapiens
agaacggcttgctt

SEQ ID NO: 1135739 - DNA, 16 bp, Homo sapiens
agaacggttgccccag

SEQ ID NO: 1135740 - DNA, 16 bp, Homo sapiens
agaacgtatttagcca

SEQ ID NO: 1135741 - DNA, 22 bp, Homo sapiens
agaacgtatttagccattaccc

SEQ ID NO: 1135742 - DNA, 15 bp, Homo sapiens
agaacgttaaactat

SEQ ID NO: 1135743 - DNA, 16 bp, Homo sapiens
agaacgttttttcctc

SEQ ID NO: 1135744 - DNA, 20 bp, Homo sapiens
agaactactttgaaaacaat

SEQ ID NO: 1135745 - DNA, 22 bp, Homo sapiens
agaactagttttgggaaatgta

SEQ ID NO: 1135746 - DNA, 23 bp, Homo sapiens
agaactagttttgggaaatgtag

SEQ ID NO: 1135747 - DNA, 22 bp, Homo sapiens
agaactatcatttttacactat

SEQ ID NO: 1135748 - DNA, 14 bp, Homo sapiens
agaactatctgcat

SEQ ID NO: 1135749 - DNA, 23 bp, Homo sapiens
agaactattgtgctcagagacac

SEQ ID NO: 1135750 - DNA, 20 bp, Homo sapiens
agaactcactctgggctgta

SEQ ID NO: 1135751 - DNA, 18 bp, Homo sapiens
agaactcagaagagaaat

SEQ ID NO: 1135752 - DNA, 17 bp, Homo sapiens
agaactcagttttaact

SEQ ID NO: 1135753 - DNA, 16 bp, Homo sapiens
agaactccaggccctc

SEQ ID NO: 1135754 - DNA, 20 bp, Homo sapiens
agaactcctccaaagcatgt

SEQ ID NO: 1135755 - DNA, 18 bp, Homo sapiens
agaactccttattttgta

SEQ ID NO: 1135756 - DNA, 16 bp, Homo sapiens
agaactctctccctgg

SEQ ID NO: 1135757 - DNA, 17 bp, Homo sapiens
agaactctctccctggt

SEQ ID NO: 1135758 - DNA, 16 bp, Homo sapiens
agaactctctggaagc

SEQ ID NO: 1135759 - DNA, 23 bp, Homo sapiens
agaactctctgtcttctctccac

SEQ ID NO: 1135760 - DNA, 14 bp, Homo sapiens
agaactctggcttt

SEQ ID NO: 1135761 - DNA, 15 bp, Homo sapiens
agaactgaagccact

SEQ ID NO: 1135762 - DNA, 23 bp, Homo sapiens
agaactgacaaaggagccttgat

SEQ ID NO: 1135763 - DNA, 15 bp, Homo sapiens
agaactgagctcctc

SEQ ID NO: 1135764 - DNA, 22 bp, Homo sapiens
agaactgagctcctctgggcag

SEQ ID NO: 1135765 - DNA, 22 bp, Homo sapiens
agaactgagggctctgtttgtg

SEQ ID NO: 1135766 - DNA, 15 bp, Homo sapiens
agaactgcacttttt

SEQ ID NO: 1135767 - DNA, 14 bp, Homo sapiens
agaactgcagacct

SEQ ID NO: 1135768 - DNA, 23 bp, Homo sapiens
agaactgcagatagcccaggagc

SEQ ID NO: 1135769 - DNA, 15 bp, Homo sapiens
agaactgcaggccct

SEQ ID NO: 1135770 - DNA, 20 bp, Homo sapiens
agaactgcaggccctggcct

SEQ ID NO: 1135771 - DNA, 20 bp, Homo sapiens
agaactgcatatgtttcgct

SEQ ID NO: 1135772 - DNA, 11 bp, Homo sapiens
agaactgccat

SEQ ID NO: 1135773 - DNA, 14 bp, Homo sapiens
agaactgccattat

SEQ ID NO: 1135774 - DNA, 12 bp, Homo sapiens
agaactgccctt

SEQ ID NO: 1135775 - DNA, 18 bp, Homo sapiens
agaactgcccttgctgcc

SEQ ID NO: 1135776 - DNA, 21 bp, Homo sapiens
agaactgcttctaagatgcca

SEQ ID NO: 1135777 - DNA, 15 bp, Homo sapiens
agaactggctgggcc

SEQ ID NO: 1135778 - DNA, 17 bp, Homo sapiens
agaactggctgggcccc

SEQ ID NO: 1135779 - DNA, 19 bp, Homo sapiens
agaactggctgggcccctg

SEQ ID NO: 1135780 - DNA, 21 bp, Homo sapiens
agaactggctgggcccctggg

SEQ ID NO: 1135781 - DNA, 19 bp, Homo sapiens
agaactgtatgtcagacat

SEQ ID NO: 1135782 - DNA, 16 bp, Homo sapiens
agaactgtcccatccc

SEQ ID NO: 1135783 - DNA, 23 bp, Homo sapiens
agaactgtcccatccccaggtcc

SEQ ID NO: 1135784 - DNA, 19 bp, Homo sapiens
agaactgtgaaatttacaa

SEQ ID NO: 1135785 - DNA, 16 bp, Homo sapiens
agaactgtgccacaat

SEQ ID NO: 1135786 - DNA, 20 bp, Homo sapiens
agaacttaaattatgtttta

SEQ ID NO: 1135787 - DNA, 17 bp, Homo sapiens
agaacttcagaaagact

SEQ ID NO: 1135788 - DNA, 18 bp, Homo sapiens
agaacttcagaaagactt

SEQ ID NO: 1135789 - DNA, 13 bp, Homo sapiens
agaacttccctga

SEQ ID NO: 1135790 - DNA, 23 bp, Homo sapiens
agaacttccctgattgacctgct

SEQ ID NO: 1135791 - DNA, 15 bp, Homo sapiens
agaactttaaagctc

SEQ ID NO: 1135792 - DNA, 20 bp, Homo sapiens
agaactttggaggcaaatct

SEQ ID NO: 1135793 - DNA, 11 bp, Homo sapiens
agaagaaaacc

SEQ ID NO: 1135794 - DNA, 19 bp, Homo sapiens
agaagaaaatagaattgac

SEQ ID NO: 1135795 - DNA, 20 bp, Homo sapiens
agaaatatttgtgacaaaaa

SEQ ID NO: 1135796 - DNA, 19 bp, Homo sapiens
agaaatattttaaaatcag

SEQ ID NO: 1135797 - DNA, 15 bp, Homo sapiens
agaaatcaatagttg

SEQ ID NO: 1135798 - DNA, 16 bp, Homo sapiens
agaaatcacaggggcg

SEQ ID NO: 1135799 - DNA, 20 bp, Homo sapiens
agaaatcacgttgctggtgg

SEQ ID NO: 1135800 - DNA, 10 bp, Homo sapiens
agaaatcact

SEQ ID NO: 1135801 - DNA, 11 bp, Homo sapiens
agaaatcactg

SEQ ID NO: 1135802 - DNA, 18 bp, Homo sapiens
agaaatcactgtgaaatt

SEQ ID NO: 1135803 - DNA, 23 bp, Homo sapiens
agaaatcactgtgaaatttcatg

SEQ ID NO: 1135804 - DNA, 22 bp, Homo sapiens
agaaatcattgtagaaacacag

SEQ ID NO: 1135805 - DNA, 22 bp, Homo sapiens
agaaatcattttgcaatccctt

SEQ ID NO: 1135806 - DNA, 19 bp, Homo sapiens
agaaatccccccttcagaa

SEQ ID NO: 1135807 - DNA, 20 bp, Homo sapiens
agaaatccccccttcagaac

SEQ ID NO: 1135808 - DNA, 19 bp, Homo sapiens
agaaatccctgtttaatat

SEQ ID NO: 1135809 - DNA, 17 bp, Homo sapiens
agaaatcggttgctgtt

SEQ ID NO: 1135810 - DNA, 14 bp, Homo sapiens
agaaatctagaaga

SEQ ID NO: 1135811 - DNA, 23 bp, Homo sapiens
agaaatctagtatttcatgctgg

SEQ ID NO: 1135812 - DNA, 18 bp, Homo sapiens
agaaatctcacttttctc

SEQ ID NO: 1135813 - DNA, 22 bp, Homo sapiens
agaaatctggtcttgttagaaa

SEQ ID NO: 1135814 - DNA, 12 bp, Homo sapiens
agaaatgaaaaa

SEQ ID NO: 1135815 - DNA, 13 bp, Homo sapiens
agaaatgaacaaa

SEQ ID NO: 1135816 - DNA, 23 bp, Homo sapiens
agaaatgaccaatattatactaa

SEQ ID NO: 1135817 - DNA, 22 bp, Homo sapiens
agaaatgattcaaattgctgct

SEQ ID NO: 1135818 - DNA, 15 bp, Homo sapiens
agaaatgcatatttg

SEQ ID NO: 1135819 - DNA, 22 bp, Homo sapiens
agaaatgcccccattctcccag

SEQ ID NO: 1135820 - DNA, 15 bp, Homo sapiens
agaaatgccttaccc

SEQ ID NO: 1135821 - DNA, 22 bp, Homo sapiens
agaaatgctgcctgcctgtctg

SEQ ID NO: 1135822 - DNA, 15 bp, Homo sapiens
agaaatgctgctggc

SEQ ID NO: 1135823 - DNA, 15 bp, Homo sapiens
agaaatgcttagaaa

SEQ ID NO: 1135824 - DNA, 15 bp, Homo sapiens
agaaatggaatgaat

SEQ ID NO: 1135825 - DNA, 16 bp, Homo sapiens
agaaatggcgtctgct

SEQ ID NO: 1135826 - DNA, 22 bp, Homo sapiens
agaaatggcgtctgctctggtg

SEQ ID NO: 1135827 - DNA, 19 bp, Homo sapiens
agaaatggctatgaacaga

SEQ ID NO: 1135828 - DNA, 17 bp, Homo sapiens
agaaatgggcagttctc

SEQ ID NO: 1135829 - DNA, 19 bp, Homo sapiens
agaaatgggcagttctccc

SEQ ID NO: 1135830 - DNA, 22 bp, Homo sapiens
agaaatgggcagttctcccagg

SEQ ID NO: 1135831 - DNA, 20 bp, Homo sapiens
agaaatgggggtggcaagtg

SEQ ID NO: 1135832 - DNA, 17 bp, Homo sapiens
agaaatgtaaactgcca

SEQ ID NO: 1135833 - DNA, 13 bp, Homo sapiens
agaaatgtaaatg

SEQ ID NO: 1135834 - DNA, 18 bp, Homo sapiens
agaaatgtaaatgttatt

SEQ ID NO: 1135835 - DNA, 16 bp, Homo sapiens
agaaatgtacagcaag

SEQ ID NO: 1135836 - DNA, 13 bp, Homo sapiens
agaaatgtctaat

SEQ ID NO: 1135837 - DNA, 16 bp, Homo sapiens
agaaatgtctctgctc

SEQ ID NO: 1135838 - DNA, 16 bp, Homo sapiens
agaaatgttgttcatt

SEQ ID NO: 1135839 - DNA, 13 bp, Homo sapiens
agaaattaaaata

SEQ ID NO: 1135840 - DNA, 20 bp, Homo sapiens
agaaattacctgtggatatt

SEQ ID NO: 1135841 - DNA, 21 bp, Homo sapiens
agaaattagaaaaaaattact

SEQ ID NO: 1135842 - DNA, 17 bp, Homo sapiens
agaaattagaaacctta

SEQ ID NO: 1135843 - DNA, 19 bp, Homo sapiens
agaaattagtcacttaaaa

SEQ ID NO: 1135844 - DNA, 16 bp, Homo sapiens
agaaattatttaataa

SEQ ID NO: 1135845 - DNA, 17 bp, Homo sapiens
agaaattatttaataaa

SEQ ID NO: 1135846 - DNA, 22 bp, Homo sapiens
agaaattcaatttggatttaaa

SEQ ID NO: 1135847 - DNA, 20 bp, Homo sapiens
agaaattcaggtacagaaaa

SEQ ID NO: 1135848 - DNA, 20 bp, Homo sapiens
agaaattccaactcctgatg

SEQ ID NO: 1135849 - DNA, 21 bp, Homo sapiens
agaaattccatacttctctca

SEQ ID NO: 1135850 - DNA, 23 bp, Homo sapiens
agaaattccatacttctctcaga

SEQ ID NO: 1135851 - DNA, 13 bp, Homo sapiens
agaaattcctgta

SEQ ID NO: 1135852 - DNA, 20 bp, Homo sapiens
agaaattcgtgtgttttttt

SEQ ID NO: 1135853 - DNA, 22 bp, Homo sapiens
agaaattctgcaagtttctgtt

SEQ ID NO: 1135854 - DNA, 18 bp, Homo sapiens
agaaattcttgttatggt

SEQ ID NO: 1135855 - DNA, 15 bp, Homo sapiens
agaaattggctggat

SEQ ID NO: 1135856 - DNA, 14 bp, Homo sapiens
agaaattgtatatt

SEQ ID NO: 1135857 - DNA, 18 bp, Homo sapiens
agaaatttaaaagacact

SEQ ID NO: 1135858 - DNA, 13 bp, Homo sapiens
agaaatttaaact

SEQ ID NO: 1135859 - DNA, 20 bp, Homo sapiens
agaaatttgatttctattca

SEQ ID NO: 1135860 - DNA, 19 bp, Homo sapiens
agaaatttgtctttttgta

SEQ ID NO: 1135861 - DNA, 19 bp, Homo sapiens
agaacaaaaaaatctgcag

SEQ ID NO: 1135862 - DNA, 16 bp, Homo sapiens
agaacaaacaaaactt

SEQ ID NO: 1135863 - DNA, 20 bp, Homo sapiens
agaacaaacacctccccagc

SEQ ID NO: 1135864 - DNA, 15 bp, Homo sapiens
agaacaaagctgtta

SEQ ID NO: 1135865 - DNA, 16 bp, Homo sapiens
agaacaaagctgttaa

SEQ ID NO: 1135866 - DNA, 17 bp, Homo sapiens
agaacaaagctgttaaa

SEQ ID NO: 1135867 - DNA, 18 bp, Homo sapiens
agaacaaagctgttaaac

SEQ ID NO: 1135868 - DNA, 15 bp, Homo sapiens
agaacaaatgtgttt

SEQ ID NO: 1135869 - DNA, 20 bp, Homo sapiens
agaacaaatgtgtttttcta

SEQ ID NO: 1135870 - DNA, 11 bp, Homo sapiens
agaacaacttg

SEQ ID NO: 1135871 - DNA, 22 bp, Homo sapiens
agaacaagaaagggccaggaga

SEQ ID NO: 1135872 - DNA, 14 bp, Homo sapiens
agaacaagaaatgg

SEQ ID NO: 1135873 - DNA, 19 bp, Homo sapiens
agaacaagagtttgttctg

SEQ ID NO: 1135874 - DNA, 12 bp, Homo sapiens
agaacaaggcac

SEQ ID NO: 1135875 - DNA, 18 bp, Homo sapiens
agaacaagtcacagctgc

SEQ ID NO: 1135876 - DNA, 19 bp, Homo sapiens
agaacaagtgcctcctgga

SEQ ID NO: 1135877 - DNA, 16 bp, Homo sapiens
agaacaatcactattc

SEQ ID NO: 1135878 - DNA, 17 bp, Homo sapiens
agaacaatcactattct

SEQ ID NO: 1135879 - DNA, 17 bp, Homo sapiens
agaacaatgggaggctg

SEQ ID NO: 1135880 - DNA, 18 bp, Homo sapiens
agaacacaaaacttgaaa

SEQ ID NO: 1135881 - DNA, 22 bp, Homo sapiens
agaacacaaagcggggggaggg

SEQ ID NO: 1135882 - DNA, 15 bp, Homo sapiens
agaacacacacactt

SEQ ID NO: 1135883 - DNA, 20 bp, Homo sapiens
agaacacacagactttctgt

SEQ ID NO: 1135884 - DNA, 16 bp, Homo sapiens
agaacacagcatgtgc

SEQ ID NO: 1135885 - DNA, 18 bp, Homo sapiens
agaacacagcatgtgcca

SEQ ID NO: 1135886 - DNA, 21 bp, Homo sapiens
agaacacagcatgtgccaaga

SEQ ID NO: 1135887 - DNA, 11 bp, Homo sapiens
agaacacagtt

SEQ ID NO: 1135888 - DNA, 14 bp, Homo sapiens
agaacactaattca

SEQ ID NO: 1135889 - DNA, 15 bp, Homo sapiens
agaacactaattcat

SEQ ID NO: 1135890 - DNA, 14 bp, Homo sapiens
agaacactgcctct

SEQ ID NO: 1135891 - DNA, 12 bp, Homo sapiens
agaacacttatg

SEQ ID NO: 1135892 - DNA, 16 bp, Homo sapiens
agaacagagggccaga

SEQ ID NO: 1135893 - DNA, 18 bp, Homo sapiens
agaacagcagactcagct

SEQ ID NO: 1135894 - DNA, 20 bp, Homo sapiens
agaacagccgctcctgtctg

SEQ ID NO: 1135895 - DNA, 22 bp, Homo sapiens
agaacagccgctcctgtctgcc

SEQ ID NO: 1135896 - DNA, 23 bp, Homo sapiens
agaacagccgctcctgtctgcca

SEQ ID NO: 1135897 - DNA, 20 bp, Homo sapiens
agaacagctgttcctgtgtt

SEQ ID NO: 1135898 - DNA, 21 bp, Homo sapiens
agaacagggtcatgtttgcag

SEQ ID NO: 1135899 - DNA, 17 bp, Homo sapiens
agaacaggtgggctgta

SEQ ID NO: 1135900 - DNA, 18 bp, Homo sapiens
agaacagtaggattgctg

SEQ ID NO: 1135901 - DNA, 15 bp, Homo sapiens
agaacagtcatgtat

SEQ ID NO: 1135902 - DNA, 19 bp, Homo sapiens
agaacagtttcatcaggac

SEQ ID NO: 1135903 - DNA, 16 bp, Homo sapiens
agaacataaagcaaat

SEQ ID NO: 1135904 - DNA, 22 bp, Homo sapiens
agaacatacaaggacattcact

SEQ ID NO: 1135905 - DNA, 18 bp, Homo sapiens
agaacatacatgatacat

SEQ ID NO: 1135906 - DNA, 15 bp, Homo sapiens
agaacatcattagaa

SEQ ID NO: 1135907 - DNA, 20 bp, Homo sapiens
agaacatcattagaacaaag

SEQ ID NO: 1135908 - DNA, 18 bp, Homo sapiens
agaacatccaaggagaaa

SEQ ID NO: 1135909 - DNA, 15 bp, Homo sapiens
agaacatccctgggc

SEQ ID NO: 1135910 - DNA, 18 bp, Homo sapiens
agaacatccctgggcaag

SEQ ID NO: 1135911 - DNA, 14 bp, Homo sapiens
agaacatgaaatgc

SEQ ID NO: 1135912 - DNA, 14 bp, Homo sapiens
agaacatggacttg

SEQ ID NO: 1135913 - DNA, 21 bp, Homo sapiens
agaacatgttaagataactta

SEQ ID NO: 1135914 - DNA, 17 bp, Homo sapiens
agaacattcacttttgt

SEQ ID NO: 1135915 - DNA, 19 bp, Homo sapiens
agaacattcacttttgtta

SEQ ID NO: 1135916 - DNA, 11 bp, Homo sapiens
agaacattgta

SEQ ID NO: 1135917 - DNA, 13 bp, Homo sapiens
agaacattttaat

SEQ ID NO: 1135918 - DNA, 23 bp, Homo sapiens
agaaccaaaaaaaaaaaaggaaa

SEQ ID NO: 1135919 - DNA, 14 bp, Homo sapiens
agaaaccctgtctc

SEQ ID NO: 1135920 - DNA, 18 bp, Homo sapiens
agaaacctatctcaggga

SEQ ID NO: 1135921 - DNA, 20 bp, Homo sapiens
agaaacctatctcagggagg

SEQ ID NO: 1135922 - DNA, 17 bp, Homo sapiens
agaaaccttaatatgtg

SEQ ID NO: 1135923 - DNA, 18 bp, Homo sapiens
agaaaccttattgtacct

SEQ ID NO: 1135924 - DNA, 20 bp, Homo sapiens
agaaaccttattgtacctct

SEQ ID NO: 1135925 - DNA, 18 bp, Homo sapiens
agaaacctttttaaaaat

SEQ ID NO: 1135926 - DNA, 15 bp, Homo sapiens
agaaactaaaaatat

SEQ ID NO: 1135927 - DNA, 17 bp, Homo sapiens
agaaactaattgacttt

SEQ ID NO: 1135928 - DNA, 14 bp, Homo sapiens
agaaactacaaata

SEQ ID NO: 1135929 - DNA, 14 bp, Homo sapiens
agaaactatttctg

SEQ ID NO: 1135930 - DNA, 13 bp, Homo sapiens
agaaactcctgtt

SEQ ID NO: 1135931 - DNA, 16 bp, Homo sapiens
agaaactgaaagtgtt

SEQ ID NO: 1135932 - DNA, 19 bp, Homo sapiens
agaaactgaaagtgtttta

SEQ ID NO: 1135933 - DNA, 13 bp, Homo sapiens
agaaactgaacca

SEQ ID NO: 1135934 - DNA, 22 bp, Homo sapiens
agaaactgacatgccctccctt

SEQ ID NO: 1135935 - DNA, 13 bp, Homo sapiens
agaaactgaggaa

SEQ ID NO: 1135936 - DNA, 15 bp, Homo sapiens
agaaactgcagggaa

SEQ ID NO: 1135937 - DNA, 18 bp, Homo sapiens
agaaactggattaaaaca

SEQ ID NO: 1135938 - DNA, 21 bp, Homo sapiens
agaaactggattaaaacaatt

SEQ ID NO: 1135939 - DNA, 17 bp, Homo sapiens
agaaactggcaaagcag

SEQ ID NO: 1135940 - DNA, 15 bp, Homo sapiens
agaaactgttcccac

SEQ ID NO: 1135941 - DNA, 23 bp, Homo sapiens
agaaacttaaatgttattatctg

SEQ ID NO: 1135942 - DNA, 12 bp, Homo sapiens
agaaacttagag

SEQ ID NO: 1135943 - DNA, 13 bp, Homo sapiens
agaaacttcgcct

SEQ ID NO: 1135944 - DNA, 18 bp, Homo sapiens
agaaacttggctggaatt

SEQ ID NO: 1135945 - DNA, 13 bp, Homo sapiens
agaaacttgtgaa

SEQ ID NO: 1135946 - DNA, 18 bp, Homo sapiens
agaaactttctggtgctg

SEQ ID NO: 1135947 - DNA, 13 bp, Homo sapiens
agaaactttgcct

SEQ ID NO: 1135948 - DNA, 19 bp, Homo sapiens
agaaacttttttatttaaa

SEQ ID NO: 1135949 - DNA, 15 bp, Homo sapiens
agaaagaaaaggcaa

SEQ ID NO: 1135950 - DNA, 14 bp, Homo sapiens
agaaagaacatttt

SEQ ID NO: 1135951 - DNA, 12 bp, Homo sapiens
agaaagaagcca

SEQ ID NO: 1135952 - DNA, 13 bp, Homo sapiens
agaaagaaggaag

SEQ ID NO: 1135953 - DNA, 14 bp, Homo sapiens
agaaagaaggaagt

SEQ ID NO: 1135954 - DNA, 22 bp, Homo sapiens
agaaagaataggggctgaagac

SEQ ID NO: 1135955 - DNA, 16 bp, Homo sapiens
agaaagaatgcaagag

SEQ ID NO: 1135956 - DNA, 21 bp, Homo sapiens
agaaagaatgttactgcctta

SEQ ID NO: 1135957 - DNA, 20 bp, Homo sapiens
agaaagactatctaaatgtt

SEQ ID NO: 1135958 - DNA, 17 bp, Homo sapiens
agaaagagaatgaactg

SEQ ID NO: 1135959 - DNA, 19 bp, Homo sapiens
agaaagagcacttaagaga

SEQ ID NO: 1135960 - DNA, 22 bp, Homo sapiens
agaaagagcacttaagagaata

SEQ ID NO: 1135961 - DNA, 15 bp, Homo sapiens
agaaagagctacctg

SEQ ID NO: 1135962 - DNA, 20 bp, Homo sapiens
agaaagagggtcccagggct

SEQ ID NO: 1135963 - DNA, 14 bp, Homo sapiens
agaaagatccaccc

SEQ ID NO: 1135964 - DNA, 19 bp, Homo sapiens
agaaagatctaagcagctg

SEQ ID NO: 1135965 - DNA, 20 bp, Homo sapiens
agaaagatgtatataggtgt

SEQ ID NO: 1135966 - DNA, 14 bp, Homo sapiens
agaaagatgttcca

SEQ ID NO: 1135967 - DNA, 17 bp, Homo sapiens
agaaagcaaaattatgt

SEQ ID NO: 1135968 - DNA, 14 bp, Homo sapiens
agaaagcataaaat

SEQ ID NO: 1135969 - DNA, 17 bp, Homo sapiens
agaaagcatatcccacc

SEQ ID NO: 1135970 - DNA, 15 bp, Homo sapiens
agaaagcatattgac

SEQ ID NO: 1135971 - DNA, 16 bp, Homo sapiens
agaaagccaccttgtt

SEQ ID NO: 1135972 - DNA, 13 bp, Homo sapiens
agaaagcccacct

SEQ ID NO: 1135973 - DNA, 14 bp, Homo sapiens
agaaagcccacctg

SEQ ID NO: 1135974 - DNA, 16 bp, Homo sapiens
agaaagcctcctgccc

SEQ ID NO: 1135975 - DNA, 19 bp, Homo sapiens
agaaagcctgggtgacatt

SEQ ID NO: 1135976 - DNA, 19 bp, Homo sapiens
agaaagcctgttcccctca

SEQ ID NO: 1135977 - DNA, 20 bp, Homo sapiens
agaaagctagatatgcctta

SEQ ID NO: 1135978 - DNA, 11 bp, Homo sapiens
agaaagctcaa

SEQ ID NO: 1135979 - DNA, 14 bp, Homo sapiens
agaaagctgacatt

SEQ ID NO: 1135980 - DNA, 16 bp, Homo sapiens
agaaagctggtaaact

SEQ ID NO: 1135981 - DNA, 23 bp, Homo sapiens
agaaagcttcttcagagtgaaga

SEQ ID NO: 1135982 - DNA, 14 bp, Homo sapiens
agaaagcttttatt

SEQ ID NO: 1135983 - DNA, 23 bp, Homo sapiens
agaaaggaaatgagatgacagta

SEQ ID NO: 1135984 - DNA, 17 bp, Homo sapiens
agaaaggaacctgggat

SEQ ID NO: 1135985 - DNA, 18 bp, Homo sapiens
agaaaggaagcattgtaa

SEQ ID NO: 1135986 - DNA, 19 bp, Homo sapiens
agaaaggaagcattgtaaa

SEQ ID NO: 1135987 - DNA, 13 bp, Homo sapiens
agaaaggagagaa

SEQ ID NO: 1135988 - DNA, 17 bp, Homo sapiens
agaaaggaggggagaac

SEQ ID NO: 1135989 - DNA, 19 bp, Homo sapiens
agaaaggatatttaagaaa

SEQ ID NO: 1135990 - DNA, 22 bp, Homo sapiens
agaaaggcaggtttcatttctt

SEQ ID NO: 1135991 - DNA, 21 bp, Homo sapiens
agaaaggctgttaaatacagg

SEQ ID NO: 1135992 - DNA, 16 bp, Homo sapiens
agaaagggaaactggc

SEQ ID NO: 1135993 - DNA, 17 bp, Homo sapiens
agaaagggcaaattatt

SEQ ID NO: 1135994 - DNA, 12 bp, Homo sapiens
agaaagggcaga

SEQ ID NO: 1135995 - DNA, 20 bp, Homo sapiens
agaaagggcagaggaagaga

SEQ ID NO: 1135996 - DNA, 22 bp, Homo sapiens
agaaagggcagaggaagagaca

SEQ ID NO: 1135997 - DNA, 23 bp, Homo sapiens
agaaaggtctgaaatccagcatc

SEQ ID NO: 1135998 - DNA, 23 bp, Homo sapiens
agaaaggtgagtttgagctgcct

SEQ ID NO: 1135999 - DNA, 17 bp, Homo sapiens
agaaagtaagtcttttt

SEQ ID NO: 1136000 - DNA, 21 bp, Homo sapiens
agaaagtagaggcatgatgat

SEQ ID NO: 1136001 - DNA, 15 bp, Homo sapiens
agaaagtgaagcaaa

SEQ ID NO: 1136002 - DNA, 23 bp, Homo sapiens
agaaagtgaagcaaatcagaaac

SEQ ID NO: 1136003 - DNA, 22 bp, Homo sapiens
agaaagtgcctgacacactaac

SEQ ID NO: 1136004 - DNA, 23 bp, Homo sapiens
agaaagtggaaaacaaggaagtc

SEQ ID NO: 1136005 - DNA, 16 bp, Homo sapiens
agaaagtgggaggtca

SEQ ID NO: 1136006 - DNA, 19 bp, Homo sapiens
agaaagtgggaggtcagga

SEQ ID NO: 1136007 - DNA, 11 bp, Homo sapiens
agaaagtgtat

SEQ ID NO: 1136008 - DNA, 13 bp, Homo sapiens
agaaagtgtattt

SEQ ID NO: 1136009 - DNA, 17 bp, Homo sapiens
agaaagtgtgagcaaac

SEQ ID NO: 1136010 - DNA, 22 bp, Homo sapiens
agaaagtgtgtgtgttctgtag

SEQ ID NO: 1136011 - DNA, 20 bp, Homo sapiens
agaaagttattcttggtact

SEQ ID NO: 1136012 - DNA, 21 bp, Homo sapiens
agaaagttccaaatgtttata

SEQ ID NO: 1136013 - DNA, 17 bp, Homo sapiens
agaaataaaaggaagcc

SEQ ID NO: 1136014 - DNA, 22 bp, Homo sapiens
agaaataaaatatctccaaatg

SEQ ID NO: 1136015 - DNA, 14 bp, Homo sapiens
agaaataaacctta

SEQ ID NO: 1136016 - DNA, 16 bp, Homo sapiens
agaaataaaccttaat

SEQ ID NO: 1136017 - DNA, 18 bp, Homo sapiens
agaaataaagtttgctta

SEQ ID NO: 1136018 - DNA, 21 bp, Homo sapiens
agaaataaagtttgcttagaa

SEQ ID NO: 1136019 - DNA, 14 bp, Homo sapiens
agaaataaatcaga

SEQ ID NO: 1136020 - DNA, 22 bp, Homo sapiens
agaaataacagaagaaaataga

SEQ ID NO: 1136021 - DNA, 13 bp, Homo sapiens
agaaataagaatt

SEQ ID NO: 1136022 - DNA, 15 bp, Homo sapiens
agaaataatggtctt

SEQ ID NO: 1136023 - DNA, 14 bp, Homo sapiens
agaaatacaaaata

SEQ ID NO: 1136024 - DNA, 19 bp, Homo sapiens
agaaatacaattctacatt

SEQ ID NO: 1136025 - DNA, 14 bp, Homo sapiens
agaaatacagctgg

SEQ ID NO: 1136026 - DNA, 15 bp, Homo sapiens
agaaatacagctggc

SEQ ID NO: 1136027 - DNA, 16 bp, Homo sapiens
agaaatacagctggct

SEQ ID NO: 1136028 - DNA, 12 bp, Homo sapiens
agaaatacagtc

SEQ ID NO: 1136029 - DNA, 15 bp, Homo sapiens
agaaatacctgtcta

SEQ ID NO: 1136030 - DNA, 14 bp, Homo sapiens
agaaatactcatgt

SEQ ID NO: 1136031 - DNA, 15 bp, Homo sapiens
agaaatactcatgtg

SEQ ID NO: 1136032 - DNA, 14 bp, Homo sapiens
agaaatagacaaaa

SEQ ID NO: 1136033 - DNA, 22 bp, Homo sapiens
agaaataggtatcaaaatagtt

SEQ ID NO: 1136034 - DNA, 14 bp, Homo sapiens
agaaataggttaaa

SEQ ID NO: 1136035 - DNA, 16 bp, Homo sapiens
agaaatatattttttg

SEQ ID NO: 1136036 - DNA, 15 bp, Homo sapiens
agaaatatctgtgaa

SEQ ID NO: 1136037 - DNA, 23 bp, Homo sapiens
agaaatatctgtgaaatatcatc

SEQ ID NO: 1136038 - DNA, 20 bp, Homo sapiens
agaaatatctttctcttacc

SEQ ID NO: 1136039 - DNA, 22 bp, Homo sapiens
agaaatatgattttatttgaca

SEQ ID NO: 1136040 - DNA, 22 bp, Homo sapiens
agaaatatggaacttacattgt

SEQ ID NO: 1136041 - DNA, 14 bp, Homo sapiens
agaaatatggacac

SEQ ID NO: 1136042 - DNA, 17 bp, Homo sapiens
agaaatatggacactta

SEQ ID NO: 1136043 - DNA, 18 bp, Homo sapiens
agaaatattccaaatgtc

SEQ ID NO: 1136044 - DNA, 12 bp, Homo sapiens
agaagagacagg

SEQ ID NO: 1136045 - DNA, 20 bp, Homo sapiens
agaagagaggggaagaattt

SEQ ID NO: 1136046 - DNA, 21 bp, Homo sapiens
agaagagaggggaagaattta

SEQ ID NO: 1136047 - DNA, 23 bp, Homo sapiens
agaagagaggggaagaatttaat

SEQ ID NO: 1136048 - DNA, 20 bp, Homo sapiens
agaagagatgcactatatgt

SEQ ID NO: 1136049 - DNA, 17 bp, Homo sapiens
agaagagcacagagccc

SEQ ID NO: 1136050 - DNA, 12 bp, Homo sapiens
agaagagccctg

SEQ ID NO: 1136051 - DNA, 20 bp, Homo sapiens
agaagagcttgcacagccaa

SEQ ID NO: 1136052 - DNA, 13 bp, Homo sapiens
agaagaggaagaa

SEQ ID NO: 1136053 - DNA, 22 bp, Homo sapiens
agaagaggaagaaattcaggta

SEQ ID NO: 1136054 - DNA, 13 bp, Homo sapiens
agaagaggaggag

SEQ ID NO: 1136055 - DNA, 15 bp, Homo sapiens
agaagaggaggaggt

SEQ ID NO: 1136056 - DNA, 15 bp, Homo sapiens
agaagaggcaagtgg

SEQ ID NO: 1136057 - DNA, 16 bp, Homo sapiens
agaagagggcccagcc

SEQ ID NO: 1136058 - DNA, 17 bp, Homo sapiens
agaagagggcccagccc

SEQ ID NO: 1136059 - DNA, 19 bp, Homo sapiens
agaagagggcccagcccag

SEQ ID NO: 1136060 - DNA, 14 bp, Homo sapiens
agaagagggcctgt

SEQ ID NO: 1136061 - DNA, 16 bp, Homo sapiens
agaagagggcctgtgg

SEQ ID NO: 1136062 - DNA, 17 bp, Homo sapiens
agaagagggtgtgtttg

SEQ ID NO: 1136063 - DNA, 14 bp, Homo sapiens
agaagagtattttt

SEQ ID NO: 1136064 - DNA, 19 bp, Homo sapiens
agaagagttttagagaaaa

SEQ ID NO: 1136065 - DNA, 20 bp, Homo sapiens
agaagagtttttattacaaa

SEQ ID NO: 1136066 - DNA, 14 bp, Homo sapiens
agaagataatcatt

SEQ ID NO: 1136067 - DNA, 20 bp, Homo sapiens
agaagataatcattgcttat

SEQ ID NO: 1136068 - DNA, 15 bp, Homo sapiens
agaagatagggaaca

SEQ ID NO: 1136069 - DNA, 20 bp, Homo sapiens
agaagatatattaaatgtag

SEQ ID NO: 1136070 - DNA, 16 bp, Homo sapiens
agaagatgaatggtct

SEQ ID NO: 1136071 - DNA, 16 bp, Homo sapiens
agaagatgccagcttc

SEQ ID NO: 1136072 - DNA, 14 bp, Homo sapiens
agaagatgtgtaaa

SEQ ID NO: 1136073 - DNA, 18 bp, Homo sapiens
agaagatgtgtaaacagg

SEQ ID NO: 1136074 - DNA, 17 bp, Homo sapiens
agaagattcccacccct

SEQ ID NO: 1136075 - DNA, 17 bp, Homo sapiens
agaagatttcagagctg

SEQ ID NO: 1136076 - DNA, 22 bp, Homo sapiens
agaagatttgatgctggagagg

SEQ ID NO: 1136077 - DNA, 18 bp, Homo sapiens
agaagattttgaaatttt

SEQ ID NO: 1136078 - DNA, 18 bp, Homo sapiens
agaagcaaagatttcagt

SEQ ID NO: 1136079 - DNA, 23 bp, Homo sapiens
agaagcaacctcagtaatttaga

SEQ ID NO: 1136080 - DNA, 13 bp, Homo sapiens
agaagcaagccag

SEQ ID NO: 1136081 - DNA, 22 bp, Homo sapiens
agaagcaatctttgaaataaaa

SEQ ID NO: 1136082 - DNA, 18 bp, Homo sapiens
agaagcacagctcctgcc

SEQ ID NO: 1136083 - DNA, 21 bp, Homo sapiens
agaagcacagctcctgccagg

SEQ ID NO: 1136084 - DNA, 13 bp, Homo sapiens
agaagcacatgtg

SEQ ID NO: 1136085 - DNA, 13 bp, Homo sapiens
agaagcagcccct

SEQ ID NO: 1136086 - DNA, 18 bp, Homo sapiens
agaagcagcccctcgagg

SEQ ID NO: 1136087 - DNA, 24 bp, Homo sapiens
agaagcagcccctcgaggcctaca

SEQ ID NO: 1136088 - DNA, 15 bp, Homo sapiens
agaagcagcttcttt

SEQ ID NO: 1136089 - DNA, 14 bp, Homo sapiens
agaagcagtgagcc

SEQ ID NO: 1136090 - DNA, 23 bp, Homo sapiens
agaagcagtgagccgcatcttct

SEQ ID NO: 1136091 - DNA, 18 bp, Homo sapiens
agaagcattaacttctct

SEQ ID NO: 1136092 - DNA, 10 bp, Homo sapiens
agaagcattt

SEQ ID NO: 1136093 - DNA, 21 bp, Homo sapiens
agaagcatttgatattatcta

SEQ ID NO: 1136094 - DNA, 13 bp, Homo sapiens
agaagcatttgta

SEQ ID NO: 1136095 - DNA, 19 bp, Homo sapiens
agaagcatttgtattttgt

SEQ ID NO: 1136096 - DNA, 18 bp, Homo sapiens
agaagccaactatgatta

SEQ ID NO: 1136097 - DNA, 21 bp, Homo sapiens
agaagccaagctccctggagc

SEQ ID NO: 1136098 - DNA, 18 bp, Homo sapiens
agaagccaagggaaaggg

SEQ ID NO: 1136099 - DNA, 19 bp, Homo sapiens
agaagccacatcgttgaga

SEQ ID NO: 1136100 - DNA, 20 bp, Homo sapiens
agaagccacgctgtcctctc

SEQ ID NO: 1136101 - DNA, 14 bp, Homo sapiens
agaagccagaaggt

SEQ ID NO: 1136102 - DNA, 14 bp, Homo sapiens
agaagccaggaggc

SEQ ID NO: 1136103 - DNA, 22 bp, Homo sapiens
agaagccaggaggcctgcacca

SEQ ID NO: 1136104 - DNA, 23 bp, Homo sapiens
agaagccatatatgaccagaagc

SEQ ID NO: 1136105 - DNA, 23 bp, Homo sapiens
agaagccatctgacagcaggcca

SEQ ID NO: 1136106 - DNA, 22 bp, Homo sapiens
agaagccatggaaaaacttcct

SEQ ID NO: 1136107 - DNA, 14 bp, Homo sapiens
agaagccatgggac

SEQ ID NO: 1136108 - DNA, 21 bp, Homo sapiens
agaagcccaatattataattt

SEQ ID NO: 1136109 - DNA, 21 bp, Homo sapiens
agaagcccatgtcttctgctg

SEQ ID NO: 1136110 - DNA, 24 bp, Homo sapiens
agaagcccatgtcttctgctgttc

SEQ ID NO: 1136111 - DNA, 17 bp, Homo sapiens
agaagccccacagcctg

SEQ ID NO: 1136112 - DNA, 18 bp, Homo sapiens
agaagccctgcagagcac

SEQ ID NO: 1136113 - DNA, 21 bp, Homo sapiens
agaagccgagagccttttgtg

SEQ ID NO: 1136114 - DNA, 16 bp, Homo sapiens
agaagccgggaacaga

SEQ ID NO: 1136115 - DNA, 14 bp, Homo sapiens
agaagcctgaggct

SEQ ID NO: 1136116 - DNA, 17 bp, Homo sapiens
agaagcctgaggctggg

SEQ ID NO: 1136117 - DNA, 14 bp, Homo sapiens
agaagccttcagct

SEQ ID NO: 1136118 - DNA, 19 bp, Homo sapiens
agaagccttcagctccagg

SEQ ID NO: 1136119 - DNA, 18 bp, Homo sapiens
agaagcgtttttaacctg

SEQ ID NO: 1136120 - DNA, 20 bp, Homo sapiens
agaagcgtttttaacctgtt

SEQ ID NO: 1136121 - DNA, 18 bp, Homo sapiens
agaagctaaggtttagat

SEQ ID NO: 1136122 - DNA, 22 bp, Homo sapiens
agaagctacccctcaaactgca

SEQ ID NO: 1136123 - DNA, 18 bp, Homo sapiens
agaagctagatgcccctg

SEQ ID NO: 1136124 - DNA, 21 bp, Homo sapiens
agaagctataaattcctcttt

SEQ ID NO: 1136125 - DNA, 13 bp, Homo sapiens
agaagctcagctg

SEQ ID NO: 1136126 - DNA, 17 bp, Homo sapiens
agaagctcagctgcatt

SEQ ID NO: 1136127 - DNA, 17 bp, Homo sapiens
agaagctcccaggaaca

SEQ ID NO: 1136128 - DNA, 16 bp, Homo sapiens
actgaaaacttagcca

SEQ ID NO: 1136129 - DNA, 17 bp, Homo sapiens
actgaaaacttagccag

SEQ ID NO: 1136130 - DNA, 16 bp, Homo sapiens
actgaaaagaaggaaa

SEQ ID NO: 1136131 - DNA, 16 bp, Homo sapiens
actgaaaatctaatat

SEQ ID NO: 1136132 - DNA, 23 bp, Homo sapiens
actgaaaatctaatattaaaaat

SEQ ID NO: 1136133 - DNA, 13 bp, Homo sapiens
actgaaaatgtaa

SEQ ID NO: 1136134 - DNA, 14 bp, Homo sapiens
actgaaaatgtaaa

SEQ ID NO: 1136135 - DNA, 16 bp, Homo sapiens
actgaaaatgtaaatt

SEQ ID NO: 1136136 - DNA, 15 bp, Homo sapiens
actgaaaccattttc

SEQ ID NO: 1136137 - DNA, 15 bp, Homo sapiens
actgaaacctgagat

SEQ ID NO: 1136138 - DNA, 18 bp, Homo sapiens
actgaaacgtattcagag

SEQ ID NO: 1136139 - DNA, 21 bp, Homo sapiens
actgaaagaagaaaacagtac

SEQ ID NO: 1136140 - DNA, 19 bp, Homo sapiens
actgaaagcagcagctagg

SEQ ID NO: 1136141 - DNA, 20 bp, Homo sapiens
actgaaagccttagggaagc

SEQ ID NO: 1136142 - DNA, 20 bp, Homo sapiens
actgaaaggcagaactcaga

SEQ ID NO: 1136143 - DNA, 17 bp, Homo sapiens
actgaaagttttgtaaa

SEQ ID NO: 1136144 - DNA, 17 bp, Homo sapiens
actgaaatgaccaagac

SEQ ID NO: 1136145 - DNA, 17 bp, Homo sapiens
actgaaatgcctgcttt

SEQ ID NO: 1136146 - DNA, 16 bp, Homo sapiens
actgaaatttaagaaa

SEQ ID NO: 1136147 - DNA, 21 bp, Homo sapiens
actgaaatttgttatacttca

SEQ ID NO: 1136148 - DNA, 12 bp, Homo sapiens
actgaacaaaac

SEQ ID NO: 1136149 - DNA, 15 bp, Homo sapiens
actgaacaaaaccta

SEQ ID NO: 1136150 - DNA, 15 bp, Homo sapiens
actgaacacatgtgt

SEQ ID NO: 1136151 - DNA, 20 bp, Homo sapiens
actgaacacatgtgtatgat

SEQ ID NO: 1136152 - DNA, 14 bp, Homo sapiens
actgaacatgttta

SEQ ID NO: 1136153 - DNA, 16 bp, Homo sapiens
actgaacatgtttaca

SEQ ID NO: 1136154 - DNA, 20 bp, Homo sapiens
actgaaccactgcttctctt

SEQ ID NO: 1136155 - DNA, 22 bp, Homo sapiens
actgaactagcaattggttgtt

SEQ ID NO: 1136156 - DNA, 18 bp, Homo sapiens
actgaactcactttcctc

SEQ ID NO: 1136157 - DNA, 21 bp, Homo sapiens
actgaacttcaggataataaa

SEQ ID NO: 1136158 - DNA, 22 bp, Homo sapiens
actgaagaagtcactgaacaaa

SEQ ID NO: 1136159 - DNA, 15 bp, Homo sapiens
actgaagaattttga

SEQ ID NO: 1136160 - DNA, 12 bp, Homo sapiens
actgaagagtaa

SEQ ID NO: 1136161 - DNA, 19 bp, Homo sapiens
actgaagatgaaatatata

SEQ ID NO: 1136162 - DNA, 19 bp, Homo sapiens
actgaagccacttggccca

SEQ ID NO: 1136163 - DNA, 21 bp, Homo sapiens
actgaagccacttggcccaga

SEQ ID NO: 1136164 - DNA, 15 bp, Homo sapiens
actgaagcctgcagg

SEQ ID NO: 1136165 - DNA, 21 bp, Homo sapiens
actgaagccttcttctgccac

SEQ ID NO: 1136166 - DNA, 18 bp, Homo sapiens
actgaaggaaaaacacaa

SEQ ID NO: 1136167 - DNA, 20 bp, Homo sapiens
actgaaggaaaagcaagaaa

SEQ ID NO: 1136168 - DNA, 11 bp, Homo sapiens
actgaaggaga

SEQ ID NO: 1136169 - DNA, 13 bp, Homo sapiens
actgaaggagaag

SEQ ID NO: 1136170 - DNA, 20 bp, Homo sapiens
actgaaggggcacaccactg

SEQ ID NO: 1136171 - DNA, 19 bp, Homo sapiens
actgaagtcttttctgtca

SEQ ID NO: 1136172 - DNA, 21 bp, Homo sapiens
actgaagtggctggtagaaaa

SEQ ID NO: 1136173 - DNA, 19 bp, Homo sapiens
actgaataaactcaaaact

SEQ ID NO: 1136174 - DNA, 23 bp, Homo sapiens
actgaataaggagaagagtattt

SEQ ID NO: 1136175 - DNA, 12 bp, Homo sapiens
actgaatatata

SEQ ID NO: 1136176 - DNA, 18 bp, Homo sapiens
actgaatatttatatttc

SEQ ID NO: 1136177 - DNA, 18 bp, Homo sapiens
actgaatattttggaaac

SEQ ID NO: 1136178 - DNA, 18 bp, Homo sapiens
actgaatctatggcttta

SEQ ID NO: 1136179 - DNA, 20 bp, Homo sapiens
actgaatgaagcagtatttt

SEQ ID NO: 1136180 - DNA, 21 bp, Homo sapiens
actgaatgaagcagtattttg

SEQ ID NO: 1136181 - DNA, 17 bp, Homo sapiens
actgaatgtcagggctg

SEQ ID NO: 1136182 - DNA, 14 bp, Homo sapiens
actgaatgtcattg

SEQ ID NO: 1136183 - DNA, 14 bp, Homo sapiens
actgaatgttttat

SEQ ID NO: 1136184 - DNA, 23 bp, Homo sapiens
agaatattagctttactgtttgt

SEQ ID NO: 1136185 - DNA, 15 bp, Homo sapiens
agaatattcaaaatt

SEQ ID NO: 1136186 - DNA, 13 bp, Homo sapiens
agaatattgcaaa

SEQ ID NO: 1136187 - DNA, 15 bp, Homo sapiens
agaatattgcaaaat

SEQ ID NO: 1136188 - DNA, 19 bp, Homo sapiens
agaatattgcaaaatacat

SEQ ID NO: 1136189 - DNA, 21 bp, Homo sapiens
agaatattgcaaaatacatga

SEQ ID NO: 1136190 - DNA, 22 bp, Homo sapiens
agaatatttattacctctgata

SEQ ID NO: 1136191 - DNA, 21 bp, Homo sapiens
agaatatttttatatttcctt

SEQ ID NO: 1136192 - DNA, 14 bp, Homo sapiens
agaatcaacagatg

SEQ ID NO: 1136193 - DNA, 15 bp, Homo sapiens
agaatcaacagatga

SEQ ID NO: 1136194 - DNA, 23 bp, Homo sapiens
agaatcaactaggtatttaagac

SEQ ID NO: 1136195 - DNA, 17 bp, Homo sapiens
agaatcacttaagcctg

SEQ ID NO: 1136196 - DNA, 16 bp, Homo sapiens
agaatcaggttgcaaa

SEQ ID NO: 1136197 - DNA, 19 bp, Homo sapiens
agaatcagtcttgcagctg

SEQ ID NO: 1136198 - DNA, 19 bp, Homo sapiens
agaatcatgctgttgcatt

SEQ ID NO: 1136199 - DNA, 21 bp, Homo sapiens
agaatcatgctgttgcattta

SEQ ID NO: 1136200 - DNA, 18 bp, Homo sapiens
agaatcatggagaaaatg

SEQ ID NO: 1136201 - DNA, 21 bp, Homo sapiens
agaatcatgtgaacccgggac

SEQ ID NO: 1136202 - DNA, 14 bp, Homo sapiens
agaatcattgctta

SEQ ID NO: 1136203 - DNA, 18 bp, Homo sapiens
agaatcccaaatttgatt

SEQ ID NO: 1136204 - DNA, 18 bp, Homo sapiens
agaatcccactttctata

SEQ ID NO: 1136205 - DNA, 23 bp, Homo sapiens
agaatcccagccggccaatggaa

SEQ ID NO: 1136206 - DNA, 15 bp, Homo sapiens
agaatccctgttcat

SEQ ID NO: 1136207 - DNA, 17 bp, Homo sapiens
agaatcccttaaaatta

SEQ ID NO: 1136208 - DNA, 19 bp, Homo sapiens
agaatcccttaaaattacc

SEQ ID NO: 1136209 - DNA, 20 bp, Homo sapiens
agaatcccttaaaattacca

SEQ ID NO: 1136210 - DNA, 15 bp, Homo sapiens
agaatcctttacatt

SEQ ID NO: 1136211 - DNA, 23 bp, Homo sapiens
agaatcgatgggggatgcttcat

SEQ ID NO: 1136212 - DNA, 20 bp, Homo sapiens
agaatctaaaccttacatgt

SEQ ID NO: 1136213 - DNA, 13 bp, Homo sapiens
agaatctagaaga

SEQ ID NO: 1136214 - DNA, 17 bp, Homo sapiens
agaatctagaagatgtg

SEQ ID NO: 1136215 - DNA, 21 bp, Homo sapiens
agaatctagaagatgtgtaaa

SEQ ID NO: 1136216 - DNA, 23 bp, Homo sapiens
agaatctcttcatgcttgacata

SEQ ID NO: 1136217 - DNA, 14 bp, Homo sapiens
agaatctgagacat

SEQ ID NO: 1136218 - DNA, 20 bp, Homo sapiens
agaatctgctgttgccatag

SEQ ID NO: 1136219 - DNA, 13 bp, Homo sapiens
agaatctgggggt

SEQ ID NO: 1136220 - DNA, 18 bp, Homo sapiens
agaatcttaatgcttgta

SEQ ID NO: 1136221 - DNA, 18 bp, Homo sapiens
agaatcttgactttctga

SEQ ID NO: 1136222 - DNA, 22 bp, Homo sapiens
agaatcttgactttctgattgg

SEQ ID NO: 1136223 - DNA, 18 bp, Homo sapiens
agaatctttattgagaaa

SEQ ID NO: 1136224 - DNA, 24 bp, Homo sapiens
agaatctttattgagaaagagcac

SEQ ID NO: 1136225 - DNA, 12 bp, Homo sapiens
agaatcttttaa

SEQ ID NO: 1136226 - DNA, 13 bp, Homo sapiens
agaatcttttaaa

SEQ ID NO: 1136227 - DNA, 15 bp, Homo sapiens
agaatgaaatgtatg

SEQ ID NO: 1136228 - DNA, 16 bp, Homo sapiens
agaatgaaatgtatgt

SEQ ID NO: 1136229 - DNA, 17 bp, Homo sapiens
agaatgaaatgtatgtg

SEQ ID NO: 1136230 - DNA, 21 bp, Homo sapiens
agaatgaaccctcctcctttt

SEQ ID NO: 1136231 - DNA, 23 bp, Homo sapiens
agaatgaactgtggaatttattg

SEQ ID NO: 1136232 - DNA, 15 bp, Homo sapiens
agaatgaatttatct

SEQ ID NO: 1136233 - DNA, 21 bp, Homo sapiens
agaatgagagcgacacagacg

SEQ ID NO: 1136234 - DNA, 22 bp, Homo sapiens
agaatgagggaaattgctattt

SEQ ID NO: 1136235 - DNA, 16 bp, Homo sapiens
agaatgagggccaaga

SEQ ID NO: 1136236 - DNA, 15 bp, Homo sapiens
agaatgagtgcaggt

SEQ ID NO: 1136237 - DNA, 15 bp, Homo sapiens
agaatgagtgggaat

SEQ ID NO: 1136238 - DNA, 12 bp, Homo sapiens
agaatgatgcta

SEQ ID NO: 1136239 - DNA, 16 bp, Homo sapiens
agaatgatgttttaaa

SEQ ID NO: 1136240 - DNA, 17 bp, Homo sapiens
agaatgatgttttaaaa

SEQ ID NO: 1136241 - DNA, 22 bp, Homo sapiens
agaatgatgttttaaaaaaatt

SEQ ID NO: 1136242 - DNA, 14 bp, Homo sapiens
agaatgattaatca

SEQ ID NO: 1136243 - DNA, 20 bp, Homo sapiens
agaatgatttgtaaatagct

SEQ ID NO: 1136244 - DNA, 17 bp, Homo sapiens
agaatgcacaagaatgg

SEQ ID NO: 1136245 - DNA, 20 bp, Homo sapiens
agaatgcacaagaatggatc

SEQ ID NO: 1136246 - DNA, 19 bp, Homo sapiens
agaatgcagattcctgggc

SEQ ID NO: 1136247 - DNA, 22 bp, Homo sapiens
agaatgcagattcctgggcctg

SEQ ID NO: 1136248 - DNA, 20 bp, Homo sapiens
agaatgcagcccaccaggag

SEQ ID NO: 1136249 - DNA, 17 bp, Homo sapiens
agaatgcatctcatcaa

SEQ ID NO: 1136250 - DNA, 13 bp, Homo sapiens
agaatgcattaaa

SEQ ID NO: 1136251 - DNA, 16 bp, Homo sapiens
agaatgcattcaaaat

SEQ ID NO: 1136252 - DNA, 16 bp, Homo sapiens
agaatgcattccctga

SEQ ID NO: 1136253 - DNA, 21 bp, Homo sapiens
agaatgcattccctgaatctg

SEQ ID NO: 1136254 - DNA, 14 bp, Homo sapiens
agaatgccatttct

SEQ ID NO: 1136255 - DNA, 21 bp, Homo sapiens
agaatgccatttctcacgccc

SEQ ID NO: 1136256 - DNA, 18 bp, Homo sapiens
agaatgccgaggagttgt

SEQ ID NO: 1136257 - DNA, 13 bp, Homo sapiens
agaatgctggttt

SEQ ID NO: 1136258 - DNA, 13 bp, Homo sapiens
agaatgctgtaca

SEQ ID NO: 1136259 - DNA, 20 bp, Homo sapiens
agaatgctgtacatctattt

SEQ ID NO: 1136260 - DNA, 16 bp, Homo sapiens
agaatggaagcctgaa

SEQ ID NO: 1136261 - DNA, 18 bp, Homo sapiens
agaatggaatccatctgt

SEQ ID NO: 1136262 - DNA, 13 bp, Homo sapiens
agaatggagaaag

SEQ ID NO: 1136263 - DNA, 19 bp, Homo sapiens
agaatggagaaagtaagtc

SEQ ID NO: 1136264 - DNA, 22 bp, Homo sapiens
agaatggagaaagtaagtcttt

SEQ ID NO: 1136265 - DNA, 14 bp, Homo sapiens
agaatggagacaga

SEQ ID NO: 1136266 - DNA, 19 bp, Homo sapiens
agaatggatcacaagatgg

SEQ ID NO: 1136267 - DNA, 18 bp, Homo sapiens
agaatggcatttgcaata

SEQ ID NO: 1136268 - DNA, 21 bp, Homo sapiens
agaatggcatttgcaataaaa

SEQ ID NO: 1136269 - DNA, 13 bp, Homo sapiens
agaatggctgcac

SEQ ID NO: 1136270 - DNA, 19 bp, Homo sapiens
agaatggctgggtcagggc

SEQ ID NO: 1136271 - DNA, 23 bp, Homo sapiens
agaatggctttcaataccctttt

SEQ ID NO: 1136272 - DNA, 16 bp, Homo sapiens
agaatgggagaaaatt

SEQ ID NO: 1136273 - DNA, 22 bp, Homo sapiens
agaatgggggctttcggggagg

SEQ ID NO: 1136274 - DNA, 20 bp, Homo sapiens
agaatggtgtgaacccggga

SEQ ID NO: 1136275 - DNA, 23 bp, Homo sapiens
agaatggttgccttaaagaaagt

SEQ ID NO: 1136276 - DNA, 12 bp, Homo sapiens
agaatgtaaagc

SEQ ID NO: 1136277 - DNA, 13 bp, Homo sapiens
agaatgtaaagct

SEQ ID NO: 1136278 - DNA, 16 bp, Homo sapiens
agaatgtaaagcttgt

SEQ ID NO: 1136279 - DNA, 16 bp, Homo sapiens
agaatgtagtcagact

SEQ ID NO: 1136280 - DNA, 23 bp, Homo sapiens
agaatgtagtcagactgacacta

SEQ ID NO: 1136281 - DNA, 21 bp, Homo sapiens
agaatgtatccccaaaagcgt

SEQ ID NO: 1136282 - DNA, 17 bp, Homo sapiens
agaatgtatctgtgaag

SEQ ID NO: 1136283 - DNA, 23 bp, Homo sapiens
agaatgtattttcatagatgtgt

SEQ ID NO: 1136284 - DNA, 19 bp, Homo sapiens
agaatgtcactgtagtttt

SEQ ID NO: 1136285 - DNA, 17 bp, Homo sapiens
agaatgtcagatttctg

SEQ ID NO: 1136286 - DNA, 22 bp, Homo sapiens
agaatgtcagatttctggttga

SEQ ID NO: 1136287 - DNA, 16 bp, Homo sapiens
agaatgtctgaagtac

SEQ ID NO: 1136288 - DNA, 22 bp, Homo sapiens
agaatgtctgaagtacaaacat

SEQ ID NO: 1136289 - DNA, 21 bp, Homo sapiens
agaatgtgtgtgtgtggcagg

SEQ ID NO: 1136290 - DNA, 20 bp, Homo sapiens
agaatgttaatttattttgc

SEQ ID NO: 1136291 - DNA, 15 bp, Homo sapiens
agaatgttagagtaa

SEQ ID NO: 1136292 - DNA, 17 bp, Homo sapiens
agaatgttagtaaagga

SEQ ID NO: 1136293 - DNA, 19 bp, Homo sapiens
agaatgttccagacattct

SEQ ID NO: 1136294 - DNA, 16 bp, Homo sapiens
agaatgttgtacttga

SEQ ID NO: 1136295 - DNA, 15 bp, Homo sapiens
agaatgttgtattca

SEQ ID NO: 1136296 - DNA, 18 bp, Homo sapiens
agaatgttgtattcagtg

SEQ ID NO: 1136297 - DNA, 19 bp, Homo sapiens
agaatgttgtattcagtga

SEQ ID NO: 1136298 - DNA, 13 bp, Homo sapiens
agaatgtttcatt

SEQ ID NO: 1136299 - DNA, 12 bp, Homo sapiens
agaattaaaact

SEQ ID NO: 1136300 - DNA, 22 bp, Homo sapiens
agaattaagcagaacactgcag

SEQ ID NO: 1136301 - DNA, 20 bp, Homo sapiens
agaattaccattaattacat

SEQ ID NO: 1136302 - DNA, 18 bp, Homo sapiens
agaattaccatttgttaa

SEQ ID NO: 1136303 - DNA, 20 bp, Homo sapiens
agaattactatttactttat

SEQ ID NO: 1136304 - DNA, 15 bp, Homo sapiens
agaattagtatgtct

SEQ ID NO: 1136305 - DNA, 17 bp, Homo sapiens
agaattagtatgtctgt

SEQ ID NO: 1136306 - DNA, 17 bp, Homo sapiens
agaattagtgccagaat

SEQ ID NO: 1136307 - DNA, 21 bp, Homo sapiens
agaattagtgccagaatttta

SEQ ID NO: 1136308 - DNA, 20 bp, Homo sapiens
agaattataattagttcctc

SEQ ID NO: 1136309 - DNA, 13 bp, Homo sapiens
agaattatatagg

SEQ ID NO: 1136310 - DNA, 22 bp, Homo sapiens
agaattatataggttgtgcaaa

SEQ ID NO: 1136311 - DNA, 23 bp, Homo sapiens
agaattatccattacgtgcattt

SEQ ID NO: 1136312 - DNA, 17 bp, Homo sapiens
agaattatctaatttat

SEQ ID NO: 1136313 - DNA, 20 bp, Homo sapiens
agaattatctaatttataaa

SEQ ID NO: 1136314 - DNA, 21 bp, Homo sapiens
agaattatctaatttataaaa

SEQ ID NO: 1136315 - DNA, 14 bp, Homo sapiens
agaattatgtaata

SEQ ID NO: 1136316 - DNA, 20 bp, Homo sapiens
agaattatgtaatatattgt

SEQ ID NO: 1136317 - DNA, 19 bp, Homo sapiens
agaattattcagtgaattt

SEQ ID NO: 1136318 - DNA, 14 bp, Homo sapiens
agaattatttttca

SEQ ID NO: 1136319 - DNA, 16 bp, Homo sapiens
agaattatttttgtgt

SEQ ID NO: 1136320 - DNA, 20 bp, Homo sapiens
agaattcaaactggggcctc

SEQ ID NO: 1136321 - DNA, 20 bp, Homo sapiens
agaattcacacaactacttt

SEQ ID NO: 1136322 - DNA, 18 bp, Homo sapiens
agaattcagaagacccct

SEQ ID NO: 1136323 - DNA, 18 bp, Homo sapiens
agaattcattcatactta

SEQ ID NO: 1136324 - DNA, 14 bp, Homo sapiens
agaattccaaggag

SEQ ID NO: 1136325 - DNA, 20 bp, Homo sapiens
agaattccaaggagttccat

SEQ ID NO: 1136326 - DNA, 21 bp, Homo sapiens
agaattcccttgaattgtgta

SEQ ID NO: 1136327 - DNA, 22 bp, Homo sapiens
agaattcccttgaattgtgtat

SEQ ID NO: 1136328 - DNA, 20 bp, Homo sapiens
agaattccttcgaaaggcct

SEQ ID NO: 1136329 - DNA, 19 bp, Homo sapiens
agaattcggtgtgctgcca

SEQ ID NO: 1136330 - DNA, 14 bp, Homo sapiens
agaattctagtgct

SEQ ID NO: 1136331 - DNA, 20 bp, Homo sapiens
agaattctcagaatctcaaa

SEQ ID NO: 1136332 - DNA, 18 bp, Homo sapiens
agaattctggtgtttaca

SEQ ID NO: 1136333 - DNA, 20 bp, Homo sapiens
agaattcttacatgttttct

SEQ ID NO: 1136334 - DNA, 19 bp, Homo sapiens
agaattgacattgaaatct

SEQ ID NO: 1136335 - DNA, 10 bp, Homo sapiens
agaattgact

SEQ ID NO: 1136336 - DNA, 19 bp, Homo sapiens
agaattgactgcagttgaa

SEQ ID NO: 1136337 - DNA, 17 bp, Homo sapiens
agaattgagtaatggtg

SEQ ID NO: 1136338 - DNA, 14 bp, Homo sapiens
agaattgagtgttt

SEQ ID NO: 1136339 - DNA, 13 bp, Homo sapiens
agaattggctcaa

SEQ ID NO: 1136340 - DNA, 13 bp, Homo sapiens
agaattgggaagc

SEQ ID NO: 1136341 - DNA, 22 bp, Homo sapiens
agaattgtatctcatactgtct

SEQ ID NO: 1136342 - DNA, 23 bp, Homo sapiens
agaattgtatctcatactgtctg

SEQ ID NO: 1136343 - DNA, 15 bp, Homo sapiens
agaattgtctctggg

SEQ ID NO: 1136344 - DNA, 18 bp, Homo sapiens
agaattgtttttgaattt

SEQ ID NO: 1136345 - DNA, 20 bp, Homo sapiens
agaatttaagtagaaaagtt

SEQ ID NO: 1136346 - DNA, 15 bp, Homo sapiens
agaatttaatggact

SEQ ID NO: 1136347 - DNA, 23 bp, Homo sapiens
agaatttaatggactgtgaattt

SEQ ID NO: 1136348 - DNA, 19 bp, Homo sapiens
agaatttagggagaaatgt

SEQ ID NO: 1136349 - DNA, 21 bp, Homo sapiens
agaatttatcacacttctgtg

SEQ ID NO: 1136350 - DNA, 16 bp, Homo sapiens
agaatttatctccctt

SEQ ID NO: 1136351 - DNA, 21 bp, Homo sapiens
agaatttattagtttaaaatg

SEQ ID NO: 1136352 - DNA, 13 bp, Homo sapiens
agaatttctaaag

SEQ ID NO: 1136353 - DNA, 16 bp, Homo sapiens
agaatttctaaagtaa

SEQ ID NO: 1136354 - DNA, 16 bp, Homo sapiens
agaatttctaccattt

SEQ ID NO: 1136355 - DNA, 20 bp, Homo sapiens
agaatttctaccatttcaga

SEQ ID NO: 1136356 - DNA, 21 bp, Homo sapiens
agaatttctaccatttcagag

SEQ ID NO: 1136357 - DNA, 16 bp, Homo sapiens
agaatttctgctaaat

SEQ ID NO: 1136358 - DNA, 18 bp, Homo sapiens
agaatttctgctaaatat

SEQ ID NO: 1136359 - DNA, 22 bp, Homo sapiens
agaatttgaagacttcaaaata

SEQ ID NO: 1136360 - DNA, 18 bp, Homo sapiens
agaatttgagtgctctga

SEQ ID NO: 1136361 - DNA, 13 bp, Homo sapiens
agaatttgcatac

SEQ ID NO: 1136362 - DNA, 15 bp, Homo sapiens
agaatttggaaatcc

SEQ ID NO: 1136363 - DNA, 16 bp, Homo sapiens
agaatttgtatgtatt

SEQ ID NO: 1136364 - DNA, 21 bp, Homo sapiens
agaatttgtgttgaaggaact

SEQ ID NO: 1136365 - DNA, 16 bp, Homo sapiens
agaattttaagtgctt

SEQ ID NO: 1136366 - DNA, 13 bp, Homo sapiens
agaattttaatgt

SEQ ID NO: 1136367 - DNA, 23 bp, Homo sapiens
agaattttaatgtgaagacattt

SEQ ID NO: 1136368 - DNA, 13 bp, Homo sapiens
agaattttagtcc

SEQ ID NO: 1136369 - DNA, 19 bp, Homo sapiens
agaattttatttttctgtg

SEQ ID NO: 1136370 - DNA, 18 bp, Homo sapiens
agaattttgagtattcca

SEQ ID NO: 1136371 - DNA, 20 bp, Homo sapiens
agaattttgttttacttttt

SEQ ID NO: 1136372 - DNA, 13 bp, Homo sapiens
agaatttttaaca

SEQ ID NO: 1136373 - DNA, 15 bp, Homo sapiens
agaatttttttgtct

SEQ ID NO: 1136374 - DNA, 18 bp, Homo sapiens
agacaaaaaaatttaaaa

SEQ ID NO: 1136375 - DNA, 20 bp, Homo sapiens
agacaaaaaaatttaaaatt

SEQ ID NO: 1136376 - DNA, 14 bp, Homo sapiens
agacaaaaagacaa

SEQ ID NO: 1136377 - DNA, 15 bp, Homo sapiens
agacaaaaagacaaa

SEQ ID NO: 1136378 - DNA, 21 bp, Homo sapiens
agacaaaaagccttgaagaaa

SEQ ID NO: 1136379 - DNA, 12 bp, Homo sapiens
agacaaaaagta

SEQ ID NO: 1136380 - DNA, 23 bp, Homo sapiens
agacaaaaatcaaagaacagatg

SEQ ID NO: 1136381 - DNA, 13 bp, Homo sapiens
agacaaaaccaaa

SEQ ID NO: 1136382 - DNA, 17 bp, Homo sapiens
agacaaaacgagtcttt

SEQ ID NO: 1136383 - DNA, 14 bp, Homo sapiens
agacaaaagaaact

SEQ ID NO: 1136384 - DNA, 17 bp, Homo sapiens
agacaaaagaaacttac

SEQ ID NO: 1136385 - DNA, 15 bp, Homo sapiens
agacaaaagagcagt

SEQ ID NO: 1136386 - DNA, 17 bp, Homo sapiens
agacaaaatttgagaat

SEQ ID NO: 1136387 - DNA, 18 bp, Homo sapiens
agacaaaatttgagaata

SEQ ID NO: 1136388 - DNA, 15 bp, Homo sapiens
agacaaagcaggagt

SEQ ID NO: 1136389 - DNA, 20 bp, Homo sapiens
agacaaagccttaagcaaat

SEQ ID NO: 1136390 - DNA, 14 bp, Homo sapiens
agacaaaggaggaa

SEQ ID NO: 1136391 - DNA, 16 bp, Homo sapiens
agacaaaggaggaatt

SEQ ID NO: 1136392 - DNA, 24 bp, Homo sapiens
agacaaagtcaataaaagagctgt

SEQ ID NO: 1136393 - DNA, 22 bp, Homo sapiens
agacaaatattcctttgcatat

SEQ ID NO: 1136394 - DNA, 16 bp, Homo sapiens
agacaaatatttggag

SEQ ID NO: 1136395 - DNA, 17 bp, Homo sapiens
agacaaatcaacagaag

SEQ ID NO: 1136396 - DNA, 18 bp, Homo sapiens
agacaaatctttaagaat

SEQ ID NO: 1136397 - DNA, 23 bp, Homo sapiens
agacaaatctttaagaatagttc

SEQ ID NO: 1136398 - DNA, 14 bp, Homo sapiens
agacaaatggagga

SEQ ID NO: 1136399 - DNA, 21 bp, Homo sapiens
agacaaattctgtttcttgag

SEQ ID NO: 1136400 - DNA, 14 bp, Homo sapiens
agacaaccaaaaca

SEQ ID NO: 1136401 - DNA, 16 bp, Homo sapiens
agacaaccaaaacata

SEQ ID NO: 1136402 - DNA, 20 bp, Homo sapiens
agacaaccctgcaaaggact

SEQ ID NO: 1136403 - DNA, 14 bp, Homo sapiens
agacaacctttctg

SEQ ID NO: 1136404 - DNA, 15 bp, Homo sapiens
agacaacctttctgt

SEQ ID NO: 1136405 - DNA, 18 bp, Homo sapiens
agacaacgatgaatttct

SEQ ID NO: 1136406 - DNA, 21 bp, Homo sapiens
agacaactatcaattcttgag

SEQ ID NO: 1136407 - DNA, 13 bp, Homo sapiens
agacaagagctgc

SEQ ID NO: 1136408 - DNA, 14 bp, Homo sapiens
agacaagagctgct

SEQ ID NO: 1136409 - DNA, 16 bp, Homo sapiens
agacaagagctgctgt

SEQ ID NO: 1136410 - DNA, 17 bp, Homo sapiens
agacaagatattgtaca

SEQ ID NO: 1136411 - DNA, 21 bp, Homo sapiens
agacaagatattgtacataaa

SEQ ID NO: 1136412 - DNA, 22 bp, Homo sapiens
agacaagatattgtacataaaa

SEQ ID NO: 1136413 - DNA, 14 bp, Homo sapiens
agacaagcaacagg

SEQ ID NO: 1136414 - DNA, 15 bp, Homo sapiens
agacaagccctggca

SEQ ID NO: 1136415 - DNA, 12 bp, Homo sapiens
agacaaggtgct

SEQ ID NO: 1136416 - DNA, 15 bp, Homo sapiens
agacaaggtgctaac

SEQ ID NO: 1136417 - DNA, 20 bp, Homo sapiens
agacaagtgactgtatctgt

SEQ ID NO: 1136418 - DNA, 14 bp, Homo sapiens
agacaatacagtaa

SEQ ID NO: 1136419 - DNA, 13 bp, Homo sapiens
agacaatatacaa

SEQ ID NO: 1136420 - DNA, 15 bp, Homo sapiens
agacaatatacaagc

SEQ ID NO: 1136421 - DNA, 18 bp, Homo sapiens
agacaatatgaacaaact

SEQ ID NO: 1136422 - DNA, 18 bp, Homo sapiens
agacaatatgtgagtgcc

SEQ ID NO: 1136423 - DNA, 20 bp, Homo sapiens
agacaatatgtgagtgcctt

SEQ ID NO: 1136424 - DNA, 21 bp, Homo sapiens
agacaatatgtgagtgccttt

SEQ ID NO: 1136425 - DNA, 13 bp, Homo sapiens
agacaatgactta

SEQ ID NO: 1136426 - DNA, 20 bp, Homo sapiens
agacaatgacttactgtaca

SEQ ID NO: 1136427 - DNA, 18 bp, Homo sapiens
agacaatggacccttttt

SEQ ID NO: 1136428 - DNA, 14 bp, Homo sapiens
agacaatgttttct

SEQ ID NO: 1136429 - DNA, 17 bp, Homo sapiens
agacaatgttttcttca

SEQ ID NO: 1136430 - DNA, 18 bp, Homo sapiens
agacaattagcagaatgg

SEQ ID NO: 1136431 - DNA, 19 bp, Homo sapiens
agacaattagcagaatgga

SEQ ID NO: 1136432 - DNA, 20 bp, Homo sapiens
agacaatttcttctaataaa

SEQ ID NO: 1136433 - DNA, 24 bp, Homo sapiens
agacaattttcataacttgataaa

SEQ ID NO: 1136434 - DNA, 16 bp, Homo sapiens
agacaattttgcttca

SEQ ID NO: 1136435 - DNA, 16 bp, Homo sapiens
agacacaatatgtatg

SEQ ID NO: 1136436 - DNA, 11 bp, Homo sapiens
agacacacaca

SEQ ID NO: 1136437 - DNA, 21 bp, Homo sapiens
agacacacacacgcacgcaca

SEQ ID NO: 1136438 - DNA, 22 bp, Homo sapiens
agacacacacacgcacgcacac

SEQ ID NO: 1136439 - DNA, 14 bp, Homo sapiens
agacacacctgagg

SEQ ID NO: 1136440 - DNA, 17 bp, Homo sapiens
agacacacgcacacaca

SEQ ID NO: 1136441 - DNA, 18 bp, Homo sapiens
agacacacgcacacacac

SEQ ID NO: 1136442 - DNA, 12 bp, Homo sapiens
agacacagactg

SEQ ID NO: 1136443 - DNA, 13 bp, Homo sapiens
agacacagcctcc

SEQ ID NO: 1136444 - DNA, 17 bp, Homo sapiens
agacacaggaaaaataa

SEQ ID NO: 1136445 - DNA, 22 bp, Homo sapiens
agacacagggacttgaagttgt

SEQ ID NO: 1136446 - DNA, 14 bp, Homo sapiens
agacacatatgagg

SEQ ID NO: 1136447 - DNA, 21 bp, Homo sapiens
agacacatgaaggtaaataaa

SEQ ID NO: 1136448 - DNA, 21 bp, Homo sapiens
agacaccatcttttgtgagat

SEQ ID NO: 1136449 - DNA, 20 bp, Homo sapiens
agacacccgattcctgccca

SEQ ID NO: 1136450 - DNA, 17 bp, Homo sapiens
agacacctccccctacc

SEQ ID NO: 1136451 - DNA, 21 bp, Homo sapiens
agacacctccccctacccata

SEQ ID NO: 1136452 - DNA, 14 bp, Homo sapiens
agacacctgcacct

SEQ ID NO: 1136453 - DNA, 14 bp, Homo sapiens
agacacctggactg

SEQ ID NO: 1136454 - DNA, 20 bp, Homo sapiens
agacacctggactgagccaa

SEQ ID NO: 1136455 - DNA, 19 bp, Homo sapiens
agacacctgttcacagaaa

SEQ ID NO: 1136456 - DNA, 21 bp, Homo sapiens
agacacctgttcacagaaaaa

SEQ ID NO: 1136457 - DNA, 21 bp, Homo sapiens
agacacgcacggcagccacag

SEQ ID NO: 1136458 - DNA, 18 bp, Homo sapiens
agacactgaaaaatctaa

SEQ ID NO: 1136459 - DNA, 19 bp, Homo sapiens
agacactgagcttctgaga

SEQ ID NO: 1136460 - DNA, 13 bp, Homo sapiens
agacactgagtca

SEQ ID NO: 1136461 - DNA, 18 bp, Homo sapiens
agacactgatctggctgc

SEQ ID NO: 1136462 - DNA, 20 bp, Homo sapiens
agacactgccacacagggtc

SEQ ID NO: 1136463 - DNA, 10 bp, Homo sapiens
agacactgga

SEQ ID NO: 1136464 - DNA, 12 bp, Homo sapiens
agacactggaca

SEQ ID NO: 1136465 - DNA, 12 bp, Homo sapiens
agacactggttt

SEQ ID NO: 1136466 - DNA, 18 bp, Homo sapiens
agacactggtttacactt

SEQ ID NO: 1136467 - DNA, 11 bp, Homo sapiens
agacactgtga

SEQ ID NO: 1136468 - DNA, 14 bp, Homo sapiens
agacactgttgata

SEQ ID NO: 1136469 - DNA, 18 bp, Homo sapiens
agacactgttgcaaaggt

SEQ ID NO: 1136470 - DNA, 23 bp, Homo sapiens
agacactttggaagtttgtgttc

SEQ ID NO: 1136471 - DNA, 18 bp, Homo sapiens
agacagaaaagtgcctga

SEQ ID NO: 1136472 - DNA, 22 bp, Homo sapiens
agacagaaaagtgcctgagctg

SEQ ID NO: 1136473 - DNA, 11 bp, Homo sapiens
agacagaaact

SEQ ID NO: 1136474 - DNA, 13 bp, Homo sapiens
agacagaaactgg

SEQ ID NO: 1136475 - DNA, 14 bp, Homo sapiens
agacagaaactgga

SEQ ID NO: 1136476 - DNA, 18 bp, Homo sapiens
agacagaacacctatgca

SEQ ID NO: 1136477 - DNA, 17 bp, Homo sapiens
agacagaacccctacat

SEQ ID NO: 1136478 - DNA, 15 bp, Homo sapiens
agacagaagaaacaa

SEQ ID NO: 1136479 - DNA, 16 bp, Homo sapiens
agacagaagaaacaag

SEQ ID NO: 1136480 - DNA, 17 bp, Homo sapiens
agacagaagaaacaagg

SEQ ID NO: 1136481 - DNA, 19 bp, Homo sapiens
agacagaagcaggctggag

SEQ ID NO: 1136482 - DNA, 12 bp, Homo sapiens
agacagaatctc

SEQ ID NO: 1136483 - DNA, 19 bp, Homo sapiens
agacagaatggtggagtgt

SEQ ID NO: 1136484 - DNA, 14 bp, Homo sapiens
agacagaatgtatc

SEQ ID NO: 1136485 - DNA, 16 bp, Homo sapiens
agacagacacacacac

SEQ ID NO: 1136486 - DNA, 17 bp, Homo sapiens
agacagaccacttgcca

SEQ ID NO: 1136487 - DNA, 15 bp, Homo sapiens
agacagaccctctgc

SEQ ID NO: 1136488 - DNA, 21 bp, Homo sapiens
agacagaccggggttcaagcc

SEQ ID NO: 1136489 - DNA, 14 bp, Homo sapiens
agacagactagaag

SEQ ID NO: 1136490 - DNA, 21 bp, Homo sapiens
agacagaggaaagggctggct

SEQ ID NO: 1136491 - DNA, 11 bp, Homo sapiens
agacagagtct

SEQ ID NO: 1136492 - DNA, 18 bp, Homo sapiens
agacagagtgaatttcag

SEQ ID NO: 1136493 - DNA, 22 bp, Homo sapiens
agacagatacctccaaccctgc

SEQ ID NO: 1136494 - DNA, 16 bp, Homo sapiens
agacagatcactcctg

SEQ ID NO: 1136495 - DNA, 20 bp, Homo sapiens
agacagatcactcctggagg

SEQ ID NO: 1136496 - DNA, 14 bp, Homo sapiens
agacagcaccactg

SEQ ID NO: 1136497 - DNA, 14 bp, Homo sapiens
agacagcagacaaa

SEQ ID NO: 1136498 - DNA, 16 bp, Homo sapiens
agacagcagcctgtat

SEQ ID NO: 1136499 - DNA, 16 bp, Homo sapiens
agacagcatgtgttaa

SEQ ID NO: 1136500 - DNA, 23 bp, Homo sapiens
agacagcccaggatactggcaca

SEQ ID NO: 1136501 - DNA, 19 bp, Homo sapiens
agacagccccaagcttctg

SEQ ID NO: 1136502 - DNA, 12 bp, Homo sapiens
agacagcttctc

SEQ ID NO: 1136503 - DNA, 22 bp, Homo sapiens
agacagcttctctgcagtaaaa

SEQ ID NO: 1136504 - DNA, 17 bp, Homo sapiens
agacaggaagaccaagg

SEQ ID NO: 1136505 - DNA, 15 bp, Homo sapiens
agacaggagacaaaa

SEQ ID NO: 1136506 - DNA, 19 bp, Homo sapiens
agacaggcagggagggctt

SEQ ID NO: 1136507 - DNA, 16 bp, Homo sapiens
agacaggcccaagaga

SEQ ID NO: 1136508 - DNA, 22 bp, Homo sapiens
agacaggcccaagagatgaaga

SEQ ID NO: 1136509 - DNA, 23 bp, Homo sapiens
agacaggcccaagagatgaagag

SEQ ID NO: 1136510 - DNA, 13 bp, Homo sapiens
agacaggccctcc

SEQ ID NO: 1136511 - DNA, 18 bp, Homo sapiens
agacaggccctccctgtc

SEQ ID NO: 1136512 - DNA, 22 bp, Homo sapiens
agacagggaaaggtcagcccgt

SEQ ID NO: 1136513 - DNA, 16 bp, Homo sapiens
agacagggtctcactc

SEQ ID NO: 1136514 - DNA, 19 bp, Homo sapiens
agacagggtctcactctgt

SEQ ID NO: 1136515 - DNA, 21 bp, Homo sapiens
agacagggtgctgatgggaag

SEQ ID NO: 1136516 - DNA, 15 bp, Homo sapiens
agacaggtctagact

SEQ ID NO: 1136517 - DNA, 15 bp, Homo sapiens
agacagtattgccac

SEQ ID NO: 1136518 - DNA, 17 bp, Homo sapiens
agacagtccaaccttga

SEQ ID NO: 1136519 - DNA, 18 bp, Homo sapiens
agacagtcctaacaatat

SEQ ID NO: 1136520 - DNA, 13 bp, Homo sapiens
agacagtctggaa

SEQ ID NO: 1136521 - DNA, 14 bp, Homo sapiens
agacagtgaatttg

SEQ ID NO: 1136522 - DNA, 23 bp, Homo sapiens
agacagtgactgtacagttatca

SEQ ID NO: 1136523 - DNA, 19 bp, Homo sapiens
agacagtgagacagtctgg

SEQ ID NO: 1136524 - DNA, 20 bp, Homo sapiens
agacagtgagacagtctgga

SEQ ID NO: 1136525 - DNA, 13 bp, Homo sapiens
agacagtgatatt

SEQ ID NO: 1136526 - DNA, 12 bp, Homo sapiens
agacagtgatct

SEQ ID NO: 1136527 - DNA, 17 bp, Homo sapiens
agacagtgatctccata

SEQ ID NO: 1136528 - DNA, 20 bp, Homo sapiens
agacagtgatctccatatgt

SEQ ID NO: 1136529 - DNA, 21 bp, Homo sapiens
agacagtgatctccatatgtt

SEQ ID NO: 1136530 - DNA, 14 bp, Homo sapiens
agacagtgggaaat

SEQ ID NO: 1136531 - DNA, 14 bp, Homo sapiens
agacagttctctgt

SEQ ID NO: 1136532 - DNA, 12 bp, Homo sapiens
agacataaaact

SEQ ID NO: 1136533 - DNA, 17 bp, Homo sapiens
agacataaaactttaaa

SEQ ID NO: 1136534 - DNA, 15 bp, Homo sapiens
agacataaagccttt

SEQ ID NO: 1136535 - DNA, 11 bp, Homo sapiens
agacatacata

SEQ ID NO: 1136536 - DNA, 20 bp, Homo sapiens
agacatacatagacatttca

SEQ ID NO: 1136537 - DNA, 22 bp, Homo sapiens
agacatacatagacatttcaaa

SEQ ID NO: 1136538 - DNA, 19 bp, Homo sapiens
agacatactaaccagcaga

SEQ ID NO: 1136539 - DNA, 23 bp, Homo sapiens
agacatactaaccagcagaaatg

SEQ ID NO: 1136540 - DNA, 22 bp, Homo sapiens
agacatactccttccatcaaat

SEQ ID NO: 1136541 - DNA, 14 bp, Homo sapiens
agacatatttaact

SEQ ID NO: 1136542 - DNA, 15 bp, Homo sapiens
agacatcaggaaggt

SEQ ID NO: 1136543 - DNA, 17 bp, Homo sapiens
agacatcagtattctgc

SEQ ID NO: 1136544 - DNA, 22 bp, Homo sapiens
agacatccaaatttttttttaa

SEQ ID NO: 1136545 - DNA, 21 bp, Homo sapiens
agacatccatgtttgtaaaac

SEQ ID NO: 1136546 - DNA, 18 bp, Homo sapiens
agacatctccagtgtgcc

SEQ ID NO: 1136547 - DNA, 16 bp, Homo sapiens
agacatctctgcaccc

SEQ ID NO: 1136548 - DNA, 17 bp, Homo sapiens
agacatctctggagcca

SEQ ID NO: 1136549 - DNA, 21 bp, Homo sapiens
agacatctctggagccagaga

SEQ ID NO: 1136550 - DNA, 14 bp, Homo sapiens
agacatctgcaccc

SEQ ID NO: 1136551 - DNA, 17 bp, Homo sapiens
agacatctgcctgtaat

SEQ ID NO: 1136552 - DNA, 15 bp, Homo sapiens
agacatctgctgtta

SEQ ID NO: 1136553 - DNA, 13 bp, Homo sapiens
agacatcttcaga

SEQ ID NO: 1136554 - DNA, 14 bp, Homo sapiens
agacatcttcagat

SEQ ID NO: 1136555 - DNA, 19 bp, Homo sapiens
agacatgcagcctaaggct

SEQ ID NO: 1136556 - DNA, 13 bp, Homo sapiens
acttctagtttca

SEQ ID NO: 1136557 - DNA, 16 bp, Homo sapiens
acttctagtttcacgt

SEQ ID NO: 1136558 - DNA, 21 bp, Homo sapiens
acttctatattttaatagaaa

SEQ ID NO: 1136559 - DNA, 23 bp, Homo sapiens
acttctatattttaatagaaata

SEQ ID NO: 1136560 - DNA, 23 bp, Homo sapiens
acttctcaactccagagcccctt

SEQ ID NO: 1136561 - DNA, 23 bp, Homo sapiens
acttctcatcatattgtatgtaa

SEQ ID NO: 1136562 - DNA, 19 bp, Homo sapiens
actgtctcctccctgggct

SEQ ID NO: 1136563 - DNA, 21 bp, Homo sapiens
actgtctcctccctgggctaa

SEQ ID NO: 1136564 - DNA, 16 bp, Homo sapiens
actgtctctggagtga

SEQ ID NO: 1136565 - DNA, 21 bp, Homo sapiens
actgtctgggattaagggcaa

SEQ ID NO: 1136566 - DNA, 13 bp, Homo sapiens
actgtctggtttt

SEQ ID NO: 1136567 - DNA, 17 bp, Homo sapiens
actgtctggttttaaca

SEQ ID NO: 1136568 - DNA, 19 bp, Homo sapiens
actgtctggttttaacaat

SEQ ID NO: 1136569 - DNA, 15 bp, Homo sapiens
actgtctgtgaacag

SEQ ID NO: 1136570 - DNA, 20 bp, Homo sapiens
actgtcttcctcaaaataaa

SEQ ID NO: 1136571 - DNA, 17 bp, Homo sapiens
actgtctttaaaagaga

SEQ ID NO: 1136572 - DNA, 19 bp, Homo sapiens
actgtctttattcttatta

SEQ ID NO: 1136573 - DNA, 20 bp, Homo sapiens
actgtgaaaatagtgtaaga

SEQ ID NO: 1136574 - DNA, 17 bp, Homo sapiens
actgtgaaatttcatga

SEQ ID NO: 1136575 - DNA, 15 bp, Homo sapiens
actgtgaatttcaaa

SEQ ID NO: 1136576 - DNA, 13 bp, Homo sapiens
actgtgacagact

SEQ ID NO: 1136577 - DNA, 22 bp, Homo sapiens
actgtgaccaagtataaacttt

SEQ ID NO: 1136578 - DNA, 14 bp, Homo sapiens
actgtgaccacctt

SEQ ID NO: 1136579 - DNA, 16 bp, Homo sapiens
actgtgaccaccttct

SEQ ID NO: 1136580 - DNA, 21 bp, Homo sapiens
actgtgaccaccttctgtccc

SEQ ID NO: 1136581 - DNA, 21 bp, Homo sapiens
actgtgacccccagctccggc

SEQ ID NO: 1136582 - DNA, 11 bp, Homo sapiens
actgtgactga

SEQ ID NO: 1136583 - DNA, 20 bp, Homo sapiens
actgtgagagttgtctctgt

SEQ ID NO: 1136584 - DNA, 14 bp, Homo sapiens
acttaaaaatgtaa

SEQ ID NO: 1136585 - DNA, 15 bp, Homo sapiens
acttaaaagtattca

SEQ ID NO: 1136586 - DNA, 17 bp, Homo sapiens
acttaaaagtattcata

SEQ ID NO: 1136587 - DNA, 19 bp, Homo sapiens
acttaaacttgcatcactt

SEQ ID NO: 1136588 - DNA, 12 bp, Homo sapiens
acttaaagcaaa

SEQ ID NO: 1136589 - DNA, 17 bp, Homo sapiens
acttaaagcaaaatagt

SEQ ID NO: 1136590 - DNA, 15 bp, Homo sapiens
acttaaataatgtga

SEQ ID NO: 1136591 - DNA, 17 bp, Homo sapiens
acttaaataatgtgaaa

SEQ ID NO: 1136592 - DNA, 15 bp, Homo sapiens
acttaaatgttatta

SEQ ID NO: 1136593 - DNA, 18 bp, Homo sapiens
acttaaatgttattatct

SEQ ID NO: 1136594 - DNA, 17 bp, Homo sapiens
acttaaattttaattta

SEQ ID NO: 1136595 - DNA, 12 bp, Homo sapiens
acttaacatttc

SEQ ID NO: 1136596 - DNA, 15 bp, Homo sapiens
acttaacggctccag

SEQ ID NO: 1136597 - DNA, 19 bp, Homo sapiens
acttaacggctccaggatt

SEQ ID NO: 1136598 - DNA, 21 bp, Homo sapiens
acttaactctcaagctaagta

SEQ ID NO: 1136599 - DNA, 15 bp, Homo sapiens
acttaactttaactt

SEQ ID NO: 1136600 - DNA, 14 bp, Homo sapiens
acttaagagaatat

SEQ ID NO: 1136601 - DNA, 18 bp, Homo sapiens
acttaagagaatatttta

SEQ ID NO: 1136602 - DNA, 13 bp, Homo sapiens
acttaagcaaaag

SEQ ID NO: 1136603 - DNA, 21 bp, Homo sapiens
acttaaggacctttttaaaga

SEQ ID NO: 1136604 - DNA, 17 bp, Homo sapiens
acttaagtctcgaatgt

SEQ ID NO: 1136605 - DNA, 11 bp, Homo sapiens
acttaagttct

SEQ ID NO: 1136606 - DNA, 13 bp, Homo sapiens
acttaagttcttt

SEQ ID NO: 1136607 - DNA, 19 bp, Homo sapiens
acttaagttggtcctttac

SEQ ID NO: 1136608 - DNA, 13 bp, Homo sapiens
acttaataaattc

SEQ ID NO: 1136609 - DNA, 15 bp, Homo sapiens
acttaataactgtgt

SEQ ID NO: 1136610 - DNA, 18 bp, Homo sapiens
acttaataactgtgtact

SEQ ID NO: 1136611 - DNA, 17 bp, Homo sapiens
acttaatactaccttga

SEQ ID NO: 1136612 - DNA, 17 bp, Homo sapiens
acttaatctaaatggaa

SEQ ID NO: 1136613 - DNA, 17 bp, Homo sapiens
acttaatctaagaaaca

SEQ ID NO: 1136614 - DNA, 15 bp, Homo sapiens
acttaatgaaaacaa

SEQ ID NO: 1136615 - DNA, 16 bp, Homo sapiens
acttaatgaaaacaat

SEQ ID NO: 1136616 - DNA, 17 bp, Homo sapiens
acttaatgtaaaaccca

SEQ ID NO: 1136617 - DNA, 13 bp, Homo sapiens
acttaatgtttct

SEQ ID NO: 1136618 - DNA, 19 bp, Homo sapiens
acttaattgccagcaaata

SEQ ID NO: 1136619 - DNA, 15 bp, Homo sapiens
acttaatttgtaaac

SEQ ID NO: 1136620 - DNA, 22 bp, Homo sapiens
acttaatttgtaaacttctgaa

SEQ ID NO: 1136621 - DNA, 15 bp, Homo sapiens
acttacaaaatgcca

SEQ ID NO: 1136622 - DNA, 12 bp, Homo sapiens
acttacaagaaa

SEQ ID NO: 1136623 - DNA, 16 bp, Homo sapiens
acttacaatttgcaca

SEQ ID NO: 1136624 - DNA, 20 bp, Homo sapiens
acttacacctggaatgttag

SEQ ID NO: 1136625 - DNA, 23 bp, Homo sapiens
acttacattgttcaattagaata

SEQ ID NO: 1136626 - DNA, 14 bp, Homo sapiens
acttacatttacaa

SEQ ID NO: 1136627 - DNA, 15 bp, Homo sapiens
acttacatttacaaa

SEQ ID NO: 1136628 - DNA, 13 bp, Homo sapiens
acttacatttcag

SEQ ID NO: 1136629 - DNA, 15 bp, Homo sapiens
acttacatttccatt

SEQ ID NO: 1136630 - DNA, 16 bp, Homo sapiens
acttacgtaaaacatt

SEQ ID NO: 1136631 - DNA, 13 bp, Homo sapiens
acttactataatt

SEQ ID NO: 1136632 - DNA, 12 bp, Homo sapiens
acttactatttt

SEQ ID NO: 1136633 - DNA, 13 bp, Homo sapiens
acttactgtacat

SEQ ID NO: 1136634 - DNA, 16 bp, Homo sapiens
acttactgtacatgaa

SEQ ID NO: 1136635 - DNA, 21 bp, Homo sapiens
acttactgtccaccagtttat

SEQ ID NO: 1136636 - DNA, 18 bp, Homo sapiens
acttagaatagtttgaaa

SEQ ID NO: 1136637 - DNA, 14 bp, Homo sapiens
acttagaggaaaat

SEQ ID NO: 1136638 - DNA, 13 bp, Homo sapiens
acttagaggaaat

SEQ ID NO: 1136639 - DNA, 18 bp, Homo sapiens
acttagagtttctgtttg

SEQ ID NO: 1136640 - DNA, 20 bp, Homo sapiens
acttagatattaaaatttgg

SEQ ID NO: 1136641 - DNA, 18 bp, Homo sapiens
acttagatctctcctgca

SEQ ID NO: 1136642 - DNA, 16 bp, Homo sapiens
acttagatgttaaatg

SEQ ID NO: 1136643 - DNA, 18 bp, Homo sapiens
acttagatgttaaatgtt

SEQ ID NO: 1136644 - DNA, 21 bp, Homo sapiens
acttagcagtgagtattggaa

SEQ ID NO: 1136645 - DNA, 18 bp, Homo sapiens
acttagccagttcaaagt

SEQ ID NO: 1136646 - DNA, 22 bp, Homo sapiens
acttagccagttcaaagtgtat

SEQ ID NO: 1136647 - DNA, 15 bp, Homo sapiens
acttagccattgaaa

SEQ ID NO: 1136648 - DNA, 17 bp, Homo sapiens
acttagccattgaaatg

SEQ ID NO: 1136649 - DNA, 22 bp, Homo sapiens
acttagccatttttcaaagcaa

SEQ ID NO: 1136650 - DNA, 23 bp, Homo sapiens
acttagccatttttcaaagcaat

SEQ ID NO: 1136651 - DNA, 15 bp, Homo sapiens
acttagcccaagagg

SEQ ID NO: 1136652 - DNA, 21 bp, Homo sapiens
acttagcccaagaggtctgag

SEQ ID NO: 1136653 - DNA, 21 bp, Homo sapiens
acttagccgcaccctgcacct

SEQ ID NO: 1136654 - DNA, 17 bp, Homo sapiens
acttagcctttacctgt

SEQ ID NO: 1136655 - DNA, 20 bp, Homo sapiens
acttagcctttacctgtgaa

SEQ ID NO: 1136656 - DNA, 17 bp, Homo sapiens
acttagcgtcaagacat

SEQ ID NO: 1136657 - DNA, 11 bp, Homo sapiens
acttagctcag

SEQ ID NO: 1136658 - DNA, 17 bp, Homo sapiens
acttagctcaggtgcct

SEQ ID NO: 1136659 - DNA, 20 bp, Homo sapiens
acttagctgtactataagta

SEQ ID NO: 1136660 - DNA, 16 bp, Homo sapiens
acttagggaagaaaaa

SEQ ID NO: 1136661 - DNA, 21 bp, Homo sapiens
acttagggaagaaaaagcaag

SEQ ID NO: 1136662 - DNA, 16 bp, Homo sapiens
acttagggcaccaggg

SEQ ID NO: 1136663 - DNA, 19 bp, Homo sapiens
acttaggtaaaataaaaga

SEQ ID NO: 1136664 - DNA, 18 bp, Homo sapiens
acttaggttattttgctt

SEQ ID NO: 1136665 - DNA, 20 bp, Homo sapiens
acttaggttattttgctttg

SEQ ID NO: 1136666 - DNA, 22 bp, Homo sapiens
acttagtagtttttacaaaact

SEQ ID NO: 1136667 - DNA, 17 bp, Homo sapiens
acttagtatattttctt

SEQ ID NO: 1136668 - DNA, 18 bp, Homo sapiens
acttagtggtatgtctct

SEQ ID NO: 1136669 - DNA, 19 bp, Homo sapiens
acttagttaaaattgattt

SEQ ID NO: 1136670 - DNA, 14 bp, Homo sapiens
acttataccaaagg

SEQ ID NO: 1136671 - DNA, 18 bp, Homo sapiens
acttatagtacatgataa

SEQ ID NO: 1136672 - DNA, 15 bp, Homo sapiens
acttatagttaatat

SEQ ID NO: 1136673 - DNA, 19 bp, Homo sapiens
acttatagttaatattttg

SEQ ID NO: 1136674 - DNA, 14 bp, Homo sapiens
acttatatcaactt

SEQ ID NO: 1136675 - DNA, 15 bp, Homo sapiens
acttatattgtaaga

SEQ ID NO: 1136676 - DNA, 18 bp, Homo sapiens
acttatattgtaagaaat

SEQ ID NO: 1136677 - DNA, 12 bp, Homo sapiens
acttatatttta

SEQ ID NO: 1136678 - DNA, 13 bp, Homo sapiens
acttatattttat

SEQ ID NO: 1136679 - DNA, 15 bp, Homo sapiens
acttatattttgatt

SEQ ID NO: 1136680 - DNA, 21 bp, Homo sapiens
acttatcagtttgctaatgtt

SEQ ID NO: 1136681 - DNA, 22 bp, Homo sapiens
acttatcatttttgtataaaaa

SEQ ID NO: 1136682 - DNA, 21 bp, Homo sapiens
acttatctagaaagaaaagac

SEQ ID NO: 1136683 - DNA, 15 bp, Homo sapiens
acttatgctgctgtg

SEQ ID NO: 1136684 - DNA, 15 bp, Homo sapiens
acttatgtttttaaa

SEQ ID NO: 1136685 - DNA, 18 bp, Homo sapiens
acttattaaaaaatttgt

SEQ ID NO: 1136686 - DNA, 14 bp, Homo sapiens
acttattactgcta

SEQ ID NO: 1136687 - DNA, 15 bp, Homo sapiens
acttattatgcataa

SEQ ID NO: 1136688 - DNA, 20 bp, Homo sapiens
acttattattaataatgaag

SEQ ID NO: 1136689 - DNA, 18 bp, Homo sapiens
acttattccaagtgcatt

SEQ ID NO: 1136690 - DNA, 18 bp, Homo sapiens
acttattccctcatcctt

SEQ ID NO: 1136691 - DNA, 21 bp, Homo sapiens
acttattccctcatcctttca

SEQ ID NO: 1136692 - DNA, 22 bp, Homo sapiens
acttattccgagaatgccgagg

SEQ ID NO: 1136693 - DNA, 17 bp, Homo sapiens
actgcatactttttaaa

SEQ ID NO: 1136694 - DNA, 20 bp, Homo sapiens
actgcatactttttaaatgt

SEQ ID NO: 1136695 - DNA, 23 bp, Homo sapiens
actgcatactttttaaatgtaaa

SEQ ID NO: 1136696 - DNA, 17 bp, Homo sapiens
actgcatggacctaaca

SEQ ID NO: 1136697 - DNA, 14 bp, Homo sapiens
actgcatgtgactt

SEQ ID NO: 1136698 - DNA, 15 bp, Homo sapiens
actgcatgtgacttc

SEQ ID NO: 1136699 - DNA, 16 bp, Homo sapiens
actgcatgtttgtgat

SEQ ID NO: 1136700 - DNA, 21 bp, Homo sapiens
actgcattctctcccatcctg

SEQ ID NO: 1136701 - DNA, 23 bp, Homo sapiens
actgcattcttctgagcactgtt

SEQ ID NO: 1136702 - DNA, 16 bp, Homo sapiens
actgccaagagccgac

SEQ ID NO: 1136703 - DNA, 18 bp, Homo sapiens
actgccaagcttcctgtg

SEQ ID NO: 1136704 - DNA, 22 bp, Homo sapiens
actgccaagcttcctgtgccct

SEQ ID NO: 1136705 - DNA, 23 bp, Homo sapiens
actgccaagcttcctgtgccctc

SEQ ID NO: 1136706 - DNA, 18 bp, Homo sapiens
actgccacactctccatc

SEQ ID NO: 1136707 - DNA, 21 bp, Homo sapiens
actgccacactctccatcacc

SEQ ID NO: 1136708 - DNA, 13 bp, Homo sapiens
actgccactgtgt

SEQ ID NO: 1136709 - DNA, 14 bp, Homo sapiens
actgccactgtgtg

SEQ ID NO: 1136710 - DNA, 16 bp, Homo sapiens
actgccactgtgtgcc

SEQ ID NO: 1136711 - DNA, 18 bp, Homo sapiens
actgccactgtgtgcctt

SEQ ID NO: 1136712 - DNA, 12 bp, Homo sapiens
actgccaggcac

SEQ ID NO: 1136713 - DNA, 14 bp, Homo sapiens
actgccaggcacct

SEQ ID NO: 1136714 - DNA, 18 bp, Homo sapiens
actgccaggcacctggcc

SEQ ID NO: 1136715 - DNA, 22 bp, Homo sapiens
actgccaggcacctggcctgct

SEQ ID NO: 1136716 - DNA, 17 bp, Homo sapiens
actgccaggccagcctc

SEQ ID NO: 1136717 - DNA, 18 bp, Homo sapiens
actgccaggccagcctcc

SEQ ID NO: 1136718 - DNA, 19 bp, Homo sapiens
actgccagtccccctgccc

SEQ ID NO: 1136719 - DNA, 18 bp, Homo sapiens
actgccatgatagctggg

SEQ ID NO: 1136720 - DNA, 20 bp, Homo sapiens
actgccatgcaccaggactg

SEQ ID NO: 1136721 - DNA, 14 bp, Homo sapiens
actgccatgccagc

SEQ ID NO: 1136722 - DNA, 20 bp, Homo sapiens
actgccattattttctgtca

SEQ ID NO: 1136723 - DNA, 21 bp, Homo sapiens
actgccattattttctgtcag

SEQ ID NO: 1136724 - DNA, 15 bp, Homo sapiens
actgcccaaatagga

SEQ ID NO: 1136725 - DNA, 16 bp, Homo sapiens
actgcccaccaaaggt

SEQ ID NO: 1136726 - DNA, 11 bp, Homo sapiens
actgcccagcc

SEQ ID NO: 1136727 - DNA, 19 bp, Homo sapiens
actgcccatggacaggctg

SEQ ID NO: 1136728 - DNA, 18 bp, Homo sapiens
actgccccacggagacag

SEQ ID NO: 1136729 - DNA, 20 bp, Homo sapiens
actgccccacggagacagag

SEQ ID NO: 1136730 - DNA, 14 bp, Homo sapiens
actgccccacttct

SEQ ID NO: 1136731 - DNA, 18 bp, Homo sapiens
actgccccacttctggca

SEQ ID NO: 1136732 - DNA, 20 bp, Homo sapiens
actgccccacttctggcatg

SEQ ID NO: 1136733 - DNA, 13 bp, Homo sapiens
actgccccagcca

SEQ ID NO: 1136734 - DNA, 16 bp, Homo sapiens
actgccccagccaacg

SEQ ID NO: 1136735 - DNA, 14 bp, Homo sapiens
actgcccccactgt

SEQ ID NO: 1136736 - DNA, 22 bp, Homo sapiens
actgcccccactgtccccctac

SEQ ID NO: 1136737 - DNA, 23 bp, Homo sapiens
actgcccccagaaagcctcctgc

SEQ ID NO: 1136738 - DNA, 19 bp, Homo sapiens
actgccccccatgaggaag

SEQ ID NO: 1136739 - DNA, 22 bp, Homo sapiens
actgccccccatgaggaaggaa

SEQ ID NO: 1136740 - DNA, 13 bp, Homo sapiens
actgccccccgag

SEQ ID NO: 1136741 - DNA, 19 bp, Homo sapiens
actgccccctgctgccatg

SEQ ID NO: 1136742 - DNA, 20 bp, Homo sapiens
actgccccgtgtgaatgtag

SEQ ID NO: 1136743 - DNA, 21 bp, Homo sapiens
actgccccgtgtgaatgtagc

SEQ ID NO: 1136744 - DNA, 15 bp, Homo sapiens
actgcccctgctgtg

SEQ ID NO: 1136745 - DNA, 20 bp, Homo sapiens
actgcccgagctggtgcatt

SEQ ID NO: 1136746 - DNA, 21 bp, Homo sapiens
actgcccgagctggtgcatta

SEQ ID NO: 1136747 - DNA, 22 bp, Homo sapiens
actgcccggcagggtcctagaa

SEQ ID NO: 1136748 - DNA, 17 bp, Homo sapiens
actgcccggggcagctg

SEQ ID NO: 1136749 - DNA, 13 bp, Homo sapiens
actgccctaagcc

SEQ ID NO: 1136750 - DNA, 12 bp, Homo sapiens
actgccctgcct

SEQ ID NO: 1136751 - DNA, 14 bp, Homo sapiens
actgccctgcctgc

SEQ ID NO: 1136752 - DNA, 12 bp, Homo sapiens
actgccctggca

SEQ ID NO: 1136753 - DNA, 17 bp, Homo sapiens
actgccctggcagcagc

SEQ ID NO: 1136754 - DNA, 12 bp, Homo sapiens
actgcccttcca

SEQ ID NO: 1136755 - DNA, 12 bp, Homo sapiens
actgcccttctc

SEQ ID NO: 1136756 - DNA, 20 bp, Homo sapiens
actgccgaagaattgtcttg

SEQ ID NO: 1136757 - DNA, 22 bp, Homo sapiens
actgccgaccgaggctggagct

SEQ ID NO: 1136758 - DNA, 23 bp, Homo sapiens
actgccgaccgaggctggagctg

SEQ ID NO: 1136759 - DNA, 20 bp, Homo sapiens
actgccggtcacccaggctc

SEQ ID NO: 1136760 - DNA, 16 bp, Homo sapiens
actgccgtaatttaac

SEQ ID NO: 1136761 - DNA, 17 bp, Homo sapiens
actgccgtaatttaact

SEQ ID NO: 1136762 - DNA, 14 bp, Homo sapiens
actgcctactgtta

SEQ ID NO: 1136763 - DNA, 18 bp, Homo sapiens
actgcctactgttactct

SEQ ID NO: 1136764 - DNA, 17 bp, Homo sapiens
actgcctccctctcttc

SEQ ID NO: 1136765 - DNA, 18 bp, Homo sapiens
actgcctccctctcttcc

SEQ ID NO: 1136766 - DNA, 17 bp, Homo sapiens
actgcctcctgcctggg

SEQ ID NO: 1136767 - DNA, 16 bp, Homo sapiens
actgcctcctgttttc

SEQ ID NO: 1136768 - DNA, 21 bp, Homo sapiens
actgcctcctgttttctccct

SEQ ID NO: 1136769 - DNA, 16 bp, Homo sapiens
actgcctctatgccct

SEQ ID NO: 1136770 - DNA, 20 bp, Homo sapiens
actgcctctatgccctgcag

SEQ ID NO: 1136771 - DNA, 13 bp, Homo sapiens
actgcctctccct

SEQ ID NO: 1136772 - DNA, 14 bp, Homo sapiens
actgcctctccctc

SEQ ID NO: 1136773 - DNA, 16 bp, Homo sapiens
actgcctctccctctg

SEQ ID NO: 1136774 - DNA, 14 bp, Homo sapiens
actgcctcttcctc

SEQ ID NO: 1136775 - DNA, 9 bp, Homo sapiens
actgcctgc

SEQ ID NO: 1136776 - DNA, 22 bp, Homo sapiens
actgcctgcagaggtctgtgct

SEQ ID NO: 1136777 - DNA, 24 bp, Homo sapiens
actgcctgcagaggtctgtgctga

SEQ ID NO: 1136778 - DNA, 16 bp, Homo sapiens
actgcctgccaccgcg

SEQ ID NO: 1136779 - DNA, 12 bp, Homo sapiens
actgcctgggcc

SEQ ID NO: 1136780 - DNA, 14 bp, Homo sapiens
actgcctgggctcc

SEQ ID NO: 1136781 - DNA, 23 bp, Homo sapiens
actgcctgtagcaatggccagag

SEQ ID NO: 1136782 - DNA, 23 bp, Homo sapiens
actgccttctcctctctgggcct

SEQ ID NO: 1136783 - DNA, 18 bp, Homo sapiens
actgccttggcttcaggg

SEQ ID NO: 1136784 - DNA, 13 bp, Homo sapiens
actgcctttagaa

SEQ ID NO: 1136785 - DNA, 19 bp, Homo sapiens
actgcctttagaaaatata

SEQ ID NO: 1136786 - DNA, 22 bp, Homo sapiens
actgcgaagaccctcttgccca

SEQ ID NO: 1136787 - DNA, 17 bp, Homo sapiens
actgcgataactgagaa

SEQ ID NO: 1136788 - DNA, 15 bp, Homo sapiens
actgcgcccagcctg

SEQ ID NO: 1136789 - DNA, 23 bp, Homo sapiens
actgcgcccttaactgcatccag

SEQ ID NO: 1136790 - DNA, 20 bp, Homo sapiens
actgcggaaaaggaaggaaa

SEQ ID NO: 1136791 - DNA, 20 bp, Homo sapiens
actgcgggatggtcctgggg

SEQ ID NO: 1136792 - DNA, 21 bp, Homo sapiens
actgcgggatggtcctggggc

SEQ ID NO: 1136793 - DNA, 13 bp, Homo sapiens
actgctaaataaa

SEQ ID NO: 1136794 - DNA, 17 bp, Homo sapiens
actgctaaataaaattt

SEQ ID NO: 1136795 - DNA, 20 bp, Homo sapiens
actgctaaataaaatttgtt

SEQ ID NO: 1136796 - DNA, 20 bp, Homo sapiens
actgctaaggctgctggctt

SEQ ID NO: 1136797 - DNA, 17 bp, Homo sapiens
actgctaagtatttccc

SEQ ID NO: 1136798 - DNA, 14 bp, Homo sapiens
actgctaatgttga

SEQ ID NO: 1136799 - DNA, 15 bp, Homo sapiens
actgctaatgttgat

SEQ ID NO: 1136800 - DNA, 14 bp, Homo sapiens
actgctacagcaat

SEQ ID NO: 1136801 - DNA, 22 bp, Homo sapiens
actgctactgtaattttatatg

SEQ ID NO: 1136802 - DNA, 18 bp, Homo sapiens
actgctaggcgagtgcca

SEQ ID NO: 1136803 - DNA, 17 bp, Homo sapiens
actgctaggtgggccag

SEQ ID NO: 1136804 - DNA, 20 bp, Homo sapiens
actgctaggtgggccagccc

SEQ ID NO: 1136805 - DNA, 19 bp, Homo sapiens
actgctagtcttaagaact

SEQ ID NO: 1136806 - DNA, 16 bp, Homo sapiens
actgctatagcctaag

SEQ ID NO: 1136807 - DNA, 16 bp, Homo sapiens
actgctcaagaagaca

SEQ ID NO: 1136808 - DNA, 18 bp, Homo sapiens
actgctcaagaagacatg

SEQ ID NO: 1136809 - DNA, 22 bp, Homo sapiens
actgctcagaacttgctgctgt

SEQ ID NO: 1136810 - DNA, 18 bp, Homo sapiens
actgctcagagctttaaa

SEQ ID NO: 1136811 - DNA, 14 bp, Homo sapiens
actgctcagctctg

SEQ ID NO: 1136812 - DNA, 16 bp, Homo sapiens
actgctcagctctggt

SEQ ID NO: 1136813 - DNA, 23 bp, Homo sapiens
actgctcatcattccttgagaaa

SEQ ID NO: 1136814 - DNA, 12 bp, Homo sapiens
actgctccaaat

SEQ ID NO: 1136815 - DNA, 16 bp, Homo sapiens
actgctccaagggaca

SEQ ID NO: 1136816 - DNA, 20 bp, Homo sapiens
actgctccatttataacccc

SEQ ID NO: 1136817 - DNA, 15 bp, Homo sapiens
actcctgggctcaag

SEQ ID NO: 1136818 - DNA, 16 bp, Homo sapiens
actcctggggcctctt

SEQ ID NO: 1136819 - DNA, 14 bp, Homo sapiens
actcctgggtgggt

SEQ ID NO: 1136820 - DNA, 14 bp, Homo sapiens
actcctgggttgag

SEQ ID NO: 1136821 - DNA, 13 bp, Homo sapiens
actcctggtctgt

SEQ ID NO: 1136822 - DNA, 18 bp, Homo sapiens
actcctgtacactgaata

SEQ ID NO: 1136823 - DNA, 14 bp, Homo sapiens
actcctgtcaccta

SEQ ID NO: 1136824 - DNA, 19 bp, Homo sapiens
actcctgtcccgccttcct

SEQ ID NO: 1136825 - DNA, 20 bp, Homo sapiens
actcctgtgctctggaggct

SEQ ID NO: 1136826 - DNA, 12 bp, Homo sapiens
actccttagaga

SEQ ID NO: 1136827 - DNA, 14 bp, Homo sapiens
actccttcctggcc

SEQ ID NO: 1136828 - DNA, 14 bp, Homo sapiens
actccttctcccca

SEQ ID NO: 1136829 - DNA, 15 bp, Homo sapiens
actccttctccccaa

SEQ ID NO: 1136830 - DNA, 21 bp, Homo sapiens
actccttctctcactgtgtta

SEQ ID NO: 1136831 - DNA, 23 bp, Homo sapiens
actccttgtggactggctgtgcc

SEQ ID NO: 1136832 - DNA, 22 bp, Homo sapiens
actccttgttagcccttcagat

SEQ ID NO: 1136833 - DNA, 19 bp, Homo sapiens
actcctttactgcagcctg

SEQ ID NO: 1136834 - DNA, 14 bp, Homo sapiens
actcctttatctgt

SEQ ID NO: 1136835 - DNA, 20 bp, Homo sapiens
actcctttccaatagaaaga

SEQ ID NO: 1136836 - DNA, 14 bp, Homo sapiens
actcctttcctctg

SEQ ID NO: 1136837 - DNA, 19 bp, Homo sapiens
actcctttgctaatgctat

SEQ ID NO: 1136838 - DNA, 14 bp, Homo sapiens
actccttttaaaga

SEQ ID NO: 1136839 - DNA, 23 bp, Homo sapiens
actccttttaaagaaaaaaattg

SEQ ID NO: 1136840 - DNA, 21 bp, Homo sapiens
actccttttggtgtgttggac

SEQ ID NO: 1136841 - DNA, 19 bp, Homo sapiens
actcgaaactgacagtatt

SEQ ID NO: 1136842 - DNA, 18 bp, Homo sapiens
actcgagtcacactcaag

SEQ ID NO: 1136843 - DNA, 16 bp, Homo sapiens
actcgatgcactgacc

SEQ ID NO: 1136844 - DNA, 21 bp, Homo sapiens
actcgccatttcctcacgtgc

SEQ ID NO: 1136845 - DNA, 17 bp, Homo sapiens
actcgcccgcccactgt

SEQ ID NO: 1136846 - DNA, 21 bp, Homo sapiens
actcgcccgcccactgtcctg

SEQ ID NO: 1136847 - DNA, 21 bp, Homo sapiens
actcgcctgtggacggggagg

SEQ ID NO: 1136848 - DNA, 15 bp, Homo sapiens
actcggccactgtgt

SEQ ID NO: 1136849 - DNA, 17 bp, Homo sapiens
actcggccactgtgtct

SEQ ID NO: 1136850 - DNA, 21 bp, Homo sapiens
actcggccactgtgtctctgt

SEQ ID NO: 1136851 - DNA, 13 bp, Homo sapiens
actcggcttcctg

SEQ ID NO: 1136852 - DNA, 18 bp, Homo sapiens
actcgggagctgcacaca

SEQ ID NO: 1136853 - DNA, 19 bp, Homo sapiens
actcgtgacttgtcccctc

SEQ ID NO: 1136854 - DNA, 14 bp, Homo sapiens
actctaaactgcaa

SEQ ID NO: 1136855 - DNA, 22 bp, Homo sapiens
actctaaactgcaaacagaaat

SEQ ID NO: 1136856 - DNA, 14 bp, Homo sapiens
actctaaagtctgt

SEQ ID NO: 1136857 - DNA, 21 bp, Homo sapiens
actctaaatgcagttttaaga

SEQ ID NO: 1136858 - DNA, 22 bp, Homo sapiens
actctaaatgcagttttaagaa

SEQ ID NO: 1136859 - DNA, 17 bp, Homo sapiens
actctaacactcgactc

SEQ ID NO: 1136860 - DNA, 15 bp, Homo sapiens
actctaaccctgtgg

SEQ ID NO: 1136861 - DNA, 20 bp, Homo sapiens
actctaagtcatgtatgttt

SEQ ID NO: 1136862 - DNA, 15 bp, Homo sapiens
actctaattagagaa

SEQ ID NO: 1136863 - DNA, 23 bp, Homo sapiens
actctacacggactgaggtgcct

SEQ ID NO: 1136864 - DNA, 13 bp, Homo sapiens
actctacactgaa

SEQ ID NO: 1136865 - DNA, 16 bp, Homo sapiens
actctacactgtgaac

SEQ ID NO: 1136866 - DNA, 21 bp, Homo sapiens
actctacatgtaactatttct

SEQ ID NO: 1136867 - DNA, 17 bp, Homo sapiens
actctacccatattaca

SEQ ID NO: 1136868 - DNA, 18 bp, Homo sapiens
actctaccctcccacccc

SEQ ID NO: 1136869 - DNA, 13 bp, Homo sapiens
actctaccctctt

SEQ ID NO: 1136870 - DNA, 21 bp, Homo sapiens
actctaccctcttagaaaaac

SEQ ID NO: 1136871 - DNA, 21 bp, Homo sapiens
actctacttaatccaatgggt

SEQ ID NO: 1136872 - DNA, 18 bp, Homo sapiens
actctagaaaaaagggct

SEQ ID NO: 1136873 - DNA, 18 bp, Homo sapiens
actctagaacatgcacat

SEQ ID NO: 1136874 - DNA, 20 bp, Homo sapiens
actctagaacatgcacattt

SEQ ID NO: 1136875 - DNA, 17 bp, Homo sapiens
actctagacaagatatt

SEQ ID NO: 1136876 - DNA, 21 bp, Homo sapiens
actctagatgaagttttacat

SEQ ID NO: 1136877 - DNA, 22 bp, Homo sapiens
actctagatgaagttttacatt

SEQ ID NO: 1136878 - DNA, 20 bp, Homo sapiens
actctagcctgggccagaga

SEQ ID NO: 1136879 - DNA, 13 bp, Homo sapiens
actctaggaagaa

SEQ ID NO: 1136880 - DNA, 23 bp, Homo sapiens
actctagggatataaaaacagat

SEQ ID NO: 1136881 - DNA, 18 bp, Homo sapiens
actctagtgacttcctgg

SEQ ID NO: 1136882 - DNA, 16 bp, Homo sapiens
actctagttctagatg

SEQ ID NO: 1136883 - DNA, 12 bp, Homo sapiens
actctagttctg

SEQ ID NO: 1136884 - DNA, 20 bp, Homo sapiens
acctctgttgtcctcccctt

SEQ ID NO: 1136885 - DNA, 22 bp, Homo sapiens
acctctgttgtcctccccttgg

SEQ ID NO: 1136886 - DNA, 15 bp, Homo sapiens
acctcttactttgct

SEQ ID NO: 1136887 - DNA, 16 bp, Homo sapiens
acctcttactttgctt

SEQ ID NO: 1136888 - DNA, 15 bp, Homo sapiens
acctcttagctgagt

SEQ ID NO: 1136889 - DNA, 15 bp, Homo sapiens
acctcttcagaggcc

SEQ ID NO: 1136890 - DNA, 18 bp, Homo sapiens
acctcttcagaggccctc

SEQ ID NO: 1136891 - DNA, 11 bp, Homo sapiens
acctcttccac

SEQ ID NO: 1136892 - DNA, 16 bp, Homo sapiens
acctcttcccatgact

SEQ ID NO: 1136893 - DNA, 13 bp, Homo sapiens
acctcttccccag

SEQ ID NO: 1136894 - DNA, 13 bp, Homo sapiens
acctcttcctctg

SEQ ID NO: 1136895 - DNA, 16 bp, Homo sapiens
acctcttcctctggtt

SEQ ID NO: 1136896 - DNA, 16 bp, Homo sapiens
acctcttctcttcctg

SEQ ID NO: 1136897 - DNA, 17 bp, Homo sapiens
acctcttgagccttgaa

SEQ ID NO: 1136898 - DNA, 20 bp, Homo sapiens
acctcttgagccttgaactt

SEQ ID NO: 1136899 - DNA, 21 bp, Homo sapiens
acctcttgagccttgaacttt

SEQ ID NO: 1136900 - DNA, 13 bp, Homo sapiens
acctcttgctgtc

SEQ ID NO: 1136901 - DNA, 15 bp, Homo sapiens
acctcttgtgcaagg

SEQ ID NO: 1136902 - DNA, 16 bp, Homo sapiens
acctcttgtttctggg

SEQ ID NO: 1136903 - DNA, 23 bp, Homo sapiens
acctcttgtttctgggtccctgc

SEQ ID NO: 1136904 - DNA, 17 bp, Homo sapiens
acctcttttgttgtcct

SEQ ID NO: 1136905 - DNA, 17 bp, Homo sapiens
acctctttttcctcctg

SEQ ID NO: 1136906 - DNA, 22 bp, Homo sapiens
acctctttttcctcctggacac

SEQ ID NO: 1136907 - DNA, 18 bp, Homo sapiens
acctgaaaaaaagtttac

SEQ ID NO: 1136908 - DNA, 19 bp, Homo sapiens
acctgaaaacactgtgcac

SEQ ID NO: 1136909 - DNA, 12 bp, Homo sapiens
acctgaaacact

SEQ ID NO: 1136910 - DNA, 14 bp, Homo sapiens
acctgaaacactgg

SEQ ID NO: 1136911 - DNA, 19 bp, Homo sapiens
acctgaaacactggacctg

SEQ ID NO: 1136912 - DNA, 22 bp, Homo sapiens
acctgaaagacagtatgagaaa

SEQ ID NO: 1136913 - DNA, 17 bp, Homo sapiens
acctgaaataatatatt

SEQ ID NO: 1136914 - DNA, 22 bp, Homo sapiens
acctgaaataatatatttcttc

SEQ ID NO: 1136915 - DNA, 18 bp, Homo sapiens
acctgaaattaatttgtg

SEQ ID NO: 1136916 - DNA, 13 bp, Homo sapiens
actacctgtcaag

SEQ ID NO: 1136917 - DNA, 12 bp, Homo sapiens
actacctgtgta

SEQ ID NO: 1136918 - DNA, 17 bp, Homo sapiens
actaccttgaaaataag

SEQ ID NO: 1136919 - DNA, 15 bp, Homo sapiens
actactactctgcca

SEQ ID NO: 1136920 - DNA, 16 bp, Homo sapiens
actactactctgccaa

SEQ ID NO: 1136921 - DNA, 19 bp, Homo sapiens
actactagatgtctttagg

SEQ ID NO: 1136922 - DNA, 21 bp, Homo sapiens
actactcctctgcagtgcctt

SEQ ID NO: 1136923 - DNA, 14 bp, Homo sapiens
actactctgccaat

SEQ ID NO: 1136924 - DNA, 15 bp, Homo sapiens
actactctttgattt

SEQ ID NO: 1136925 - DNA, 18 bp, Homo sapiens
actactgaacacatgtgt

SEQ ID NO: 1136926 - DNA, 23 bp, Homo sapiens
actactgacatgtggggccaggt

SEQ ID NO: 1136927 - DNA, 21 bp, Homo sapiens
actactgcctttagaaaatat

SEQ ID NO: 1136928 - DNA, 17 bp, Homo sapiens
actactgctcctgtggc

SEQ ID NO: 1136929 - DNA, 14 bp, Homo sapiens
actactgggtgtca

SEQ ID NO: 1136930 - DNA, 13 bp, Homo sapiens
actactgtacttt

SEQ ID NO: 1136931 - DNA, 16 bp, Homo sapiens
actactgtggaaagac

SEQ ID NO: 1136932 - DNA, 13 bp, Homo sapiens
actactgtgttcc

SEQ ID NO: 1136933 - DNA, 13 bp, Homo sapiens
actacttcatttt

SEQ ID NO: 1136934 - DNA, 15 bp, Homo sapiens
actacttcattttct

SEQ ID NO: 1136935 - DNA, 23 bp, Homo sapiens
actacttcttttttcaaaagaaa

SEQ ID NO: 1136936 - DNA, 20 bp, Homo sapiens
actactttgaaaacaattca

SEQ ID NO: 1136937 - DNA, 14 bp, Homo sapiens
actacttttctaaa

SEQ ID NO: 1136938 - DNA, 16 bp, Homo sapiens
actacttttctaaaat

SEQ ID NO: 1136939 - DNA, 16 bp, Homo sapiens
actactttttatactc

SEQ ID NO: 1136940 - DNA, 15 bp, Homo sapiens
actagaacaacttga

SEQ ID NO: 1136941 - DNA, 18 bp, Homo sapiens
actagaacctatctttaa

SEQ ID NO: 1136942 - DNA, 16 bp, Homo sapiens
actagaactctccatc

SEQ ID NO: 1136943 - DNA, 14 bp, Homo sapiens
actagaagggccag

SEQ ID NO: 1136944 - DNA, 16 bp, Homo sapiens
actagaagtcctgctg

SEQ ID NO: 1136945 - DNA, 16 bp, Homo sapiens
actagaattcatgtga

SEQ ID NO: 1136946 - DNA, 20 bp, Homo sapiens
actagaattctagtgctgct

SEQ ID NO: 1136947 - DNA, 16 bp, Homo sapiens
actagagacaaatctt

SEQ ID NO: 1136948 - DNA, 17 bp, Homo sapiens
actagagatattttgta

SEQ ID NO: 1136949 - DNA, 15 bp, Homo sapiens
actagagctttcttt

SEQ ID NO: 1136950 - DNA, 15 bp, Homo sapiens
actagaggccaggga

SEQ ID NO: 1136951 - DNA, 18 bp, Homo sapiens
actagaggccagggcagc

SEQ ID NO: 1136952 - DNA, 22 bp, Homo sapiens
actagagggacctctcccaggg

SEQ ID NO: 1136953 - DNA, 16 bp, Homo sapiens
actagagggcccatca

SEQ ID NO: 1136954 - DNA, 21 bp, Homo sapiens
actagaggtgagaaatttaaa

SEQ ID NO: 1136955 - DNA, 12 bp, Homo sapiens
actagatgtagt

SEQ ID NO: 1136956 - DNA, 13 bp, Homo sapiens
actagatgtagta

SEQ ID NO: 1136957 - DNA, 16 bp, Homo sapiens
actagatgtagtattt

SEQ ID NO: 1136958 - DNA, 19 bp, Homo sapiens
actagatgtatgtgaataa

SEQ ID NO: 1136959 - DNA, 18 bp, Homo sapiens
actagattacattcagtt

SEQ ID NO: 1136960 - DNA, 15 bp, Homo sapiens
actagattgtgatcc

SEQ ID NO: 1136961 - DNA, 13 bp, Homo sapiens
actagcaaaataa

SEQ ID NO: 1136962 - DNA, 14 bp, Homo sapiens
actagcaaaataaa

SEQ ID NO: 1136963 - DNA, 15 bp, Homo sapiens
actagcaaaataaaa

SEQ ID NO: 1136964 - DNA, 23 bp, Homo sapiens
actagcaggcaatgctgtacttt

SEQ ID NO: 1136965 - DNA, 20 bp, Homo sapiens
actagcattacattattaaa

SEQ ID NO: 1136966 - DNA, 18 bp, Homo sapiens
actagccaaaccaggacc

SEQ ID NO: 1136967 - DNA, 14 bp, Homo sapiens
actagccagacaaa

SEQ ID NO: 1136968 - DNA, 15 bp, Homo sapiens
actagcccaatgaaa

SEQ ID NO: 1136969 - DNA, 18 bp, Homo sapiens
actagccctcctttttcc

SEQ ID NO: 1136970 - DNA, 15 bp, Homo sapiens
actagcctgtgatta

SEQ ID NO: 1136971 - DNA, 19 bp, Homo sapiens
actagctatctaggtggag

SEQ ID NO: 1136972 - DNA, 19 bp, Homo sapiens
actagcttactgatgatgt

SEQ ID NO: 1136973 - DNA, 22 bp, Homo sapiens
actagcttgaacttagatgtta

SEQ ID NO: 1136974 - DNA, 21 bp, Homo sapiens
actaggcatgtcagaggaccc

SEQ ID NO: 1136975 - DNA, 17 bp, Homo sapiens
actaggctaaactcaag

SEQ ID NO: 1136976 - DNA, 18 bp, Homo sapiens
actagggactatcaggta

SEQ ID NO: 1136977 - DNA, 19 bp, Homo sapiens
actagggagccatttgaga

SEQ ID NO: 1136978 - DNA, 17 bp, Homo sapiens
actagggattcaggctg

SEQ ID NO: 1136979 - DNA, 18 bp, Homo sapiens
actagggattcaggctgc

SEQ ID NO: 1136980 - DNA, 11 bp, Homo sapiens
actagggctga

SEQ ID NO: 1136981 - DNA, 22 bp, Homo sapiens
actaggggatataggagaggaa

SEQ ID NO: 1136982 - DNA, 21 bp, Homo sapiens
actagggtgagggttttctgt

SEQ ID NO: 1136983 - DNA, 13 bp, Homo sapiens
actaggtaaaatt

SEQ ID NO: 1136984 - DNA, 18 bp, Homo sapiens
actaggtaacttcatatt

SEQ ID NO: 1136985 - DNA, 22 bp, Homo sapiens
actaggtattgtctactctgaa

SEQ ID NO: 1136986 - DNA, 23 bp, Homo sapiens
actaggtattgtctactctgaag

SEQ ID NO: 1136987 - DNA, 19 bp, Homo sapiens
actaggtgacatgtctact

SEQ ID NO: 1136988 - DNA, 13 bp, Homo sapiens
actaggtgtcccc

SEQ ID NO: 1136989 - DNA, 15 bp, Homo sapiens
actaggttcttttcc

SEQ ID NO: 1136990 - DNA, 19 bp, Homo sapiens
actaggttggacagccccc

SEQ ID NO: 1136991 - DNA, 19 bp, Homo sapiens
actagtagttcctgctaca

SEQ ID NO: 1136992 - DNA, 13 bp, Homo sapiens
actagtctgtgta

SEQ ID NO: 1136993 - DNA, 17 bp, Homo sapiens
actagtctgtgtaactt

SEQ ID NO: 1136994 - DNA, 15 bp, Homo sapiens
actagtgacagcttg

SEQ ID NO: 1136995 - DNA, 21 bp, Homo sapiens
actagtgacagtttcttttgt

SEQ ID NO: 1136996 - DNA, 18 bp, Homo sapiens
actagtgagtcagcacct

SEQ ID NO: 1136997 - DNA, 13 bp, Homo sapiens
actagtgcaaatc

SEQ ID NO: 1136998 - DNA, 13 bp, Homo sapiens
actagtgttctgt

SEQ ID NO: 1136999 - DNA, 22 bp, Homo sapiens
actagttacacatcttcaacag

SEQ ID NO: 1137000 - DNA, 17 bp, Homo sapiens
actagtttgattattat

SEQ ID NO: 1137001 - DNA, 20 bp, Homo sapiens
actagtttgattattatgtt

SEQ ID NO: 1137002 - DNA, 23 bp, Homo sapiens
actagtttttagaaaagaaagca

SEQ ID NO: 1137003 - DNA, 13 bp, Homo sapiens
actataaaagctt

SEQ ID NO: 1137004 - DNA, 20 bp, Homo sapiens
actataaacttaagggcaag

SEQ ID NO: 1137005 - DNA, 20 bp, Homo sapiens
actataaagaagtaacaaaa

SEQ ID NO: 1137006 - DNA, 12 bp, Homo sapiens
actataaagaga

SEQ ID NO: 1137007 - DNA, 14 bp, Homo sapiens
actataaagagaag

SEQ ID NO: 1137008 - DNA, 12 bp, Homo sapiens
actataaataaa

SEQ ID NO: 1137009 - DNA, 20 bp, Homo sapiens
actataagcaagaaggcaaa

SEQ ID NO: 1137010 - DNA, 15 bp, Homo sapiens
actataaggtgcctc

SEQ ID NO: 1137011 - DNA, 17 bp, Homo sapiens
actataaggtgcctcag

SEQ ID NO: 1137012 - DNA, 15 bp, Homo sapiens
actataatgtgaaat

SEQ ID NO: 1137013 - DNA, 20 bp, Homo sapiens
actatagcaaagtagtactt

SEQ ID NO: 1137014 - DNA, 21 bp, Homo sapiens
actatagtaacttaatactct

SEQ ID NO: 1137015 - DNA, 13 bp, Homo sapiens
actatataaataa

SEQ ID NO: 1137016 - DNA, 14 bp, Homo sapiens
actatataaataag

SEQ ID NO: 1137017 - DNA, 20 bp, Homo sapiens
actatataaccctaggaatt

SEQ ID NO: 1137018 - DNA, 19 bp, Homo sapiens
actatataatttatttcca

SEQ ID NO: 1137019 - DNA, 21 bp, Homo sapiens
actatatcagtagtgtacatt

SEQ ID NO: 1137020 - DNA, 19 bp, Homo sapiens
actatattcatttccactc

SEQ ID NO: 1137021 - DNA, 21 bp, Homo sapiens
actatatttatttttgggttt

SEQ ID NO: 1137022 - DNA, 15 bp, Homo sapiens
actatcattctcagt

SEQ ID NO: 1137023 - DNA, 22 bp, Homo sapiens
actatcatttttacactattgt

SEQ ID NO: 1137024 - DNA, 13 bp, Homo sapiens
actatccaagtgt

SEQ ID NO: 1137025 - DNA, 17 bp, Homo sapiens
actatcccaatcaaaga

SEQ ID NO: 1137026 - DNA, 15 bp, Homo sapiens
actatcctgtaaata

SEQ ID NO: 1137027 - DNA, 21 bp, Homo sapiens
accggcccctggcagcacagc

SEQ ID NO: 1137028 - DNA, 19 bp, Homo sapiens
accggcctgtgggtctctg

SEQ ID NO: 1137029 - DNA, 20 bp, Homo sapiens
accggcctgtgggtctctga

SEQ ID NO: 1137030 - DNA, 21 bp, Homo sapiens
accggcctgtgggtctctgaa

SEQ ID NO: 1137031 - DNA, 14 bp, Homo sapiens
accggctctcacct

SEQ ID NO: 1137032 - DNA, 19 bp, Homo sapiens
accgggagcctccccctca

SEQ ID NO: 1137033 - DNA, 17 bp, Homo sapiens
accgggcactggcactg

SEQ ID NO: 1137034 - DNA, 21 bp, Homo sapiens
accgggctccatgcctctgga

SEQ ID NO: 1137035 - DNA, 22 bp, Homo sapiens
accggggagcccccgccccgcc

SEQ ID NO: 1137036 - DNA, 14 bp, Homo sapiens
accggggcaagagg

SEQ ID NO: 1137037 - DNA, 14 bp, Homo sapiens
accgggtgggcctg

SEQ ID NO: 1137038 - DNA, 15 bp, Homo sapiens
accgggtgggcctgg

SEQ ID NO: 1137039 - DNA, 21 bp, Homo sapiens
accgggtgggcctggcctgag

SEQ ID NO: 1137040 - DNA, 22 bp, Homo sapiens
accgggtgggcctggcctgagc

SEQ ID NO: 1137041 - DNA, 15 bp, Homo sapiens
accggtccagctggc

SEQ ID NO: 1137042 - DNA, 18 bp, Homo sapiens
accggtccagctggcctg

SEQ ID NO: 1137043 - DNA, 14 bp, Homo sapiens
accggtcccttcca

SEQ ID NO: 1137044 - DNA, 23 bp, Homo sapiens
accgtaaaggtttatttttctgt

SEQ ID NO: 1137045 - DNA, 14 bp, Homo sapiens
accgtcccagggct

SEQ ID NO: 1137046 - DNA, 15 bp, Homo sapiens
accgtccgccctgct

SEQ ID NO: 1137047 - DNA, 17 bp, Homo sapiens
accgtcctgctgtccct

SEQ ID NO: 1137048 - DNA, 23 bp, Homo sapiens
accgtcctgctgtccctgtcagg

SEQ ID NO: 1137049 - DNA, 17 bp, Homo sapiens
accgtcgacaagaatgt

SEQ ID NO: 1137050 - DNA, 16 bp, Homo sapiens
accgtcgggggctgag

SEQ ID NO: 1137051 - DNA, 15 bp, Homo sapiens
accgtctacatttca

SEQ ID NO: 1137052 - DNA, 16 bp, Homo sapiens
accgtctacatttcac

SEQ ID NO: 1137053 - DNA, 16 bp, Homo sapiens
accgtctcactgtgtg

SEQ ID NO: 1137054 - DNA, 17 bp, Homo sapiens
accgtctcactgtgtgt

SEQ ID NO: 1137055 - DNA, 17 bp, Homo sapiens
accgtctcggccctgaa

SEQ ID NO: 1137056 - DNA, 20 bp, Homo sapiens
accgtgatttggaagagagg

SEQ ID NO: 1137057 - DNA, 15 bp, Homo sapiens
accgtgcccacgagg

SEQ ID NO: 1137058 - DNA, 19 bp, Homo sapiens
accgtgccccacctcccca

SEQ ID NO: 1137059 - DNA, 23 bp, Homo sapiens
accgtgccccacctccccacaca

SEQ ID NO: 1137060 - DNA, 11 bp, Homo sapiens
accgtgcctgg

SEQ ID NO: 1137061 - DNA, 12 bp, Homo sapiens
accgtgcctggc

SEQ ID NO: 1137062 - DNA, 15 bp, Homo sapiens
accgtgcgagctgcc

SEQ ID NO: 1137063 - DNA, 13 bp, Homo sapiens
accgtggcctggg

SEQ ID NO: 1137064 - DNA, 17 bp, Homo sapiens
accgtggcctgggcttg

SEQ ID NO: 1137065 - DNA, 18 bp, Homo sapiens
accgtgggcagggagcgg

SEQ ID NO: 1137066 - DNA, 14 bp, Homo sapiens
accgtggggaaggg

SEQ ID NO: 1137067 - DNA, 15 bp, Homo sapiens
accgtggggaagggg

SEQ ID NO: 1137068 - DNA, 21 bp, Homo sapiens
accgtgggggaactgacgctg

SEQ ID NO: 1137069 - DNA, 17 bp, Homo sapiens
accgtggtatgtctgcc

SEQ ID NO: 1137070 - DNA, 20 bp, Homo sapiens
accgtggtatgtctgccatg

SEQ ID NO: 1137071 - DNA, 12 bp, Homo sapiens
accgtgtacaat

SEQ ID NO: 1137072 - DNA, 13 bp, Homo sapiens
accgtgtcaagct

SEQ ID NO: 1137073 - DNA, 14 bp, Homo sapiens
accgtgtcaagctg

SEQ ID NO: 1137074 - DNA, 23 bp, Homo sapiens
acctcagctgcacattcctggcc

SEQ ID NO: 1137075 - DNA, 16 bp, Homo sapiens
acctcaggagggcagg

SEQ ID NO: 1137076 - DNA, 20 bp, Homo sapiens
acctcaggagggcaggctga

SEQ ID NO: 1137077 - DNA, 18 bp, Homo sapiens
acctcaggatgggccaaa

SEQ ID NO: 1137078 - DNA, 12 bp, Homo sapiens
acctcaggcagc

SEQ ID NO: 1137079 - DNA, 13 bp, Homo sapiens
acctcaggccagg

SEQ ID NO: 1137080 - DNA, 18 bp, Homo sapiens
acctcaggcttccttggc

SEQ ID NO: 1137081 - DNA, 12 bp, Homo sapiens
acctcagggcac

SEQ ID NO: 1137082 - DNA, 15 bp, Homo sapiens
acctcagggccaagc

SEQ ID NO: 1137083 - DNA, 12 bp, Homo sapiens
acctcagggctc

SEQ ID NO: 1137084 - DNA, 20 bp, Homo sapiens
acctcagggctcccaggggt

SEQ ID NO: 1137085 - DNA, 22 bp, Homo sapiens
acctcagggctgtcccagcccc

SEQ ID NO: 1137086 - DNA, 18 bp, Homo sapiens
acctcaggggcacctccg

SEQ ID NO: 1137087 - DNA, 18 bp, Homo sapiens
acctcaggtgagaagcag

SEQ ID NO: 1137088 - DNA, 17 bp, Homo sapiens
acctcagtaatttagaa

SEQ ID NO: 1137089 - DNA, 14 bp, Homo sapiens
acctcagtagaaaa

SEQ ID NO: 1137090 - DNA, 15 bp, Homo sapiens
acctcagtatttatg

SEQ ID NO: 1137091 - DNA, 15 bp, Homo sapiens
acctcagtcatattt

SEQ ID NO: 1137092 - DNA, 21 bp, Homo sapiens
acctcagtggatcttcagaac

SEQ ID NO: 1137093 - DNA, 21 bp, Homo sapiens
acctcagtgtcatttatgaaa

SEQ ID NO: 1137094 - DNA, 16 bp, Homo sapiens
acctcagttcccttgg

SEQ ID NO: 1137095 - DNA, 17 bp, Homo sapiens
acctcagttcccttggc

SEQ ID NO: 1137096 - DNA, 18 bp, Homo sapiens
acctcagttcccttggcc

SEQ ID NO: 1137097 - DNA, 17 bp, Homo sapiens
acctcagttttatcatt

SEQ ID NO: 1137098 - DNA, 16 bp, Homo sapiens
acctcatcactggact

SEQ ID NO: 1137099 - DNA, 14 bp, Homo sapiens
acctcatcaggatg

SEQ ID NO: 1137100 - DNA, 15 bp, Homo sapiens
acctcatcaggatga

SEQ ID NO: 1137101 - DNA, 18 bp, Homo sapiens
acctcatcaggatgaacc

SEQ ID NO: 1137102 - DNA, 20 bp, Homo sapiens
acctcatcaggatgaaccca

SEQ ID NO: 1137103 - DNA, 23 bp, Homo sapiens
acctcatctctgaaaattctgga

SEQ ID NO: 1137104 - DNA, 22 bp, Homo sapiens
acctcatctgtggagctgccac

SEQ ID NO: 1137105 - DNA, 13 bp, Homo sapiens
acctcatgcccac

SEQ ID NO: 1137106 - DNA, 21 bp, Homo sapiens
acctcatgcccaccccctgcc

SEQ ID NO: 1137107 - DNA, 22 bp, Homo sapiens
acctcatgcccaccccctgccc

SEQ ID NO: 1137108 - DNA, 17 bp, Homo sapiens
acctcatgcccagctct

SEQ ID NO: 1137109 - DNA, 20 bp, Homo sapiens
acctcatgcccagctctctg

SEQ ID NO: 1137110 - DNA, 20 bp, Homo sapiens
acctcatggattgccacagc

SEQ ID NO: 1137111 - DNA, 19 bp, Homo sapiens
acctcatggtcatggacag

SEQ ID NO: 1137112 - DNA, 20 bp, Homo sapiens
acctcattccggccacatca

SEQ ID NO: 1137113 - DNA, 13 bp, Homo sapiens
acctcattctgaa

SEQ ID NO: 1137114 - DNA, 21 bp, Homo sapiens
acctccaaagcttcccacggc

SEQ ID NO: 1137115 - DNA, 14 bp, Homo sapiens
acctccaaccctgc

SEQ ID NO: 1137116 - DNA, 16 bp, Homo sapiens
acctccaaccctgccg

SEQ ID NO: 1137117 - DNA, 20 bp, Homo sapiens
acctccaactggatgttgac

SEQ ID NO: 1137118 - DNA, 21 bp, Homo sapiens
acctccaagcaagtagctttc

SEQ ID NO: 1137119 - DNA, 18 bp, Homo sapiens
acctccaagcatttcatg

SEQ ID NO: 1137120 - DNA, 19 bp, Homo sapiens
acctccaataaagtgcctt

SEQ ID NO: 1137121 - DNA, 17 bp, Homo sapiens
acctccaatgctgcctg

SEQ ID NO: 1137122 - DNA, 19 bp, Homo sapiens
acctccacacccgtgagaa

SEQ ID NO: 1137123 - DNA, 17 bp, Homo sapiens
acctccacccagcccct

SEQ ID NO: 1137124 - DNA, 17 bp, Homo sapiens
acctccacccccgccac

SEQ ID NO: 1137125 - DNA, 19 bp, Homo sapiens
acctccacgccactgcctc

SEQ ID NO: 1137126 - DNA, 20 bp, Homo sapiens
acctccacgccactgcctcc

SEQ ID NO: 1137127 - DNA, 16 bp, Homo sapiens
acctccagcccgggag

SEQ ID NO: 1137128 - DNA, 14 bp, Homo sapiens
acctccagcctccc

SEQ ID NO: 1137129 - DNA, 21 bp, Homo sapiens
acctccagcctccctgtctcc

SEQ ID NO: 1137130 - DNA, 18 bp, Homo sapiens
acctccaggggctcctgg

SEQ ID NO: 1137131 - DNA, 19 bp, Homo sapiens
acctccagtcacactcccc

SEQ ID NO: 1137132 - DNA, 15 bp, Homo sapiens
acctccatatgctgt

SEQ ID NO: 1137133 - DNA, 15 bp, Homo sapiens
acctccatccctgct

SEQ ID NO: 1137134 - DNA, 16 bp, Homo sapiens
acctccatccctgctc

SEQ ID NO: 1137135 - DNA, 16 bp, Homo sapiens
acctccattaaagtct

SEQ ID NO: 1137136 - DNA, 20 bp, Homo sapiens
acctccattaaagtctgaat

SEQ ID NO: 1137137 - DNA, 13 bp, Homo sapiens
acctcccaactct

SEQ ID NO: 1137138 - DNA, 16 bp, Homo sapiens
acctcccacactccca

SEQ ID NO: 1137139 - DNA, 21 bp, Homo sapiens
acctcccactttgtctgtaca

SEQ ID NO: 1137140 - DNA, 13 bp, Homo sapiens
acctcccagaggt

SEQ ID NO: 1137141 - DNA, 14 bp, Homo sapiens
acctcccagaggtc

SEQ ID NO: 1137142 - DNA, 21 bp, Homo sapiens
acctcccagaggtccagccca

SEQ ID NO: 1137143 - DNA, 23 bp, Homo sapiens
acctcccagaggtccagcccatc

SEQ ID NO: 1137144 - DNA, 14 bp, Homo sapiens
acctcccagcccta

SEQ ID NO: 1137145 - DNA, 19 bp, Homo sapiens
acctcccagccctatggat

SEQ ID NO: 1137146 - DNA, 22 bp, Homo sapiens
acctcccagccctatggatgtg

SEQ ID NO: 1137147 - DNA, 14 bp, Homo sapiens
acctcccatttctg

SEQ ID NO: 1137148 - DNA, 19 bp, Homo sapiens
acctccccacacacaggcc

SEQ ID NO: 1137149 - DNA, 21 bp, Homo sapiens
acctccccacacacaggcctt

SEQ ID NO: 1137150 - DNA, 15 bp, Homo sapiens
acctccccagcattc

SEQ ID NO: 1137151 - DNA, 23 bp, Homo sapiens
acctccccagcattccagcccct

SEQ ID NO: 1137152 - DNA, 13 bp, Homo sapiens
acctccccccact

SEQ ID NO: 1137153 - DNA, 15 bp, Homo sapiens
acctccccccactgc

SEQ ID NO: 1137154 - DNA, 22 bp, Homo sapiens
acctccccccactgcaggcccc

SEQ ID NO: 1137155 - DNA, 16 bp, Homo sapiens
acctccccctacccat

SEQ ID NO: 1137156 - DNA, 20 bp, Homo sapiens
accctgcaagaccacggagg

SEQ ID NO: 1137157 - DNA, 14 bp, Homo sapiens
accctgcaccctcc

SEQ ID NO: 1137158 - DNA, 16 bp, Homo sapiens
accctgcaccctccta

SEQ ID NO: 1137159 - DNA, 15 bp, Homo sapiens
accctgcacctgctg

SEQ ID NO: 1137160 - DNA, 23 bp, Homo sapiens
accctgcacctgctgcgtcccca

SEQ ID NO: 1137161 - DNA, 18 bp, Homo sapiens
accctgcaggacttgcca

SEQ ID NO: 1137162 - DNA, 19 bp, Homo sapiens
accctgccacagccagagg

SEQ ID NO: 1137163 - DNA, 13 bp, Homo sapiens
accctgccagtgc

SEQ ID NO: 1137164 - DNA, 17 bp, Homo sapiens
accctgccagtgccagg

SEQ ID NO: 1137165 - DNA, 20 bp, Homo sapiens
accctgccagtgccagggtg

SEQ ID NO: 1137166 - DNA, 17 bp, Homo sapiens
accctgccccagctggg

SEQ ID NO: 1137167 - DNA, 17 bp, Homo sapiens
accctgccccttgccat

SEQ ID NO: 1137168 - DNA, 11 bp, Homo sapiens
accctgccgag

SEQ ID NO: 1137169 - DNA, 18 bp, Homo sapiens
accctgccgagggggctg

SEQ ID NO: 1137170 - DNA, 18 bp, Homo sapiens
accctgccgtcaccacca

SEQ ID NO: 1137171 - DNA, 11 bp, Homo sapiens
accctgcctcc

SEQ ID NO: 1137172 - DNA, 14 bp, Homo sapiens
accctgcctgagcc

SEQ ID NO: 1137173 - DNA, 17 bp, Homo sapiens
accctgcctgagcccag

SEQ ID NO: 1137174 - DNA, 20 bp, Homo sapiens
accctgcctgagcccaggag

SEQ ID NO: 1137175 - DNA, 20 bp, Homo sapiens
accctgcctgtcacctggga

SEQ ID NO: 1137176 - DNA, 18 bp, Homo sapiens
accctgccttatcttgca

SEQ ID NO: 1137177 - DNA, 16 bp, Homo sapiens
accctgcgcctccaga

SEQ ID NO: 1137178 - DNA, 18 bp, Homo sapiens
accctgcgcctccagagg

SEQ ID NO: 1137179 - DNA, 15 bp, Homo sapiens
accctgcgggccagg

SEQ ID NO: 1137180 - DNA, 16 bp, Homo sapiens
accctgcgggccaggg

SEQ ID NO: 1137181 - DNA, 14 bp, Homo sapiens
accctgctcacagg

SEQ ID NO: 1137182 - DNA, 18 bp, Homo sapiens
accctgctcatccactct

SEQ ID NO: 1137183 - DNA, 18 bp, Homo sapiens
accctgctcctcctgccc

SEQ ID NO: 1137184 - DNA, 19 bp, Homo sapiens
accctgctcctcctgccct

SEQ ID NO: 1137185 - DNA, 19 bp, Homo sapiens
accctgctgaacacagtgt

SEQ ID NO: 1137186 - DNA, 23 bp, Homo sapiens
accctgctgaacacagtgtctgt

SEQ ID NO: 1137187 - DNA, 16 bp, Homo sapiens
accctgcttctcccgg

SEQ ID NO: 1137188 - DNA, 17 bp, Homo sapiens
accctgcttctcccggg

SEQ ID NO: 1137189 - DNA, 19 bp, Homo sapiens
accctggaaaggggagttg

SEQ ID NO: 1137190 - DNA, 18 bp, Homo sapiens
accctggaattcagcacc

SEQ ID NO: 1137191 - DNA, 14 bp, Homo sapiens
accctggagccatc

SEQ ID NO: 1137192 - DNA, 13 bp, Homo sapiens
accctggagccca

SEQ ID NO: 1137193 - DNA, 15 bp, Homo sapiens
accctggcattatgt

SEQ ID NO: 1137194 - DNA, 18 bp, Homo sapiens
accctggcccgcccctcg

SEQ ID NO: 1137195 - DNA, 22 bp, Homo sapiens
accctggccgccccctgccccc

SEQ ID NO: 1137196 - DNA, 11 bp, Homo sapiens
accctggcctc

SEQ ID NO: 1137197 - DNA, 23 bp, Homo sapiens
accctgggaagttggagcaagag

SEQ ID NO: 1137198 - DNA, 23 bp, Homo sapiens
accctgggacctatacagaacag

SEQ ID NO: 1137199 - DNA, 15 bp, Homo sapiens
accctgggctgggga

SEQ ID NO: 1137200 - DNA, 20 bp, Homo sapiens
accctgggctgtccagcctt

SEQ ID NO: 1137201 - DNA, 18 bp, Homo sapiens
accctggggcctgactgc

SEQ ID NO: 1137202 - DNA, 22 bp, Homo sapiens
accctggggcctgactgctcag

SEQ ID NO: 1137203 - DNA, 22 bp, Homo sapiens
accctggggcctggacctgcct

SEQ ID NO: 1137204 - DNA, 22 bp, Homo sapiens
accctggggctgcttaggaaac

SEQ ID NO: 1137205 - DNA, 14 bp, Homo sapiens
accctgggtgccat

SEQ ID NO: 1137206 - DNA, 21 bp, Homo sapiens
accctgggtgccattcccagc

SEQ ID NO: 1137207 - DNA, 13 bp, Homo sapiens
accctggtgacct

SEQ ID NO: 1137208 - DNA, 15 bp, Homo sapiens
accctggtgacctcc

SEQ ID NO: 1137209 - DNA, 17 bp, Homo sapiens
accctggtgacctcctg

SEQ ID NO: 1137210 - DNA, 21 bp, Homo sapiens
accctggtgacctcctgtcac

SEQ ID NO: 1137211 - DNA, 21 bp, Homo sapiens
accctggtggtattttatttt

SEQ ID NO: 1137212 - DNA, 17 bp, Homo sapiens
accctggtggttgctgt

SEQ ID NO: 1137213 - DNA, 19 bp, Homo sapiens
accctggtggttgctgttt

SEQ ID NO: 1137214 - DNA, 16 bp, Homo sapiens
accctgtcccccagct

SEQ ID NO: 1137215 - DNA, 19 bp, Homo sapiens
accctgtccggcccagtgc

SEQ ID NO: 1137216 - DNA, 11 bp, Homo sapiens
accctgtcctc

SEQ ID NO: 1137217 - DNA, 19 bp, Homo sapiens
accctgtcctgcagtccca

SEQ ID NO: 1137218 - DNA, 14 bp, Homo sapiens
accctgtctctact

SEQ ID NO: 1137219 - DNA, 21 bp, Homo sapiens
accctgtctcttaaagaaaaa

SEQ ID NO: 1137220 - DNA, 18 bp, Homo sapiens
accatgcagcccctgggc

SEQ ID NO: 1137221 - DNA, 20 bp, Homo sapiens
accatgcagcccctgggccc

SEQ ID NO: 1137222 - DNA, 23 bp, Homo sapiens
accatgccagacccactgaaatg

SEQ ID NO: 1137223 - DNA, 19 bp, Homo sapiens
accatgccaggctaatttt

SEQ ID NO: 1137224 - DNA, 13 bp, Homo sapiens
accatgctcaact

SEQ ID NO: 1137225 - DNA, 14 bp, Homo sapiens
accatgctggcggc

SEQ ID NO: 1137226 - DNA, 21 bp, Homo sapiens
accatgctggcggcgcagagg

SEQ ID NO: 1137227 - DNA, 21 bp, Homo sapiens
accatggacactacacccagc

SEQ ID NO: 1137228 - DNA, 22 bp, Homo sapiens
accatggacactacacccagca

SEQ ID NO: 1137229 - DNA, 23 bp, Homo sapiens
accatggacactacacccagcaa

SEQ ID NO: 1137230 - DNA, 24 bp, Homo sapiens
accatggacactacacccagcaat

SEQ ID NO: 1137231 - DNA, 15 bp, Homo sapiens
accatggccagccaa

SEQ ID NO: 1137232 - DNA, 21 bp, Homo sapiens
accatgggaggtggggcctca

SEQ ID NO: 1137233 - DNA, 22 bp, Homo sapiens
accatggtcggaaaacatgcta

SEQ ID NO: 1137234 - DNA, 18 bp, Homo sapiens
accatgtaagcactctgg

SEQ ID NO: 1137235 - DNA, 17 bp, Homo sapiens
accatgtacatgaagaa

SEQ ID NO: 1137236 - DNA, 12 bp, Homo sapiens
accatgtcattt

SEQ ID NO: 1137237 - DNA, 18 bp, Homo sapiens
accatgtcatttcagaag

SEQ ID NO: 1137238 - DNA, 22 bp, Homo sapiens
accatgtgaaactctaccctga

SEQ ID NO: 1137239 - DNA, 12 bp, Homo sapiens
accatgtgccat

SEQ ID NO: 1137240 - DNA, 12 bp, Homo sapiens
accatgtggcca

SEQ ID NO: 1137241 - DNA, 16 bp, Homo sapiens
accatgtgtcacttgt

SEQ ID NO: 1137242 - DNA, 17 bp, Homo sapiens
accatgtgttatgtttt

SEQ ID NO: 1137243 - DNA, 16 bp, Homo sapiens
accatgttagccttag

SEQ ID NO: 1137244 - DNA, 14 bp, Homo sapiens
accatgttgcgttc

SEQ ID NO: 1137245 - DNA, 18 bp, Homo sapiens
accatgttggccaggctg

SEQ ID NO: 1137246 - DNA, 14 bp, Homo sapiens
accatgttggtcag

SEQ ID NO: 1137247 - DNA, 13 bp, Homo sapiens
accatgtttcaaa

SEQ ID NO: 1137248 - DNA, 19 bp, Homo sapiens
accatgtttgagctcagac

SEQ ID NO: 1137249 - DNA, 20 bp, Homo sapiens
accatgtttgagctcagacc

SEQ ID NO: 1137250 - DNA, 17 bp, Homo sapiens
accattaaaactgcttt

SEQ ID NO: 1137251 - DNA, 18 bp, Homo sapiens
accattaaaactgctttt

SEQ ID NO: 1137252 - DNA, 13 bp, Homo sapiens
accattaaagtca

SEQ ID NO: 1137253 - DNA, 13 bp, Homo sapiens
accattacatgtt

SEQ ID NO: 1137254 - DNA, 15 bp, Homo sapiens
accattataatttat

SEQ ID NO: 1137255 - DNA, 14 bp, Homo sapiens
accattcacatttg

SEQ ID NO: 1137256 - DNA, 22 bp, Homo sapiens
accattcactactcatgcgtga

SEQ ID NO: 1137257 - DNA, 21 bp, Homo sapiens
accattccaagtctccacccc

SEQ ID NO: 1137258 - DNA, 13 bp, Homo sapiens
accattcctgcct

SEQ ID NO: 1137259 - DNA, 14 bp, Homo sapiens
accattcctgcctt

SEQ ID NO: 1137260 - DNA, 16 bp, Homo sapiens
accattccttcaaata

SEQ ID NO: 1137261 - DNA, 17 bp, Homo sapiens
accattccttcaaataa

SEQ ID NO: 1137262 - DNA, 20 bp, Homo sapiens
accattccttcaaataaaga

SEQ ID NO: 1137263 - DNA, 21 bp, Homo sapiens
accattgaaatcagcatgaca

SEQ ID NO: 1137264 - DNA, 22 bp, Homo sapiens
accattgaaatcagcatgacaa

SEQ ID NO: 1137265 - DNA, 16 bp, Homo sapiens
accattgaaggcttaa

SEQ ID NO: 1137266 - DNA, 24 bp, Homo sapiens
accattgacctcagctgcacattc

SEQ ID NO: 1137267 - DNA, 13 bp, Homo sapiens
accattgcttcac

SEQ ID NO: 1137268 - DNA, 15 bp, Homo sapiens
accattgcttcacta

SEQ ID NO: 1137269 - DNA, 21 bp, Homo sapiens
accattggacagtctccctga

SEQ ID NO: 1137270 - DNA, 16 bp, Homo sapiens
accattgtaactatta

SEQ ID NO: 1137271 - DNA, 22 bp, Homo sapiens
accattgtcctaagaacaatgc

SEQ ID NO: 1137272 - DNA, 22 bp, Homo sapiens
accattgttctgaatgctgctt

SEQ ID NO: 1137273 - DNA, 11 bp, Homo sapiens
accatttataa

SEQ ID NO: 1137274 - DNA, 12 bp, Homo sapiens
accatttataat

SEQ ID NO: 1137275 - DNA, 14 bp, Homo sapiens
accatttcagagag

SEQ ID NO: 1137276 - DNA, 20 bp, Homo sapiens
accatttcagagaggccttt

SEQ ID NO: 1137277 - DNA, 20 bp, Homo sapiens
accatttcttggcattggaa

SEQ ID NO: 1137278 - DNA, 13 bp, Homo sapiens
accatttgtaata

SEQ ID NO: 1137279 - DNA, 18 bp, Homo sapiens
accatttgtaataaagta

SEQ ID NO: 1137280 - DNA, 21 bp, Homo sapiens
accatttgtaataaagtatat

SEQ ID NO: 1137281 - DNA, 22 bp, Homo sapiens
accattttaacctagatgttta

SEQ ID NO: 1137282 - DNA, 14 bp, Homo sapiens
accattttagtttt

SEQ ID NO: 1137283 - DNA, 15 bp, Homo sapiens
accattttcctttgg

SEQ ID NO: 1137284 - DNA, 11 bp, Homo sapiens
accattttcta

SEQ ID NO: 1137285 - DNA, 22 bp, Homo sapiens
accatttttaaagtagaagagg

SEQ ID NO: 1137286 - DNA, 16 bp, Homo sapiens
accatttttgttactc

SEQ ID NO: 1137287 - DNA, 22 bp, Homo sapiens
accattttttaaggaaacaata

SEQ ID NO: 1137288 - DNA, 20 bp, Homo sapiens
acccaaaaatatctcctcca

SEQ ID NO: 1137289 - DNA, 15 bp, Homo sapiens
acccaaaagaaactg

SEQ ID NO: 1137290 - DNA, 16 bp, Homo sapiens
acccaaacacttctgc

SEQ ID NO: 1137291 - DNA, 19 bp, Homo sapiens
acccaaacacttctgcttt

SEQ ID NO: 1137292 - DNA, 14 bp, Homo sapiens
acccaaaccctagg

SEQ ID NO: 1137293 - DNA, 15 bp, Homo sapiens
acccaaaccctaggt

SEQ ID NO: 1137294 - DNA, 18 bp, Homo sapiens
acccaaagaccaatattc

SEQ ID NO: 1137295 - DNA, 13 bp, Homo sapiens
acccaaagcaaaa

SEQ ID NO: 1137296 - DNA, 22 bp, Homo sapiens
acccaaagcacatgcttagctt

SEQ ID NO: 1137297 - DNA, 13 bp, Homo sapiens
acccaaagccctg

SEQ ID NO: 1137298 - DNA, 21 bp, Homo sapiens
acccaaagcctgtcccaggac

SEQ ID NO: 1137299 - DNA, 15 bp, Homo sapiens
acccaacagctcaga

SEQ ID NO: 1137300 - DNA, 15 bp, Homo sapiens
acccaacccaaacca

SEQ ID NO: 1137301 - DNA, 16 bp, Homo sapiens
acccaacccaaaccat

SEQ ID NO: 1137302 - DNA, 18 bp, Homo sapiens
acccaacccaatccctct

SEQ ID NO: 1137303 - DNA, 17 bp, Homo sapiens
acccaaccctatctcct

SEQ ID NO: 1137304 - DNA, 18 bp, Homo sapiens
acccaactgacctgccag

SEQ ID NO: 1137305 - DNA, 22 bp, Homo sapiens
acccaagagaggaaggacccct

SEQ ID NO: 1137306 - DNA, 15 bp, Homo sapiens
acccaagcaaggcca

SEQ ID NO: 1137307 - DNA, 13 bp, Homo sapiens
acccaggctgcac

SEQ ID NO: 1137308 - DNA, 15 bp, Homo sapiens
acccaggctgcactg

SEQ ID NO: 1137309 - DNA, 17 bp, Homo sapiens
acccaggctgcactgca

SEQ ID NO: 1137310 - DNA, 23 bp, Homo sapiens
acccaggctggtctcaaactcct

SEQ ID NO: 1137311 - DNA, 12 bp, Homo sapiens
acccagggagct

SEQ ID NO: 1137312 - DNA, 21 bp, Homo sapiens
acccagggcccaggcaaatca

SEQ ID NO: 1137313 - DNA, 22 bp, Homo sapiens
acccagggcctgacttgagcca

SEQ ID NO: 1137314 - DNA, 23 bp, Homo sapiens
acccagggcctgacttgagccac

SEQ ID NO: 1137315 - DNA, 23 bp, Homo sapiens
acccagggctagtataaacatga

SEQ ID NO: 1137316 - DNA, 18 bp, Homo sapiens
acccagggctctgcccca

SEQ ID NO: 1137317 - DNA, 21 bp, Homo sapiens
acccagggctctgccccagtc

SEQ ID NO: 1137318 - DNA, 22 bp, Homo sapiens
acccaggggaaggccctgaggc

SEQ ID NO: 1137319 - DNA, 15 bp, Homo sapiens
acccagtattactgc

SEQ ID NO: 1137320 - DNA, 19 bp, Homo sapiens
acccagtattactgctgct

SEQ ID NO: 1137321 - DNA, 18 bp, Homo sapiens
acccagtcacctctgtct

SEQ ID NO: 1137322 - DNA, 21 bp, Homo sapiens
acccagtcccacactgtggcc

SEQ ID NO: 1137323 - DNA, 17 bp, Homo sapiens
acccagtccccgtgccc

SEQ ID NO: 1137324 - DNA, 14 bp, Homo sapiens
acccagtccctggg

SEQ ID NO: 1137325 - DNA, 17 bp, Homo sapiens
acccagtctcctctcca

SEQ ID NO: 1137326 - DNA, 22 bp, Homo sapiens
acccagtgaggatgctgcagtg

SEQ ID NO: 1137327 - DNA, 15 bp, Homo sapiens
acccagtgctgccat

SEQ ID NO: 1137328 - DNA, 18 bp, Homo sapiens
acccagtgctgccatgcc

SEQ ID NO: 1137329 - DNA, 22 bp, Homo sapiens
acccagtgctgccatgccactg

SEQ ID NO: 1137330 - DNA, 14 bp, Homo sapiens
acccagtggaattc

SEQ ID NO: 1137331 - DNA, 15 bp, Homo sapiens
acccagttctgaata

SEQ ID NO: 1137332 - DNA, 18 bp, Homo sapiens
acccagttgccatctgcg

SEQ ID NO: 1137333 - DNA, 15 bp, Homo sapiens
acccataatcatgta

SEQ ID NO: 1137334 - DNA, 16 bp, Homo sapiens
acccatacaatgtatg

SEQ ID NO: 1137335 - DNA, 17 bp, Homo sapiens
acccatacaatgtatgt

SEQ ID NO: 1137336 - DNA, 16 bp, Homo sapiens
acccatagcttccatg

SEQ ID NO: 1137337 - DNA, 23 bp, Homo sapiens
acccatatccttaccctccttgg

SEQ ID NO: 1137338 - DNA, 15 bp, Homo sapiens
acccatcaacaaaaa

SEQ ID NO: 1137339 - DNA, 19 bp, Homo sapiens
acccatcggtgtccattta

SEQ ID NO: 1137340 - DNA, 21 bp, Homo sapiens
acccatcggtgtccatttata

SEQ ID NO: 1137341 - DNA, 17 bp, Homo sapiens
acccatcttcctgctgc

SEQ ID NO: 1137342 - DNA, 20 bp, Homo sapiens
acccatctttaatttatatc

SEQ ID NO: 1137343 - DNA, 23 bp, Homo sapiens
acccatgactttatatggatgat

SEQ ID NO: 1137344 - DNA, 20 bp, Homo sapiens
acccatgagcctgcccgctg

SEQ ID NO: 1137345 - DNA, 20 bp, Homo sapiens
acccatgaggcaatgtcagg

SEQ ID NO: 1137346 - DNA, 23 bp, Homo sapiens
acccatgcacactcatgcacaca

SEQ ID NO: 1137347 - DNA, 16 bp, Homo sapiens
acccatgccagagagg

SEQ ID NO: 1137348 - DNA, 15 bp, Homo sapiens
accaggcaaattcac

SEQ ID NO: 1137349 - DNA, 12 bp, Homo sapiens
accaggcagctg

SEQ ID NO: 1137350 - DNA, 18 bp, Homo sapiens
accaggcagctgagacca

SEQ ID NO: 1137351 - DNA, 12 bp, Homo sapiens
accaggccacct

SEQ ID NO: 1137352 - DNA, 15 bp, Homo sapiens
accaggccattctgc

SEQ ID NO: 1137353 - DNA, 17 bp, Homo sapiens
accaggcccaaggaggg

SEQ ID NO: 1137354 - DNA, 18 bp, Homo sapiens
accaggccgtcctcccgg

SEQ ID NO: 1137355 - DNA, 19 bp, Homo sapiens
accaggccgtcctcccggg

SEQ ID NO: 1137356 - DNA, 19 bp, Homo sapiens
accaggctggagtgcagtg

SEQ ID NO: 1137357 - DNA, 19 bp, Homo sapiens
accaggctggcgcagccaa

SEQ ID NO: 1137358 - DNA, 20 bp, Homo sapiens
accaggctggcgcagccaag

SEQ ID NO: 1137359 - DNA, 23 bp, Homo sapiens
accagggaagaagatcaacgcct

SEQ ID NO: 1137360 - DNA, 17 bp, Homo sapiens
accagggactgcagctg

SEQ ID NO: 1137361 - DNA, 21 bp, Homo sapiens
accagggagaccgagcgcttt

SEQ ID NO: 1137362 - DNA, 13 bp, Homo sapiens
accagggatgctg

SEQ ID NO: 1137363 - DNA, 14 bp, Homo sapiens
accagggatgctgg

SEQ ID NO: 1137364 - DNA, 18 bp, Homo sapiens
accagggatgctgggctg

SEQ ID NO: 1137365 - DNA, 23 bp, Homo sapiens
accagggcgaacgacaatagctt

SEQ ID NO: 1137366 - DNA, 18 bp, Homo sapiens
accagggcgctgggaagg

SEQ ID NO: 1137367 - DNA, 17 bp, Homo sapiens
accaggggaaggaagga

SEQ ID NO: 1137368 - DNA, 21 bp, Homo sapiens
accaggggcccaccctctgcc

SEQ ID NO: 1137369 - DNA, 24 bp, Homo sapiens
accaggggtgatttcagagagggc

SEQ ID NO: 1137370 - DNA, 14 bp, Homo sapiens
accagggtcccagg

SEQ ID NO: 1137371 - DNA, 15 bp, Homo sapiens
accagggtcccagga

SEQ ID NO: 1137372 - DNA, 16 bp, Homo sapiens
accagggtcccaggaa

SEQ ID NO: 1137373 - DNA, 17 bp, Homo sapiens
accagggtcccaggaag

SEQ ID NO: 1137374 - DNA, 19 bp, Homo sapiens
accagggtcccaggaagcc

SEQ ID NO: 1137375 - DNA, 19 bp, Homo sapiens
accagggtccgcaccagct

SEQ ID NO: 1137376 - DNA, 21 bp, Homo sapiens
accagggtccgcaccagctgc

SEQ ID NO: 1137377 - DNA, 23 bp, Homo sapiens
accagggtccgcaccagctgctc

SEQ ID NO: 1137378 - DNA, 21 bp, Homo sapiens
accagggtccttttgacactg

SEQ ID NO: 1137379 - DNA, 21 bp, Homo sapiens
accagggtggaccaggcctgg

SEQ ID NO: 1137380 - DNA, 14 bp, Homo sapiens
accagggtttagtt

SEQ ID NO: 1137381 - DNA, 21 bp, Homo sapiens
accaggtcaccatcctcagag

SEQ ID NO: 1137382 - DNA, 17 bp, Homo sapiens
accaggtccagatgtgc

SEQ ID NO: 1137383 - DNA, 16 bp, Homo sapiens
accaggtcttggagct

SEQ ID NO: 1137384 - DNA, 23 bp, Homo sapiens
accaggtgcctttcaaatttaga

SEQ ID NO: 1137385 - DNA, 22 bp, Homo sapiens
accaggtgggagcgttttgttg

SEQ ID NO: 1137386 - DNA, 18 bp, Homo sapiens
accagtacctctgtatag

SEQ ID NO: 1137387 - DNA, 23 bp, Homo sapiens
accagtacctctgtatagaaatc

SEQ ID NO: 1137388 - DNA, 20 bp, Homo sapiens
accagtaggggcttataata

SEQ ID NO: 1137389 - DNA, 18 bp, Homo sapiens
accagtatttttgctgct

SEQ ID NO: 1137390 - DNA, 21 bp, Homo sapiens
accagtatttttgctgcttct

SEQ ID NO: 1137391 - DNA, 19 bp, Homo sapiens
accagtctcctcactctgt

SEQ ID NO: 1137392 - DNA, 18 bp, Homo sapiens
accagtctgtaaaataca

SEQ ID NO: 1137393 - DNA, 12 bp, Homo sapiens
accagtctgtct

SEQ ID NO: 1137394 - DNA, 21 bp, Homo sapiens
accagtctttaaaggcccagc

SEQ ID NO: 1137395 - DNA, 22 bp, Homo sapiens
accagtgagaactctctccctg

SEQ ID NO: 1137396 - DNA, 23 bp, Homo sapiens
accagtgcccaaagtctgtgtga

SEQ ID NO: 1137397 - DNA, 22 bp, Homo sapiens
accagtggcgttgttgcatgtt

SEQ ID NO: 1137398 - DNA, 19 bp, Homo sapiens
accagtgggatgggctcta

SEQ ID NO: 1137399 - DNA, 19 bp, Homo sapiens
accagtgtagcatcttcct

SEQ ID NO: 1137400 - DNA, 21 bp, Homo sapiens
accagtgtagcatcttcctct

SEQ ID NO: 1137401 - DNA, 16 bp, Homo sapiens
accagtgtagccttgc

SEQ ID NO: 1137402 - DNA, 18 bp, Homo sapiens
accagtgtcccctccact

SEQ ID NO: 1137403 - DNA, 21 bp, Homo sapiens
accagtgtggtttgtgtttga

SEQ ID NO: 1137404 - DNA, 15 bp, Homo sapiens
accagtgtgtggggg

SEQ ID NO: 1137405 - DNA, 16 bp, Homo sapiens
accagtgtgtggggga

SEQ ID NO: 1137406 - DNA, 14 bp, Homo sapiens
accagtgttgggtt

SEQ ID NO: 1137407 - DNA, 19 bp, Homo sapiens
accagtgttgggttttttt

SEQ ID NO: 1137408 - DNA, 16 bp, Homo sapiens
accagttaatttttcc

SEQ ID NO: 1137409 - DNA, 22 bp, Homo sapiens
accagttctcgttttgggccag

SEQ ID NO: 1137410 - DNA, 22 bp, Homo sapiens
accagttgccctagcccagact

SEQ ID NO: 1137411 - DNA, 14 bp, Homo sapiens
accagttgcctttt

SEQ ID NO: 1137412 - DNA, 15 bp, Homo sapiens
accagttgtatttaa

SEQ ID NO: 1137413 - DNA, 15 bp, Homo sapiens
accagtttatacaga

SEQ ID NO: 1137414 - DNA, 12 bp, Homo sapiens
accagtttgcat

SEQ ID NO: 1137415 - DNA, 18 bp, Homo sapiens
accagtttgtccatcttg

SEQ ID NO: 1137416 - DNA, 16 bp, Homo sapiens
accataaaaagaggat

SEQ ID NO: 1137417 - DNA, 22 bp, Homo sapiens
accataaatcaattcatgttta

SEQ ID NO: 1137418 - DNA, 23 bp, Homo sapiens
accataacaccgtcccagggctc

SEQ ID NO: 1137419 - DNA, 21 bp, Homo sapiens
accataagggactgtgccaga

SEQ ID NO: 1137420 - DNA, 13 bp, Homo sapiens
accataatcttat

SEQ ID NO: 1137421 - DNA, 19 bp, Homo sapiens
accataattttttttaaag

SEQ ID NO: 1137422 - DNA, 16 bp, Homo sapiens
accatactaattatac

SEQ ID NO: 1137423 - DNA, 15 bp, Homo sapiens
accatactgagggac

SEQ ID NO: 1137424 - DNA, 16 bp, Homo sapiens
accatactgtctctgg

SEQ ID NO: 1137425 - DNA, 12 bp, Homo sapiens
accatagaaaaa

SEQ ID NO: 1137426 - DNA, 15 bp, Homo sapiens
accatagaaaaatgt

SEQ ID NO: 1137427 - DNA, 16 bp, Homo sapiens
accataggaagacata

SEQ ID NO: 1137428 - DNA, 21 bp, Homo sapiens
accatagtaccatttatacaa

SEQ ID NO: 1137429 - DNA, 16 bp, Homo sapiens
accatagttttgttta

SEQ ID NO: 1137430 - DNA, 18 bp, Homo sapiens
accatagttttgtttaat

SEQ ID NO: 1137431 - DNA, 20 bp, Homo sapiens
accatatgtctgcttctgtc

SEQ ID NO: 1137432 - DNA, 14 bp, Homo sapiens
accatattaccaca

SEQ ID NO: 1137433 - DNA, 20 bp, Homo sapiens
accatattaccacagacata

SEQ ID NO: 1137434 - DNA, 22 bp, Homo sapiens
accatattgtgcttcacagtag

SEQ ID NO: 1137435 - DNA, 17 bp, Homo sapiens
accatcaagttgtgcca

SEQ ID NO: 1137436 - DNA, 13 bp, Homo sapiens
accatcaataaag

SEQ ID NO: 1137437 - DNA, 21 bp, Homo sapiens
accatcaccaccgcctctggc

SEQ ID NO: 1137438 - DNA, 22 bp, Homo sapiens
accatcactcactcactcccca

SEQ ID NO: 1137439 - DNA, 17 bp, Homo sapiens
accactggtacttcctt

SEQ ID NO: 1137440 - DNA, 17 bp, Homo sapiens
accactggtcccagagc

SEQ ID NO: 1137441 - DNA, 16 bp, Homo sapiens
accactggtctgtagg

SEQ ID NO: 1137442 - DNA, 12 bp, Homo sapiens
accactgtctcc

SEQ ID NO: 1137443 - DNA, 18 bp, Homo sapiens
accactgtgccactgact

SEQ ID NO: 1137444 - DNA, 16 bp, Homo sapiens
accactgtgtatttaa

SEQ ID NO: 1137445 - DNA, 20 bp, Homo sapiens
accacttatttattgttgcc

SEQ ID NO: 1137446 - DNA, 16 bp, Homo sapiens
accacttctccatgct

SEQ ID NO: 1137447 - DNA, 17 bp, Homo sapiens
accacttctccatgctg

SEQ ID NO: 1137448 - DNA, 20 bp, Homo sapiens
accacttctccatgctgcaa

SEQ ID NO: 1137449 - DNA, 22 bp, Homo sapiens
accacttctctgctgcctctgt

SEQ ID NO: 1137450 - DNA, 14 bp, Homo sapiens
accacttctgtggg

SEQ ID NO: 1137451 - DNA, 15 bp, Homo sapiens
accacttctgtgggc

SEQ ID NO: 1137452 - DNA, 18 bp, Homo sapiens
accacttctgtgggcatg

SEQ ID NO: 1137453 - DNA, 21 bp, Homo sapiens
accacttgaatttattgatat

SEQ ID NO: 1137454 - DNA, 22 bp, Homo sapiens
accacttttctgctgttgcctc

SEQ ID NO: 1137455 - DNA, 14 bp, Homo sapiens
accagaaaagcaat

SEQ ID NO: 1137456 - DNA, 22 bp, Homo sapiens
accagaaacacccctctgtcta

SEQ ID NO: 1137457 - DNA, 16 bp, Homo sapiens
accagaaacagggaca

SEQ ID NO: 1137458 - DNA, 15 bp, Homo sapiens
accagaaattccagt

SEQ ID NO: 1137459 - DNA, 16 bp, Homo sapiens
accagaacgcacccca

SEQ ID NO: 1137460 - DNA, 18 bp, Homo sapiens
accagaacgcaccccact

SEQ ID NO: 1137461 - DNA, 21 bp, Homo sapiens
accagacgccttcctctctgg

SEQ ID NO: 1137462 - DNA, 23 bp, Homo sapiens
accagacgtcaggccctgactcc

SEQ ID NO: 1137463 - DNA, 16 bp, Homo sapiens
accagacttggcctcc

SEQ ID NO: 1137464 - DNA, 12 bp, Homo sapiens
accagactttga

SEQ ID NO: 1137465 - DNA, 19 bp, Homo sapiens
accagagcaacctctcact

SEQ ID NO: 1137466 - DNA, 16 bp, Homo sapiens
accagagccgggagga

SEQ ID NO: 1137467 - DNA, 19 bp, Homo sapiens
accagaggctgcagaaggc

SEQ ID NO: 1137468 - DNA, 21 bp, Homo sapiens
accagaggctgcagaaggcca

SEQ ID NO: 1137469 - DNA, 22 bp, Homo sapiens
accagatccttttccagaaata

SEQ ID NO: 1137470 - DNA, 16 bp, Homo sapiens
accagatctttctctt

SEQ ID NO: 1137471 - DNA, 20 bp, Homo sapiens
accagatgaaataatgttct

SEQ ID NO: 1137472 - DNA, 16 bp, Homo sapiens
accagatgaacatttc

SEQ ID NO: 1137473 - DNA, 16 bp, Homo sapiens
accagatgagaattag

SEQ ID NO: 1137474 - DNA, 11 bp, Homo sapiens
accagatgcta

SEQ ID NO: 1137475 - DNA, 14 bp, Homo sapiens
accagatgctactg

SEQ ID NO: 1137476 - DNA, 21 bp, Homo sapiens
accagatgcttttgtgagaaa

SEQ ID NO: 1137477 - DNA, 18 bp, Homo sapiens
accagatgtgcttttatt

SEQ ID NO: 1137478 - DNA, 21 bp, Homo sapiens
accagatgtgcttttatttag

SEQ ID NO: 1137479 - DNA, 21 bp, Homo sapiens
accagattctatcctcatctt

SEQ ID NO: 1137480 - DNA, 15 bp, Homo sapiens
accagcaagtcccag

SEQ ID NO: 1137481 - DNA, 17 bp, Homo sapiens
accagcaagtcccagac

SEQ ID NO: 1137482 - DNA, 17 bp, Homo sapiens
accagcaatatatctga

SEQ ID NO: 1137483 - DNA, 14 bp, Homo sapiens
accagcactcagcc

SEQ ID NO: 1137484 - DNA, 15 bp, Homo sapiens
accagcactgtctca

SEQ ID NO: 1137485 - DNA, 16 bp, Homo sapiens
accagcactgtctcag

SEQ ID NO: 1137486 - DNA, 13 bp, Homo sapiens
accagcagaaatg

SEQ ID NO: 1137487 - DNA, 17 bp, Homo sapiens
accagcagcctggaccc

SEQ ID NO: 1137488 - DNA, 18 bp, Homo sapiens
accagcagcgcctttccc

SEQ ID NO: 1137489 - DNA, 23 bp, Homo sapiens
accagcaggaggttctgggcctc

SEQ ID NO: 1137490 - DNA, 14 bp, Homo sapiens
accagcatctggaa

SEQ ID NO: 1137491 - DNA, 17 bp, Homo sapiens
accagcatctggtcttg

SEQ ID NO: 1137492 - DNA, 15 bp, Homo sapiens
accagcattccctac

SEQ ID NO: 1137493 - DNA, 11 bp, Homo sapiens
accagcatttg

SEQ ID NO: 1137494 - DNA, 18 bp, Homo sapiens
accagccagccctggccc

SEQ ID NO: 1137495 - DNA, 11 bp, Homo sapiens
accagccagcg

SEQ ID NO: 1137496 - DNA, 17 bp, Homo sapiens
accagccagtaaatggg

SEQ ID NO: 1137497 - DNA, 16 bp, Homo sapiens
accagccatcctccct

SEQ ID NO: 1137498 - DNA, 21 bp, Homo sapiens
accagccattggctatttaaa

SEQ ID NO: 1137499 - DNA, 14 bp, Homo sapiens
accagcccagatgt

SEQ ID NO: 1137500 - DNA, 15 bp, Homo sapiens
accagcccagatgtt

SEQ ID NO: 1137501 - DNA, 12 bp, Homo sapiens
accagcccagcc

SEQ ID NO: 1137502 - DNA, 23 bp, Homo sapiens
accagcccattggccgagctcct

SEQ ID NO: 1137503 - DNA, 22 bp, Homo sapiens
accagccccactgccagcagca

SEQ ID NO: 1137504 - DNA, 15 bp, Homo sapiens
accagccccagcaag

SEQ ID NO: 1137505 - DNA, 16 bp, Homo sapiens
accagccccatcagaa

SEQ ID NO: 1137506 - DNA, 21 bp, Homo sapiens
accagcccccaggaagacatt

SEQ ID NO: 1137507 - DNA, 22 bp, Homo sapiens
accagcccccaggaagacatta

SEQ ID NO: 1137508 - DNA, 18 bp, Homo sapiens
accagcccccgccccaga

SEQ ID NO: 1137509 - DNA, 13 bp, Homo sapiens
accagccccctgg

SEQ ID NO: 1137510 - DNA, 14 bp, Homo sapiens
accagccccctgga

SEQ ID NO: 1137511 - DNA, 16 bp, Homo sapiens
accagccccctggatg

SEQ ID NO: 1137512 - DNA, 18 bp, Homo sapiens
accagcccgacagtgcca

SEQ ID NO: 1137513 - DNA, 22 bp, Homo sapiens
accagcccgacagtgccatccc

SEQ ID NO: 1137514 - DNA, 16 bp, Homo sapiens
accagcccggcctgct

SEQ ID NO: 1137515 - DNA, 20 bp, Homo sapiens
accagccctagctgtcccat

SEQ ID NO: 1137516 - DNA, 15 bp, Homo sapiens
accagccgccccagc

SEQ ID NO: 1137517 - DNA, 13 bp, Homo sapiens
accagccgctgca

SEQ ID NO: 1137518 - DNA, 16 bp, Homo sapiens
accagccgctgcaggg

SEQ ID NO: 1137519 - DNA, 21 bp, Homo sapiens
accagcctccatgctgcctcc

SEQ ID NO: 1137520 - DNA, 20 bp, Homo sapiens
accagcctgaccaacatggt

SEQ ID NO: 1137521 - DNA, 13 bp, Homo sapiens
accagcctgctga

SEQ ID NO: 1137522 - DNA, 23 bp, Homo sapiens
accagcctgttggacccgctctg

SEQ ID NO: 1137523 - DNA, 15 bp, Homo sapiens
accagccttcggagc

SEQ ID NO: 1137524 - DNA, 24 bp, Homo sapiens
accagcctttgggtcctgggcagg

SEQ ID NO: 1137525 - DNA, 23 bp, Homo sapiens
accagcgaggaggctccagaggg

SEQ ID NO: 1137526 - DNA, 13 bp, Homo sapiens
accagcgcccgct

SEQ ID NO: 1137527 - DNA, 17 bp, Homo sapiens
accagcgcccgctgggc

SEQ ID NO: 1137528 - DNA, 23 bp, Homo sapiens
accagcgcccgctgggctgagcc

SEQ ID NO: 1137529 - DNA, 22 bp, Homo sapiens
accagctaagaaaagattttaa

SEQ ID NO: 1137530 - DNA, 18 bp, Homo sapiens
accagctcaggggacact

SEQ ID NO: 1137531 - DNA, 20 bp, Homo sapiens
accagctccacacattccag

SEQ ID NO: 1137532 - DNA, 17 bp, Homo sapiens
accagctcccagggtgg

SEQ ID NO: 1137533 - DNA, 20 bp, Homo sapiens
accagctcctccagccctgc

SEQ ID NO: 1137534 - DNA, 13 bp, Homo sapiens
accagctctgtgg

SEQ ID NO: 1137535 - DNA, 15 bp, Homo sapiens
accacagcaactgac

SEQ ID NO: 1137536 - DNA, 15 bp, Homo sapiens
accacagcacagcca

SEQ ID NO: 1137537 - DNA, 16 bp, Homo sapiens
accacagcacagccaa

SEQ ID NO: 1137538 - DNA, 16 bp, Homo sapiens
accacagccagcacct

SEQ ID NO: 1137539 - DNA, 18 bp, Homo sapiens
accacagcccgctctctg

SEQ ID NO: 1137540 - DNA, 20 bp, Homo sapiens
accacagcccgctctctggc

SEQ ID NO: 1137541 - DNA, 15 bp, Homo sapiens
accacagccctgtca

SEQ ID NO: 1137542 - DNA, 17 bp, Homo sapiens
accacagccctgtcagt

SEQ ID NO: 1137543 - DNA, 19 bp, Homo sapiens
accacagccggtcagagga

SEQ ID NO: 1137544 - DNA, 18 bp, Homo sapiens
accacaggttctcactag

SEQ ID NO: 1137545 - DNA, 15 bp, Homo sapiens
accacagtgggtggc

SEQ ID NO: 1137546 - DNA, 11 bp, Homo sapiens
accacagtgtc

SEQ ID NO: 1137547 - DNA, 20 bp, Homo sapiens
accacataatttttgtacat

SEQ ID NO: 1137548 - DNA, 19 bp, Homo sapiens
accacatagcatgcttcct

SEQ ID NO: 1137549 - DNA, 14 bp, Homo sapiens
accacatctgctct

SEQ ID NO: 1137550 - DNA, 15 bp, Homo sapiens
accacatctgtcctc

SEQ ID NO: 1137551 - DNA, 21 bp, Homo sapiens
accacatgaactacgtgacct

SEQ ID NO: 1137552 - DNA, 11 bp, Homo sapiens
accacatgggc

SEQ ID NO: 1137553 - DNA, 16 bp, Homo sapiens
accacatgggctgggg

SEQ ID NO: 1137554 - DNA, 17 bp, Homo sapiens
accacatgggctggggg

SEQ ID NO: 1137555 - DNA, 15 bp, Homo sapiens
accacattgcttttc

SEQ ID NO: 1137556 - DNA, 22 bp, Homo sapiens
accacatttcctctgttctttt

SEQ ID NO: 1137557 - DNA, 19 bp, Homo sapiens
accaccaactactacctgt

SEQ ID NO: 1137558 - DNA, 15 bp, Homo sapiens
accaccacgcagccg

SEQ ID NO: 1137559 - DNA, 14 bp, Homo sapiens
accaccacgcctgg

SEQ ID NO: 1137560 - DNA, 22 bp, Homo sapiens
accaccacggccaccactgcag

SEQ ID NO: 1137561 - DNA, 19 bp, Homo sapiens
accaccagcgttcccttct

SEQ ID NO: 1137562 - DNA, 12 bp, Homo sapiens
accaccaggagc

SEQ ID NO: 1137563 - DNA, 20 bp, Homo sapiens
accaccaggagcagcagcca

SEQ ID NO: 1137564 - DNA, 21 bp, Homo sapiens
accaccaggagcagcagccag

SEQ ID NO: 1137565 - DNA, 22 bp, Homo sapiens
accaccaggagcagcagccagc

SEQ ID NO: 1137566 - DNA, 17 bp, Homo sapiens
accaccagggtcccagg

SEQ ID NO: 1137567 - DNA, 20 bp, Homo sapiens
accaccagggtcccaggaag

SEQ ID NO: 1137568 - DNA, 22 bp, Homo sapiens
accaccagggtcccaggaagcc

SEQ ID NO: 1137569 - DNA, 17 bp, Homo sapiens
accaccagggtggacca

SEQ ID NO: 1137570 - DNA, 18 bp, Homo sapiens
accaccagggtggaccag

SEQ ID NO: 1137571 - DNA, 11 bp, Homo sapiens
accacccagcc

SEQ ID NO: 1137572 - DNA, 17 bp, Homo sapiens
accacccatatcatgca

SEQ ID NO: 1137573 - DNA, 10 bp, Homo sapiens
accaccccct

SEQ ID NO: 1137574 - DNA, 22 bp, Homo sapiens
accaccccgcctgccctcatgg

SEQ ID NO: 1137575 - DNA, 14 bp, Homo sapiens
accacccctaccac

SEQ ID NO: 1137576 - DNA, 14 bp, Homo sapiens
accaccccttcctg

SEQ ID NO: 1137577 - DNA, 13 bp, Homo sapiens
accaccctcactg

SEQ ID NO: 1137578 - DNA, 12 bp, Homo sapiens
accaccctcagg

SEQ ID NO: 1137579 - DNA, 14 bp, Homo sapiens
accaccctcaggtg

SEQ ID NO: 1137580 - DNA, 15 bp, Homo sapiens
accaccctcaggtgc

SEQ ID NO: 1137581 - DNA, 16 bp, Homo sapiens
accaccctcaggtgcc

SEQ ID NO: 1137582 - DNA, 19 bp, Homo sapiens
accaccctcaggtgcctcc

SEQ ID NO: 1137583 - DNA, 16 bp, Homo sapiens
accaccctcccctctc

SEQ ID NO: 1137584 - DNA, 17 bp, Homo sapiens
accaccctcccctctct

SEQ ID NO: 1137585 - DNA, 18 bp, Homo sapiens
accaccctcccctctctt

SEQ ID NO: 1137586 - DNA, 23 bp, Homo sapiens
accaccctcccctctcttgcacc

SEQ ID NO: 1137587 - DNA, 12 bp, Homo sapiens
accaccctgagc

SEQ ID NO: 1137588 - DNA, 14 bp, Homo sapiens
accaccctgctcat

SEQ ID NO: 1137589 - DNA, 21 bp, Homo sapiens
accaccgcatatgcatgccag

SEQ ID NO: 1137590 - DNA, 23 bp, Homo sapiens
accaccgcatatgcatgccaggc

SEQ ID NO: 1137591 - DNA, 15 bp, Homo sapiens
accaccgctccccag

SEQ ID NO: 1137592 - DNA, 14 bp, Homo sapiens
accaccggccccct

SEQ ID NO: 1137593 - DNA, 15 bp, Homo sapiens
accaccgttcagtca

SEQ ID NO: 1137594 - DNA, 18 bp, Homo sapiens
accacctaatcaggctga

SEQ ID NO: 1137595 - DNA, 15 bp, Homo sapiens
accacctcactcctg

SEQ ID NO: 1137596 - DNA, 16 bp, Homo sapiens
accacctcactcctgt

SEQ ID NO: 1137597 - DNA, 14 bp, Homo sapiens
accacctccctcac

SEQ ID NO: 1137598 - DNA, 15 bp, Homo sapiens
accacctctgtgggc

SEQ ID NO: 1137599 - DNA, 13 bp, Homo sapiens
accacctggagtg

SEQ ID NO: 1137600 - DNA, 14 bp, Homo sapiens
accacctgtacata

SEQ ID NO: 1137601 - DNA, 19 bp, Homo sapiens
accaccttcccagctctcc

SEQ ID NO: 1137602 - DNA, 22 bp, Homo sapiens
accaccttcccagctctccctc

SEQ ID NO: 1137603 - DNA, 16 bp, Homo sapiens
accaccttctgtcccc

SEQ ID NO: 1137604 - DNA, 19 bp, Homo sapiens
accaccttctgtccccagc

SEQ ID NO: 1137605 - DNA, 23 bp, Homo sapiens
accaccttctgtccccagccctg

SEQ ID NO: 1137606 - DNA, 14 bp, Homo sapiens
accacctttactgt

SEQ ID NO: 1137607 - DNA, 17 bp, Homo sapiens
accaccttttattacat

SEQ ID NO: 1137608 - DNA, 16 bp, Homo sapiens
accacgactggccagg

SEQ ID NO: 1137609 - DNA, 16 bp, Homo sapiens
accacgatgtggccct

SEQ ID NO: 1137610 - DNA, 20 bp, Homo sapiens
accacgatgtggccctggcc

SEQ ID NO: 1137611 - DNA, 22 bp, Homo sapiens
accacgatgtggccctggcctg

SEQ ID NO: 1137612 - DNA, 23 bp, Homo sapiens
accacgcacctccacgccactgc

SEQ ID NO: 1137613 - DNA, 19 bp, Homo sapiens
accacgccagctaattttt

SEQ ID NO: 1137614 - DNA, 21 bp, Homo sapiens
accacgcccagctaatttttg

SEQ ID NO: 1137615 - DNA, 21 bp, Homo sapiens
accacgcccggctaatgtttg

SEQ ID NO: 1137616 - DNA, 20 bp, Homo sapiens
accacgcccgtcctgcctgt

SEQ ID NO: 1137617 - DNA, 18 bp, Homo sapiens
accacgccgccctccatc

SEQ ID NO: 1137618 - DNA, 18 bp, Homo sapiens
accacgcctcttgaccag

SEQ ID NO: 1137619 - DNA, 18 bp, Homo sapiens
accacgccttgaccttcc

SEQ ID NO: 1137620 - DNA, 18 bp, Homo sapiens
accacggagggagcgaca

SEQ ID NO: 1137621 - DNA, 19 bp, Homo sapiens
accacgggcccgggttggg

SEQ ID NO: 1137622 - DNA, 14 bp, Homo sapiens
accacgtccagctg

SEQ ID NO: 1137623 - DNA, 16 bp, Homo sapiens
accacgtctgccaggc

SEQ ID NO: 1137624 - DNA, 17 bp, Homo sapiens
accacgtctgccaggcc

SEQ ID NO: 1137625 - DNA, 19 bp, Homo sapiens
accacgtctgccaggccca

SEQ ID NO: 1137626 - DNA, 23 bp, Homo sapiens
accacgtctggctccctgcccct

SEQ ID NO: 1137627 - DNA, 19 bp, Homo sapiens
accacgtgaaactgctgtt

SEQ ID NO: 1137628 - DNA, 21 bp, Homo sapiens
accacgtgaaatttgcctctg

SEQ ID NO: 1137629 - DNA, 17 bp, Homo sapiens
accacgtggggctcact

SEQ ID NO: 1137630 - DNA, 15 bp, Homo sapiens
accacgtttctaaag

SEQ ID NO: 1137631 - DNA, 16 bp, Homo sapiens
accactaactcctgag

SEQ ID NO: 1137632 - DNA, 15 bp, Homo sapiens
accactacattctgt

SEQ ID NO: 1137633 - DNA, 16 bp, Homo sapiens
accactacattctgtt

SEQ ID NO: 1137634 - DNA, 17 bp, Homo sapiens
accactacattctgtta

SEQ ID NO: 1137635 - DNA, 16 bp, Homo sapiens
accactaccagccagc

SEQ ID NO: 1137636 - DNA, 16 bp, Homo sapiens
acattggtaagaatga

SEQ ID NO: 1137637 - DNA, 19 bp, Homo sapiens
acattggtgaaggatccag

SEQ ID NO: 1137638 - DNA, 22 bp, Homo sapiens
acattggtgaaggatccaggaa

SEQ ID NO: 1137639 - DNA, 13 bp, Homo sapiens
acattgtaaagta

SEQ ID NO: 1137640 - DNA, 17 bp, Homo sapiens
acattgtaaagtatgtg

SEQ ID NO: 1137641 - DNA, 23 bp, Homo sapiens
acattgtaaatatttactctttg

SEQ ID NO: 1137642 - DNA, 12 bp, Homo sapiens
acattgtactgt

SEQ ID NO: 1137643 - DNA, 14 bp, Homo sapiens
acattgtacttaaa

SEQ ID NO: 1137644 - DNA, 15 bp, Homo sapiens
acattgtataggcca

SEQ ID NO: 1137645 - DNA, 21 bp, Homo sapiens
acattgtataggccatctgta

SEQ ID NO: 1137646 - DNA, 13 bp, Homo sapiens
acattgtcaataa

SEQ ID NO: 1137647 - DNA, 22 bp, Homo sapiens
acattgtgatgtatattccttt

SEQ ID NO: 1137648 - DNA, 16 bp, Homo sapiens
acattgttaaaataaa

SEQ ID NO: 1137649 - DNA, 17 bp, Homo sapiens
acattgttaagaaaaat

SEQ ID NO: 1137650 - DNA, 16 bp, Homo sapiens
acattgttcaattaga

SEQ ID NO: 1137651 - DNA, 19 bp, Homo sapiens
acattgtttttgtatattg

SEQ ID NO: 1137652 - DNA, 18 bp, Homo sapiens
acatttaaaacattaaaa

SEQ ID NO: 1137653 - DNA, 18 bp, Homo sapiens
acatttaaaacatttgaa

SEQ ID NO: 1137654 - DNA, 20 bp, Homo sapiens
acatttaaactttttaaaat

SEQ ID NO: 1137655 - DNA, 17 bp, Homo sapiens
acatttaaagagatttc

SEQ ID NO: 1137656 - DNA, 23 bp, Homo sapiens
acatttaaataaaactttccaaa

SEQ ID NO: 1137657 - DNA, 17 bp, Homo sapiens
acatttaaatgtaactt

SEQ ID NO: 1137658 - DNA, 23 bp, Homo sapiens
acatttaaattttaccctttaga

SEQ ID NO: 1137659 - DNA, 14 bp, Homo sapiens
acatttaacataat

SEQ ID NO: 1137660 - DNA, 16 bp, Homo sapiens
acatttaacataatgg

SEQ ID NO: 1137661 - DNA, 14 bp, Homo sapiens
acatttaataaaac

SEQ ID NO: 1137662 - DNA, 16 bp, Homo sapiens
acatttaataaaactg

SEQ ID NO: 1137663 - DNA, 16 bp, Homo sapiens
acatttaatacagcag

SEQ ID NO: 1137664 - DNA, 16 bp, Homo sapiens
acatttaatatcttca

SEQ ID NO: 1137665 - DNA, 12 bp, Homo sapiens
acatttaccaaa

SEQ ID NO: 1137666 - DNA, 14 bp, Homo sapiens
acatttaccaaatt

SEQ ID NO: 1137667 - DNA, 19 bp, Homo sapiens
acatttaccaaattgcttg

SEQ ID NO: 1137668 - DNA, 17 bp, Homo sapiens
acatttagaaaagtgaa

SEQ ID NO: 1137669 - DNA, 16 bp, Homo sapiens
acatttagaagaaaga

SEQ ID NO: 1137670 - DNA, 17 bp, Homo sapiens
acatttatagaagaaat

SEQ ID NO: 1137671 - DNA, 18 bp, Homo sapiens
acatttatatatatatgt

SEQ ID NO: 1137672 - DNA, 19 bp, Homo sapiens
acatttatatatatatgta

SEQ ID NO: 1137673 - DNA, 15 bp, Homo sapiens
acatttatttcctcc

SEQ ID NO: 1137674 - DNA, 15 bp, Homo sapiens
acatttatttttata

SEQ ID NO: 1137675 - DNA, 15 bp, Homo sapiens
acatttcaaattgaa

SEQ ID NO: 1137676 - DNA, 17 bp, Homo sapiens
acatttcaaattgaatt

SEQ ID NO: 1137677 - DNA, 19 bp, Homo sapiens
acatttcaatgtcagcctt

SEQ ID NO: 1137678 - DNA, 16 bp, Homo sapiens
acatttcaccatggcc

SEQ ID NO: 1137679 - DNA, 16 bp, Homo sapiens
acatttcatacaacag

SEQ ID NO: 1137680 - DNA, 12 bp, Homo sapiens
acatttcatccg

SEQ ID NO: 1137681 - DNA, 16 bp, Homo sapiens
acatttccaacttgat

SEQ ID NO: 1137682 - DNA, 14 bp, Homo sapiens
acatttccatttat

SEQ ID NO: 1137683 - DNA, 22 bp, Homo sapiens
acatttccatttattgtttgaa

SEQ ID NO: 1137684 - DNA, 12 bp, Homo sapiens
acatttctctga

SEQ ID NO: 1137685 - DNA, 23 bp, Homo sapiens
acatttctgaattgttggggttt

SEQ ID NO: 1137686 - DNA, 13 bp, Homo sapiens
acatttctgacac

SEQ ID NO: 1137687 - DNA, 14 bp, Homo sapiens
acatttcttatgat

SEQ ID NO: 1137688 - DNA, 13 bp, Homo sapiens
acatttctttctt

SEQ ID NO: 1137689 - DNA, 22 bp, Homo sapiens
acatttgaattcttgatctcta

SEQ ID NO: 1137690 - DNA, 11 bp, Homo sapiens
acatttgatat

SEQ ID NO: 1137691 - DNA, 12 bp, Homo sapiens
acatttgatatt

SEQ ID NO: 1137692 - DNA, 20 bp, Homo sapiens
acatttgatatttttccatt

SEQ ID NO: 1137693 - DNA, 17 bp, Homo sapiens
acatttgatgcatgtct

SEQ ID NO: 1137694 - DNA, 12 bp, Homo sapiens
acatttgatgta

SEQ ID NO: 1137695 - DNA, 16 bp, Homo sapiens
acatttgccttgcaga

SEQ ID NO: 1137696 - DNA, 23 bp, Homo sapiens
acatttgccttttgttaaaagat

SEQ ID NO: 1137697 - DNA, 23 bp, Homo sapiens
acatttgctgttttaaacattaa

SEQ ID NO: 1137698 - DNA, 18 bp, Homo sapiens
acatttggaatacttttt

SEQ ID NO: 1137699 - DNA, 18 bp, Homo sapiens
acatttggacatttccag

SEQ ID NO: 1137700 - DNA, 20 bp, Homo sapiens
acatttggagtgttcccctt

SEQ ID NO: 1137701 - DNA, 18 bp, Homo sapiens
acatttgggttactattt

SEQ ID NO: 1137702 - DNA, 21 bp, Homo sapiens
acatttgtaagtgtaaaaaat

SEQ ID NO: 1137703 - DNA, 13 bp, Homo sapiens
acatttgtacttt

SEQ ID NO: 1137704 - DNA, 14 bp, Homo sapiens
acatttgtcagtat

SEQ ID NO: 1137705 - DNA, 15 bp, Homo sapiens
acatttgtcagtatt

SEQ ID NO: 1137706 - DNA, 22 bp, Homo sapiens
acatttgtgctccattttttct

SEQ ID NO: 1137707 - DNA, 14 bp, Homo sapiens
acatttgtttcccc

SEQ ID NO: 1137708 - DNA, 16 bp, Homo sapiens
acatttgtttccccca

SEQ ID NO: 1137709 - DNA, 18 bp, Homo sapiens
acattttaaaaacataga

SEQ ID NO: 1137710 - DNA, 16 bp, Homo sapiens
acattttaaaagtgcc

SEQ ID NO: 1137711 - DNA, 20 bp, Homo sapiens
acattttaaataaaagaaaa

SEQ ID NO: 1137712 - DNA, 16 bp, Homo sapiens
acattttacacactgt

SEQ ID NO: 1137713 - DNA, 18 bp, Homo sapiens
acattttactttttcctg

SEQ ID NO: 1137714 - DNA, 14 bp, Homo sapiens
acattttataattt

SEQ ID NO: 1137715 - DNA, 18 bp, Homo sapiens
acattttatactgtacat

SEQ ID NO: 1137716 - DNA, 14 bp, Homo sapiens
acattttatgagag

SEQ ID NO: 1137717 - DNA, 18 bp, Homo sapiens
acattttattttattatg

SEQ ID NO: 1137718 - DNA, 19 bp, Homo sapiens
acattttattttattatgc

SEQ ID NO: 1137719 - DNA, 22 bp, Homo sapiens
acattttatttttaaaatatta

SEQ ID NO: 1137720 - DNA, 12 bp, Homo sapiens
acattttcagtg

SEQ ID NO: 1137721 - DNA, 12 bp, Homo sapiens
acattttccttt

SEQ ID NO: 1137722 - DNA, 15 bp, Homo sapiens
acattttcgtcctgt

SEQ ID NO: 1137723 - DNA, 19 bp, Homo sapiens
acattttcgtcctgtagca

SEQ ID NO: 1137724 - DNA, 13 bp, Homo sapiens
acattttctaaat

SEQ ID NO: 1137725 - DNA, 16 bp, Homo sapiens
acattttctggattct

SEQ ID NO: 1137726 - DNA, 12 bp, Homo sapiens
acattttctggt

SEQ ID NO: 1137727 - DNA, 21 bp, Homo sapiens
acattttctttctttttctgg

SEQ ID NO: 1137728 - DNA, 21 bp, Homo sapiens
acattttcttttattatcagt

SEQ ID NO: 1137729 - DNA, 12 bp, Homo sapiens
acattttgaagt

SEQ ID NO: 1137730 - DNA, 17 bp, Homo sapiens
acattttggtgagaaat

SEQ ID NO: 1137731 - DNA, 18 bp, Homo sapiens
acattttggtgagaaatg

SEQ ID NO: 1137732 - DNA, 14 bp, Homo sapiens
acattttgtaaaat

SEQ ID NO: 1137733 - DNA, 14 bp, Homo sapiens
acattttgtatcaa

SEQ ID NO: 1137734 - DNA, 15 bp, Homo sapiens
acatttttaagtgct

SEQ ID NO: 1137735 - DNA, 19 bp, Homo sapiens
acatttttaagtgctgcat

SEQ ID NO: 1137736 - DNA, 14 bp, Homo sapiens
acatttttacaata

SEQ ID NO: 1137737 - DNA, 21 bp, Homo sapiens
acatttttcagatataaaaga

SEQ ID NO: 1137738 - DNA, 19 bp, Homo sapiens
acatttttccgtttgcttt

SEQ ID NO: 1137739 - DNA, 14 bp, Homo sapiens
acatttttgggggg

SEQ ID NO: 1137740 - DNA, 12 bp, Homo sapiens
acattttttaaa

SEQ ID NO: 1137741 - DNA, 17 bp, Homo sapiens
acattttttaaatgcac

SEQ ID NO: 1137742 - DNA, 18 bp, Homo sapiens
acattttttagtctgtaa

SEQ ID NO: 1137743 - DNA, 20 bp, Homo sapiens
acattttttgctataatcat

SEQ ID NO: 1137744 - DNA, 18 bp, Homo sapiens
acatttttttatgctctt

SEQ ID NO: 1137745 - DNA, 19 bp, Homo sapiens
acatttttttttctccata

SEQ ID NO: 1137746 - DNA, 14 bp, Homo sapiens
accaaaaattgcca

SEQ ID NO: 1137747 - DNA, 24 bp, Homo sapiens
accaaaacaccccaacttggcagc

SEQ ID NO: 1137748 - DNA, 12 bp, Homo sapiens
accaaaacatgt

SEQ ID NO: 1137749 - DNA, 18 bp, Homo sapiens
accaaaaccatccatccc

SEQ ID NO: 1137750 - DNA, 14 bp, Homo sapiens
accaaaacttccaa

SEQ ID NO: 1137751 - DNA, 17 bp, Homo sapiens
acatgtgccgaatgtgc

SEQ ID NO: 1137752 - DNA, 19 bp, Homo sapiens
acatgtgccgaatgtgcag

SEQ ID NO: 1137753 - DNA, 17 bp, Homo sapiens
acatgtgctgatgttta

SEQ ID NO: 1137754 - DNA, 18 bp, Homo sapiens
acatgtggaaagtgaatt

SEQ ID NO: 1137755 - DNA, 16 bp, Homo sapiens
acatgtgtatttatac

SEQ ID NO: 1137756 - DNA, 22 bp, Homo sapiens
acatgtgtgtatatgtagatgt

SEQ ID NO: 1137757 - DNA, 14 bp, Homo sapiens
acatgtgtttctga

SEQ ID NO: 1137758 - DNA, 21 bp, Homo sapiens
acatgtgttttaattccaata

SEQ ID NO: 1137759 - DNA, 17 bp, Homo sapiens
acatgttaaacttactt

SEQ ID NO: 1137760 - DNA, 17 bp, Homo sapiens
acatgttactgaccagc

SEQ ID NO: 1137761 - DNA, 17 bp, Homo sapiens
acatgttactgcttcat

SEQ ID NO: 1137762 - DNA, 22 bp, Homo sapiens
acatgttactggataaattgtt

SEQ ID NO: 1137763 - DNA, 21 bp, Homo sapiens
acatgttatcaaatctgggta

SEQ ID NO: 1137764 - DNA, 14 bp, Homo sapiens
acatgttatttgta

SEQ ID NO: 1137765 - DNA, 22 bp, Homo sapiens
acatgttctaggtttcagcaac

SEQ ID NO: 1137766 - DNA, 14 bp, Homo sapiens
acatgttcttgtca

SEQ ID NO: 1137767 - DNA, 23 bp, Homo sapiens
acatgttcttgtcataaaatgca

SEQ ID NO: 1137768 - DNA, 17 bp, Homo sapiens
acatgttggaaatgtgt

SEQ ID NO: 1137769 - DNA, 17 bp, Homo sapiens
acatgtttaaatagcct

SEQ ID NO: 1137770 - DNA, 17 bp, Homo sapiens
acatgtttaaattgtaa

SEQ ID NO: 1137771 - DNA, 19 bp, Homo sapiens
acatgtttaaattgtaaat

SEQ ID NO: 1137772 - DNA, 13 bp, Homo sapiens
acatgtttataaa

SEQ ID NO: 1137773 - DNA, 18 bp, Homo sapiens
acatgtttcaagaaccgc

SEQ ID NO: 1137774 - DNA, 13 bp, Homo sapiens
acatgtttctgtt

SEQ ID NO: 1137775 - DNA, 21 bp, Homo sapiens
acatgtttgcacctttctagt

SEQ ID NO: 1137776 - DNA, 22 bp, Homo sapiens
acatgtttgcacctttctagtt

SEQ ID NO: 1137777 - DNA, 23 bp, Homo sapiens
acatgtttttgttttctttgaat

SEQ ID NO: 1137778 - DNA, 22 bp, Homo sapiens
acatgttttttcatttgtaaaa

SEQ ID NO: 1137779 - DNA, 15 bp, Homo sapiens
acattaaaaaatgaa

SEQ ID NO: 1137780 - DNA, 18 bp, Homo sapiens
acattaaacaatgatcac

SEQ ID NO: 1137781 - DNA, 16 bp, Homo sapiens
acattaaacactgtaa

SEQ ID NO: 1137782 - DNA, 18 bp, Homo sapiens
acattaaacactgtaatc

SEQ ID NO: 1137783 - DNA, 20 bp, Homo sapiens
acattaaacactgtaatctt

SEQ ID NO: 1137784 - DNA, 18 bp, Homo sapiens
acattaactcagtggaag

SEQ ID NO: 1137785 - DNA, 22 bp, Homo sapiens
acattaactcattagactggaa

SEQ ID NO: 1137786 - DNA, 14 bp, Homo sapiens
acattaagaaaatc

SEQ ID NO: 1137787 - DNA, 14 bp, Homo sapiens
acattaaggaattt

SEQ ID NO: 1137788 - DNA, 19 bp, Homo sapiens
acattaatagcagcctttc

SEQ ID NO: 1137789 - DNA, 15 bp, Homo sapiens
acattaatctcaaag

SEQ ID NO: 1137790 - DNA, 14 bp, Homo sapiens
acattaatgcccag

SEQ ID NO: 1137791 - DNA, 16 bp, Homo sapiens
acattaatgcccagcc

SEQ ID NO: 1137792 - DNA, 22 bp, Homo sapiens
acattaattttgtgcattcttt

SEQ ID NO: 1137793 - DNA, 16 bp, Homo sapiens
acattaccatataatg

SEQ ID NO: 1137794 - DNA, 15 bp, Homo sapiens
acattaccattcata

SEQ ID NO: 1137795 - DNA, 16 bp, Homo sapiens
acattagatgtcatga

SEQ ID NO: 1137796 - DNA, 22 bp, Homo sapiens
acattaggagtaactttcaacc

SEQ ID NO: 1137797 - DNA, 20 bp, Homo sapiens
acattaggggaaccattgtt

SEQ ID NO: 1137798 - DNA, 13 bp, Homo sapiens
acattagttttaa

SEQ ID NO: 1137799 - DNA, 16 bp, Homo sapiens
acattataatgtacag

SEQ ID NO: 1137800 - DNA, 14 bp, Homo sapiens
acattatattctct

SEQ ID NO: 1137801 - DNA, 19 bp, Homo sapiens
acattatcgggagcagtgt

SEQ ID NO: 1137802 - DNA, 21 bp, Homo sapiens
acattatcgggagcagtgtct

SEQ ID NO: 1137803 - DNA, 22 bp, Homo sapiens
acattatcgggagcagtgtctt

SEQ ID NO: 1137804 - DNA, 13 bp, Homo sapiens
acattatcttagt

SEQ ID NO: 1137805 - DNA, 14 bp, Homo sapiens
acattatcttctgg

SEQ ID NO: 1137806 - DNA, 13 bp, Homo sapiens
acattatgcaaat

SEQ ID NO: 1137807 - DNA, 12 bp, Homo sapiens
acattattctgg

SEQ ID NO: 1137808 - DNA, 19 bp, Homo sapiens
acattatttattaaaaatg

SEQ ID NO: 1137809 - DNA, 21 bp, Homo sapiens
acattatttattaaaaatgtt

SEQ ID NO: 1137810 - DNA, 22 bp, Homo sapiens
acattatttattaaaaatgttc

SEQ ID NO: 1137811 - DNA, 18 bp, Homo sapiens
acattcaacagagactga

SEQ ID NO: 1137812 - DNA, 15 bp, Homo sapiens
acattcacttttgtt

SEQ ID NO: 1137813 - DNA, 15 bp, Homo sapiens
acattcagaaaactt

SEQ ID NO: 1137814 - DNA, 22 bp, Homo sapiens
acattcagaaaacttcaagaca

SEQ ID NO: 1137815 - DNA, 17 bp, Homo sapiens
acattcagaggaagaca

SEQ ID NO: 1137816 - DNA, 19 bp, Homo sapiens
acattcaggaattcttgga

SEQ ID NO: 1137817 - DNA, 22 bp, Homo sapiens
acattcatagtctttggagaaa

SEQ ID NO: 1137818 - DNA, 20 bp, Homo sapiens
acattcatgtaactctccag

SEQ ID NO: 1137819 - DNA, 21 bp, Homo sapiens
acattcatgtaactctccagc

SEQ ID NO: 1137820 - DNA, 17 bp, Homo sapiens
acattcattttctcagt

SEQ ID NO: 1137821 - DNA, 16 bp, Homo sapiens
acattccatgacgaca

SEQ ID NO: 1137822 - DNA, 16 bp, Homo sapiens
acattcccatggtggc

SEQ ID NO: 1137823 - DNA, 16 bp, Homo sapiens
acattccccagagtgg

SEQ ID NO: 1137824 - DNA, 14 bp, Homo sapiens
acattccctctcct

SEQ ID NO: 1137825 - DNA, 17 bp, Homo sapiens
acattccctctcctgcc

SEQ ID NO: 1137826 - DNA, 22 bp, Homo sapiens
acattcccttgatggtctcaag

SEQ ID NO: 1137827 - DNA, 12 bp, Homo sapiens
acattcctcagc

SEQ ID NO: 1137828 - DNA, 22 bp, Homo sapiens
acattcctcagctgccaagcac

SEQ ID NO: 1137829 - DNA, 13 bp, Homo sapiens
acattcctggccc

SEQ ID NO: 1137830 - DNA, 23 bp, Homo sapiens
acattccttctcccatctcttcc

SEQ ID NO: 1137831 - DNA, 18 bp, Homo sapiens
acattccttgtcaccagc

SEQ ID NO: 1137832 - DNA, 20 bp, Homo sapiens
acattcggctccctggagcc

SEQ ID NO: 1137833 - DNA, 13 bp, Homo sapiens
acattctacttca

SEQ ID NO: 1137834 - DNA, 19 bp, Homo sapiens
acattctacttcagctttg

SEQ ID NO: 1137835 - DNA, 22 bp, Homo sapiens
acattctagatgcaagtctctt

SEQ ID NO: 1137836 - DNA, 20 bp, Homo sapiens
acattctattgactttctta

SEQ ID NO: 1137837 - DNA, 12 bp, Homo sapiens
acattctcacat

SEQ ID NO: 1137838 - DNA, 13 bp, Homo sapiens
acattctcacata

SEQ ID NO: 1137839 - DNA, 22 bp, Homo sapiens
acattctctaggagaaacttag

SEQ ID NO: 1137840 - DNA, 23 bp, Homo sapiens
acattctgattcgaatgacactg

SEQ ID NO: 1137841 - DNA, 15 bp, Homo sapiens
acattctgcaatggc

SEQ ID NO: 1137842 - DNA, 20 bp, Homo sapiens
acattctggggaaacaacat

SEQ ID NO: 1137843 - DNA, 20 bp, Homo sapiens
acattctggtctcgtcttcc

SEQ ID NO: 1137844 - DNA, 20 bp, Homo sapiens
acattctggtgaccagactt

SEQ ID NO: 1137845 - DNA, 13 bp, Homo sapiens
acattctgtgtgt

SEQ ID NO: 1137846 - DNA, 18 bp, Homo sapiens
acattctgtgtgtatcta

SEQ ID NO: 1137847 - DNA, 22 bp, Homo sapiens
acattcttagctgtaacttaac

SEQ ID NO: 1137848 - DNA, 14 bp, Homo sapiens
acattcttcaaaga

SEQ ID NO: 1137849 - DNA, 23 bp, Homo sapiens
acattcttccatcatcactgtaa

SEQ ID NO: 1137850 - DNA, 12 bp, Homo sapiens
acattcttttaa

SEQ ID NO: 1137851 - DNA, 15 bp, Homo sapiens
acattgaaagtgaaa

SEQ ID NO: 1137852 - DNA, 19 bp, Homo sapiens
acattgaaatctaggaaaa

SEQ ID NO: 1137853 - DNA, 15 bp, Homo sapiens
acattgaagtaatga

SEQ ID NO: 1137854 - DNA, 16 bp, Homo sapiens
acattgaatgcgcttt

SEQ ID NO: 1137855 - DNA, 13 bp, Homo sapiens
acattgaattcat

SEQ ID NO: 1137856 - DNA, 20 bp, Homo sapiens
acattgaccaagaactgcat

SEQ ID NO: 1137857 - DNA, 17 bp, Homo sapiens
acattgatacaaagtac

SEQ ID NO: 1137858 - DNA, 21 bp, Homo sapiens
acattgatgtaaggactgtaa

SEQ ID NO: 1137859 - DNA, 14 bp, Homo sapiens
acattgatttttct

SEQ ID NO: 1137860 - DNA, 19 bp, Homo sapiens
acattgatttttctataat

SEQ ID NO: 1137861 - DNA, 20 bp, Homo sapiens
acattgcactttataaacac

SEQ ID NO: 1137862 - DNA, 17 bp, Homo sapiens
acattgccaaaaaggat

SEQ ID NO: 1137863 - DNA, 15 bp, Homo sapiens
acattgcctgttctg

SEQ ID NO: 1137864 - DNA, 19 bp, Homo sapiens
acattgcctgttctgcttc

SEQ ID NO: 1137865 - DNA, 12 bp, Homo sapiens
acattgccttct

SEQ ID NO: 1137866 - DNA, 21 bp, Homo sapiens
acattgctccaagatgttctc

SEQ ID NO: 1137867 - DNA, 15 bp, Homo sapiens
acattgctctatgtc

SEQ ID NO: 1137868 - DNA, 15 bp, Homo sapiens
acattgctctctggg

SEQ ID NO: 1137869 - DNA, 13 bp, Homo sapiens
acattgctgcctt

SEQ ID NO: 1137870 - DNA, 19 bp, Homo sapiens
acagccggtcagaggagcg

SEQ ID NO: 1137871 - DNA, 22 bp, Homo sapiens
acagccgtcccgcgttcaagac

SEQ ID NO: 1137872 - DNA, 12 bp, Homo sapiens
acagcctagggt

SEQ ID NO: 1137873 - DNA, 19 bp, Homo sapiens
acagcctatagtaaatgtg

SEQ ID NO: 1137874 - DNA, 14 bp, Homo sapiens
acagcctcacagaa

SEQ ID NO: 1137875 - DNA, 17 bp, Homo sapiens
acagcctcacagaagaa

SEQ ID NO: 1137876 - DNA, 18 bp, Homo sapiens
acagcctcacttgaatgt

SEQ ID NO: 1137877 - DNA, 16 bp, Homo sapiens
acagcctccagggccc

SEQ ID NO: 1137878 - DNA, 16 bp, Homo sapiens
acagcctcccaccccc

SEQ ID NO: 1137879 - DNA, 12 bp, Homo sapiens
acagcctccccc

SEQ ID NO: 1137880 - DNA, 13 bp, Homo sapiens
acagcctcccccg

SEQ ID NO: 1137881 - DNA, 21 bp, Homo sapiens
acagcctcccctgccagggca

SEQ ID NO: 1137882 - DNA, 17 bp, Homo sapiens
acagcctccctgagcct

SEQ ID NO: 1137883 - DNA, 20 bp, Homo sapiens
acagcctccctgagcctgca

SEQ ID NO: 1137884 - DNA, 14 bp, Homo sapiens
acagcctcttgccc

SEQ ID NO: 1137885 - DNA, 23 bp, Homo sapiens
acagcctctttcctaacttcctt

SEQ ID NO: 1137886 - DNA, 21 bp, Homo sapiens
acagcctgacaacatttctat

SEQ ID NO: 1137887 - DNA, 15 bp, Homo sapiens
acagcctgcaagtca

SEQ ID NO: 1137888 - DNA, 12 bp, Homo sapiens
acagcctgctgg

SEQ ID NO: 1137889 - DNA, 19 bp, Homo sapiens
acagcctgctggcagggcc

SEQ ID NO: 1137890 - DNA, 11 bp, Homo sapiens
acagcctgggg

SEQ ID NO: 1137891 - DNA, 21 bp, Homo sapiens
acagcctgtggcggtgcctgg

SEQ ID NO: 1137892 - DNA, 22 bp, Homo sapiens
acagcctgtggcggtgcctggg

SEQ ID NO: 1137893 - DNA, 19 bp, Homo sapiens
acagccttagctgccagtg

SEQ ID NO: 1137894 - DNA, 23 bp, Homo sapiens
acagccttatttttgtatgcctt

SEQ ID NO: 1137895 - DNA, 13 bp, Homo sapiens
acagccttcccca

SEQ ID NO: 1137896 - DNA, 15 bp, Homo sapiens
acagccttccttctg

SEQ ID NO: 1137897 - DNA, 16 bp, Homo sapiens
acagccttccttctgc

SEQ ID NO: 1137898 - DNA, 19 bp, Homo sapiens
acagccttccttctgctcc

SEQ ID NO: 1137899 - DNA, 23 bp, Homo sapiens
acagccttccttctgctcccacc

SEQ ID NO: 1137900 - DNA, 18 bp, Homo sapiens
acagccttgttcctcagc

SEQ ID NO: 1137901 - DNA, 12 bp, Homo sapiens
acagcgagcctg

SEQ ID NO: 1137902 - DNA, 16 bp, Homo sapiens
acagcgagggcagctg

SEQ ID NO: 1137903 - DNA, 17 bp, Homo sapiens
acatgactctttattgt

SEQ ID NO: 1137904 - DNA, 19 bp, Homo sapiens
acatgactctttattgtct

SEQ ID NO: 1137905 - DNA, 21 bp, Homo sapiens
acatgactctttattgtctgt

SEQ ID NO: 1137906 - DNA, 16 bp, Homo sapiens
acatgactgggcctcc

SEQ ID NO: 1137907 - DNA, 18 bp, Homo sapiens
acatgactgggcctccct

SEQ ID NO: 1137908 - DNA, 20 bp, Homo sapiens
acatgacttattatgcataa

SEQ ID NO: 1137909 - DNA, 12 bp, Homo sapiens
acatgagaaaga

SEQ ID NO: 1137910 - DNA, 15 bp, Homo sapiens
acatgagatggagag

SEQ ID NO: 1137911 - DNA, 18 bp, Homo sapiens
acatgaggactctattct

SEQ ID NO: 1137912 - DNA, 22 bp, Homo sapiens
acatgaggactctattctttaa

SEQ ID NO: 1137913 - DNA, 21 bp, Homo sapiens
acatgaggccatctcaggaga

SEQ ID NO: 1137914 - DNA, 13 bp, Homo sapiens
acatgatggggaa

SEQ ID NO: 1137915 - DNA, 14 bp, Homo sapiens
acatgatgtgagat

SEQ ID NO: 1137916 - DNA, 17 bp, Homo sapiens
acatgatttccttgaat

SEQ ID NO: 1137917 - DNA, 16 bp, Homo sapiens
acatgcaacagaagtg

SEQ ID NO: 1137918 - DNA, 23 bp, Homo sapiens
acatgcaagaccagtattctaaa

SEQ ID NO: 1137919 - DNA, 17 bp, Homo sapiens
acatgcaaggtcatttt

SEQ ID NO: 1137920 - DNA, 15 bp, Homo sapiens
acatgcacatttata

SEQ ID NO: 1137921 - DNA, 19 bp, Homo sapiens
acatgcacatttatatata

SEQ ID NO: 1137922 - DNA, 23 bp, Homo sapiens
acatgcaccttatatttctgtgt

SEQ ID NO: 1137923 - DNA, 16 bp, Homo sapiens
acatgcactatgagga

SEQ ID NO: 1137924 - DNA, 15 bp, Homo sapiens
acatgcagttcatta

SEQ ID NO: 1137925 - DNA, 23 bp, Homo sapiens
acatgcatccatttactgacact

SEQ ID NO: 1137926 - DNA, 14 bp, Homo sapiens
acatgccagaagga

SEQ ID NO: 1137927 - DNA, 21 bp, Homo sapiens
acatgccagaaggaatcttct

SEQ ID NO: 1137928 - DNA, 16 bp, Homo sapiens
acatgcccaaaactta

SEQ ID NO: 1137929 - DNA, 15 bp, Homo sapiens
acatgccccctccct

SEQ ID NO: 1137930 - DNA, 19 bp, Homo sapiens
acatgccccctcccttcac

SEQ ID NO: 1137931 - DNA, 12 bp, Homo sapiens
acatgcccctcc

SEQ ID NO: 1137932 - DNA, 17 bp, Homo sapiens
acatgcccctcccccag

SEQ ID NO: 1137933 - DNA, 19 bp, Homo sapiens
acatgcccctcccccagct

SEQ ID NO: 1137934 - DNA, 20 bp, Homo sapiens
acatgcccctcccccagctg

SEQ ID NO: 1137935 - DNA, 14 bp, Homo sapiens
acatgccctccctt

SEQ ID NO: 1137936 - DNA, 15 bp, Homo sapiens
acatgccgcagggag

SEQ ID NO: 1137937 - DNA, 11 bp, Homo sapiens
acatgcctgca

SEQ ID NO: 1137938 - DNA, 12 bp, Homo sapiens
acatgcctgcca

SEQ ID NO: 1137939 - DNA, 16 bp, Homo sapiens
acatgccttggtgccg

SEQ ID NO: 1137940 - DNA, 17 bp, Homo sapiens
acatgctaaatagttct

SEQ ID NO: 1137941 - DNA, 24 bp, Homo sapiens
acatgctaagagaagtagaaatca

SEQ ID NO: 1137942 - DNA, 21 bp, Homo sapiens
acatgctacacactgcatgtt

SEQ ID NO: 1137943 - DNA, 22 bp, Homo sapiens
acatgctatgctgaagacattc

SEQ ID NO: 1137944 - DNA, 19 bp, Homo sapiens
acatgctcacctctagcct

SEQ ID NO: 1137945 - DNA, 12 bp, Homo sapiens
acatgctctttt

SEQ ID NO: 1137946 - DNA, 20 bp, Homo sapiens
acatgctctttttttaagtg

SEQ ID NO: 1137947 - DNA, 19 bp, Homo sapiens
acatgctgaggttttgaat

SEQ ID NO: 1137948 - DNA, 21 bp, Homo sapiens
acatgctgaggttttgaataa

SEQ ID NO: 1137949 - DNA, 15 bp, Homo sapiens
acatgctgcctggca

SEQ ID NO: 1137950 - DNA, 20 bp, Homo sapiens
acatgctgctctggtgcacg

SEQ ID NO: 1137951 - DNA, 21 bp, Homo sapiens
acatgctggttacctgttcca

SEQ ID NO: 1137952 - DNA, 23 bp, Homo sapiens
acatgctgtgctctttgaagaga

SEQ ID NO: 1137953 - DNA, 17 bp, Homo sapiens
acatgcttactttttaa

SEQ ID NO: 1137954 - DNA, 21 bp, Homo sapiens
acatgcttactttttaatttt

SEQ ID NO: 1137955 - DNA, 22 bp, Homo sapiens
acatgcttagcttatctttctt

SEQ ID NO: 1137956 - DNA, 16 bp, Homo sapiens
acatgcttgaataact

SEQ ID NO: 1137957 - DNA, 21 bp, Homo sapiens
acatgcttttctgccactcca

SEQ ID NO: 1137958 - DNA, 14 bp, Homo sapiens
acatggaaaacaga

SEQ ID NO: 1137959 - DNA, 16 bp, Homo sapiens
acatggaaaacagagt

SEQ ID NO: 1137960 - DNA, 22 bp, Homo sapiens
acatggaaaacagagtatttct

SEQ ID NO: 1137961 - DNA, 18 bp, Homo sapiens
acatggaataacatgtaa

SEQ ID NO: 1137962 - DNA, 12 bp, Homo sapiens
acatggaccagc

SEQ ID NO: 1137963 - DNA, 17 bp, Homo sapiens
acatggacttgtatatt

SEQ ID NO: 1137964 - DNA, 23 bp, Homo sapiens
acatggacttgtatatttgtaca

SEQ ID NO: 1137965 - DNA, 17 bp, Homo sapiens
acatggagactcctgcc

SEQ ID NO: 1137966 - DNA, 21 bp, Homo sapiens
acatggagactcctgccctgt

SEQ ID NO: 1137967 - DNA, 22 bp, Homo sapiens
acatggagactcctgccctgtt

SEQ ID NO: 1137968 - DNA, 17 bp, Homo sapiens
acatggagatgtaaaat

SEQ ID NO: 1137969 - DNA, 19 bp, Homo sapiens
acatggagccccctctgcc

SEQ ID NO: 1137970 - DNA, 15 bp, Homo sapiens
acatggagctcttgt

SEQ ID NO: 1137971 - DNA, 19 bp, Homo sapiens
acatggatacttcctgggt

SEQ ID NO: 1137972 - DNA, 19 bp, Homo sapiens
acatggatgaaattcccgt

SEQ ID NO: 1137973 - DNA, 20 bp, Homo sapiens
acatggattttggcagggcg

SEQ ID NO: 1137974 - DNA, 18 bp, Homo sapiens
acatggcaattgcactca

SEQ ID NO: 1137975 - DNA, 14 bp, Homo sapiens
acatggccagtgtg

SEQ ID NO: 1137976 - DNA, 23 bp, Homo sapiens
acatggcccattggagcacctgg

SEQ ID NO: 1137977 - DNA, 18 bp, Homo sapiens
acatggcctgtttgggag

SEQ ID NO: 1137978 - DNA, 18 bp, Homo sapiens
acatggcgccctgcctcc

SEQ ID NO: 1137979 - DNA, 19 bp, Homo sapiens
acatggcgccctgcctcct

SEQ ID NO: 1137980 - DNA, 20 bp, Homo sapiens
acatggcgccctgcctcctg

SEQ ID NO: 1137981 - DNA, 23 bp, Homo sapiens
acatgggagccgggtctgcctct

SEQ ID NO: 1137982 - DNA, 18 bp, Homo sapiens
acatggggcaagccaggg

SEQ ID NO: 1137983 - DNA, 19 bp, Homo sapiens
acatggggcaagccagggc

SEQ ID NO: 1137984 - DNA, 21 bp, Homo sapiens
acatggggttggctgggccca

SEQ ID NO: 1137985 - DNA, 23 bp, Homo sapiens
acatggtgaaaccccgtctctac

SEQ ID NO: 1137986 - DNA, 18 bp, Homo sapiens
acatggtgcccctagctt

SEQ ID NO: 1137987 - DNA, 18 bp, Homo sapiens
acatggtgcctgagaggc

SEQ ID NO: 1137988 - DNA, 16 bp, Homo sapiens
acatggtgtctcccaa

SEQ ID NO: 1137989 - DNA, 18 bp, Homo sapiens
acatggttaccatgtctt

SEQ ID NO: 1137990 - DNA, 14 bp, Homo sapiens
acatggttggggga

SEQ ID NO: 1137991 - DNA, 20 bp, Homo sapiens
acatggttgtgacctgagga

SEQ ID NO: 1137992 - DNA, 14 bp, Homo sapiens
acatgtaaaatatg

SEQ ID NO: 1137993 - DNA, 20 bp, Homo sapiens
acatgtaactatttcttcag

SEQ ID NO: 1137994 - DNA, 13 bp, Homo sapiens
acatgtaagaaaa

SEQ ID NO: 1137995 - DNA, 15 bp, Homo sapiens
acatgtaagaaaatg

SEQ ID NO: 1137996 - DNA, 14 bp, Homo sapiens
acatgtaataaatt

SEQ ID NO: 1137997 - DNA, 16 bp, Homo sapiens
acatgtaataaattca

SEQ ID NO: 1137998 - DNA, 15 bp, Homo sapiens
acatgtaattaagta

SEQ ID NO: 1137999 - DNA, 21 bp, Homo sapiens
acatgtaattaagtactatgt

SEQ ID NO: 1138000 - DNA, 23 bp, Homo sapiens
acatgtaattaagtactatgtat

SEQ ID NO: 1138001 - DNA, 21 bp, Homo sapiens
acatgtacataaactgtcact

SEQ ID NO: 1138002 - DNA, 13 bp, Homo sapiens
acatgtactccag

SEQ ID NO: 1138003 - DNA, 18 bp, Homo sapiens
acatgtactccagaggga

SEQ ID NO: 1138004 - DNA, 17 bp, Homo sapiens
acatgtaggaagtagga

SEQ ID NO: 1138005 - DNA, 21 bp, Homo sapiens
acatgtaggtaggaagcactg

SEQ ID NO: 1138006 - DNA, 12 bp, Homo sapiens
acatgtcaatct

SEQ ID NO: 1138007 - DNA, 18 bp, Homo sapiens
acatgtcacaatacagta

SEQ ID NO: 1138008 - DNA, 18 bp, Homo sapiens
acatgtcagtaccttcaa

SEQ ID NO: 1138009 - DNA, 15 bp, Homo sapiens
acatgtcagttttat

SEQ ID NO: 1138010 - DNA, 20 bp, Homo sapiens
acatgtcctaattcttctgt

SEQ ID NO: 1138011 - DNA, 22 bp, Homo sapiens
acatgtcctaattcttctgtcc

SEQ ID NO: 1138012 - DNA, 16 bp, Homo sapiens
acatgtccttgtgtgt

SEQ ID NO: 1138013 - DNA, 14 bp, Homo sapiens
acatgtctactttt

SEQ ID NO: 1138014 - DNA, 15 bp, Homo sapiens
acatgtctacttttt

SEQ ID NO: 1138015 - DNA, 16 bp, Homo sapiens
acatgtctacttttta

SEQ ID NO: 1138016 - DNA, 16 bp, Homo sapiens
acatgtctcctatcct

SEQ ID NO: 1138017 - DNA, 16 bp, Homo sapiens
acatgtctgtcctcag

SEQ ID NO: 1138018 - DNA, 21 bp, Homo sapiens
acatgtctgtcctcagagcag

SEQ ID NO: 1138019 - DNA, 21 bp, Homo sapiens
acatgtgaaaagcttaataaa

SEQ ID NO: 1138020 - DNA, 17 bp, Homo sapiens
acatgtgaagctatttg

SEQ ID NO: 1138021 - DNA, 16 bp, Homo sapiens
acatgtgacatttata

SEQ ID NO: 1138022 - DNA, 17 bp, Homo sapiens
acatgtgaggaggaaaa

SEQ ID NO: 1138023 - DNA, 19 bp, Homo sapiens
acatgtgaggaggaaaagg

SEQ ID NO: 1138024 - DNA, 20 bp, Homo sapiens
acaaaccaccaggactgaaa

SEQ ID NO: 1138025 - DNA, 21 bp, Homo sapiens
acaaaccaggtcaccatcctc

SEQ ID NO: 1138026 - DNA, 18 bp, Homo sapiens
acaaaccataactgacaa

SEQ ID NO: 1138027 - DNA, 17 bp, Homo sapiens
acaaaccattttatttt

SEQ ID NO: 1138028 - DNA, 17 bp, Homo sapiens
acaaacctactgcccac

SEQ ID NO: 1138029 - DNA, 18 bp, Homo sapiens
acaaacctagaattttct

SEQ ID NO: 1138030 - DNA, 16 bp, Homo sapiens
acaaacgtgtttttta

SEQ ID NO: 1138031 - DNA, 14 bp, Homo sapiens
acaaactcagatcc

SEQ ID NO: 1138032 - DNA, 17 bp, Homo sapiens
acaaactcagatccttg

SEQ ID NO: 1138033 - DNA, 22 bp, Homo sapiens
acaaactctctgaacccctccc

SEQ ID NO: 1138034 - DNA, 20 bp, Homo sapiens
acaaactcttcagttaattc

SEQ ID NO: 1138035 - DNA, 10 bp, Homo sapiens
acaaactgca

SEQ ID NO: 1138036 - DNA, 19 bp, Homo sapiens
acaaactgtgaaaatagtg

SEQ ID NO: 1138037 - DNA, 15 bp, Homo sapiens
acaaactttgcatct

SEQ ID NO: 1138038 - DNA, 15 bp, Homo sapiens
acaaagaaaaaaaat

SEQ ID NO: 1138039 - DNA, 17 bp, Homo sapiens
acaaagaaacaaagatg

SEQ ID NO: 1138040 - DNA, 18 bp, Homo sapiens
acaaagaaacaaagatgt

SEQ ID NO: 1138041 - DNA, 20 bp, Homo sapiens
acaaagaaacaaagatgtta

SEQ ID NO: 1138042 - DNA, 22 bp, Homo sapiens
acaaagaaatccggagaagctg

SEQ ID NO: 1138043 - DNA, 18 bp, Homo sapiens
acaaagacaaaagtctgt

SEQ ID NO: 1138044 - DNA, 19 bp, Homo sapiens
acaaagacaaattctgttt

SEQ ID NO: 1138045 - DNA, 22 bp, Homo sapiens
acaaagacaaattctgtttctt

SEQ ID NO: 1138046 - DNA, 18 bp, Homo sapiens
acaaagagttcaagaaat

SEQ ID NO: 1138047 - DNA, 19 bp, Homo sapiens
acaaagagttcaagaaata

SEQ ID NO: 1138048 - DNA, 20 bp, Homo sapiens
acaaagatgagctctgaaca

SEQ ID NO: 1138049 - DNA, 13 bp, Homo sapiens
acaaagcaaaggc

SEQ ID NO: 1138050 - DNA, 16 bp, Homo sapiens
acaaagcaaaggcagt

SEQ ID NO: 1138051 - DNA, 19 bp, Homo sapiens
acaaagcacagtttgaaca

SEQ ID NO: 1138052 - DNA, 13 bp, Homo sapiens
acaaagcagccac

SEQ ID NO: 1138053 - DNA, 15 bp, Homo sapiens
acaaagcaggagtgg

SEQ ID NO: 1138054 - DNA, 18 bp, Homo sapiens
acaaagcaggagtggaag

SEQ ID NO: 1138055 - DNA, 21 bp, Homo sapiens
acaaagcagtatataataact

SEQ ID NO: 1138056 - DNA, 23 bp, Homo sapiens
acaaagcagtatataataacttt

SEQ ID NO: 1138057 - DNA, 17 bp, Homo sapiens
acaaagccaaacaaaac

SEQ ID NO: 1138058 - DNA, 20 bp, Homo sapiens
acaaagccaaacaaaactga

SEQ ID NO: 1138059 - DNA, 17 bp, Homo sapiens
acaaagccaacagtcaa

SEQ ID NO: 1138060 - DNA, 15 bp, Homo sapiens
acaaagccagaggag

SEQ ID NO: 1138061 - DNA, 18 bp, Homo sapiens
acaaagccttaagcaaat

SEQ ID NO: 1138062 - DNA, 19 bp, Homo sapiens
acaaagccttatcaagtgt

SEQ ID NO: 1138063 - DNA, 20 bp, Homo sapiens
acaaagctgttaaactgtta

SEQ ID NO: 1138064 - DNA, 15 bp, Homo sapiens
acaaagcttctaaag

SEQ ID NO: 1138065 - DNA, 21 bp, Homo sapiens
acaaagcttctatcccaggag

SEQ ID NO: 1138066 - DNA, 15 bp, Homo sapiens
acaaagctttgctac

SEQ ID NO: 1138067 - DNA, 16 bp, Homo sapiens
acaaagctttgctaca

SEQ ID NO: 1138068 - DNA, 15 bp, Homo sapiens
acaaaggaggaattt

SEQ ID NO: 1138069 - DNA, 11 bp, Homo sapiens
acaaaggatga

SEQ ID NO: 1138070 - DNA, 22 bp, Homo sapiens
acaaaggatgaagaacacagca

SEQ ID NO: 1138071 - DNA, 19 bp, Homo sapiens
acaaaggtataattttatg

SEQ ID NO: 1138072 - DNA, 21 bp, Homo sapiens
acaaaggtggaataaacatta

SEQ ID NO: 1138073 - DNA, 19 bp, Homo sapiens
acaaaggtttaaagtttga

SEQ ID NO: 1138074 - DNA, 14 bp, Homo sapiens
acaaagtaaaatga

SEQ ID NO: 1138075 - DNA, 17 bp, Homo sapiens
acaaagtacagaaaaat

SEQ ID NO: 1138076 - DNA, 18 bp, Homo sapiens
acaaagtactctttaaca

SEQ ID NO: 1138077 - DNA, 16 bp, Homo sapiens
acaaagtcacagtcgt

SEQ ID NO: 1138078 - DNA, 20 bp, Homo sapiens
acaaagtcatcccctctcag

SEQ ID NO: 1138079 - DNA, 16 bp, Homo sapiens
acaaagtccaagtctg

SEQ ID NO: 1138080 - DNA, 18 bp, Homo sapiens
acaaagtgactgtttggc

SEQ ID NO: 1138081 - DNA, 19 bp, Homo sapiens
acaaagtgggtgtgtggcc

SEQ ID NO: 1138082 - DNA, 13 bp, Homo sapiens
acaaagtgttgaa

SEQ ID NO: 1138083 - DNA, 19 bp, Homo sapiens
acaaagtgttgaaaatgta

SEQ ID NO: 1138084 - DNA, 21 bp, Homo sapiens
acaaagttactaggtaacttc

SEQ ID NO: 1138085 - DNA, 23 bp, Homo sapiens
acaaagttactaggtaacttcat

SEQ ID NO: 1138086 - DNA, 14 bp, Homo sapiens
acaaagttctcaga

SEQ ID NO: 1138087 - DNA, 20 bp, Homo sapiens
acaaagtttacattgtcctg

SEQ ID NO: 1138088 - DNA, 18 bp, Homo sapiens
acaaagtttcagagtata

SEQ ID NO: 1138089 - DNA, 18 bp, Homo sapiens
acaaagttttaaacgaaa

SEQ ID NO: 1138090 - DNA, 18 bp, Homo sapiens
acaaataaaattggcacc

SEQ ID NO: 1138091 - DNA, 19 bp, Homo sapiens
acaaataaatgattatatt

SEQ ID NO: 1138092 - DNA, 16 bp, Homo sapiens
acaaataacaatgtgc

SEQ ID NO: 1138093 - DNA, 12 bp, Homo sapiens
acaaataatcac

SEQ ID NO: 1138094 - DNA, 23 bp, Homo sapiens
acaaataggtagagtcattcata

SEQ ID NO: 1138095 - DNA, 14 bp, Homo sapiens
acaaatataagaat

SEQ ID NO: 1138096 - DNA, 15 bp, Homo sapiens
acaaatataagaata

SEQ ID NO: 1138097 - DNA, 17 bp, Homo sapiens
acaaatataagaataaa

SEQ ID NO: 1138098 - DNA, 13 bp, Homo sapiens
acaaatatgaaaa

SEQ ID NO: 1138099 - DNA, 12 bp, Homo sapiens
acaaatatgcaa

SEQ ID NO: 1138100 - DNA, 13 bp, Homo sapiens
acaaatatgcttt

SEQ ID NO: 1138101 - DNA, 19 bp, Homo sapiens
acaaatattcactggcccc

SEQ ID NO: 1138102 - DNA, 12 bp, Homo sapiens
acaaatatttat

SEQ ID NO: 1138103 - DNA, 17 bp, Homo sapiens
acaaatcacacctctgg

SEQ ID NO: 1138104 - DNA, 22 bp, Homo sapiens
acaaatctaatctcttattcta

SEQ ID NO: 1138105 - DNA, 15 bp, Homo sapiens
acaaatctataaata

SEQ ID NO: 1138106 - DNA, 14 bp, Homo sapiens
acaaatctttaaga

SEQ ID NO: 1138107 - DNA, 16 bp, Homo sapiens
acaaatgactgtatct

SEQ ID NO: 1138108 - DNA, 12 bp, Homo sapiens
aatttgattgat

SEQ ID NO: 1138109 - DNA, 13 bp, Homo sapiens
aatttgattgatt

SEQ ID NO: 1138110 - DNA, 14 bp, Homo sapiens
aatttgattgattt

SEQ ID NO: 1138111 - DNA, 15 bp, Homo sapiens
aatttgattgatttg

SEQ ID NO: 1138112 - DNA, 16 bp, Homo sapiens
aatttgattgctttgc

SEQ ID NO: 1138113 - DNA, 15 bp, Homo sapiens
aatttgatttctatt

SEQ ID NO: 1138114 - DNA, 22 bp, Homo sapiens
aatttgcaacaggggaggaaaa

SEQ ID NO: 1138115 - DNA, 15 bp, Homo sapiens
aatttgcacaatatt

SEQ ID NO: 1138116 - DNA, 12 bp, Homo sapiens
aatttgcacagt

SEQ ID NO: 1138117 - DNA, 20 bp, Homo sapiens
aatttgcacggtttgtgaga

SEQ ID NO: 1138118 - DNA, 20 bp, Homo sapiens
aatttgcactaaatcagaga

SEQ ID NO: 1138119 - DNA, 17 bp, Homo sapiens
aatttgcatattctatt

SEQ ID NO: 1138120 - DNA, 23 bp, Homo sapiens
aatttgcattaaattcacaaact

SEQ ID NO: 1138121 - DNA, 15 bp, Homo sapiens
aatttgcattactct

SEQ ID NO: 1138122 - DNA, 16 bp, Homo sapiens
aatttgcattactctg

SEQ ID NO: 1138123 - DNA, 20 bp, Homo sapiens
aatttgccatgacatttcat

SEQ ID NO: 1138124 - DNA, 24 bp, Homo sapiens
aatttgccatgacatttcatctgg

SEQ ID NO: 1138125 - DNA, 13 bp, Homo sapiens
aatttgcctgctg

SEQ ID NO: 1138126 - DNA, 22 bp, Homo sapiens
aatttgcctgtaacaagccaga

SEQ ID NO: 1138127 - DNA, 20 bp, Homo sapiens
aatttgctgccaaatgcgta

SEQ ID NO: 1138128 - DNA, 20 bp, Homo sapiens
aatttgctggagaagtgtgt

SEQ ID NO: 1138129 - DNA, 16 bp, Homo sapiens
aatttgctttaattaa

SEQ ID NO: 1138130 - DNA, 20 bp, Homo sapiens
aatttggagcacaaaattca

SEQ ID NO: 1138131 - DNA, 20 bp, Homo sapiens
aatttggataataaaaattg

SEQ ID NO: 1138132 - DNA, 23 bp, Homo sapiens
aatttggataataaaaattgtag

SEQ ID NO: 1138133 - DNA, 15 bp, Homo sapiens
aatttggcaaaacaa

SEQ ID NO: 1138134 - DNA, 19 bp, Homo sapiens
aatttggcaaaacaaaatg

SEQ ID NO: 1138135 - DNA, 18 bp, Homo sapiens
aatttggcctgcactaat

SEQ ID NO: 1138136 - DNA, 13 bp, Homo sapiens
aatttggccttaa

SEQ ID NO: 1138137 - DNA, 23 bp, Homo sapiens
aatttggccttaagaactgtgtc

SEQ ID NO: 1138138 - DNA, 14 bp, Homo sapiens
aatttggctgcttc

SEQ ID NO: 1138139 - DNA, 12 bp, Homo sapiens
aatttgggcctc

SEQ ID NO: 1138140 - DNA, 14 bp, Homo sapiens
aatttggggaaaat

SEQ ID NO: 1138141 - DNA, 16 bp, Homo sapiens
aatttggtgcttataa

SEQ ID NO: 1138142 - DNA, 24 bp, Homo sapiens
aatttgtaaaaacagcattgcttt

SEQ ID NO: 1138143 - DNA, 16 bp, Homo sapiens
aatttgtaaacttctg

SEQ ID NO: 1138144 - DNA, 13 bp, Homo sapiens
aatttgtaaatga

SEQ ID NO: 1138145 - DNA, 20 bp, Homo sapiens
aatttgtaaatgattttaat

SEQ ID NO: 1138146 - DNA, 23 bp, Homo sapiens
aatttgtaagcaacttgcttcta

SEQ ID NO: 1138147 - DNA, 21 bp, Homo sapiens
aatttgtacaatggtttattc

SEQ ID NO: 1138148 - DNA, 23 bp, Homo sapiens
aatttgtataaagcattactctt

SEQ ID NO: 1138149 - DNA, 18 bp, Homo sapiens
aatttgtatgctaaatga

SEQ ID NO: 1138150 - DNA, 19 bp, Homo sapiens
aatttgtatgctaaatgag

SEQ ID NO: 1138151 - DNA, 16 bp, Homo sapiens
aatttgtccattgtaa

SEQ ID NO: 1138152 - DNA, 16 bp, Homo sapiens
aatttgtctcctactc

SEQ ID NO: 1138153 - DNA, 20 bp, Homo sapiens
aatttgtctgaaacatttca

SEQ ID NO: 1138154 - DNA, 13 bp, Homo sapiens
aatttgtcttaaa

SEQ ID NO: 1138155 - DNA, 13 bp, Homo sapiens
aatttgtgaattt

SEQ ID NO: 1138156 - DNA, 18 bp, Homo sapiens
aatttgtgatacaatgct

SEQ ID NO: 1138157 - DNA, 10 bp, Homo sapiens
aatttgtgtg

SEQ ID NO: 1138158 - DNA, 14 bp, Homo sapiens
aatttgtgtgtttt

SEQ ID NO: 1138159 - DNA, 23 bp, Homo sapiens
aatttgtgtgtttttagctgtga

SEQ ID NO: 1138160 - DNA, 21 bp, Homo sapiens
aatttgttaattcctatgaag

SEQ ID NO: 1138161 - DNA, 19 bp, Homo sapiens
aatttgttatacttcaaaa

SEQ ID NO: 1138162 - DNA, 18 bp, Homo sapiens
aatttgttattttgcaac

SEQ ID NO: 1138163 - DNA, 12 bp, Homo sapiens
aatttgttgcat

SEQ ID NO: 1138164 - DNA, 15 bp, Homo sapiens
aatttgttgtttgtt

SEQ ID NO: 1138165 - DNA, 16 bp, Homo sapiens
aatttgtttaaaattc

SEQ ID NO: 1138166 - DNA, 19 bp, Homo sapiens
aatttgtttaaaattctct

SEQ ID NO: 1138167 - DNA, 20 bp, Homo sapiens
aatttgtttaaaattctctt

SEQ ID NO: 1138168 - DNA, 18 bp, Homo sapiens
aatttgtttaaagaataa

SEQ ID NO: 1138169 - DNA, 21 bp, Homo sapiens
aatttgtttaattaaatttaa

SEQ ID NO: 1138170 - DNA, 17 bp, Homo sapiens
aatttgtttgaaatctt

SEQ ID NO: 1138171 - DNA, 15 bp, Homo sapiens
aattttaaaaagcag

SEQ ID NO: 1138172 - DNA, 14 bp, Homo sapiens
aattttaaacaaag

SEQ ID NO: 1138173 - DNA, 12 bp, Homo sapiens
aattttaaagcc

SEQ ID NO: 1138174 - DNA, 13 bp, Homo sapiens
aattttaaagtat

SEQ ID NO: 1138175 - DNA, 14 bp, Homo sapiens
aattttaaagtatg

SEQ ID NO: 1138176 - DNA, 13 bp, Homo sapiens
aattttaaagttc

SEQ ID NO: 1138177 - DNA, 14 bp, Homo sapiens
aattttaaagttct

SEQ ID NO: 1138178 - DNA, 12 bp, Homo sapiens
aattttaaataa

SEQ ID NO: 1138179 - DNA, 17 bp, Homo sapiens
aattttaaataaaagtg

SEQ ID NO: 1138180 - DNA, 18 bp, Homo sapiens
aattttaaataaaagtga

SEQ ID NO: 1138181 - DNA, 15 bp, Homo sapiens
aattttaaataacct

SEQ ID NO: 1138182 - DNA, 12 bp, Homo sapiens
aattttaaatta

SEQ ID NO: 1138183 - DNA, 19 bp, Homo sapiens
aattttaagtgctttgtaa

SEQ ID NO: 1138184 - DNA, 22 bp, Homo sapiens
aattttaagtgctttgtaatgg

SEQ ID NO: 1138185 - DNA, 16 bp, Homo sapiens
aattttaatattttat

SEQ ID NO: 1138186 - DNA, 20 bp, Homo sapiens
aattttaatctgaaaattta

SEQ ID NO: 1138187 - DNA, 23 bp, Homo sapiens
aattttaatgatggtgttaaagc

SEQ ID NO: 1138188 - DNA, 18 bp, Homo sapiens
aattttaatgctgtttct

SEQ ID NO: 1138189 - DNA, 20 bp, Homo sapiens
aattttaatgctgtttctaa

SEQ ID NO: 1138190 - DNA, 21 bp, Homo sapiens
aattttaatgctgtttctaag

SEQ ID NO: 1138191 - DNA, 22 bp, Homo sapiens
aattttaatgctgtttctaaga

SEQ ID NO: 1138192 - DNA, 13 bp, Homo sapiens
aattttaatgtga

SEQ ID NO: 1138193 - DNA, 13 bp, Homo sapiens
aattttaatttat

SEQ ID NO: 1138194 - DNA, 15 bp, Homo sapiens
aattttaatttattt

SEQ ID NO: 1138195 - DNA, 13 bp, Homo sapiens
aattttacacatt

SEQ ID NO: 1138196 - DNA, 17 bp, Homo sapiens
aattttaccctttagac

SEQ ID NO: 1138197 - DNA, 21 bp, Homo sapiens
aattttaccctttagactgta

SEQ ID NO: 1138198 - DNA, 13 bp, Homo sapiens
aattttagaaata

SEQ ID NO: 1138199 - DNA, 15 bp, Homo sapiens
aattttagaaatatt

SEQ ID NO: 1138200 - DNA, 20 bp, Homo sapiens
aattttatagctcagtttat

SEQ ID NO: 1138201 - DNA, 18 bp, Homo sapiens
aattttatattcagtgaa

SEQ ID NO: 1138202 - DNA, 12 bp, Homo sapiens
aattttatgaat

SEQ ID NO: 1138203 - DNA, 11 bp, Homo sapiens
aattttatgta

SEQ ID NO: 1138204 - DNA, 11 bp, Homo sapiens
aattttattat

SEQ ID NO: 1138205 - DNA, 23 bp, Homo sapiens
aattttatttgttctttttctga

SEQ ID NO: 1138206 - DNA, 16 bp, Homo sapiens
aattttatttttctgt

SEQ ID NO: 1138207 - DNA, 13 bp, Homo sapiens
aattttcactgct

SEQ ID NO: 1138208 - DNA, 14 bp, Homo sapiens
aattttcacttctg

SEQ ID NO: 1138209 - DNA, 21 bp, Homo sapiens
aattttcacttttggcaatga

SEQ ID NO: 1138210 - DNA, 18 bp, Homo sapiens
aattttcattaaacttga

SEQ ID NO: 1138211 - DNA, 15 bp, Homo sapiens
aattttctaaaagct

SEQ ID NO: 1138212 - DNA, 23 bp, Homo sapiens
aattttctaagacagtttttata

SEQ ID NO: 1138213 - DNA, 12 bp, Homo sapiens
aattttctagac

SEQ ID NO: 1138214 - DNA, 15 bp, Homo sapiens
aattttctagacttt

SEQ ID NO: 1138215 - DNA, 17 bp, Homo sapiens
aattttctagactttct

SEQ ID NO: 1138216 - DNA, 19 bp, Homo sapiens
aattttctccctttatgta

SEQ ID NO: 1138217 - DNA, 13 bp, Homo sapiens
aattttctccttg

SEQ ID NO: 1138218 - DNA, 22 bp, Homo sapiens
aattttctggaatacatgaaat

SEQ ID NO: 1138219 - DNA, 19 bp, Homo sapiens
aattttcttcatgcaatga

SEQ ID NO: 1138220 - DNA, 12 bp, Homo sapiens
aattttctttca

SEQ ID NO: 1138221 - DNA, 16 bp, Homo sapiens
aattttctttgtttct

SEQ ID NO: 1138222 - DNA, 23 bp, Homo sapiens
aattttcttttaagcatttgtat

SEQ ID NO: 1138223 - DNA, 12 bp, Homo sapiens
aattttgacact

SEQ ID NO: 1138224 - DNA, 15 bp, Homo sapiens
aattttgagaaaaat

SEQ ID NO: 1138225 - DNA, 17 bp, Homo sapiens
aattttgagtattccat

SEQ ID NO: 1138226 - DNA, 23 bp, Homo sapiens
aattttgataaaaatttagaaca

SEQ ID NO: 1138227 - DNA, 11 bp, Homo sapiens
aattttgatat

SEQ ID NO: 1138228 - DNA, 23 bp, Homo sapiens
aattttgatctttttatattctt

SEQ ID NO: 1138229 - DNA, 20 bp, Homo sapiens
aattttgctggaattcctaa

SEQ ID NO: 1138230 - DNA, 19 bp, Homo sapiens
aattttggaataatttcta

SEQ ID NO: 1138231 - DNA, 20 bp, Homo sapiens
aattttggaataatttctat

SEQ ID NO: 1138232 - DNA, 23 bp, Homo sapiens
aattttgggtattgtaatctgaa

SEQ ID NO: 1138233 - DNA, 17 bp, Homo sapiens
aattggatttcctaata

SEQ ID NO: 1138234 - DNA, 15 bp, Homo sapiens
aattggcaggataag

SEQ ID NO: 1138235 - DNA, 17 bp, Homo sapiens
aattggcagtgactttg

SEQ ID NO: 1138236 - DNA, 16 bp, Homo sapiens
aattggcataatttgt

SEQ ID NO: 1138237 - DNA, 16 bp, Homo sapiens
aattgggaatgcaata

SEQ ID NO: 1138238 - DNA, 21 bp, Homo sapiens
aattgggagcttgggaatgga

SEQ ID NO: 1138239 - DNA, 14 bp, Homo sapiens
aattgggagtccag

SEQ ID NO: 1138240 - DNA, 16 bp, Homo sapiens
aattgggcactattta

SEQ ID NO: 1138241 - DNA, 19 bp, Homo sapiens
aattgggccagcttttcaa

SEQ ID NO: 1138242 - DNA, 19 bp, Homo sapiens
aattgggctggattgtgct

SEQ ID NO: 1138243 - DNA, 16 bp, Homo sapiens
aattggggaggagggg

SEQ ID NO: 1138244 - DNA, 21 bp, Homo sapiens
aattggtaaaactcactgtga

SEQ ID NO: 1138245 - DNA, 12 bp, Homo sapiens
aattggtaatat

SEQ ID NO: 1138246 - DNA, 16 bp, Homo sapiens
aattggtaattacctg

SEQ ID NO: 1138247 - DNA, 18 bp, Homo sapiens
aattggtatcaagaaagt

SEQ ID NO: 1138248 - DNA, 20 bp, Homo sapiens
aattggtgctatttgaagaa

SEQ ID NO: 1138249 - DNA, 14 bp, Homo sapiens
aagtgagagaaaaa

SEQ ID NO: 1138250 - DNA, 13 bp, Homo sapiens
aagtgagagggga

SEQ ID NO: 1138251 - DNA, 17 bp, Homo sapiens
aagtgagaggggaggga

SEQ ID NO: 1138252 - DNA, 19 bp, Homo sapiens
aagtgagaggggagggagg

SEQ ID NO: 1138253 - DNA, 11 bp, Homo sapiens
aagtgagcaga

SEQ ID NO: 1138254 - DNA, 14 bp, Homo sapiens
aagtgagcagaaca

SEQ ID NO: 1138255 - DNA, 13 bp, Homo sapiens
aagtgagcccccc

SEQ ID NO: 1138256 - DNA, 16 bp, Homo sapiens
aagtgagcccccccct

SEQ ID NO: 1138257 - DNA, 17 bp, Homo sapiens
aagtgaggcccaaggag

SEQ ID NO: 1138258 - DNA, 19 bp, Homo sapiens
aagtgaggcccaaggagct

SEQ ID NO: 1138259 - DNA, 20 bp, Homo sapiens
aagtgaggcccaaggagctt

SEQ ID NO: 1138260 - DNA, 14 bp, Homo sapiens
aagtgatagaaatg

SEQ ID NO: 1138261 - DNA, 18 bp, Homo sapiens
aagtgataggataaagtt

SEQ ID NO: 1138262 - DNA, 21 bp, Homo sapiens
aagtgatcaaactacatattg

SEQ ID NO: 1138263 - DNA, 18 bp, Homo sapiens
aagtgatccttccacctc

SEQ ID NO: 1138264 - DNA, 16 bp, Homo sapiens
aagtgatctgtgttca

SEQ ID NO: 1138265 - DNA, 19 bp, Homo sapiens
aagtgatgtcatttgagca

SEQ ID NO: 1138266 - DNA, 17 bp, Homo sapiens
aagtgattatctctttg

SEQ ID NO: 1138267 - DNA, 17 bp, Homo sapiens
aagtgattctaagattt

SEQ ID NO: 1138268 - DNA, 20 bp, Homo sapiens
aagtgattctcctgcctcag

SEQ ID NO: 1138269 - DNA, 21 bp, Homo sapiens
aagtgattctcctgcctcagc

SEQ ID NO: 1138270 - DNA, 23 bp, Homo sapiens
aagtgattcttccacctcagcct

SEQ ID NO: 1138271 - DNA, 22 bp, Homo sapiens
aagtgattttatttttgcaaaa

SEQ ID NO: 1138272 - DNA, 20 bp, Homo sapiens
aagtgcaacatttctgtata

SEQ ID NO: 1138273 - DNA, 15 bp, Homo sapiens
aagtgcactttctaa

SEQ ID NO: 1138274 - DNA, 18 bp, Homo sapiens
aagtgcacttttttatga

SEQ ID NO: 1138275 - DNA, 19 bp, Homo sapiens
aagtgcacttttttatgaa

SEQ ID NO: 1138276 - DNA, 21 bp, Homo sapiens
aagtgcagcccttcctcctga

SEQ ID NO: 1138277 - DNA, 12 bp, Homo sapiens
aagtgcaggctg

SEQ ID NO: 1138278 - DNA, 17 bp, Homo sapiens
aagtgcaggctggcacc

SEQ ID NO: 1138279 - DNA, 20 bp, Homo sapiens
aagtgcagggaggaaaagtg

SEQ ID NO: 1138280 - DNA, 18 bp, Homo sapiens
aagtgcagtcatttgtgg

SEQ ID NO: 1138281 - DNA, 19 bp, Homo sapiens
aagtgcatccaaaggtgct

SEQ ID NO: 1138282 - DNA, 23 bp, Homo sapiens
aagttgtttatgtatcagctctc

SEQ ID NO: 1138283 - DNA, 19 bp, Homo sapiens
aagtttaaaagccatgtat

SEQ ID NO: 1138284 - DNA, 20 bp, Homo sapiens
aagtttaacaaatgactgta

SEQ ID NO: 1138285 - DNA, 21 bp, Homo sapiens
aagtttaactttaaaactgta

SEQ ID NO: 1138286 - DNA, 21 bp, Homo sapiens
aagtttacaagtgtatatcag

SEQ ID NO: 1138287 - DNA, 15 bp, Homo sapiens
aagtttacacttcat

SEQ ID NO: 1138288 - DNA, 23 bp, Homo sapiens
aagtttagcccctgaaagccatg

SEQ ID NO: 1138289 - DNA, 18 bp, Homo sapiens
aagtttatcagtaaataa

SEQ ID NO: 1138290 - DNA, 16 bp, Homo sapiens
aagtttattctcattt

SEQ ID NO: 1138291 - DNA, 14 bp, Homo sapiens
aagtttatttgaga

SEQ ID NO: 1138292 - DNA, 20 bp, Homo sapiens
aagtttattttttctacaca

SEQ ID NO: 1138293 - DNA, 21 bp, Homo sapiens
aagtttattttttctacacag

SEQ ID NO: 1138294 - DNA, 22 bp, Homo sapiens
aagtttattttttctacacagt

SEQ ID NO: 1138295 - DNA, 20 bp, Homo sapiens
aagtttcaaacttactattt

SEQ ID NO: 1138296 - DNA, 20 bp, Homo sapiens
aagtttcaagttttaaagtt

SEQ ID NO: 1138297 - DNA, 20 bp, Homo sapiens
aagtttcacaggtcaataaa

SEQ ID NO: 1138298 - DNA, 15 bp, Homo sapiens
aagtttcatcatttt

SEQ ID NO: 1138299 - DNA, 16 bp, Homo sapiens
aagtttccatcatcta

SEQ ID NO: 1138300 - DNA, 12 bp, Homo sapiens
aagtttctattc

SEQ ID NO: 1138301 - DNA, 15 bp, Homo sapiens
aagtttctctgcaga

SEQ ID NO: 1138302 - DNA, 15 bp, Homo sapiens
aagtttctcttcacc

SEQ ID NO: 1138303 - DNA, 14 bp, Homo sapiens
aagtttctgtttca

SEQ ID NO: 1138304 - DNA, 18 bp, Homo sapiens
aagtttgaaaagcaatat

SEQ ID NO: 1138305 - DNA, 17 bp, Homo sapiens
aagtttgaaggaaacag

SEQ ID NO: 1138306 - DNA, 15 bp, Homo sapiens
aagtttgaccagtgc

SEQ ID NO: 1138307 - DNA, 15 bp, Homo sapiens
aagtttgatttcatt

SEQ ID NO: 1138308 - DNA, 15 bp, Homo sapiens
aagtttgatttttgt

SEQ ID NO: 1138309 - DNA, 12 bp, Homo sapiens
aagtttgctaaa

SEQ ID NO: 1138310 - DNA, 18 bp, Homo sapiens
aagtttgctaaaagaaga

SEQ ID NO: 1138311 - DNA, 23 bp, Homo sapiens
aagtttggagcactagtttgatt

SEQ ID NO: 1138312 - DNA, 18 bp, Homo sapiens
aagtttggtattgtaaaa

SEQ ID NO: 1138313 - DNA, 13 bp, Homo sapiens
aagtttgtagcca

SEQ ID NO: 1138314 - DNA, 15 bp, Homo sapiens
aagtttgtgttctgt

SEQ ID NO: 1138315 - DNA, 19 bp, Homo sapiens
aagtttgtgttctgtttgt

SEQ ID NO: 1138316 - DNA, 18 bp, Homo sapiens
aagtttgttcacttaaat

SEQ ID NO: 1138317 - DNA, 14 bp, Homo sapiens
aagtttgttgaaaa

SEQ ID NO: 1138318 - DNA, 22 bp, Homo sapiens
aagtttgtttatgcattgcctt

SEQ ID NO: 1138319 - DNA, 13 bp, Homo sapiens
aagttttaatgta

SEQ ID NO: 1138320 - DNA, 16 bp, Homo sapiens
aagttttcaaatttgt

SEQ ID NO: 1138321 - DNA, 22 bp, Homo sapiens
aagttttcccttgaggaaacaa

SEQ ID NO: 1138322 - DNA, 13 bp, Homo sapiens
aagttttcctgat

SEQ ID NO: 1138323 - DNA, 20 bp, Homo sapiens
aagttttcttcccagagaga

SEQ ID NO: 1138324 - DNA, 13 bp, Homo sapiens
aagttttgtaaaa

SEQ ID NO: 1138325 - DNA, 19 bp, Homo sapiens
aagttttgtaaaagaaatc

SEQ ID NO: 1138326 - DNA, 17 bp, Homo sapiens
aagttttgtgtgtatat

SEQ ID NO: 1138327 - DNA, 18 bp, Homo sapiens
aagttttgtgtgtatata

SEQ ID NO: 1138328 - DNA, 20 bp, Homo sapiens
aagtttttctttaatatgat

SEQ ID NO: 1138329 - DNA, 14 bp, Homo sapiens
aataaaaaagcaaa

SEQ ID NO: 1138330 - DNA, 15 bp, Homo sapiens
aataaaaaatagaca

SEQ ID NO: 1138331 - DNA, 16 bp, Homo sapiens
aataaaaaatagacat

SEQ ID NO: 1138332 - DNA, 17 bp, Homo sapiens
aataaaaaatgaaaaga

SEQ ID NO: 1138333 - DNA, 19 bp, Homo sapiens
aataaaaaattatgacaat

SEQ ID NO: 1138334 - DNA, 17 bp, Homo sapiens
aataaaaactaatttca

SEQ ID NO: 1138335 - DNA, 21 bp, Homo sapiens
aataaaaactgactccttaga

SEQ ID NO: 1138336 - DNA, 14 bp, Homo sapiens
aataaaaagacaac

SEQ ID NO: 1138337 - DNA, 18 bp, Homo sapiens
aataaaaagcttttgtct

SEQ ID NO: 1138338 - DNA, 11 bp, Homo sapiens
aataaaaagtg

SEQ ID NO: 1138339 - DNA, 19 bp, Homo sapiens
aataaaaagtgaacttttg

SEQ ID NO: 1138340 - DNA, 20 bp, Homo sapiens
aataaaaagtgaacttttgt

SEQ ID NO: 1138341 - DNA, 19 bp, Homo sapiens
aataaaaagtgacacagca

SEQ ID NO: 1138342 - DNA, 20 bp, Homo sapiens
aataaaaagtgacacagcag

SEQ ID NO: 1138343 - DNA, 13 bp, Homo sapiens
aataaaaatgcta

SEQ ID NO: 1138344 - DNA, 21 bp, Homo sapiens
aataaaaattgtagcttttta

SEQ ID NO: 1138345 - DNA, 16 bp, Homo sapiens
aataaaacaactctga

SEQ ID NO: 1138346 - DNA, 11 bp, Homo sapiens
aataaaacaag

SEQ ID NO: 1138347 - DNA, 12 bp, Homo sapiens
aataaaacaagc

SEQ ID NO: 1138348 - DNA, 15 bp, Homo sapiens
aataaaacatagcaa

SEQ ID NO: 1138349 - DNA, 16 bp, Homo sapiens
aataaaacatgtaata

SEQ ID NO: 1138350 - DNA, 13 bp, Homo sapiens
aataaaaccagct

SEQ ID NO: 1138351 - DNA, 12 bp, Homo sapiens
aataaaacccaa

SEQ ID NO: 1138352 - DNA, 22 bp, Homo sapiens
aataaaacctttcaaatttcac

SEQ ID NO: 1138353 - DNA, 22 bp, Homo sapiens
aataaaactaagctctttgaga

SEQ ID NO: 1138354 - DNA, 14 bp, Homo sapiens
aataaaactattta

SEQ ID NO: 1138355 - DNA, 23 bp, Homo sapiens
aataaaactatttaaaattggca

SEQ ID NO: 1138356 - DNA, 12 bp, Homo sapiens
aataaaactgaa

SEQ ID NO: 1138357 - DNA, 16 bp, Homo sapiens
aattctaagttattta

SEQ ID NO: 1138358 - DNA, 14 bp, Homo sapiens
aattctactggaaa

SEQ ID NO: 1138359 - DNA, 15 bp, Homo sapiens
aattctactggaaaa

SEQ ID NO: 1138360 - DNA, 18 bp, Homo sapiens
aattctactggaaaaaaa

SEQ ID NO: 1138361 - DNA, 14 bp, Homo sapiens
aattctactttgag

SEQ ID NO: 1138362 - DNA, 14 bp, Homo sapiens
aattctagctgtat

SEQ ID NO: 1138363 - DNA, 23 bp, Homo sapiens
aattctaggcatcccaggggacc

SEQ ID NO: 1138364 - DNA, 20 bp, Homo sapiens
aattctagtgtccataaata

SEQ ID NO: 1138365 - DNA, 15 bp, Homo sapiens
aattctatgcctgtc

SEQ ID NO: 1138366 - DNA, 19 bp, Homo sapiens
aattctatgttaaatactg

SEQ ID NO: 1138367 - DNA, 21 bp, Homo sapiens
aattctatgttaaatactgtg

SEQ ID NO: 1138368 - DNA, 17 bp, Homo sapiens
acacttggcatacaaaa

SEQ ID NO: 1138369 - DNA, 15 bp, Homo sapiens
acacttggtgtactg

SEQ ID NO: 1138370 - DNA, 13 bp, Homo sapiens
acacttgtgccag

SEQ ID NO: 1138371 - DNA, 16 bp, Homo sapiens
acacttgtgtgtgggc

SEQ ID NO: 1138372 - DNA, 13 bp, Homo sapiens
acactttacaatg

SEQ ID NO: 1138373 - DNA, 20 bp, Homo sapiens
acactttagttatattcact

SEQ ID NO: 1138374 - DNA, 14 bp, Homo sapiens
acactttctcttca

SEQ ID NO: 1138375 - DNA, 20 bp, Homo sapiens
acactttgaaatgtgtttct

SEQ ID NO: 1138376 - DNA, 23 bp, Homo sapiens
acactttgagcatttttaaggga

SEQ ID NO: 1138377 - DNA, 22 bp, Homo sapiens
acactttgcactgatatatcat

SEQ ID NO: 1138378 - DNA, 22 bp, Homo sapiens
acactttggaagtttgtgttct

SEQ ID NO: 1138379 - DNA, 23 bp, Homo sapiens
acactttgttgcaagatgtgaat

SEQ ID NO: 1138380 - DNA, 18 bp, Homo sapiens
acacttttaaaaaacaaa

SEQ ID NO: 1138381 - DNA, 17 bp, Homo sapiens
acacttttggaaccatg

SEQ ID NO: 1138382 - DNA, 16 bp, Homo sapiens
acactttttgtatttt

SEQ ID NO: 1138383 - DNA, 23 bp, Homo sapiens
acactttttgtattttttcctta

SEQ ID NO: 1138384 - DNA, 16 bp, Homo sapiens
acagaaaaacaatctt

SEQ ID NO: 1138385 - DNA, 18 bp, Homo sapiens
acagaaaagtgcctgagc

SEQ ID NO: 1138386 - DNA, 17 bp, Homo sapiens
acagaaacatgccagaa

SEQ ID NO: 1138387 - DNA, 16 bp, Homo sapiens
acagaaaccagaaaag

SEQ ID NO: 1138388 - DNA, 17 bp, Homo sapiens
acagaaaccagaaaagc

SEQ ID NO: 1138389 - DNA, 21 bp, Homo sapiens
acagaaagctagatatgcctt

SEQ ID NO: 1138390 - DNA, 18 bp, Homo sapiens
acagaaatactgctctga

SEQ ID NO: 1138391 - DNA, 14 bp, Homo sapiens
acagaaatagactt

SEQ ID NO: 1138392 - DNA, 17 bp, Homo sapiens
acagaaatagacttaat

SEQ ID NO: 1138393 - DNA, 21 bp, Homo sapiens
acagaaatcagaggagagacg

SEQ ID NO: 1138394 - DNA, 19 bp, Homo sapiens
acagaaatgctgctggcca

SEQ ID NO: 1138395 - DNA, 20 bp, Homo sapiens
acagaaatgctgctggccaa

SEQ ID NO: 1138396 - DNA, 14 bp, Homo sapiens
acagaaatgtacag

SEQ ID NO: 1138397 - DNA, 16 bp, Homo sapiens
acagaaatgtacagca

SEQ ID NO: 1138398 - DNA, 12 bp, Homo sapiens
acagaacactta

SEQ ID NO: 1138399 - DNA, 13 bp, Homo sapiens
acagaacacttat

SEQ ID NO: 1138400 - DNA, 13 bp, Homo sapiens
acagaacagggtc

SEQ ID NO: 1138401 - DNA, 19 bp, Homo sapiens
acagaactcgatgcactga

SEQ ID NO: 1138402 - DNA, 21 bp, Homo sapiens
acagaactcgatgcactgacc

SEQ ID NO: 1138403 - DNA, 20 bp, Homo sapiens
acagaactctttcaaaacct

SEQ ID NO: 1138404 - DNA, 21 bp, Homo sapiens
acagaacttcagaaagacttg

SEQ ID NO: 1138405 - DNA, 17 bp, Homo sapiens
acagaacttgaatgtgt

SEQ ID NO: 1138406 - DNA, 19 bp, Homo sapiens
acagaacttgaatgtgtca

SEQ ID NO: 1138407 - DNA, 20 bp, Homo sapiens
acagaagagtaaactggtga

SEQ ID NO: 1138408 - DNA, 18 bp, Homo sapiens
acagaagcaggctggagg

SEQ ID NO: 1138409 - DNA, 19 bp, Homo sapiens
acagaagcaggctggaggt

SEQ ID NO: 1138410 - DNA, 14 bp, Homo sapiens
acagaagcatttgt

SEQ ID NO: 1138411 - DNA, 16 bp, Homo sapiens
acagaagcatttgtat

SEQ ID NO: 1138412 - DNA, 17 bp, Homo sapiens
acagaagcatttgtatt

SEQ ID NO: 1138413 - DNA, 13 bp, Homo sapiens
acagaagccagga

SEQ ID NO: 1138414 - DNA, 20 bp, Homo sapiens
acagaagcccatgtcttctg

SEQ ID NO: 1138415 - DNA, 22 bp, Homo sapiens
acagaagctcttactctttcct

SEQ ID NO: 1138416 - DNA, 14 bp, Homo sapiens
acagaagggctctt

SEQ ID NO: 1138417 - DNA, 17 bp, Homo sapiens
acagaagtcatgaagcc

SEQ ID NO: 1138418 - DNA, 13 bp, Homo sapiens
acagaataaaagt

SEQ ID NO: 1138419 - DNA, 23 bp, Homo sapiens
acagaataaaagttcctctccct

SEQ ID NO: 1138420 - DNA, 23 bp, Homo sapiens
acagaatatttttatatttcctt

SEQ ID NO: 1138421 - DNA, 13 bp, Homo sapiens
acagaatcttctg

SEQ ID NO: 1138422 - DNA, 13 bp, Homo sapiens
acagaatgcatta

SEQ ID NO: 1138423 - DNA, 16 bp, Homo sapiens
acagaatgcattaaaa

SEQ ID NO: 1138424 - DNA, 17 bp, Homo sapiens
acagaatgcattaaaaa

SEQ ID NO: 1138425 - DNA, 15 bp, Homo sapiens
acagaatgtatctgt

SEQ ID NO: 1138426 - DNA, 13 bp, Homo sapiens
acagaatgtgttc

SEQ ID NO: 1138427 - DNA, 14 bp, Homo sapiens
acagaatgtgttct

SEQ ID NO: 1138428 - DNA, 16 bp, Homo sapiens
acagaatgtgttcttt

SEQ ID NO: 1138429 - DNA, 18 bp, Homo sapiens
acagaatgtgttcttttc

SEQ ID NO: 1138430 - DNA, 20 bp, Homo sapiens
acagaattatagatgtctga

SEQ ID NO: 1138431 - DNA, 17 bp, Homo sapiens
acagaattctgctacct

SEQ ID NO: 1138432 - DNA, 23 bp, Homo sapiens
acagaatttgaattatcagcaaa

SEQ ID NO: 1138433 - DNA, 19 bp, Homo sapiens
acagacaaaaacagcctca

SEQ ID NO: 1138434 - DNA, 12 bp, Homo sapiens
acagacaaggtt

SEQ ID NO: 1138435 - DNA, 15 bp, Homo sapiens
acagacacaatatgt

SEQ ID NO: 1138436 - DNA, 23 bp, Homo sapiens
acagacacaatatgtatgctttt

SEQ ID NO: 1138437 - DNA, 11 bp, Homo sapiens
acagacacaca

SEQ ID NO: 1138438 - DNA, 13 bp, Homo sapiens
acagacacacaca

SEQ ID NO: 1138439 - DNA, 14 bp, Homo sapiens
acagacacacacac

SEQ ID NO: 1138440 - DNA, 18 bp, Homo sapiens
acagacacacacacgcac

SEQ ID NO: 1138441 - DNA, 22 bp, Homo sapiens
acagacacacacacgcacgcac

SEQ ID NO: 1138442 - DNA, 11 bp, Homo sapiens
acagacacctc

SEQ ID NO: 1138443 - DNA, 13 bp, Homo sapiens
acagacacctccc

SEQ ID NO: 1138444 - DNA, 19 bp, Homo sapiens
acagacacctccccctacc

SEQ ID NO: 1138445 - DNA, 21 bp, Homo sapiens
acagacacctccccctaccca

SEQ ID NO: 1138446 - DNA, 22 bp, Homo sapiens
acagacacctccccctacccat

SEQ ID NO: 1138447 - DNA, 23 bp, Homo sapiens
acagacacctccccctacccata

SEQ ID NO: 1138448 - DNA, 14 bp, Homo sapiens
acagacactaactt

SEQ ID NO: 1138449 - DNA, 20 bp, Homo sapiens
acagacactacatatctaaa

SEQ ID NO: 1138450 - DNA, 14 bp, Homo sapiens
acagacactggcat

SEQ ID NO: 1138451 - DNA, 13 bp, Homo sapiens
acagacatacata

SEQ ID NO: 1138452 - DNA, 18 bp, Homo sapiens
acagacatactaaccagc

SEQ ID NO: 1138453 - DNA, 17 bp, Homo sapiens
acagaccaatagacatt

SEQ ID NO: 1138454 - DNA, 13 bp, Homo sapiens
acagacccaggac

SEQ ID NO: 1138455 - DNA, 21 bp, Homo sapiens
acagacccctcccctcgtgtc

SEQ ID NO: 1138456 - DNA, 19 bp, Homo sapiens
acagaccgaactgttgtat

SEQ ID NO: 1138457 - DNA, 14 bp, Homo sapiens
acagacctgcagtg

SEQ ID NO: 1138458 - DNA, 22 bp, Homo sapiens
acagacctgcagtgaggggccc

SEQ ID NO: 1138459 - DNA, 16 bp, Homo sapiens
acagacctgctctgga

SEQ ID NO: 1138460 - DNA, 19 bp, Homo sapiens
acagacctggagcccctgg

SEQ ID NO: 1138461 - DNA, 18 bp, Homo sapiens
acagacgctgctgtcaca

SEQ ID NO: 1138462 - DNA, 16 bp, Homo sapiens
acagacggaaatgaaa

SEQ ID NO: 1138463 - DNA, 14 bp, Homo sapiens
acagactattttta

SEQ ID NO: 1138464 - DNA, 15 bp, Homo sapiens
acagactcactggga

SEQ ID NO: 1138465 - DNA, 17 bp, Homo sapiens
acagactcctgaggaca

SEQ ID NO: 1138466 - DNA, 13 bp, Homo sapiens
acagactgcccca

SEQ ID NO: 1138467 - DNA, 19 bp, Homo sapiens
acagactgccccagccaac

SEQ ID NO: 1138468 - DNA, 15 bp, Homo sapiens
acagactggcaataa

SEQ ID NO: 1138469 - DNA, 16 bp, Homo sapiens
acagactggcaataaa

SEQ ID NO: 1138470 - DNA, 17 bp, Homo sapiens
acagactggcaataaac

SEQ ID NO: 1138471 - DNA, 19 bp, Homo sapiens
acagactggcaataaactc

SEQ ID NO: 1138472 - DNA, 12 bp, Homo sapiens
acagactgtttt

SEQ ID NO: 1138473 - DNA, 18 bp, Homo sapiens
acagactgttttactgtt

SEQ ID NO: 1138474 - DNA, 15 bp, Homo sapiens
acagacttctccaga

SEQ ID NO: 1138475 - DNA, 16 bp, Homo sapiens
acagacttctccagac

SEQ ID NO: 1138476 - DNA, 19 bp, Homo sapiens
acagacttctggaaggctg

SEQ ID NO: 1138477 - DNA, 16 bp, Homo sapiens
acagacttgagaactt

SEQ ID NO: 1138478 - DNA, 21 bp, Homo sapiens
acagactttctgtgacgcaga

SEQ ID NO: 1138479 - DNA, 16 bp, Homo sapiens
acagactttggacagt

SEQ ID NO: 1138480 - DNA, 21 bp, Homo sapiens
acagactttggacagtggcct

SEQ ID NO: 1138481 - DNA, 10 bp, Homo sapiens
acagagaaag

SEQ ID NO: 1138482 - DNA, 13 bp, Homo sapiens
acagagaaagaaa

SEQ ID NO: 1138483 - DNA, 14 bp, Homo sapiens
acagagaaggcagg

SEQ ID NO: 1138484 - DNA, 15 bp, Homo sapiens
acagagaaggcagga

SEQ ID NO: 1138485 - DNA, 19 bp, Homo sapiens
acagagaaggcgcttccca

SEQ ID NO: 1138486 - DNA, 20 bp, Homo sapiens
acagagaagtttgtagccag

SEQ ID NO: 1138487 - DNA, 21 bp, Homo sapiens
acagagaagtttgtagccagg

SEQ ID NO: 1138488 - DNA, 22 bp, Homo sapiens
acagagaagtttgtagccaggt

SEQ ID NO: 1138489 - DNA, 23 bp, Homo sapiens
acagagaagtttgtagccaggta

SEQ ID NO: 1138490 - DNA, 14 bp, Homo sapiens
acagagaatttcta

SEQ ID NO: 1138491 - DNA, 15 bp, Homo sapiens
acagagacacctgca

SEQ ID NO: 1138492 - DNA, 21 bp, Homo sapiens
acagagacacctgcacctccc

SEQ ID NO: 1138493 - DNA, 23 bp, Homo sapiens
acagagacaggcccaagagatga

SEQ ID NO: 1138494 - DNA, 16 bp, Homo sapiens
acagagagaggggaga

SEQ ID NO: 1138495 - DNA, 16 bp, Homo sapiens
acagagaggagaaaca

SEQ ID NO: 1138496 - DNA, 20 bp, Homo sapiens
acagagagggacacatgccc

SEQ ID NO: 1138497 - DNA, 21 bp, Homo sapiens
acagagagggacacatgcccc

SEQ ID NO: 1138498 - DNA, 16 bp, Homo sapiens
acagagataccattca

SEQ ID NO: 1138499 - DNA, 19 bp, Homo sapiens
acagagatgcatgcgcagg

SEQ ID NO: 1138500 - DNA, 23 bp, Homo sapiens
acagagatgcatgcgcaggctca

SEQ ID NO: 1138501 - DNA, 17 bp, Homo sapiens
acagagattctggatct

SEQ ID NO: 1138502 - DNA, 20 bp, Homo sapiens
acagagattgaactccaaga

SEQ ID NO: 1138503 - DNA, 12 bp, Homo sapiens
acagagcaagac

SEQ ID NO: 1138504 - DNA, 18 bp, Homo sapiens
acagagcacctgtagctg

SEQ ID NO: 1138505 - DNA, 17 bp, Homo sapiens
acagagcaggggctcca

SEQ ID NO: 1138506 - DNA, 18 bp, Homo sapiens
acagagcaggggctccag

SEQ ID NO: 1138507 - DNA, 14 bp, Homo sapiens
acagagccacccca

SEQ ID NO: 1138508 - DNA, 21 bp, Homo sapiens
acagagccaccccatgagctc

SEQ ID NO: 1138509 - DNA, 21 bp, Homo sapiens
acagagcgagagtctgtctca

SEQ ID NO: 1138510 - DNA, 13 bp, Homo sapiens
acagagctgagga

SEQ ID NO: 1138511 - DNA, 12 bp, Homo sapiens
acagagctgtgg

SEQ ID NO: 1138512 - DNA, 17 bp, Homo sapiens
acagaggaaagggctgg

SEQ ID NO: 1138513 - DNA, 20 bp, Homo sapiens
acagaggaaagggctggctc

SEQ ID NO: 1138514 - DNA, 15 bp, Homo sapiens
acagaggaggcctca

SEQ ID NO: 1138515 - DNA, 16 bp, Homo sapiens
acagaggaggtcagca

SEQ ID NO: 1138516 - DNA, 21 bp, Homo sapiens
acagaggatgccttttctgtg

SEQ ID NO: 1138517 - DNA, 17 bp, Homo sapiens
acagaggctattgtccc

SEQ ID NO: 1138518 - DNA, 16 bp, Homo sapiens
acagaggctggcactg

SEQ ID NO: 1138519 - DNA, 24 bp, Homo sapiens
acagaggctggcactgagcctgct

SEQ ID NO: 1138520 - DNA, 23 bp, Homo sapiens
acagagggaccaaattgcttcta

SEQ ID NO: 1138521 - DNA, 18 bp, Homo sapiens
acagagggagacagggct

SEQ ID NO: 1138522 - DNA, 12 bp, Homo sapiens
acagagggctgc

SEQ ID NO: 1138523 - DNA, 16 bp, Homo sapiens
acagagggctgcattc

SEQ ID NO: 1138524 - DNA, 15 bp, Homo sapiens
acagaggggactctg

SEQ ID NO: 1138525 - DNA, 19 bp, Homo sapiens
acagagggtcccattgtgc

SEQ ID NO: 1138526 - DNA, 23 bp, Homo sapiens
acagagggtcccattgtgcagaa

SEQ ID NO: 1138527 - DNA, 23 bp, Homo sapiens
acagagtacttggctgttagccc

SEQ ID NO: 1138528 - DNA, 19 bp, Homo sapiens
acagagtccaatttaagga

SEQ ID NO: 1138529 - DNA, 13 bp, Homo sapiens
acagagtctgggt

SEQ ID NO: 1138530 - DNA, 14 bp, Homo sapiens
acagagtgaaaaat

SEQ ID NO: 1138531 - DNA, 17 bp, Homo sapiens
acagagtgaaaaatctt

SEQ ID NO: 1138532 - DNA, 15 bp, Homo sapiens
acagagtgctggact

SEQ ID NO: 1138533 - DNA, 17 bp, Homo sapiens
acagagtgctggactgt

SEQ ID NO: 1138534 - DNA, 16 bp, Homo sapiens
acagagtgcttttctg

SEQ ID NO: 1138535 - DNA, 19 bp, Homo sapiens
acagagtggtctttctgga

SEQ ID NO: 1138536 - DNA, 21 bp, Homo sapiens
acagagtggtctttctggaga

SEQ ID NO: 1138537 - DNA, 16 bp, Homo sapiens
acagagtggtttccaa

SEQ ID NO: 1138538 - DNA, 18 bp, Homo sapiens
acagagtgtgctgctatt

SEQ ID NO: 1138539 - DNA, 17 bp, Homo sapiens
acagagttgttacattt

SEQ ID NO: 1138540 - DNA, 19 bp, Homo sapiens
acagagttgttacattttt

SEQ ID NO: 1138541 - DNA, 20 bp, Homo sapiens
acagagttgttacattttta

SEQ ID NO: 1138542 - DNA, 22 bp, Homo sapiens
acagagttgttacatttttaag

SEQ ID NO: 1138543 - DNA, 14 bp, Homo sapiens
acagataactgaaa

SEQ ID NO: 1138544 - DNA, 18 bp, Homo sapiens
acagataactgaaaatta

SEQ ID NO: 1138545 - DNA, 13 bp, Homo sapiens
acagataagcaag

SEQ ID NO: 1138546 - DNA, 14 bp, Homo sapiens
acagataattcatt

SEQ ID NO: 1138547 - DNA, 13 bp, Homo sapiens
acagatacatttc

SEQ ID NO: 1138548 - DNA, 13 bp, Homo sapiens
acagatacctcca

SEQ ID NO: 1138549 - DNA, 22 bp, Homo sapiens
acagatacctccaaccctgccg

SEQ ID NO: 1138550 - DNA, 17 bp, Homo sapiens
acagatagacagtgctg

SEQ ID NO: 1138551 - DNA, 20 bp, Homo sapiens
acagatagatatatgctctg

SEQ ID NO: 1138552 - DNA, 14 bp, Homo sapiens
acagatataaatgg

SEQ ID NO: 1138553 - DNA, 17 bp, Homo sapiens
acagatataaatggctg

SEQ ID NO: 1138554 - DNA, 23 bp, Homo sapiens
acagatatgggtgtttttaataa

SEQ ID NO: 1138555 - DNA, 22 bp, Homo sapiens
acagatatttagctctgtggaa

SEQ ID NO: 1138556 - DNA, 14 bp, Homo sapiens
acagatcaagctgt

SEQ ID NO: 1138557 - DNA, 16 bp, Homo sapiens
acagatcaagctgtga

SEQ ID NO: 1138558 - DNA, 18 bp, Homo sapiens
acagatcaagctgtgaga

SEQ ID NO: 1138559 - DNA, 16 bp, Homo sapiens
acagatcactcctgga

SEQ ID NO: 1138560 - DNA, 12 bp, Homo sapiens
acagatcagtaa

SEQ ID NO: 1138561 - DNA, 19 bp, Homo sapiens
acagatcataggaagtggc

SEQ ID NO: 1138562 - DNA, 20 bp, Homo sapiens
acagatcataggaagtggct

SEQ ID NO: 1138563 - DNA, 18 bp, Homo sapiens
acagatccccaagcctgg

SEQ ID NO: 1138564 - DNA, 16 bp, Homo sapiens
acagatctttactctt

SEQ ID NO: 1138565 - DNA, 14 bp, Homo sapiens
acagatgaatgtat

SEQ ID NO: 1138566 - DNA, 22 bp, Homo sapiens
acagatgataaatatttatgct

SEQ ID NO: 1138567 - DNA, 23 bp, Homo sapiens
acagatgatagtccaatttttac

SEQ ID NO: 1138568 - DNA, 16 bp, Homo sapiens
acagatgatgaagaaa

SEQ ID NO: 1138569 - DNA, 18 bp, Homo sapiens
acagatgatgaagaaatg

SEQ ID NO: 1138570 - DNA, 16 bp, Homo sapiens
acagatgcaatgtgct

SEQ ID NO: 1138571 - DNA, 18 bp, Homo sapiens
acagatgccaacttccca

SEQ ID NO: 1138572 - DNA, 14 bp, Homo sapiens
acagatgccccaga

SEQ ID NO: 1138573 - DNA, 17 bp, Homo sapiens
acagatgccccagagct

SEQ ID NO: 1138574 - DNA, 19 bp, Homo sapiens
acagatgccccagagctgt

SEQ ID NO: 1138575 - DNA, 21 bp, Homo sapiens
acagatgccccagagctgttt

SEQ ID NO: 1138576 - DNA, 22 bp, Homo sapiens
acagatgccccagagctgttta

SEQ ID NO: 1138577 - DNA, 18 bp, Homo sapiens
acagatgccttttttgta

SEQ ID NO: 1138578 - DNA, 12 bp, Homo sapiens
acagatgctcca

SEQ ID NO: 1138579 - DNA, 22 bp, Homo sapiens
acagatggacactgccaagagc

SEQ ID NO: 1138580 - DNA, 22 bp, Homo sapiens
acagatggacgcaggccctgtc

SEQ ID NO: 1138581 - DNA, 17 bp, Homo sapiens
acagatggatttgcctg

SEQ ID NO: 1138582 - DNA, 22 bp, Homo sapiens
acagatggcactttgaaggggc

SEQ ID NO: 1138583 - DNA, 16 bp, Homo sapiens
acagatgggcaaatta

SEQ ID NO: 1138584 - DNA, 18 bp, Homo sapiens
acagatggggtctgtgac

SEQ ID NO: 1138585 - DNA, 20 bp, Homo sapiens
acagatggggtctgtgactg

SEQ ID NO: 1138586 - DNA, 23 bp, Homo sapiens
acagatggggtctgtgactggat

SEQ ID NO: 1138587 - DNA, 19 bp, Homo sapiens
acagatgggtattaaactt

SEQ ID NO: 1138588 - DNA, 21 bp, Homo sapiens
acagatgtaattatgttttca

SEQ ID NO: 1138589 - DNA, 15 bp, Homo sapiens
acagatgtctctggg

SEQ ID NO: 1138590 - DNA, 20 bp, Homo sapiens
acagatgtgtctgggagagc

SEQ ID NO: 1138591 - DNA, 23 bp, Homo sapiens
acagatgtttcttttgtatgtaa

SEQ ID NO: 1138592 - DNA, 23 bp, Homo sapiens
acagatgtttttaattctagtat

SEQ ID NO: 1138593 - DNA, 23 bp, Homo sapiens
acagattaacctgaaagaacata

SEQ ID NO: 1138594 - DNA, 19 bp, Homo sapiens
acagattcaggccagccca

SEQ ID NO: 1138595 - DNA, 20 bp, Homo sapiens
acagattcaggccagcccag

SEQ ID NO: 1138596 - DNA, 23 bp, Homo sapiens
acagattcaggccagcccagcca

SEQ ID NO: 1138597 - DNA, 14 bp, Homo sapiens
acagattctgacat

SEQ ID NO: 1138598 - DNA, 13 bp, Homo sapiens
acagattctgatt

SEQ ID NO: 1138599 - DNA, 20 bp, Homo sapiens
acagattctttttttctgtc

SEQ ID NO: 1138600 - DNA, 18 bp, Homo sapiens
acagattgaaaagaccta

SEQ ID NO: 1138601 - DNA, 16 bp, Homo sapiens
acagattgaagaatct

SEQ ID NO: 1138602 - DNA, 17 bp, Homo sapiens
acagattgaagaatctg

SEQ ID NO: 1138603 - DNA, 15 bp, Homo sapiens
acagattgcctcctt

SEQ ID NO: 1138604 - DNA, 13 bp, Homo sapiens
acagattgctgct

SEQ ID NO: 1138605 - DNA, 15 bp, Homo sapiens
acagatttgagctca

SEQ ID NO: 1138606 - DNA, 14 bp, Homo sapiens
acagatttggaaag

SEQ ID NO: 1138607 - DNA, 23 bp, Homo sapiens
acagattttagacttaccttgaa

SEQ ID NO: 1138608 - DNA, 19 bp, Homo sapiens
acaagggagagacctcatc

SEQ ID NO: 1138609 - DNA, 21 bp, Homo sapiens
acaagggctctcaaagtataa

SEQ ID NO: 1138610 - DNA, 16 bp, Homo sapiens
acaaggggcttttccc

SEQ ID NO: 1138611 - DNA, 18 bp, Homo sapiens
acaagggtggcatcccag

SEQ ID NO: 1138612 - DNA, 16 bp, Homo sapiens
acaaggtagtttttac

SEQ ID NO: 1138613 - DNA, 20 bp, Homo sapiens
acaaggtcaggagttcgaga

SEQ ID NO: 1138614 - DNA, 21 bp, Homo sapiens
acaaggtccactccctgctcc

SEQ ID NO: 1138615 - DNA, 22 bp, Homo sapiens
acaaggtccactccctgctcca

SEQ ID NO: 1138616 - DNA, 23 bp, Homo sapiens
acaaggtgagtgtgacttccctt

SEQ ID NO: 1138617 - DNA, 13 bp, Homo sapiens
acaagtaagaaaa

SEQ ID NO: 1138618 - DNA, 14 bp, Homo sapiens
acaagtaatattat

SEQ ID NO: 1138619 - DNA, 14 bp, Homo sapiens
acaagtagttcatg

SEQ ID NO: 1138620 - DNA, 17 bp, Homo sapiens
acaagtagttcatgagt

SEQ ID NO: 1138621 - DNA, 18 bp, Homo sapiens
acaagtagttcatgagta

SEQ ID NO: 1138622 - DNA, 21 bp, Homo sapiens
acaagtatgaataaagacacc

SEQ ID NO: 1138623 - DNA, 22 bp, Homo sapiens
acaagtatgaatattactctca

SEQ ID NO: 1138624 - DNA, 17 bp, Homo sapiens
acaagtatttgttaatt

SEQ ID NO: 1138625 - DNA, 15 bp, Homo sapiens
acaagtatttttaat

SEQ ID NO: 1138626 - DNA, 14 bp, Homo sapiens
acaagtcacagctg

SEQ ID NO: 1138627 - DNA, 18 bp, Homo sapiens
acaagtcacagctgcagc

SEQ ID NO: 1138628 - DNA, 22 bp, Homo sapiens
acaagtcagctccagctttctg

SEQ ID NO: 1138629 - DNA, 21 bp, Homo sapiens
acaagtcattttaactttatc

SEQ ID NO: 1138630 - DNA, 20 bp, Homo sapiens
acaagtcctggatgttgtgt

SEQ ID NO: 1138631 - DNA, 21 bp, Homo sapiens
acaagtcctggatgttgtgtg

SEQ ID NO: 1138632 - DNA, 16 bp, Homo sapiens
acaagtgaagaacact

SEQ ID NO: 1138633 - DNA, 22 bp, Homo sapiens
acaagtgaagaacactactgct

SEQ ID NO: 1138634 - DNA, 22 bp, Homo sapiens
acaagtgaatctttctcctggt

SEQ ID NO: 1138635 - DNA, 18 bp, Homo sapiens
acaagtgaccccagggcc

SEQ ID NO: 1138636 - DNA, 18 bp, Homo sapiens
acaagtgactgtatctgt

SEQ ID NO: 1138637 - DNA, 18 bp, Homo sapiens
acaagtggactcagggca

SEQ ID NO: 1138638 - DNA, 19 bp, Homo sapiens
acaagtggactcagggcag

SEQ ID NO: 1138639 - DNA, 16 bp, Homo sapiens
acaagtggctccccac

SEQ ID NO: 1138640 - DNA, 21 bp, Homo sapiens
acaagtggctccccacctgga

SEQ ID NO: 1138641 - DNA, 18 bp, Homo sapiens
acaagtgtatatcagaaa

SEQ ID NO: 1138642 - DNA, 15 bp, Homo sapiens
acaagttattctctt

SEQ ID NO: 1138643 - DNA, 16 bp, Homo sapiens
acaagttatttaaatc

SEQ ID NO: 1138644 - DNA, 16 bp, Homo sapiens
acaagttctggcaaga

SEQ ID NO: 1138645 - DNA, 17 bp, Homo sapiens
acaagttgcgacggaga

SEQ ID NO: 1138646 - DNA, 14 bp, Homo sapiens
acaagttgtgtttg

SEQ ID NO: 1138647 - DNA, 19 bp, Homo sapiens
acaagttgttattgttgaa

SEQ ID NO: 1138648 - DNA, 16 bp, Homo sapiens
acaagtttcagacagg

SEQ ID NO: 1138649 - DNA, 14 bp, Homo sapiens
acaagtttgctaaa

SEQ ID NO: 1138650 - DNA, 22 bp, Homo sapiens
acaagtttgctaaaagaagaga

SEQ ID NO: 1138651 - DNA, 13 bp, Homo sapiens
acaagttttgtat

SEQ ID NO: 1138652 - DNA, 13 bp, Homo sapiens
acaataaaaagaa

SEQ ID NO: 1138653 - DNA, 12 bp, Homo sapiens
acaataaaacat

SEQ ID NO: 1138654 - DNA, 15 bp, Homo sapiens
acaataaaagagctt

SEQ ID NO: 1138655 - DNA, 12 bp, Homo sapiens
acaataaaatat

SEQ ID NO: 1138656 - DNA, 20 bp, Homo sapiens
acaataaacaggaattttat

SEQ ID NO: 1138657 - DNA, 17 bp, Homo sapiens
acaataaaccaaaccca

SEQ ID NO: 1138658 - DNA, 22 bp, Homo sapiens
acaataaaccaaacccagccac

SEQ ID NO: 1138659 - DNA, 19 bp, Homo sapiens
acaataaagggagaatggt

SEQ ID NO: 1138660 - DNA, 15 bp, Homo sapiens
acaataaagtttatt

SEQ ID NO: 1138661 - DNA, 17 bp, Homo sapiens
acaataaagtttattat

SEQ ID NO: 1138662 - DNA, 13 bp, Homo sapiens
acaataaatagac

SEQ ID NO: 1138663 - DNA, 16 bp, Homo sapiens
acaataaatattctgc

SEQ ID NO: 1138664 - DNA, 22 bp, Homo sapiens
acaataaatattctgcatggaa

SEQ ID NO: 1138665 - DNA, 12 bp, Homo sapiens
acaataaatgta

SEQ ID NO: 1138666 - DNA, 19 bp, Homo sapiens
acaataaatgtattcaaat

SEQ ID NO: 1138667 - DNA, 20 bp, Homo sapiens
acaataaatgtattcaaata

SEQ ID NO: 1138668 - DNA, 21 bp, Homo sapiens
acaataacactaaaattttag

SEQ ID NO: 1138669 - DNA, 15 bp, Homo sapiens
acaataacccagtta

SEQ ID NO: 1138670 - DNA, 18 bp, Homo sapiens
acaataacccagttactt

SEQ ID NO: 1138671 - DNA, 21 bp, Homo sapiens
acaataactactgtgttcctg

SEQ ID NO: 1138672 - DNA, 19 bp, Homo sapiens
acaataagacatgcttact

SEQ ID NO: 1138673 - DNA, 15 bp, Homo sapiens
acaataagcaaaaac

SEQ ID NO: 1138674 - DNA, 13 bp, Homo sapiens
acaataatttcag

SEQ ID NO: 1138675 - DNA, 19 bp, Homo sapiens
acaatacaatgtacaatta

SEQ ID NO: 1138676 - DNA, 18 bp, Homo sapiens
acaatacatgagaaagat

SEQ ID NO: 1138677 - DNA, 16 bp, Homo sapiens
acaataccactggtta

SEQ ID NO: 1138678 - DNA, 14 bp, Homo sapiens
acaatacctttttt

SEQ ID NO: 1138679 - DNA, 22 bp, Homo sapiens
acaatagccgatatcagaattt

SEQ ID NO: 1138680 - DNA, 19 bp, Homo sapiens
acaatagctttaccctcag

SEQ ID NO: 1138681 - DNA, 19 bp, Homo sapiens
acaatagggctaaatgttt

SEQ ID NO: 1138682 - DNA, 15 bp, Homo sapiens
acaatagtatagaag

SEQ ID NO: 1138683 - DNA, 23 bp, Homo sapiens
acacgcgggcgcgatcccacaca

SEQ ID NO: 1138684 - DNA, 15 bp, Homo sapiens
acacgctgcctggtc

SEQ ID NO: 1138685 - DNA, 18 bp, Homo sapiens
acacggactgaggtgcct

SEQ ID NO: 1138686 - DNA, 14 bp, Homo sapiens
acacggaggcatct

SEQ ID NO: 1138687 - DNA, 21 bp, Homo sapiens
acacggatctgagaatcttta

SEQ ID NO: 1138688 - DNA, 21 bp, Homo sapiens
acacggatctgctgggctctg

SEQ ID NO: 1138689 - DNA, 20 bp, Homo sapiens
acacggccacatcaaagagg

SEQ ID NO: 1138690 - DNA, 22 bp, Homo sapiens
acacggctgcctgacactgagc

SEQ ID NO: 1138691 - DNA, 20 bp, Homo sapiens
acacggctggtcactctgcc

SEQ ID NO: 1138692 - DNA, 19 bp, Homo sapiens
acacgtacctctcatcagt

SEQ ID NO: 1138693 - DNA, 19 bp, Homo sapiens
acacgtatcccacctgaca

SEQ ID NO: 1138694 - DNA, 23 bp, Homo sapiens
acacgtatttatatttggaaaga

SEQ ID NO: 1138695 - DNA, 15 bp, Homo sapiens
acacgtgaggggggg

SEQ ID NO: 1138696 - DNA, 18 bp, Homo sapiens
acacgtgctgtgggcctc

SEQ ID NO: 1138697 - DNA, 23 bp, Homo sapiens
acacgtgctgtgggcctcaggcg

SEQ ID NO: 1138698 - DNA, 23 bp, Homo sapiens
acacgtgggctcccctcttcctc

SEQ ID NO: 1138699 - DNA, 17 bp, Homo sapiens
acacgttctgatttctg

SEQ ID NO: 1138700 - DNA, 13 bp, Homo sapiens
acacgttgccagg

SEQ ID NO: 1138701 - DNA, 20 bp, Homo sapiens
acactaaaacaagaggacac

SEQ ID NO: 1138702 - DNA, 15 bp, Homo sapiens
acactaaaattttag

SEQ ID NO: 1138703 - DNA, 18 bp, Homo sapiens
acactaaaattttaggca

SEQ ID NO: 1138704 - DNA, 17 bp, Homo sapiens
acactaaaccaagttat

SEQ ID NO: 1138705 - DNA, 20 bp, Homo sapiens
acactaactcaccagcccca

SEQ ID NO: 1138706 - DNA, 17 bp, Homo sapiens
acactaagaaaatagca

SEQ ID NO: 1138707 - DNA, 16 bp, Homo sapiens
acactaccaaacactc

SEQ ID NO: 1138708 - DNA, 18 bp, Homo sapiens
acactaccaaacactcag

SEQ ID NO: 1138709 - DNA, 23 bp, Homo sapiens
acactaccgaatgtgtctttaga

SEQ ID NO: 1138710 - DNA, 19 bp, Homo sapiens
acactactgctaaatcctc

SEQ ID NO: 1138711 - DNA, 12 bp, Homo sapiens
acactagacaaa

SEQ ID NO: 1138712 - DNA, 16 bp, Homo sapiens
acactagaggccaggg

SEQ ID NO: 1138713 - DNA, 12 bp, Homo sapiens
acactagtctgt

SEQ ID NO: 1138714 - DNA, 23 bp, Homo sapiens
acactagtctgtgtaactttaaa

SEQ ID NO: 1138715 - DNA, 16 bp, Homo sapiens
acactatataaataag

SEQ ID NO: 1138716 - DNA, 18 bp, Homo sapiens
acactatgataaagttgt

SEQ ID NO: 1138717 - DNA, 18 bp, Homo sapiens
acactatggtatttgagt

SEQ ID NO: 1138718 - DNA, 22 bp, Homo sapiens
acactatggtatttgagtgttt

SEQ ID NO: 1138719 - DNA, 16 bp, Homo sapiens
acactattcactaaaa

SEQ ID NO: 1138720 - DNA, 22 bp, Homo sapiens
acactcaaggacaggagcctgg

SEQ ID NO: 1138721 - DNA, 14 bp, Homo sapiens
acactcagacctga

SEQ ID NO: 1138722 - DNA, 18 bp, Homo sapiens
acactcagagtaatgtct

SEQ ID NO: 1138723 - DNA, 13 bp, Homo sapiens
acactcagcacaa

SEQ ID NO: 1138724 - DNA, 14 bp, Homo sapiens
acactccacagtgt

SEQ ID NO: 1138725 - DNA, 18 bp, Homo sapiens
acactccaccctccacct

SEQ ID NO: 1138726 - DNA, 22 bp, Homo sapiens
acactccaccctccaccttcca

SEQ ID NO: 1138727 - DNA, 13 bp, Homo sapiens
acactccactctg

SEQ ID NO: 1138728 - DNA, 12 bp, Homo sapiens
acactccagcct

SEQ ID NO: 1138729 - DNA, 16 bp, Homo sapiens
acactccagcctgagc

SEQ ID NO: 1138730 - DNA, 14 bp, Homo sapiens
acactccagggaca

SEQ ID NO: 1138731 - DNA, 20 bp, Homo sapiens
acactccagggacacacagc

SEQ ID NO: 1138732 - DNA, 13 bp, Homo sapiens
acactccagtgcc

SEQ ID NO: 1138733 - DNA, 14 bp, Homo sapiens
acactccagtgcca

SEQ ID NO: 1138734 - DNA, 16 bp, Homo sapiens
acactccatgagtgtc

SEQ ID NO: 1138735 - DNA, 15 bp, Homo sapiens
acactccccgaagtc

SEQ ID NO: 1138736 - DNA, 14 bp, Homo sapiens
aacattcccagccc

SEQ ID NO: 1138737 - DNA, 23 bp, Homo sapiens
aacattcccctccccactcctct

SEQ ID NO: 1138738 - DNA, 22 bp, Homo sapiens
aacattcccgaggtcagccagg

SEQ ID NO: 1138739 - DNA, 21 bp, Homo sapiens
aacattcgatctcattcagta

SEQ ID NO: 1138740 - DNA, 11 bp, Homo sapiens
aacattctgca

SEQ ID NO: 1138741 - DNA, 19 bp, Homo sapiens
aacattctggatctgaccc

SEQ ID NO: 1138742 - DNA, 21 bp, Homo sapiens
aacattcttttaacttctttc

SEQ ID NO: 1138743 - DNA, 19 bp, Homo sapiens
aacattctttttctgttga

SEQ ID NO: 1138744 - DNA, 18 bp, Homo sapiens
aacattgaagtaatgaat

SEQ ID NO: 1138745 - DNA, 19 bp, Homo sapiens
aacattgaagtaatgaatt

SEQ ID NO: 1138746 - DNA, 19 bp, Homo sapiens
aacattgaccaagaactgc

SEQ ID NO: 1138747 - DNA, 20 bp, Homo sapiens
aacattgaccaagaactgca

SEQ ID NO: 1138748 - DNA, 23 bp, Homo sapiens
aacattgaccaagaactgcatgg

SEQ ID NO: 1138749 - DNA, 21 bp, Homo sapiens
aacattgcatataacttatat

SEQ ID NO: 1138750 - DNA, 15 bp, Homo sapiens
aacattggaatgttc

SEQ ID NO: 1138751 - DNA, 15 bp, Homo sapiens
aacattgtgatgtat

SEQ ID NO: 1138752 - DNA, 23 bp, Homo sapiens
aacattgtgttcccatttcagct

SEQ ID NO: 1138753 - DNA, 16 bp, Homo sapiens
aacatttaaacttttt

SEQ ID NO: 1138754 - DNA, 21 bp, Homo sapiens
aacatttaaagagatttccct

SEQ ID NO: 1138755 - DNA, 13 bp, Homo sapiens
aacatttaaattc

SEQ ID NO: 1138756 - DNA, 13 bp, Homo sapiens
aacatttaacata

SEQ ID NO: 1138757 - DNA, 16 bp, Homo sapiens
aacatttaacataatg

SEQ ID NO: 1138758 - DNA, 19 bp, Homo sapiens
aacatttacaataaatatt

SEQ ID NO: 1138759 - DNA, 15 bp, Homo sapiens
aacatttattttgac

SEQ ID NO: 1138760 - DNA, 17 bp, Homo sapiens
aacatttattttgacat

SEQ ID NO: 1138761 - DNA, 18 bp, Homo sapiens
aacatttcaaattgaatt

SEQ ID NO: 1138762 - DNA, 19 bp, Homo sapiens
aacatttcaaattgaattt

SEQ ID NO: 1138763 - DNA, 14 bp, Homo sapiens
aacatttcataatt

SEQ ID NO: 1138764 - DNA, 12 bp, Homo sapiens
aacatttctgta

SEQ ID NO: 1138765 - DNA, 13 bp, Homo sapiens
aacatttctgtat

SEQ ID NO: 1138766 - DNA, 15 bp, Homo sapiens
aacatttctgtatac

SEQ ID NO: 1138767 - DNA, 23 bp, Homo sapiens
aacatttctgtatactgtaaaag

SEQ ID NO: 1138768 - DNA, 24 bp, Homo sapiens
aacatttctgtatactgtaaaagt

SEQ ID NO: 1138769 - DNA, 10 bp, Homo sapiens
aacatttctt

SEQ ID NO: 1138770 - DNA, 20 bp, Homo sapiens
aacatttcttatgattttta

SEQ ID NO: 1138771 - DNA, 22 bp, Homo sapiens
aacatttgatatttttccattt

SEQ ID NO: 1138772 - DNA, 13 bp, Homo sapiens
aacatttgccttg

SEQ ID NO: 1138773 - DNA, 14 bp, Homo sapiens
aacatttgctgttt

SEQ ID NO: 1138774 - DNA, 15 bp, Homo sapiens
aacatttgctgtttt

SEQ ID NO: 1138775 - DNA, 11 bp, Homo sapiens
aacatttgttc

SEQ ID NO: 1138776 - DNA, 13 bp, Homo sapiens
aacatttgttcct

SEQ ID NO: 1138777 - DNA, 14 bp, Homo sapiens
aacatttgttcctg

SEQ ID NO: 1138778 - DNA, 16 bp, Homo sapiens
aacatttgtttccccc

SEQ ID NO: 1138779 - DNA, 17 bp, Homo sapiens
aacatttgtttccccca

SEQ ID NO: 1138780 - DNA, 22 bp, Homo sapiens
aacattttaaaaacatagaaaa

SEQ ID NO: 1138781 - DNA, 20 bp, Homo sapiens
aacattttaaataaaagaaa

SEQ ID NO: 1138782 - DNA, 16 bp, Homo sapiens
aggtgaaggaatatat

SEQ ID NO: 1138783 - DNA, 23 bp, Homo sapiens
aggtgaaggaatatatggcagag

SEQ ID NO: 1138784 - DNA, 22 bp, Homo sapiens
aggtgaaggctctcacccccat

SEQ ID NO: 1138785 - DNA, 18 bp, Homo sapiens
aggtgaagggatggggga

SEQ ID NO: 1138786 - DNA, 21 bp, Homo sapiens
aggtgaagtcgagcactctaa

SEQ ID NO: 1138787 - DNA, 17 bp, Homo sapiens
aggtgaatactcttgaa

SEQ ID NO: 1138788 - DNA, 18 bp, Homo sapiens
aggtgacaaaccatttcc

SEQ ID NO: 1138789 - DNA, 20 bp, Homo sapiens
aggtgacaaaccatttccaa

SEQ ID NO: 1138790 - DNA, 16 bp, Homo sapiens
aggtgaccttctggga

SEQ ID NO: 1138791 - DNA, 13 bp, Homo sapiens
aggtgagaaaaaa

SEQ ID NO: 1138792 - DNA, 16 bp, Homo sapiens
aggtgagaactcagaa

SEQ ID NO: 1138793 - DNA, 16 bp, Homo sapiens
aggtgagaagcagagg

SEQ ID NO: 1138794 - DNA, 19 bp, Homo sapiens
aggtgagatcacagcctcc

SEQ ID NO: 1138795 - DNA, 20 bp, Homo sapiens
aggtgagatcacagcctcca

SEQ ID NO: 1138796 - DNA, 14 bp, Homo sapiens
aggtgagcctgggc

SEQ ID NO: 1138797 - DNA, 16 bp, Homo sapiens
aggtgagcctgggcag

SEQ ID NO: 1138798 - DNA, 18 bp, Homo sapiens
aggtgagcctgggcagct

SEQ ID NO: 1138799 - DNA, 22 bp, Homo sapiens
aggtgaggcccaagagccctgt

SEQ ID NO: 1138800 - DNA, 21 bp, Homo sapiens
aggtgaggcgttctcctgctt

SEQ ID NO: 1138801 - DNA, 13 bp, Homo sapiens
aggtgagggatgt

SEQ ID NO: 1138802 - DNA, 22 bp, Homo sapiens
aggtgagtttgagctgccttcc

SEQ ID NO: 1138803 - DNA, 12 bp, Homo sapiens
aggtgataaaga

SEQ ID NO: 1138804 - DNA, 19 bp, Homo sapiens
aggtgatatataatttcct

SEQ ID NO: 1138805 - DNA, 21 bp, Homo sapiens
aggtgatatataatttcctca

SEQ ID NO: 1138806 - DNA, 23 bp, Homo sapiens
aggtgatcaaaataaaggcgcta

SEQ ID NO: 1138807 - DNA, 21 bp, Homo sapiens
aggtgatgccattacagaacc

SEQ ID NO: 1138808 - DNA, 16 bp, Homo sapiens
aggtgatgctctggct

SEQ ID NO: 1138809 - DNA, 18 bp, Homo sapiens
aggtgatgctctggcttg

SEQ ID NO: 1138810 - DNA, 15 bp, Homo sapiens
aggtgattctcaggg

SEQ ID NO: 1138811 - DNA, 18 bp, Homo sapiens
aggtgattctcagggctg

SEQ ID NO: 1138812 - DNA, 21 bp, Homo sapiens
aggtgcaacagacttgaatgc

SEQ ID NO: 1138813 - DNA, 21 bp, Homo sapiens
aggtgcaaggagtgtaaaatg

SEQ ID NO: 1138814 - DNA, 15 bp, Homo sapiens
aggtgcaattatttc

SEQ ID NO: 1138815 - DNA, 16 bp, Homo sapiens
aggtgcagttccccca

SEQ ID NO: 1138816 - DNA, 12 bp, Homo sapiens
aggtgccactcc

SEQ ID NO: 1138817 - DNA, 20 bp, Homo sapiens
aggtgccactccctgagctt

SEQ ID NO: 1138818 - DNA, 16 bp, Homo sapiens
aggtgccagaaggaag

SEQ ID NO: 1138819 - DNA, 17 bp, Homo sapiens
aggtgccagaaggaagg

SEQ ID NO: 1138820 - DNA, 14 bp, Homo sapiens
aggtgccagcaact

SEQ ID NO: 1138821 - DNA, 15 bp, Homo sapiens
aggtgccagcaactg

SEQ ID NO: 1138822 - DNA, 18 bp, Homo sapiens
aggtgccagcaactgaat

SEQ ID NO: 1138823 - DNA, 21 bp, Homo sapiens
aggtgccagcaactgaataaa

SEQ ID NO: 1138824 - DNA, 17 bp, Homo sapiens
aggtgccatctcaggag

SEQ ID NO: 1138825 - DNA, 21 bp, Homo sapiens
aggtgcccagaataagttatt

SEQ ID NO: 1138826 - DNA, 19 bp, Homo sapiens
aggtgccggggaggggcag

SEQ ID NO: 1138827 - DNA, 21 bp, Homo sapiens
aggtgccggggaggggcagag

SEQ ID NO: 1138828 - DNA, 22 bp, Homo sapiens
aggtgcctcagttttccttctg

SEQ ID NO: 1138829 - DNA, 11 bp, Homo sapiens
aggtgcctcat

SEQ ID NO: 1138830 - DNA, 21 bp, Homo sapiens
aggtgcctcatagcatagcca

SEQ ID NO: 1138831 - DNA, 11 bp, Homo sapiens
aggtgcctcca

SEQ ID NO: 1138832 - DNA, 16 bp, Homo sapiens
aggtgcctccaggtgt

SEQ ID NO: 1138833 - DNA, 18 bp, Homo sapiens
aggtgcctccaggtgtgc

SEQ ID NO: 1138834 - DNA, 16 bp, Homo sapiens
aggtgcctgctcaggt

SEQ ID NO: 1138835 - DNA, 17 bp, Homo sapiens
aggtgcctgtcccaccc

SEQ ID NO: 1138836 - DNA, 19 bp, Homo sapiens
aggtgcgtgttcagcagaa

SEQ ID NO: 1138837 - DNA, 20 bp, Homo sapiens
aggtgcgtgttcagcagaac

SEQ ID NO: 1138838 - DNA, 23 bp, Homo sapiens
aggtgctaatttgttttggatat

SEQ ID NO: 1138839 - DNA, 20 bp, Homo sapiens
aggtgctatgtcccaagagc

SEQ ID NO: 1138840 - DNA, 18 bp, Homo sapiens
aggtgctctctttctgtc

SEQ ID NO: 1138841 - DNA, 20 bp, Homo sapiens
aggtgctgagcttagccttg

SEQ ID NO: 1138842 - DNA, 13 bp, Homo sapiens
aggtgctgctcta

SEQ ID NO: 1138843 - DNA, 12 bp, Homo sapiens
aggtgctggggg

SEQ ID NO: 1138844 - DNA, 23 bp, Homo sapiens
aggtggaaattttatatgtaaat

SEQ ID NO: 1138845 - DNA, 15 bp, Homo sapiens
aggtggaagaaggga

SEQ ID NO: 1138846 - DNA, 17 bp, Homo sapiens
aggtggaagaagggaga

SEQ ID NO: 1138847 - DNA, 19 bp, Homo sapiens
aggtggaagaagggagaag

SEQ ID NO: 1138848 - DNA, 22 bp, Homo sapiens
aggtggaagaagggagaagaaa

SEQ ID NO: 1138849 - DNA, 14 bp, Homo sapiens
aggtggaagccctc

SEQ ID NO: 1138850 - DNA, 16 bp, Homo sapiens
aggtggaagccctcct

SEQ ID NO: 1138851 - DNA, 17 bp, Homo sapiens
aggtggaagccctcctt

SEQ ID NO: 1138852 - DNA, 17 bp, Homo sapiens
aggtggaaggcagacag

SEQ ID NO: 1138853 - DNA, 15 bp, Homo sapiens
aggtggaataaacat

SEQ ID NO: 1138854 - DNA, 15 bp, Homo sapiens
aggtggacaaatgtt

SEQ ID NO: 1138855 - DNA, 21 bp, Homo sapiens
aggtggagagggagatgtgtg

SEQ ID NO: 1138856 - DNA, 22 bp, Homo sapiens
aggtggagagggagatgtgtga

SEQ ID NO: 1138857 - DNA, 16 bp, Homo sapiens
aggtggagggaaggat

SEQ ID NO: 1138858 - DNA, 20 bp, Homo sapiens
aggtggaggttgcagtgagc

SEQ ID NO: 1138859 - DNA, 19 bp, Homo sapiens
aggtggaggttgtgcatgt

SEQ ID NO: 1138860 - DNA, 22 bp, Homo sapiens
aggtggatgttatgaacagctg

SEQ ID NO: 1138861 - DNA, 23 bp, Homo sapiens
aggtggatgttatgaacagctgt

SEQ ID NO: 1138862 - DNA, 16 bp, Homo sapiens
aggtggcaatgcttaa

SEQ ID NO: 1138863 - DNA, 21 bp, Homo sapiens
aggtggcaatgcttaaactaa

SEQ ID NO: 1138864 - DNA, 15 bp, Homo sapiens
aggtggcagagtgaa

SEQ ID NO: 1138865 - DNA, 14 bp, Homo sapiens
aggtggcagccctg

SEQ ID NO: 1138866 - DNA, 15 bp, Homo sapiens
aggtggcagccctgt

SEQ ID NO: 1138867 - DNA, 17 bp, Homo sapiens
aggtggcaggaccagga

SEQ ID NO: 1138868 - DNA, 14 bp, Homo sapiens
aaccctcctccttt

SEQ ID NO: 1138869 - DNA, 17 bp, Homo sapiens
aaccctctcctgtctgc

SEQ ID NO: 1138870 - DNA, 15 bp, Homo sapiens
aaccctctcttccct

SEQ ID NO: 1138871 - DNA, 16 bp, Homo sapiens
aaccctctgagttttt

SEQ ID NO: 1138872 - DNA, 18 bp, Homo sapiens
aaccctctgagtttttgt

SEQ ID NO: 1138873 - DNA, 15 bp, Homo sapiens
aaccctcttgccatc

SEQ ID NO: 1138874 - DNA, 21 bp, Homo sapiens
aaccctgattcatactccttt

SEQ ID NO: 1138875 - DNA, 12 bp, Homo sapiens
aaccctgccagt

SEQ ID NO: 1138876 - DNA, 12 bp, Homo sapiens
aaccctgcccct

SEQ ID NO: 1138877 - DNA, 19 bp, Homo sapiens
aaccctgccgtcaccacca

SEQ ID NO: 1138878 - DNA, 20 bp, Homo sapiens
aaccctgctgaacacagtgt

SEQ ID NO: 1138879 - DNA, 22 bp, Homo sapiens
aaccctgctgaacacagtgtct

SEQ ID NO: 1138880 - DNA, 15 bp, Homo sapiens
aaccctggagccatc

SEQ ID NO: 1138881 - DNA, 19 bp, Homo sapiens
aaccctggcacttaagggg

SEQ ID NO: 1138882 - DNA, 16 bp, Homo sapiens
aaccctggcctcactt

SEQ ID NO: 1138883 - DNA, 17 bp, Homo sapiens
aaccctggcctcacttg

SEQ ID NO: 1138884 - DNA, 12 bp, Homo sapiens
aaccctgggacc

SEQ ID NO: 1138885 - DNA, 14 bp, Homo sapiens
aaccctgggaccta

SEQ ID NO: 1138886 - DNA, 17 bp, Homo sapiens
aaccctgggctgtccag

SEQ ID NO: 1138887 - DNA, 20 bp, Homo sapiens
aaccctggggcctgactgct

SEQ ID NO: 1138888 - DNA, 14 bp, Homo sapiens
aaccctgtgctggt

SEQ ID NO: 1138889 - DNA, 21 bp, Homo sapiens
aaccctgtggaagcatggctg

SEQ ID NO: 1138890 - DNA, 23 bp, Homo sapiens
aaccctgtggaagcatggctgtc

SEQ ID NO: 1138891 - DNA, 13 bp, Homo sapiens
aaccctgtttcct

SEQ ID NO: 1138892 - DNA, 15 bp, Homo sapiens
aaccctgttttatac

SEQ ID NO: 1138893 - DNA, 16 bp, Homo sapiens
aaccctgttttatact

SEQ ID NO: 1138894 - DNA, 23 bp, Homo sapiens
aaccctgttttatactgtactta

SEQ ID NO: 1138895 - DNA, 17 bp, Homo sapiens
aacccttcaactcctgg

SEQ ID NO: 1138896 - DNA, 19 bp, Homo sapiens
aacccttcaactcctggct

SEQ ID NO: 1138897 - DNA, 19 bp, Homo sapiens
aacccttcatcttcctgtg

SEQ ID NO: 1138898 - DNA, 11 bp, Homo sapiens
aacccttctcc

SEQ ID NO: 1138899 - DNA, 20 bp, Homo sapiens
aacccttctcctcttgtaaa

SEQ ID NO: 1138900 - DNA, 16 bp, Homo sapiens
aaccctttagtgcttt

SEQ ID NO: 1138901 - DNA, 12 bp, Homo sapiens
aaccctttgtat

SEQ ID NO: 1138902 - DNA, 17 bp, Homo sapiens
aaccctttgtattataa

SEQ ID NO: 1138903 - DNA, 22 bp, Homo sapiens
aacccttttggcccccgagctg

SEQ ID NO: 1138904 - DNA, 23 bp, Homo sapiens
aactaagggggtagaagtagttt

SEQ ID NO: 1138905 - DNA, 16 bp, Homo sapiens
aactaagttttgtgtg

SEQ ID NO: 1138906 - DNA, 14 bp, Homo sapiens
aactaatgaacaaa

SEQ ID NO: 1138907 - DNA, 15 bp, Homo sapiens
aactaatgccttact

SEQ ID NO: 1138908 - DNA, 18 bp, Homo sapiens
aactaatgtttgaacaaa

SEQ ID NO: 1138909 - DNA, 19 bp, Homo sapiens
aactaatttgaatgtggtt

SEQ ID NO: 1138910 - DNA, 19 bp, Homo sapiens
aactaattttgttgaaaat

SEQ ID NO: 1138911 - DNA, 19 bp, Homo sapiens
aactacaaacaaaagcagc

SEQ ID NO: 1138912 - DNA, 16 bp, Homo sapiens
aactacaaagtaaaat

SEQ ID NO: 1138913 - DNA, 14 bp, Homo sapiens
aactacatctgcct

SEQ ID NO: 1138914 - DNA, 15 bp, Homo sapiens
aactacatctgcctc

SEQ ID NO: 1138915 - DNA, 15 bp, Homo sapiens
aactacattttgcaa

SEQ ID NO: 1138916 - DNA, 14 bp, Homo sapiens
aactaccccacaac

SEQ ID NO: 1138917 - DNA, 23 bp, Homo sapiens
aactaccttgctagctagccagc

SEQ ID NO: 1138918 - DNA, 21 bp, Homo sapiens
aactacgtgacctctgcaaga

SEQ ID NO: 1138919 - DNA, 20 bp, Homo sapiens
aactactacctgtaatgaca

SEQ ID NO: 1138920 - DNA, 15 bp, Homo sapiens
aactactctttgatt

SEQ ID NO: 1138921 - DNA, 12 bp, Homo sapiens
aactactgaata

SEQ ID NO: 1138922 - DNA, 16 bp, Homo sapiens
aactactgtacatttt

SEQ ID NO: 1138923 - DNA, 13 bp, Homo sapiens
aactactgtactt

SEQ ID NO: 1138924 - DNA, 14 bp, Homo sapiens
aactactgtacttt

SEQ ID NO: 1138925 - DNA, 15 bp, Homo sapiens
aactactgtgttcct

SEQ ID NO: 1138926 - DNA, 14 bp, Homo sapiens
aactactttactaa

SEQ ID NO: 1138927 - DNA, 17 bp, Homo sapiens
aactactttataactaa

SEQ ID NO: 1138928 - DNA, 22 bp, Homo sapiens
aactactttgaaaacaattcag

SEQ ID NO: 1138929 - DNA, 21 bp, Homo sapiens
aactacttttctaaaatctaa

SEQ ID NO: 1138930 - DNA, 14 bp, Homo sapiens
aactagaattagta

SEQ ID NO: 1138931 - DNA, 20 bp, Homo sapiens
aactagaattagtatgtctg

SEQ ID NO: 1138932 - DNA, 17 bp, Homo sapiens
aactagaatttattcaa

SEQ ID NO: 1138933 - DNA, 20 bp, Homo sapiens
aactagaggtgagaaattta

SEQ ID NO: 1138934 - DNA, 17 bp, Homo sapiens
aactagatttgtccttt

SEQ ID NO: 1138935 - DNA, 23 bp, Homo sapiens
aactagcacagtaaaagtaaaga

SEQ ID NO: 1138936 - DNA, 17 bp, Homo sapiens
aactagcattacattat

SEQ ID NO: 1138937 - DNA, 22 bp, Homo sapiens
aactagccagacaaaatttgag

SEQ ID NO: 1138938 - DNA, 22 bp, Homo sapiens
aactagctgggactacaggtgc

SEQ ID NO: 1138939 - DNA, 15 bp, Homo sapiens
aactaggctgagcaa

SEQ ID NO: 1138940 - DNA, 17 bp, Homo sapiens
aactagggaagataata

SEQ ID NO: 1138941 - DNA, 12 bp, Homo sapiens
aactagggctag

SEQ ID NO: 1138942 - DNA, 14 bp, Homo sapiens
aactaggtatttaa

SEQ ID NO: 1138943 - DNA, 17 bp, Homo sapiens
aactagtaataccaaag

SEQ ID NO: 1138944 - DNA, 16 bp, Homo sapiens
aactagtatcatttta

SEQ ID NO: 1138945 - DNA, 14 bp, Homo sapiens
aactagtgatgtag

SEQ ID NO: 1138946 - DNA, 19 bp, Homo sapiens
aactagttaataagtggta

SEQ ID NO: 1138947 - DNA, 18 bp, Homo sapiens
aactagtttttatagcta

SEQ ID NO: 1138948 - DNA, 20 bp, Homo sapiens
aactagtttttatagctatc

SEQ ID NO: 1138949 - DNA, 23 bp, Homo sapiens
aactataaacttaagggcaagga

SEQ ID NO: 1138950 - DNA, 19 bp, Homo sapiens
aactataaggtgcctcagt

SEQ ID NO: 1138951 - DNA, 20 bp, Homo sapiens
aactatattcatttccactc

SEQ ID NO: 1138952 - DNA, 15 bp, Homo sapiens
aactatcatttttac

SEQ ID NO: 1138953 - DNA, 18 bp, Homo sapiens
aactatcatttttacact

SEQ ID NO: 1138954 - DNA, 17 bp, Homo sapiens
aactatctcacttccag

SEQ ID NO: 1138955 - DNA, 13 bp, Homo sapiens
aactatctgcatt

SEQ ID NO: 1138956 - DNA, 16 bp, Homo sapiens
aactatctgcattatc

SEQ ID NO: 1138957 - DNA, 14 bp, Homo sapiens
aactatgaaaagtg

SEQ ID NO: 1138958 - DNA, 16 bp, Homo sapiens
aactatgattattaac

SEQ ID NO: 1138959 - DNA, 16 bp, Homo sapiens
aactatgcatctgaga

SEQ ID NO: 1138960 - DNA, 20 bp, Homo sapiens
aactatgtgctatcacatgt

SEQ ID NO: 1138961 - DNA, 12 bp, Homo sapiens
aactatgtgttc

SEQ ID NO: 1138962 - DNA, 19 bp, Homo sapiens
aactatgtgtttttctcat

SEQ ID NO: 1138963 - DNA, 17 bp, Homo sapiens
aactatgttcctaacaa

SEQ ID NO: 1138964 - DNA, 14 bp, Homo sapiens
aactattaaccttt

SEQ ID NO: 1138965 - DNA, 21 bp, Homo sapiens
aactattaaccttttttgtct

SEQ ID NO: 1138966 - DNA, 15 bp, Homo sapiens
aactattgagccttg

SEQ ID NO: 1138967 - DNA, 21 bp, Homo sapiens
aactattgcatttatatgtac

SEQ ID NO: 1138968 - DNA, 19 bp, Homo sapiens
aactattgcctctggacgt

SEQ ID NO: 1138969 - DNA, 20 bp, Homo sapiens
aactattgggtgaatatggt

SEQ ID NO: 1138970 - DNA, 21 bp, Homo sapiens
aactattgtgctcagagacac

SEQ ID NO: 1138971 - DNA, 17 bp, Homo sapiens
aactatttaaaattggc

SEQ ID NO: 1138972 - DNA, 20 bp, Homo sapiens
aactatttaaaattggcacc

SEQ ID NO: 1138973 - DNA, 20 bp, Homo sapiens
aactatttatctgtgttttt

SEQ ID NO: 1138974 - DNA, 14 bp, Homo sapiens
aactatttcttcag

SEQ ID NO: 1138975 - DNA, 16 bp, Homo sapiens
aactattttatgttca

SEQ ID NO: 1138976 - DNA, 18 bp, Homo sapiens
aactattttcaaagactt

SEQ ID NO: 1138977 - DNA, 15 bp, Homo sapiens
aactattttgtttta

SEQ ID NO: 1138978 - DNA, 17 bp, Homo sapiens
aactcaaaacacccaaa

SEQ ID NO: 1138979 - DNA, 20 bp, Homo sapiens
aactcaaagatgatggaaac

SEQ ID NO: 1138980 - DNA, 13 bp, Homo sapiens
aactcaagacaat

SEQ ID NO: 1138981 - DNA, 20 bp, Homo sapiens
aactcaagatggattaaaga

SEQ ID NO: 1138982 - DNA, 21 bp, Homo sapiens
aactcaatgctttatttgtaa

SEQ ID NO: 1138983 - DNA, 20 bp, Homo sapiens
aactcaccagccccactgcc

SEQ ID NO: 1138984 - DNA, 16 bp, Homo sapiens
aactcacccctcagca

SEQ ID NO: 1138985 - DNA, 12 bp, Homo sapiens
aactcacctgct

SEQ ID NO: 1138986 - DNA, 20 bp, Homo sapiens
aactcacctgctggcccctc

SEQ ID NO: 1138987 - DNA, 21 bp, Homo sapiens
aactcacctgctggcccctca

SEQ ID NO: 1138988 - DNA, 22 bp, Homo sapiens
aactcactaacagggagaagta

SEQ ID NO: 1138989 - DNA, 17 bp, Homo sapiens
aactcactccttttaaa

SEQ ID NO: 1138990 - DNA, 23 bp, Homo sapiens
aactcactgcctaggaggctggc

SEQ ID NO: 1138991 - DNA, 14 bp, Homo sapiens
aactcactgctcaa

SEQ ID NO: 1138992 - DNA, 16 bp, Homo sapiens
aactcagaatataaca

SEQ ID NO: 1138993 - DNA, 21 bp, Homo sapiens
aactcagaattatttttaaaa

SEQ ID NO: 1138994 - DNA, 16 bp, Homo sapiens
aactcagacattccaa

SEQ ID NO: 1138995 - DNA, 23 bp, Homo sapiens
aactcagagaaaaatgctcccca

SEQ ID NO: 1138996 - DNA, 18 bp, Homo sapiens
aactcaggcaaagaaaat

SEQ ID NO: 1138997 - DNA, 13 bp, Homo sapiens
aactcagggacag

SEQ ID NO: 1138998 - DNA, 17 bp, Homo sapiens
aactcatcattttctac

SEQ ID NO: 1138999 - DNA, 17 bp, Homo sapiens
aactcatctgttatcct

SEQ ID NO: 1139000 - DNA, 15 bp, Homo sapiens
aactcatgatcaaga

SEQ ID NO: 1139001 - DNA, 23 bp, Homo sapiens
aactcattagactggaacttgaa

SEQ ID NO: 1139002 - DNA, 15 bp, Homo sapiens
aactcattcatagga

SEQ ID NO: 1139003 - DNA, 19 bp, Homo sapiens
agtaagagctggtgtctga

SEQ ID NO: 1139004 - DNA, 14 bp, Homo sapiens
agtaagaggtgtta

SEQ ID NO: 1139005 - DNA, 21 bp, Homo sapiens
agtaagcagtgttacttgcag

SEQ ID NO: 1139006 - DNA, 20 bp, Homo sapiens
agtaagccgtgattttcatt

SEQ ID NO: 1139007 - DNA, 20 bp, Homo sapiens
agtaagctgctctattgtag

SEQ ID NO: 1139008 - DNA, 14 bp, Homo sapiens
agtaaggtgcagtt

SEQ ID NO: 1139009 - DNA, 17 bp, Homo sapiens
agtaagtaccactcagg

SEQ ID NO: 1139010 - DNA, 23 bp, Homo sapiens
agtaagtcttttttttttccaaa

SEQ ID NO: 1139011 - DNA, 14 bp, Homo sapiens
agtaagtgtacaat

SEQ ID NO: 1139012 - DNA, 11 bp, Homo sapiens
agtaagtgtgt

SEQ ID NO: 1139013 - DNA, 17 bp, Homo sapiens
agtaagtgtgtcttcct

SEQ ID NO: 1139014 - DNA, 23 bp, Homo sapiens
agtaagtgtgtcttcctagaatt

SEQ ID NO: 1139015 - DNA, 16 bp, Homo sapiens
agtaagttaataatgt

SEQ ID NO: 1139016 - DNA, 15 bp, Homo sapiens
agtaagtttcttcct

SEQ ID NO: 1139017 - DNA, 19 bp, Homo sapiens
agtaagtttttttagaaga

SEQ ID NO: 1139018 - DNA, 15 bp, Homo sapiens
agtaataaaattcaa

SEQ ID NO: 1139019 - DNA, 23 bp, Homo sapiens
agtaataaaattcaacaaacatt

SEQ ID NO: 1139020 - DNA, 16 bp, Homo sapiens
agtaataaatgaatgt

SEQ ID NO: 1139021 - DNA, 19 bp, Homo sapiens
agtaataaatgaatgtcac

SEQ ID NO: 1139022 - DNA, 13 bp, Homo sapiens
agtaatagattgt

SEQ ID NO: 1139023 - DNA, 15 bp, Homo sapiens
agtaatagattgttt

SEQ ID NO: 1139024 - DNA, 14 bp, Homo sapiens
agtaatagcctggg

SEQ ID NO: 1139025 - DNA, 18 bp, Homo sapiens
agtaataggcattttaag

SEQ ID NO: 1139026 - DNA, 23 bp, Homo sapiens
aactgcaataatatcaaaacaag

SEQ ID NO: 1139027 - DNA, 13 bp, Homo sapiens
aactgcaatagag

SEQ ID NO: 1139028 - DNA, 16 bp, Homo sapiens
aactgcaatagagact

SEQ ID NO: 1139029 - DNA, 17 bp, Homo sapiens
aactgcaatagagactg

SEQ ID NO: 1139030 - DNA, 22 bp, Homo sapiens
aactgcaatagagactgtagat

SEQ ID NO: 1139031 - DNA, 18 bp, Homo sapiens
aactgcacaatcagttta

SEQ ID NO: 1139032 - DNA, 21 bp, Homo sapiens
aactgcacagtgctgttggtg

SEQ ID NO: 1139033 - DNA, 17 bp, Homo sapiens
aactgcacatgaaagtt

SEQ ID NO: 1139034 - DNA, 21 bp, Homo sapiens
aactgcacctgggcagctcct

SEQ ID NO: 1139035 - DNA, 20 bp, Homo sapiens
aactgcagatagcccaggag

SEQ ID NO: 1139036 - DNA, 12 bp, Homo sapiens
aactgcagcctc

SEQ ID NO: 1139037 - DNA, 14 bp, Homo sapiens
aactgcagcctctc

SEQ ID NO: 1139038 - DNA, 17 bp, Homo sapiens
aactgcagcctctctgg

SEQ ID NO: 1139039 - DNA, 21 bp, Homo sapiens
aactgcatggacctaacattc

SEQ ID NO: 1139040 - DNA, 14 bp, Homo sapiens
aactgccaagggtg

SEQ ID NO: 1139041 - DNA, 14 bp, Homo sapiens
aactgccagttttg

SEQ ID NO: 1139042 - DNA, 19 bp, Homo sapiens
aactgccagttttgtttcc

SEQ ID NO: 1139043 - DNA, 19 bp, Homo sapiens
aactgcccagccccttttc

SEQ ID NO: 1139044 - DNA, 14 bp, Homo sapiens
aactgcccccactg

SEQ ID NO: 1139045 - DNA, 17 bp, Homo sapiens
aactgccctaagccccc

SEQ ID NO: 1139046 - DNA, 22 bp, Homo sapiens
aactgccctaagcccccagggc

SEQ ID NO: 1139047 - DNA, 16 bp, Homo sapiens
aactgccgtaatttaa

SEQ ID NO: 1139048 - DNA, 13 bp, Homo sapiens
aactgcctgggcc

SEQ ID NO: 1139049 - DNA, 19 bp, Homo sapiens
aactgcctggggggcaggg

SEQ ID NO: 1139050 - DNA, 16 bp, Homo sapiens
aactgccttggcttca

SEQ ID NO: 1139051 - DNA, 18 bp, Homo sapiens
aactgcgaggacatcaaa

SEQ ID NO: 1139052 - DNA, 16 bp, Homo sapiens
aactgcgttaaaggct

SEQ ID NO: 1139053 - DNA, 23 bp, Homo sapiens
aactgctaaattctatgttaaat

SEQ ID NO: 1139054 - DNA, 18 bp, Homo sapiens
aactgctaatgcaaatta

SEQ ID NO: 1139055 - DNA, 16 bp, Homo sapiens
aactgctcagagcttt

SEQ ID NO: 1139056 - DNA, 18 bp, Homo sapiens
aactgctcagagctttaa

SEQ ID NO: 1139057 - DNA, 15 bp, Homo sapiens
aactgctccaaattt

SEQ ID NO: 1139058 - DNA, 18 bp, Homo sapiens
aactgctccaaatttaac

SEQ ID NO: 1139059 - DNA, 21 bp, Homo sapiens
aactgctccaaatttaaccat

SEQ ID NO: 1139060 - DNA, 13 bp, Homo sapiens
aactgctcctcct

SEQ ID NO: 1139061 - DNA, 16 bp, Homo sapiens
aactgctctactttga

SEQ ID NO: 1139062 - DNA, 12 bp, Homo sapiens
aactgctcttga

SEQ ID NO: 1139063 - DNA, 23 bp, Homo sapiens
aactgctgactgttttctcttga

SEQ ID NO: 1139064 - DNA, 12 bp, Homo sapiens
aactgctgagcc

SEQ ID NO: 1139065 - DNA, 14 bp, Homo sapiens
aactgctgcatact

SEQ ID NO: 1139066 - DNA, 17 bp, Homo sapiens
aactgctgcatactttg

SEQ ID NO: 1139067 - DNA, 19 bp, Homo sapiens
aactgcttcatctcctttt

SEQ ID NO: 1139068 - DNA, 21 bp, Homo sapiens
aactgcttctagaaactctgg

SEQ ID NO: 1139069 - DNA, 14 bp, Homo sapiens
aactgcttcttgga

SEQ ID NO: 1139070 - DNA, 15 bp, Homo sapiens
aactgctttctgttc

SEQ ID NO: 1139071 - DNA, 20 bp, Homo sapiens
aactgcttttcctcaagcaa

SEQ ID NO: 1139072 - DNA, 20 bp, Homo sapiens
aactgcttttttttttccag

SEQ ID NO: 1139073 - DNA, 15 bp, Homo sapiens
aactggaagcacagc

SEQ ID NO: 1139074 - DNA, 18 bp, Homo sapiens
aactggagcaagaaggaa

SEQ ID NO: 1139075 - DNA, 20 bp, Homo sapiens
aactggaggaaccacatata

SEQ ID NO: 1139076 - DNA, 13 bp, Homo sapiens
aactggcaaagca

SEQ ID NO: 1139077 - DNA, 16 bp, Homo sapiens
aactggccttttgata

SEQ ID NO: 1139078 - DNA, 11 bp, Homo sapiens
aactggctggc

SEQ ID NO: 1139079 - DNA, 19 bp, Homo sapiens
aactggctgggcccctggg

SEQ ID NO: 1139080 - DNA, 20 bp, Homo sapiens
aactggctgggcccctgggg

SEQ ID NO: 1139081 - DNA, 11 bp, Homo sapiens
aactgggctgg

SEQ ID NO: 1139082 - DNA, 12 bp, Homo sapiens
aactgggctggc

SEQ ID NO: 1139083 - DNA, 16 bp, Homo sapiens
aactggggctcctcca

SEQ ID NO: 1139084 - DNA, 16 bp, Homo sapiens
aactgggggaaaagat

SEQ ID NO: 1139085 - DNA, 21 bp, Homo sapiens
aactgggggagggtgaagtga

SEQ ID NO: 1139086 - DNA, 17 bp, Homo sapiens
aactggggggccaccat

SEQ ID NO: 1139087 - DNA, 18 bp, Homo sapiens
aactggggttgagggcca

SEQ ID NO: 1139088 - DNA, 23 bp, Homo sapiens
aactgggttctttggaagcagcc

SEQ ID NO: 1139089 - DNA, 20 bp, Homo sapiens
aactggtaagcgatttgaaa

SEQ ID NO: 1139090 - DNA, 22 bp, Homo sapiens
aactggtattctgttctggagg

SEQ ID NO: 1139091 - DNA, 13 bp, Homo sapiens
aactggttagtgt

SEQ ID NO: 1139092 - DNA, 18 bp, Homo sapiens
aactggttagtgtgaaat

SEQ ID NO: 1139093 - DNA, 19 bp, Homo sapiens
aactgtaaaatgatactgt

SEQ ID NO: 1139094 - DNA, 13 bp, Homo sapiens
aactgtaaataaa

SEQ ID NO: 1139095 - DNA, 16 bp, Homo sapiens
aactgtaaataaaatg

SEQ ID NO: 1139096 - DNA, 18 bp, Homo sapiens
aactgtaaatatgtttgt

SEQ ID NO: 1139097 - DNA, 17 bp, Homo sapiens
aactgtaacgttttctt

SEQ ID NO: 1139098 - DNA, 11 bp, Homo sapiens
aactgtacagt

SEQ ID NO: 1139099 - DNA, 18 bp, Homo sapiens
aactgtacagtgtctttt

SEQ ID NO: 1139100 - DNA, 14 bp, Homo sapiens
aactgtacatttaa

SEQ ID NO: 1139101 - DNA, 15 bp, Homo sapiens
aactgtacttcactg

SEQ ID NO: 1139102 - DNA, 19 bp, Homo sapiens
aactgtagcgaccccagac

SEQ ID NO: 1139103 - DNA, 20 bp, Homo sapiens
aactgtagcgaccccagact

SEQ ID NO: 1139104 - DNA, 18 bp, Homo sapiens
aactgtagctcaagttta

SEQ ID NO: 1139105 - DNA, 23 bp, Homo sapiens
aactgtagctcaagtttaaaagc

SEQ ID NO: 1139106 - DNA, 14 bp, Homo sapiens
aactgtatatattc

SEQ ID NO: 1139107 - DNA, 19 bp, Homo sapiens
aactgtatcaaatctgtat

SEQ ID NO: 1139108 - DNA, 20 bp, Homo sapiens
aactgtatcaaatctgtata

SEQ ID NO: 1139109 - DNA, 22 bp, Homo sapiens
aactgtattctagtggctgttc

SEQ ID NO: 1139110 - DNA, 10 bp, Homo sapiens
aactgtattt

SEQ ID NO: 1139111 - DNA, 15 bp, Homo sapiens
aactgtatttaagga

SEQ ID NO: 1139112 - DNA, 22 bp, Homo sapiens
aactgtatttaaggaatcaaat

SEQ ID NO: 1139113 - DNA, 15 bp, Homo sapiens
aactgtatttcagta

SEQ ID NO: 1139114 - DNA, 16 bp, Homo sapiens
aactgtatttcagtat

SEQ ID NO: 1139115 - DNA, 22 bp, Homo sapiens
aactgtatttcagtattttcca

SEQ ID NO: 1139116 - DNA, 13 bp, Homo sapiens
aactgtatttgaa

SEQ ID NO: 1139117 - DNA, 19 bp, Homo sapiens
aactgtccgtaagcagtat

SEQ ID NO: 1139118 - DNA, 16 bp, Homo sapiens
aactgtcctgtcctgc

SEQ ID NO: 1139119 - DNA, 17 bp, Homo sapiens
aactgtcctgtcctgct

SEQ ID NO: 1139120 - DNA, 12 bp, Homo sapiens
aactgtcttgtt

SEQ ID NO: 1139121 - DNA, 18 bp, Homo sapiens
aactgtcttgtttcagtg

SEQ ID NO: 1139122 - DNA, 18 bp, Homo sapiens
aactgtctttaaaagaga

SEQ ID NO: 1139123 - DNA, 19 bp, Homo sapiens
aactgtctttaaaagagag

SEQ ID NO: 1139124 - DNA, 16 bp, Homo sapiens
aactgtgaacctggag

SEQ ID NO: 1139125 - DNA, 15 bp, Homo sapiens
aactgtgactaggca

SEQ ID NO: 1139126 - DNA, 18 bp, Homo sapiens
aactgtgcaactttttaa

SEQ ID NO: 1139127 - DNA, 19 bp, Homo sapiens
aactgtggaatataaatag

SEQ ID NO: 1139128 - DNA, 20 bp, Homo sapiens
aactgtggccgttatctgga

SEQ ID NO: 1139129 - DNA, 20 bp, Homo sapiens
aactgtgtaaaccacataat

SEQ ID NO: 1139130 - DNA, 21 bp, Homo sapiens
aactgtgtaaaccacataatt

SEQ ID NO: 1139131 - DNA, 22 bp, Homo sapiens
aactgtgtaaaccacataattt

SEQ ID NO: 1139132 - DNA, 23 bp, Homo sapiens
aactgtgtaaaccacataatttt

SEQ ID NO: 1139133 - DNA, 14 bp, Homo sapiens
aactgtgtatcatt

SEQ ID NO: 1139134 - DNA, 15 bp, Homo sapiens
aactgtgtatcatta

SEQ ID NO: 1139135 - DNA, 12 bp, Homo sapiens
aactgtgtattt

SEQ ID NO: 1139136 - DNA, 20 bp, Homo sapiens
agtatgtatattaaaaaaga

SEQ ID NO: 1139137 - DNA, 18 bp, Homo sapiens
agtatgtccttcagctga

SEQ ID NO: 1139138 - DNA, 18 bp, Homo sapiens
agtatgtctgtttttgta

SEQ ID NO: 1139139 - DNA, 19 bp, Homo sapiens
agtatgtctgtttttgtat

SEQ ID NO: 1139140 - DNA, 19 bp, Homo sapiens
agtatgtgacttttctgat

SEQ ID NO: 1139141 - DNA, 20 bp, Homo sapiens
agtatgtgacttttctgatt

SEQ ID NO: 1139142 - DNA, 19 bp, Homo sapiens
agtatgtgtcaactgagag

SEQ ID NO: 1139143 - DNA, 18 bp, Homo sapiens
agtatgttctaaccttta

SEQ ID NO: 1139144 - DNA, 14 bp, Homo sapiens
agtatgttgtacat

SEQ ID NO: 1139145 - DNA, 12 bp, Homo sapiens
agtatgttgtca

SEQ ID NO: 1139146 - DNA, 18 bp, Homo sapiens
agtatgttgtcaaagaga

SEQ ID NO: 1139147 - DNA, 13 bp, Homo sapiens
agtatgttgtcat

SEQ ID NO: 1139148 - DNA, 13 bp, Homo sapiens
agtcactagaagt

SEQ ID NO: 1139149 - DNA, 15 bp, Homo sapiens
agtcactagaagtcc

SEQ ID NO: 1139150 - DNA, 19 bp, Homo sapiens
agtcactagaagtcctgct

SEQ ID NO: 1139151 - DNA, 20 bp, Homo sapiens
agtcactagaagtcctgctg

SEQ ID NO: 1139152 - DNA, 21 bp, Homo sapiens
agtcactatgggatgagaaaa

SEQ ID NO: 1139153 - DNA, 13 bp, Homo sapiens
agtcactccctct

SEQ ID NO: 1139154 - DNA, 19 bp, Homo sapiens
agtcactccctctgccttc

SEQ ID NO: 1139155 - DNA, 14 bp, Homo sapiens
agtcactcctctct

SEQ ID NO: 1139156 - DNA, 14 bp, Homo sapiens
agtcactgaacaaa

SEQ ID NO: 1139157 - DNA, 23 bp, Homo sapiens
agtcactgagaccaaggctttct

SEQ ID NO: 1139158 - DNA, 16 bp, Homo sapiens
agtcactgatgtacaa

SEQ ID NO: 1139159 - DNA, 23 bp, Homo sapiens
agtcactgatgtacaattaaaaa

SEQ ID NO: 1139160 - DNA, 15 bp, Homo sapiens
agtcactgcagaggg

SEQ ID NO: 1139161 - DNA, 18 bp, Homo sapiens
agtcactgctgcaaggtg

SEQ ID NO: 1139162 - DNA, 23 bp, Homo sapiens
agtcacttgatgtgccattttaa

SEQ ID NO: 1139163 - DNA, 20 bp, Homo sapiens
agtcagaatgtgaaaaagga

SEQ ID NO: 1139164 - DNA, 23 bp, Homo sapiens
agtcagaatgtgaaaaaggaata

SEQ ID NO: 1139165 - DNA, 18 bp, Homo sapiens
agtcagacacgattgaga

SEQ ID NO: 1139166 - DNA, 15 bp, Homo sapiens
agtcagagacagata

SEQ ID NO: 1139167 - DNA, 19 bp, Homo sapiens
agtcagagacagatacctc

SEQ ID NO: 1139168 - DNA, 19 bp, Homo sapiens
agtcagagccctggctggg

SEQ ID NO: 1139169 - DNA, 22 bp, Homo sapiens
agtcagagccctggctgggttc

SEQ ID NO: 1139170 - DNA, 20 bp, Homo sapiens
agtcagatggaaaattcatt

SEQ ID NO: 1139171 - DNA, 12 bp, Homo sapiens
agtcagatgttt

SEQ ID NO: 1139172 - DNA, 23 bp, Homo sapiens
agtcagcaccttggcccaggagc

SEQ ID NO: 1139173 - DNA, 18 bp, Homo sapiens
agtcagccacactgggcc

SEQ ID NO: 1139174 - DNA, 15 bp, Homo sapiens
agtcagccagtggct

SEQ ID NO: 1139175 - DNA, 21 bp, Homo sapiens
agtcagctactctagttctgt

SEQ ID NO: 1139176 - DNA, 13 bp, Homo sapiens
agtcagctctctg

SEQ ID NO: 1139177 - DNA, 17 bp, Homo sapiens
agtcagctctctgccct

SEQ ID NO: 1139178 - DNA, 16 bp, Homo sapiens
agtcaggcactggctg

SEQ ID NO: 1139179 - DNA, 17 bp, Homo sapiens
agtcaggcactggctga

SEQ ID NO: 1139180 - DNA, 22 bp, Homo sapiens
agtcaggccttaattttcagta

SEQ ID NO: 1139181 - DNA, 23 bp, Homo sapiens
agtcagggcacagctgccctgct

SEQ ID NO: 1139182 - DNA, 16 bp, Homo sapiens
agtcaggggctctgtg

SEQ ID NO: 1139183 - DNA, 14 bp, Homo sapiens
agtcaggggctggg

SEQ ID NO: 1139184 - DNA, 22 bp, Homo sapiens
agtcagggtgaactgcaaagct

SEQ ID NO: 1139185 - DNA, 21 bp, Homo sapiens
agtcagggtgggaagaaagaa

SEQ ID NO: 1139186 - DNA, 14 bp, Homo sapiens
agtcaggtccaatt

SEQ ID NO: 1139187 - DNA, 19 bp, Homo sapiens
agtcaggtgggcggtgtgt

SEQ ID NO: 1139188 - DNA, 15 bp, Homo sapiens
agtcagtacccctgg

SEQ ID NO: 1139189 - DNA, 17 bp, Homo sapiens
agtcagtacgatcaagt

SEQ ID NO: 1139190 - DNA, 21 bp, Homo sapiens
agtcagtcatgatggcaccac

SEQ ID NO: 1139191 - DNA, 22 bp, Homo sapiens
agtcagtgctctcagctggcag

SEQ ID NO: 1139192 - DNA, 18 bp, Homo sapiens
agtcagtgtttcttttaa

SEQ ID NO: 1139193 - DNA, 17 bp, Homo sapiens
agtcagttcccggagca

SEQ ID NO: 1139194 - DNA, 21 bp, Homo sapiens
agtcagttcccggagcacagc

SEQ ID NO: 1139195 - DNA, 22 bp, Homo sapiens
agtcagttcccggagcacagcc

SEQ ID NO: 1139196 - DNA, 23 bp, Homo sapiens
agtcagttgctcaaaaagaaatc

SEQ ID NO: 1139197 - DNA, 14 bp, Homo sapiens
agtcagtttgcagt

SEQ ID NO: 1139198 - DNA, 12 bp, Homo sapiens
agtcataaatac

SEQ ID NO: 1139199 - DNA, 15 bp, Homo sapiens
agtcataaatactgt

SEQ ID NO: 1139200 - DNA, 23 bp, Homo sapiens
agtcatcattacttgggaaattt

SEQ ID NO: 1139201 - DNA, 16 bp, Homo sapiens
agtcatccaacaagaa

SEQ ID NO: 1139202 - DNA, 17 bp, Homo sapiens
agtcatccaacaagaag

SEQ ID NO: 1139203 - DNA, 17 bp, Homo sapiens
agtcatcccctctcagg

SEQ ID NO: 1139204 - DNA, 18 bp, Homo sapiens
agtcatcccctctcagga

SEQ ID NO: 1139205 - DNA, 14 bp, Homo sapiens
agtcatcctgccct

SEQ ID NO: 1139206 - DNA, 17 bp, Homo sapiens
agtcatcctgccctgca

SEQ ID NO: 1139207 - DNA, 22 bp, Homo sapiens
agtcatcctgccctgcagcacg

SEQ ID NO: 1139208 - DNA, 18 bp, Homo sapiens
agtcatctccatcagctg

SEQ ID NO: 1139209 - DNA, 20 bp, Homo sapiens
agtcatctccatcagctgta

SEQ ID NO: 1139210 - DNA, 11 bp, Homo sapiens
agtcatctccc

SEQ ID NO: 1139211 - DNA, 19 bp, Homo sapiens
agtcatctcccctcctggc

SEQ ID NO: 1139212 - DNA, 19 bp, Homo sapiens
agtcatctgttagggcctt

SEQ ID NO: 1139213 - DNA, 19 bp, Homo sapiens
agtcatcttgctaccagta

SEQ ID NO: 1139214 - DNA, 14 bp, Homo sapiens
agtcatgaagccca

SEQ ID NO: 1139215 - DNA, 16 bp, Homo sapiens
agtcatgatctccctg

SEQ ID NO: 1139216 - DNA, 17 bp, Homo sapiens
agtcatgatctccctgc

SEQ ID NO: 1139217 - DNA, 19 bp, Homo sapiens
agtcatgatctccctgccg

SEQ ID NO: 1139218 - DNA, 20 bp, Homo sapiens
agtcatgatctccctgccgc

SEQ ID NO: 1139219 - DNA, 21 bp, Homo sapiens
agtcatgatctccctgccgcc

SEQ ID NO: 1139220 - DNA, 16 bp, Homo sapiens
agtcatggaatcttgc

SEQ ID NO: 1139221 - DNA, 19 bp, Homo sapiens
agtcatggaatcttgctgc

SEQ ID NO: 1139222 - DNA, 16 bp, Homo sapiens
agtcatggataactac

SEQ ID NO: 1139223 - DNA, 16 bp, Homo sapiens
agtcatgggaacgcag

SEQ ID NO: 1139224 - DNA, 17 bp, Homo sapiens
agtcatgtatgtttctc

SEQ ID NO: 1139225 - DNA, 22 bp, Homo sapiens
agtcatgtatgtttctctttga

SEQ ID NO: 1139226 - DNA, 12 bp, Homo sapiens
agtcatgtgacc

SEQ ID NO: 1139227 - DNA, 14 bp, Homo sapiens
agtcattaaagaca

SEQ ID NO: 1139228 - DNA, 16 bp, Homo sapiens
agtcattaaattacta

SEQ ID NO: 1139229 - DNA, 18 bp, Homo sapiens
agtcattaaattactata

SEQ ID NO: 1139230 - DNA, 20 bp, Homo sapiens
agtcattatccttgctatga

SEQ ID NO: 1139231 - DNA, 22 bp, Homo sapiens
agtcattatgagaggcaatgat

SEQ ID NO: 1139232 - DNA, 13 bp, Homo sapiens
agtcattcagcag

SEQ ID NO: 1139233 - DNA, 13 bp, Homo sapiens
agtcattcatatt

SEQ ID NO: 1139234 - DNA, 14 bp, Homo sapiens
agtcattcatattt

SEQ ID NO: 1139235 - DNA, 15 bp, Homo sapiens
agtcattgatagaac

SEQ ID NO: 1139236 - DNA, 15 bp, Homo sapiens
agtcattgtcataag

SEQ ID NO: 1139237 - DNA, 15 bp, Homo sapiens
agtcattttcatgtg

SEQ ID NO: 1139238 - DNA, 16 bp, Homo sapiens
agtcatttttcttgat

SEQ ID NO: 1139239 - DNA, 16 bp, Homo sapiens
agtccaaatgtcctcc

SEQ ID NO: 1139240 - DNA, 17 bp, Homo sapiens
agtccaaattgtttgta

SEQ ID NO: 1139241 - DNA, 17 bp, Homo sapiens
agtccaacaatgttgtt

SEQ ID NO: 1139242 - DNA, 21 bp, Homo sapiens
agtccaaccagaaacacccct

SEQ ID NO: 1139243 - DNA, 12 bp, Homo sapiens
agtccaacctgc

SEQ ID NO: 1139244 - DNA, 14 bp, Homo sapiens
agtccaactcactt

SEQ ID NO: 1139245 - DNA, 19 bp, Homo sapiens
agtccaagagggtccttta

SEQ ID NO: 1139246 - DNA, 14 bp, Homo sapiens
agtccaagctggga

SEQ ID NO: 1139247 - DNA, 13 bp, Homo sapiens
agtccaatatttg

SEQ ID NO: 1139248 - DNA, 15 bp, Homo sapiens
agtccaattttaatt

SEQ ID NO: 1139249 - DNA, 17 bp, Homo sapiens
agtccaatttttactca

SEQ ID NO: 1139250 - DNA, 14 bp, Homo sapiens
agtccacaaaataa

SEQ ID NO: 1139251 - DNA, 20 bp, Homo sapiens
agtccacaggggccaccacc

SEQ ID NO: 1139252 - DNA, 18 bp, Homo sapiens
agtccacccttggttcct

SEQ ID NO: 1139253 - DNA, 14 bp, Homo sapiens
agtccactgtcctc

SEQ ID NO: 1139254 - DNA, 19 bp, Homo sapiens
agtccactgtcctccttgg

SEQ ID NO: 1139255 - DNA, 13 bp, Homo sapiens
agtccactgttga

SEQ ID NO: 1139256 - DNA, 20 bp, Homo sapiens
agtccagaaactgttcccac

SEQ ID NO: 1139257 - DNA, 11 bp, Homo sapiens
agtccagaccc

SEQ ID NO: 1139258 - DNA, 12 bp, Homo sapiens
agtccagagctt

SEQ ID NO: 1139259 - DNA, 15 bp, Homo sapiens
agtccagatttacac

SEQ ID NO: 1139260 - DNA, 16 bp, Homo sapiens
agtccagatttacact

SEQ ID NO: 1139261 - DNA, 22 bp, Homo sapiens
agtccagatttacactgggaga

SEQ ID NO: 1139262 - DNA, 16 bp, Homo sapiens
agtccaggcacaggat

SEQ ID NO: 1139263 - DNA, 23 bp, Homo sapiens
agtccaggccccaaaaccacagc

SEQ ID NO: 1139264 - DNA, 18 bp, Homo sapiens
agtccaggcctctctctg

SEQ ID NO: 1139265 - DNA, 17 bp, Homo sapiens
agtccagtgacctgctg

SEQ ID NO: 1139266 - DNA, 23 bp, Homo sapiens
aacttgtgaactccatcattcat

SEQ ID NO: 1139267 - DNA, 20 bp, Homo sapiens
aacttgtgtactgataaaat

SEQ ID NO: 1139268 - DNA, 21 bp, Homo sapiens
aacttgtgtactgataaaata

SEQ ID NO: 1139269 - DNA, 13 bp, Homo sapiens
aactttaaaactg

SEQ ID NO: 1139270 - DNA, 14 bp, Homo sapiens
aagaatgaaaaata

SEQ ID NO: 1139271 - DNA, 21 bp, Homo sapiens
aagaatgagaaggagtcagaa

SEQ ID NO: 1139272 - DNA, 22 bp, Homo sapiens
aagaatgagcctacgctgaaga

SEQ ID NO: 1139273 - DNA, 16 bp, Homo sapiens
aagaatgcaagagtgg

SEQ ID NO: 1139274 - DNA, 20 bp, Homo sapiens
aagaatgcacaagaatggat

SEQ ID NO: 1139275 - DNA, 20 bp, Homo sapiens
agtcgttatttctgtttgtt

SEQ ID NO: 1139276 - DNA, 21 bp, Homo sapiens
agtctaaaaagacctggcctt

SEQ ID NO: 1139277 - DNA, 21 bp, Homo sapiens
agtctaaagctggtttaatgt

SEQ ID NO: 1139278 - DNA, 23 bp, Homo sapiens
agtctaaatattcagaatctttg

SEQ ID NO: 1139279 - DNA, 23 bp, Homo sapiens
agtctaaatatttccttaaactg

SEQ ID NO: 1139280 - DNA, 20 bp, Homo sapiens
agtctaacagtttgcctgct

SEQ ID NO: 1139281 - DNA, 21 bp, Homo sapiens
agtctaagaacccatggaaaa

SEQ ID NO: 1139282 - DNA, 13 bp, Homo sapiens
agtctaccctgtc

SEQ ID NO: 1139283 - DNA, 14 bp, Homo sapiens
agtctaccctgtcc

SEQ ID NO: 1139284 - DNA, 18 bp, Homo sapiens
agtctagatggctcctct

SEQ ID NO: 1139285 - DNA, 16 bp, Homo sapiens
agtctaggagctggga

SEQ ID NO: 1139286 - DNA, 15 bp, Homo sapiens
agtctatcaaatgaa

SEQ ID NO: 1139287 - DNA, 22 bp, Homo sapiens
agtctatcaaccccagacactg

SEQ ID NO: 1139288 - DNA, 13 bp, Homo sapiens
agtctatgcttaa

SEQ ID NO: 1139289 - DNA, 13 bp, Homo sapiens
agtctatgttcaa

SEQ ID NO: 1139290 - DNA, 23 bp, Homo sapiens
agtctattcattaagtaatcttt

SEQ ID NO: 1139291 - DNA, 13 bp, Homo sapiens
agtctattgtctc

SEQ ID NO: 1139292 - DNA, 20 bp, Homo sapiens
agtctatttccactgaacaa

SEQ ID NO: 1139293 - DNA, 20 bp, Homo sapiens
agtctatttttttaactgaa

SEQ ID NO: 1139294 - DNA, 21 bp, Homo sapiens
agtctatttttttaactgaaa

SEQ ID NO: 1139295 - DNA, 16 bp, Homo sapiens
agtctcaacatgtgtt

SEQ ID NO: 1139296 - DNA, 20 bp, Homo sapiens
agtctcaacatgtgtttctg

SEQ ID NO: 1139297 - DNA, 22 bp, Homo sapiens
agtctcaacatgtgtttctgac

SEQ ID NO: 1139298 - DNA, 23 bp, Homo sapiens
agtctcaacatgtgtttctgaca

SEQ ID NO: 1139299 - DNA, 20 bp, Homo sapiens
agtctcacccattatctgga

SEQ ID NO: 1139300 - DNA, 15 bp, Homo sapiens
agtctcagagaccag

SEQ ID NO: 1139301 - DNA, 17 bp, Homo sapiens
agtctcagagaccagca

SEQ ID NO: 1139302 - DNA, 18 bp, Homo sapiens
agtctcagagaccagcac

SEQ ID NO: 1139303 - DNA, 19 bp, Homo sapiens
agtctcagtgaagactatg

SEQ ID NO: 1139304 - DNA, 16 bp, Homo sapiens
agtctcagttctcttg

SEQ ID NO: 1139305 - DNA, 18 bp, Homo sapiens
agtctcagtttgtgtgtc

SEQ ID NO: 1139306 - DNA, 21 bp, Homo sapiens
agtctcagtttgtgtgtctta

SEQ ID NO: 1139307 - DNA, 17 bp, Homo sapiens
agtctcatctcctgacc

SEQ ID NO: 1139308 - DNA, 19 bp, Homo sapiens
agtctcatctcctgaccct

SEQ ID NO: 1139309 - DNA, 15 bp, Homo sapiens
agtctcatgggaagc

SEQ ID NO: 1139310 - DNA, 17 bp, Homo sapiens
agtctcattacttttga

SEQ ID NO: 1139311 - DNA, 23 bp, Homo sapiens
agtctcattcgcctttgtcttgt

SEQ ID NO: 1139312 - DNA, 11 bp, Homo sapiens
agtctccctga

SEQ ID NO: 1139313 - DNA, 15 bp, Homo sapiens
agtctccctgatgga

SEQ ID NO: 1139314 - DNA, 18 bp, Homo sapiens
agtctccctgatggaccc

SEQ ID NO: 1139315 - DNA, 20 bp, Homo sapiens
agtctccctgatggaccctc

SEQ ID NO: 1139316 - DNA, 13 bp, Homo sapiens
agtctcctcactc

SEQ ID NO: 1139317 - DNA, 21 bp, Homo sapiens
agtctcctcccctactctgcc

SEQ ID NO: 1139318 - DNA, 13 bp, Homo sapiens
agtctcctctcca

SEQ ID NO: 1139319 - DNA, 23 bp, Homo sapiens
agtctcctgtcttatggtccaga

SEQ ID NO: 1139320 - DNA, 22 bp, Homo sapiens
agtctcctttgcactgagggcc

SEQ ID NO: 1139321 - DNA, 23 bp, Homo sapiens
agtctctatattatgtcttcttt

SEQ ID NO: 1139322 - DNA, 19 bp, Homo sapiens
agtctctctctgttgccca

SEQ ID NO: 1139323 - DNA, 22 bp, Homo sapiens
agtctctctggggccacacaga

SEQ ID NO: 1139324 - DNA, 12 bp, Homo sapiens
agtctctctgtg

SEQ ID NO: 1139325 - DNA, 15 bp, Homo sapiens
agtctctctgtgaat

SEQ ID NO: 1139326 - DNA, 16 bp, Homo sapiens
agtctctctgtgaata

SEQ ID NO: 1139327 - DNA, 17 bp, Homo sapiens
agtctctcttaaagttg

SEQ ID NO: 1139328 - DNA, 23 bp, Homo sapiens
agtctctcttctctccagctgac

SEQ ID NO: 1139329 - DNA, 16 bp, Homo sapiens
agtctctgagcagtga

SEQ ID NO: 1139330 - DNA, 16 bp, Homo sapiens
agtctctgaggggcta

SEQ ID NO: 1139331 - DNA, 15 bp, Homo sapiens
agtctctgccaccca

SEQ ID NO: 1139332 - DNA, 19 bp, Homo sapiens
agtctctgccacccactca

SEQ ID NO: 1139333 - DNA, 21 bp, Homo sapiens
agtctctgccacccactcagg

SEQ ID NO: 1139334 - DNA, 11 bp, Homo sapiens
agtctctgtga

SEQ ID NO: 1139335 - DNA, 12 bp, Homo sapiens
agtctctgtgaa

SEQ ID NO: 1139336 - DNA, 12 bp, Homo sapiens
agtctcttccac

SEQ ID NO: 1139337 - DNA, 13 bp, Homo sapiens
agtctcttctcca

SEQ ID NO: 1139338 - DNA, 21 bp, Homo sapiens
agtctcttctccactggatgg

SEQ ID NO: 1139339 - DNA, 13 bp, Homo sapiens
agtctcttgtttg

SEQ ID NO: 1139340 - DNA, 21 bp, Homo sapiens
agtctctttaatcttcagttt

SEQ ID NO: 1139341 - DNA, 18 bp, Homo sapiens
agtctgaaaatagaactt

SEQ ID NO: 1139342 - DNA, 17 bp, Homo sapiens
agtctgaacccttgtgc

SEQ ID NO: 1139343 - DNA, 18 bp, Homo sapiens
agtctgaagtttcattta

SEQ ID NO: 1139344 - DNA, 17 bp, Homo sapiens
agtctgaatgctgccac

SEQ ID NO: 1139345 - DNA, 12 bp, Homo sapiens
agtctgagaaat

SEQ ID NO: 1139346 - DNA, 19 bp, Homo sapiens
agtctgagatgccccgagc

SEQ ID NO: 1139347 - DNA, 15 bp, Homo sapiens
agtctgagcccccgg

SEQ ID NO: 1139348 - DNA, 17 bp, Homo sapiens
agtctgagcccccggct

SEQ ID NO: 1139349 - DNA, 18 bp, Homo sapiens
agtctgaggactgtcctc

SEQ ID NO: 1139350 - DNA, 13 bp, Homo sapiens
agtctgagtcctg

SEQ ID NO: 1139351 - DNA, 20 bp, Homo sapiens
agtctgagtcctgtctctgc

SEQ ID NO: 1139352 - DNA, 22 bp, Homo sapiens
agtctgattataccatgtgtgc

SEQ ID NO: 1139353 - DNA, 23 bp, Homo sapiens
agtctgattataccatgtgtgct

SEQ ID NO: 1139354 - DNA, 22 bp, Homo sapiens
agtctgcaaaatgaggaatgta

SEQ ID NO: 1139355 - DNA, 11 bp, Homo sapiens
agtctgccact

SEQ ID NO: 1139356 - DNA, 20 bp, Homo sapiens
agtctgcccacgcagaggac

SEQ ID NO: 1139357 - DNA, 17 bp, Homo sapiens
agtctgccgcccacctc

SEQ ID NO: 1139358 - DNA, 13 bp, Homo sapiens
agtctgctctgct

SEQ ID NO: 1139359 - DNA, 20 bp, Homo sapiens
agtctggaaagtgatgtcag

SEQ ID NO: 1139360 - DNA, 18 bp, Homo sapiens
agtctggacctccatccc

SEQ ID NO: 1139361 - DNA, 20 bp, Homo sapiens
agtctggacctccatccctg

SEQ ID NO: 1139362 - DNA, 17 bp, Homo sapiens
agtctggatctgggacc

SEQ ID NO: 1139363 - DNA, 21 bp, Homo sapiens
agtctgggacacaaaactccg

SEQ ID NO: 1139364 - DNA, 13 bp, Homo sapiens
agtctgggcctct

SEQ ID NO: 1139365 - DNA, 15 bp, Homo sapiens
agtctgggcctctga

SEQ ID NO: 1139366 - DNA, 19 bp, Homo sapiens
agtctggggacctggcact

SEQ ID NO: 1139367 - DNA, 14 bp, Homo sapiens
agtctggtggagga

SEQ ID NO: 1139368 - DNA, 18 bp, Homo sapiens
agtctgtcaggtttggtt

SEQ ID NO: 1139369 - DNA, 15 bp, Homo sapiens
agtctgtcatcctct

SEQ ID NO: 1139370 - DNA, 18 bp, Homo sapiens
agtctgtcatcctctgga

SEQ ID NO: 1139371 - DNA, 13 bp, Homo sapiens
agtctgtcatgaa

SEQ ID NO: 1139372 - DNA, 17 bp, Homo sapiens
agtctgtctactgtggt

SEQ ID NO: 1139373 - DNA, 23 bp, Homo sapiens
agtctgtctcttggctttgtcac

SEQ ID NO: 1139374 - DNA, 18 bp, Homo sapiens
agtctgtcttcctgcctt

SEQ ID NO: 1139375 - DNA, 22 bp, Homo sapiens
agtctgtggctttttgttcaga

SEQ ID NO: 1139376 - DNA, 21 bp, Homo sapiens
agtctgtgtaactttaaacat

SEQ ID NO: 1139377 - DNA, 12 bp, Homo sapiens
agtctgtgtgaa

SEQ ID NO: 1139378 - DNA, 18 bp, Homo sapiens
agtctgtgtgatgaactt

SEQ ID NO: 1139379 - DNA, 22 bp, Homo sapiens
agtctgtgtgatgaactttctc

SEQ ID NO: 1139380 - DNA, 14 bp, Homo sapiens
agtctgttatgcac

SEQ ID NO: 1139381 - DNA, 21 bp, Homo sapiens
agtctgttatgcactgtggtt

SEQ ID NO: 1139382 - DNA, 14 bp, Homo sapiens
agtctgttatttat

SEQ ID NO: 1139383 - DNA, 21 bp, Homo sapiens
agtctgttcactgcattcacc

SEQ ID NO: 1139384 - DNA, 16 bp, Homo sapiens
agtctgttgattaaag

SEQ ID NO: 1139385 - DNA, 20 bp, Homo sapiens
agtcttaacaaaccaacatc

SEQ ID NO: 1139386 - DNA, 23 bp, Homo sapiens
agtcttaacaaaccaacatcttt

SEQ ID NO: 1139387 - DNA, 14 bp, Homo sapiens
agtcttaactggtc

SEQ ID NO: 1139388 - DNA, 23 bp, Homo sapiens
agtcttaataaaataaactagat

SEQ ID NO: 1139389 - DNA, 13 bp, Homo sapiens
agtcttagatgta

SEQ ID NO: 1139390 - DNA, 23 bp, Homo sapiens
agtcttagatgtatatatttcct

SEQ ID NO: 1139391 - DNA, 19 bp, Homo sapiens
aagagctcaggcttttcca

SEQ ID NO: 1139392 - DNA, 17 bp, Homo sapiens
aagagctcccctccaca

SEQ ID NO: 1139393 - DNA, 23 bp, Homo sapiens
aagagctcccctccacagctgca

SEQ ID NO: 1139394 - DNA, 18 bp, Homo sapiens
aagagctggtggtttgat

SEQ ID NO: 1139395 - DNA, 12 bp, Homo sapiens
aagagctgtctg

SEQ ID NO: 1139396 - DNA, 17 bp, Homo sapiens
aagagctgtctgactgc

SEQ ID NO: 1139397 - DNA, 17 bp, Homo sapiens
aagagcttataaaattt

SEQ ID NO: 1139398 - DNA, 18 bp, Homo sapiens
aagagcttgcacagccaa

SEQ ID NO: 1139399 - DNA, 15 bp, Homo sapiens
aagagcttgctccag

SEQ ID NO: 1139400 - DNA, 22 bp, Homo sapiens
aagagcttgctccagattctga

SEQ ID NO: 1139401 - DNA, 14 bp, Homo sapiens
aagagcttgctttg

SEQ ID NO: 1139402 - DNA, 20 bp, Homo sapiens
aagaggaacagcactgggga

SEQ ID NO: 1139403 - DNA, 14 bp, Homo sapiens
aagaggaagagaga

SEQ ID NO: 1139404 - DNA, 13 bp, Homo sapiens
aagaggaagcaaa

SEQ ID NO: 1139405 - DNA, 17 bp, Homo sapiens
aagaggactgagactgg

SEQ ID NO: 1139406 - DNA, 15 bp, Homo sapiens
aagaggactgtgtga

SEQ ID NO: 1139407 - DNA, 21 bp, Homo sapiens
agtgactgatggctaatgtac

SEQ ID NO: 1139408 - DNA, 16 bp, Homo sapiens
agtgactgtatctgtg

SEQ ID NO: 1139409 - DNA, 21 bp, Homo sapiens
agtgactgttgtagcattttc

SEQ ID NO: 1139410 - DNA, 15 bp, Homo sapiens
agtgacttcctgggg

SEQ ID NO: 1139411 - DNA, 13 bp, Homo sapiens
agtgacttctgag

SEQ ID NO: 1139412 - DNA, 21 bp, Homo sapiens
agtgacttggccccagacgca

SEQ ID NO: 1139413 - DNA, 20 bp, Homo sapiens
agtgacttgttctgagtaag

SEQ ID NO: 1139414 - DNA, 14 bp, Homo sapiens
agtgactttgtata

SEQ ID NO: 1139415 - DNA, 20 bp, Homo sapiens
agtgactttgtatagagaat

SEQ ID NO: 1139416 - DNA, 16 bp, Homo sapiens
agtgactttttctgag

SEQ ID NO: 1139417 - DNA, 20 bp, Homo sapiens
agtgactttttctgagcttt

SEQ ID NO: 1139418 - DNA, 22 bp, Homo sapiens
agtgagaaaaagctcctgtcct

SEQ ID NO: 1139419 - DNA, 17 bp, Homo sapiens
agtgagaaaactgtgac

SEQ ID NO: 1139420 - DNA, 20 bp, Homo sapiens
agtgagaaaagttcaatact

SEQ ID NO: 1139421 - DNA, 19 bp, Homo sapiens
agtgagaagctgaggccta

SEQ ID NO: 1139422 - DNA, 16 bp, Homo sapiens
agtgagacagtctgga

SEQ ID NO: 1139423 - DNA, 17 bp, Homo sapiens
agtgagaccctgtctca

SEQ ID NO: 1139424 - DNA, 18 bp, Homo sapiens
agtgagactccacctcaa

SEQ ID NO: 1139425 - DNA, 11 bp, Homo sapiens
agtgagactgc

SEQ ID NO: 1139426 - DNA, 22 bp, Homo sapiens
agtgagactggggccactacat

SEQ ID NO: 1139427 - DNA, 13 bp, Homo sapiens
agtgagagacatt

SEQ ID NO: 1139428 - DNA, 22 bp, Homo sapiens
agtgagagacattaactcatta

SEQ ID NO: 1139429 - DNA, 18 bp, Homo sapiens
agtgagagagacaagaag

SEQ ID NO: 1139430 - DNA, 22 bp, Homo sapiens
agtgagagaggaggcctggacc

SEQ ID NO: 1139431 - DNA, 20 bp, Homo sapiens
agtgagagcctttgccttta

SEQ ID NO: 1139432 - DNA, 16 bp, Homo sapiens
agtgagagctttgctt

SEQ ID NO: 1139433 - DNA, 12 bp, Homo sapiens
agtgagaggctg

SEQ ID NO: 1139434 - DNA, 15 bp, Homo sapiens
agtgagaggggaggg

SEQ ID NO: 1139435 - DNA, 14 bp, Homo sapiens
agtgagatagaata

SEQ ID NO: 1139436 - DNA, 16 bp, Homo sapiens
agtgagatagcattgt

SEQ ID NO: 1139437 - DNA, 22 bp, Homo sapiens
agtgagatagcattgtgaactg

SEQ ID NO: 1139438 - DNA, 14 bp, Homo sapiens
agtgagatgaggga

SEQ ID NO: 1139439 - DNA, 23 bp, Homo sapiens
agtgagatgagggatgggcctgg

SEQ ID NO: 1139440 - DNA, 17 bp, Homo sapiens
agtgagatgtagaaagt

SEQ ID NO: 1139441 - DNA, 18 bp, Homo sapiens
agtgagatgtagaaagtt

SEQ ID NO: 1139442 - DNA, 14 bp, Homo sapiens
agtgagcaaggggg

SEQ ID NO: 1139443 - DNA, 17 bp, Homo sapiens
agtgagcaagggggccc

SEQ ID NO: 1139444 - DNA, 18 bp, Homo sapiens
agtgagcaagggggccca

SEQ ID NO: 1139445 - DNA, 20 bp, Homo sapiens
agtgagcaaggtgctcttga

SEQ ID NO: 1139446 - DNA, 16 bp, Homo sapiens
agtgagcagagatgta

SEQ ID NO: 1139447 - DNA, 22 bp, Homo sapiens
agtgagcagctactgtaacttt

SEQ ID NO: 1139448 - DNA, 23 bp, Homo sapiens
agtgagcagctactgtaactttt

SEQ ID NO: 1139449 - DNA, 13 bp, Homo sapiens
agtgagcagggtg

SEQ ID NO: 1139450 - DNA, 21 bp, Homo sapiens
agtgagcagggtggggtctgg

SEQ ID NO: 1139451 - DNA, 13 bp, Homo sapiens
agtgagcatatct

SEQ ID NO: 1139452 - DNA, 12 bp, Homo sapiens
agtgagcccccc

SEQ ID NO: 1139453 - DNA, 17 bp, Homo sapiens
agtgagcccctccccag

SEQ ID NO: 1139454 - DNA, 19 bp, Homo sapiens
agtgagcccctccccagcc

SEQ ID NO: 1139455 - DNA, 20 bp, Homo sapiens
agtgagccgagattgcacca

SEQ ID NO: 1139456 - DNA, 19 bp, Homo sapiens
agtgagccgcatcttctcc

SEQ ID NO: 1139457 - DNA, 24 bp, Homo sapiens
agtgagccgcatcttctccatctg

SEQ ID NO: 1139458 - DNA, 17 bp, Homo sapiens
agtgagcctcctgtgcc

SEQ ID NO: 1139459 - DNA, 18 bp, Homo sapiens
agtgagcctcctgtgcct

SEQ ID NO: 1139460 - DNA, 22 bp, Homo sapiens
agtgagcctcctgtgcctggcc

SEQ ID NO: 1139461 - DNA, 13 bp, Homo sapiens
agtgagcctgggc

SEQ ID NO: 1139462 - DNA, 15 bp, Homo sapiens
agtgagcctgggcca

SEQ ID NO: 1139463 - DNA, 14 bp, Homo sapiens
agtgagctttgctg

SEQ ID NO: 1139464 - DNA, 20 bp, Homo sapiens
agtgagctttgctgctacag

SEQ ID NO: 1139465 - DNA, 14 bp, Homo sapiens
agtgaggagaatga

SEQ ID NO: 1139466 - DNA, 12 bp, Homo sapiens
agtgaggagggt

SEQ ID NO: 1139467 - DNA, 17 bp, Homo sapiens
agtgaggatgctgcagt

SEQ ID NO: 1139468 - DNA, 21 bp, Homo sapiens
agtgaggattttgttgatacc

SEQ ID NO: 1139469 - DNA, 15 bp, Homo sapiens
agtgaggcccaggga

SEQ ID NO: 1139470 - DNA, 17 bp, Homo sapiens
agtgaggcttccaggct

SEQ ID NO: 1139471 - DNA, 17 bp, Homo sapiens
agtgagggcctcagagc

SEQ ID NO: 1139472 - DNA, 14 bp, Homo sapiens
agtgaggggccctc

SEQ ID NO: 1139473 - DNA, 19 bp, Homo sapiens
agtgaggggttacctccct

SEQ ID NO: 1139474 - DNA, 22 bp, Homo sapiens
agtgaggtgtgtcacaatgaga

SEQ ID NO: 1139475 - DNA, 17 bp, Homo sapiens
agtgagtaattttggat

SEQ ID NO: 1139476 - DNA, 20 bp, Homo sapiens
agtgagtattggaagacttg

SEQ ID NO: 1139477 - DNA, 14 bp, Homo sapiens
agtgagtcacctgc

SEQ ID NO: 1139478 - DNA, 18 bp, Homo sapiens
agtgagtcacctgctcca

SEQ ID NO: 1139479 - DNA, 20 bp, Homo sapiens
agtgagtcacctgctccaga

SEQ ID NO: 1139480 - DNA, 22 bp, Homo sapiens
agtgagtctggtggaggagctg

SEQ ID NO: 1139481 - DNA, 12 bp, Homo sapiens
agtgagtgtaaa

SEQ ID NO: 1139482 - DNA, 16 bp, Homo sapiens
agtgagtgtggctccc

SEQ ID NO: 1139483 - DNA, 18 bp, Homo sapiens
agtgagtgtggctcccct

SEQ ID NO: 1139484 - DNA, 13 bp, Homo sapiens
agtgagtgtgtgt

SEQ ID NO: 1139485 - DNA, 15 bp, Homo sapiens
agtgagtgtgtgtgc

SEQ ID NO: 1139486 - DNA, 16 bp, Homo sapiens
agtgagtgtgtgtgct

SEQ ID NO: 1139487 - DNA, 16 bp, Homo sapiens
agtgagtttgtaaata

SEQ ID NO: 1139488 - DNA, 23 bp, Homo sapiens
agtgagttttactcttaaatcat

SEQ ID NO: 1139489 - DNA, 17 bp, Homo sapiens
agtgatacaacttcaag

SEQ ID NO: 1139490 - DNA, 20 bp, Homo sapiens
agtgatactatccagttact

SEQ ID NO: 1139491 - DNA, 15 bp, Homo sapiens
agtgatagtcttttg

SEQ ID NO: 1139492 - DNA, 17 bp, Homo sapiens
agtgatagtcttttgct

SEQ ID NO: 1139493 - DNA, 21 bp, Homo sapiens
agtgatatagtgctgtttaag

SEQ ID NO: 1139494 - DNA, 15 bp, Homo sapiens
agtgatatcacctct

SEQ ID NO: 1139495 - DNA, 20 bp, Homo sapiens
agtgatatgatccagagcag

SEQ ID NO: 1139496 - DNA, 15 bp, Homo sapiens
agtgatattggaact

SEQ ID NO: 1139497 - DNA, 14 bp, Homo sapiens
agtgatcaaactac

SEQ ID NO: 1139498 - DNA, 16 bp, Homo sapiens
agtgatcaataaaatg

SEQ ID NO: 1139499 - DNA, 15 bp, Homo sapiens
agtgatcatttaaaa

SEQ ID NO: 1139500 - DNA, 18 bp, Homo sapiens
agtgatctatgtttgtgt

SEQ ID NO: 1139501 - DNA, 13 bp, Homo sapiens
agtgatctccata

SEQ ID NO: 1139502 - DNA, 13 bp, Homo sapiens
agtgatctgtcca

SEQ ID NO: 1139503 - DNA, 23 bp, Homo sapiens
agtgatgaatgtactatgtctga

SEQ ID NO: 1139504 - DNA, 19 bp, Homo sapiens
agtgatgatgttttgatat

SEQ ID NO: 1139505 - DNA, 20 bp, Homo sapiens
agtgatgcaataaccagcat

SEQ ID NO: 1139506 - DNA, 19 bp, Homo sapiens
agtgatgccgggcgccagg

SEQ ID NO: 1139507 - DNA, 22 bp, Homo sapiens
agtgatgccgggcgccaggaca

SEQ ID NO: 1139508 - DNA, 23 bp, Homo sapiens
agtgatgccgggcgccaggacag

SEQ ID NO: 1139509 - DNA, 24 bp, Homo sapiens
agtgatgccgggcgccaggacagc

SEQ ID NO: 1139510 - DNA, 19 bp, Homo sapiens
agtgatggcgcgggaggca

SEQ ID NO: 1139511 - DNA, 20 bp, Homo sapiens
agtgatggcgcgggaggcac

SEQ ID NO: 1139512 - DNA, 23 bp, Homo sapiens
agtgatggcgcgggaggcaccag

SEQ ID NO: 1139513 - DNA, 12 bp, Homo sapiens
aagcaaagacaa

SEQ ID NO: 1139514 - DNA, 19 bp, Homo sapiens
aagcaaagatttcagtaga

SEQ ID NO: 1139515 - DNA, 22 bp, Homo sapiens
aagcaaagatttcagtagaatt

SEQ ID NO: 1139516 - DNA, 14 bp, Homo sapiens
aagcaaaggcagtc

SEQ ID NO: 1139517 - DNA, 18 bp, Homo sapiens
aagcaaaggggacagctg

SEQ ID NO: 1139518 - DNA, 17 bp, Homo sapiens
aagcaaatcagaaactt

SEQ ID NO: 1139519 - DNA, 14 bp, Homo sapiens
aagcaaatcatttg

SEQ ID NO: 1139520 - DNA, 19 bp, Homo sapiens
aagcaaatcatttgtttaa

SEQ ID NO: 1139521 - DNA, 21 bp, Homo sapiens
aagcaaatctttctgtaaaca

SEQ ID NO: 1139522 - DNA, 19 bp, Homo sapiens
aagcaaattgtttcagttt

SEQ ID NO: 1139523 - DNA, 13 bp, Homo sapiens
aagcaacatttgt

SEQ ID NO: 1139524 - DNA, 21 bp, Homo sapiens
aagcaacatttgtatggattt

SEQ ID NO: 1139525 - DNA, 22 bp, Homo sapiens
aagcaacccgctggagcccaca

SEQ ID NO: 1139526 - DNA, 14 bp, Homo sapiens
aagcaactgttatg

SEQ ID NO: 1139527 - DNA, 17 bp, Homo sapiens
aagcaagagagatgttt

SEQ ID NO: 1139528 - DNA, 17 bp, Homo sapiens
aagcaagatgagctgtg

SEQ ID NO: 1139529 - DNA, 15 bp, Homo sapiens
aagcaagcattcaga

SEQ ID NO: 1139530 - DNA, 19 bp, Homo sapiens
aagcaagcattcagaagaa

SEQ ID NO: 1139531 - DNA, 21 bp, Homo sapiens
aagcaagcattcagaagaaaa

SEQ ID NO: 1139532 - DNA, 20 bp, Homo sapiens
aagcaaggaagatatacatg

SEQ ID NO: 1139533 - DNA, 21 bp, Homo sapiens
aagcaagggagaaaagagaaa

SEQ ID NO: 1139534 - DNA, 17 bp, Homo sapiens
aagcaagggcaaacagt

SEQ ID NO: 1139535 - DNA, 19 bp, Homo sapiens
aagcaagtaaaaaggctaa

SEQ ID NO: 1139536 - DNA, 20 bp, Homo sapiens
aagcaagtgagtctggtgga

SEQ ID NO: 1139537 - DNA, 17 bp, Homo sapiens
aagcaataaagattttt

SEQ ID NO: 1139538 - DNA, 16 bp, Homo sapiens
aagcaataaatgaatg

SEQ ID NO: 1139539 - DNA, 18 bp, Homo sapiens
agtgcggacccttcccag

SEQ ID NO: 1139540 - DNA, 23 bp, Homo sapiens
agtgcggacccttcccagccctc

SEQ ID NO: 1139541 - DNA, 20 bp, Homo sapiens
agtgcggcgtgggggcactg

SEQ ID NO: 1139542 - DNA, 18 bp, Homo sapiens
agtgcggttcctcatctg

SEQ ID NO: 1139543 - DNA, 17 bp, Homo sapiens
agtgcgtgaatgtatgt

SEQ ID NO: 1139544 - DNA, 14 bp, Homo sapiens
agtgcgttctccca

SEQ ID NO: 1139545 - DNA, 23 bp, Homo sapiens
agtgctaaacatggcttaatctt

SEQ ID NO: 1139546 - DNA, 13 bp, Homo sapiens
agtgctattctgt

SEQ ID NO: 1139547 - DNA, 14 bp, Homo sapiens
agtgctattctgtg

SEQ ID NO: 1139548 - DNA, 17 bp, Homo sapiens
agtgctcaccagccctg

SEQ ID NO: 1139549 - DNA, 14 bp, Homo sapiens
agtgctccctcaca

SEQ ID NO: 1139550 - DNA, 20 bp, Homo sapiens
agtgctcgagtcacattctg

SEQ ID NO: 1139551 - DNA, 22 bp, Homo sapiens
agtgctcgagtcacattctgct

SEQ ID NO: 1139552 - DNA, 16 bp, Homo sapiens
agtgctctcagctggc

SEQ ID NO: 1139553 - DNA, 18 bp, Homo sapiens
agtgctctgaccctgggc

SEQ ID NO: 1139554 - DNA, 11 bp, Homo sapiens
agtgctctgat

SEQ ID NO: 1139555 - DNA, 16 bp, Homo sapiens
agtgctctgatccctc

SEQ ID NO: 1139556 - DNA, 12 bp, Homo sapiens
agtgctctgcct

SEQ ID NO: 1139557 - DNA, 13 bp, Homo sapiens
agtgctctgcctc

SEQ ID NO: 1139558 - DNA, 16 bp, Homo sapiens
agtgctctgcctcaga

SEQ ID NO: 1139559 - DNA, 18 bp, Homo sapiens
agtgctcttggctgaccc

SEQ ID NO: 1139560 - DNA, 16 bp, Homo sapiens
agtgctgaacagtgga

SEQ ID NO: 1139561 - DNA, 20 bp, Homo sapiens
agtgctgagattacagacgt

SEQ ID NO: 1139562 - DNA, 14 bp, Homo sapiens
agtgctgaggccag

SEQ ID NO: 1139563 - DNA, 16 bp, Homo sapiens
agtgctgaggccaggg

SEQ ID NO: 1139564 - DNA, 21 bp, Homo sapiens
agtgctgatccggctgctcct

SEQ ID NO: 1139565 - DNA, 14 bp, Homo sapiens
agtgctgattcaaa

SEQ ID NO: 1139566 - DNA, 16 bp, Homo sapiens
agtgctgattcaaacc

SEQ ID NO: 1139567 - DNA, 19 bp, Homo sapiens
agtgctgcagccaaagaca

SEQ ID NO: 1139568 - DNA, 19 bp, Homo sapiens
agtgctgcatttaaaagat

SEQ ID NO: 1139569 - DNA, 22 bp, Homo sapiens
agtgctgcatttaaaagataca

SEQ ID NO: 1139570 - DNA, 18 bp, Homo sapiens
agtgctgccatgccactg

SEQ ID NO: 1139571 - DNA, 21 bp, Homo sapiens
agtgctgccatgccactgcca

SEQ ID NO: 1139572 - DNA, 22 bp, Homo sapiens
agtgctgccctgcgaagtggct

SEQ ID NO: 1139573 - DNA, 15 bp, Homo sapiens
agtgctgctgaagat

SEQ ID NO: 1139574 - DNA, 16 bp, Homo sapiens
agtgctgctgtaaata

SEQ ID NO: 1139575 - DNA, 12 bp, Homo sapiens
agtgctgcttct

SEQ ID NO: 1139576 - DNA, 14 bp, Homo sapiens
agtgctgcttcttg

SEQ ID NO: 1139577 - DNA, 15 bp, Homo sapiens
agtgctgcttcttgc

SEQ ID NO: 1139578 - DNA, 16 bp, Homo sapiens
agtgctgcttgtgcct

SEQ ID NO: 1139579 - DNA, 12 bp, Homo sapiens
agtgctggactg

SEQ ID NO: 1139580 - DNA, 22 bp, Homo sapiens
agtgctggagtctcctgaggac

SEQ ID NO: 1139581 - DNA, 16 bp, Homo sapiens
agtgctggctcacagt

SEQ ID NO: 1139582 - DNA, 11 bp, Homo sapiens
agtgctgggat

SEQ ID NO: 1139583 - DNA, 17 bp, Homo sapiens
agtgctgggattacagg

SEQ ID NO: 1139584 - DNA, 20 bp, Homo sapiens
agtgctgggattacaggcat

SEQ ID NO: 1139585 - DNA, 20 bp, Homo sapiens
agtgctgggattacaggcgt

SEQ ID NO: 1139586 - DNA, 24 bp, Homo sapiens
agtgctgggattgtgggcatgagc

SEQ ID NO: 1139587 - DNA, 18 bp, Homo sapiens
agtgctgggcactgctcc

SEQ ID NO: 1139588 - DNA, 19 bp, Homo sapiens
agtgctggtcagagagacc

SEQ ID NO: 1139589 - DNA, 16 bp, Homo sapiens
agtgctgtaatattgt

SEQ ID NO: 1139590 - DNA, 21 bp, Homo sapiens
agtgctgtacccttccacctc

SEQ ID NO: 1139591 - DNA, 12 bp, Homo sapiens
agtgctgtgaaa

SEQ ID NO: 1139592 - DNA, 13 bp, Homo sapiens
agtgctgtgaaaa

SEQ ID NO: 1139593 - DNA, 18 bp, Homo sapiens
agtgctgtgcaaggtatt

SEQ ID NO: 1139594 - DNA, 14 bp, Homo sapiens
agtgctgtggcctg

SEQ ID NO: 1139595 - DNA, 20 bp, Homo sapiens
agtgctgtggcctgggcaag

SEQ ID NO: 1139596 - DNA, 22 bp, Homo sapiens
agtgctgtttattaatcttagt

SEQ ID NO: 1139597 - DNA, 18 bp, Homo sapiens
agtgcttacattttaata

SEQ ID NO: 1139598 - DNA, 14 bp, Homo sapiens
agtgcttcagcctg

SEQ ID NO: 1139599 - DNA, 15 bp, Homo sapiens
agtgcttcagcctga

SEQ ID NO: 1139600 - DNA, 20 bp, Homo sapiens
agtgcttcagcctgaggctg

SEQ ID NO: 1139601 - DNA, 16 bp, Homo sapiens
agtgcttccaaggatg

SEQ ID NO: 1139602 - DNA, 14 bp, Homo sapiens
agtgcttctctaca

SEQ ID NO: 1139603 - DNA, 14 bp, Homo sapiens
agtgcttcttacta

SEQ ID NO: 1139604 - DNA, 16 bp, Homo sapiens
agtgcttgcatcctat

SEQ ID NO: 1139605 - DNA, 19 bp, Homo sapiens
agtgcttgttagagagaaa

SEQ ID NO: 1139606 - DNA, 21 bp, Homo sapiens
agtgcttgttagagagaaaga

SEQ ID NO: 1139607 - DNA, 23 bp, Homo sapiens
agtgctttctttccgtcaccctg

SEQ ID NO: 1139608 - DNA, 17 bp, Homo sapiens
agtgctttgacttcttg

SEQ ID NO: 1139609 - DNA, 19 bp, Homo sapiens
agtgctttgcatgtattag

SEQ ID NO: 1139610 - DNA, 18 bp, Homo sapiens
agtgcttttcactacttt

SEQ ID NO: 1139611 - DNA, 21 bp, Homo sapiens
agtggaaaataggctttttaa

SEQ ID NO: 1139612 - DNA, 15 bp, Homo sapiens
agtggaaatgttcta

SEQ ID NO: 1139613 - DNA, 17 bp, Homo sapiens
agtggaacacaaatgaa

SEQ ID NO: 1139614 - DNA, 23 bp, Homo sapiens
agtggaacagtcacccttctggg

SEQ ID NO: 1139615 - DNA, 21 bp, Homo sapiens
agtggaacctcctatatcatt

SEQ ID NO: 1139616 - DNA, 16 bp, Homo sapiens
agtggaagagcagcct

SEQ ID NO: 1139617 - DNA, 24 bp, Homo sapiens
agtggaagagcagcctgatggcca

SEQ ID NO: 1139618 - DNA, 19 bp, Homo sapiens
agtggaaggcattgtcctg

SEQ ID NO: 1139619 - DNA, 18 bp, Homo sapiens
agtggaagttcttcaaga

SEQ ID NO: 1139620 - DNA, 19 bp, Homo sapiens
agtggaagttcttcaagag

SEQ ID NO: 1139621 - DNA, 21 bp, Homo sapiens
agtggaatgcagggaagaggg

SEQ ID NO: 1139622 - DNA, 18 bp, Homo sapiens
agtggaattagagggcct

SEQ ID NO: 1139623 - DNA, 21 bp, Homo sapiens
agtggacatggtcacagtcct

SEQ ID NO: 1139624 - DNA, 19 bp, Homo sapiens
agtggaccaggacaggacc

SEQ ID NO: 1139625 - DNA, 20 bp, Homo sapiens
agtggaccaggacaggacca

SEQ ID NO: 1139626 - DNA, 20 bp, Homo sapiens
agtggaccgaaatctgtatt

SEQ ID NO: 1139627 - DNA, 23 bp, Homo sapiens
agtggaccttaggccttcctctc

SEQ ID NO: 1139628 - DNA, 19 bp, Homo sapiens
agtggaccttgagaccaca

SEQ ID NO: 1139629 - DNA, 16 bp, Homo sapiens
agtggactcagggcag

SEQ ID NO: 1139630 - DNA, 18 bp, Homo sapiens
agtggactgaatgtgcct

SEQ ID NO: 1139631 - DNA, 15 bp, Homo sapiens
agtggactttccacc

SEQ ID NO: 1139632 - DNA, 18 bp, Homo sapiens
agtggactttccaccccc

SEQ ID NO: 1139633 - DNA, 16 bp, Homo sapiens
agtggagaattatata

SEQ ID NO: 1139634 - DNA, 14 bp, Homo sapiens
agtggtctctgctg

SEQ ID NO: 1139635 - DNA, 20 bp, Homo sapiens
agtggtcttatttttgggtg

SEQ ID NO: 1139636 - DNA, 20 bp, Homo sapiens
agtggtctttctggagaggt

SEQ ID NO: 1139637 - DNA, 15 bp, Homo sapiens
agtggtgcttagaaa

SEQ ID NO: 1139638 - DNA, 14 bp, Homo sapiens
agtggtgggggaag

SEQ ID NO: 1139639 - DNA, 16 bp, Homo sapiens
agtggtgggggaaggc

SEQ ID NO: 1139640 - DNA, 19 bp, Homo sapiens
agtggtggttttctgttct

SEQ ID NO: 1139641 - DNA, 20 bp, Homo sapiens
agtggtggttttctgttctt

SEQ ID NO: 1139642 - DNA, 14 bp, Homo sapiens
agtggttattcatt

SEQ ID NO: 1139643 - DNA, 14 bp, Homo sapiens
agtggttcctgtgg

SEQ ID NO: 1139644 - DNA, 16 bp, Homo sapiens
agtggtttcggaaaaa

SEQ ID NO: 1139645 - DNA, 22 bp, Homo sapiens
agtggtttctacttcccctggg

SEQ ID NO: 1139646 - DNA, 13 bp, Homo sapiens
agtgtaaaataag

SEQ ID NO: 1139647 - DNA, 14 bp, Homo sapiens
agtgtaaaatattt

SEQ ID NO: 1139648 - DNA, 18 bp, Homo sapiens
agtgtaaaatattttgaa

SEQ ID NO: 1139649 - DNA, 17 bp, Homo sapiens
agtgtaaataattttaa

SEQ ID NO: 1139650 - DNA, 14 bp, Homo sapiens
agtgtaaatccttt

SEQ ID NO: 1139651 - DNA, 15 bp, Homo sapiens
agtgtaacaattgtg

SEQ ID NO: 1139652 - DNA, 18 bp, Homo sapiens
agtgtaacaattgtgtag

SEQ ID NO: 1139653 - DNA, 16 bp, Homo sapiens
agtgtaacagctgagg

SEQ ID NO: 1139654 - DNA, 18 bp, Homo sapiens
agtgtaacttgcttaaat

SEQ ID NO: 1139655 - DNA, 17 bp, Homo sapiens
agtgtaagaactgtaca

SEQ ID NO: 1139656 - DNA, 21 bp, Homo sapiens
agtgtaagaactgtacattgt

SEQ ID NO: 1139657 - DNA, 16 bp, Homo sapiens
agtgtaataatgttat

SEQ ID NO: 1139658 - DNA, 14 bp, Homo sapiens
agtgtaattgagaa

SEQ ID NO: 1139659 - DNA, 12 bp, Homo sapiens
agtgtacaattg

SEQ ID NO: 1139660 - DNA, 15 bp, Homo sapiens
agtgtacagtcttgt

SEQ ID NO: 1139661 - DNA, 23 bp, Homo sapiens
agtgtacatggaataacatgtaa

SEQ ID NO: 1139662 - DNA, 13 bp, Homo sapiens
agtgtaccataat

SEQ ID NO: 1139663 - DNA, 18 bp, Homo sapiens
agtgtacccatctttaat

SEQ ID NO: 1139664 - DNA, 17 bp, Homo sapiens
agtgtagaagaaaatat

SEQ ID NO: 1139665 - DNA, 20 bp, Homo sapiens
agtgtagatgtagcattgtt

SEQ ID NO: 1139666 - DNA, 16 bp, Homo sapiens
agtgtagcatcttcct

SEQ ID NO: 1139667 - DNA, 19 bp, Homo sapiens
agtgtagcatcttcctctg

SEQ ID NO: 1139668 - DNA, 21 bp, Homo sapiens
agtgtagcatcttcctctgca

SEQ ID NO: 1139669 - DNA, 21 bp, Homo sapiens
agtgtagcccacacttgagag

SEQ ID NO: 1139670 - DNA, 23 bp, Homo sapiens
agtgtagcccacacttgagagga

SEQ ID NO: 1139671 - DNA, 14 bp, Homo sapiens
aagcccctgggccc

SEQ ID NO: 1139672 - DNA, 15 bp, Homo sapiens
aagcccgacttgctg

SEQ ID NO: 1139673 - DNA, 15 bp, Homo sapiens
aagccctaagcctgt

SEQ ID NO: 1139674 - DNA, 23 bp, Homo sapiens
aagccctaagcctgtccccagac

SEQ ID NO: 1139675 - DNA, 16 bp, Homo sapiens
aagccctacagagctg

SEQ ID NO: 1139676 - DNA, 19 bp, Homo sapiens
aagccctacagagctgtgg

SEQ ID NO: 1139677 - DNA, 15 bp, Homo sapiens
aagccctcattttta

SEQ ID NO: 1139678 - DNA, 19 bp, Homo sapiens
aagccctgagctttctgct

SEQ ID NO: 1139679 - DNA, 23 bp, Homo sapiens
aagccctgattgtgtatattcat

SEQ ID NO: 1139680 - DNA, 13 bp, Homo sapiens
aagccctgcctct

SEQ ID NO: 1139681 - DNA, 17 bp, Homo sapiens
aagccctgcctctgtgt

SEQ ID NO: 1139682 - DNA, 13 bp, Homo sapiens
aagccctggagac

SEQ ID NO: 1139683 - DNA, 18 bp, Homo sapiens
aagccctgtcgagacact

SEQ ID NO: 1139684 - DNA, 19 bp, Homo sapiens
aagccctgtcgagacactt

SEQ ID NO: 1139685 - DNA, 20 bp, Homo sapiens
aagccctgtcgagacacttg

SEQ ID NO: 1139686 - DNA, 13 bp, Homo sapiens
aagcccttatttg

SEQ ID NO: 1139687 - DNA, 20 bp, Homo sapiens
aagcccttccatgtcgcctc

SEQ ID NO: 1139688 - DNA, 18 bp, Homo sapiens
aagccctttgctctggag

SEQ ID NO: 1139689 - DNA, 19 bp, Homo sapiens
aagccgactctggccctgg

SEQ ID NO: 1139690 - DNA, 21 bp, Homo sapiens
aagccgactctggccctggcc

SEQ ID NO: 1139691 - DNA, 14 bp, Homo sapiens
aagccggcggccca

SEQ ID NO: 1139692 - DNA, 13 bp, Homo sapiens
aagccgggggagg

SEQ ID NO: 1139693 - DNA, 16 bp, Homo sapiens
aagccggtgcctgggt

SEQ ID NO: 1139694 - DNA, 16 bp, Homo sapiens
aagccggtgtccctgg

SEQ ID NO: 1139695 - DNA, 19 bp, Homo sapiens
aagccgtctgactccagag

SEQ ID NO: 1139696 - DNA, 20 bp, Homo sapiens
aagccgtctgactccagagt

SEQ ID NO: 1139697 - DNA, 20 bp, Homo sapiens
aagcctagacaacctttctg

SEQ ID NO: 1139698 - DNA, 21 bp, Homo sapiens
aagcctagacaacctttctgt

SEQ ID NO: 1139699 - DNA, 23 bp, Homo sapiens
aagcctagacaacctttctgtag

SEQ ID NO: 1139700 - DNA, 18 bp, Homo sapiens
aagcctatacgtttctgt

SEQ ID NO: 1139701 - DNA, 18 bp, Homo sapiens
aagcctcaaaacaaaggc

SEQ ID NO: 1139702 - DNA, 23 bp, Homo sapiens
aagcctcacgtatttcacagagc

SEQ ID NO: 1139703 - DNA, 21 bp, Homo sapiens
aagcctcatcatcagagcctt

SEQ ID NO: 1139704 - DNA, 22 bp, Homo sapiens
aagcctcatttgaatgtgtgaa

SEQ ID NO: 1139705 - DNA, 13 bp, Homo sapiens
aagcctccaaggg

SEQ ID NO: 1139706 - DNA, 19 bp, Homo sapiens
aagcctccgcctgctgtgt

SEQ ID NO: 1139707 - DNA, 14 bp, Homo sapiens
aagcctcctgcccc

SEQ ID NO: 1139708 - DNA, 14 bp, Homo sapiens
aagcctcctgtacc

SEQ ID NO: 1139709 - DNA, 13 bp, Homo sapiens
aagcctccttttt

SEQ ID NO: 1139710 - DNA, 14 bp, Homo sapiens
aagcctctctcctt

SEQ ID NO: 1139711 - DNA, 23 bp, Homo sapiens
aagcctctctccttggccacaga

SEQ ID NO: 1139712 - DNA, 17 bp, Homo sapiens
aagcctctgccctgcct

SEQ ID NO: 1139713 - DNA, 19 bp, Homo sapiens
aagcctctgccctgcctcc

SEQ ID NO: 1139714 - DNA, 20 bp, Homo sapiens
aagcctctgccctgcctccc

SEQ ID NO: 1139715 - DNA, 11 bp, Homo sapiens
aagcctctgct

SEQ ID NO: 1139716 - DNA, 14 bp, Homo sapiens
aagcctctgctgcc

SEQ ID NO: 1139717 - DNA, 23 bp, Homo sapiens
aagcctctggctagaggccagcc

SEQ ID NO: 1139718 - DNA, 22 bp, Homo sapiens
aagcctcttattccaggagaag

SEQ ID NO: 1139719 - DNA, 23 bp, Homo sapiens
aagcctgaactgaggccttgtgt

SEQ ID NO: 1139720 - DNA, 24 bp, Homo sapiens
aagcctgaaggggcgtctgttccc

SEQ ID NO: 1139721 - DNA, 14 bp, Homo sapiens
aagcctgcaggagt

SEQ ID NO: 1139722 - DNA, 21 bp, Homo sapiens
aagcctgcctaggaattccca

SEQ ID NO: 1139723 - DNA, 13 bp, Homo sapiens
aagcctgcctccc

SEQ ID NO: 1139724 - DNA, 15 bp, Homo sapiens
aagcctgcctcccaa

SEQ ID NO: 1139725 - DNA, 19 bp, Homo sapiens
aagcctgcggcgccagcct

SEQ ID NO: 1139726 - DNA, 20 bp, Homo sapiens
aagcctgcggcgccagcctc

SEQ ID NO: 1139727 - DNA, 19 bp, Homo sapiens
aagcctgctggctgcggcc

SEQ ID NO: 1139728 - DNA, 21 bp, Homo sapiens
aagcctgctggctgcggcccc

SEQ ID NO: 1139729 - DNA, 15 bp, Homo sapiens
aagcctggaagccat

SEQ ID NO: 1139730 - DNA, 18 bp, Homo sapiens
aagcctggactctgcccc

SEQ ID NO: 1139731 - DNA, 13 bp, Homo sapiens
aagcctggattcc

SEQ ID NO: 1139732 - DNA, 14 bp, Homo sapiens
aagcctggcaccca

SEQ ID NO: 1139733 - DNA, 19 bp, Homo sapiens
aagcctggtttttctcaat

SEQ ID NO: 1139734 - DNA, 15 bp, Homo sapiens
aagcctgtcccagga

SEQ ID NO: 1139735 - DNA, 16 bp, Homo sapiens
aagcctgtcccaggac

SEQ ID NO: 1139736 - DNA, 15 bp, Homo sapiens
aagcctgtctctttc

SEQ ID NO: 1139737 - DNA, 23 bp, Homo sapiens
aagcctgtgaataaaaaccctgt

SEQ ID NO: 1139738 - DNA, 12 bp, Homo sapiens
aagcctgtgggc

SEQ ID NO: 1139739 - DNA, 18 bp, Homo sapiens
aagcctgttcccctcact

SEQ ID NO: 1139740 - DNA, 18 bp, Homo sapiens
aagcctgttgtttaagtg

SEQ ID NO: 1139741 - DNA, 16 bp, Homo sapiens
aagccttaagcaaatt

SEQ ID NO: 1139742 - DNA, 23 bp, Homo sapiens
aagccttatcaagtgtcttccat

SEQ ID NO: 1139743 - DNA, 15 bp, Homo sapiens
aagccttcagctcca

SEQ ID NO: 1139744 - DNA, 21 bp, Homo sapiens
aagccttgaagaaaatgactt

SEQ ID NO: 1139745 - DNA, 15 bp, Homo sapiens
aagcctttccataag

SEQ ID NO: 1139746 - DNA, 20 bp, Homo sapiens
aagcctttggtgaattcctt

SEQ ID NO: 1139747 - DNA, 17 bp, Homo sapiens
aagccttttaaatcatc

SEQ ID NO: 1139748 - DNA, 22 bp, Homo sapiens
aagcgaagtctttgccttctct

SEQ ID NO: 1139749 - DNA, 15 bp, Homo sapiens
aagcgaattatactc

SEQ ID NO: 1139750 - DNA, 19 bp, Homo sapiens
aagcgacctctcttgaggt

SEQ ID NO: 1139751 - DNA, 20 bp, Homo sapiens
aagcgactctcctgtttgga

SEQ ID NO: 1139752 - DNA, 18 bp, Homo sapiens
aagcgaggtcaacagaga

SEQ ID NO: 1139753 - DNA, 20 bp, Homo sapiens
aagcgatgaatttggagact

SEQ ID NO: 1139754 - DNA, 15 bp, Homo sapiens
aagcgcccacccagg

SEQ ID NO: 1139755 - DNA, 18 bp, Homo sapiens
aagcgcccctcactcctg

SEQ ID NO: 1139756 - DNA, 15 bp, Homo sapiens
aagctggactagtgt

SEQ ID NO: 1139757 - DNA, 18 bp, Homo sapiens
aagctggagctcttggaa

SEQ ID NO: 1139758 - DNA, 20 bp, Homo sapiens
aagctggagctcttggaaga

SEQ ID NO: 1139759 - DNA, 18 bp, Homo sapiens
aagctggagtgctgcttg

SEQ ID NO: 1139760 - DNA, 19 bp, Homo sapiens
aagctggcagaacggagga

SEQ ID NO: 1139761 - DNA, 13 bp, Homo sapiens
aagctggcctgag

SEQ ID NO: 1139762 - DNA, 12 bp, Homo sapiens
aagctggctctg

SEQ ID NO: 1139763 - DNA, 22 bp, Homo sapiens
aagctggctttgaaacctcagg

SEQ ID NO: 1139764 - DNA, 11 bp, Homo sapiens
aagctgggcag

SEQ ID NO: 1139765 - DNA, 18 bp, Homo sapiens
aagctgggcccaaaggcc

SEQ ID NO: 1139766 - DNA, 15 bp, Homo sapiens
aagctgggccgaggc

SEQ ID NO: 1139767 - DNA, 12 bp, Homo sapiens
aagctgggctgt

SEQ ID NO: 1139768 - DNA, 16 bp, Homo sapiens
aagctggtaaaaatga

SEQ ID NO: 1139769 - DNA, 14 bp, Homo sapiens
aagctgtaaattac

SEQ ID NO: 1139770 - DNA, 16 bp, Homo sapiens
aagctgtacccttgag

SEQ ID NO: 1139771 - DNA, 17 bp, Homo sapiens
aagctgtcaggctggga

SEQ ID NO: 1139772 - DNA, 17 bp, Homo sapiens
aagctgtggcagccgtc

SEQ ID NO: 1139773 - DNA, 12 bp, Homo sapiens
aagctgtgtcct

SEQ ID NO: 1139774 - DNA, 16 bp, Homo sapiens
aagctgttaaactgtt

SEQ ID NO: 1139775 - DNA, 17 bp, Homo sapiens
aagctgttaaactgtta

SEQ ID NO: 1139776 - DNA, 20 bp, Homo sapiens
aagctgttaaactgttagca

SEQ ID NO: 1139777 - DNA, 18 bp, Homo sapiens
aagctgttactgtcttca

SEQ ID NO: 1139778 - DNA, 14 bp, Homo sapiens
aagcttaaaacttt

SEQ ID NO: 1139779 - DNA, 15 bp, Homo sapiens
aagcttaaaactttg

SEQ ID NO: 1139780 - DNA, 17 bp, Homo sapiens
aagcttaatatgtgctg

SEQ ID NO: 1139781 - DNA, 19 bp, Homo sapiens
aagcttaatggctgataat

SEQ ID NO: 1139782 - DNA, 11 bp, Homo sapiens
aagcttagaac

SEQ ID NO: 1139783 - DNA, 17 bp, Homo sapiens
aagcttatttttatgtg

SEQ ID NO: 1139784 - DNA, 18 bp, Homo sapiens
aagcttcaaactgcatga

SEQ ID NO: 1139785 - DNA, 17 bp, Homo sapiens
aagcttcaaattataga

SEQ ID NO: 1139786 - DNA, 20 bp, Homo sapiens
aagcttcaaattatagaaac

SEQ ID NO: 1139787 - DNA, 21 bp, Homo sapiens
aagcttcaaattatagaaaca

SEQ ID NO: 1139788 - DNA, 21 bp, Homo sapiens
aagcttcattctccttgttgt

SEQ ID NO: 1139789 - DNA, 15 bp, Homo sapiens
aagcttccacaaaat

SEQ ID NO: 1139790 - DNA, 16 bp, Homo sapiens
aagcttccacaaaatt

SEQ ID NO: 1139791 - DNA, 20 bp, Homo sapiens
aagcttccacaaaattagaa

SEQ ID NO: 1139792 - DNA, 21 bp, Homo sapiens
aagcttccatgattctattta

SEQ ID NO: 1139793 - DNA, 14 bp, Homo sapiens
aagcttccctctca

SEQ ID NO: 1139794 - DNA, 21 bp, Homo sapiens
aagcttcctgtgccctcaccc

SEQ ID NO: 1139795 - DNA, 12 bp, Homo sapiens
aagcttgactcc

SEQ ID NO: 1139796 - DNA, 19 bp, Homo sapiens
aagcttgcaccttttcatg

SEQ ID NO: 1139797 - DNA, 21 bp, Homo sapiens
aagcttggcagccgagctcgt

SEQ ID NO: 1139798 - DNA, 18 bp, Homo sapiens
aagcttggtcaaactttt

SEQ ID NO: 1139799 - DNA, 19 bp, Homo sapiens
aagcttggtcaaacttttt

SEQ ID NO: 1139800 - DNA, 19 bp, Homo sapiens
aagcttggtgacaaaattc

SEQ ID NO: 1139801 - DNA, 14 bp, Homo sapiens
aagcttgtgtactt

SEQ ID NO: 1139802 - DNA, 13 bp, Homo sapiens
aagctttactact

SEQ ID NO: 1139803 - DNA, 18 bp, Homo sapiens
agttatattgaatatatc

SEQ ID NO: 1139804 - DNA, 23 bp, Homo sapiens
agttatatttcagatgtaatgtt

SEQ ID NO: 1139805 - DNA, 16 bp, Homo sapiens
agttatattttgcagt

SEQ ID NO: 1139806 - DNA, 15 bp, Homo sapiens
agttatcaaaaagta

SEQ ID NO: 1139807 - DNA, 16 bp, Homo sapiens
agttatcaaaaagtat

SEQ ID NO: 1139808 - DNA, 18 bp, Homo sapiens
agttatcaactttagcta

SEQ ID NO: 1139809 - DNA, 17 bp, Homo sapiens
agttatctaaaagaaat

SEQ ID NO: 1139810 - DNA, 15 bp, Homo sapiens
agttatctaagttaa

SEQ ID NO: 1139811 - DNA, 10 bp, Homo sapiens
agttatctta

SEQ ID NO: 1139812 - DNA, 14 bp, Homo sapiens
agttatcttagctg

SEQ ID NO: 1139813 - DNA, 13 bp, Homo sapiens
agttatcttcttt

SEQ ID NO: 1139814 - DNA, 18 bp, Homo sapiens
agttatctttgaatatgt

SEQ ID NO: 1139815 - DNA, 23 bp, Homo sapiens
agttatgccgtataggatgtcag

SEQ ID NO: 1139816 - DNA, 21 bp, Homo sapiens
agttatggcctatacactatt

SEQ ID NO: 1139817 - DNA, 17 bp, Homo sapiens
agttatggtgatgactt

SEQ ID NO: 1139818 - DNA, 15 bp, Homo sapiens
agttatgtgaatgat

SEQ ID NO: 1139819 - DNA, 20 bp, Homo sapiens
agttattaacgggcatgtat

SEQ ID NO: 1139820 - DNA, 20 bp, Homo sapiens
agttattaactttaatgttt

SEQ ID NO: 1139821 - DNA, 20 bp, Homo sapiens
agttattatctatggaaatg

SEQ ID NO: 1139822 - DNA, 13 bp, Homo sapiens
agttattcaaatt

SEQ ID NO: 1139823 - DNA, 17 bp, Homo sapiens
agttattcaaatttgta

SEQ ID NO: 1139824 - DNA, 19 bp, Homo sapiens
agttattgaatcttaattt

SEQ ID NO: 1139825 - DNA, 19 bp, Homo sapiens
agttattgcagtttatcat

SEQ ID NO: 1139826 - DNA, 15 bp, Homo sapiens
agttatttaatcaaa

SEQ ID NO: 1139827 - DNA, 18 bp, Homo sapiens
agttatttacttttacca

SEQ ID NO: 1139828 - DNA, 22 bp, Homo sapiens
agttatttatgcctctgtattt

SEQ ID NO: 1139829 - DNA, 19 bp, Homo sapiens
agttatttgtataaattaa

SEQ ID NO: 1139830 - DNA, 14 bp, Homo sapiens
agttattttccagg

SEQ ID NO: 1139831 - DNA, 14 bp, Homo sapiens
agttattttctaca

SEQ ID NO: 1139832 - DNA, 23 bp, Homo sapiens
agttattttctacagtggtttta

SEQ ID NO: 1139833 - DNA, 17 bp, Homo sapiens
agttattttcttgttta

SEQ ID NO: 1139834 - DNA, 21 bp, Homo sapiens
agttatttttatttatttaaa

SEQ ID NO: 1139835 - DNA, 12 bp, Homo sapiens
agttatttttct

SEQ ID NO: 1139836 - DNA, 15 bp, Homo sapiens
agttcaaagtgtata

SEQ ID NO: 1139837 - DNA, 16 bp, Homo sapiens
agttcaaagtgtatat

SEQ ID NO: 1139838 - DNA, 22 bp, Homo sapiens
agttcaaagtgtatatttattc

SEQ ID NO: 1139839 - DNA, 16 bp, Homo sapiens
agttcaaatcctcacc

SEQ ID NO: 1139840 - DNA, 17 bp, Homo sapiens
agttcaaatcctcacca

SEQ ID NO: 1139841 - DNA, 22 bp, Homo sapiens
agttcaaatcctcaccatccac

SEQ ID NO: 1139842 - DNA, 18 bp, Homo sapiens
agttcaaattcttctgaa

SEQ ID NO: 1139843 - DNA, 19 bp, Homo sapiens
agttcaagaaataagtttt

SEQ ID NO: 1139844 - DNA, 10 bp, Homo sapiens
agttcaatgc

SEQ ID NO: 1139845 - DNA, 15 bp, Homo sapiens
agttcaccttggaag

SEQ ID NO: 1139846 - DNA, 16 bp, Homo sapiens
agttcaccttggaagg

SEQ ID NO: 1139847 - DNA, 16 bp, Homo sapiens
agttcactataaatgg

SEQ ID NO: 1139848 - DNA, 15 bp, Homo sapiens
agttcagaatttagt

SEQ ID NO: 1139849 - DNA, 11 bp, Homo sapiens
agttcagatct

SEQ ID NO: 1139850 - DNA, 15 bp, Homo sapiens
agttcagcaccaccc

SEQ ID NO: 1139851 - DNA, 17 bp, Homo sapiens
agttcagcaccacccta

SEQ ID NO: 1139852 - DNA, 21 bp, Homo sapiens
agttcaggctctgagacacac

SEQ ID NO: 1139853 - DNA, 15 bp, Homo sapiens
agttcagttctgttt

SEQ ID NO: 1139854 - DNA, 16 bp, Homo sapiens
agttcatatatcaaga

SEQ ID NO: 1139855 - DNA, 19 bp, Homo sapiens
agttcatcaccatttcctc

SEQ ID NO: 1139856 - DNA, 20 bp, Homo sapiens
agttcatccaatcctcactg

SEQ ID NO: 1139857 - DNA, 17 bp, Homo sapiens
agttcatcgattttcta

SEQ ID NO: 1139858 - DNA, 22 bp, Homo sapiens
agttcatgcagctgtggcagag

SEQ ID NO: 1139859 - DNA, 20 bp, Homo sapiens
agttcatggggatctggggg

SEQ ID NO: 1139860 - DNA, 22 bp, Homo sapiens
agttcatggggatctggggggt

SEQ ID NO: 1139861 - DNA, 22 bp, Homo sapiens
agttcatgtatgttcagaagaa

SEQ ID NO: 1139862 - DNA, 17 bp, Homo sapiens
agttcatgtttgcttca

SEQ ID NO: 1139863 - DNA, 23 bp, Homo sapiens
agttcatgtttgcttcataaatg

SEQ ID NO: 1139864 - DNA, 16 bp, Homo sapiens
agttcattagaaatat

SEQ ID NO: 1139865 - DNA, 23 bp, Homo sapiens
agttcattagaaatattttaaaa

SEQ ID NO: 1139866 - DNA, 15 bp, Homo sapiens
agttccagaaagtaa

SEQ ID NO: 1139867 - DNA, 23 bp, Homo sapiens
agttccatcaggtcccccccagg

SEQ ID NO: 1139868 - DNA, 23 bp, Homo sapiens
agttcccaagaaaggaaaccttt

SEQ ID NO: 1139869 - DNA, 17 bp, Homo sapiens
agttcccacattaaaga

SEQ ID NO: 1139870 - DNA, 22 bp, Homo sapiens
agttcccacattaaagaagacc

SEQ ID NO: 1139871 - DNA, 18 bp, Homo sapiens
agttcccaccatctgatt

SEQ ID NO: 1139872 - DNA, 13 bp, Homo sapiens
agttcccagctcc

SEQ ID NO: 1139873 - DNA, 16 bp, Homo sapiens
agttcccagctccccc

SEQ ID NO: 1139874 - DNA, 23 bp, Homo sapiens
agttcccagctccccccgcccac

SEQ ID NO: 1139875 - DNA, 23 bp, Homo sapiens
agttcccatggtgtatgtggttt

SEQ ID NO: 1139876 - DNA, 15 bp, Homo sapiens
agttcccccagtacc

SEQ ID NO: 1139877 - DNA, 22 bp, Homo sapiens
agttcccccagtacctccaagc

SEQ ID NO: 1139878 - DNA, 18 bp, Homo sapiens
agtttaccatttgtaata

SEQ ID NO: 1139879 - DNA, 22 bp, Homo sapiens
agtttacctcatccatgcactt

SEQ ID NO: 1139880 - DNA, 16 bp, Homo sapiens
agtttactttgccaac

SEQ ID NO: 1139881 - DNA, 13 bp, Homo sapiens
agtttagaacaga

SEQ ID NO: 1139882 - DNA, 15 bp, Homo sapiens
agtttagaacagagg

SEQ ID NO: 1139883 - DNA, 21 bp, Homo sapiens
agtttagaggaaaaaaatgac

SEQ ID NO: 1139884 - DNA, 23 bp, Homo sapiens
agtttagatcccatgtcacctca

SEQ ID NO: 1139885 - DNA, 21 bp, Homo sapiens
agtttagtcgtctaaacataa

SEQ ID NO: 1139886 - DNA, 19 bp, Homo sapiens
agtttagtgtgtgtgcaga

SEQ ID NO: 1139887 - DNA, 17 bp, Homo sapiens
agtttatattgtggaat

SEQ ID NO: 1139888 - DNA, 15 bp, Homo sapiens
agtttatatttaact

SEQ ID NO: 1139889 - DNA, 14 bp, Homo sapiens
agtttatcattcaa

SEQ ID NO: 1139890 - DNA, 21 bp, Homo sapiens
agtttattacaatgtatcttt

SEQ ID NO: 1139891 - DNA, 13 bp, Homo sapiens
agtttattctgtg

SEQ ID NO: 1139892 - DNA, 23 bp, Homo sapiens
agtttattctgtggttctataat

SEQ ID NO: 1139893 - DNA, 22 bp, Homo sapiens
agtttattgacaataatttcag

SEQ ID NO: 1139894 - DNA, 13 bp, Homo sapiens
agtttatttccac

SEQ ID NO: 1139895 - DNA, 22 bp, Homo sapiens
agtttatttccactattttcaa

SEQ ID NO: 1139896 - DNA, 17 bp, Homo sapiens
agtttatttgagaaaat

SEQ ID NO: 1139897 - DNA, 19 bp, Homo sapiens
agtttatttgagaaaatat

SEQ ID NO: 1139898 - DNA, 21 bp, Homo sapiens
agtttcaaacttactattttg

SEQ ID NO: 1139899 - DNA, 14 bp, Homo sapiens
agtttcaaatctgt

SEQ ID NO: 1139900 - DNA, 16 bp, Homo sapiens
agtttcaaatctgtaa

SEQ ID NO: 1139901 - DNA, 12 bp, Homo sapiens
agtttcaatgtg

SEQ ID NO: 1139902 - DNA, 22 bp, Homo sapiens
agtttcacagaaaataaggcac

SEQ ID NO: 1139903 - DNA, 18 bp, Homo sapiens
agtttcaccactcctctc

SEQ ID NO: 1139904 - DNA, 22 bp, Homo sapiens
agtttcaccactcctctccctt

SEQ ID NO: 1139905 - DNA, 19 bp, Homo sapiens
agtttcacgtaaatattca

SEQ ID NO: 1139906 - DNA, 15 bp, Homo sapiens
agtttcactccctct

SEQ ID NO: 1139907 - DNA, 17 bp, Homo sapiens
agtttcactgtactgca

SEQ ID NO: 1139908 - DNA, 17 bp, Homo sapiens
agtttcagatatatatc

SEQ ID NO: 1139909 - DNA, 23 bp, Homo sapiens
agtttcagatatatatcatattg

SEQ ID NO: 1139910 - DNA, 22 bp, Homo sapiens
agtttcagtattagatgcactt

SEQ ID NO: 1139911 - DNA, 16 bp, Homo sapiens
agtttcagtttctgtt

SEQ ID NO: 1139912 - DNA, 16 bp, Homo sapiens
agtttcatcaggacca

SEQ ID NO: 1139913 - DNA, 21 bp, Homo sapiens
agtttcatgaaatgattggaa

SEQ ID NO: 1139914 - DNA, 16 bp, Homo sapiens
agtttcatgtaaagaa

SEQ ID NO: 1139915 - DNA, 19 bp, Homo sapiens
agtttcatgtatgtatata

SEQ ID NO: 1139916 - DNA, 17 bp, Homo sapiens
agtttcattctcctgcc

SEQ ID NO: 1139917 - DNA, 11 bp, Homo sapiens
agtttcccttc

SEQ ID NO: 1139918 - DNA, 16 bp, Homo sapiens
agtttcctcagaaccc

SEQ ID NO: 1139919 - DNA, 23 bp, Homo sapiens
agtttcctcagaacccacagtga

SEQ ID NO: 1139920 - DNA, 11 bp, Homo sapiens
agtttcctgga

SEQ ID NO: 1139921 - DNA, 12 bp, Homo sapiens
agtttccttttt

SEQ ID NO: 1139922 - DNA, 16 bp, Homo sapiens
agtttcctttttaata

SEQ ID NO: 1139923 - DNA, 18 bp, Homo sapiens
agtttcctttttaatatg

SEQ ID NO: 1139924 - DNA, 17 bp, Homo sapiens
agtttcgacttatttct

SEQ ID NO: 1139925 - DNA, 20 bp, Homo sapiens
agtttcgaggggtcctcacc

SEQ ID NO: 1139926 - DNA, 17 bp, Homo sapiens
agtttctagaggcctca

SEQ ID NO: 1139927 - DNA, 12 bp, Homo sapiens
agtttctatttt

SEQ ID NO: 1139928 - DNA, 16 bp, Homo sapiens
agtttctcagctccca

SEQ ID NO: 1139929 - DNA, 22 bp, Homo sapiens
agtttctcagggtcactgtcct

SEQ ID NO: 1139930 - DNA, 11 bp, Homo sapiens
agtttctctaa

SEQ ID NO: 1139931 - DNA, 15 bp, Homo sapiens
agtttctctgccttc

SEQ ID NO: 1139932 - DNA, 18 bp, Homo sapiens
agtttctgaatattttaa

SEQ ID NO: 1139933 - DNA, 16 bp, Homo sapiens
agtttctggccctggc

SEQ ID NO: 1139934 - DNA, 23 bp, Homo sapiens
agtttctgttctccctgggaagc

SEQ ID NO: 1139935 - DNA, 16 bp, Homo sapiens
agtttctgtttcaaag

SEQ ID NO: 1139936 - DNA, 18 bp, Homo sapiens
agtttctgtttgattctt

SEQ ID NO: 1139937 - DNA, 20 bp, Homo sapiens
aaggcccagccataaaagca

SEQ ID NO: 1139938 - DNA, 15 bp, Homo sapiens
aaggcccagccccta

SEQ ID NO: 1139939 - DNA, 22 bp, Homo sapiens
aaggcccagggaggcagcgtgg

SEQ ID NO: 1139940 - DNA, 20 bp, Homo sapiens
aaggcccatgcccccttcgc

SEQ ID NO: 1139941 - DNA, 14 bp, Homo sapiens
aaggccccagagac

SEQ ID NO: 1139942 - DNA, 16 bp, Homo sapiens
aaggccccagagagac

SEQ ID NO: 1139943 - DNA, 18 bp, Homo sapiens
aaggccccagggacagag

SEQ ID NO: 1139944 - DNA, 23 bp, Homo sapiens
aaggccccagggacagaggccaa

SEQ ID NO: 1139945 - DNA, 16 bp, Homo sapiens
aaggcccctgcaatgt

SEQ ID NO: 1139946 - DNA, 22 bp, Homo sapiens
aaggccctcggagctggctgtg

SEQ ID NO: 1139947 - DNA, 22 bp, Homo sapiens
aaggccctgctttttttcttaa

SEQ ID NO: 1139948 - DNA, 11 bp, Homo sapiens
aaggcccttgt

SEQ ID NO: 1139949 - DNA, 13 bp, Homo sapiens
aaggccctttcct

SEQ ID NO: 1139950 - DNA, 16 bp, Homo sapiens
aaggccgaagctctgg

SEQ ID NO: 1139951 - DNA, 16 bp, Homo sapiens
aaggccgagggccagg

SEQ ID NO: 1139952 - DNA, 17 bp, Homo sapiens
aaggccgagggccaggc

SEQ ID NO: 1139953 - DNA, 16 bp, Homo sapiens
aaggcctaaggaagcc

SEQ ID NO: 1139954 - DNA, 18 bp, Homo sapiens
aaggcctctcagacccag

SEQ ID NO: 1139955 - DNA, 21 bp, Homo sapiens
aaggcctcttgtaaagactgg

SEQ ID NO: 1139956 - DNA, 16 bp, Homo sapiens
aaggcctcttgtgctc

SEQ ID NO: 1139957 - DNA, 14 bp, Homo sapiens
aaggcctgccctcc

SEQ ID NO: 1139958 - DNA, 23 bp, Homo sapiens
aaggcctgggctggcctggcagt

SEQ ID NO: 1139959 - DNA, 17 bp, Homo sapiens
aaggccttcagacacat

SEQ ID NO: 1139960 - DNA, 15 bp, Homo sapiens
aaggccttccctgtc

SEQ ID NO: 1139961 - DNA, 15 bp, Homo sapiens
aaggccttctcctcc

SEQ ID NO: 1139962 - DNA, 19 bp, Homo sapiens
aaggccttgcctggcctga

SEQ ID NO: 1139963 - DNA, 21 bp, Homo sapiens
aaggccttggtggagcagcca

SEQ ID NO: 1139964 - DNA, 12 bp, Homo sapiens
aaggcctttctt

SEQ ID NO: 1139965 - DNA, 20 bp, Homo sapiens
aaggcgagtccaggagctca

SEQ ID NO: 1139966 - DNA, 22 bp, Homo sapiens
aaggcgcccccgccccaggctt

SEQ ID NO: 1139967 - DNA, 23 bp, Homo sapiens
aaggcgcccccgccccaggcttc

SEQ ID NO: 1139968 - DNA, 17 bp, Homo sapiens
aaggcgctgagactgtg

SEQ ID NO: 1139969 - DNA, 17 bp, Homo sapiens
aaggcgctgggtgcctg

SEQ ID NO: 1139970 - DNA, 18 bp, Homo sapiens
aaggcgggagcatctctt

SEQ ID NO: 1139971 - DNA, 15 bp, Homo sapiens
aaggcgggtggatca

SEQ ID NO: 1139972 - DNA, 17 bp, Homo sapiens
aaggctaaaaagcaaca

SEQ ID NO: 1139973 - DNA, 14 bp, Homo sapiens
aaggctacaggctc

SEQ ID NO: 1139974 - DNA, 15 bp, Homo sapiens
aaggctatgtaaaca

SEQ ID NO: 1139975 - DNA, 14 bp, Homo sapiens
aaggctcatttaaa

SEQ ID NO: 1139976 - DNA, 14 bp, Homo sapiens
aaggctccccaccc

SEQ ID NO: 1139977 - DNA, 23 bp, Homo sapiens
aaggctcgattttgtatctgcag

SEQ ID NO: 1139978 - DNA, 12 bp, Homo sapiens
aaggctctgtca

SEQ ID NO: 1139979 - DNA, 18 bp, Homo sapiens
aaggctctgtcactccag

SEQ ID NO: 1139980 - DNA, 21 bp, Homo sapiens
aaggctctgttatcagctggg

SEQ ID NO: 1139981 - DNA, 17 bp, Homo sapiens
aaggctgaactcttcag

SEQ ID NO: 1139982 - DNA, 16 bp, Homo sapiens
aaggctgatgtcaatt

SEQ ID NO: 1139983 - DNA, 12 bp, Homo sapiens
aaggctgcccct

SEQ ID NO: 1139984 - DNA, 19 bp, Homo sapiens
aaggctgcccctgtaaggt

SEQ ID NO: 1139985 - DNA, 23 bp, Homo sapiens
aaggctgctcacaagttctattt

SEQ ID NO: 1139986 - DNA, 12 bp, Homo sapiens
aaggctgctggc

SEQ ID NO: 1139987 - DNA, 22 bp, Homo sapiens
aaggctgctggcttcagggagg

SEQ ID NO: 1139988 - DNA, 23 bp, Homo sapiens
aaggctgctggcttcagggaggg

SEQ ID NO: 1139989 - DNA, 20 bp, Homo sapiens
aaggctggccagcaaggcag

SEQ ID NO: 1139990 - DNA, 12 bp, Homo sapiens
aaggctggctga

SEQ ID NO: 1139991 - DNA, 13 bp, Homo sapiens
aaggctggggcat

SEQ ID NO: 1139992 - DNA, 15 bp, Homo sapiens
aaggctggggcatgg

SEQ ID NO: 1139993 - DNA, 16 bp, Homo sapiens
aaggcttaagaactgc

SEQ ID NO: 1139994 - DNA, 15 bp, Homo sapiens
aaggcttcactctta

SEQ ID NO: 1139995 - DNA, 18 bp, Homo sapiens
aaggcttctctctgtggg

SEQ ID NO: 1139996 - DNA, 19 bp, Homo sapiens
aaggcttgggatttgctgt

SEQ ID NO: 1139997 - DNA, 16 bp, Homo sapiens
aaggctttaaagctga

SEQ ID NO: 1139998 - DNA, 15 bp, Homo sapiens
aaggctttatctcag

SEQ ID NO: 1139999 - DNA, 22 bp, Homo sapiens
aaggcttttggtctccctggga

SEQ ID NO: 1140000 - DNA, 16 bp, Homo sapiens
ataaaaaggaaattag

SEQ ID NO: 1140001 - DNA, 18 bp, Homo sapiens
ataaaaaggaaattagtc

SEQ ID NO: 1140002 - DNA, 23 bp, Homo sapiens
ataaaaaggaagtggggacagat

SEQ ID NO: 1140003 - DNA, 17 bp, Homo sapiens
ataaaaagtcacaatga

SEQ ID NO: 1140004 - DNA, 15 bp, Homo sapiens
ataaaaagtgaactt

SEQ ID NO: 1140005 - DNA, 21 bp, Homo sapiens
ataaaaagtgaacttttgtaa

SEQ ID NO: 1140006 - DNA, 13 bp, Homo sapiens
ataaaaagtttca

SEQ ID NO: 1140007 - DNA, 22 bp, Homo sapiens
ataaaaataaatttggttctaa

SEQ ID NO: 1140008 - DNA, 12 bp, Homo sapiens
ataaaaataata

SEQ ID NO: 1140009 - DNA, 13 bp, Homo sapiens
ataaaaatataaa

SEQ ID NO: 1140010 - DNA, 12 bp, Homo sapiens
ataaaaatatat

SEQ ID NO: 1140011 - DNA, 13 bp, Homo sapiens
ataaaaatatata

SEQ ID NO: 1140012 - DNA, 16 bp, Homo sapiens
ataaaaatatgtacaa

SEQ ID NO: 1140013 - DNA, 16 bp, Homo sapiens
ataaaaatgatctaaa

SEQ ID NO: 1140014 - DNA, 15 bp, Homo sapiens
ataaaaattatcaaa

SEQ ID NO: 1140015 - DNA, 14 bp, Homo sapiens
ataaaaattctgaa

SEQ ID NO: 1140016 - DNA, 16 bp, Homo sapiens
ataaaacaactctgat

SEQ ID NO: 1140017 - DNA, 17 bp, Homo sapiens
ataaaacaagccttaat

SEQ ID NO: 1140018 - DNA, 14 bp, Homo sapiens
ataaaacacacctc

SEQ ID NO: 1140019 - DNA, 14 bp, Homo sapiens
ataaaacagaatct

SEQ ID NO: 1140020 - DNA, 12 bp, Homo sapiens
ataaaacaggta

SEQ ID NO: 1140021 - DNA, 13 bp, Homo sapiens
ataaaacagtcat

SEQ ID NO: 1140022 - DNA, 21 bp, Homo sapiens
ataaaacagtcatggcctgag

SEQ ID NO: 1140023 - DNA, 15 bp, Homo sapiens
ataaaacctttcaaa

SEQ ID NO: 1140024 - DNA, 21 bp, Homo sapiens
ataaaacctttcaaatttcac

SEQ ID NO: 1140025 - DNA, 19 bp, Homo sapiens
ataaaactcagttaaaatg

SEQ ID NO: 1140026 - DNA, 12 bp, Homo sapiens
ataaaactgaaa

SEQ ID NO: 1140027 - DNA, 14 bp, Homo sapiens
ataaaactgaaata

SEQ ID NO: 1140028 - DNA, 16 bp, Homo sapiens
ataaaactgaaataaa

SEQ ID NO: 1140029 - DNA, 18 bp, Homo sapiens
ataaaactgaaataaacc

SEQ ID NO: 1140030 - DNA, 13 bp, Homo sapiens
ataaaactgcaca

SEQ ID NO: 1140031 - DNA, 15 bp, Homo sapiens
ataaaactggctttg

SEQ ID NO: 1140032 - DNA, 15 bp, Homo sapiens
ataaaactgtgacta

SEQ ID NO: 1140033 - DNA, 17 bp, Homo sapiens
ataaaactgtgtaaacc

SEQ ID NO: 1140034 - DNA, 19 bp, Homo sapiens
ataaaactttaaaaggcaa

SEQ ID NO: 1140035 - DNA, 17 bp, Homo sapiens
ataaaactttgctgcca

SEQ ID NO: 1140036 - DNA, 12 bp, Homo sapiens
ataaaagacaca

SEQ ID NO: 1140037 - DNA, 15 bp, Homo sapiens
ataaaagcataaatg

SEQ ID NO: 1140038 - DNA, 18 bp, Homo sapiens
ataaaagcataaatgcaa

SEQ ID NO: 1140039 - DNA, 20 bp, Homo sapiens
ataaaagcataaatgcaaac

SEQ ID NO: 1140040 - DNA, 15 bp, Homo sapiens
ataaaagcattgtct

SEQ ID NO: 1140041 - DNA, 14 bp, Homo sapiens
ataaaagctataaa

SEQ ID NO: 1140042 - DNA, 20 bp, Homo sapiens
ataaaagctataaagtatat

SEQ ID NO: 1140043 - DNA, 19 bp, Homo sapiens
ataaaagctcagatgacat

SEQ ID NO: 1140044 - DNA, 22 bp, Homo sapiens
ataaaagctgaagttactttat

SEQ ID NO: 1140045 - DNA, 16 bp, Homo sapiens
ataaaaggatgttaca

SEQ ID NO: 1140046 - DNA, 19 bp, Homo sapiens
ataaaaggatgttacaagt

SEQ ID NO: 1140047 - DNA, 19 bp, Homo sapiens
ataaaaggcaaatgtgtac

SEQ ID NO: 1140048 - DNA, 23 bp, Homo sapiens
ataaaaggtttctttttttttcc

SEQ ID NO: 1140049 - DNA, 16 bp, Homo sapiens
ataaaagttttctcca

SEQ ID NO: 1140050 - DNA, 17 bp, Homo sapiens
ataaaataaacttctta

SEQ ID NO: 1140051 - DNA, 13 bp, Homo sapiens
ataaaataaagta

SEQ ID NO: 1140052 - DNA, 16 bp, Homo sapiens
ataaaataaagtatat

SEQ ID NO: 1140053 - DNA, 16 bp, Homo sapiens
ataaaataaataattt

SEQ ID NO: 1140054 - DNA, 13 bp, Homo sapiens
ataaaataaatat

SEQ ID NO: 1140055 - DNA, 16 bp, Homo sapiens
ataaaataaatatata

SEQ ID NO: 1140056 - DNA, 13 bp, Homo sapiens
ataaaataactaa

SEQ ID NO: 1140057 - DNA, 17 bp, Homo sapiens
ataaaataactaaaatg

SEQ ID NO: 1140058 - DNA, 23 bp, Homo sapiens
ataaaataatgggattttctttt

SEQ ID NO: 1140059 - DNA, 19 bp, Homo sapiens
ataaaatagaataattctt

SEQ ID NO: 1140060 - DNA, 21 bp, Homo sapiens
ataaaatagaataattctttt

SEQ ID NO: 1140061 - DNA, 18 bp, Homo sapiens
ataaaatagtatgaaaat

SEQ ID NO: 1140062 - DNA, 14 bp, Homo sapiens
ataaaatatcataa

SEQ ID NO: 1140063 - DNA, 21 bp, Homo sapiens
ataaaatatgaagacataaac

SEQ ID NO: 1140064 - DNA, 16 bp, Homo sapiens
ataaaatattattgaa

SEQ ID NO: 1140065 - DNA, 18 bp, Homo sapiens
ataaaatattattgaact

SEQ ID NO: 1140066 - DNA, 20 bp, Homo sapiens
ataaaatcctaagacacaaa

SEQ ID NO: 1140067 - DNA, 16 bp, Homo sapiens
ataaaatgaaaattgt

SEQ ID NO: 1140068 - DNA, 17 bp, Homo sapiens
ataaaatgaaaattgta

SEQ ID NO: 1140069 - DNA, 14 bp, Homo sapiens
ataaaatgaacatc

SEQ ID NO: 1140070 - DNA, 17 bp, Homo sapiens
aaggtggggagaagctg

SEQ ID NO: 1140071 - DNA, 18 bp, Homo sapiens
aaggtggggccctgcccc

SEQ ID NO: 1140072 - DNA, 23 bp, Homo sapiens
aaggtggggtatttaccacagca

SEQ ID NO: 1140073 - DNA, 20 bp, Homo sapiens
aaggtggtggggctgccgga

SEQ ID NO: 1140074 - DNA, 17 bp, Homo sapiens
aaggtgtaactctaatt

SEQ ID NO: 1140075 - DNA, 12 bp, Homo sapiens
aaggtgtattta

SEQ ID NO: 1140076 - DNA, 15 bp, Homo sapiens
aaggtgtccagggtc

SEQ ID NO: 1140077 - DNA, 18 bp, Homo sapiens
aaggtgtgctagaacaag

SEQ ID NO: 1140078 - DNA, 22 bp, Homo sapiens
aaggtgtgtccttgaactgagg

SEQ ID NO: 1140079 - DNA, 22 bp, Homo sapiens
aaggtgttcattcacttgcatt

SEQ ID NO: 1140080 - DNA, 18 bp, Homo sapiens
aaggtgtttatttttaac

SEQ ID NO: 1140081 - DNA, 18 bp, Homo sapiens
aaggttaccaagaagcct

SEQ ID NO: 1140082 - DNA, 18 bp, Homo sapiens
aaggttactcagcagcag

SEQ ID NO: 1140083 - DNA, 18 bp, Homo sapiens
aaggttaggatttaacag

SEQ ID NO: 1140084 - DNA, 18 bp, Homo sapiens
aaggttatcagtgcttcc

SEQ ID NO: 1140085 - DNA, 17 bp, Homo sapiens
aaggttcactaaagcag

SEQ ID NO: 1140086 - DNA, 18 bp, Homo sapiens
aaggttccaactgtatat

SEQ ID NO: 1140087 - DNA, 19 bp, Homo sapiens
aaggttccaactgtatata

SEQ ID NO: 1140088 - DNA, 21 bp, Homo sapiens
aaggttctcaggtgttgccaa

SEQ ID NO: 1140089 - DNA, 17 bp, Homo sapiens
aaggttctcataggaaa

SEQ ID NO: 1140090 - DNA, 21 bp, Homo sapiens
aaggttcttcccttttacata

SEQ ID NO: 1140091 - DNA, 13 bp, Homo sapiens
aaggttgaataat

SEQ ID NO: 1140092 - DNA, 14 bp, Homo sapiens
aaggttggatggat

SEQ ID NO: 1140093 - DNA, 16 bp, Homo sapiens
aaggttggttgctaag

SEQ ID NO: 1140094 - DNA, 19 bp, Homo sapiens
aaggtttaaagtttgaaga

SEQ ID NO: 1140095 - DNA, 21 bp, Homo sapiens
aaggtttaggctggtggccca

SEQ ID NO: 1140096 - DNA, 22 bp, Homo sapiens
aaggtttaggctggtggcccag

SEQ ID NO: 1140097 - DNA, 16 bp, Homo sapiens
aaggtttataaagcag

SEQ ID NO: 1140098 - DNA, 22 bp, Homo sapiens
aaggtttcgtttctgtatacaa

SEQ ID NO: 1140099 - DNA, 19 bp, Homo sapiens
aaggtttggaaggagcaga

SEQ ID NO: 1140100 - DNA, 13 bp, Homo sapiens
aaggtttggtgtg

SEQ ID NO: 1140101 - DNA, 15 bp, Homo sapiens
aaggttttcatttgc

SEQ ID NO: 1140102 - DNA, 23 bp, Homo sapiens
aaggttttgtattttttaaaaca

SEQ ID NO: 1140103 - DNA, 23 bp, Homo sapiens
aaggttttgttgtgttctgttga

SEQ ID NO: 1140104 - DNA, 13 bp, Homo sapiens
aagtaaaaaaaca

SEQ ID NO: 1140105 - DNA, 13 bp, Homo sapiens
aagtaaaaacact

SEQ ID NO: 1140106 - DNA, 16 bp, Homo sapiens
aagtaaaaattgaact

SEQ ID NO: 1140107 - DNA, 13 bp, Homo sapiens
aagtaaaagcaaa

SEQ ID NO: 1140108 - DNA, 18 bp, Homo sapiens
aagtaaaatgaacatttt

SEQ ID NO: 1140109 - DNA, 12 bp, Homo sapiens
aagtaaactttt

SEQ ID NO: 1140110 - DNA, 21 bp, Homo sapiens
aagtaaagctaaaatgatttt

SEQ ID NO: 1140111 - DNA, 19 bp, Homo sapiens
aagtaaagtgatgtttgtg

SEQ ID NO: 1140112 - DNA, 12 bp, Homo sapiens
aagtaaatacaa

SEQ ID NO: 1140113 - DNA, 14 bp, Homo sapiens
aagtaaatctgaga

SEQ ID NO: 1140114 - DNA, 14 bp, Homo sapiens
aagtaaattatgta

SEQ ID NO: 1140115 - DNA, 19 bp, Homo sapiens
aagtaacaatctatggctt

SEQ ID NO: 1140116 - DNA, 12 bp, Homo sapiens
aagtaacacttt

SEQ ID NO: 1140117 - DNA, 23 bp, Homo sapiens
aagtaactcttacctaaactgag

SEQ ID NO: 1140118 - DNA, 23 bp, Homo sapiens
aagtaactgggattacaggcatg

SEQ ID NO: 1140119 - DNA, 14 bp, Homo sapiens
aagtaacttaagga

SEQ ID NO: 1140120 - DNA, 21 bp, Homo sapiens
aagtaacttttaaaatttgtc

SEQ ID NO: 1140121 - DNA, 13 bp, Homo sapiens
aagtaagaaaata

SEQ ID NO: 1140122 - DNA, 16 bp, Homo sapiens
aagtaagaaaatattt

SEQ ID NO: 1140123 - DNA, 15 bp, Homo sapiens
ataaatgaatgtcac

SEQ ID NO: 1140124 - DNA, 16 bp, Homo sapiens
ataaatgaattttagt

SEQ ID NO: 1140125 - DNA, 15 bp, Homo sapiens
ataaatgacacccag

SEQ ID NO: 1140126 - DNA, 12 bp, Homo sapiens
ataaatgagcaa

SEQ ID NO: 1140127 - DNA, 15 bp, Homo sapiens
ataaatgattatatt

SEQ ID NO: 1140128 - DNA, 16 bp, Homo sapiens
ataaatgattcttagt

SEQ ID NO: 1140129 - DNA, 24 bp, Homo sapiens
ataaatggccagtgctgcttcttg

SEQ ID NO: 1140130 - DNA, 21 bp, Homo sapiens
ataaatggtttggtgcttttt

SEQ ID NO: 1140131 - DNA, 21 bp, Homo sapiens
ataaatgtaaaaatgaaggaa

SEQ ID NO: 1140132 - DNA, 15 bp, Homo sapiens
ataaatgtcactgcc

SEQ ID NO: 1140133 - DNA, 20 bp, Homo sapiens
ataaatgtgtgtatgtgtgt

SEQ ID NO: 1140134 - DNA, 13 bp, Homo sapiens
ataaatgtgttcc

SEQ ID NO: 1140135 - DNA, 15 bp, Homo sapiens
ataaatgtgtttata

SEQ ID NO: 1140136 - DNA, 20 bp, Homo sapiens
ataaatgtttaaatataaat

SEQ ID NO: 1140137 - DNA, 11 bp, Homo sapiens
ataaattaaat

SEQ ID NO: 1140138 - DNA, 12 bp, Homo sapiens
ataaattaaata

SEQ ID NO: 1140139 - DNA, 16 bp, Homo sapiens
ataaattaaataaact

SEQ ID NO: 1140140 - DNA, 17 bp, Homo sapiens
ataaattaagttactgg

SEQ ID NO: 1140141 - DNA, 13 bp, Homo sapiens
ataaattacacaa

SEQ ID NO: 1140142 - DNA, 13 bp, Homo sapiens
ataaattacagtc

SEQ ID NO: 1140143 - DNA, 13 bp, Homo sapiens
ataaattataagt

SEQ ID NO: 1140144 - DNA, 14 bp, Homo sapiens
ataaattatcttat

SEQ ID NO: 1140145 - DNA, 15 bp, Homo sapiens
ataaattatggcatt

SEQ ID NO: 1140146 - DNA, 14 bp, Homo sapiens
ataaattattcaga

SEQ ID NO: 1140147 - DNA, 19 bp, Homo sapiens
ataaattatttgattattt

SEQ ID NO: 1140148 - DNA, 12 bp, Homo sapiens
ataaattcagat

SEQ ID NO: 1140149 - DNA, 15 bp, Homo sapiens
ataaattccactgga

SEQ ID NO: 1140150 - DNA, 19 bp, Homo sapiens
ataaattccagaggactct

SEQ ID NO: 1140151 - DNA, 13 bp, Homo sapiens
ataaattgctcaa

SEQ ID NO: 1140152 - DNA, 14 bp, Homo sapiens
ataaattgtacatt

SEQ ID NO: 1140153 - DNA, 16 bp, Homo sapiens
ataaattgtacatttt

SEQ ID NO: 1140154 - DNA, 23 bp, Homo sapiens
ataaattgtacattttgtaaaat

SEQ ID NO: 1140155 - DNA, 14 bp, Homo sapiens
ataaattgtttagt

SEQ ID NO: 1140156 - DNA, 22 bp, Homo sapiens
ataaattgtttagtggaaaata

SEQ ID NO: 1140157 - DNA, 14 bp, Homo sapiens
ataaatttatttac

SEQ ID NO: 1140158 - DNA, 13 bp, Homo sapiens
ataaatttcccag

SEQ ID NO: 1140159 - DNA, 12 bp, Homo sapiens
ataaatttctgg

SEQ ID NO: 1140160 - DNA, 14 bp, Homo sapiens
ataaatttgttgaa

SEQ ID NO: 1140161 - DNA, 17 bp, Homo sapiens
ataaattttcaaatcct

SEQ ID NO: 1140162 - DNA, 18 bp, Homo sapiens
ataacaaatttttcaaat

SEQ ID NO: 1140163 - DNA, 17 bp, Homo sapiens
ataacaagaagcccagt

SEQ ID NO: 1140164 - DNA, 13 bp, Homo sapiens
ataacaagagttt

SEQ ID NO: 1140165 - DNA, 17 bp, Homo sapiens
ataacaagatctttcag

SEQ ID NO: 1140166 - DNA, 17 bp, Homo sapiens
ataacaaggagatttct

SEQ ID NO: 1140167 - DNA, 19 bp, Homo sapiens
ataacaaggagatttctta

SEQ ID NO: 1140168 - DNA, 14 bp, Homo sapiens
ataacaattcctct

SEQ ID NO: 1140169 - DNA, 15 bp, Homo sapiens
ataacaattgtttgg

SEQ ID NO: 1140170 - DNA, 14 bp, Homo sapiens
ataacacaatatga

SEQ ID NO: 1140171 - DNA, 14 bp, Homo sapiens
ataacacagagaga

SEQ ID NO: 1140172 - DNA, 23 bp, Homo sapiens
ataacacagatattgttataaat

SEQ ID NO: 1140173 - DNA, 23 bp, Homo sapiens
ataacactataaaggttgacaat

SEQ ID NO: 1140174 - DNA, 14 bp, Homo sapiens
ataacacttaactt

SEQ ID NO: 1140175 - DNA, 23 bp, Homo sapiens
ataacagaaagcctgggtgacat

SEQ ID NO: 1140176 - DNA, 17 bp, Homo sapiens
ataacagaagaaaatag

SEQ ID NO: 1140177 - DNA, 21 bp, Homo sapiens
ataacagctgcaattccctgg

SEQ ID NO: 1140178 - DNA, 16 bp, Homo sapiens
ataacagtaaatgtgc

SEQ ID NO: 1140179 - DNA, 21 bp, Homo sapiens
ataacagtgtctttctagcca

SEQ ID NO: 1140180 - DNA, 18 bp, Homo sapiens
ataacagttatatttttg

SEQ ID NO: 1140181 - DNA, 14 bp, Homo sapiens
ataacatctttatt

SEQ ID NO: 1140182 - DNA, 13 bp, Homo sapiens
ataacatgtaaaa

SEQ ID NO: 1140183 - DNA, 18 bp, Homo sapiens
ataacatgtaattaagta

SEQ ID NO: 1140184 - DNA, 15 bp, Homo sapiens
ataacattcagttcc

SEQ ID NO: 1140185 - DNA, 14 bp, Homo sapiens
ataacattctgaat

SEQ ID NO: 1140186 - DNA, 22 bp, Homo sapiens
ataaccaacattaaaactcata

SEQ ID NO: 1140187 - DNA, 19 bp, Homo sapiens
ataaccagctgtaacacag

SEQ ID NO: 1140188 - DNA, 14 bp, Homo sapiens
ataaccctgccagt

SEQ ID NO: 1140189 - DNA, 15 bp, Homo sapiens
ataaccctgccagtg

SEQ ID NO: 1140190 - DNA, 15 bp, Homo sapiens
ataacctagttaaag

SEQ ID NO: 1140191 - DNA, 20 bp, Homo sapiens
ataacctctggcccttggaa

SEQ ID NO: 1140192 - DNA, 13 bp, Homo sapiens
ataacgccccaga

SEQ ID NO: 1140193 - DNA, 21 bp, Homo sapiens
ataacggaaaaataattgcca

SEQ ID NO: 1140194 - DNA, 18 bp, Homo sapiens
ataacgtgttcaatattt

SEQ ID NO: 1140195 - DNA, 18 bp, Homo sapiens
ataacgtttaagccaaaa

SEQ ID NO: 1140196 - DNA, 20 bp, Homo sapiens
ataacgtttaagccaaaaca

SEQ ID NO: 1140197 - DNA, 14 bp, Homo sapiens
ataactaaataaag

SEQ ID NO: 1140198 - DNA, 10 bp, Homo sapiens
ataactaagg

SEQ ID NO: 1140199 - DNA, 18 bp, Homo sapiens
ataactactgtgttcctg

SEQ ID NO: 1140200 - DNA, 21 bp, Homo sapiens
ataactagacatctgctgtta

SEQ ID NO: 1140201 - DNA, 19 bp, Homo sapiens
ataactagtgttgcttgga

SEQ ID NO: 1140202 - DNA, 18 bp, Homo sapiens
ataactcatcataaaata

SEQ ID NO: 1140203 - DNA, 14 bp, Homo sapiens
aagtctattcaaaa

SEQ ID NO: 1140204 - DNA, 12 bp, Homo sapiens
aagtctcagcta

SEQ ID NO: 1140205 - DNA, 21 bp, Homo sapiens
aagtctcataggttaaaaaaa

SEQ ID NO: 1140206 - DNA, 16 bp, Homo sapiens
aagtctccatgaagag

SEQ ID NO: 1140207 - DNA, 14 bp, Homo sapiens
aagtctccttcccc

SEQ ID NO: 1140208 - DNA, 18 bp, Homo sapiens
aagtctcgaatgtaattg

SEQ ID NO: 1140209 - DNA, 13 bp, Homo sapiens
aagtctctctgtg

SEQ ID NO: 1140210 - DNA, 18 bp, Homo sapiens
aagtctctctgtgaatac

SEQ ID NO: 1140211 - DNA, 23 bp, Homo sapiens
aagtctctctgtgaatacaatta

SEQ ID NO: 1140212 - DNA, 16 bp, Homo sapiens
aagtctctgctggccc

SEQ ID NO: 1140213 - DNA, 15 bp, Homo sapiens
aagtctctttttctt

SEQ ID NO: 1140214 - DNA, 24 bp, Homo sapiens
aagtctgaaaatagaacttgcctt

SEQ ID NO: 1140215 - DNA, 19 bp, Homo sapiens
aagtctggacaaatgtata

SEQ ID NO: 1140216 - DNA, 21 bp, Homo sapiens
aagtctgtccttgaaggacta

SEQ ID NO: 1140217 - DNA, 22 bp, Homo sapiens
aagtctgtgtgatgaactttct

SEQ ID NO: 1140218 - DNA, 20 bp, Homo sapiens
aagtctgttgattaaagatg

SEQ ID NO: 1140219 - DNA, 18 bp, Homo sapiens
aagtcttagatgtatata

SEQ ID NO: 1140220 - DNA, 20 bp, Homo sapiens
aagtcttcactctctgaaga

SEQ ID NO: 1140221 - DNA, 12 bp, Homo sapiens
aagtcttcaggg

SEQ ID NO: 1140222 - DNA, 15 bp, Homo sapiens
aagtcttccctcaga

SEQ ID NO: 1140223 - DNA, 22 bp, Homo sapiens
aagtcttccctgatcaagtcac

SEQ ID NO: 1140224 - DNA, 14 bp, Homo sapiens
aagtcttccttaaa

SEQ ID NO: 1140225 - DNA, 13 bp, Homo sapiens
aagtctttcagat

SEQ ID NO: 1140226 - DNA, 18 bp, Homo sapiens
aagtctttcagtggaatt

SEQ ID NO: 1140227 - DNA, 14 bp, Homo sapiens
aagtctttcttctt

SEQ ID NO: 1140228 - DNA, 14 bp, Homo sapiens
aagtcttttctgtc

SEQ ID NO: 1140229 - DNA, 21 bp, Homo sapiens
aagtcttttttttttccaaat

SEQ ID NO: 1140230 - DNA, 15 bp, Homo sapiens
aagtgaaaaaaagaa

SEQ ID NO: 1140231 - DNA, 22 bp, Homo sapiens
aagtgaaaaaaagaaacgaaaa

SEQ ID NO: 1140232 - DNA, 12 bp, Homo sapiens
aagtgaaaactt

SEQ ID NO: 1140233 - DNA, 12 bp, Homo sapiens
aagtgaaaatat

SEQ ID NO: 1140234 - DNA, 14 bp, Homo sapiens
aagtgaaaatggtc

SEQ ID NO: 1140235 - DNA, 16 bp, Homo sapiens
aagtgaaatcaaaggt

SEQ ID NO: 1140236 - DNA, 12 bp, Homo sapiens
aagtgaaggaaa

SEQ ID NO: 1140237 - DNA, 21 bp, Homo sapiens
aagtgaaggttcccaaggaca

SEQ ID NO: 1140238 - DNA, 17 bp, Homo sapiens
aagtgaaggtttacaat

SEQ ID NO: 1140239 - DNA, 22 bp, Homo sapiens
aagtgaatacattttataattt

SEQ ID NO: 1140240 - DNA, 18 bp, Homo sapiens
aagtgaatctgattgcac

SEQ ID NO: 1140241 - DNA, 22 bp, Homo sapiens
aagtgaatctttctcctggtga

SEQ ID NO: 1140242 - DNA, 16 bp, Homo sapiens
aagtgaatttatgaga

SEQ ID NO: 1140243 - DNA, 23 bp, Homo sapiens
aagtgaatttgaatgaaaaattt

SEQ ID NO: 1140244 - DNA, 14 bp, Homo sapiens
aagtgaatttttct

SEQ ID NO: 1140245 - DNA, 19 bp, Homo sapiens
aagtgaatttttctctaac

SEQ ID NO: 1140246 - DNA, 15 bp, Homo sapiens
ataataaaaattgta

SEQ ID NO: 1140247 - DNA, 12 bp, Homo sapiens
ataataaaatca

SEQ ID NO: 1140248 - DNA, 11 bp, Homo sapiens
ataataaaatg

SEQ ID NO: 1140249 - DNA, 12 bp, Homo sapiens
ataataaaatgc

SEQ ID NO: 1140250 - DNA, 13 bp, Homo sapiens
ataataaaatgca

SEQ ID NO: 1140251 - DNA, 14 bp, Homo sapiens
ataataaaatgcaa

SEQ ID NO: 1140252 - DNA, 18 bp, Homo sapiens
ataataaaatgcaaatga

SEQ ID NO: 1140253 - DNA, 22 bp, Homo sapiens
ataataaaatgcaaatgaatca

SEQ ID NO: 1140254 - DNA, 12 bp, Homo sapiens
ataataaacttt

SEQ ID NO: 1140255 - DNA, 21 bp, Homo sapiens
ataataaagtagcaaaacaaa

SEQ ID NO: 1140256 - DNA, 22 bp, Homo sapiens
ataataaagtattccaccttaa

SEQ ID NO: 1140257 - DNA, 23 bp, Homo sapiens
ataataaagtattccaccttaaa

SEQ ID NO: 1140258 - DNA, 12 bp, Homo sapiens
ataataaatagt

SEQ ID NO: 1140259 - DNA, 13 bp, Homo sapiens
ataataaatagtt

SEQ ID NO: 1140260 - DNA, 18 bp, Homo sapiens
ataataaattaaacatgc

SEQ ID NO: 1140261 - DNA, 18 bp, Homo sapiens
ataataaattgatttgtt

SEQ ID NO: 1140262 - DNA, 17 bp, Homo sapiens
ataataactgaactgtt

SEQ ID NO: 1140263 - DNA, 14 bp, Homo sapiens
ataataagttttga

SEQ ID NO: 1140264 - DNA, 15 bp, Homo sapiens
ataataagttttgat

SEQ ID NO: 1140265 - DNA, 16 bp, Homo sapiens
ataataagttttgata

SEQ ID NO: 1140266 - DNA, 20 bp, Homo sapiens
ataataagttttgatataat

SEQ ID NO: 1140267 - DNA, 14 bp, Homo sapiens
ataataataaagtg

SEQ ID NO: 1140268 - DNA, 14 bp, Homo sapiens
ataataatgggttt

SEQ ID NO: 1140269 - DNA, 18 bp, Homo sapiens
ataatacaccactacatt

SEQ ID NO: 1140270 - DNA, 18 bp, Homo sapiens
ataatacagaatcttgtt

SEQ ID NO: 1140271 - DNA, 19 bp, Homo sapiens
ataatacagtatctcaggg

SEQ ID NO: 1140272 - DNA, 15 bp, Homo sapiens
ataatactaaaactc

SEQ ID NO: 1140273 - DNA, 22 bp, Homo sapiens
ataatactatatttatactgta

SEQ ID NO: 1140274 - DNA, 23 bp, Homo sapiens
ataatacttgcaactaaggacaa

SEQ ID NO: 1140275 - DNA, 14 bp, Homo sapiens
ataatactttgtat

SEQ ID NO: 1140276 - DNA, 17 bp, Homo sapiens
ataatactttgtataca

SEQ ID NO: 1140277 - DNA, 21 bp, Homo sapiens
ataatactttgtatacaagta

SEQ ID NO: 1140278 - DNA, 14 bp, Homo sapiens
ataatagatgatgg

SEQ ID NO: 1140279 - DNA, 12 bp, Homo sapiens
ataataggaatt

SEQ ID NO: 1140280 - DNA, 13 bp, Homo sapiens
ataataggaattc

SEQ ID NO: 1140281 - DNA, 17 bp, Homo sapiens
ataataggtagcctgct

SEQ ID NO: 1140282 - DNA, 18 bp, Homo sapiens
ataataggtagcctgctg

SEQ ID NO: 1140283 - DNA, 23 bp, Homo sapiens
ataataggtagggggctttcact

SEQ ID NO: 1140284 - DNA, 14 bp, Homo sapiens
ataatatcaaataa

SEQ ID NO: 1140285 - DNA, 19 bp, Homo sapiens
ataatatctaaagttatat

SEQ ID NO: 1140286 - DNA, 14 bp, Homo sapiens
ataatatgaagcct

SEQ ID NO: 1140287 - DNA, 16 bp, Homo sapiens
ataatatgaagccttt

SEQ ID NO: 1140288 - DNA, 17 bp, Homo sapiens
ataatatggctatgctt

SEQ ID NO: 1140289 - DNA, 14 bp, Homo sapiens
ataatattagtgat

SEQ ID NO: 1140290 - DNA, 12 bp, Homo sapiens
ataatattgaaa

SEQ ID NO: 1140291 - DNA, 16 bp, Homo sapiens
ataatattgaaaattg

SEQ ID NO: 1140292 - DNA, 16 bp, Homo sapiens
ataatatttactgtta

SEQ ID NO: 1140293 - DNA, 15 bp, Homo sapiens
ataatatttctgaaa

SEQ ID NO: 1140294 - DNA, 12 bp, Homo sapiens
ataatatttctt

SEQ ID NO: 1140295 - DNA, 14 bp, Homo sapiens
ataatatttcttaa

SEQ ID NO: 1140296 - DNA, 22 bp, Homo sapiens
ataatatttcttaatttggata

SEQ ID NO: 1140297 - DNA, 19 bp, Homo sapiens
ataatattttacatacact

SEQ ID NO: 1140298 - DNA, 19 bp, Homo sapiens
ataatatttttgtatttct

SEQ ID NO: 1140299 - DNA, 20 bp, Homo sapiens
ataatatttttgtatttctc

SEQ ID NO: 1140300 - DNA, 21 bp, Homo sapiens
ataatatttttgtatttctct

SEQ ID NO: 1140301 - DNA, 13 bp, Homo sapiens
ataatcaagattt

SEQ ID NO: 1140302 - DNA, 18 bp, Homo sapiens
ataatcacgctttcctga

SEQ ID NO: 1140303 - DNA, 22 bp, Homo sapiens
ataatcactctaattaattgta

SEQ ID NO: 1140304 - DNA, 19 bp, Homo sapiens
ataatcagaatggaagaga

SEQ ID NO: 1140305 - DNA, 21 bp, Homo sapiens
ataatcagcaagaatttgatc

SEQ ID NO: 1140306 - DNA, 17 bp, Homo sapiens
ataatcagcctcttaaa

SEQ ID NO: 1140307 - DNA, 14 bp, Homo sapiens
ataatcagtaaata

SEQ ID NO: 1140308 - DNA, 17 bp, Homo sapiens
ataatcagtgactgaaa

SEQ ID NO: 1140309 - DNA, 23 bp, Homo sapiens
ataatcagtgactgaaaccattt

SEQ ID NO: 1140310 - DNA, 19 bp, Homo sapiens
ataatcatcaagtaataca

SEQ ID NO: 1140311 - DNA, 18 bp, Homo sapiens
ataatcatctctgtcaca

SEQ ID NO: 1140312 - DNA, 21 bp, Homo sapiens
ataatcattctttcccctcag

SEQ ID NO: 1140313 - DNA, 20 bp, Homo sapiens
ataatccacccccaggtgca

SEQ ID NO: 1140314 - DNA, 15 bp, Homo sapiens
ataatcccagcactt

SEQ ID NO: 1140315 - DNA, 17 bp, Homo sapiens
ataatcccagcactttg

SEQ ID NO: 1140316 - DNA, 18 bp, Homo sapiens
ataatccttgataatata

SEQ ID NO: 1140317 - DNA, 19 bp, Homo sapiens
ataatccttgataatatat

SEQ ID NO: 1140318 - DNA, 17 bp, Homo sapiens
ataatcgctcttttcca

SEQ ID NO: 1140319 - DNA, 21 bp, Homo sapiens
ataatcgctcttttccactcc

SEQ ID NO: 1140320 - DNA, 20 bp, Homo sapiens
ataatctactgtacacaatc

SEQ ID NO: 1140321 - DNA, 13 bp, Homo sapiens
ataatctatatta

SEQ ID NO: 1140322 - DNA, 21 bp, Homo sapiens
ataatctatttctatgagaaa

SEQ ID NO: 1140323 - DNA, 20 bp, Homo sapiens
ataatctcaaaggagaaaaa

SEQ ID NO: 1140324 - DNA, 14 bp, Homo sapiens
ataatctctgattc

SEQ ID NO: 1140325 - DNA, 22 bp, Homo sapiens
ataatctggactcctctgtcca

SEQ ID NO: 1140326 - DNA, 14 bp, Homo sapiens
ataatctgtacaat

SEQ ID NO: 1140327 - DNA, 19 bp, Homo sapiens
ataatctgtcaaaacactg

SEQ ID NO: 1140328 - DNA, 23 bp, Homo sapiens
ataatcttattagggagaaaatt

SEQ ID NO: 1140329 - DNA, 15 bp, Homo sapiens
ataatcttctgcctt

SEQ ID NO: 1140330 - DNA, 12 bp, Homo sapiens
ataatgaaaata

SEQ ID NO: 1140331 - DNA, 13 bp, Homo sapiens
ataatgaacagaa

SEQ ID NO: 1140332 - DNA, 13 bp, Homo sapiens
ataatgaacccat

SEQ ID NO: 1140333 - DNA, 17 bp, Homo sapiens
ataatgaataaactgaa

SEQ ID NO: 1140334 - DNA, 13 bp, Homo sapiens
ataatgaataaat

SEQ ID NO: 1140335 - DNA, 14 bp, Homo sapiens
ataatgaataaatc

SEQ ID NO: 1140336 - DNA, 14 bp, Homo sapiens
ataatgatacttaa

SEQ ID NO: 1140337 - DNA, 19 bp, Homo sapiens
ataatgatcgaaaaaataa

SEQ ID NO: 1140338 - DNA, 17 bp, Homo sapiens
aagttgaagctaagatt

SEQ ID NO: 1140339 - DNA, 18 bp, Homo sapiens
aagttgaagctaagattt

SEQ ID NO: 1140340 - DNA, 19 bp, Homo sapiens
aagttgaatatttaagaaa

SEQ ID NO: 1140341 - DNA, 16 bp, Homo sapiens
aagttgacttatagta

SEQ ID NO: 1140342 - DNA, 23 bp, Homo sapiens
aagttgacttatagtacatgata

SEQ ID NO: 1140343 - DNA, 19 bp, Homo sapiens
aagttgagggaaagagctt

SEQ ID NO: 1140344 - DNA, 19 bp, Homo sapiens
aagttgagtatcccttatc

SEQ ID NO: 1140345 - DNA, 15 bp, Homo sapiens
aagttgcagctgttt

SEQ ID NO: 1140346 - DNA, 21 bp, Homo sapiens
aagttgcagctgttttgttga

SEQ ID NO: 1140347 - DNA, 22 bp, Homo sapiens
aagttgcgacggagagaaaaaa

SEQ ID NO: 1140348 - DNA, 13 bp, Homo sapiens
aagttgctgttta

SEQ ID NO: 1140349 - DNA, 11 bp, Homo sapiens
aagttggaagg

SEQ ID NO: 1140350 - DNA, 12 bp, Homo sapiens
aagttggaagga

SEQ ID NO: 1140351 - DNA, 16 bp, Homo sapiens
aagttggtattaataa

SEQ ID NO: 1140352 - DNA, 20 bp, Homo sapiens
aagttggtattaataaaaag

SEQ ID NO: 1140353 - DNA, 15 bp, Homo sapiens
aagttgtaaaaatga

SEQ ID NO: 1140354 - DNA, 11 bp, Homo sapiens
aagttgtaaca

SEQ ID NO: 1140355 - DNA, 12 bp, Homo sapiens
aagttgtaccaa

SEQ ID NO: 1140356 - DNA, 17 bp, Homo sapiens
aagttgtaccaaaacat

SEQ ID NO: 1140357 - DNA, 19 bp, Homo sapiens
aagttgtaccaaaacatcc

SEQ ID NO: 1140358 - DNA, 21 bp, Homo sapiens
aagttgtataggctaaatgtt

SEQ ID NO: 1140359 - DNA, 18 bp, Homo sapiens
aagttgtctgtctgaatg

SEQ ID NO: 1140360 - DNA, 15 bp, Homo sapiens
aagttgtgcatgtat

SEQ ID NO: 1140361 - DNA, 18 bp, Homo sapiens
aagttgtgccttttatag

SEQ ID NO: 1140362 - DNA, 20 bp, Homo sapiens
aagttgtgccttttatagct

SEQ ID NO: 1140363 - DNA, 15 bp, Homo sapiens
aagttgtgcttgttt

SEQ ID NO: 1140364 - DNA, 17 bp, Homo sapiens
aagttgtgcttttctgt

SEQ ID NO: 1140365 - DNA, 14 bp, Homo sapiens
aagttgtggatatc

SEQ ID NO: 1140366 - DNA, 20 bp, Homo sapiens
aagttgttactaactaaact

SEQ ID NO: 1140367 - DNA, 21 bp, Homo sapiens
aagttgttactaactaaactc

SEQ ID NO: 1140368 - DNA, 23 bp, Homo sapiens
aagttgttactaactaaactctc

SEQ ID NO: 1140369 - DNA, 19 bp, Homo sapiens
atacacaactttgcaaatt

SEQ ID NO: 1140370 - DNA, 11 bp, Homo sapiens
atacacacaca

SEQ ID NO: 1140371 - DNA, 14 bp, Homo sapiens
atacacacacacac

SEQ ID NO: 1140372 - DNA, 11 bp, Homo sapiens
atacacacata

SEQ ID NO: 1140373 - DNA, 13 bp, Homo sapiens
atacacacatata

SEQ ID NO: 1140374 - DNA, 20 bp, Homo sapiens
atacacacatgccctcctgg

SEQ ID NO: 1140375 - DNA, 14 bp, Homo sapiens
atacacaggatcct

SEQ ID NO: 1140376 - DNA, 16 bp, Homo sapiens
atacacagtactttat

SEQ ID NO: 1140377 - DNA, 19 bp, Homo sapiens
atacacagtactttattgt

SEQ ID NO: 1140378 - DNA, 20 bp, Homo sapiens
atacacagttaaataaatag

SEQ ID NO: 1140379 - DNA, 14 bp, Homo sapiens
atacacatacatac

SEQ ID NO: 1140380 - DNA, 16 bp, Homo sapiens
atacacatacatacat

SEQ ID NO: 1140381 - DNA, 21 bp, Homo sapiens
atacaccacctcactcctgtt

SEQ ID NO: 1140382 - DNA, 19 bp, Homo sapiens
atacaccactacattctgt

SEQ ID NO: 1140383 - DNA, 20 bp, Homo sapiens
atacaccactgcaaaatgtc

SEQ ID NO: 1140384 - DNA, 19 bp, Homo sapiens
atacacgaatagacatcaa

SEQ ID NO: 1140385 - DNA, 20 bp, Homo sapiens
atacacgaatagacatcaaa

SEQ ID NO: 1140386 - DNA, 14 bp, Homo sapiens
atacactaaaaatc

SEQ ID NO: 1140387 - DNA, 17 bp, Homo sapiens
atacactatgaaattca

SEQ ID NO: 1140388 - DNA, 21 bp, Homo sapiens
atacactgaagttaacagaga

SEQ ID NO: 1140389 - DNA, 20 bp, Homo sapiens
atacactgaattgaatctac

SEQ ID NO: 1140390 - DNA, 12 bp, Homo sapiens
atacactgagat

SEQ ID NO: 1140391 - DNA, 23 bp, Homo sapiens
atacactgcactttgtttagaaa

SEQ ID NO: 1140392 - DNA, 20 bp, Homo sapiens
atacactgtagtttttgaaa

SEQ ID NO: 1140393 - DNA, 22 bp, Homo sapiens
atacacttattggaactctgct

SEQ ID NO: 1140394 - DNA, 20 bp, Homo sapiens
atacacttcttttgaacatc

SEQ ID NO: 1140395 - DNA, 16 bp, Homo sapiens
atacagaaagaagcag

SEQ ID NO: 1140396 - DNA, 23 bp, Homo sapiens
atacagaaagatggatgtgcttt

SEQ ID NO: 1140397 - DNA, 14 bp, Homo sapiens
atacagaactcaca

SEQ ID NO: 1140398 - DNA, 20 bp, Homo sapiens
atacagaactcacagtacct

SEQ ID NO: 1140399 - DNA, 14 bp, Homo sapiens
atacagaactcttt

SEQ ID NO: 1140400 - DNA, 23 bp, Homo sapiens
atacagaactctttcaaaacctt

SEQ ID NO: 1140401 - DNA, 18 bp, Homo sapiens
atacagaatcttgttttg

SEQ ID NO: 1140402 - DNA, 23 bp, Homo sapiens
atacagacacatttacactagag

SEQ ID NO: 1140403 - DNA, 12 bp, Homo sapiens
atacagacacta

SEQ ID NO: 1140404 - DNA, 19 bp, Homo sapiens
atacagacactaagttata

SEQ ID NO: 1140405 - DNA, 18 bp, Homo sapiens
atacagaccgaactgttg

SEQ ID NO: 1140406 - DNA, 21 bp, Homo sapiens
atacagagatatacaaatata

SEQ ID NO: 1140407 - DNA, 22 bp, Homo sapiens
atacagagatatacaaatatat

SEQ ID NO: 1140408 - DNA, 12 bp, Homo sapiens
atacagagccac

SEQ ID NO: 1140409 - DNA, 14 bp, Homo sapiens
atacagagctctct

SEQ ID NO: 1140410 - DNA, 13 bp, Homo sapiens
atacagaggagat

SEQ ID NO: 1140411 - DNA, 17 bp, Homo sapiens
atacagagtacgttaaa

SEQ ID NO: 1140412 - DNA, 21 bp, Homo sapiens
atacagataattcatttgtat

SEQ ID NO: 1140413 - DNA, 23 bp, Homo sapiens
atacagatagatatatgctctgc

SEQ ID NO: 1140414 - DNA, 19 bp, Homo sapiens
atacagatggagcaaatgt

SEQ ID NO: 1140415 - DNA, 20 bp, Homo sapiens
atacagcctatagtaaatgt

SEQ ID NO: 1140416 - DNA, 22 bp, Homo sapiens
atacagcctctacagccgtccc

SEQ ID NO: 1140417 - DNA, 16 bp, Homo sapiens
atacagctggctatct

SEQ ID NO: 1140418 - DNA, 20 bp, Homo sapiens
atacagctggctatctacta

SEQ ID NO: 1140419 - DNA, 17 bp, Homo sapiens
atacaggaaaaacaaaa

SEQ ID NO: 1140420 - DNA, 13 bp, Homo sapiens
atacaggaaacag

SEQ ID NO: 1140421 - DNA, 12 bp, Homo sapiens
atacaggaagaa

SEQ ID NO: 1140422 - DNA, 19 bp, Homo sapiens
atacagtaactttatgtgt

SEQ ID NO: 1140423 - DNA, 12 bp, Homo sapiens
atacagtacaca

SEQ ID NO: 1140424 - DNA, 12 bp, Homo sapiens
atacagtgccca

SEQ ID NO: 1140425 - DNA, 14 bp, Homo sapiens
atacagtgcccacc

SEQ ID NO: 1140426 - DNA, 23 bp, Homo sapiens
atacagtgcccaccgccctcctc

SEQ ID NO: 1140427 - DNA, 14 bp, Homo sapiens
atacagtgttattt

SEQ ID NO: 1140428 - DNA, 21 bp, Homo sapiens
atacagttctgctctggttgt

SEQ ID NO: 1140429 - DNA, 20 bp, Homo sapiens
atacagttgttggcctccgg

SEQ ID NO: 1140430 - DNA, 21 bp, Homo sapiens
atacagtttatttttaaagat

SEQ ID NO: 1140431 - DNA, 17 bp, Homo sapiens
atacagtttgacttttt

SEQ ID NO: 1140432 - DNA, 20 bp, Homo sapiens
atacagtttgactttttgga

SEQ ID NO: 1140433 - DNA, 13 bp, Homo sapiens
atacagttttcta

SEQ ID NO: 1140434 - DNA, 20 bp, Homo sapiens
atacataaaagaaataaacc

SEQ ID NO: 1140435 - DNA, 20 bp, Homo sapiens
atacataaacaagaccacgt

SEQ ID NO: 1140436 - DNA, 22 bp, Homo sapiens
atacataatgggccactgaaat

SEQ ID NO: 1140437 - DNA, 14 bp, Homo sapiens
atacatacacatac

SEQ ID NO: 1140438 - DNA, 16 bp, Homo sapiens
atacatacacatacat

SEQ ID NO: 1140439 - DNA, 15 bp, Homo sapiens
atacatacatacata

SEQ ID NO: 1140440 - DNA, 14 bp, Homo sapiens
atacatacatgtat

SEQ ID NO: 1140441 - DNA, 14 bp, Homo sapiens
atacatagacattt

SEQ ID NO: 1140442 - DNA, 19 bp, Homo sapiens
atacatagacatttcaaaa

SEQ ID NO: 1140443 - DNA, 23 bp, Homo sapiens
atacataggtctgtatggctgta

SEQ ID NO: 1140444 - DNA, 18 bp, Homo sapiens
atacatatatatatttgt

SEQ ID NO: 1140445 - DNA, 23 bp, Homo sapiens
atacatatatatatttgtaacat

SEQ ID NO: 1140446 - DNA, 15 bp, Homo sapiens
atacatatatctaca

SEQ ID NO: 1140447 - DNA, 19 bp, Homo sapiens
atacatatatctacacata

SEQ ID NO: 1140448 - DNA, 22 bp, Homo sapiens
atacatatatctacacatacag

SEQ ID NO: 1140449 - DNA, 23 bp, Homo sapiens
atacatatatctacacatacaga

SEQ ID NO: 1140450 - DNA, 14 bp, Homo sapiens
atacatatctttat

SEQ ID NO: 1140451 - DNA, 18 bp, Homo sapiens
atacatatggatgttact

SEQ ID NO: 1140452 - DNA, 22 bp, Homo sapiens
atacatcactgcttgatgaagc

SEQ ID NO: 1140453 - DNA, 14 bp, Homo sapiens
atacatctgctgtg

SEQ ID NO: 1140454 - DNA, 13 bp, Homo sapiens
atacatgaagctt

SEQ ID NO: 1140455 - DNA, 18 bp, Homo sapiens
atacatgaagcttcatgc

SEQ ID NO: 1140456 - DNA, 13 bp, Homo sapiens
atacatgagaaag

SEQ ID NO: 1140457 - DNA, 15 bp, Homo sapiens
atacatgagaaagat

SEQ ID NO: 1140458 - DNA, 13 bp, Homo sapiens
atacatgcatata

SEQ ID NO: 1140459 - DNA, 20 bp, Homo sapiens
atacatgcatataatgaata

SEQ ID NO: 1140460 - DNA, 10 bp, Homo sapiens
atacatgcca

SEQ ID NO: 1140461 - DNA, 18 bp, Homo sapiens
atacatgctaagagaagt

SEQ ID NO: 1140462 - DNA, 14 bp, Homo sapiens
atacatggttgtga

SEQ ID NO: 1140463 - DNA, 20 bp, Homo sapiens
atacatggttgtgacctgag

SEQ ID NO: 1140464 - DNA, 22 bp, Homo sapiens
atacatgtaattctaccaaggt

SEQ ID NO: 1140465 - DNA, 13 bp, Homo sapiens
atacatgtttgtt

SEQ ID NO: 1140466 - DNA, 19 bp, Homo sapiens
atacatgtttgttggttga

SEQ ID NO: 1140467 - DNA, 19 bp, Homo sapiens
atacattaacggtgctaaa

SEQ ID NO: 1140468 - DNA, 23 bp, Homo sapiens
atacattaggaagtggcagttct

SEQ ID NO: 1140469 - DNA, 16 bp, Homo sapiens
atacattagttttaat

SEQ ID NO: 1140470 - DNA, 20 bp, Homo sapiens
atacattagttttaatctct

SEQ ID NO: 1140471 - DNA, 20 bp, Homo sapiens
aataacctctggcccttgga

SEQ ID NO: 1140472 - DNA, 21 bp, Homo sapiens
aataacctctggcccttggaa

SEQ ID NO: 1140473 - DNA, 11 bp, Homo sapiens
aataacctgcc

SEQ ID NO: 1140474 - DNA, 14 bp, Homo sapiens
aataacctttctgg

SEQ ID NO: 1140475 - DNA, 15 bp, Homo sapiens
aataactaaaaggta

SEQ ID NO: 1140476 - DNA, 19 bp, Homo sapiens
aataactactgtgttcctg

SEQ ID NO: 1140477 - DNA, 11 bp, Homo sapiens
aataactattt

SEQ ID NO: 1140478 - DNA, 16 bp, Homo sapiens
aataactccaagcaga

SEQ ID NO: 1140479 - DNA, 14 bp, Homo sapiens
aataactccttctt

SEQ ID NO: 1140480 - DNA, 11 bp, Homo sapiens
aataactgaac

SEQ ID NO: 1140481 - DNA, 19 bp, Homo sapiens
aataactgaactgtttggt

SEQ ID NO: 1140482 - DNA, 16 bp, Homo sapiens
aataactgaatttgga

SEQ ID NO: 1140483 - DNA, 16 bp, Homo sapiens
aataactgtgtactgt

SEQ ID NO: 1140484 - DNA, 13 bp, Homo sapiens
aataactgtgtgg

SEQ ID NO: 1140485 - DNA, 21 bp, Homo sapiens
aataacttcagtcctgctcca

SEQ ID NO: 1140486 - DNA, 18 bp, Homo sapiens
aataacttctatatttta

SEQ ID NO: 1140487 - DNA, 23 bp, Homo sapiens
aataacttctatattttaataga

SEQ ID NO: 1140488 - DNA, 15 bp, Homo sapiens
aataacttctatgtt

SEQ ID NO: 1140489 - DNA, 19 bp, Homo sapiens
aataacttctatgttggtt

SEQ ID NO: 1140490 - DNA, 14 bp, Homo sapiens
aataactttcttac

SEQ ID NO: 1140491 - DNA, 15 bp, Homo sapiens
aatacagtaagtaaa

SEQ ID NO: 1140492 - DNA, 23 bp, Homo sapiens
aatacatacggtcaggtttaaca

SEQ ID NO: 1140493 - DNA, 22 bp, Homo sapiens
aatacatgtacctatagaaata

SEQ ID NO: 1140494 - DNA, 16 bp, Homo sapiens
aatacatgtttgttgg

SEQ ID NO: 1140495 - DNA, 17 bp, Homo sapiens
aatacattaacggtgct

SEQ ID NO: 1140496 - DNA, 21 bp, Homo sapiens
aatacattctatgacattttt

SEQ ID NO: 1140497 - DNA, 15 bp, Homo sapiens
aatacatttgatttg

SEQ ID NO: 1140498 - DNA, 17 bp, Homo sapiens
aatacatttgtaagtgt

SEQ ID NO: 1140499 - DNA, 17 bp, Homo sapiens
aatacattttataattt

SEQ ID NO: 1140500 - DNA, 16 bp, Homo sapiens
aataccaaatatttta

SEQ ID NO: 1140501 - DNA, 17 bp, Homo sapiens
aataccaaatattttag

SEQ ID NO: 1140502 - DNA, 22 bp, Homo sapiens
aataccaagagcaatttacctg

SEQ ID NO: 1140503 - DNA, 18 bp, Homo sapiens
aataccactctgtaattg

SEQ ID NO: 1140504 - DNA, 20 bp, Homo sapiens
aataccactctgtaattgca

SEQ ID NO: 1140505 - DNA, 19 bp, Homo sapiens
aataccagccagtaaatgg

SEQ ID NO: 1140506 - DNA, 20 bp, Homo sapiens
aataccagtgaaccaaagag

SEQ ID NO: 1140507 - DNA, 22 bp, Homo sapiens
aataccataggaagacataaaa

SEQ ID NO: 1140508 - DNA, 13 bp, Homo sapiens
aataccattgaaa

SEQ ID NO: 1140509 - DNA, 18 bp, Homo sapiens
aatacccaaatgtccctg

SEQ ID NO: 1140510 - DNA, 17 bp, Homo sapiens
aatacctcaatttttgt

SEQ ID NO: 1140511 - DNA, 15 bp, Homo sapiens
aatacctcatgcttc

SEQ ID NO: 1140512 - DNA, 16 bp, Homo sapiens
aatacctcttagctga

SEQ ID NO: 1140513 - DNA, 12 bp, Homo sapiens
aatacctgctca

SEQ ID NO: 1140514 - DNA, 18 bp, Homo sapiens
aataccttctatgtatta

SEQ ID NO: 1140515 - DNA, 16 bp, Homo sapiens
aatacgcactacatgt

SEQ ID NO: 1140516 - DNA, 18 bp, Homo sapiens
aatacgcactacatgtgg

SEQ ID NO: 1140517 - DNA, 15 bp, Homo sapiens
aatacgcctttaaag

SEQ ID NO: 1140518 - DNA, 23 bp, Homo sapiens
aatacgctaagcctggaagccat

SEQ ID NO: 1140519 - DNA, 21 bp, Homo sapiens
aatacgtgccagatataactg

SEQ ID NO: 1140520 - DNA, 19 bp, Homo sapiens
aatacgtgtcaaaaaagaa

SEQ ID NO: 1140521 - DNA, 13 bp, Homo sapiens
aatactacctata

SEQ ID NO: 1140522 - DNA, 20 bp, Homo sapiens
aatactacctataggaaagt

SEQ ID NO: 1140523 - DNA, 15 bp, Homo sapiens
aatactaccttgaaa

SEQ ID NO: 1140524 - DNA, 16 bp, Homo sapiens
aatactaccttgaaaa

SEQ ID NO: 1140525 - DNA, 17 bp, Homo sapiens
aatactaccttgaaaat

SEQ ID NO: 1140526 - DNA, 18 bp, Homo sapiens
aatactatccatgtaata

SEQ ID NO: 1140527 - DNA, 19 bp, Homo sapiens
aatactcatcagagcagct

SEQ ID NO: 1140528 - DNA, 14 bp, Homo sapiens
aatactcatgaatg

SEQ ID NO: 1140529 - DNA, 22 bp, Homo sapiens
aatactctaccctcttagaaaa

SEQ ID NO: 1140530 - DNA, 18 bp, Homo sapiens
aatactctatttttacat

SEQ ID NO: 1140531 - DNA, 14 bp, Homo sapiens
aatactctgttgta

SEQ ID NO: 1140532 - DNA, 13 bp, Homo sapiens
aatactcttccca

SEQ ID NO: 1140533 - DNA, 14 bp, Homo sapiens
aatactcttgaaag

SEQ ID NO: 1140534 - DNA, 15 bp, Homo sapiens
aatactcttgaaagg

SEQ ID NO: 1140535 - DNA, 11 bp, Homo sapiens
aatactgacct

SEQ ID NO: 1140536 - DNA, 18 bp, Homo sapiens
aatactgagatgctgggc

SEQ ID NO: 1140537 - DNA, 19 bp, Homo sapiens
aatactgagatgctgggct

SEQ ID NO: 1140538 - DNA, 22 bp, Homo sapiens
aatactgccggtcacccaggct

SEQ ID NO: 1140539 - DNA, 22 bp, Homo sapiens
aatactgcctagaaaatgcaaa

SEQ ID NO: 1140540 - DNA, 23 bp, Homo sapiens
aatactgctacagcaatttctaa

SEQ ID NO: 1140541 - DNA, 21 bp, Homo sapiens
aatactggaataatttgtaaa

SEQ ID NO: 1140542 - DNA, 14 bp, Homo sapiens
aatactggactcag

SEQ ID NO: 1140543 - DNA, 16 bp, Homo sapiens
aatactgtattttgta

SEQ ID NO: 1140544 - DNA, 17 bp, Homo sapiens
aatactgtcaaacaata

SEQ ID NO: 1140545 - DNA, 15 bp, Homo sapiens
aatactgtgcagaat

SEQ ID NO: 1140546 - DNA, 17 bp, Homo sapiens
aatactgtgcagaataa

SEQ ID NO: 1140547 - DNA, 14 bp, Homo sapiens
aatacttacctaat

SEQ ID NO: 1140548 - DNA, 19 bp, Homo sapiens
aatacttactataatttga

SEQ ID NO: 1140549 - DNA, 18 bp, Homo sapiens
aatacttatgttgtattg

SEQ ID NO: 1140550 - DNA, 11 bp, Homo sapiens
aatacttattt

SEQ ID NO: 1140551 - DNA, 15 bp, Homo sapiens
aatacttattttcag

SEQ ID NO: 1140552 - DNA, 12 bp, Homo sapiens
aatacttccaga

SEQ ID NO: 1140553 - DNA, 14 bp, Homo sapiens
aatacttccagaag

SEQ ID NO: 1140554 - DNA, 22 bp, Homo sapiens
aatacttctcattttttaaaaa

SEQ ID NO: 1140555 - DNA, 15 bp, Homo sapiens
aatacttgacctctg

SEQ ID NO: 1140556 - DNA, 15 bp, Homo sapiens
aatacttgactcatt

SEQ ID NO: 1140557 - DNA, 20 bp, Homo sapiens
aatacttgcaactaaggaca

SEQ ID NO: 1140558 - DNA, 21 bp, Homo sapiens
aatacttgcaactaaggacaa

SEQ ID NO: 1140559 - DNA, 14 bp, Homo sapiens
aatacttgcagttg

SEQ ID NO: 1140560 - DNA, 18 bp, Homo sapiens
aatacttgtcaatattta

SEQ ID NO: 1140561 - DNA, 20 bp, Homo sapiens
aatacttgtcaatatttaaa

SEQ ID NO: 1140562 - DNA, 15 bp, Homo sapiens
aatactttaaaggaa

SEQ ID NO: 1140563 - DNA, 16 bp, Homo sapiens
aatactttaaaggaaa

SEQ ID NO: 1140564 - DNA, 17 bp, Homo sapiens
aatactttaaaggaaaa

SEQ ID NO: 1140565 - DNA, 23 bp, Homo sapiens
aatactttgcagcacagctgaga

SEQ ID NO: 1140566 - DNA, 16 bp, Homo sapiens
aatactttgcttcata

SEQ ID NO: 1140567 - DNA, 23 bp, Homo sapiens
aatactttgtatacaagtactgg

SEQ ID NO: 1140568 - DNA, 18 bp, Homo sapiens
aatacttttactctgcct

SEQ ID NO: 1140569 - DNA, 16 bp, Homo sapiens
aatacttttgtccaat

SEQ ID NO: 1140570 - DNA, 17 bp, Homo sapiens
aatagaaaaaaagaaaa

SEQ ID NO: 1140571 - DNA, 18 bp, Homo sapiens
aatagaaaactgaaaatc

SEQ ID NO: 1140572 - DNA, 20 bp, Homo sapiens
aatagaaaactgaaaatcta

SEQ ID NO: 1140573 - DNA, 20 bp, Homo sapiens
aatagaaaatgtaataactt

SEQ ID NO: 1140574 - DNA, 12 bp, Homo sapiens
aatagaaacaag

SEQ ID NO: 1140575 - DNA, 14 bp, Homo sapiens
aatagaaagaaact

SEQ ID NO: 1140576 - DNA, 19 bp, Homo sapiens
aatagaaataaattcctaa

SEQ ID NO: 1140577 - DNA, 16 bp, Homo sapiens
aatagaaatttccaga

SEQ ID NO: 1140578 - DNA, 13 bp, Homo sapiens
aatagaaattttc

SEQ ID NO: 1140579 - DNA, 15 bp, Homo sapiens
aatagaaattttgta

SEQ ID NO: 1140580 - DNA, 16 bp, Homo sapiens
aatagaaattttgtaa

SEQ ID NO: 1140581 - DNA, 19 bp, Homo sapiens
aatagaaattttgtaagaa

SEQ ID NO: 1140582 - DNA, 13 bp, Homo sapiens
aatagaacacagt

SEQ ID NO: 1140583 - DNA, 22 bp, Homo sapiens
aatagaactatctgcattatct

SEQ ID NO: 1140584 - DNA, 22 bp, Homo sapiens
aatagaagctaaggtttagata

SEQ ID NO: 1140585 - DNA, 17 bp, Homo sapiens
aatagaagttttcctga

SEQ ID NO: 1140586 - DNA, 13 bp, Homo sapiens
aatagaataattc

SEQ ID NO: 1140587 - DNA, 17 bp, Homo sapiens
aatagaataattctttt

SEQ ID NO: 1140588 - DNA, 13 bp, Homo sapiens
aatagaatgatag

SEQ ID NO: 1140589 - DNA, 15 bp, Homo sapiens
aatagacaaaaagta

SEQ ID NO: 1140590 - DNA, 17 bp, Homo sapiens
aatagacaaaaagtata

SEQ ID NO: 1140591 - DNA, 18 bp, Homo sapiens
aatagacaaaaagtatat

SEQ ID NO: 1140592 - DNA, 22 bp, Homo sapiens
aatagacactccccgaagtctt

SEQ ID NO: 1140593 - DNA, 23 bp, Homo sapiens
aatagacactccccgaagtcttt

SEQ ID NO: 1140594 - DNA, 16 bp, Homo sapiens
aatagacagcatgaga

SEQ ID NO: 1140595 - DNA, 19 bp, Homo sapiens
aatagacagtaaaatacta

SEQ ID NO: 1140596 - DNA, 15 bp, Homo sapiens
aatagacatgtagtt

SEQ ID NO: 1140597 - DNA, 15 bp, Homo sapiens
aatagactaaatgaa

SEQ ID NO: 1140598 - DNA, 20 bp, Homo sapiens
aatagactcgctagtcagta

SEQ ID NO: 1140599 - DNA, 21 bp, Homo sapiens
aatagactgtaacttccaaat

SEQ ID NO: 1140600 - DNA, 16 bp, Homo sapiens
aatagacttaaatctc

SEQ ID NO: 1140601 - DNA, 14 bp, Homo sapiens
aatagacttctctt

SEQ ID NO: 1140602 - DNA, 22 bp, Homo sapiens
atactctgtagtctcagttcgt

SEQ ID NO: 1140603 - DNA, 12 bp, Homo sapiens
atactctgtcag

SEQ ID NO: 1140604 - DNA, 15 bp, Homo sapiens
atactctgtcagatg

SEQ ID NO: 1140605 - DNA, 22 bp, Homo sapiens
atactcttcctatttttgtagt

SEQ ID NO: 1140606 - DNA, 13 bp, Homo sapiens
atactctttcaat

SEQ ID NO: 1140607 - DNA, 19 bp, Homo sapiens
atactctttcaataaatgt

SEQ ID NO: 1140608 - DNA, 15 bp, Homo sapiens
atactctttctgtat

SEQ ID NO: 1140609 - DNA, 22 bp, Homo sapiens
atactctttctgtatatacttt

SEQ ID NO: 1140610 - DNA, 18 bp, Homo sapiens
atactgaaagatctctgt

SEQ ID NO: 1140611 - DNA, 12 bp, Homo sapiens
atactgaaggaa

SEQ ID NO: 1140612 - DNA, 18 bp, Homo sapiens
atactgacagaagttatt

SEQ ID NO: 1140613 - DNA, 21 bp, Homo sapiens
aatatatcagaatctgtgtga

SEQ ID NO: 1140614 - DNA, 20 bp, Homo sapiens
aatatatctaccccagacta

SEQ ID NO: 1140615 - DNA, 19 bp, Homo sapiens
aatatatctagaactatca

SEQ ID NO: 1140616 - DNA, 14 bp, Homo sapiens
aatatatgcttttg

SEQ ID NO: 1140617 - DNA, 23 bp, Homo sapiens
aatatatggaattcctctactgc

SEQ ID NO: 1140618 - DNA, 14 bp, Homo sapiens
aatatatggcagag

SEQ ID NO: 1140619 - DNA, 19 bp, Homo sapiens
aatatatggcagagttgta

SEQ ID NO: 1140620 - DNA, 22 bp, Homo sapiens
aatatatggcagagttgtaaat

SEQ ID NO: 1140621 - DNA, 13 bp, Homo sapiens
aatatatgtatgt

SEQ ID NO: 1140622 - DNA, 12 bp, Homo sapiens
aatatatgtatt

SEQ ID NO: 1140623 - DNA, 13 bp, Homo sapiens
aatatatgtattt

SEQ ID NO: 1140624 - DNA, 15 bp, Homo sapiens
aatatatgttctgca

SEQ ID NO: 1140625 - DNA, 16 bp, Homo sapiens
aatatatgttctgcaa

SEQ ID NO: 1140626 - DNA, 23 bp, Homo sapiens
aatatatgttctgcaagaattaa

SEQ ID NO: 1140627 - DNA, 12 bp, Homo sapiens
aatatattactg

SEQ ID NO: 1140628 - DNA, 16 bp, Homo sapiens
aatatattactgattt

SEQ ID NO: 1140629 - DNA, 18 bp, Homo sapiens
aatatattacttaactgt

SEQ ID NO: 1140630 - DNA, 19 bp, Homo sapiens
aatatattgaacttttgta

SEQ ID NO: 1140631 - DNA, 15 bp, Homo sapiens
aatatatttaagata

SEQ ID NO: 1140632 - DNA, 13 bp, Homo sapiens
aatatatttcttc

SEQ ID NO: 1140633 - DNA, 16 bp, Homo sapiens
aatatatttcttcttc

SEQ ID NO: 1140634 - DNA, 19 bp, Homo sapiens
aatatatttgtgtatttaa

SEQ ID NO: 1140635 - DNA, 15 bp, Homo sapiens
aatatattttctgtt

SEQ ID NO: 1140636 - DNA, 19 bp, Homo sapiens
aatatattttgtttacaaa

SEQ ID NO: 1140637 - DNA, 20 bp, Homo sapiens
aatatatttttatatttagt

SEQ ID NO: 1140638 - DNA, 14 bp, Homo sapiens
aatatcaaagtcat

SEQ ID NO: 1140639 - DNA, 20 bp, Homo sapiens
aatatcaaagtcattaaaga

SEQ ID NO: 1140640 - DNA, 12 bp, Homo sapiens
aatatcaaataa

SEQ ID NO: 1140641 - DNA, 17 bp, Homo sapiens
aatatcaaataataaag

SEQ ID NO: 1140642 - DNA, 14 bp, Homo sapiens
aatatcaaatgcag

SEQ ID NO: 1140643 - DNA, 22 bp, Homo sapiens
aatatcaaatgcagtatatttc

SEQ ID NO: 1140644 - DNA, 17 bp, Homo sapiens
aatatcactgtaatgag

SEQ ID NO: 1140645 - DNA, 21 bp, Homo sapiens
aatatcagtattctgacatgt

SEQ ID NO: 1140646 - DNA, 22 bp, Homo sapiens
aatatcagtattctgacatgta

SEQ ID NO: 1140647 - DNA, 14 bp, Homo sapiens
aatatcataaagca

SEQ ID NO: 1140648 - DNA, 20 bp, Homo sapiens
aatatcatgtcttgtgcata

SEQ ID NO: 1140649 - DNA, 13 bp, Homo sapiens
aatatcattgatt

SEQ ID NO: 1140650 - DNA, 16 bp, Homo sapiens
aatatccaaagactgt

SEQ ID NO: 1140651 - DNA, 18 bp, Homo sapiens
aatatcccaacattctgc

SEQ ID NO: 1140652 - DNA, 19 bp, Homo sapiens
aatatcccaacattctgca

SEQ ID NO: 1140653 - DNA, 16 bp, Homo sapiens
aatatccctacatgta

SEQ ID NO: 1140654 - DNA, 17 bp, Homo sapiens
aatatccctcttgtaag

SEQ ID NO: 1140655 - DNA, 16 bp, Homo sapiens
aatatcctaaacatca

SEQ ID NO: 1140656 - DNA, 17 bp, Homo sapiens
aatatcctaaacatcat

SEQ ID NO: 1140657 - DNA, 18 bp, Homo sapiens
aatatcctaaacatcatt

SEQ ID NO: 1140658 - DNA, 13 bp, Homo sapiens
aatatcctcaggg

SEQ ID NO: 1140659 - DNA, 14 bp, Homo sapiens
aatatcctgtaata

SEQ ID NO: 1140660 - DNA, 15 bp, Homo sapiens
aatatcgatataaat

SEQ ID NO: 1140661 - DNA, 23 bp, Homo sapiens
aatatcgttagggtgaagcatta

SEQ ID NO: 1140662 - DNA, 22 bp, Homo sapiens
aatatctaatatatatgaataa

SEQ ID NO: 1140663 - DNA, 20 bp, Homo sapiens
aatatctcctccaatgtcct

SEQ ID NO: 1140664 - DNA, 21 bp, Homo sapiens
aatatctcctccaatgtcctg

SEQ ID NO: 1140665 - DNA, 17 bp, Homo sapiens
aatatctgaaaatgtat

SEQ ID NO: 1140666 - DNA, 13 bp, Homo sapiens
aatatctgggatt

SEQ ID NO: 1140667 - DNA, 21 bp, Homo sapiens
aatatctgggattctacttta

SEQ ID NO: 1140668 - DNA, 19 bp, Homo sapiens
aatatctgtgaaatatcat

SEQ ID NO: 1140669 - DNA, 18 bp, Homo sapiens
aatatcttgctggattaa

SEQ ID NO: 1140670 - DNA, 21 bp, Homo sapiens
aatatcttgctggattaatgt

SEQ ID NO: 1140671 - DNA, 15 bp, Homo sapiens
aatatcttggcctaa

SEQ ID NO: 1140672 - DNA, 12 bp, Homo sapiens
aatatctttctg

SEQ ID NO: 1140673 - DNA, 15 bp, Homo sapiens
aatatgaaaaatgta

SEQ ID NO: 1140674 - DNA, 19 bp, Homo sapiens
aatatgaaaaatgtaaata

SEQ ID NO: 1140675 - DNA, 13 bp, Homo sapiens
aatatgaaaactt

SEQ ID NO: 1140676 - DNA, 17 bp, Homo sapiens
aatatgaagagtttttt

SEQ ID NO: 1140677 - DNA, 15 bp, Homo sapiens
aatatgaagcctttg

SEQ ID NO: 1140678 - DNA, 21 bp, Homo sapiens
aatatgaagcctttggtgaat

SEQ ID NO: 1140679 - DNA, 12 bp, Homo sapiens
aatatgaatgcc

SEQ ID NO: 1140680 - DNA, 22 bp, Homo sapiens
aatatgaatgcccccagctggc

SEQ ID NO: 1140681 - DNA, 16 bp, Homo sapiens
aatatgacagctgtcc

SEQ ID NO: 1140682 - DNA, 19 bp, Homo sapiens
aatatgactttttataaaa

SEQ ID NO: 1140683 - DNA, 20 bp, Homo sapiens
aatatgactttttataaaat

SEQ ID NO: 1140684 - DNA, 20 bp, Homo sapiens
aatatgatcaggtaactttc

SEQ ID NO: 1140685 - DNA, 20 bp, Homo sapiens
aatatgatccctaatgtgtt

SEQ ID NO: 1140686 - DNA, 16 bp, Homo sapiens
aatatgatgttaaaaa

SEQ ID NO: 1140687 - DNA, 21 bp, Homo sapiens
aatatgattctagtacataat

SEQ ID NO: 1140688 - DNA, 14 bp, Homo sapiens
aatatgcaaagtct

SEQ ID NO: 1140689 - DNA, 17 bp, Homo sapiens
aatatgcaacattgtcc

SEQ ID NO: 1140690 - DNA, 18 bp, Homo sapiens
aatatgcaagcagctttt

SEQ ID NO: 1140691 - DNA, 13 bp, Homo sapiens
aatatgcactttc

SEQ ID NO: 1140692 - DNA, 14 bp, Homo sapiens
aatatgccccttct

SEQ ID NO: 1140693 - DNA, 21 bp, Homo sapiens
aatatgcctgctatttgaagt

SEQ ID NO: 1140694 - DNA, 17 bp, Homo sapiens
aatatgctgcaacaaaa

SEQ ID NO: 1140695 - DNA, 18 bp, Homo sapiens
aatatgctgcaacaaaat

SEQ ID NO: 1140696 - DNA, 14 bp, Homo sapiens
aatatgctgccaaa

SEQ ID NO: 1140697 - DNA, 19 bp, Homo sapiens
aatatgctgccaaattttg

SEQ ID NO: 1140698 - DNA, 10 bp, Homo sapiens
aatatgctta

SEQ ID NO: 1140699 - DNA, 19 bp, Homo sapiens
aatatgcttaaaataagca

SEQ ID NO: 1140700 - DNA, 23 bp, Homo sapiens
aatatgcttaaaataagcaggtg

SEQ ID NO: 1140701 - DNA, 23 bp, Homo sapiens
aatatggaaatcttttacatttt

SEQ ID NO: 1140702 - DNA, 15 bp, Homo sapiens
aatatggaacttaca

SEQ ID NO: 1140703 - DNA, 24 bp, Homo sapiens
aatatggaacttacattgttcaat

SEQ ID NO: 1140704 - DNA, 18 bp, Homo sapiens
aatatggaacttctaata

SEQ ID NO: 1140705 - DNA, 20 bp, Homo sapiens
aatatggaacttctaatata

SEQ ID NO: 1140706 - DNA, 15 bp, Homo sapiens
aatatggactgctca

SEQ ID NO: 1140707 - DNA, 18 bp, Homo sapiens
aatatggctataaatata

SEQ ID NO: 1140708 - DNA, 19 bp, Homo sapiens
aatatgggcattgtagtta

SEQ ID NO: 1140709 - DNA, 11 bp, Homo sapiens
aatatgtatgc

SEQ ID NO: 1140710 - DNA, 16 bp, Homo sapiens
aatatgtattttccta

SEQ ID NO: 1140711 - DNA, 16 bp, Homo sapiens
aatatgtcaaaaaggg

SEQ ID NO: 1140712 - DNA, 13 bp, Homo sapiens
aatatgtcagatg

SEQ ID NO: 1140713 - DNA, 16 bp, Homo sapiens
aatatgtctgcaggtt

SEQ ID NO: 1140714 - DNA, 16 bp, Homo sapiens
aatatgtgaagttttc

SEQ ID NO: 1140715 - DNA, 21 bp, Homo sapiens
aatatgtgagtgccttttgca

SEQ ID NO: 1140716 - DNA, 21 bp, Homo sapiens
aatatgttaacctcagtgtca

SEQ ID NO: 1140717 - DNA, 16 bp, Homo sapiens
aatatgttagcaaaga

SEQ ID NO: 1140718 - DNA, 18 bp, Homo sapiens
aatatgttgagtgttcat

SEQ ID NO: 1140719 - DNA, 22 bp, Homo sapiens
aatatgtttagttttacatttt

SEQ ID NO: 1140720 - DNA, 23 bp, Homo sapiens
aatatgtttagttttacatttta

SEQ ID NO: 1140721 - DNA, 14 bp, Homo sapiens
aatatgtttccttg

SEQ ID NO: 1140722 - DNA, 18 bp, Homo sapiens
aatatgtttccttgttta

SEQ ID NO: 1140723 - DNA, 17 bp, Homo sapiens
aatattaaaccctggat

SEQ ID NO: 1140724 - DNA, 19 bp, Homo sapiens
aatattaaagattctcttt

SEQ ID NO: 1140725 - DNA, 23 bp, Homo sapiens
aatattaaagctcttcatttctg

SEQ ID NO: 1140726 - DNA, 16 bp, Homo sapiens
aatattaaatacagac

SEQ ID NO: 1140727 - DNA, 19 bp, Homo sapiens
aatattaacacgctgcctg

SEQ ID NO: 1140728 - DNA, 21 bp, Homo sapiens
aatattaacacgctgcctggt

SEQ ID NO: 1140729 - DNA, 14 bp, Homo sapiens
aatattaagacaat

SEQ ID NO: 1140730 - DNA, 15 bp, Homo sapiens
aatattaatgccttt

SEQ ID NO: 1140731 - DNA, 21 bp, Homo sapiens
aatattactctcaaaatcttt

SEQ ID NO: 1140732 - DNA, 21 bp, Homo sapiens
aatattactgtctttattctt

SEQ ID NO: 1140733 - DNA, 22 bp, Homo sapiens
atagctaggtgacatatacata

SEQ ID NO: 1140734 - DNA, 16 bp, Homo sapiens
atagctatatccatgt

SEQ ID NO: 1140735 - DNA, 14 bp, Homo sapiens
atatttaatgcatt

SEQ ID NO: 1140736 - DNA, 19 bp, Homo sapiens
atatttaatgcattaaacc

SEQ ID NO: 1140737 - DNA, 21 bp, Homo sapiens
atatttaatggcactgagaaa

SEQ ID NO: 1140738 - DNA, 20 bp, Homo sapiens
atatttaatgttttaaatgt

SEQ ID NO: 1140739 - DNA, 21 bp, Homo sapiens
atatttaatgttttaaatgta

SEQ ID NO: 1140740 - DNA, 16 bp, Homo sapiens
atatttaattatgaaa

SEQ ID NO: 1140741 - DNA, 18 bp, Homo sapiens
atatttaattatgaaaac

SEQ ID NO: 1140742 - DNA, 13 bp, Homo sapiens
atatttacagaag

SEQ ID NO: 1140743 - DNA, 18 bp, Homo sapiens
atatttactaactaaata

SEQ ID NO: 1140744 - DNA, 16 bp, Homo sapiens
atatttactctttgca

SEQ ID NO: 1140745 - DNA, 19 bp, Homo sapiens
atatttacttcttatacat

SEQ ID NO: 1140746 - DNA, 20 bp, Homo sapiens
atatttagatgtaattttgt

SEQ ID NO: 1140747 - DNA, 19 bp, Homo sapiens
atatttagcaaataatttc

SEQ ID NO: 1140748 - DNA, 20 bp, Homo sapiens
atatttagtaaagcttttct

SEQ ID NO: 1140749 - DNA, 23 bp, Homo sapiens
atatttagttacgtataatgctt

SEQ ID NO: 1140750 - DNA, 22 bp, Homo sapiens
atatttagttatagtttcagat

SEQ ID NO: 1140751 - DNA, 11 bp, Homo sapiens
atatttataac

SEQ ID NO: 1140752 - DNA, 22 bp, Homo sapiens
atatttataactcatcataaaa

SEQ ID NO: 1140753 - DNA, 20 bp, Homo sapiens
atatttatactctagaacat

SEQ ID NO: 1140754 - DNA, 14 bp, Homo sapiens
atatttatatatat

SEQ ID NO: 1140755 - DNA, 20 bp, Homo sapiens
atatttatccaaaatgtgta

SEQ ID NO: 1140756 - DNA, 13 bp, Homo sapiens
atatttatgctta

SEQ ID NO: 1140757 - DNA, 21 bp, Homo sapiens
atatttatgcttaaaatatgt

SEQ ID NO: 1140758 - DNA, 14 bp, Homo sapiens
atatttatgtagat

SEQ ID NO: 1140759 - DNA, 14 bp, Homo sapiens
atatttattacctc

SEQ ID NO: 1140760 - DNA, 13 bp, Homo sapiens
atatttattgtta

SEQ ID NO: 1140761 - DNA, 16 bp, Homo sapiens
atatttattgttagaa

SEQ ID NO: 1140762 - DNA, 15 bp, Homo sapiens
atatttatttcagat

SEQ ID NO: 1140763 - DNA, 17 bp, Homo sapiens
atatttatttcctgcta

SEQ ID NO: 1140764 - DNA, 21 bp, Homo sapiens
atatttattttctttctgtaa

SEQ ID NO: 1140765 - DNA, 14 bp, Homo sapiens
atatttatttttgg

SEQ ID NO: 1140766 - DNA, 17 bp, Homo sapiens
atatttcaaacattttg

SEQ ID NO: 1140767 - DNA, 20 bp, Homo sapiens
atatttcacttttgttctgc

SEQ ID NO: 1140768 - DNA, 10 bp, Homo sapiens
atatttcatt

SEQ ID NO: 1140769 - DNA, 13 bp, Homo sapiens
atatttcatttta

SEQ ID NO: 1140770 - DNA, 19 bp, Homo sapiens
aatgaggagagaaaatata

SEQ ID NO: 1140771 - DNA, 18 bp, Homo sapiens
aatgaggaggtacattga

SEQ ID NO: 1140772 - DNA, 14 bp, Homo sapiens
aatgagggactgga

SEQ ID NO: 1140773 - DNA, 20 bp, Homo sapiens
aatgagggactggaaccagg

SEQ ID NO: 1140774 - DNA, 11 bp, Homo sapiens
aatgagggagg

SEQ ID NO: 1140775 - DNA, 16 bp, Homo sapiens
aatgagggtttctgat

SEQ ID NO: 1140776 - DNA, 15 bp, Homo sapiens
aatgaggtcccaggc

SEQ ID NO: 1140777 - DNA, 16 bp, Homo sapiens
aatgaggtctgaaatg

SEQ ID NO: 1140778 - DNA, 14 bp, Homo sapiens
aatgaggtctgttt

SEQ ID NO: 1140779 - DNA, 17 bp, Homo sapiens
aatgagtaaaaactaga

SEQ ID NO: 1140780 - DNA, 17 bp, Homo sapiens
aatgagtaacatttgct

SEQ ID NO: 1140781 - DNA, 14 bp, Homo sapiens
aatgagtcaatcag

SEQ ID NO: 1140782 - DNA, 21 bp, Homo sapiens
aatgagtcaatcagcctttag

SEQ ID NO: 1140783 - DNA, 17 bp, Homo sapiens
aatgagtcatttgttta

SEQ ID NO: 1140784 - DNA, 16 bp, Homo sapiens
aatgagtgaattgaat

SEQ ID NO: 1140785 - DNA, 15 bp, Homo sapiens
aatgagtttgtatta

SEQ ID NO: 1140786 - DNA, 17 bp, Homo sapiens
aatgagtttgtattatt

SEQ ID NO: 1140787 - DNA, 22 bp, Homo sapiens
aatgataaactcagatctgatc

SEQ ID NO: 1140788 - DNA, 23 bp, Homo sapiens
aatgatatactgatcttcattac

SEQ ID NO: 1140789 - DNA, 18 bp, Homo sapiens
aatgatatagccagaaaa

SEQ ID NO: 1140790 - DNA, 12 bp, Homo sapiens
aatgatatcttt

SEQ ID NO: 1140791 - DNA, 14 bp, Homo sapiens
aatgatattgctga

SEQ ID NO: 1140792 - DNA, 16 bp, Homo sapiens
aatgatattgctgaag

SEQ ID NO: 1140793 - DNA, 21 bp, Homo sapiens
aatgatatttaggtttttggc

SEQ ID NO: 1140794 - DNA, 15 bp, Homo sapiens
aatgatcaaaacatg

SEQ ID NO: 1140795 - DNA, 19 bp, Homo sapiens
aatgatcacatctaaagct

SEQ ID NO: 1140796 - DNA, 20 bp, Homo sapiens
aatgatcacatctaaagctt

SEQ ID NO: 1140797 - DNA, 21 bp, Homo sapiens
aatgatcacatctaaagcttt

SEQ ID NO: 1140798 - DNA, 15 bp, Homo sapiens
aatgatcagaacaaa

SEQ ID NO: 1140799 - DNA, 16 bp, Homo sapiens
aatgatcagcatctgt

SEQ ID NO: 1140800 - DNA, 22 bp, Homo sapiens
aatgatcatatcaattggcagt

SEQ ID NO: 1140801 - DNA, 14 bp, Homo sapiens
aatgatcatgaaac

SEQ ID NO: 1140802 - DNA, 19 bp, Homo sapiens
aatgatccccagctgttta

SEQ ID NO: 1140803 - DNA, 18 bp, Homo sapiens
aatgatcgaaaaaataat

SEQ ID NO: 1140804 - DNA, 23 bp, Homo sapiens
aatgatcgaaaaaataattattt

SEQ ID NO: 1140805 - DNA, 19 bp, Homo sapiens
aatgatctcggatgaccaa

SEQ ID NO: 1140806 - DNA, 22 bp, Homo sapiens
aatgatctctctgaatcctaag

SEQ ID NO: 1140807 - DNA, 16 bp, Homo sapiens
aatgatctcttctttt

SEQ ID NO: 1140808 - DNA, 18 bp, Homo sapiens
aatgatgaaatctttctt

SEQ ID NO: 1140809 - DNA, 17 bp, Homo sapiens
aatgatgatgataatga

SEQ ID NO: 1140810 - DNA, 15 bp, Homo sapiens
aatgatggaagttca

SEQ ID NO: 1140811 - DNA, 20 bp, Homo sapiens
aatgatggtaaagccatgtt

SEQ ID NO: 1140812 - DNA, 14 bp, Homo sapiens
aatgatgtccagaa

SEQ ID NO: 1140813 - DNA, 15 bp, Homo sapiens
aatgatgtgcaaaac

SEQ ID NO: 1140814 - DNA, 17 bp, Homo sapiens
aatgatgtgcaaaacct

SEQ ID NO: 1140815 - DNA, 21 bp, Homo sapiens
aatgatgtgtacccaaacgtg

SEQ ID NO: 1140816 - DNA, 14 bp, Homo sapiens
aatgatgttttaaa

SEQ ID NO: 1140817 - DNA, 16 bp, Homo sapiens
aatgatgttttaaaaa

SEQ ID NO: 1140818 - DNA, 22 bp, Homo sapiens
aatgattataagccctgcataa

SEQ ID NO: 1140819 - DNA, 18 bp, Homo sapiens
aatgattatattcacaga

SEQ ID NO: 1140820 - DNA, 23 bp, Homo sapiens
aatgattcagtgttaaatgtgat

SEQ ID NO: 1140821 - DNA, 14 bp, Homo sapiens
aatgattcatgtta

SEQ ID NO: 1140822 - DNA, 20 bp, Homo sapiens
aatgattgaaaataatgctg

SEQ ID NO: 1140823 - DNA, 17 bp, Homo sapiens
aatgattggttaaaatg

SEQ ID NO: 1140824 - DNA, 20 bp, Homo sapiens
aatgattggttaaaatgtga

SEQ ID NO: 1140825 - DNA, 21 bp, Homo sapiens
aatgattggttaaaatgtgat

SEQ ID NO: 1140826 - DNA, 14 bp, Homo sapiens
aatgattgtaaaat

SEQ ID NO: 1140827 - DNA, 15 bp, Homo sapiens
aatgattgtagtaat

SEQ ID NO: 1140828 - DNA, 22 bp, Homo sapiens
aatgatttcatgctatctctgt

SEQ ID NO: 1140829 - DNA, 18 bp, Homo sapiens
aatgatttccaaagagaa

SEQ ID NO: 1140830 - DNA, 20 bp, Homo sapiens
aatgatttccaaagagaaaa

SEQ ID NO: 1140831 - DNA, 15 bp, Homo sapiens
aatgatttgctcttt

SEQ ID NO: 1140832 - DNA, 12 bp, Homo sapiens
aatgatttgtgt

SEQ ID NO: 1140833 - DNA, 20 bp, Homo sapiens
aatgatttgtgtttctttat

SEQ ID NO: 1140834 - DNA, 17 bp, Homo sapiens
aatgatttttctttaca

SEQ ID NO: 1140835 - DNA, 12 bp, Homo sapiens
aatgcaaaatga

SEQ ID NO: 1140836 - DNA, 13 bp, Homo sapiens
aatgcaaaattag

SEQ ID NO: 1140837 - DNA, 14 bp, Homo sapiens
aatgcaaatgaatc

SEQ ID NO: 1140838 - DNA, 16 bp, Homo sapiens
aatgcaaatgaatcat

SEQ ID NO: 1140839 - DNA, 13 bp, Homo sapiens
aatgcaaattaaa

SEQ ID NO: 1140840 - DNA, 18 bp, Homo sapiens
aatgcaaattaaaacata

SEQ ID NO: 1140841 - DNA, 19 bp, Homo sapiens
aatgcaaatttctataaat

SEQ ID NO: 1140842 - DNA, 19 bp, Homo sapiens
aatgcaagagtgattgcag

SEQ ID NO: 1140843 - DNA, 16 bp, Homo sapiens
aatgcaaggggctgca

SEQ ID NO: 1140844 - DNA, 21 bp, Homo sapiens
aatgcaagtaagactttctga

SEQ ID NO: 1140845 - DNA, 13 bp, Homo sapiens
aatgcaataactc

SEQ ID NO: 1140846 - DNA, 15 bp, Homo sapiens
aatgcaataactctg

SEQ ID NO: 1140847 - DNA, 13 bp, Homo sapiens
aatgcaataattt

SEQ ID NO: 1140848 - DNA, 14 bp, Homo sapiens
aatgcaataatttt

SEQ ID NO: 1140849 - DNA, 17 bp, Homo sapiens
aatgcaataattttact

SEQ ID NO: 1140850 - DNA, 17 bp, Homo sapiens
aatgcaatttaaaatta

SEQ ID NO: 1140851 - DNA, 16 bp, Homo sapiens
aatgcaatttgattga

SEQ ID NO: 1140852 - DNA, 16 bp, Homo sapiens
aatgcacaagctcaga

SEQ ID NO: 1140853 - DNA, 17 bp, Homo sapiens
aatgcacaagctcagaa

SEQ ID NO: 1140854 - DNA, 13 bp, Homo sapiens
aatgcacctggaa

SEQ ID NO: 1140855 - DNA, 22 bp, Homo sapiens
aatgcactgtattgctcctccc

SEQ ID NO: 1140856 - DNA, 15 bp, Homo sapiens
aatgcactttctatc

SEQ ID NO: 1140857 - DNA, 21 bp, Homo sapiens
aatggaattgcttctgtgtag

SEQ ID NO: 1140858 - DNA, 14 bp, Homo sapiens
aatggacacaaatt

SEQ ID NO: 1140859 - DNA, 17 bp, Homo sapiens
aatggacacaaattttc

SEQ ID NO: 1140860 - DNA, 20 bp, Homo sapiens
aatggacacaaattttcaag

SEQ ID NO: 1140861 - DNA, 21 bp, Homo sapiens
aatggacacaaattttcaagt

SEQ ID NO: 1140862 - DNA, 22 bp, Homo sapiens
aatggacatcctgtataagcac

SEQ ID NO: 1140863 - DNA, 20 bp, Homo sapiens
aatggactaaaacattttga

SEQ ID NO: 1140864 - DNA, 14 bp, Homo sapiens
aatggactcaaact

SEQ ID NO: 1140865 - DNA, 21 bp, Homo sapiens
aatggactgtgaatttcaaaa

SEQ ID NO: 1140866 - DNA, 17 bp, Homo sapiens
aatggagcatcaagcca

SEQ ID NO: 1140867 - DNA, 22 bp, Homo sapiens
aatggagctcagtaacataact

SEQ ID NO: 1140868 - DNA, 18 bp, Homo sapiens
aatggaggagtctcaaca

SEQ ID NO: 1140869 - DNA, 22 bp, Homo sapiens
aatggaggggcagagccaggaa

SEQ ID NO: 1140870 - DNA, 20 bp, Homo sapiens
aatggagtctcccactgcaa

SEQ ID NO: 1140871 - DNA, 14 bp, Homo sapiens
aatggagtcttttc

SEQ ID NO: 1140872 - DNA, 16 bp, Homo sapiens
aatggatacataaaga

SEQ ID NO: 1140873 - DNA, 14 bp, Homo sapiens
aatggatagctcat

SEQ ID NO: 1140874 - DNA, 23 bp, Homo sapiens
aatggatatagaaaatcttagta

SEQ ID NO: 1140875 - DNA, 14 bp, Homo sapiens
aatggatattatta

SEQ ID NO: 1140876 - DNA, 17 bp, Homo sapiens
aatggatcacaagatgg

SEQ ID NO: 1140877 - DNA, 13 bp, Homo sapiens
aatggatccacaa

SEQ ID NO: 1140878 - DNA, 14 bp, Homo sapiens
aatggattctctat

SEQ ID NO: 1140879 - DNA, 19 bp, Homo sapiens
aatggatttttgactttgt

SEQ ID NO: 1140880 - DNA, 21 bp, Homo sapiens
aatggcaaggcagccctgtct

SEQ ID NO: 1140881 - DNA, 23 bp, Homo sapiens
aatggcaaggcagccctgtctga

SEQ ID NO: 1140882 - DNA, 21 bp, Homo sapiens
aatggcaatagggtagaatga

SEQ ID NO: 1140883 - DNA, 10 bp, Homo sapiens
aatggcacct

SEQ ID NO: 1140884 - DNA, 18 bp, Homo sapiens
aatggcaccttccccctt

SEQ ID NO: 1140885 - DNA, 22 bp, Homo sapiens
aatggcagcattcccaccaaca

SEQ ID NO: 1140886 - DNA, 13 bp, Homo sapiens
aatggcagctaga

SEQ ID NO: 1140887 - DNA, 16 bp, Homo sapiens
aatggcagctagtgcc

SEQ ID NO: 1140888 - DNA, 18 bp, Homo sapiens
aatggcagctagtgcctt

SEQ ID NO: 1140889 - DNA, 13 bp, Homo sapiens
aatggcagtttga

SEQ ID NO: 1140890 - DNA, 20 bp, Homo sapiens
aatggccagagcctctggcc

SEQ ID NO: 1140891 - DNA, 13 bp, Homo sapiens
aatggccagtgct

SEQ ID NO: 1140892 - DNA, 16 bp, Homo sapiens
aatggccagtgctgct

SEQ ID NO: 1140893 - DNA, 15 bp, Homo sapiens
aatggccagttttct

SEQ ID NO: 1140894 - DNA, 12 bp, Homo sapiens
aatggccatgca

SEQ ID NO: 1140895 - DNA, 15 bp, Homo sapiens
aatggccatgcagga

SEQ ID NO: 1140896 - DNA, 17 bp, Homo sapiens
aatggccatgcaggagg

SEQ ID NO: 1140897 - DNA, 18 bp, Homo sapiens
aatggccatgcaggaggt

SEQ ID NO: 1140898 - DNA, 15 bp, Homo sapiens
aatggcctcatgtgg

SEQ ID NO: 1140899 - DNA, 14 bp, Homo sapiens
aatggcctgccttg

SEQ ID NO: 1140900 - DNA, 13 bp, Homo sapiens
aatggcctttatt

SEQ ID NO: 1140901 - DNA, 22 bp, Homo sapiens
atcaaatactttaaaggaaaaa

SEQ ID NO: 1140902 - DNA, 11 bp, Homo sapiens
atcaaatatag

SEQ ID NO: 1140903 - DNA, 14 bp, Homo sapiens
atcaaatatagaaa

SEQ ID NO: 1140904 - DNA, 20 bp, Homo sapiens
atcaaatctaccactgtatg

SEQ ID NO: 1140905 - DNA, 17 bp, Homo sapiens
atcaaatctcctgctga

SEQ ID NO: 1140906 - DNA, 21 bp, Homo sapiens
atcaaatctgtatatgttgta

SEQ ID NO: 1140907 - DNA, 20 bp, Homo sapiens
atcaaatctgtgctctttca

SEQ ID NO: 1140908 - DNA, 17 bp, Homo sapiens
atcaaatggtatctttt

SEQ ID NO: 1140909 - DNA, 16 bp, Homo sapiens
atcaaatgttacagtt

SEQ ID NO: 1140910 - DNA, 23 bp, Homo sapiens
atcaaatttgaataaaaatctta

SEQ ID NO: 1140911 - DNA, 23 bp, Homo sapiens
atcaaattttgccagagaaacta

SEQ ID NO: 1140912 - DNA, 18 bp, Homo sapiens
atcaacaagagttgtctt

SEQ ID NO: 1140913 - DNA, 23 bp, Homo sapiens
atcaacaataccttttttttcag

SEQ ID NO: 1140914 - DNA, 21 bp, Homo sapiens
atcaacattaggagtaacttt

SEQ ID NO: 1140915 - DNA, 16 bp, Homo sapiens
atcaacatttatgacc

SEQ ID NO: 1140916 - DNA, 20 bp, Homo sapiens
atcaaccaactgcacaatca

SEQ ID NO: 1140917 - DNA, 23 bp, Homo sapiens
atcaaccaactgcacaatcagtt

SEQ ID NO: 1140918 - DNA, 18 bp, Homo sapiens
atcaaccccagacactgg

SEQ ID NO: 1140919 - DNA, 11 bp, Homo sapiens
atcaactgaat

SEQ ID NO: 1140920 - DNA, 22 bp, Homo sapiens
atcaactggagtctatgcttaa

SEQ ID NO: 1140921 - DNA, 16 bp, Homo sapiens
atcaacttgtgtactg

SEQ ID NO: 1140922 - DNA, 14 bp, Homo sapiens
atcaactttaatca

SEQ ID NO: 1140923 - DNA, 15 bp, Homo sapiens
atcaactttaatcaa

SEQ ID NO: 1140924 - DNA, 14 bp, Homo sapiens
atcaactttactgt

SEQ ID NO: 1140925 - DNA, 21 bp, Homo sapiens
atcaagaaaaaaagggagaat

SEQ ID NO: 1140926 - DNA, 15 bp, Homo sapiens
atcaagactatctac

SEQ ID NO: 1140927 - DNA, 19 bp, Homo sapiens
atcaagactatctacaaaa

SEQ ID NO: 1140928 - DNA, 16 bp, Homo sapiens
atcaagagaaacttca

SEQ ID NO: 1140929 - DNA, 18 bp, Homo sapiens
atcaagagaatcaacaga

SEQ ID NO: 1140930 - DNA, 21 bp, Homo sapiens
atcaagagaatcaacagatga

SEQ ID NO: 1140931 - DNA, 21 bp, Homo sapiens
atcaagagtccggatttctaa

SEQ ID NO: 1140932 - DNA, 13 bp, Homo sapiens
atcaagatatatg

SEQ ID NO: 1140933 - DNA, 22 bp, Homo sapiens
atcaagatgagagaactggagg

SEQ ID NO: 1140934 - DNA, 17 bp, Homo sapiens
atcaagcaggaattatg

SEQ ID NO: 1140935 - DNA, 18 bp, Homo sapiens
atcaagcaggaattatgt

SEQ ID NO: 1140936 - DNA, 19 bp, Homo sapiens
atcaagcaggaattatgtc

SEQ ID NO: 1140937 - DNA, 14 bp, Homo sapiens
atcaagccagttct

SEQ ID NO: 1140938 - DNA, 16 bp, Homo sapiens
atcaagctagaaggcc

SEQ ID NO: 1140939 - DNA, 17 bp, Homo sapiens
atcaagcttgtgtactt

SEQ ID NO: 1140940 - DNA, 17 bp, Homo sapiens
atcaagcttttctgtag

SEQ ID NO: 1140941 - DNA, 19 bp, Homo sapiens
atcaagcttttctgtagat

SEQ ID NO: 1140942 - DNA, 14 bp, Homo sapiens
atcaaggcaaaagg

SEQ ID NO: 1140943 - DNA, 18 bp, Homo sapiens
atcaagggaagaactatt

SEQ ID NO: 1140944 - DNA, 23 bp, Homo sapiens
atcaaggttataattttttttaa

SEQ ID NO: 1140945 - DNA, 14 bp, Homo sapiens
atcaagtaatacaa

SEQ ID NO: 1140946 - DNA, 15 bp, Homo sapiens
atcaagtaatacaaa

SEQ ID NO: 1140947 - DNA, 18 bp, Homo sapiens
atcaagtacctatattga

SEQ ID NO: 1140948 - DNA, 21 bp, Homo sapiens
atcaagtacctatattgattt

SEQ ID NO: 1140949 - DNA, 13 bp, Homo sapiens
atcaagtatagaa

SEQ ID NO: 1140950 - DNA, 17 bp, Homo sapiens
atcaagtatagaaaatc

SEQ ID NO: 1140951 - DNA, 21 bp, Homo sapiens
atcaagtatagaaaatcttca

SEQ ID NO: 1140952 - DNA, 18 bp, Homo sapiens
atcaagtattataccttt

SEQ ID NO: 1140953 - DNA, 12 bp, Homo sapiens
atcaagtcaccg

SEQ ID NO: 1140954 - DNA, 16 bp, Homo sapiens
atcaagtccatctgac

SEQ ID NO: 1140955 - DNA, 13 bp, Homo sapiens
atcaagtgcagtc

SEQ ID NO: 1140956 - DNA, 17 bp, Homo sapiens
atcaagtggcatgtgct

SEQ ID NO: 1140957 - DNA, 16 bp, Homo sapiens
atcaagtgtcttccat

SEQ ID NO: 1140958 - DNA, 16 bp, Homo sapiens
atcaagtgtgctttag

SEQ ID NO: 1140959 - DNA, 23 bp, Homo sapiens
atcaagttgttgactgtgattag

SEQ ID NO: 1140960 - DNA, 15 bp, Homo sapiens
atcaataaaatgtga

SEQ ID NO: 1140961 - DNA, 13 bp, Homo sapiens
atcaataagaagg

SEQ ID NO: 1140962 - DNA, 16 bp, Homo sapiens
atcaatatcccaacat

SEQ ID NO: 1140963 - DNA, 17 bp, Homo sapiens
atcaatatcccaacatt

SEQ ID NO: 1140964 - DNA, 13 bp, Homo sapiens
atcaatcaaataa

SEQ ID NO: 1140965 - DNA, 15 bp, Homo sapiens
atcaatcaatggtgc

SEQ ID NO: 1140966 - DNA, 17 bp, Homo sapiens
atcaatcaggaatgagt

SEQ ID NO: 1140967 - DNA, 19 bp, Homo sapiens
atcaatcatctgtgtgaaa

SEQ ID NO: 1140968 - DNA, 18 bp, Homo sapiens
atcaatcttgttactgct

SEQ ID NO: 1140969 - DNA, 20 bp, Homo sapiens
atcaatgaggtatcttcttt

SEQ ID NO: 1140970 - DNA, 14 bp, Homo sapiens
atcaatgggaaata

SEQ ID NO: 1140971 - DNA, 22 bp, Homo sapiens
atcaatgggatatgattggttc

SEQ ID NO: 1140972 - DNA, 14 bp, Homo sapiens
atcaatggtgcaaa

SEQ ID NO: 1140973 - DNA, 17 bp, Homo sapiens
atcaatggtgcaaaaaa

SEQ ID NO: 1140974 - DNA, 19 bp, Homo sapiens
atcaatgtttcttctaggt

SEQ ID NO: 1140975 - DNA, 13 bp, Homo sapiens
atcaattaaatgt

SEQ ID NO: 1140976 - DNA, 20 bp, Homo sapiens
atcaattggcagtgactttg

SEQ ID NO: 1140977 - DNA, 21 bp, Homo sapiens
atcaattggcagtgactttgt

SEQ ID NO: 1140978 - DNA, 23 bp, Homo sapiens
atcaattggcagtgactttgtat

SEQ ID NO: 1140979 - DNA, 16 bp, Homo sapiens
atcagagagtgtacat

SEQ ID NO: 1140980 - DNA, 16 bp, Homo sapiens
atcagagcaggacctc

SEQ ID NO: 1140981 - DNA, 20 bp, Homo sapiens
atcagaggtttgcttcctca

SEQ ID NO: 1140982 - DNA, 22 bp, Homo sapiens
atcagaggtttgcttcctcagt

SEQ ID NO: 1140983 - DNA, 13 bp, Homo sapiens
atcagatacatca

SEQ ID NO: 1140984 - DNA, 15 bp, Homo sapiens
atcagatagcatctt

SEQ ID NO: 1140985 - DNA, 16 bp, Homo sapiens
atcagatatgcttact

SEQ ID NO: 1140986 - DNA, 12 bp, Homo sapiens
atcagatcaaga

SEQ ID NO: 1140987 - DNA, 18 bp, Homo sapiens
atcagatcatttcaaaac

SEQ ID NO: 1140988 - DNA, 21 bp, Homo sapiens
atcagatctggggcagcaccc

SEQ ID NO: 1140989 - DNA, 23 bp, Homo sapiens
atcagatgaactcttagaaatga

SEQ ID NO: 1140990 - DNA, 21 bp, Homo sapiens
atcagatgctgaattgagaat

SEQ ID NO: 1140991 - DNA, 13 bp, Homo sapiens
atcagcaaagaaa

SEQ ID NO: 1140992 - DNA, 14 bp, Homo sapiens
atcagcaaagaaaa

SEQ ID NO: 1140993 - DNA, 17 bp, Homo sapiens
atcagcaatattgcctg

SEQ ID NO: 1140994 - DNA, 14 bp, Homo sapiens
atcagcatgacaaa

SEQ ID NO: 1140995 - DNA, 22 bp, Homo sapiens
atcagcatgacaaaaataacac

SEQ ID NO: 1140996 - DNA, 15 bp, Homo sapiens
atcagcattgtttca

SEQ ID NO: 1140997 - DNA, 14 bp, Homo sapiens
atcagccattaaaa

SEQ ID NO: 1140998 - DNA, 24 bp, Homo sapiens
atcagccattaaaataaaacaagc

SEQ ID NO: 1140999 - DNA, 16 bp, Homo sapiens
atcagccatttgccat

SEQ ID NO: 1141000 - DNA, 15 bp, Homo sapiens
atcagcccccagcct

SEQ ID NO: 1141001 - DNA, 16 bp, Homo sapiens
atcagcccccagcctt

SEQ ID NO: 1141002 - DNA, 13 bp, Homo sapiens
atcagccccgcct

SEQ ID NO: 1141003 - DNA, 20 bp, Homo sapiens
atcagccccgcctgtcacaa

SEQ ID NO: 1141004 - DNA, 21 bp, Homo sapiens
atcagccccgcctgtcacaat

SEQ ID NO: 1141005 - DNA, 23 bp, Homo sapiens
atcagccccgcctgtcacaataa

SEQ ID NO: 1141006 - DNA, 21 bp, Homo sapiens
atcagcctgggcaatgtgata

SEQ ID NO: 1141007 - DNA, 20 bp, Homo sapiens
atcagcctggggcctgggga

SEQ ID NO: 1141008 - DNA, 20 bp, Homo sapiens
atcagcgggtctcctcccag

SEQ ID NO: 1141009 - DNA, 16 bp, Homo sapiens
atcagcgtagtgtttt

SEQ ID NO: 1141010 - DNA, 16 bp, Homo sapiens
atcagctcccaacgag

SEQ ID NO: 1141011 - DNA, 15 bp, Homo sapiens
atcagctctcctggc

SEQ ID NO: 1141012 - DNA, 16 bp, Homo sapiens
atcagctctctgctgg

SEQ ID NO: 1141013 - DNA, 12 bp, Homo sapiens
atcagctgggca

SEQ ID NO: 1141014 - DNA, 14 bp, Homo sapiens
atcagctgggcagt

SEQ ID NO: 1141015 - DNA, 16 bp, Homo sapiens
atcagcttcttgcact

SEQ ID NO: 1141016 - DNA, 18 bp, Homo sapiens
atcagcttttctgatggt

SEQ ID NO: 1141017 - DNA, 20 bp, Homo sapiens
atcagcttttgttctagact

SEQ ID NO: 1141018 - DNA, 14 bp, Homo sapiens
atcaggaaaggctg

SEQ ID NO: 1141019 - DNA, 14 bp, Homo sapiens
atcaggaaccaggg

SEQ ID NO: 1141020 - DNA, 15 bp, Homo sapiens
atcaggaaccagggc

SEQ ID NO: 1141021 - DNA, 16 bp, Homo sapiens
atcaggaaccagggcc

SEQ ID NO: 1141022 - DNA, 14 bp, Homo sapiens
atcaggaagactgg

SEQ ID NO: 1141023 - DNA, 22 bp, Homo sapiens
atcaggaatattttccaaagag

SEQ ID NO: 1141024 - DNA, 22 bp, Homo sapiens
atcaggagcccccaacacaggc

SEQ ID NO: 1141025 - DNA, 19 bp, Homo sapiens
atcaggataccagaggaag

SEQ ID NO: 1141026 - DNA, 12 bp, Homo sapiens
atcaggatgaac

SEQ ID NO: 1141027 - DNA, 19 bp, Homo sapiens
atcaggatgaacccaggac

SEQ ID NO: 1141028 - DNA, 13 bp, Homo sapiens
atcaggcactggt

SEQ ID NO: 1141029 - DNA, 16 bp, Homo sapiens
atcaggctcctcagcc

SEQ ID NO: 1141030 - DNA, 15 bp, Homo sapiens
atcagggccctgccc

SEQ ID NO: 1141031 - DNA, 18 bp, Homo sapiens
aatgtataattaacttaa

SEQ ID NO: 1141032 - DNA, 20 bp, Homo sapiens
aatgtataattaacttaact

SEQ ID NO: 1141033 - DNA, 12 bp, Homo sapiens
aatgtatataaa

SEQ ID NO: 1141034 - DNA, 13 bp, Homo sapiens
aatgtatataaaa

SEQ ID NO: 1141035 - DNA, 21 bp, Homo sapiens
aatgtatatgttttgtgggaa

SEQ ID NO: 1141036 - DNA, 18 bp, Homo sapiens
aatgtatatttgctgcaa

SEQ ID NO: 1141037 - DNA, 20 bp, Homo sapiens
aatgtatatttgctgcaaag

SEQ ID NO: 1141038 - DNA, 21 bp, Homo sapiens
aatgtatatttgctgcaaaga

SEQ ID NO: 1141039 - DNA, 22 bp, Homo sapiens
aatgtatatttgctgcaaagag

SEQ ID NO: 1141040 - DNA, 13 bp, Homo sapiens
aatgtatcaggaa

SEQ ID NO: 1141041 - DNA, 22 bp, Homo sapiens
aatgtatcatttttgtgcacag

SEQ ID NO: 1141042 - DNA, 23 bp, Homo sapiens
aatgtatccaaggaaacatttta

SEQ ID NO: 1141043 - DNA, 16 bp, Homo sapiens
aatgtatccagaggaa

SEQ ID NO: 1141044 - DNA, 14 bp, Homo sapiens
aatgtatctaagaa

SEQ ID NO: 1141045 - DNA, 17 bp, Homo sapiens
aatgtatctatttgtac

SEQ ID NO: 1141046 - DNA, 18 bp, Homo sapiens
aatgtatctatttgtaca

SEQ ID NO: 1141047 - DNA, 19 bp, Homo sapiens
aatgtatctatttgtacaa

SEQ ID NO: 1141048 - DNA, 20 bp, Homo sapiens
aatgtatctatttgtacaat

SEQ ID NO: 1141049 - DNA, 13 bp, Homo sapiens
aatgtatcttatt

SEQ ID NO: 1141050 - DNA, 17 bp, Homo sapiens
aatgtatcttattcaca

SEQ ID NO: 1141051 - DNA, 20 bp, Homo sapiens
aatgtatctttattaaaaca

SEQ ID NO: 1141052 - DNA, 14 bp, Homo sapiens
aatgtatgtaaata

SEQ ID NO: 1141053 - DNA, 19 bp, Homo sapiens
aatgtatgtaatgtgtggt

SEQ ID NO: 1141054 - DNA, 17 bp, Homo sapiens
aatgtatgtacaataca

SEQ ID NO: 1141055 - DNA, 19 bp, Homo sapiens
aatgtatgtacaatacaat

SEQ ID NO: 1141056 - DNA, 13 bp, Homo sapiens
aatgtatgtgcac

SEQ ID NO: 1141057 - DNA, 21 bp, Homo sapiens
aatgtatgtgcactgtcactt

SEQ ID NO: 1141058 - DNA, 14 bp, Homo sapiens
aatgtatgtgtaag

SEQ ID NO: 1141059 - DNA, 22 bp, Homo sapiens
aatgtattatgtcctgtgagat

SEQ ID NO: 1141060 - DNA, 14 bp, Homo sapiens
aatgtattattctg

SEQ ID NO: 1141061 - DNA, 16 bp, Homo sapiens
aatgtattattctgca

SEQ ID NO: 1141062 - DNA, 16 bp, Homo sapiens
aatgtattcccttcag

SEQ ID NO: 1141063 - DNA, 21 bp, Homo sapiens
aatgtattctatctctcttta

SEQ ID NO: 1141064 - DNA, 19 bp, Homo sapiens
aatgtattgattacaaata

SEQ ID NO: 1141065 - DNA, 19 bp, Homo sapiens
aatgtattgattcaacagg

SEQ ID NO: 1141066 - DNA, 14 bp, Homo sapiens
aatgtatttaatta

SEQ ID NO: 1141067 - DNA, 14 bp, Homo sapiens
aatgtatttcctga

SEQ ID NO: 1141068 - DNA, 18 bp, Homo sapiens
aatgtatttcctgaaata

SEQ ID NO: 1141069 - DNA, 12 bp, Homo sapiens
aatgtattttaa

SEQ ID NO: 1141070 - DNA, 23 bp, Homo sapiens
aatgtattttggttgctgatgtt

SEQ ID NO: 1141071 - DNA, 17 bp, Homo sapiens
aatgtcacagtaatgca

SEQ ID NO: 1141072 - DNA, 16 bp, Homo sapiens
aatgtcaccaccttcc

SEQ ID NO: 1141073 - DNA, 13 bp, Homo sapiens
aatgtcagaaaat

SEQ ID NO: 1141074 - DNA, 19 bp, Homo sapiens
aatgtcagaaaccagttat

SEQ ID NO: 1141075 - DNA, 14 bp, Homo sapiens
aatgtcagatttct

SEQ ID NO: 1141076 - DNA, 18 bp, Homo sapiens
aatgtcagatttctggtt

SEQ ID NO: 1141077 - DNA, 13 bp, Homo sapiens
aatgtcagccttt

SEQ ID NO: 1141078 - DNA, 18 bp, Homo sapiens
aatgtcaggaacagaagg

SEQ ID NO: 1141079 - DNA, 20 bp, Homo sapiens
aatgtcaggaacagaaggat

SEQ ID NO: 1141080 - DNA, 23 bp, Homo sapiens
aatgtcagttctgatatggaagc

SEQ ID NO: 1141081 - DNA, 15 bp, Homo sapiens
aatgtcatatactgc

SEQ ID NO: 1141082 - DNA, 14 bp, Homo sapiens
aatgtcattgaaaa

SEQ ID NO: 1141083 - DNA, 14 bp, Homo sapiens
aatgtcattgctaa

SEQ ID NO: 1141084 - DNA, 15 bp, Homo sapiens
aatgtcattgtctac

SEQ ID NO: 1141085 - DNA, 16 bp, Homo sapiens
aatgtccagccacccc

SEQ ID NO: 1141086 - DNA, 15 bp, Homo sapiens
aatgtccccactccc

SEQ ID NO: 1141087 - DNA, 16 bp, Homo sapiens
aatgtccccactcccg

SEQ ID NO: 1141088 - DNA, 23 bp, Homo sapiens
aatgtcccccatcatgtggccca

SEQ ID NO: 1141089 - DNA, 22 bp, Homo sapiens
aatgtcctaacagagaaataga

SEQ ID NO: 1141090 - DNA, 18 bp, Homo sapiens
aatgtcctccagaagcct

SEQ ID NO: 1141091 - DNA, 18 bp, Homo sapiens
aatgtcctgaaacatgaa

SEQ ID NO: 1141092 - DNA, 18 bp, Homo sapiens
aatgtcgagtatattatt

SEQ ID NO: 1141093 - DNA, 20 bp, Homo sapiens
aatgtcgagtatattattat

SEQ ID NO: 1141094 - DNA, 15 bp, Homo sapiens
aatgtcgatcaagag

SEQ ID NO: 1141095 - DNA, 20 bp, Homo sapiens
aatgtcgatcaagagaatca

SEQ ID NO: 1141096 - DNA, 18 bp, Homo sapiens
aatgtctaaatgctgaaa

SEQ ID NO: 1141097 - DNA, 14 bp, Homo sapiens
aatgtctaattttc

SEQ ID NO: 1141098 - DNA, 15 bp, Homo sapiens
aatgtctcccacacc

SEQ ID NO: 1141099 - DNA, 19 bp, Homo sapiens
aatgtctcccacacccacc

SEQ ID NO: 1141100 - DNA, 12 bp, Homo sapiens
aatgtctctgct

SEQ ID NO: 1141101 - DNA, 16 bp, Homo sapiens
aatgtttaaatataaa

SEQ ID NO: 1141102 - DNA, 18 bp, Homo sapiens
aatgtttaaatcatgtat

SEQ ID NO: 1141103 - DNA, 22 bp, Homo sapiens
aatgtttatactgtatttctaa

SEQ ID NO: 1141104 - DNA, 15 bp, Homo sapiens
aatgtttatgagcca

SEQ ID NO: 1141105 - DNA, 17 bp, Homo sapiens
aatgtttatgagccaga

SEQ ID NO: 1141106 - DNA, 23 bp, Homo sapiens
aatgtttatgcaaggaaggaaag

SEQ ID NO: 1141107 - DNA, 20 bp, Homo sapiens
aatgtttattatttacatca

SEQ ID NO: 1141108 - DNA, 21 bp, Homo sapiens
aatgtttatttagctctgaag

SEQ ID NO: 1141109 - DNA, 22 bp, Homo sapiens
aatgtttatttagctctgaagc

SEQ ID NO: 1141110 - DNA, 20 bp, Homo sapiens
aatgtttccaacctggagta

SEQ ID NO: 1141111 - DNA, 15 bp, Homo sapiens
aatgtttcctccaaa

SEQ ID NO: 1141112 - DNA, 13 bp, Homo sapiens
aatgtttccttaa

SEQ ID NO: 1141113 - DNA, 20 bp, Homo sapiens
aatgtttcttcatttctctg

SEQ ID NO: 1141114 - DNA, 23 bp, Homo sapiens
aatgtttcttctaggttctaaaa

SEQ ID NO: 1141115 - DNA, 17 bp, Homo sapiens
aatgtttcttttccctt

SEQ ID NO: 1141116 - DNA, 18 bp, Homo sapiens
aatgtttgaaaacaaaaa

SEQ ID NO: 1141117 - DNA, 13 bp, Homo sapiens
aatgtttgatgtc

SEQ ID NO: 1141118 - DNA, 13 bp, Homo sapiens
aatgtttgattta

SEQ ID NO: 1141119 - DNA, 21 bp, Homo sapiens
aatgtttggattctcttagct

SEQ ID NO: 1141120 - DNA, 14 bp, Homo sapiens
aatgtttgtatttt

SEQ ID NO: 1141121 - DNA, 21 bp, Homo sapiens
aatgtttgtgatattaaattt

SEQ ID NO: 1141122 - DNA, 15 bp, Homo sapiens
aatgtttgttattta

SEQ ID NO: 1141123 - DNA, 14 bp, Homo sapiens
aatgttttaaatgt

SEQ ID NO: 1141124 - DNA, 15 bp, Homo sapiens
aatgttttaaatgta

SEQ ID NO: 1141125 - DNA, 19 bp, Homo sapiens
aatgttttaaatgtacaga

SEQ ID NO: 1141126 - DNA, 20 bp, Homo sapiens
aatgttttactgtgaaactg

SEQ ID NO: 1141127 - DNA, 17 bp, Homo sapiens
aatgttttatttatcaa

SEQ ID NO: 1141128 - DNA, 19 bp, Homo sapiens
aatgttttcattatgttca

SEQ ID NO: 1141129 - DNA, 20 bp, Homo sapiens
aatgttttcattatgttcat

SEQ ID NO: 1141130 - DNA, 21 bp, Homo sapiens
aatgttttcattatgttcatg

SEQ ID NO: 1141131 - DNA, 23 bp, Homo sapiens
aatgttttcttcaacatgctcca

SEQ ID NO: 1141132 - DNA, 13 bp, Homo sapiens
aatgttttctttg

SEQ ID NO: 1141133 - DNA, 16 bp, Homo sapiens
aatgttttctttgcaa

SEQ ID NO: 1141134 - DNA, 22 bp, Homo sapiens
aatgttttgccagccacttacc

SEQ ID NO: 1141135 - DNA, 12 bp, Homo sapiens
aatgttttgtaa

SEQ ID NO: 1141136 - DNA, 13 bp, Homo sapiens
aatgttttgtaaa

SEQ ID NO: 1141137 - DNA, 18 bp, Homo sapiens
aatgttttgtaaacattt

SEQ ID NO: 1141138 - DNA, 20 bp, Homo sapiens
aatgtttttccctccccaga

SEQ ID NO: 1141139 - DNA, 13 bp, Homo sapiens
aatgttttttgcc

SEQ ID NO: 1141140 - DNA, 21 bp, Homo sapiens
aattaaaaaaaaagatctgtt

SEQ ID NO: 1141141 - DNA, 18 bp, Homo sapiens
aattaaaaaaaagaagag

SEQ ID NO: 1141142 - DNA, 22 bp, Homo sapiens
aattaaaaaatgaaattaaaaa

SEQ ID NO: 1141143 - DNA, 15 bp, Homo sapiens
aattaaaaactttaa

SEQ ID NO: 1141144 - DNA, 15 bp, Homo sapiens
aattaaaaactttca

SEQ ID NO: 1141145 - DNA, 14 bp, Homo sapiens
aattaaaaatgaaa

SEQ ID NO: 1141146 - DNA, 13 bp, Homo sapiens
aattaaaacactt

SEQ ID NO: 1141147 - DNA, 11 bp, Homo sapiens
aattaaaactg

SEQ ID NO: 1141148 - DNA, 15 bp, Homo sapiens
aattaaaactgagtc

SEQ ID NO: 1141149 - DNA, 18 bp, Homo sapiens
aattaaaagcaaatcatt

SEQ ID NO: 1141150 - DNA, 21 bp, Homo sapiens
aattaaaataggcatattact

SEQ ID NO: 1141151 - DNA, 21 bp, Homo sapiens
aattaaaatggatgccttgaa

SEQ ID NO: 1141152 - DNA, 18 bp, Homo sapiens
aattaaaatggtttttgt

SEQ ID NO: 1141153 - DNA, 14 bp, Homo sapiens
aattaaacaattta

SEQ ID NO: 1141154 - DNA, 14 bp, Homo sapiens
aattaaacattttt

SEQ ID NO: 1141155 - DNA, 15 bp, Homo sapiens
aattaaactttgtat

SEQ ID NO: 1141156 - DNA, 16 bp, Homo sapiens
aattaaagatgccata

SEQ ID NO: 1141157 - DNA, 17 bp, Homo sapiens
aattaaagatgccatag

SEQ ID NO: 1141158 - DNA, 18 bp, Homo sapiens
aattaaaggtcctgccct

SEQ ID NO: 1141159 - DNA, 16 bp, Homo sapiens
aattaaagtactttaa

SEQ ID NO: 1141160 - DNA, 14 bp, Homo sapiens
atcatgcattgttg

SEQ ID NO: 1141161 - DNA, 21 bp, Homo sapiens
atcatgcattgttgaggtggt

SEQ ID NO: 1141162 - DNA, 23 bp, Homo sapiens
atcatgccttgataaatatatat

SEQ ID NO: 1141163 - DNA, 14 bp, Homo sapiens
atcatgcgttttat

SEQ ID NO: 1141164 - DNA, 17 bp, Homo sapiens
atcatgcgttttatatc

SEQ ID NO: 1141165 - DNA, 19 bp, Homo sapiens
atcatggaatatttatagg

SEQ ID NO: 1141166 - DNA, 14 bp, Homo sapiens
atcatggatcttgg

SEQ ID NO: 1141167 - DNA, 20 bp, Homo sapiens
atcatggattcattacagct

SEQ ID NO: 1141168 - DNA, 17 bp, Homo sapiens
atcatggtaatgacaga

SEQ ID NO: 1141169 - DNA, 20 bp, Homo sapiens
atcatggtcaagttcccaac

SEQ ID NO: 1141170 - DNA, 15 bp, Homo sapiens
atcatggtgaaaagc

SEQ ID NO: 1141171 - DNA, 14 bp, Homo sapiens
atcatgtaaatgct

SEQ ID NO: 1141172 - DNA, 11 bp, Homo sapiens
atcatgtatgt

SEQ ID NO: 1141173 - DNA, 16 bp, Homo sapiens
atcatgtatgttatga

SEQ ID NO: 1141174 - DNA, 11 bp, Homo sapiens
atcatgtctgt

SEQ ID NO: 1141175 - DNA, 21 bp, Homo sapiens
atcatgtgctcagaagaggaa

SEQ ID NO: 1141176 - DNA, 16 bp, Homo sapiens
atcatgtggccagccc

SEQ ID NO: 1141177 - DNA, 18 bp, Homo sapiens
atcatgtgggtgagccag

SEQ ID NO: 1141178 - DNA, 15 bp, Homo sapiens
atcatgttaaattag

SEQ ID NO: 1141179 - DNA, 21 bp, Homo sapiens
atcatgttgttgtgtgtatat

SEQ ID NO: 1141180 - DNA, 22 bp, Homo sapiens
atcatgttgttgtgtgtatatg

SEQ ID NO: 1141181 - DNA, 15 bp, Homo sapiens
atcatgtttattttg

SEQ ID NO: 1141182 - DNA, 16 bp, Homo sapiens
atcatgtttattttga

SEQ ID NO: 1141183 - DNA, 14 bp, Homo sapiens
atcatgtttgctct

SEQ ID NO: 1141184 - DNA, 15 bp, Homo sapiens
atcatgtttgctctc

SEQ ID NO: 1141185 - DNA, 18 bp, Homo sapiens
atcatgttttataatttg

SEQ ID NO: 1141186 - DNA, 20 bp, Homo sapiens
atcattaaaaattaccttta

SEQ ID NO: 1141187 - DNA, 24 bp, Homo sapiens
atcattaattagaaggttatcctt

SEQ ID NO: 1141188 - DNA, 17 bp, Homo sapiens
atcattacccttccctg

SEQ ID NO: 1141189 - DNA, 20 bp, Homo sapiens
atcattactgttccagattc

SEQ ID NO: 1141190 - DNA, 11 bp, Homo sapiens
atcattagaac

SEQ ID NO: 1141191 - DNA, 22 bp, Homo sapiens
atcattataactgaaggagaag

SEQ ID NO: 1141192 - DNA, 21 bp, Homo sapiens
atcattcatccaggactgaga

SEQ ID NO: 1141193 - DNA, 22 bp, Homo sapiens
atcattcattcttagctcttaa

SEQ ID NO: 1141194 - DNA, 15 bp, Homo sapiens
atcattccagtgcta

SEQ ID NO: 1141195 - DNA, 19 bp, Homo sapiens
atcattccagtgctagaaa

SEQ ID NO: 1141196 - DNA, 17 bp, Homo sapiens
atcattctacagaataa

SEQ ID NO: 1141197 - DNA, 12 bp, Homo sapiens
atcattctctgt

SEQ ID NO: 1141198 - DNA, 18 bp, Homo sapiens
atcattcttactaaaaag

SEQ ID NO: 1141199 - DNA, 14 bp, Homo sapiens
atcattctttcccc

SEQ ID NO: 1141200 - DNA, 14 bp, Homo sapiens
atcattgaaatact

SEQ ID NO: 1141201 - DNA, 16 bp, Homo sapiens
atcattgaaatacttt

SEQ ID NO: 1141202 - DNA, 18 bp, Homo sapiens
atcattgaaatacttttt

SEQ ID NO: 1141203 - DNA, 13 bp, Homo sapiens
atcattgatttta

SEQ ID NO: 1141204 - DNA, 21 bp, Homo sapiens
atcattgcactctagcctggg

SEQ ID NO: 1141205 - DNA, 12 bp, Homo sapiens
atcattgcattt

SEQ ID NO: 1141206 - DNA, 15 bp, Homo sapiens
atcattgctcccctg

SEQ ID NO: 1141207 - DNA, 17 bp, Homo sapiens
atcattgctcccctgat

SEQ ID NO: 1141208 - DNA, 11 bp, Homo sapiens
atcattgctta

SEQ ID NO: 1141209 - DNA, 18 bp, Homo sapiens
atcattgctttgaagcag

SEQ ID NO: 1141210 - DNA, 13 bp, Homo sapiens
atcattgtatgtg

SEQ ID NO: 1141211 - DNA, 16 bp, Homo sapiens
atcattgtattcttta

SEQ ID NO: 1141212 - DNA, 17 bp, Homo sapiens
atcatttaaaaagctca

SEQ ID NO: 1141213 - DNA, 13 bp, Homo sapiens
atcatttactctt

SEQ ID NO: 1141214 - DNA, 19 bp, Homo sapiens
atcatttattttttacatt

SEQ ID NO: 1141215 - DNA, 23 bp, Homo sapiens
atcatttcagtatcatctccatc

SEQ ID NO: 1141216 - DNA, 23 bp, Homo sapiens
atcatttcctgggagaaagacca

SEQ ID NO: 1141217 - DNA, 11 bp, Homo sapiens
atcatttctgt

SEQ ID NO: 1141218 - DNA, 19 bp, Homo sapiens
atcatttcttgggccctcc

SEQ ID NO: 1141219 - DNA, 22 bp, Homo sapiens
atcatttcttgggccctcctga

SEQ ID NO: 1141220 - DNA, 18 bp, Homo sapiens
atcatttgcccttaagga

SEQ ID NO: 1141221 - DNA, 12 bp, Homo sapiens
atcatttgttca

SEQ ID NO: 1141222 - DNA, 18 bp, Homo sapiens
atcatttgttggaatgaa

SEQ ID NO: 1141223 - DNA, 12 bp, Homo sapiens
aattacattttt

SEQ ID NO: 1141224 - DNA, 17 bp, Homo sapiens
aattacatttttaagct

SEQ ID NO: 1141225 - DNA, 19 bp, Homo sapiens
aattaccatagagtaatga

SEQ ID NO: 1141226 - DNA, 22 bp, Homo sapiens
aattaccatagagtaatgatgt

SEQ ID NO: 1141227 - DNA, 15 bp, Homo sapiens
aattaccattaatta

SEQ ID NO: 1141228 - DNA, 22 bp, Homo sapiens
aattaccattaattacatacag

SEQ ID NO: 1141229 - DNA, 15 bp, Homo sapiens
aattaccatttgtta

SEQ ID NO: 1141230 - DNA, 16 bp, Homo sapiens
aattaccatttgttaa

SEQ ID NO: 1141231 - DNA, 19 bp, Homo sapiens
aattacctaggctgaggtt

SEQ ID NO: 1141232 - DNA, 23 bp, Homo sapiens
aattaccttagattagctctgga

SEQ ID NO: 1141233 - DNA, 14 bp, Homo sapiens
aattaccttctatt

SEQ ID NO: 1141234 - DNA, 16 bp, Homo sapiens
aattacctttaatttt

SEQ ID NO: 1141235 - DNA, 23 bp, Homo sapiens
aattacgttcttacaagcttaaa

SEQ ID NO: 1141236 - DNA, 24 bp, Homo sapiens
aattactaaattgtatacattttg

SEQ ID NO: 1141237 - DNA, 22 bp, Homo sapiens
aattactaataaattgacataa

SEQ ID NO: 1141238 - DNA, 15 bp, Homo sapiens
aattactacaaaatt

SEQ ID NO: 1141239 - DNA, 17 bp, Homo sapiens
aattactatagcaaagt

SEQ ID NO: 1141240 - DNA, 22 bp, Homo sapiens
aattactattcttggttcttat

SEQ ID NO: 1141241 - DNA, 18 bp, Homo sapiens
aattactatttactttat

SEQ ID NO: 1141242 - DNA, 19 bp, Homo sapiens
aattactcagcagaatggt

SEQ ID NO: 1141243 - DNA, 12 bp, Homo sapiens
aattactgtttt

SEQ ID NO: 1141244 - DNA, 13 bp, Homo sapiens
aattacttatttt

SEQ ID NO: 1141245 - DNA, 22 bp, Homo sapiens
aattactttggggctaatttaa

SEQ ID NO: 1141246 - DNA, 14 bp, Homo sapiens
aattactttggtag

SEQ ID NO: 1141247 - DNA, 20 bp, Homo sapiens
aattagaaaaaaattactaa

SEQ ID NO: 1141248 - DNA, 11 bp, Homo sapiens
aattagaaaat

SEQ ID NO: 1141249 - DNA, 19 bp, Homo sapiens
aattagaaaatattctcta

SEQ ID NO: 1141250 - DNA, 12 bp, Homo sapiens
aattagaaaatt

SEQ ID NO: 1141251 - DNA, 13 bp, Homo sapiens
aattagaaaatta

SEQ ID NO: 1141252 - DNA, 13 bp, Homo sapiens
aattagaaatcaa

SEQ ID NO: 1141253 - DNA, 18 bp, Homo sapiens
aattagaaattggctgga

SEQ ID NO: 1141254 - DNA, 13 bp, Homo sapiens
aattagaagacat

SEQ ID NO: 1141255 - DNA, 15 bp, Homo sapiens
aattagaatagtgtt

SEQ ID NO: 1141256 - DNA, 17 bp, Homo sapiens
aattagaatgaatttat

SEQ ID NO: 1141257 - DNA, 19 bp, Homo sapiens
aattagaatgaatttatct

SEQ ID NO: 1141258 - DNA, 18 bp, Homo sapiens
aattagacatcttcagat

SEQ ID NO: 1141259 - DNA, 15 bp, Homo sapiens
aattagagaactgga

SEQ ID NO: 1141260 - DNA, 21 bp, Homo sapiens
aattagagagcatctgcaaca

SEQ ID NO: 1141261 - DNA, 12 bp, Homo sapiens
aattagaggaga

SEQ ID NO: 1141262 - DNA, 13 bp, Homo sapiens
aattagaggagac

SEQ ID NO: 1141263 - DNA, 15 bp, Homo sapiens
aattagattatttct

SEQ ID NO: 1141264 - DNA, 14 bp, Homo sapiens
aattagcagaatgg

SEQ ID NO: 1141265 - DNA, 19 bp, Homo sapiens
aattagcagaatggagaaa

SEQ ID NO: 1141266 - DNA, 20 bp, Homo sapiens
aattagcagaatggagaaag

SEQ ID NO: 1141267 - DNA, 21 bp, Homo sapiens
aattagcagaatggagaaagt

SEQ ID NO: 1141268 - DNA, 22 bp, Homo sapiens
aattagcagaatggagaaagta

SEQ ID NO: 1141269 - DNA, 18 bp, Homo sapiens
aattagcatgcaagcttg

SEQ ID NO: 1141270 - DNA, 20 bp, Homo sapiens
aattaggaataaataaaaat

SEQ ID NO: 1141271 - DNA, 15 bp, Homo sapiens
aattaggctgtaact

SEQ ID NO: 1141272 - DNA, 16 bp, Homo sapiens
aattaggctgtaacta

SEQ ID NO: 1141273 - DNA, 17 bp, Homo sapiens
aattaggctgtaactac

SEQ ID NO: 1141274 - DNA, 18 bp, Homo sapiens
aattaggctgtaactact

SEQ ID NO: 1141275 - DNA, 21 bp, Homo sapiens
aattaggctgtaactacttta

SEQ ID NO: 1141276 - DNA, 15 bp, Homo sapiens
aattaggttgaaaca

SEQ ID NO: 1141277 - DNA, 17 bp, Homo sapiens
aattaggttgaaacata

SEQ ID NO: 1141278 - DNA, 18 bp, Homo sapiens
aattaggttgaaacatat

SEQ ID NO: 1141279 - DNA, 20 bp, Homo sapiens
aattagtaaaaaatcaatta

SEQ ID NO: 1141280 - DNA, 19 bp, Homo sapiens
aattagtacctcaaagtaa

SEQ ID NO: 1141281 - DNA, 23 bp, Homo sapiens
aattagtatgtctgtttttgtat

SEQ ID NO: 1141282 - DNA, 15 bp, Homo sapiens
aattagtctttttct

SEQ ID NO: 1141283 - DNA, 15 bp, Homo sapiens
aattagtgccactta

SEQ ID NO: 1141284 - DNA, 20 bp, Homo sapiens
aattagtgtgacagtttcca

SEQ ID NO: 1141285 - DNA, 22 bp, Homo sapiens
aattagtgtgacagtttccaaa

SEQ ID NO: 1141286 - DNA, 23 bp, Homo sapiens
aattagtgtgacagtttccaaat

SEQ ID NO: 1141287 - DNA, 16 bp, Homo sapiens
aattagttcagccatt

SEQ ID NO: 1141288 - DNA, 20 bp, Homo sapiens
atccacccagtgctgccatg

SEQ ID NO: 1141289 - DNA, 23 bp, Homo sapiens
atccacccagtgctgccatgcca

SEQ ID NO: 1141290 - DNA, 23 bp, Homo sapiens
atccacccgctgcccctccccgt

SEQ ID NO: 1141291 - DNA, 13 bp, Homo sapiens
atccacctgtctc

SEQ ID NO: 1141292 - DNA, 19 bp, Homo sapiens
atccacgtggcctctctct

SEQ ID NO: 1141293 - DNA, 16 bp, Homo sapiens
atccacgtgtggcctc

SEQ ID NO: 1141294 - DNA, 18 bp, Homo sapiens
atccacgtgtggcctccg

SEQ ID NO: 1141295 - DNA, 16 bp, Homo sapiens
atccactctaccctcc

SEQ ID NO: 1141296 - DNA, 22 bp, Homo sapiens
atccactctaccctcccacccc

SEQ ID NO: 1141297 - DNA, 21 bp, Homo sapiens
atccactgggtgtaaacacat

SEQ ID NO: 1141298 - DNA, 13 bp, Homo sapiens
atccacttaagtt

SEQ ID NO: 1141299 - DNA, 16 bp, Homo sapiens
atccacttaagttctt

SEQ ID NO: 1141300 - DNA, 22 bp, Homo sapiens
atccacttcttggttcctggga

SEQ ID NO: 1141301 - DNA, 17 bp, Homo sapiens
atccacttttcttcttc

SEQ ID NO: 1141302 - DNA, 14 bp, Homo sapiens
atccagaaagctga

SEQ ID NO: 1141303 - DNA, 15 bp, Homo sapiens
atccagaaagctgag

SEQ ID NO: 1141304 - DNA, 23 bp, Homo sapiens
atccagaaataaaacaactctga

SEQ ID NO: 1141305 - DNA, 15 bp, Homo sapiens
atccagaagagccca

SEQ ID NO: 1141306 - DNA, 23 bp, Homo sapiens
atccagacagtcgctcagtctgt

SEQ ID NO: 1141307 - DNA, 15 bp, Homo sapiens
atccagagagcagct

SEQ ID NO: 1141308 - DNA, 14 bp, Homo sapiens
atccagagatgact

SEQ ID NO: 1141309 - DNA, 19 bp, Homo sapiens
atccagagattcattttct

SEQ ID NO: 1141310 - DNA, 14 bp, Homo sapiens
atccagagctgttt

SEQ ID NO: 1141311 - DNA, 18 bp, Homo sapiens
atccagatccagactgta

SEQ ID NO: 1141312 - DNA, 13 bp, Homo sapiens
atccagccacgga

SEQ ID NO: 1141313 - DNA, 14 bp, Homo sapiens
atccagccagaccc

SEQ ID NO: 1141314 - DNA, 17 bp, Homo sapiens
atccagcctttccaagt

SEQ ID NO: 1141315 - DNA, 15 bp, Homo sapiens
atccagctatgttat

SEQ ID NO: 1141316 - DNA, 14 bp, Homo sapiens
atccagctcactca

SEQ ID NO: 1141317 - DNA, 11 bp, Homo sapiens
atccagctccc

SEQ ID NO: 1141318 - DNA, 21 bp, Homo sapiens
atccagctccctagactgcat

SEQ ID NO: 1141319 - DNA, 15 bp, Homo sapiens
atccagctcctctag

SEQ ID NO: 1141320 - DNA, 23 bp, Homo sapiens
atccagctcctctaggggcagcc

SEQ ID NO: 1141321 - DNA, 14 bp, Homo sapiens
atccagctgagtga

SEQ ID NO: 1141322 - DNA, 16 bp, Homo sapiens
atccagctgcccctcc

SEQ ID NO: 1141323 - DNA, 18 bp, Homo sapiens
atccagctgcccctccct

SEQ ID NO: 1141324 - DNA, 15 bp, Homo sapiens
atccaggactgagat

SEQ ID NO: 1141325 - DNA, 15 bp, Homo sapiens
atccaggcacagctg

SEQ ID NO: 1141326 - DNA, 16 bp, Homo sapiens
atccaggcacagctga

SEQ ID NO: 1141327 - DNA, 16 bp, Homo sapiens
atccaggcaccaggac

SEQ ID NO: 1141328 - DNA, 24 bp, Homo sapiens
atccaggcagtcgggggctggcct

SEQ ID NO: 1141329 - DNA, 16 bp, Homo sapiens
atccaggccaaagccc

SEQ ID NO: 1141330 - DNA, 23 bp, Homo sapiens
atccaggccggcttgccacaccc

SEQ ID NO: 1141331 - DNA, 21 bp, Homo sapiens
atccaggtcatgcagttcctg

SEQ ID NO: 1141332 - DNA, 23 bp, Homo sapiens
atccaggtcatgcagttcctggc

SEQ ID NO: 1141333 - DNA, 19 bp, Homo sapiens
atccaggttccctcccaga

SEQ ID NO: 1141334 - DNA, 13 bp, Homo sapiens
atccagtataaga

SEQ ID NO: 1141335 - DNA, 17 bp, Homo sapiens
atccagtgtctcacagc

SEQ ID NO: 1141336 - DNA, 16 bp, Homo sapiens
atccagttcatgagaa

SEQ ID NO: 1141337 - DNA, 14 bp, Homo sapiens
atccagttcctgct

SEQ ID NO: 1141338 - DNA, 15 bp, Homo sapiens
atccagttcctgctc

SEQ ID NO: 1141339 - DNA, 19 bp, Homo sapiens
atccagttcctgctctctg

SEQ ID NO: 1141340 - DNA, 15 bp, Homo sapiens
atccagtttcccacc

SEQ ID NO: 1141341 - DNA, 19 bp, Homo sapiens
atccagtttcccaccacct

SEQ ID NO: 1141342 - DNA, 15 bp, Homo sapiens
atccagtttgttctc

SEQ ID NO: 1141343 - DNA, 16 bp, Homo sapiens
atccataaagaagcaa

SEQ ID NO: 1141344 - DNA, 21 bp, Homo sapiens
atccataaagaagcaataaag

SEQ ID NO: 1141345 - DNA, 23 bp, Homo sapiens
aattattcctttcctagactaat

SEQ ID NO: 1141346 - DNA, 20 bp, Homo sapiens
aattattctataatttccat

SEQ ID NO: 1141347 - DNA, 13 bp, Homo sapiens
aattattctgatt

SEQ ID NO: 1141348 - DNA, 16 bp, Homo sapiens
aattattctgattctt

SEQ ID NO: 1141349 - DNA, 13 bp, Homo sapiens
aattattgacact

SEQ ID NO: 1141350 - DNA, 13 bp, Homo sapiens
aattattgcttaa

SEQ ID NO: 1141351 - DNA, 16 bp, Homo sapiens
aattattgtagacatg

SEQ ID NO: 1141352 - DNA, 17 bp, Homo sapiens
aattatttcttaattat

SEQ ID NO: 1141353 - DNA, 18 bp, Homo sapiens
aattatttctttattaac

SEQ ID NO: 1141354 - DNA, 20 bp, Homo sapiens
aattatttgattatttaaga

SEQ ID NO: 1141355 - DNA, 12 bp, Homo sapiens
aattatttgcta

SEQ ID NO: 1141356 - DNA, 15 bp, Homo sapiens
aattatttgtgtaat

SEQ ID NO: 1141357 - DNA, 19 bp, Homo sapiens
aattatttgtgtaatagaa

SEQ ID NO: 1141358 - DNA, 11 bp, Homo sapiens
aattattttaa

SEQ ID NO: 1141359 - DNA, 15 bp, Homo sapiens
aattattttaaaata

SEQ ID NO: 1141360 - DNA, 14 bp, Homo sapiens
aattattttattgt

SEQ ID NO: 1141361 - DNA, 20 bp, Homo sapiens
aattattttgaatgtcacaa

SEQ ID NO: 1141362 - DNA, 19 bp, Homo sapiens
aattattttggtactttta

SEQ ID NO: 1141363 - DNA, 17 bp, Homo sapiens
aattatttttaatttaa

SEQ ID NO: 1141364 - DNA, 20 bp, Homo sapiens
aattatttttaatttaaaaa

SEQ ID NO: 1141365 - DNA, 14 bp, Homo sapiens
aattatttttgtgt

SEQ ID NO: 1141366 - DNA, 17 bp, Homo sapiens
aattcaaaaataaatta

SEQ ID NO: 1141367 - DNA, 20 bp, Homo sapiens
aattcaaaaataaattagaa

SEQ ID NO: 1141368 - DNA, 13 bp, Homo sapiens
aattcaaaatgct

SEQ ID NO: 1141369 - DNA, 18 bp, Homo sapiens
aattcaaacatattcttt

SEQ ID NO: 1141370 - DNA, 15 bp, Homo sapiens
aattcaacaaacatt

SEQ ID NO: 1141371 - DNA, 17 bp, Homo sapiens
aattcaacatcaaaact

SEQ ID NO: 1141372 - DNA, 21 bp, Homo sapiens
aattcaaccactgtaaaatga

SEQ ID NO: 1141373 - DNA, 14 bp, Homo sapiens
aattcaaccctttg

SEQ ID NO: 1141374 - DNA, 20 bp, Homo sapiens
aattcaagagctagaaaaat

SEQ ID NO: 1141375 - DNA, 18 bp, Homo sapiens
aattcaagcctctaaaca

SEQ ID NO: 1141376 - DNA, 20 bp, Homo sapiens
aattcaagcctctaaacaga

SEQ ID NO: 1141377 - DNA, 16 bp, Homo sapiens
aattcaagctgagaaa

SEQ ID NO: 1141378 - DNA, 23 bp, Homo sapiens
aattcaaggaatttcttaacttc

SEQ ID NO: 1141379 - DNA, 23 bp, Homo sapiens
aattcaagtgcttaaaaatactt

SEQ ID NO: 1141380 - DNA, 14 bp, Homo sapiens
aattcacaaacttt

SEQ ID NO: 1141381 - DNA, 23 bp, Homo sapiens
aattcacagatatttaaagaatg

SEQ ID NO: 1141382 - DNA, 20 bp, Homo sapiens
aattcacagtgctcttttct

SEQ ID NO: 1141383 - DNA, 14 bp, Homo sapiens
aattcaccaaagta

SEQ ID NO: 1141384 - DNA, 17 bp, Homo sapiens
aattcaccaaagtattt

SEQ ID NO: 1141385 - DNA, 16 bp, Homo sapiens
aattcaccagtgttcc

SEQ ID NO: 1141386 - DNA, 14 bp, Homo sapiens
aattcacctatgtt

SEQ ID NO: 1141387 - DNA, 17 bp, Homo sapiens
aattcacctatgttatt

SEQ ID NO: 1141388 - DNA, 21 bp, Homo sapiens
aattcacctatgttattttgt

SEQ ID NO: 1141389 - DNA, 21 bp, Homo sapiens
aattcactaatcttgaatgtt

SEQ ID NO: 1141390 - DNA, 22 bp, Homo sapiens
aattcactaatcttgaatgttt

SEQ ID NO: 1141391 - DNA, 18 bp, Homo sapiens
aattcagaactaaatttt

SEQ ID NO: 1141392 - DNA, 23 bp, Homo sapiens
aattcagaactaaatttttcata

SEQ ID NO: 1141393 - DNA, 16 bp, Homo sapiens
aattcagacatctgag

SEQ ID NO: 1141394 - DNA, 20 bp, Homo sapiens
aattcagatatatttttcac

SEQ ID NO: 1141395 - DNA, 19 bp, Homo sapiens
aattcagatcaaaatgcct

SEQ ID NO: 1141396 - DNA, 20 bp, Homo sapiens
aattcagatgttttacgcaa

SEQ ID NO: 1141397 - DNA, 14 bp, Homo sapiens
aattcagcaccctg

SEQ ID NO: 1141398 - DNA, 17 bp, Homo sapiens
aattcagcaccctgggt

SEQ ID NO: 1141399 - DNA, 15 bp, Homo sapiens
aattcagcactgatt

SEQ ID NO: 1141400 - DNA, 14 bp, Homo sapiens
aattcagcatttga

SEQ ID NO: 1141401 - DNA, 12 bp, Homo sapiens
aattcaggactc

SEQ ID NO: 1141402 - DNA, 19 bp, Homo sapiens
aattcaggtttttcctttt

SEQ ID NO: 1141403 - DNA, 17 bp, Homo sapiens
aattcagtggtcttatt

SEQ ID NO: 1141404 - DNA, 17 bp, Homo sapiens
aattcagttataaagtc

SEQ ID NO: 1141405 - DNA, 15 bp, Homo sapiens
aattcagtttcataa

SEQ ID NO: 1141406 - DNA, 20 bp, Homo sapiens
aattcagtttttgtatcttg

SEQ ID NO: 1141407 - DNA, 14 bp, Homo sapiens
aattcagttttttt

SEQ ID NO: 1141408 - DNA, 14 bp, Homo sapiens
aattcatgtaacag

SEQ ID NO: 1141409 - DNA, 12 bp, Homo sapiens
aattcatttcta

SEQ ID NO: 1141410 - DNA, 13 bp, Homo sapiens
aattcatttctaa

SEQ ID NO: 1141411 - DNA, 15 bp, Homo sapiens
aattcatttttttca

SEQ ID NO: 1141412 - DNA, 15 bp, Homo sapiens
aattccaaaatccaa

SEQ ID NO: 1141413 - DNA, 22 bp, Homo sapiens
aattccaaatttttttcttagg

SEQ ID NO: 1141414 - DNA, 16 bp, Homo sapiens
aattccaactcctgat

SEQ ID NO: 1141415 - DNA, 12 bp, Homo sapiens
aattccaaggag

SEQ ID NO: 1141416 - DNA, 15 bp, Homo sapiens
atcccagcttgcccc

SEQ ID NO: 1141417 - DNA, 18 bp, Homo sapiens
atcccagcttgctgaggg

SEQ ID NO: 1141418 - DNA, 19 bp, Homo sapiens
atcccagcttgctgagggg

SEQ ID NO: 1141419 - DNA, 17 bp, Homo sapiens
atcccagggtcccaccc

SEQ ID NO: 1141420 - DNA, 16 bp, Homo sapiens
atcccagtcactcctc

SEQ ID NO: 1141421 - DNA, 22 bp, Homo sapiens
atcccagtttaatattccaata

SEQ ID NO: 1141422 - DNA, 22 bp, Homo sapiens
atcccatatatttaatatgtca

SEQ ID NO: 1141423 - DNA, 23 bp, Homo sapiens
atcccatcgtctcggccttcaca

SEQ ID NO: 1141424 - DNA, 14 bp, Homo sapiens
atcccatctctccc

SEQ ID NO: 1141425 - DNA, 17 bp, Homo sapiens
atcccatctctcccact

SEQ ID NO: 1141426 - DNA, 20 bp, Homo sapiens
atcccatctctcccacttcc

SEQ ID NO: 1141427 - DNA, 15 bp, Homo sapiens
atcccatctgctaga

SEQ ID NO: 1141428 - DNA, 18 bp, Homo sapiens
atcccattaatcatttcc

SEQ ID NO: 1141429 - DNA, 21 bp, Homo sapiens
atcccatttcttgaaaagcct

SEQ ID NO: 1141430 - DNA, 23 bp, Homo sapiens
atcccatttcttgaaaagccttg

SEQ ID NO: 1141431 - DNA, 13 bp, Homo sapiens
atccccaagcctg

SEQ ID NO: 1141432 - DNA, 16 bp, Homo sapiens
atccccaagcctggca

SEQ ID NO: 1141433 - DNA, 12 bp, Homo sapiens
atccccaagctg

SEQ ID NO: 1141434 - DNA, 19 bp, Homo sapiens
atccccaccttcacctcgg

SEQ ID NO: 1141435 - DNA, 19 bp, Homo sapiens
atccccactgggaccaacc

SEQ ID NO: 1141436 - DNA, 12 bp, Homo sapiens
atccccagagcc

SEQ ID NO: 1141437 - DNA, 19 bp, Homo sapiens
atccccagagcccagctct

SEQ ID NO: 1141438 - DNA, 20 bp, Homo sapiens
atccccagagcccagctctt

SEQ ID NO: 1141439 - DNA, 16 bp, Homo sapiens
atccccagcctaggac

SEQ ID NO: 1141440 - DNA, 22 bp, Homo sapiens
atccccagctggtggccctgtg

SEQ ID NO: 1141441 - DNA, 14 bp, Homo sapiens
atccccagctttct

SEQ ID NO: 1141442 - DNA, 13 bp, Homo sapiens
atccccagggcag

SEQ ID NO: 1141443 - DNA, 15 bp, Homo sapiens
atccccatcggccct

SEQ ID NO: 1141444 - DNA, 17 bp, Homo sapiens
atccccatcggccctgt

SEQ ID NO: 1141445 - DNA, 23 bp, Homo sapiens
atccccatcggccctgtcccctg

SEQ ID NO: 1141446 - DNA, 13 bp, Homo sapiens
atccccatctccc

SEQ ID NO: 1141447 - DNA, 15 bp, Homo sapiens
atccccatctccctg

SEQ ID NO: 1141448 - DNA, 18 bp, Homo sapiens
atccccatctccctgcct

SEQ ID NO: 1141449 - DNA, 13 bp, Homo sapiens
atcccccaaagtt

SEQ ID NO: 1141450 - DNA, 12 bp, Homo sapiens
atcccccagaaa

SEQ ID NO: 1141451 - DNA, 12 bp, Homo sapiens
atccccccaccc

SEQ ID NO: 1141452 - DNA, 19 bp, Homo sapiens
atcccccctgctgcccagt

SEQ ID NO: 1141453 - DNA, 14 bp, Homo sapiens
atccccctaaacta

SEQ ID NO: 1141454 - DNA, 23 bp, Homo sapiens
atccccctctcacgccacccccg

SEQ ID NO: 1141455 - DNA, 20 bp, Homo sapiens
atccccctctttgcacagca

SEQ ID NO: 1141456 - DNA, 12 bp, Homo sapiens
atccccctgtgg

SEQ ID NO: 1141457 - DNA, 17 bp, Homo sapiens
atcccccttcttcctcc

SEQ ID NO: 1141458 - DNA, 20 bp, Homo sapiens
atccccgcctggccaggagc

SEQ ID NO: 1141459 - DNA, 19 bp, Homo sapiens
atccccgcttccccttgcc

SEQ ID NO: 1141460 - DNA, 14 bp, Homo sapiens
atcccctcaacacc

SEQ ID NO: 1141461 - DNA, 22 bp, Homo sapiens
atcccctcaacaccctgcttct

SEQ ID NO: 1141462 - DNA, 23 bp, Homo sapiens
atcccctcaacaccctgcttctc

SEQ ID NO: 1141463 - DNA, 15 bp, Homo sapiens
atcccctcagcctct

SEQ ID NO: 1141464 - DNA, 20 bp, Homo sapiens
atcccctcagcctcttctct

SEQ ID NO: 1141465 - DNA, 17 bp, Homo sapiens
atcccctccctgcctgc

SEQ ID NO: 1141466 - DNA, 20 bp, Homo sapiens
atcccctccctgcctgctcc

SEQ ID NO: 1141467 - DNA, 16 bp, Homo sapiens
atcctaggcatttgct

SEQ ID NO: 1141468 - DNA, 21 bp, Homo sapiens
atcctagtaattgcctagaaa

SEQ ID NO: 1141469 - DNA, 17 bp, Homo sapiens
atcctagtttcctctcc

SEQ ID NO: 1141470 - DNA, 13 bp, Homo sapiens
atcctatatctgt

SEQ ID NO: 1141471 - DNA, 15 bp, Homo sapiens
atcctatatctgttt

SEQ ID NO: 1141472 - DNA, 19 bp, Homo sapiens
atcctatctggggagctcc

SEQ ID NO: 1141473 - DNA, 12 bp, Homo sapiens
atcctatgctta

SEQ ID NO: 1141474 - DNA, 12 bp, Homo sapiens
atcctatgtttt

SEQ ID NO: 1141475 - DNA, 20 bp, Homo sapiens
atcctatgtttttgttcaaa

SEQ ID NO: 1141476 - DNA, 23 bp, Homo sapiens
atcctcaaatcagtcttccttgt

SEQ ID NO: 1141477 - DNA, 15 bp, Homo sapiens
atcctcaatccagct

SEQ ID NO: 1141478 - DNA, 12 bp, Homo sapiens
atcctcacacta

SEQ ID NO: 1141479 - DNA, 13 bp, Homo sapiens
atcctcacccaga

SEQ ID NO: 1141480 - DNA, 14 bp, Homo sapiens
atcctcacccagat

SEQ ID NO: 1141481 - DNA, 17 bp, Homo sapiens
atcctcacccagatcag

SEQ ID NO: 1141482 - DNA, 14 bp, Homo sapiens
atcctcactgggtg

SEQ ID NO: 1141483 - DNA, 15 bp, Homo sapiens
atcctcactgggtgg

SEQ ID NO: 1141484 - DNA, 14 bp, Homo sapiens
atcctcagaggctg

SEQ ID NO: 1141485 - DNA, 19 bp, Homo sapiens
atcctcagaggctgagccc

SEQ ID NO: 1141486 - DNA, 21 bp, Homo sapiens
atcctcagccgagaaattggg

SEQ ID NO: 1141487 - DNA, 21 bp, Homo sapiens
atcctcatatggcccagtgtc

SEQ ID NO: 1141488 - DNA, 14 bp, Homo sapiens
atcctcatccctga

SEQ ID NO: 1141489 - DNA, 15 bp, Homo sapiens
atcctcatctttttt

SEQ ID NO: 1141490 - DNA, 21 bp, Homo sapiens
atcctcattgcctcctgttct

SEQ ID NO: 1141491 - DNA, 23 bp, Homo sapiens
atcctccaacttcatttgatgct

SEQ ID NO: 1141492 - DNA, 16 bp, Homo sapiens
atcctccaatgtctaa

SEQ ID NO: 1141493 - DNA, 14 bp, Homo sapiens
atcctccacagaga

SEQ ID NO: 1141494 - DNA, 11 bp, Homo sapiens
atcctccagca

SEQ ID NO: 1141495 - DNA, 13 bp, Homo sapiens
atcctccagccct

SEQ ID NO: 1141496 - DNA, 14 bp, Homo sapiens
atcctccagccctg

SEQ ID NO: 1141497 - DNA, 23 bp, Homo sapiens
atcctccagcttctggtactctc

SEQ ID NO: 1141498 - DNA, 19 bp, Homo sapiens
atcctccagtaccttgctt

SEQ ID NO: 1141499 - DNA, 14 bp, Homo sapiens
atcctccattgctc

SEQ ID NO: 1141500 - DNA, 22 bp, Homo sapiens
atcctcccaaccaaccagcagg

SEQ ID NO: 1141501 - DNA, 18 bp, Homo sapiens
atcctccccttccctgca

SEQ ID NO: 1141502 - DNA, 19 bp, Homo sapiens
atcctccccttttaccact

SEQ ID NO: 1141503 - DNA, 14 bp, Homo sapiens
atcctccctccacc

SEQ ID NO: 1141504 - DNA, 17 bp, Homo sapiens
atcctccctggcagaca

SEQ ID NO: 1141505 - DNA, 16 bp, Homo sapiens
atcctcccttgcccca

SEQ ID NO: 1141506 - DNA, 16 bp, Homo sapiens
atcctccgtccagccg

SEQ ID NO: 1141507 - DNA, 20 bp, Homo sapiens
atcctcctacctccaaagct

SEQ ID NO: 1141508 - DNA, 18 bp, Homo sapiens
atcctcctcagcccccag

SEQ ID NO: 1141509 - DNA, 23 bp, Homo sapiens
atcctcctcagcccccaggccag

SEQ ID NO: 1141510 - DNA, 11 bp, Homo sapiens
atcctcctccc

SEQ ID NO: 1141511 - DNA, 10 bp, Homo sapiens
atcctcctgc

SEQ ID NO: 1141512 - DNA, 11 bp, Homo sapiens
atcctcctgca

SEQ ID NO: 1141513 - DNA, 13 bp, Homo sapiens
atcctcctgccca

SEQ ID NO: 1141514 - DNA, 20 bp, Homo sapiens
atcctcctgcccagctcctc

SEQ ID NO: 1141515 - DNA, 17 bp, Homo sapiens
atcctcctgcctcagcc

SEQ ID NO: 1141516 - DNA, 12 bp, Homo sapiens
atcctcctggaa

SEQ ID NO: 1141517 - DNA, 23 bp, Homo sapiens
atcctcctggaaccttgctgtcc

SEQ ID NO: 1141518 - DNA, 20 bp, Homo sapiens
atcctcctggtgcccacagc

SEQ ID NO: 1141519 - DNA, 17 bp, Homo sapiens
atcctcctttcagttcg

SEQ ID NO: 1141520 - DNA, 18 bp, Homo sapiens
atcctcctttcagttcgt

SEQ ID NO: 1141521 - DNA, 19 bp, Homo sapiens
atcctctattttgtgatga

SEQ ID NO: 1141522 - DNA, 15 bp, Homo sapiens
atcctctccaccctc

SEQ ID NO: 1141523 - DNA, 16 bp, Homo sapiens
atcctctccaccctcc

SEQ ID NO: 1141524 - DNA, 15 bp, Homo sapiens
atcctctccactcca

SEQ ID NO: 1141525 - DNA, 17 bp, Homo sapiens
atcctctccccctcctc

SEQ ID NO: 1141526 - DNA, 21 bp, Homo sapiens
atcctctccccctcctccagg

SEQ ID NO: 1141527 - DNA, 11 bp, Homo sapiens
atcctctctct

SEQ ID NO: 1141528 - DNA, 16 bp, Homo sapiens
atcctctcttcctctt

SEQ ID NO: 1141529 - DNA, 13 bp, Homo sapiens
atcctctggaagg

SEQ ID NO: 1141530 - DNA, 14 bp, Homo sapiens
atcctctggacacg

SEQ ID NO: 1141531 - DNA, 14 bp, Homo sapiens
atcctctggctggc

SEQ ID NO: 1141532 - DNA, 20 bp, Homo sapiens
atcctctgtaaactttttgt

SEQ ID NO: 1141533 - DNA, 15 bp, Homo sapiens
atcctcttcctctga

SEQ ID NO: 1141534 - DNA, 16 bp, Homo sapiens
atcctcttcctctgag

SEQ ID NO: 1141535 - DNA, 17 bp, Homo sapiens
atcctctttactctggg

SEQ ID NO: 1141536 - DNA, 18 bp, Homo sapiens
atcctcttttaatggcat

SEQ ID NO: 1141537 - DNA, 22 bp, Homo sapiens
atcctcttttaatggcatttct

SEQ ID NO: 1141538 - DNA, 16 bp, Homo sapiens
atcctgaaagggcact

SEQ ID NO: 1141539 - DNA, 16 bp, Homo sapiens
atcctgaaatttcaga

SEQ ID NO: 1141540 - DNA, 17 bp, Homo sapiens
atcctgaactttctccc

SEQ ID NO: 1141541 - DNA, 13 bp, Homo sapiens
atcctgaagagca

SEQ ID NO: 1141542 - DNA, 16 bp, Homo sapiens
atcctgaataaaccag

SEQ ID NO: 1141543 - DNA, 17 bp, Homo sapiens
atcctgaatctgtgcaa

SEQ ID NO: 1141544 - DNA, 13 bp, Homo sapiens
atcctgagccccg

SEQ ID NO: 1141545 - DNA, 11 bp, Homo sapiens
atcctgagctc

SEQ ID NO: 1141546 - DNA, 18 bp, Homo sapiens
atcctgagctcacagagt

SEQ ID NO: 1141547 - DNA, 17 bp, Homo sapiens
atcctgaggccagtggc

SEQ ID NO: 1141548 - DNA, 15 bp, Homo sapiens
aattgatcctttgat

SEQ ID NO: 1141549 - DNA, 18 bp, Homo sapiens
aattgatcttttttaatt

SEQ ID NO: 1141550 - DNA, 16 bp, Homo sapiens
aattgatgtatatgtt

SEQ ID NO: 1141551 - DNA, 18 bp, Homo sapiens
aattgatgttttacgtgc

SEQ ID NO: 1141552 - DNA, 20 bp, Homo sapiens
aattgatgttttacgtgcaa

SEQ ID NO: 1141553 - DNA, 22 bp, Homo sapiens
aattgatgttttacgtgcaaac

SEQ ID NO: 1141554 - DNA, 19 bp, Homo sapiens
aattgattgtcagccacct

SEQ ID NO: 1141555 - DNA, 19 bp, Homo sapiens
aattgatttttctcttcat

SEQ ID NO: 1141556 - DNA, 20 bp, Homo sapiens
aattgcaaaaacatagaaat

SEQ ID NO: 1141557 - DNA, 18 bp, Homo sapiens
aattgcaaatcttgaaat

SEQ ID NO: 1141558 - DNA, 14 bp, Homo sapiens
aattgcacttttaa

SEQ ID NO: 1141559 - DNA, 18 bp, Homo sapiens
aattgcagtttcatgtat

SEQ ID NO: 1141560 - DNA, 21 bp, Homo sapiens
aattgcagtttcatgtatgta

SEQ ID NO: 1141561 - DNA, 14 bp, Homo sapiens
aattgccaaagctg

SEQ ID NO: 1141562 - DNA, 14 bp, Homo sapiens
aattgccagcaaat

SEQ ID NO: 1141563 - DNA, 19 bp, Homo sapiens
aattgcctacaataaaaag

SEQ ID NO: 1141564 - DNA, 19 bp, Homo sapiens
aattgcctataatacttgc

SEQ ID NO: 1141565 - DNA, 21 bp, Homo sapiens
aattgcctataatacttgcaa

SEQ ID NO: 1141566 - DNA, 16 bp, Homo sapiens
aattgcctcttgcagg

SEQ ID NO: 1141567 - DNA, 14 bp, Homo sapiens
aattgcctgatttg

SEQ ID NO: 1141568 - DNA, 19 bp, Homo sapiens
aattgcctgcagagagaag

SEQ ID NO: 1141569 - DNA, 16 bp, Homo sapiens
aattgctaatgttgct

SEQ ID NO: 1141570 - DNA, 20 bp, Homo sapiens
aattgctattttatttgtat

SEQ ID NO: 1141571 - DNA, 20 bp, Homo sapiens
aattgctcctaagcttcaaa

SEQ ID NO: 1141572 - DNA, 12 bp, Homo sapiens
aattgctccttg

SEQ ID NO: 1141573 - DNA, 23 bp, Homo sapiens
aattgctcttggctgtgaaaaga

SEQ ID NO: 1141574 - DNA, 21 bp, Homo sapiens
aattgctggaacccaggaggt

SEQ ID NO: 1141575 - DNA, 13 bp, Homo sapiens
aattgctgtgcct

SEQ ID NO: 1141576 - DNA, 19 bp, Homo sapiens
aattgcttaaaagacattt

SEQ ID NO: 1141577 - DNA, 15 bp, Homo sapiens
aattgcttacatttt

SEQ ID NO: 1141578 - DNA, 21 bp, Homo sapiens
aattgcttacatttttacaat

SEQ ID NO: 1141579 - DNA, 19 bp, Homo sapiens
aattgcttaccaaaggata

SEQ ID NO: 1141580 - DNA, 13 bp, Homo sapiens
aattgctttgaag

SEQ ID NO: 1141581 - DNA, 14 bp, Homo sapiens
aattgctttgaagc

SEQ ID NO: 1141582 - DNA, 20 bp, Homo sapiens
aattgcttttgaaaaacaac

SEQ ID NO: 1141583 - DNA, 16 bp, Homo sapiens
aattgcttttgttgtg

SEQ ID NO: 1141584 - DNA, 20 bp, Homo sapiens
aattgcttttgttgtgactt

SEQ ID NO: 1141585 - DNA, 22 bp, Homo sapiens
aattgcttttgttgtgactttt

SEQ ID NO: 1141586 - DNA, 14 bp, Homo sapiens
aattggaatcttca

SEQ ID NO: 1141587 - DNA, 20 bp, Homo sapiens
aattggaatcttcacctcag

SEQ ID NO: 1141588 - DNA, 23 bp, Homo sapiens
aattggaatggaactactgtact

SEQ ID NO: 1141589 - DNA, 15 bp, Homo sapiens
aattggatttcctaa

SEQ ID NO: 1141590 - DNA, 15 bp, Homo sapiens
aatttagaaatcatt

SEQ ID NO: 1141591 - DNA, 17 bp, Homo sapiens
aatttagaaatcatttt

SEQ ID NO: 1141592 - DNA, 13 bp, Homo sapiens
aatttagagcgtt

SEQ ID NO: 1141593 - DNA, 19 bp, Homo sapiens
aatttagagtcaatttgct

SEQ ID NO: 1141594 - DNA, 19 bp, Homo sapiens
aatttagccctttaaaacg

SEQ ID NO: 1141595 - DNA, 14 bp, Homo sapiens
aatttagtaaatgt

SEQ ID NO: 1141596 - DNA, 20 bp, Homo sapiens
aatttagtaaatgttatctt

SEQ ID NO: 1141597 - DNA, 16 bp, Homo sapiens
aatttagtgtatccat

SEQ ID NO: 1141598 - DNA, 17 bp, Homo sapiens
aatttagtgtatccata

SEQ ID NO: 1141599 - DNA, 22 bp, Homo sapiens
aatttagtttcatataaagtat

SEQ ID NO: 1141600 - DNA, 16 bp, Homo sapiens
aatttataaaaaggtg

SEQ ID NO: 1141601 - DNA, 16 bp, Homo sapiens
aatttataaagaaaaa

SEQ ID NO: 1141602 - DNA, 15 bp, Homo sapiens
aatttataaaggtct

SEQ ID NO: 1141603 - DNA, 15 bp, Homo sapiens
aatttataatgtatt

SEQ ID NO: 1141604 - DNA, 17 bp, Homo sapiens
aatttataatgtatttg

SEQ ID NO: 1141605 - DNA, 19 bp, Homo sapiens
aatttataatgtatttgaa

SEQ ID NO: 1141606 - DNA, 20 bp, Homo sapiens
aatttataatgtatttgaaa

SEQ ID NO: 1141607 - DNA, 17 bp, Homo sapiens
aatttatacaatatcat

SEQ ID NO: 1141608 - DNA, 16 bp, Homo sapiens
aatttatatgtatatt

SEQ ID NO: 1141609 - DNA, 16 bp, Homo sapiens
aatttatattgtaaat

SEQ ID NO: 1141610 - DNA, 22 bp, Homo sapiens
aatttatcatgttttataattt

SEQ ID NO: 1141611 - DNA, 18 bp, Homo sapiens
aatttatcttgtctctgg

SEQ ID NO: 1141612 - DNA, 20 bp, Homo sapiens
aatttatcttgtctctgggc

SEQ ID NO: 1141613 - DNA, 12 bp, Homo sapiens
aatttatcttta

SEQ ID NO: 1141614 - DNA, 14 bp, Homo sapiens
aatttatgcatttc

SEQ ID NO: 1141615 - DNA, 16 bp, Homo sapiens
aatttatgcatttcat

SEQ ID NO: 1141616 - DNA, 20 bp, Homo sapiens
aatttatgcatttcattcaa

SEQ ID NO: 1141617 - DNA, 22 bp, Homo sapiens
aatttatgcatttcattcaaat

SEQ ID NO: 1141618 - DNA, 18 bp, Homo sapiens
aatttattaattgctttg

SEQ ID NO: 1141619 - DNA, 19 bp, Homo sapiens
aatttattaattgctttga

SEQ ID NO: 1141620 - DNA, 22 bp, Homo sapiens
aatttattacaaatcagaactt

SEQ ID NO: 1141621 - DNA, 16 bp, Homo sapiens
aatttattagtttaaa

SEQ ID NO: 1141622 - DNA, 22 bp, Homo sapiens
aatttattatatatttacagaa

SEQ ID NO: 1141623 - DNA, 13 bp, Homo sapiens
aatttattatggc

SEQ ID NO: 1141624 - DNA, 21 bp, Homo sapiens
aatttattcaattcctctggg

SEQ ID NO: 1141625 - DNA, 16 bp, Homo sapiens
aatttattcacatata

SEQ ID NO: 1141626 - DNA, 14 bp, Homo sapiens
aatttattggcagc

SEQ ID NO: 1141627 - DNA, 21 bp, Homo sapiens
aatttattggcagccaaggaa

SEQ ID NO: 1141628 - DNA, 14 bp, Homo sapiens
aatttattggggtg

SEQ ID NO: 1141629 - DNA, 16 bp, Homo sapiens
aatttatttatattcc

SEQ ID NO: 1141630 - DNA, 21 bp, Homo sapiens
aatttatttccactaaaaata

SEQ ID NO: 1141631 - DNA, 22 bp, Homo sapiens
aatttatttccccgagtcctca

SEQ ID NO: 1141632 - DNA, 13 bp, Homo sapiens
aatttatttgttt

SEQ ID NO: 1141633 - DNA, 18 bp, Homo sapiens
aatttattttataagaaa

SEQ ID NO: 1141634 - DNA, 13 bp, Homo sapiens
aatttattttctt

SEQ ID NO: 1141635 - DNA, 16 bp, Homo sapiens
aatttattttgctccc

SEQ ID NO: 1141636 - DNA, 11 bp, Homo sapiens
aatttcaaaat

SEQ ID NO: 1141637 - DNA, 12 bp, Homo sapiens
aatttcaaaatg

SEQ ID NO: 1141638 - DNA, 16 bp, Homo sapiens
aatttcaaaatgcttt

SEQ ID NO: 1141639 - DNA, 16 bp, Homo sapiens
aatttcaaaatttaaa

SEQ ID NO: 1141640 - DNA, 20 bp, Homo sapiens
aatttcacagttctgtaatg

SEQ ID NO: 1141641 - DNA, 14 bp, Homo sapiens
aatttcacattaat

SEQ ID NO: 1141642 - DNA, 20 bp, Homo sapiens
aatttcacctgtaaacctga

SEQ ID NO: 1141643 - DNA, 12 bp, Homo sapiens
aatttcaggaaa

SEQ ID NO: 1141644 - DNA, 21 bp, Homo sapiens
aatttcaggaggaatactgaa

SEQ ID NO: 1141645 - DNA, 17 bp, Homo sapiens
aatttcaggcattttgt

SEQ ID NO: 1141646 - DNA, 20 bp, Homo sapiens
aatttcaggttttgtaaaga

SEQ ID NO: 1141647 - DNA, 19 bp, Homo sapiens
aatttcagtcaattctgat

SEQ ID NO: 1141648 - DNA, 18 bp, Homo sapiens
aatttcataattctgaaa

SEQ ID NO: 1141649 - DNA, 19 bp, Homo sapiens
aatttcataattctgaaac

SEQ ID NO: 1141650 - DNA, 20 bp, Homo sapiens
aatttcatagctgtacttct

SEQ ID NO: 1141651 - DNA, 21 bp, Homo sapiens
aatttcatagctgtacttctt

SEQ ID NO: 1141652 - DNA, 16 bp, Homo sapiens
aatttcatgtaaaaca

SEQ ID NO: 1141653 - DNA, 21 bp, Homo sapiens
aatttccacaaaatctgtcca

SEQ ID NO: 1141654 - DNA, 15 bp, Homo sapiens
aatttccagagaaga

SEQ ID NO: 1141655 - DNA, 19 bp, Homo sapiens
aatttccaggaaaaaataa

SEQ ID NO: 1141656 - DNA, 23 bp, Homo sapiens
aatttccagtttaagtaattgcc

SEQ ID NO: 1141657 - DNA, 22 bp, Homo sapiens
aatttcccacaccgtgtaaacc

SEQ ID NO: 1141658 - DNA, 18 bp, Homo sapiens
aatttcccagttaaagat

SEQ ID NO: 1141659 - DNA, 19 bp, Homo sapiens
aatttcccagttaaagatt

SEQ ID NO: 1141660 - DNA, 15 bp, Homo sapiens
aatttcctcactgcc

SEQ ID NO: 1141661 - DNA, 16 bp, Homo sapiens
aatttcctgtttgaaa

SEQ ID NO: 1141662 - DNA, 16 bp, Homo sapiens
aatttccttcaggttt

SEQ ID NO: 1141663 - DNA, 21 bp, Homo sapiens
aatttccttctgttaagaaag

SEQ ID NO: 1141664 - DNA, 13 bp, Homo sapiens
aatttcgccttaa

SEQ ID NO: 1141665 - DNA, 18 bp, Homo sapiens
aatttcggattttttcca

SEQ ID NO: 1141666 - DNA, 13 bp, Homo sapiens
aatttctaaatct

SEQ ID NO: 1141667 - DNA, 16 bp, Homo sapiens
aatttctaccatttca

SEQ ID NO: 1141668 - DNA, 18 bp, Homo sapiens
aatttctaccatttcaga

SEQ ID NO: 1141669 - DNA, 16 bp, Homo sapiens
aatttctactttgaag

SEQ ID NO: 1141670 - DNA, 14 bp, Homo sapiens
aatttctcctccct

SEQ ID NO: 1141671 - DNA, 20 bp, Homo sapiens
aatttctcctcccttccttt

SEQ ID NO: 1141672 - DNA, 12 bp, Homo sapiens
aatttctgcctt

SEQ ID NO: 1141673 - DNA, 18 bp, Homo sapiens
aatttctgctgtggtcta

SEQ ID NO: 1141674 - DNA, 13 bp, Homo sapiens
aatttctggcctc

SEQ ID NO: 1141675 - DNA, 16 bp, Homo sapiens
aatttctggcctccta

SEQ ID NO: 1141676 - DNA, 17 bp, Homo sapiens
aatttctgggatattta

SEQ ID NO: 1141677 - DNA, 20 bp, Homo sapiens
aatttcttaacttcttgctt

SEQ ID NO: 1141678 - DNA, 17 bp, Homo sapiens
atcgcttgagcccagga

SEQ ID NO: 1141679 - DNA, 17 bp, Homo sapiens
atcggactctgcccctg

SEQ ID NO: 1141680 - DNA, 22 bp, Homo sapiens
atcggaggctgggcccctggga

SEQ ID NO: 1141681 - DNA, 18 bp, Homo sapiens
atcggaggcttgtcagag

SEQ ID NO: 1141682 - DNA, 21 bp, Homo sapiens
atcggatctggggctctggga

SEQ ID NO: 1141683 - DNA, 21 bp, Homo sapiens
atcggccatcaagggaagaac

SEQ ID NO: 1141684 - DNA, 12 bp, Homo sapiens
atcggccctgtc

SEQ ID NO: 1141685 - DNA, 17 bp, Homo sapiens
atcggccctgtcccctg

SEQ ID NO: 1141686 - DNA, 15 bp, Homo sapiens
atcgggagcacccag

SEQ ID NO: 1141687 - DNA, 12 bp, Homo sapiens
atcgggggcctg

SEQ ID NO: 1141688 - DNA, 22 bp, Homo sapiens
atcgggtccagagaccacacca

SEQ ID NO: 1141689 - DNA, 18 bp, Homo sapiens
atcggtgaaactaacaga

SEQ ID NO: 1141690 - DNA, 15 bp, Homo sapiens
atcggtgtccattta

SEQ ID NO: 1141691 - DNA, 20 bp, Homo sapiens
atcgtaaaaaaatagaaaaa

SEQ ID NO: 1141692 - DNA, 14 bp, Homo sapiens
atcgtcactgctta

SEQ ID NO: 1141693 - DNA, 18 bp, Homo sapiens
atcgtctccaattcgaaa

SEQ ID NO: 1141694 - DNA, 12 bp, Homo sapiens
atcgtctcggcc

SEQ ID NO: 1141695 - DNA, 16 bp, Homo sapiens
atcgtctcggcccctc

SEQ ID NO: 1141696 - DNA, 18 bp, Homo sapiens
atcgtgacccttcagggc

SEQ ID NO: 1141697 - DNA, 20 bp, Homo sapiens
atcgtgacccttcagggcca

SEQ ID NO: 1141698 - DNA, 19 bp, Homo sapiens
atcgtgcatttgaggggcc

SEQ ID NO: 1141699 - DNA, 18 bp, Homo sapiens
atcgtgccgttactctcc

SEQ ID NO: 1141700 - DNA, 17 bp, Homo sapiens
atcgtgctaaattttca

SEQ ID NO: 1141701 - DNA, 20 bp, Homo sapiens
atcgtgctgggataactggc

SEQ ID NO: 1141702 - DNA, 22 bp, Homo sapiens
atcgtggcacgtattgctgtgt

SEQ ID NO: 1141703 - DNA, 14 bp, Homo sapiens
atcgttccccaccc

SEQ ID NO: 1141704 - DNA, 18 bp, Homo sapiens
atcgttctctctttgcat

SEQ ID NO: 1141705 - DNA, 14 bp, Homo sapiens
atcgttgagacatc

SEQ ID NO: 1141706 - DNA, 13 bp, Homo sapiens
atcgtttctcaga

SEQ ID NO: 1141707 - DNA, 18 bp, Homo sapiens
atcgttttcttaaagtgc

SEQ ID NO: 1141708 - DNA, 21 bp, Homo sapiens
atctaaaacaaaatctgaact

SEQ ID NO: 1141709 - DNA, 13 bp, Homo sapiens
atctaaaatgatt

SEQ ID NO: 1141710 - DNA, 16 bp, Homo sapiens
atctaaacgtggtcac

SEQ ID NO: 1141711 - DNA, 19 bp, Homo sapiens
atctaaagctttatctttg

SEQ ID NO: 1141712 - DNA, 16 bp, Homo sapiens
aatttgctgaaaacat

SEQ ID NO: 1141713 - DNA, 22 bp, Homo sapiens
aatttgctgaaaacattacatg

SEQ ID NO: 1141714 - DNA, 13 bp, Homo sapiens
aatttgctttaat

SEQ ID NO: 1141715 - DNA, 17 bp, Homo sapiens
aatttggagtaaatata

SEQ ID NO: 1141716 - DNA, 13 bp, Homo sapiens
aatttggcaattt

SEQ ID NO: 1141717 - DNA, 15 bp, Homo sapiens
aatttggcaattttg

SEQ ID NO: 1141718 - DNA, 19 bp, Homo sapiens
aatttggccttaagaactg

SEQ ID NO: 1141719 - DNA, 21 bp, Homo sapiens
aatttggccttaagaactgtg

SEQ ID NO: 1141720 - DNA, 22 bp, Homo sapiens
aatttgggaaggtttgtgtttt

SEQ ID NO: 1141721 - DNA, 19 bp, Homo sapiens
aatttgggatactaaagta

SEQ ID NO: 1141722 - DNA, 14 bp, Homo sapiens
aatttgggatgctg

SEQ ID NO: 1141723 - DNA, 15 bp, Homo sapiens
aatttgggcctcttg

SEQ ID NO: 1141724 - DNA, 18 bp, Homo sapiens
aatttggtaaaaatgctg

SEQ ID NO: 1141725 - DNA, 19 bp, Homo sapiens
aatttggtgcttataagag

SEQ ID NO: 1141726 - DNA, 16 bp, Homo sapiens
aatttggttctaatag

SEQ ID NO: 1141727 - DNA, 19 bp, Homo sapiens
aatttggtttaaaaataca

SEQ ID NO: 1141728 - DNA, 12 bp, Homo sapiens
aatttgtaaact

SEQ ID NO: 1141729 - DNA, 18 bp, Homo sapiens
aatttgtaaacttctgaa

SEQ ID NO: 1141730 - DNA, 20 bp, Homo sapiens
aatttgtaaacttctgaaga

SEQ ID NO: 1141731 - DNA, 19 bp, Homo sapiens
aatttgtaattgcttacat

SEQ ID NO: 1141732 - DNA, 13 bp, Homo sapiens
aatttgtacaatg

SEQ ID NO: 1141733 - DNA, 16 bp, Homo sapiens
aatttgtacaatggtt

SEQ ID NO: 1141734 - DNA, 18 bp, Homo sapiens
aatttgtacaatggttta

SEQ ID NO: 1141735 - DNA, 19 bp, Homo sapiens
aatttgtacaggactgtaa

SEQ ID NO: 1141736 - DNA, 14 bp, Homo sapiens
aatttgtatatcat

SEQ ID NO: 1141737 - DNA, 10 bp, Homo sapiens
aatttgtcag

SEQ ID NO: 1141738 - DNA, 13 bp, Homo sapiens
aatttgtctccta

SEQ ID NO: 1141739 - DNA, 22 bp, Homo sapiens
aatttgtctgaaacatttcata

SEQ ID NO: 1141740 - DNA, 14 bp, Homo sapiens
aatttgtgaatttg

SEQ ID NO: 1141741 - DNA, 14 bp, Homo sapiens
aatttgtgatacaa

SEQ ID NO: 1141742 - DNA, 17 bp, Homo sapiens
aatttgtgtgtttttag

SEQ ID NO: 1141743 - DNA, 14 bp, Homo sapiens
aatttgttaattcc

SEQ ID NO: 1141744 - DNA, 20 bp, Homo sapiens
aatttgttaattcctatgaa

SEQ ID NO: 1141745 - DNA, 18 bp, Homo sapiens
aatttgttatacttcaaa

SEQ ID NO: 1141746 - DNA, 18 bp, Homo sapiens
aatttgttgaaattatgt

SEQ ID NO: 1141747 - DNA, 14 bp, Homo sapiens
aattttaaaaatac

SEQ ID NO: 1141748 - DNA, 18 bp, Homo sapiens
aattttaaaaataccaat

SEQ ID NO: 1141749 - DNA, 15 bp, Homo sapiens
aattttaaaatctga

SEQ ID NO: 1141750 - DNA, 22 bp, Homo sapiens
aattttaaaatctgagggaaat

SEQ ID NO: 1141751 - DNA, 15 bp, Homo sapiens
aattttaaagccatt

SEQ ID NO: 1141752 - DNA, 12 bp, Homo sapiens
aattttaaagtt

SEQ ID NO: 1141753 - DNA, 19 bp, Homo sapiens
aattttaacctatgatatt

SEQ ID NO: 1141754 - DNA, 11 bp, Homo sapiens
aattttaactg

SEQ ID NO: 1141755 - DNA, 14 bp, Homo sapiens
aattttaactgatt

SEQ ID NO: 1141756 - DNA, 19 bp, Homo sapiens
aattttaatattcttttgt

SEQ ID NO: 1141757 - DNA, 20 bp, Homo sapiens
aattttaatattcttttgtt

SEQ ID NO: 1141758 - DNA, 18 bp, Homo sapiens
aattttaatgatggtgtt

SEQ ID NO: 1141759 - DNA, 13 bp, Homo sapiens
aattttaatgcta

SEQ ID NO: 1141760 - DNA, 16 bp, Homo sapiens
aattttaatgctgttt

SEQ ID NO: 1141761 - DNA, 23 bp, Homo sapiens
aattttacaagggcataaagtaa

SEQ ID NO: 1141762 - DNA, 20 bp, Homo sapiens
aattttacacgcttttgtga

SEQ ID NO: 1141763 - DNA, 21 bp, Homo sapiens
aattttacactctgtattgaa

SEQ ID NO: 1141764 - DNA, 16 bp, Homo sapiens
aattttacatgacaga

SEQ ID NO: 1141765 - DNA, 20 bp, Homo sapiens
aattttacatgtttataaat

SEQ ID NO: 1141766 - DNA, 18 bp, Homo sapiens
aattttaccctttagact

SEQ ID NO: 1141767 - DNA, 13 bp, Homo sapiens
aattttagaactt

SEQ ID NO: 1141768 - DNA, 15 bp, Homo sapiens
aattttagaacttta

SEQ ID NO: 1141769 - DNA, 12 bp, Homo sapiens
aattttaggaac

SEQ ID NO: 1141770 - DNA, 21 bp, Homo sapiens
aattttaggaacttcagagat

SEQ ID NO: 1141771 - DNA, 23 bp, Homo sapiens
aattttaggcactcttaaatgat

SEQ ID NO: 1141772 - DNA, 13 bp, Homo sapiens
aattttagtattc

SEQ ID NO: 1141773 - DNA, 14 bp, Homo sapiens
aattttagtattca

SEQ ID NO: 1141774 - DNA, 18 bp, Homo sapiens
aattttagtcactaagac

SEQ ID NO: 1141775 - DNA, 12 bp, Homo sapiens
aattttagtgta

SEQ ID NO: 1141776 - DNA, 15 bp, Homo sapiens
aattttagtttttca

SEQ ID NO: 1141777 - DNA, 16 bp, Homo sapiens
aattttagtttttcat

SEQ ID NO: 1141778 - DNA, 19 bp, Homo sapiens
aattttatatgtaaatgtg

SEQ ID NO: 1141779 - DNA, 20 bp, Homo sapiens
aattttatatgtaaatgtgt

SEQ ID NO: 1141780 - DNA, 14 bp, Homo sapiens
aattttatccctca

SEQ ID NO: 1141781 - DNA, 15 bp, Homo sapiens
aattttattgcaaag

SEQ ID NO: 1141782 - DNA, 16 bp, Homo sapiens
aattttattgcaaagt

SEQ ID NO: 1141783 - DNA, 21 bp, Homo sapiens
aattttatttgttctttttct

SEQ ID NO: 1141784 - DNA, 19 bp, Homo sapiens
aattttattttaaaatttc

SEQ ID NO: 1141785 - DNA, 22 bp, Homo sapiens
aattttattttaaaatttcata

SEQ ID NO: 1141786 - DNA, 15 bp, Homo sapiens
aattttattttgctg

SEQ ID NO: 1141787 - DNA, 13 bp, Homo sapiens
aattttcaaatcc

SEQ ID NO: 1141788 - DNA, 15 bp, Homo sapiens
aattttcaaggcctt

SEQ ID NO: 1141789 - DNA, 18 bp, Homo sapiens
aattttcaaggccttcag

SEQ ID NO: 1141790 - DNA, 22 bp, Homo sapiens
aattttcaaggccttcagttta

SEQ ID NO: 1141791 - DNA, 15 bp, Homo sapiens
aattttcaagtaatt

SEQ ID NO: 1141792 - DNA, 21 bp, Homo sapiens
aattttcaagtttacacttca

SEQ ID NO: 1141793 - DNA, 16 bp, Homo sapiens
aattttcagagacttt

SEQ ID NO: 1141794 - DNA, 20 bp, Homo sapiens
aattttcattaaacttgaag

SEQ ID NO: 1141795 - DNA, 19 bp, Homo sapiens
aattttcctaataaagttc

SEQ ID NO: 1141796 - DNA, 16 bp, Homo sapiens
aattttctaaaagctt

SEQ ID NO: 1141797 - DNA, 16 bp, Homo sapiens
aattttctaagacagt

SEQ ID NO: 1141798 - DNA, 17 bp, Homo sapiens
aattttctcattttctt

SEQ ID NO: 1141799 - DNA, 18 bp, Homo sapiens
aattttctcccaggaagc

SEQ ID NO: 1141800 - DNA, 13 bp, Homo sapiens
aattttctccctt

SEQ ID NO: 1141801 - DNA, 18 bp, Homo sapiens
aattttctccctttatgt

SEQ ID NO: 1141802 - DNA, 23 bp, Homo sapiens
aattttctccctttatgtatctc

SEQ ID NO: 1141803 - DNA, 13 bp, Homo sapiens
aattttctctcca

SEQ ID NO: 1141804 - DNA, 14 bp, Homo sapiens
aattttcttcatgc

SEQ ID NO: 1141805 - DNA, 16 bp, Homo sapiens
aattttcttgtttgtt

SEQ ID NO: 1141806 - DNA, 23 bp, Homo sapiens
aattttctttaaccagtctgaag

SEQ ID NO: 1141807 - DNA, 13 bp, Homo sapiens
atctatgtgtttc

SEQ ID NO: 1141808 - DNA, 22 bp, Homo sapiens
atctatgtgtttctgtaacaaa

SEQ ID NO: 1141809 - DNA, 16 bp, Homo sapiens
atctatgtttgtgtga

SEQ ID NO: 1141810 - DNA, 19 bp, Homo sapiens
atctatgtttgtgtgattt

SEQ ID NO: 1141811 - DNA, 12 bp, Homo sapiens
atctattaatat

SEQ ID NO: 1141812 - DNA, 17 bp, Homo sapiens
atctattcagacaagca

SEQ ID NO: 1141813 - DNA, 19 bp, Homo sapiens
atctattctcaaagctaaa

SEQ ID NO: 1141814 - DNA, 15 bp, Homo sapiens
atctatttattaata

SEQ ID NO: 1141815 - DNA, 19 bp, Homo sapiens
atctatttattaatattta

SEQ ID NO: 1141816 - DNA, 19 bp, Homo sapiens
atctatttcatgtttttga

SEQ ID NO: 1141817 - DNA, 15 bp, Homo sapiens
atctatttctatgag

SEQ ID NO: 1141818 - DNA, 18 bp, Homo sapiens
atctatttgtacaatttt

SEQ ID NO: 1141819 - DNA, 20 bp, Homo sapiens
atctatttgtacaattttaa

SEQ ID NO: 1141820 - DNA, 20 bp, Homo sapiens
atctatttttttttcttttt

SEQ ID NO: 1141821 - DNA, 12 bp, Homo sapiens
atctcaaaatta

SEQ ID NO: 1141822 - DNA, 14 bp, Homo sapiens
atctcaaagcacaa

SEQ ID NO: 1141823 - DNA, 19 bp, Homo sapiens
atctcaaaggagaaaaaaa

SEQ ID NO: 1141824 - DNA, 21 bp, Homo sapiens
atctcaaataactaaaaggta

SEQ ID NO: 1141825 - DNA, 13 bp, Homo sapiens
atctcaaatttat

SEQ ID NO: 1141826 - DNA, 22 bp, Homo sapiens
atctcaacagaattaaaatgtc

SEQ ID NO: 1141827 - DNA, 22 bp, Homo sapiens
atctcaagatgggggcagggct

SEQ ID NO: 1141828 - DNA, 15 bp, Homo sapiens
atctcaatctgcagc

SEQ ID NO: 1141829 - DNA, 18 bp, Homo sapiens
atctcaatgaagccagct

SEQ ID NO: 1141830 - DNA, 14 bp, Homo sapiens
atctcacaggctga

SEQ ID NO: 1141831 - DNA, 17 bp, Homo sapiens
atctcacaggctgagaa

SEQ ID NO: 1141832 - DNA, 14 bp, Homo sapiens
atctcaccccatcc

SEQ ID NO: 1141833 - DNA, 16 bp, Homo sapiens
atctcaccccatccca

SEQ ID NO: 1141834 - DNA, 22 bp, Homo sapiens
atctcaccccatcccacaccct

SEQ ID NO: 1141835 - DNA, 18 bp, Homo sapiens
aattttgtgcattctttg

SEQ ID NO: 1141836 - DNA, 21 bp, Homo sapiens
aattttgtgcattctttggta

SEQ ID NO: 1141837 - DNA, 16 bp, Homo sapiens
aattttgttctctggg

SEQ ID NO: 1141838 - DNA, 17 bp, Homo sapiens
aattttgttctctggga

SEQ ID NO: 1141839 - DNA, 19 bp, Homo sapiens
aattttgttctctgggaga

SEQ ID NO: 1141840 - DNA, 21 bp, Homo sapiens
aattttgtttcagaattttgt

SEQ ID NO: 1141841 - DNA, 22 bp, Homo sapiens
aattttgtttcagaattttgta

SEQ ID NO: 1141842 - DNA, 14 bp, Homo sapiens
aattttgttttact

SEQ ID NO: 1141843 - DNA, 16 bp, Homo sapiens
aattttgttttacttt

SEQ ID NO: 1141844 - DNA, 22 bp, Homo sapiens
aattttgtttttattttcaaga

SEQ ID NO: 1141845 - DNA, 19 bp, Homo sapiens
aatttttaaacaagtattt

SEQ ID NO: 1141846 - DNA, 19 bp, Homo sapiens
aatttttaaagtatatatt

SEQ ID NO: 1141847 - DNA, 14 bp, Homo sapiens
aatttttaactttt

SEQ ID NO: 1141848 - DNA, 21 bp, Homo sapiens
aatttttaacttttggaatca

SEQ ID NO: 1141849 - DNA, 22 bp, Homo sapiens
aatttttaacttttggaatcat

SEQ ID NO: 1141850 - DNA, 17 bp, Homo sapiens
aatttttaagctgcaaa

SEQ ID NO: 1141851 - DNA, 14 bp, Homo sapiens
aatttttaatgttt

SEQ ID NO: 1141852 - DNA, 15 bp, Homo sapiens
aatttttacatttgt

SEQ ID NO: 1141853 - DNA, 18 bp, Homo sapiens
aatttttattaaattatg

SEQ ID NO: 1141854 - DNA, 15 bp, Homo sapiens
aatttttatttcttt

SEQ ID NO: 1141855 - DNA, 21 bp, Homo sapiens
aatttttatttctttttaatt

SEQ ID NO: 1141856 - DNA, 19 bp, Homo sapiens
aatttttcagatgcttctg

SEQ ID NO: 1141857 - DNA, 13 bp, Homo sapiens
aatttttcataga

SEQ ID NO: 1141858 - DNA, 16 bp, Homo sapiens
aatttttcattctcag

SEQ ID NO: 1141859 - DNA, 14 bp, Homo sapiens
aatttttccaacta

SEQ ID NO: 1141860 - DNA, 17 bp, Homo sapiens
aatttttcccagtattt

SEQ ID NO: 1141861 - DNA, 16 bp, Homo sapiens
aatttttctgtacttc

SEQ ID NO: 1141862 - DNA, 21 bp, Homo sapiens
aatttttcttaagacagagtc

SEQ ID NO: 1141863 - DNA, 13 bp, Homo sapiens
aatttttgaaaag

SEQ ID NO: 1141864 - DNA, 19 bp, Homo sapiens
aatttttgacactttttgt

SEQ ID NO: 1141865 - DNA, 18 bp, Homo sapiens
aatttttgcctatcttta

SEQ ID NO: 1141866 - DNA, 18 bp, Homo sapiens
aatttttgcttaacatta

SEQ ID NO: 1141867 - DNA, 20 bp, Homo sapiens
aatttttgcttttagaaaag

SEQ ID NO: 1141868 - DNA, 16 bp, Homo sapiens
aatttttggttgaata

SEQ ID NO: 1141869 - DNA, 18 bp, Homo sapiens
aatttttggttgaataaa

SEQ ID NO: 1141870 - DNA, 20 bp, Homo sapiens
aatttttggtttatgacttt

SEQ ID NO: 1141871 - DNA, 14 bp, Homo sapiens
aatttttgtaattt

SEQ ID NO: 1141872 - DNA, 17 bp, Homo sapiens
aatttttgtattatttt

SEQ ID NO: 1141873 - DNA, 13 bp, Homo sapiens
aattttttgactt

SEQ ID NO: 1141874 - DNA, 15 bp, Homo sapiens
aattttttggtacaa

SEQ ID NO: 1141875 - DNA, 16 bp, Homo sapiens
aatttttttaatgttt

SEQ ID NO: 1141876 - DNA, 17 bp, Homo sapiens
aatttttttattactga

SEQ ID NO: 1141877 - DNA, 15 bp, Homo sapiens
aatttttttcaatat

SEQ ID NO: 1141878 - DNA, 18 bp, Homo sapiens
aatttttttgtattttag

SEQ ID NO: 1141879 - DNA, 16 bp, Homo sapiens
aattttttttaaagaa

SEQ ID NO: 1141880 - DNA, 20 bp, Homo sapiens
aattttttttaatgtacaag

SEQ ID NO: 1141881 - DNA, 16 bp, Homo sapiens
aattttttttacattt

SEQ ID NO: 1141882 - DNA, 20 bp, Homo sapiens
aattttttttattagtattg

SEQ ID NO: 1141883 - DNA, 23 bp, Homo sapiens
aattttttttattagtattgttg

SEQ ID NO: 1141884 - DNA, 23 bp, Homo sapiens
aattttttttgttttttgtaact

SEQ ID NO: 1141885 - DNA, 19 bp, Homo sapiens
aatttttttttaaatttta

SEQ ID NO: 1141886 - DNA, 22 bp, Homo sapiens
aatttttttttattttgctttg

SEQ ID NO: 1141887 - DNA, 14 bp, Homo sapiens
aattttttttttcc

SEQ ID NO: 1141888 - DNA, 23 bp, Homo sapiens
aattttttttttcctcttcagaa

SEQ ID NO: 1141889 - DNA, 20 bp, Homo sapiens
aattttttttttttaacttt

SEQ ID NO: 1141890 - DNA, 17 bp, Homo sapiens
acaaaaaaaaagtttta

SEQ ID NO: 1141891 - DNA, 12 bp, Homo sapiens
acaaaaaaacta

SEQ ID NO: 1141892 - DNA, 23 bp, Homo sapiens
acaaaaaaactataaaaaagaaa

SEQ ID NO: 1141893 - DNA, 17 bp, Homo sapiens
acaaaaaacgaatgaaa

SEQ ID NO: 1141894 - DNA, 14 bp, Homo sapiens
acaaaaaactgcct

SEQ ID NO: 1141895 - DNA, 19 bp, Homo sapiens
acaaaaaataaaatgaaca

SEQ ID NO: 1141896 - DNA, 12 bp, Homo sapiens
acaaaaaatact

SEQ ID NO: 1141897 - DNA, 12 bp, Homo sapiens
acaaaaacaaaa

SEQ ID NO: 1141898 - DNA, 18 bp, Homo sapiens
acaaaaacaaaaaaacta

SEQ ID NO: 1141899 - DNA, 13 bp, Homo sapiens
acaaaaacaagac

SEQ ID NO: 1141900 - DNA, 19 bp, Homo sapiens
acaaaaacagaatttgaga

SEQ ID NO: 1141901 - DNA, 21 bp, Homo sapiens
acaaaaacagcctcacagaag

SEQ ID NO: 1141902 - DNA, 15 bp, Homo sapiens
acaaaaaccagcagg

SEQ ID NO: 1141903 - DNA, 14 bp, Homo sapiens
acaaaaagaaaaga

SEQ ID NO: 1141904 - DNA, 20 bp, Homo sapiens
acaaaaagaaatcttgtctt

SEQ ID NO: 1141905 - DNA, 21 bp, Homo sapiens
acaaaaagaaatcttgtctta

SEQ ID NO: 1141906 - DNA, 13 bp, Homo sapiens
acaaaaagagctt

SEQ ID NO: 1141907 - DNA, 16 bp, Homo sapiens
acaaaaagcataaaaa

SEQ ID NO: 1141908 - DNA, 15 bp, Homo sapiens
acaaaaagcttcccc

SEQ ID NO: 1141909 - DNA, 17 bp, Homo sapiens
acaaaaaggagcgggca

SEQ ID NO: 1141910 - DNA, 15 bp, Homo sapiens
acaaaaagtgcttca

SEQ ID NO: 1141911 - DNA, 18 bp, Homo sapiens
acaaaaagtttccatatg

SEQ ID NO: 1141912 - DNA, 12 bp, Homo sapiens
acaaaaataaat

SEQ ID NO: 1141913 - DNA, 19 bp, Homo sapiens
acaaaaatgaactgaagtt

SEQ ID NO: 1141914 - DNA, 23 bp, Homo sapiens
acaaaaatgaactgaagtttcac

SEQ ID NO: 1141915 - DNA, 14 bp, Homo sapiens
acaaaaattaaaat

SEQ ID NO: 1141916 - DNA, 14 bp, Homo sapiens
acaaaaattaggta

SEQ ID NO: 1141917 - DNA, 13 bp, Homo sapiens
acaaaaatttatt

SEQ ID NO: 1141918 - DNA, 13 bp, Homo sapiens
acaaaaatttgaa

SEQ ID NO: 1141919 - DNA, 15 bp, Homo sapiens
acaaaacaaacttcc

SEQ ID NO: 1141920 - DNA, 19 bp, Homo sapiens
acaaaacaacaaaaaccaa

SEQ ID NO: 1141921 - DNA, 23 bp, Homo sapiens
acaaaacactcggcatttcaaat

SEQ ID NO: 1141922 - DNA, 15 bp, Homo sapiens
acaaaacgagtcttt

SEQ ID NO: 1141923 - DNA, 20 bp, Homo sapiens
acaaaactgttcttttgcat

SEQ ID NO: 1141924 - DNA, 11 bp, Homo sapiens
acaaaacttcc

SEQ ID NO: 1141925 - DNA, 12 bp, Homo sapiens
acaaaacttgaa

SEQ ID NO: 1141926 - DNA, 14 bp, Homo sapiens
acaaaacttttcta

SEQ ID NO: 1141927 - DNA, 16 bp, Homo sapiens
acaaaagaatttttgt

SEQ ID NO: 1141928 - DNA, 11 bp, Homo sapiens
acaaaagcaat

SEQ ID NO: 1141929 - DNA, 18 bp, Homo sapiens
acaaaagcagccctctgc

SEQ ID NO: 1141930 - DNA, 22 bp, Homo sapiens
acaaaagcatgtgagactggtt

SEQ ID NO: 1141931 - DNA, 15 bp, Homo sapiens
acaaaagctttgaat

SEQ ID NO: 1141932 - DNA, 16 bp, Homo sapiens
acaaaaggcatctgaa

SEQ ID NO: 1141933 - DNA, 16 bp, Homo sapiens
acaaaagtacattgct

SEQ ID NO: 1141934 - DNA, 15 bp, Homo sapiens
acaaaagtctgtctt

SEQ ID NO: 1141935 - DNA, 21 bp, Homo sapiens
acaaaagtctgtctttcctga

SEQ ID NO: 1141936 - DNA, 17 bp, Homo sapiens
atctctctgcagctgcc

SEQ ID NO: 1141937 - DNA, 18 bp, Homo sapiens
atctctctgcagctgccg

SEQ ID NO: 1141938 - DNA, 21 bp, Homo sapiens
atctctctgccctctccctgt

SEQ ID NO: 1141939 - DNA, 23 bp, Homo sapiens
atctctctgccctctccctgtgt

SEQ ID NO: 1141940 - DNA, 20 bp, Homo sapiens
atctctctggcttctgaaga

SEQ ID NO: 1141941 - DNA, 16 bp, Homo sapiens
atctctctggggccct

SEQ ID NO: 1141942 - DNA, 23 bp, Homo sapiens
atctctctggggccctgggcctc

SEQ ID NO: 1141943 - DNA, 16 bp, Homo sapiens
atctctgaaaattctg

SEQ ID NO: 1141944 - DNA, 13 bp, Homo sapiens
atctctgagtgga

SEQ ID NO: 1141945 - DNA, 20 bp, Homo sapiens
atctctgagttctgtgtatt

SEQ ID NO: 1141946 - DNA, 23 bp, Homo sapiens
atctctgcaccctggggcctgga

SEQ ID NO: 1141947 - DNA, 20 bp, Homo sapiens
atctctgcagtttttcccaa

SEQ ID NO: 1141948 - DNA, 18 bp, Homo sapiens
atctctgccgtctctcct

SEQ ID NO: 1141949 - DNA, 20 bp, Homo sapiens
atctctggaaggggcagccc

SEQ ID NO: 1141950 - DNA, 23 bp, Homo sapiens
atctctggaaggggcagccctga

SEQ ID NO: 1141951 - DNA, 18 bp, Homo sapiens
atctctggagccagagag

SEQ ID NO: 1141952 - DNA, 18 bp, Homo sapiens
atctctggcaccacacta

SEQ ID NO: 1141953 - DNA, 13 bp, Homo sapiens
atctctgtaaagc

SEQ ID NO: 1141954 - DNA, 17 bp, Homo sapiens
atctctgtaaagctaaa

SEQ ID NO: 1141955 - DNA, 18 bp, Homo sapiens
atctctgtaaagctaaaa

SEQ ID NO: 1141956 - DNA, 17 bp, Homo sapiens
atctctgtcacatccaa

SEQ ID NO: 1141957 - DNA, 21 bp, Homo sapiens
atctggaagccaaaatgtagg

SEQ ID NO: 1141958 - DNA, 17 bp, Homo sapiens
atctggacagaacattt

SEQ ID NO: 1141959 - DNA, 22 bp, Homo sapiens
atctggaccccatctgtgaata

SEQ ID NO: 1141960 - DNA, 18 bp, Homo sapiens
atctggactcctctgtcc

SEQ ID NO: 1141961 - DNA, 19 bp, Homo sapiens
atctggactcctctgtcca

SEQ ID NO: 1141962 - DNA, 20 bp, Homo sapiens
atctggagaccagggagcct

SEQ ID NO: 1141963 - DNA, 13 bp, Homo sapiens
atctggcactgtt

SEQ ID NO: 1141964 - DNA, 14 bp, Homo sapiens
atctggcactgtta

SEQ ID NO: 1141965 - DNA, 20 bp, Homo sapiens
atctggcattctacacctgg

SEQ ID NO: 1141966 - DNA, 20 bp, Homo sapiens
atctggccctcgacactcac

SEQ ID NO: 1141967 - DNA, 14 bp, Homo sapiens
atctggctgcacag

SEQ ID NO: 1141968 - DNA, 17 bp, Homo sapiens
atctggctgcacaggct

SEQ ID NO: 1141969 - DNA, 20 bp, Homo sapiens
atctgggaaatgaggttttt

SEQ ID NO: 1141970 - DNA, 14 bp, Homo sapiens
atctgggactttca

SEQ ID NO: 1141971 - DNA, 13 bp, Homo sapiens
atctgggagggaa

SEQ ID NO: 1141972 - DNA, 22 bp, Homo sapiens
atctgggattcccaccaaggtc

SEQ ID NO: 1141973 - DNA, 21 bp, Homo sapiens
atctggggagctcctggccag

SEQ ID NO: 1141974 - DNA, 23 bp, Homo sapiens
atctggggcagcaccctataaat

SEQ ID NO: 1141975 - DNA, 16 bp, Homo sapiens
atctggggctctggga

SEQ ID NO: 1141976 - DNA, 15 bp, Homo sapiens
atctggggggtgggg

SEQ ID NO: 1141977 - DNA, 13 bp, Homo sapiens
atctgggggtgag

SEQ ID NO: 1141978 - DNA, 15 bp, Homo sapiens
atctgggtagctgta

SEQ ID NO: 1141979 - DNA, 15 bp, Homo sapiens
atctgggtgactgag

SEQ ID NO: 1141980 - DNA, 18 bp, Homo sapiens
atctgggtgcatgatctt

SEQ ID NO: 1141981 - DNA, 16 bp, Homo sapiens
atctgggttaagtgtt

SEQ ID NO: 1141982 - DNA, 15 bp, Homo sapiens
atctggtatatgtca

SEQ ID NO: 1141983 - DNA, 15 bp, Homo sapiens
atctggtcaagttga

SEQ ID NO: 1141984 - DNA, 14 bp, Homo sapiens
atctggtcatttgg

SEQ ID NO: 1141985 - DNA, 17 bp, Homo sapiens
atctggtcccttgcagc

SEQ ID NO: 1141986 - DNA, 14 bp, Homo sapiens
atctggtcctaccc

SEQ ID NO: 1141987 - DNA, 13 bp, Homo sapiens
atctggtctcttc

SEQ ID NO: 1141988 - DNA, 18 bp, Homo sapiens
atctggtcttgttagaaa

SEQ ID NO: 1141989 - DNA, 19 bp, Homo sapiens
atctggtcttgttagaaaa

SEQ ID NO: 1141990 - DNA, 23 bp, Homo sapiens
atctggtcttgtttccaggagca

SEQ ID NO: 1141991 - DNA, 17 bp, Homo sapiens
atctggtgatttctagc

SEQ ID NO: 1141992 - DNA, 14 bp, Homo sapiens
atctggtgcctcct

SEQ ID NO: 1141993 - DNA, 16 bp, Homo sapiens
atctggtgcctcctca

SEQ ID NO: 1141994 - DNA, 20 bp, Homo sapiens
atctggtggtcagccctagg

SEQ ID NO: 1141995 - DNA, 15 bp, Homo sapiens
atctggtgttgggga

SEQ ID NO: 1141996 - DNA, 14 bp, Homo sapiens
atctgtaaactgtg

SEQ ID NO: 1141997 - DNA, 17 bp, Homo sapiens
atctgtaaactgtgtat

SEQ ID NO: 1141998 - DNA, 13 bp, Homo sapiens
atctgtaaagcca

SEQ ID NO: 1141999 - DNA, 14 bp, Homo sapiens
atctgtaaagccag

SEQ ID NO: 1142000 - DNA, 18 bp, Homo sapiens
atctgtaaatatcccaga

SEQ ID NO: 1142001 - DNA, 19 bp, Homo sapiens
atctgtaaatatcccagag

SEQ ID NO: 1142002 - DNA, 17 bp, Homo sapiens
atctgtaagagcttgct

SEQ ID NO: 1142003 - DNA, 20 bp, Homo sapiens
atctgtaagagcttgctcca

SEQ ID NO: 1142004 - DNA, 11 bp, Homo sapiens
atctgtacatg

SEQ ID NO: 1142005 - DNA, 20 bp, Homo sapiens
atctgtacatgttcttgtca

SEQ ID NO: 1142006 - DNA, 13 bp, Homo sapiens
atctgtactttgt

SEQ ID NO: 1142007 - DNA, 15 bp, Homo sapiens
atctgtactttgtgt

SEQ ID NO: 1142008 - DNA, 12 bp, Homo sapiens
atctgtagatac

SEQ ID NO: 1142009 - DNA, 22 bp, Homo sapiens
atctgtagatactagctatcta

SEQ ID NO: 1142010 - DNA, 14 bp, Homo sapiens
atctgtagggctgg

SEQ ID NO: 1142011 - DNA, 17 bp, Homo sapiens
atctgtagggctggacc

SEQ ID NO: 1142012 - DNA, 15 bp, Homo sapiens
atctgtataaataag

SEQ ID NO: 1142013 - DNA, 23 bp, Homo sapiens
atctgtataagtaagaaaatatt

SEQ ID NO: 1142014 - DNA, 21 bp, Homo sapiens
atctgtataatactttgtata

SEQ ID NO: 1142015 - DNA, 21 bp, Homo sapiens
atctgtatatacaataacata

SEQ ID NO: 1142016 - DNA, 13 bp, Homo sapiens
atctgtatctctc

SEQ ID NO: 1142017 - DNA, 15 bp, Homo sapiens
atctgtatctctctc

SEQ ID NO: 1142018 - DNA, 16 bp, Homo sapiens
atctgtattcttgctt

SEQ ID NO: 1142019 - DNA, 22 bp, Homo sapiens
atctgtatttaatggtttttat

SEQ ID NO: 1142020 - DNA, 15 bp, Homo sapiens
atctgtcaaaacact

SEQ ID NO: 1142021 - DNA, 16 bp, Homo sapiens
atctgtcaaaacactg

SEQ ID NO: 1142022 - DNA, 17 bp, Homo sapiens
atctgtcaaaacactgt

SEQ ID NO: 1142023 - DNA, 20 bp, Homo sapiens
atctgtcaaaacactgtgga

SEQ ID NO: 1142024 - DNA, 22 bp, Homo sapiens
atctgtcaagagtagttatata

SEQ ID NO: 1142025 - DNA, 10 bp, Homo sapiens
atctgtcaca

SEQ ID NO: 1142026 - DNA, 16 bp, Homo sapiens
atctgtcacaataaat

SEQ ID NO: 1142027 - DNA, 20 bp, Homo sapiens
atctgtcacacctgtgcctc

SEQ ID NO: 1142028 - DNA, 21 bp, Homo sapiens
atctgtcagcatctggctgtc

SEQ ID NO: 1142029 - DNA, 19 bp, Homo sapiens
atctgtccaaaggaggctg

SEQ ID NO: 1142030 - DNA, 13 bp, Homo sapiens
atctgtccaagga

SEQ ID NO: 1142031 - DNA, 16 bp, Homo sapiens
atctgtcccttaataa

SEQ ID NO: 1142032 - DNA, 22 bp, Homo sapiens
atctgtccgtccagagccggca

SEQ ID NO: 1142033 - DNA, 15 bp, Homo sapiens
atctgtcctcaccct

SEQ ID NO: 1142034 - DNA, 23 bp, Homo sapiens
atctgtcctcaccctgtgggacc

SEQ ID NO: 1142035 - DNA, 22 bp, Homo sapiens
atctgtctgccaacctaaaact

SEQ ID NO: 1142036 - DNA, 23 bp, Homo sapiens
atctgtctgccaacctaaaactc

SEQ ID NO: 1142037 - DNA, 15 bp, Homo sapiens
atctgtctgtctgtg

SEQ ID NO: 1142038 - DNA, 20 bp, Homo sapiens
atctgtctgtctgtgggctt

SEQ ID NO: 1142039 - DNA, 10 bp, Homo sapiens
atctgtcttc

SEQ ID NO: 1142040 - DNA, 14 bp, Homo sapiens
atctgtcttcagca

SEQ ID NO: 1142041 - DNA, 11 bp, Homo sapiens
atctgtcttgg

SEQ ID NO: 1142042 - DNA, 11 bp, Homo sapiens
atctgtctttc

SEQ ID NO: 1142043 - DNA, 20 bp, Homo sapiens
atctgtctttccactctgga

SEQ ID NO: 1142044 - DNA, 11 bp, Homo sapiens
atctgtgaaat

SEQ ID NO: 1142045 - DNA, 13 bp, Homo sapiens
atctgtgaataag

SEQ ID NO: 1142046 - DNA, 12 bp, Homo sapiens
atctgtgatgat

SEQ ID NO: 1142047 - DNA, 13 bp, Homo sapiens
atctgtgattaaa

SEQ ID NO: 1142048 - DNA, 14 bp, Homo sapiens
atctgtgcaaacag

SEQ ID NO: 1142049 - DNA, 15 bp, Homo sapiens
atctgtgcaaacagt

SEQ ID NO: 1142050 - DNA, 13 bp, Homo sapiens
atctgtgccccat

SEQ ID NO: 1142051 - DNA, 13 bp, Homo sapiens
atctgtgcctggg

SEQ ID NO: 1142052 - DNA, 15 bp, Homo sapiens
atctgtgcctgggat

SEQ ID NO: 1142053 - DNA, 23 bp, Homo sapiens
atctgtgcgcgtggcgtggcccg

SEQ ID NO: 1142054 - DNA, 23 bp, Homo sapiens
atctgtgcgtgtggcgtggcccg

SEQ ID NO: 1142055 - DNA, 15 bp, Homo sapiens
atctgtgctggccat

SEQ ID NO: 1142056 - DNA, 15 bp, Homo sapiens
atctgtggagctgcc

SEQ ID NO: 1142057 - DNA, 14 bp, Homo sapiens
atctgtggagttcc

SEQ ID NO: 1142058 - DNA, 19 bp, Homo sapiens
atctgtggagttcctgctc

SEQ ID NO: 1142059 - DNA, 23 bp, Homo sapiens
atctgtgggtctgggagtcacac

SEQ ID NO: 1142060 - DNA, 16 bp, Homo sapiens
atctgtgtacaaagaa

SEQ ID NO: 1142061 - DNA, 17 bp, Homo sapiens
atctgtgtacaatttta

SEQ ID NO: 1142062 - DNA, 12 bp, Homo sapiens
atctgtgtcttg

SEQ ID NO: 1142063 - DNA, 13 bp, Homo sapiens
atctgtgtcttgt

SEQ ID NO: 1142064 - DNA, 17 bp, Homo sapiens
atctgtgtgaaaatggg

SEQ ID NO: 1142065 - DNA, 15 bp, Homo sapiens
atctgtgtgaaactt

SEQ ID NO: 1142066 - DNA, 23 bp, Homo sapiens
atctgtgtgtgtggcgtggcccg

SEQ ID NO: 1142067 - DNA, 18 bp, Homo sapiens
acaaatgcaaatttctat

SEQ ID NO: 1142068 - DNA, 17 bp, Homo sapiens
acaaatgctcaaagaaa

SEQ ID NO: 1142069 - DNA, 17 bp, Homo sapiens
acaaatgtaagcaaagg

SEQ ID NO: 1142070 - DNA, 12 bp, Homo sapiens
acaaatgtcatt

SEQ ID NO: 1142071 - DNA, 21 bp, Homo sapiens
acaaatgtctagtttctagtg

SEQ ID NO: 1142072 - DNA, 14 bp, Homo sapiens
acaaatgtctatca

SEQ ID NO: 1142073 - DNA, 15 bp, Homo sapiens
acaaatgtgaaacgg

SEQ ID NO: 1142074 - DNA, 18 bp, Homo sapiens
acaaatgtgataatatat

SEQ ID NO: 1142075 - DNA, 16 bp, Homo sapiens
acaaatgtgtttttct

SEQ ID NO: 1142076 - DNA, 23 bp, Homo sapiens
acaaatgttgacctttgaggtct

SEQ ID NO: 1142077 - DNA, 15 bp, Homo sapiens
acaaatgtttataac

SEQ ID NO: 1142078 - DNA, 13 bp, Homo sapiens
acaaattaatttt

SEQ ID NO: 1142079 - DNA, 15 bp, Homo sapiens
acaaattagaggaga

SEQ ID NO: 1142080 - DNA, 21 bp, Homo sapiens
acaagattcccagagacagga

SEQ ID NO: 1142081 - DNA, 20 bp, Homo sapiens
acaagatttccacaattctt

SEQ ID NO: 1142082 - DNA, 20 bp, Homo sapiens
acaagattttaaagacatgt

SEQ ID NO: 1142083 - DNA, 15 bp, Homo sapiens
acaagattttttaat

SEQ ID NO: 1142084 - DNA, 22 bp, Homo sapiens
acaagattttttaattgtttaa

SEQ ID NO: 1142085 - DNA, 11 bp, Homo sapiens
acaagcaacaa

SEQ ID NO: 1142086 - DNA, 20 bp, Homo sapiens
acaagcactattttatattt

SEQ ID NO: 1142087 - DNA, 21 bp, Homo sapiens
acaagcactattttatattta

SEQ ID NO: 1142088 - DNA, 15 bp, Homo sapiens
acaagcatatttgag

SEQ ID NO: 1142089 - DNA, 21 bp, Homo sapiens
acaagccaaaagtccctccct

SEQ ID NO: 1142090 - DNA, 17 bp, Homo sapiens
acaagccaaaatgggag

SEQ ID NO: 1142091 - DNA, 18 bp, Homo sapiens
acaagccacagaagccag

SEQ ID NO: 1142092 - DNA, 18 bp, Homo sapiens
acaagcccccccttccac

SEQ ID NO: 1142093 - DNA, 18 bp, Homo sapiens
acaagccctaacttctgt

SEQ ID NO: 1142094 - DNA, 14 bp, Homo sapiens
acaagccctggcaa

SEQ ID NO: 1142095 - DNA, 14 bp, Homo sapiens
acaagccttaatct

SEQ ID NO: 1142096 - DNA, 15 bp, Homo sapiens
acaagccttaatctg

SEQ ID NO: 1142097 - DNA, 22 bp, Homo sapiens
acaagcgtcacttctcctgctg

SEQ ID NO: 1142098 - DNA, 14 bp, Homo sapiens
acaagctaagagtt

SEQ ID NO: 1142099 - DNA, 15 bp, Homo sapiens
acaagctgacttggc

SEQ ID NO: 1142100 - DNA, 12 bp, Homo sapiens
acaagctgagca

SEQ ID NO: 1142101 - DNA, 19 bp, Homo sapiens
acaagctgcaccctcaggc

SEQ ID NO: 1142102 - DNA, 22 bp, Homo sapiens
acaagctgcaccctcaggcagg

SEQ ID NO: 1142103 - DNA, 13 bp, Homo sapiens
acaagctgcactg

SEQ ID NO: 1142104 - DNA, 13 bp, Homo sapiens
acaagctgtgcag

SEQ ID NO: 1142105 - DNA, 19 bp, Homo sapiens
acaaggaaccctcaggcca

SEQ ID NO: 1142106 - DNA, 15 bp, Homo sapiens
acaaggaagccaaag

SEQ ID NO: 1142107 - DNA, 19 bp, Homo sapiens
acaaggaatttccctgtgt

SEQ ID NO: 1142108 - DNA, 17 bp, Homo sapiens
acaaggagagcggagga

SEQ ID NO: 1142109 - DNA, 21 bp, Homo sapiens
acaaggagagcggaggaggaa

SEQ ID NO: 1142110 - DNA, 14 bp, Homo sapiens
acaaggagatttct

SEQ ID NO: 1142111 - DNA, 15 bp, Homo sapiens
acaaggagatttctt

SEQ ID NO: 1142112 - DNA, 15 bp, Homo sapiens
acaaggagctcaccc

SEQ ID NO: 1142113 - DNA, 19 bp, Homo sapiens
acaaggagctcaccctgcc

SEQ ID NO: 1142114 - DNA, 15 bp, Homo sapiens
acaaggaggtagaga

SEQ ID NO: 1142115 - DNA, 17 bp, Homo sapiens
acaaggatcaggctgct

SEQ ID NO: 1142116 - DNA, 13 bp, Homo sapiens
acaaggccccaga

SEQ ID NO: 1142117 - DNA, 16 bp, Homo sapiens
acaaggccccagagac

SEQ ID NO: 1142118 - DNA, 19 bp, Homo sapiens
acaaggccttgcctggcct

SEQ ID NO: 1142119 - DNA, 14 bp, Homo sapiens
acaaggccttgctc

SEQ ID NO: 1142120 - DNA, 19 bp, Homo sapiens
acaaggccttgctcactca

SEQ ID NO: 1142121 - DNA, 13 bp, Homo sapiens
acaaggctgacca

SEQ ID NO: 1142122 - DNA, 14 bp, Homo sapiens
acaaggctggccag

SEQ ID NO: 1142123 - DNA, 18 bp, Homo sapiens
acaagggagagacctcat

SEQ ID NO: 1142124 - DNA, 14 bp, Homo sapiens
acaagggaggcagt

SEQ ID NO: 1142125 - DNA, 15 bp, Homo sapiens
acaagggaggcagtg

SEQ ID NO: 1142126 - DNA, 18 bp, Homo sapiens
acaaggggcaaatgaatt

SEQ ID NO: 1142127 - DNA, 18 bp, Homo sapiens
acaagggtctagggagag

SEQ ID NO: 1142128 - DNA, 19 bp, Homo sapiens
acaagggtctagggagaga

SEQ ID NO: 1142129 - DNA, 15 bp, Homo sapiens
acaaggtaattgttt

SEQ ID NO: 1142130 - DNA, 22 bp, Homo sapiens
acaaggtaggctgcaaaattaa

SEQ ID NO: 1142131 - DNA, 19 bp, Homo sapiens
acaaggttccctctgagaa

SEQ ID NO: 1142132 - DNA, 22 bp, Homo sapiens
acaaggttcttcccttttacat

SEQ ID NO: 1142133 - DNA, 17 bp, Homo sapiens
acaaggttggttgctaa

SEQ ID NO: 1142134 - DNA, 15 bp, Homo sapiens
acaagtaaaactgtg

SEQ ID NO: 1142135 - DNA, 13 bp, Homo sapiens
acaagtaacaaaa

SEQ ID NO: 1142136 - DNA, 21 bp, Homo sapiens
acaagtactggctctttattc

SEQ ID NO: 1142137 - DNA, 15 bp, Homo sapiens
acaagtatataattt

SEQ ID NO: 1142138 - DNA, 17 bp, Homo sapiens
acaagtatataatttac

SEQ ID NO: 1142139 - DNA, 20 bp, Homo sapiens
acaagtatatgtgaaaaaaa

SEQ ID NO: 1142140 - DNA, 20 bp, Homo sapiens
acaagtatttgttaatttag

SEQ ID NO: 1142141 - DNA, 16 bp, Homo sapiens
acaagtcacagctgca

SEQ ID NO: 1142142 - DNA, 19 bp, Homo sapiens
acaagtcacagctgcagct

SEQ ID NO: 1142143 - DNA, 15 bp, Homo sapiens
acaagtcctgtgaat

SEQ ID NO: 1142144 - DNA, 17 bp, Homo sapiens
acaagtcctgtgaattt

SEQ ID NO: 1142145 - DNA, 17 bp, Homo sapiens
acaagtctagtcttctg

SEQ ID NO: 1142146 - DNA, 18 bp, Homo sapiens
acaagtctagtcttctgg

SEQ ID NO: 1142147 - DNA, 21 bp, Homo sapiens
acaagtgaatctttctcctgg

SEQ ID NO: 1142148 - DNA, 15 bp, Homo sapiens
acaagtgaccccagg

SEQ ID NO: 1142149 - DNA, 19 bp, Homo sapiens
acaagtgaccccagggcct

SEQ ID NO: 1142150 - DNA, 20 bp, Homo sapiens
acaagtgaccccagggcctg

SEQ ID NO: 1142151 - DNA, 21 bp, Homo sapiens
acaagtgaccccagggcctgt

SEQ ID NO: 1142152 - DNA, 19 bp, Homo sapiens
acaagtgagacaaaaagca

SEQ ID NO: 1142153 - DNA, 21 bp, Homo sapiens
acaagtgagacaaaaagcact

SEQ ID NO: 1142154 - DNA, 18 bp, Homo sapiens
acaagtgccgcaaattgt

SEQ ID NO: 1142155 - DNA, 14 bp, Homo sapiens
acaagtgctgaaca

SEQ ID NO: 1142156 - DNA, 21 bp, Homo sapiens
acaagtgtaggccaccattat

SEQ ID NO: 1142157 - DNA, 19 bp, Homo sapiens
acaagtgtatatcagaaaa

SEQ ID NO: 1142158 - DNA, 20 bp, Homo sapiens
acaagtgtatatcagaaaag

SEQ ID NO: 1142159 - DNA, 19 bp, Homo sapiens
acaagtgttttagatgtta

SEQ ID NO: 1142160 - DNA, 22 bp, Homo sapiens
acaagtgttttagatgttacta

SEQ ID NO: 1142161 - DNA, 15 bp, Homo sapiens
acaagttaaataaat

SEQ ID NO: 1142162 - DNA, 11 bp, Homo sapiens
acaagttatta

SEQ ID NO: 1142163 - DNA, 17 bp, Homo sapiens
acaagttatttaaatct

SEQ ID NO: 1142164 - DNA, 14 bp, Homo sapiens
acaagttctatttc

SEQ ID NO: 1142165 - DNA, 19 bp, Homo sapiens
acaagttctatttcttgaa

SEQ ID NO: 1142166 - DNA, 20 bp, Homo sapiens
acaagttctggcaagagcag

SEQ ID NO: 1142167 - DNA, 22 bp, Homo sapiens
acaagttctggcaagagcagat

SEQ ID NO: 1142168 - DNA, 12 bp, Homo sapiens
acaagtttcaga

SEQ ID NO: 1142169 - DNA, 17 bp, Homo sapiens
acaagtttcagacaggg

SEQ ID NO: 1142170 - DNA, 12 bp, Homo sapiens
acaagtttgcta

SEQ ID NO: 1142171 - DNA, 17 bp, Homo sapiens
acaagtttgctaaaaga

SEQ ID NO: 1142172 - DNA, 18 bp, Homo sapiens
acaagtttgctaaaagaa

SEQ ID NO: 1142173 - DNA, 21 bp, Homo sapiens
acaagtttgctaaaagaagag

SEQ ID NO: 1142174 - DNA, 14 bp, Homo sapiens
acaagttttaaata

SEQ ID NO: 1142175 - DNA, 16 bp, Homo sapiens
acaagtttttctgtca

SEQ ID NO: 1142176 - DNA, 22 bp, Homo sapiens
acaagtttttctgtcaagaaga

SEQ ID NO: 1142177 - DNA, 16 bp, Homo sapiens
acaataaaaatgttta

SEQ ID NO: 1142178 - DNA, 16 bp, Homo sapiens
acaataaaacattaat

SEQ ID NO: 1142179 - DNA, 16 bp, Homo sapiens
acaataaaagagcttt

SEQ ID NO: 1142180 - DNA, 15 bp, Homo sapiens
acaataaaatattat

SEQ ID NO: 1142181 - DNA, 21 bp, Homo sapiens
acaataaacaggaattttatt

SEQ ID NO: 1142182 - DNA, 23 bp, Homo sapiens
acaataaaccaaacccagccact

SEQ ID NO: 1142183 - DNA, 20 bp, Homo sapiens
acaataaagcagtcctgttc

SEQ ID NO: 1142184 - DNA, 23 bp, Homo sapiens
acaataaagggagaatggtgctg

SEQ ID NO: 1142185 - DNA, 14 bp, Homo sapiens
acaataaagtttat

SEQ ID NO: 1142186 - DNA, 14 bp, Homo sapiens
acaataaataatct

SEQ ID NO: 1142187 - DNA, 11 bp, Homo sapiens
acaataaatgg

SEQ ID NO: 1142188 - DNA, 15 bp, Homo sapiens
acaataaatggccag

SEQ ID NO: 1142189 - DNA, 23 bp, Homo sapiens
acaataaatggccagtgctgctt

SEQ ID NO: 1142190 - DNA, 13 bp, Homo sapiens
acaataaatgtat

SEQ ID NO: 1142191 - DNA, 16 bp, Homo sapiens
acaataaatgtattca

SEQ ID NO: 1142192 - DNA, 18 bp, Homo sapiens
acaataaatgtattcaaa

SEQ ID NO: 1142193 - DNA, 14 bp, Homo sapiens
acaataaatgtgca

SEQ ID NO: 1142194 - DNA, 16 bp, Homo sapiens
acaataaattgctaat

SEQ ID NO: 1142195 - DNA, 23 bp, Homo sapiens
acaataaattgctaatgttgctg

SEQ ID NO: 1142196 - DNA, 13 bp, Homo sapiens
acaataacccagt

SEQ ID NO: 1142197 - DNA, 22 bp, Homo sapiens
acaataactactgtgttcctgg

SEQ ID NO: 1142198 - DNA, 22 bp, Homo sapiens
atcttggggcaagactgcaaac

SEQ ID NO: 1142199 - DNA, 16 bp, Homo sapiens
atcttgggggggtggc

SEQ ID NO: 1142200 - DNA, 20 bp, Homo sapiens
atcttgggggggtggccgct

SEQ ID NO: 1142201 - DNA, 19 bp, Homo sapiens
atcttggtagttctgtgcc

SEQ ID NO: 1142202 - DNA, 16 bp, Homo sapiens
acaataagcaaaaaca

SEQ ID NO: 1142203 - DNA, 18 bp, Homo sapiens
acaataataaatcctcag

SEQ ID NO: 1142204 - DNA, 12 bp, Homo sapiens
acaatacaaatg

SEQ ID NO: 1142205 - DNA, 13 bp, Homo sapiens
acaatacaatgta

SEQ ID NO: 1142206 - DNA, 14 bp, Homo sapiens
acaatacaatgtac

SEQ ID NO: 1142207 - DNA, 18 bp, Homo sapiens
acaatacaatgtacaatt

SEQ ID NO: 1142208 - DNA, 19 bp, Homo sapiens
acaatactccctttaaaga

SEQ ID NO: 1142209 - DNA, 14 bp, Homo sapiens
acaatactgttcta

SEQ ID NO: 1142210 - DNA, 19 bp, Homo sapiens
acaatagccgatatcagaa

SEQ ID NO: 1142211 - DNA, 18 bp, Homo sapiens
acaatagggctaaatgtt

SEQ ID NO: 1142212 - DNA, 18 bp, Homo sapiens
acaataggtctttctctc

SEQ ID NO: 1142213 - DNA, 20 bp, Homo sapiens
acaataggtctttctctcag

SEQ ID NO: 1142214 - DNA, 15 bp, Homo sapiens
acaatagtcagaaaa

SEQ ID NO: 1142215 - DNA, 16 bp, Homo sapiens
acaatagtcagaaaac

SEQ ID NO: 1142216 - DNA, 18 bp, Homo sapiens
acaatataaaactgtact

SEQ ID NO: 1142217 - DNA, 21 bp, Homo sapiens
acaatataaccacaaagcaca

SEQ ID NO: 1142218 - DNA, 14 bp, Homo sapiens
acaatatgtgccaa

SEQ ID NO: 1142219 - DNA, 14 bp, Homo sapiens
acaatattgtttct

SEQ ID NO: 1142220 - DNA, 15 bp, Homo sapiens
acaatattgtttcta

SEQ ID NO: 1142221 - DNA, 14 bp, Homo sapiens
acaatcaaatctcc

SEQ ID NO: 1142222 - DNA, 17 bp, Homo sapiens
acaatcaaatctcctgc

SEQ ID NO: 1142223 - DNA, 20 bp, Homo sapiens
acaatcactaaactttattt

SEQ ID NO: 1142224 - DNA, 14 bp, Homo sapiens
acaatcactattct

SEQ ID NO: 1142225 - DNA, 16 bp, Homo sapiens
acaatcactattctta

SEQ ID NO: 1142226 - DNA, 19 bp, Homo sapiens
acaatcagccacattctag

SEQ ID NO: 1142227 - DNA, 19 bp, Homo sapiens
acaatcagtcccctcccat

SEQ ID NO: 1142228 - DNA, 20 bp, Homo sapiens
acaatcagtcccctcccatc

SEQ ID NO: 1142229 - DNA, 22 bp, Homo sapiens
acaatcatgaacagctctgaga

SEQ ID NO: 1142230 - DNA, 13 bp, Homo sapiens
acaatcattgctg

SEQ ID NO: 1142231 - DNA, 21 bp, Homo sapiens
acaatcattgctgaaaatggt

SEQ ID NO: 1142232 - DNA, 22 bp, Homo sapiens
acaatcattgctgaaaatggta

SEQ ID NO: 1142233 - DNA, 18 bp, Homo sapiens
acaatcatttgctttttg

SEQ ID NO: 1142234 - DNA, 22 bp, Homo sapiens
acaatccatgtgattaatgttt

SEQ ID NO: 1142235 - DNA, 17 bp, Homo sapiens
acaatcgatggccttgc

SEQ ID NO: 1142236 - DNA, 17 bp, Homo sapiens
acaatctatggcttatt

SEQ ID NO: 1142237 - DNA, 12 bp, Homo sapiens
acaatctcaaat

SEQ ID NO: 1142238 - DNA, 21 bp, Homo sapiens
acaatcttattccgagcattc

SEQ ID NO: 1142239 - DNA, 13 bp, Homo sapiens
acaatctttcatg

SEQ ID NO: 1142240 - DNA, 12 bp, Homo sapiens
acaatgaaattg

SEQ ID NO: 1142241 - DNA, 24 bp, Homo sapiens
acaatgaacatccctttttcaatg

SEQ ID NO: 1142242 - DNA, 14 bp, Homo sapiens
acaatgaagggaaa

SEQ ID NO: 1142243 - DNA, 18 bp, Homo sapiens
acaatgaagggaaattgt

SEQ ID NO: 1142244 - DNA, 21 bp, Homo sapiens
acaatgaagggaaattgttta

SEQ ID NO: 1142245 - DNA, 12 bp, Homo sapiens
acaatgaatgta

SEQ ID NO: 1142246 - DNA, 21 bp, Homo sapiens
acaatgaatgtatattttgtg

SEQ ID NO: 1142247 - DNA, 15 bp, Homo sapiens
acaatgaatgtcttt

SEQ ID NO: 1142248 - DNA, 21 bp, Homo sapiens
acaatgacatacgcttttaat

SEQ ID NO: 1142249 - DNA, 22 bp, Homo sapiens
acaatgacatccagaaagctga

SEQ ID NO: 1142250 - DNA, 21 bp, Homo sapiens
acaatgactgctttgtttgga

SEQ ID NO: 1142251 - DNA, 22 bp, Homo sapiens
acaatgacttactgtacatgaa

SEQ ID NO: 1142252 - DNA, 14 bp, Homo sapiens
acaatgacttttaa

SEQ ID NO: 1142253 - DNA, 17 bp, Homo sapiens
acaatgagtttgggcat

SEQ ID NO: 1142254 - DNA, 22 bp, Homo sapiens
acaatgcagttctgagcaccgt

SEQ ID NO: 1142255 - DNA, 14 bp, Homo sapiens
acaatgccctgctg

SEQ ID NO: 1142256 - DNA, 21 bp, Homo sapiens
acaatgccctgctggcctgtc

SEQ ID NO: 1142257 - DNA, 16 bp, Homo sapiens
acaatgcctattgtaa

SEQ ID NO: 1142258 - DNA, 21 bp, Homo sapiens
acaatgctgtgccctaaagtg

SEQ ID NO: 1142259 - DNA, 12 bp, Homo sapiens
acaatggcacct

SEQ ID NO: 1142260 - DNA, 16 bp, Homo sapiens
acaatggcacctctgc

SEQ ID NO: 1142261 - DNA, 23 bp, Homo sapiens
acaatggcacctctgcccttccc

SEQ ID NO: 1142262 - DNA, 21 bp, Homo sapiens
acaatggctaattcccagagt

SEQ ID NO: 1142263 - DNA, 15 bp, Homo sapiens
acaatgggaggctgt

SEQ ID NO: 1142264 - DNA, 17 bp, Homo sapiens
acaatggggtgggccca

SEQ ID NO: 1142265 - DNA, 22 bp, Homo sapiens
acaatgtaaaccacatgaacta

SEQ ID NO: 1142266 - DNA, 12 bp, Homo sapiens
acaatgtacaat

SEQ ID NO: 1142267 - DNA, 14 bp, Homo sapiens
acaatgtacaatta

SEQ ID NO: 1142268 - DNA, 17 bp, Homo sapiens
acaatgtacaattatgt

SEQ ID NO: 1142269 - DNA, 14 bp, Homo sapiens
acaatgtacacact

SEQ ID NO: 1142270 - DNA, 16 bp, Homo sapiens
acaatgtataaagatt

SEQ ID NO: 1142271 - DNA, 16 bp, Homo sapiens
acaatgtatgtacaat

SEQ ID NO: 1142272 - DNA, 21 bp, Homo sapiens
acaatgtatgtacaatacaat

SEQ ID NO: 1142273 - DNA, 21 bp, Homo sapiens
acaatgtcgagtatattatta

SEQ ID NO: 1142274 - DNA, 22 bp, Homo sapiens
acaatgtcgagtatattattat

SEQ ID NO: 1142275 - DNA, 12 bp, Homo sapiens
acaatgtgaact

SEQ ID NO: 1142276 - DNA, 22 bp, Homo sapiens
acaatgtgaactttattaaata

SEQ ID NO: 1142277 - DNA, 21 bp, Homo sapiens
acaatgtggccgaggactttg

SEQ ID NO: 1142278 - DNA, 23 bp, Homo sapiens
acaatgttatcaaccaactgcac

SEQ ID NO: 1142279 - DNA, 21 bp, Homo sapiens
acaatgttgctagttttttgc

SEQ ID NO: 1142280 - DNA, 15 bp, Homo sapiens
acaatgttgtccaac

SEQ ID NO: 1142281 - DNA, 20 bp, Homo sapiens
acaatgttgtccaacaataa

SEQ ID NO: 1142282 - DNA, 17 bp, Homo sapiens
acaatgtttcttcattt

SEQ ID NO: 1142283 - DNA, 17 bp, Homo sapiens
acaatgtttgatgtccc

SEQ ID NO: 1142284 - DNA, 23 bp, Homo sapiens
acaatgtttgatgtccccaaagt

SEQ ID NO: 1142285 - DNA, 18 bp, Homo sapiens
acaattaaaccgcatgtg

SEQ ID NO: 1142286 - DNA, 17 bp, Homo sapiens
acaattaatagtttgtc

SEQ ID NO: 1142287 - DNA, 14 bp, Homo sapiens
acaattactaaatt

SEQ ID NO: 1142288 - DNA, 18 bp, Homo sapiens
acaattactaaattgtat

SEQ ID NO: 1142289 - DNA, 16 bp, Homo sapiens
acaattactcaggttt

SEQ ID NO: 1142290 - DNA, 15 bp, Homo sapiens
acaattagcagaatg

SEQ ID NO: 1142291 - DNA, 18 bp, Homo sapiens
acaattatatcagtcctc

SEQ ID NO: 1142292 - DNA, 15 bp, Homo sapiens
acaattatgtctctt

SEQ ID NO: 1142293 - DNA, 18 bp, Homo sapiens
acaattatgtgcaaaggt

SEQ ID NO: 1142294 - DNA, 21 bp, Homo sapiens
acaattattccaaaccaaatt

SEQ ID NO: 1142295 - DNA, 16 bp, Homo sapiens
acaattcagtaacaaa

SEQ ID NO: 1142296 - DNA, 16 bp, Homo sapiens
acaattcattcaccag

SEQ ID NO: 1142297 - DNA, 18 bp, Homo sapiens
acaattccaaaggaatct

SEQ ID NO: 1142298 - DNA, 16 bp, Homo sapiens
acaattccctgctgtc

SEQ ID NO: 1142299 - DNA, 13 bp, Homo sapiens
acaattctgcatg

SEQ ID NO: 1142300 - DNA, 15 bp, Homo sapiens
acaattctgcatgta

SEQ ID NO: 1142301 - DNA, 11 bp, Homo sapiens
acaattctgtc

SEQ ID NO: 1142302 - DNA, 14 bp, Homo sapiens
acaattctgtccct

SEQ ID NO: 1142303 - DNA, 17 bp, Homo sapiens
acaattctgtccctgtc

SEQ ID NO: 1142304 - DNA, 12 bp, Homo sapiens
acaattgaaatg

SEQ ID NO: 1142305 - DNA, 13 bp, Homo sapiens
acaattgaagtaa

SEQ ID NO: 1142306 - DNA, 16 bp, Homo sapiens
acaattgaagtaaact

SEQ ID NO: 1142307 - DNA, 19 bp, Homo sapiens
acaattgagggaagtttga

SEQ ID NO: 1142308 - DNA, 18 bp, Homo sapiens
acaattgatacttcaggt

SEQ ID NO: 1142309 - DNA, 17 bp, Homo sapiens
acaattgatctttttta

SEQ ID NO: 1142310 - DNA, 22 bp, Homo sapiens
acaattggtaaaactcactgtg

SEQ ID NO: 1142311 - DNA, 23 bp, Homo sapiens
acaattggtaaaactcactgtga

SEQ ID NO: 1142312 - DNA, 15 bp, Homo sapiens
acaattgtcttaaaa

SEQ ID NO: 1142313 - DNA, 16 bp, Homo sapiens
acaattgtgtagcctt

SEQ ID NO: 1142314 - DNA, 23 bp, Homo sapiens
acaattgtgtagcctttttgtat

SEQ ID NO: 1142315 - DNA, 12 bp, Homo sapiens
acaatttaaaat

SEQ ID NO: 1142316 - DNA, 19 bp, Homo sapiens
acaatttacaaagtgtgta

SEQ ID NO: 1142317 - DNA, 20 bp, Homo sapiens
acaatttacaaagtgtgtat

SEQ ID NO: 1142318 - DNA, 20 bp, Homo sapiens
acaatttattttattttagc

SEQ ID NO: 1142319 - DNA, 16 bp, Homo sapiens
acaatttcatcctcct

SEQ ID NO: 1142320 - DNA, 23 bp, Homo sapiens
acaatttccatatagtctattca

SEQ ID NO: 1142321 - DNA, 23 bp, Homo sapiens
acaatttcctttatatttagtga

SEQ ID NO: 1142322 - DNA, 16 bp, Homo sapiens
acaatttgatacataa

SEQ ID NO: 1142323 - DNA, 17 bp, Homo sapiens
acaatttgatacataat

SEQ ID NO: 1142324 - DNA, 22 bp, Homo sapiens
atgactggagtaaaccatgtat

SEQ ID NO: 1142325 - DNA, 21 bp, Homo sapiens
atgactggctgtctgcctgta

SEQ ID NO: 1142326 - DNA, 18 bp, Homo sapiens
atgactggggtgggaggt

SEQ ID NO: 1142327 - DNA, 17 bp, Homo sapiens
atgactgtgaactgggc

SEQ ID NO: 1142328 - DNA, 18 bp, Homo sapiens
atgactgtgaccaccttc

SEQ ID NO: 1142329 - DNA, 20 bp, Homo sapiens
atgactgtgaccaccttctg

SEQ ID NO: 1142330 - DNA, 18 bp, Homo sapiens
atgactgtttttgtagtg

SEQ ID NO: 1142331 - DNA, 17 bp, Homo sapiens
atgacttactgtacatg

SEQ ID NO: 1142332 - DNA, 19 bp, Homo sapiens
atgacttattatgcataaa

SEQ ID NO: 1142333 - DNA, 14 bp, Homo sapiens
atgacttatttctg

SEQ ID NO: 1142334 - DNA, 14 bp, Homo sapiens
acacagggctcaca

SEQ ID NO: 1142335 - DNA, 19 bp, Homo sapiens
acacagggctcacagggca

SEQ ID NO: 1142336 - DNA, 19 bp, Homo sapiens
acacagggctctttgatgg

SEQ ID NO: 1142337 - DNA, 17 bp, Homo sapiens
acacaggggaggtgata

SEQ ID NO: 1142338 - DNA, 20 bp, Homo sapiens
acacaggggccctgtacagt

SEQ ID NO: 1142339 - DNA, 21 bp, Homo sapiens
acacaggggccctgtacagtg

SEQ ID NO: 1142340 - DNA, 20 bp, Homo sapiens
acacagggtgacggtgacaa

SEQ ID NO: 1142341 - DNA, 16 bp, Homo sapiens
acacaggtcagggctc

SEQ ID NO: 1142342 - DNA, 17 bp, Homo sapiens
acacaggtcagggctca

SEQ ID NO: 1142343 - DNA, 21 bp, Homo sapiens
acacaggtcagggctcagagt

SEQ ID NO: 1142344 - DNA, 19 bp, Homo sapiens
acacaggtctcattgcttc

SEQ ID NO: 1142345 - DNA, 16 bp, Homo sapiens
acacaggtctttccta

SEQ ID NO: 1142346 - DNA, 16 bp, Homo sapiens
acacagtaattgtgac

SEQ ID NO: 1142347 - DNA, 20 bp, Homo sapiens
acacagtactttattgtaca

SEQ ID NO: 1142348 - DNA, 15 bp, Homo sapiens
acacagtcaaaataa

SEQ ID NO: 1142349 - DNA, 19 bp, Homo sapiens
acacagtcaaaataattct

SEQ ID NO: 1142350 - DNA, 19 bp, Homo sapiens
acacagtgatgaatgtact

SEQ ID NO: 1142351 - DNA, 20 bp, Homo sapiens
acacagtgttagtgctggtc

SEQ ID NO: 1142352 - DNA, 13 bp, Homo sapiens
acacagtgtttca

SEQ ID NO: 1142353 - DNA, 20 bp, Homo sapiens
acacagtgtttcaattctgt

SEQ ID NO: 1142354 - DNA, 14 bp, Homo sapiens
acacagttaaataa

SEQ ID NO: 1142355 - DNA, 18 bp, Homo sapiens
acacagttacacttgtgc

SEQ ID NO: 1142356 - DNA, 16 bp, Homo sapiens
acacagtttaaaaaat

SEQ ID NO: 1142357 - DNA, 18 bp, Homo sapiens
acacagtttaaaaaatca

SEQ ID NO: 1142358 - DNA, 14 bp, Homo sapiens
acacagttttgaaa

SEQ ID NO: 1142359 - DNA, 18 bp, Homo sapiens
acacatacatacacatac

SEQ ID NO: 1142360 - DNA, 19 bp, Homo sapiens
acacatactcatttttcat

SEQ ID NO: 1142361 - DNA, 22 bp, Homo sapiens
acacatactcatttttcatgat

SEQ ID NO: 1142362 - DNA, 19 bp, Homo sapiens
acacatagattcacctgta

SEQ ID NO: 1142363 - DNA, 22 bp, Homo sapiens
acacatagattcacctgtaaaa

SEQ ID NO: 1142364 - DNA, 22 bp, Homo sapiens
acacatagcaggggcaccttcc

SEQ ID NO: 1142365 - DNA, 21 bp, Homo sapiens
acacatagcgccgtgctgtaa

SEQ ID NO: 1142366 - DNA, 15 bp, Homo sapiens
acacatatacacgaa

SEQ ID NO: 1142367 - DNA, 14 bp, Homo sapiens
acacatatacatat

SEQ ID NO: 1142368 - DNA, 15 bp, Homo sapiens
acacatatacatata

SEQ ID NO: 1142369 - DNA, 21 bp, Homo sapiens
acacatatatataacaaataa

SEQ ID NO: 1142370 - DNA, 23 bp, Homo sapiens
acacatatatataacaaataata

SEQ ID NO: 1142371 - DNA, 16 bp, Homo sapiens
acacatattcaaattc

SEQ ID NO: 1142372 - DNA, 14 bp, Homo sapiens
acacatcaaatgcc

SEQ ID NO: 1142373 - DNA, 15 bp, Homo sapiens
acacatcaaatgccc

SEQ ID NO: 1142374 - DNA, 18 bp, Homo sapiens
acacatcaccaggtgcat

SEQ ID NO: 1142375 - DNA, 24 bp, Homo sapiens
acacatcatcatcgaagtcttccc

SEQ ID NO: 1142376 - DNA, 18 bp, Homo sapiens
acacatccagctgcccct

SEQ ID NO: 1142377 - DNA, 18 bp, Homo sapiens
acacatcgttgccgcagc

SEQ ID NO: 1142378 - DNA, 21 bp, Homo sapiens
acacatctattgcagagactc

SEQ ID NO: 1142379 - DNA, 12 bp, Homo sapiens
acacatctcctc

SEQ ID NO: 1142380 - DNA, 14 bp, Homo sapiens
acacatctcctcca

SEQ ID NO: 1142381 - DNA, 13 bp, Homo sapiens
acacatctggccc

SEQ ID NO: 1142382 - DNA, 18 bp, Homo sapiens
acacatctgggtgccctg

SEQ ID NO: 1142383 - DNA, 15 bp, Homo sapiens
acacatcttattgaa

SEQ ID NO: 1142384 - DNA, 14 bp, Homo sapiens
acacatcttcccta

SEQ ID NO: 1142385 - DNA, 13 bp, Homo sapiens
acacatctttcct

SEQ ID NO: 1142386 - DNA, 22 bp, Homo sapiens
acacatgacgccagataaaatg

SEQ ID NO: 1142387 - DNA, 19 bp, Homo sapiens
acacatgcaaggtcatttt

SEQ ID NO: 1142388 - DNA, 21 bp, Homo sapiens
acacatgcaaggtcatttttt

SEQ ID NO: 1142389 - DNA, 15 bp, Homo sapiens
acacatgcccctccc

SEQ ID NO: 1142390 - DNA, 16 bp, Homo sapiens
acacatgcccctcccc

SEQ ID NO: 1142391 - DNA, 16 bp, Homo sapiens
acacatgctaggatgc

SEQ ID NO: 1142392 - DNA, 16 bp, Homo sapiens
acacatgctgaggttt

SEQ ID NO: 1142393 - DNA, 22 bp, Homo sapiens
acacatgctgaggttttgaata

SEQ ID NO: 1142394 - DNA, 20 bp, Homo sapiens
acacatgtgctgatgtttac

SEQ ID NO: 1142395 - DNA, 14 bp, Homo sapiens
acacattaaatgtg

SEQ ID NO: 1142396 - DNA, 14 bp, Homo sapiens
acacattaatgaat

SEQ ID NO: 1142397 - DNA, 22 bp, Homo sapiens
acacattaatgataaactcaga

SEQ ID NO: 1142398 - DNA, 14 bp, Homo sapiens
acacattacaaagt

SEQ ID NO: 1142399 - DNA, 23 bp, Homo sapiens
acacattacaaagttaaaattgt

SEQ ID NO: 1142400 - DNA, 23 bp, Homo sapiens
acacattatcgggagcagtgtct

SEQ ID NO: 1142401 - DNA, 15 bp, Homo sapiens
acacattccagggct

SEQ ID NO: 1142402 - DNA, 16 bp, Homo sapiens
acacattctttataaa

SEQ ID NO: 1142403 - DNA, 20 bp, Homo sapiens
acacattgcagcttcaactt

SEQ ID NO: 1142404 - DNA, 15 bp, Homo sapiens
acacattgccttctg

SEQ ID NO: 1142405 - DNA, 20 bp, Homo sapiens
acacattggaatgccttgga

SEQ ID NO: 1142406 - DNA, 19 bp, Homo sapiens
acacattggaattgatgtc

SEQ ID NO: 1142407 - DNA, 14 bp, Homo sapiens
acacattgtgcttg

SEQ ID NO: 1142408 - DNA, 17 bp, Homo sapiens
acacattgtgcttggcc

SEQ ID NO: 1142409 - DNA, 15 bp, Homo sapiens
acacatttaaaacat

SEQ ID NO: 1142410 - DNA, 16 bp, Homo sapiens
acacatttacactaga

SEQ ID NO: 1142411 - DNA, 13 bp, Homo sapiens
acacatttaccaa

SEQ ID NO: 1142412 - DNA, 16 bp, Homo sapiens
acacatttaccaaatt

SEQ ID NO: 1142413 - DNA, 23 bp, Homo sapiens
acacatttgggatgttccttttt

SEQ ID NO: 1142414 - DNA, 12 bp, Homo sapiens
acacattttatg

SEQ ID NO: 1142415 - DNA, 13 bp, Homo sapiens
acacattttattt

SEQ ID NO: 1142416 - DNA, 22 bp, Homo sapiens
acacattttattttattatgca

SEQ ID NO: 1142417 - DNA, 21 bp, Homo sapiens
acacatttttaaagtctaaac

SEQ ID NO: 1142418 - DNA, 17 bp, Homo sapiens
acaccaacataaaaatg

SEQ ID NO: 1142419 - DNA, 16 bp, Homo sapiens
acaccaagcacagcag

SEQ ID NO: 1142420 - DNA, 18 bp, Homo sapiens
acaccaagcacagcagcc

SEQ ID NO: 1142421 - DNA, 13 bp, Homo sapiens
acaccaagcagca

SEQ ID NO: 1142422 - DNA, 16 bp, Homo sapiens
acaccaagcagcaaca

SEQ ID NO: 1142423 - DNA, 12 bp, Homo sapiens
acaccaaggaag

SEQ ID NO: 1142424 - DNA, 23 bp, Homo sapiens
acaccaataaatgtttgttattt

SEQ ID NO: 1142425 - DNA, 14 bp, Homo sapiens
acaccaatcagaga

SEQ ID NO: 1142426 - DNA, 17 bp, Homo sapiens
acaccaatcagagagcc

SEQ ID NO: 1142427 - DNA, 19 bp, Homo sapiens
acaccaatcagagagccta

SEQ ID NO: 1142428 - DNA, 21 bp, Homo sapiens
acaccaatcagagagcctaga

SEQ ID NO: 1142429 - DNA, 15 bp, Homo sapiens
acaccacagacacac

SEQ ID NO: 1142430 - DNA, 22 bp, Homo sapiens
acaccaccgaatatattactga

SEQ ID NO: 1142431 - DNA, 15 bp, Homo sapiens
acaccacctggagtg

SEQ ID NO: 1142432 - DNA, 19 bp, Homo sapiens
acaccactaaccatcccca

SEQ ID NO: 1142433 - DNA, 19 bp, Homo sapiens
acaccactgcaaaatgtct

SEQ ID NO: 1142434 - DNA, 11 bp, Homo sapiens
acaccactgcc

SEQ ID NO: 1142435 - DNA, 13 bp, Homo sapiens
acaccactgccct

SEQ ID NO: 1142436 - DNA, 12 bp, Homo sapiens
acaccagagctg

SEQ ID NO: 1142437 - DNA, 13 bp, Homo sapiens
acaccagagctgc

SEQ ID NO: 1142438 - DNA, 17 bp, Homo sapiens
acaccagagctgccgac

SEQ ID NO: 1142439 - DNA, 14 bp, Homo sapiens
acaccagcattcct

SEQ ID NO: 1142440 - DNA, 19 bp, Homo sapiens
acaccagcattccttttga

SEQ ID NO: 1142441 - DNA, 12 bp, Homo sapiens
acaccaggctgt

SEQ ID NO: 1142442 - DNA, 22 bp, Homo sapiens
acaccagttttgagtgtactgt

SEQ ID NO: 1142443 - DNA, 18 bp, Homo sapiens
acaccatcttttattctt

SEQ ID NO: 1142444 - DNA, 15 bp, Homo sapiens
acaccatgtgcaata

SEQ ID NO: 1142445 - DNA, 16 bp, Homo sapiens
acaccatgtgcaataa

SEQ ID NO: 1142446 - DNA, 19 bp, Homo sapiens
atgatgtctttttattaaa

SEQ ID NO: 1142447 - DNA, 23 bp, Homo sapiens
atgatgtggtgcctgaggtctgt

SEQ ID NO: 1142448 - DNA, 19 bp, Homo sapiens
atgatgtgtacccaaacgt

SEQ ID NO: 1142449 - DNA, 17 bp, Homo sapiens
atgatgtgtgagtgtaa

SEQ ID NO: 1142450 - DNA, 14 bp, Homo sapiens
atgatgtgttgtga

SEQ ID NO: 1142451 - DNA, 20 bp, Homo sapiens
atgatgttgataatttcagg

SEQ ID NO: 1142452 - DNA, 14 bp, Homo sapiens
atgatgtttgccca

SEQ ID NO: 1142453 - DNA, 14 bp, Homo sapiens
atgatgttttgata

SEQ ID NO: 1142454 - DNA, 15 bp, Homo sapiens
atgatgttttgatat

SEQ ID NO: 1142455 - DNA, 20 bp, Homo sapiens
atgattaaccacttcagctg

SEQ ID NO: 1142456 - DNA, 13 bp, Homo sapiens
atgattaatcaaa

SEQ ID NO: 1142457 - DNA, 15 bp, Homo sapiens
atgattaatcaaagg

SEQ ID NO: 1142458 - DNA, 14 bp, Homo sapiens
atgattactggcct

SEQ ID NO: 1142459 - DNA, 16 bp, Homo sapiens
atgattactttaaaat

SEQ ID NO: 1142460 - DNA, 20 bp, Homo sapiens
atgattcaattttttaatgt

SEQ ID NO: 1142461 - DNA, 15 bp, Homo sapiens
atgattcatgttata

SEQ ID NO: 1142462 - DNA, 18 bp, Homo sapiens
atgattcctggacatcac

SEQ ID NO: 1142463 - DNA, 22 bp, Homo sapiens
atgattccttgatggagatatt

SEQ ID NO: 1142464 - DNA, 23 bp, Homo sapiens
atgattcgcccaaagccagacag

SEQ ID NO: 1142465 - DNA, 18 bp, Homo sapiens
atgattctagtacataat

SEQ ID NO: 1142466 - DNA, 19 bp, Homo sapiens
atgattctagtacataatt

SEQ ID NO: 1142467 - DNA, 23 bp, Homo sapiens
acactagttttgtgccagccgtg

SEQ ID NO: 1142468 - DNA, 15 bp, Homo sapiens
acactatgataaagt

SEQ ID NO: 1142469 - DNA, 19 bp, Homo sapiens
acactatggtatttgagtg

SEQ ID NO: 1142470 - DNA, 15 bp, Homo sapiens
acactcaaggacagg

SEQ ID NO: 1142471 - DNA, 16 bp, Homo sapiens
acactcaaggacagga

SEQ ID NO: 1142472 - DNA, 14 bp, Homo sapiens
acactcaataaatt

SEQ ID NO: 1142473 - DNA, 14 bp, Homo sapiens
acactcaccagtgg

SEQ ID NO: 1142474 - DNA, 19 bp, Homo sapiens
acactcaccagtggccttt

SEQ ID NO: 1142475 - DNA, 16 bp, Homo sapiens
acactcagcacaaggc

SEQ ID NO: 1142476 - DNA, 16 bp, Homo sapiens
acactcagggcagctg

SEQ ID NO: 1142477 - DNA, 17 bp, Homo sapiens
acactcagtccactgtt

SEQ ID NO: 1142478 - DNA, 19 bp, Homo sapiens
acactcatgcacacagata

SEQ ID NO: 1142479 - DNA, 14 bp, Homo sapiens
acactccccacggg

SEQ ID NO: 1142480 - DNA, 14 bp, Homo sapiens
acactccctctcct

SEQ ID NO: 1142481 - DNA, 14 bp, Homo sapiens
acactcccttgggc

SEQ ID NO: 1142482 - DNA, 16 bp, Homo sapiens
acactcgcccgcccac

SEQ ID NO: 1142483 - DNA, 24 bp, Homo sapiens
acactcgcccgcccactgtcctgg

SEQ ID NO: 1142484 - DNA, 17 bp, Homo sapiens
acactctaactgtatat

SEQ ID NO: 1142485 - DNA, 19 bp, Homo sapiens
acactctagtgacttcctg

SEQ ID NO: 1142486 - DNA, 15 bp, Homo sapiens
acactctatatgtag

SEQ ID NO: 1142487 - DNA, 18 bp, Homo sapiens
acactctatatgtagtgc

SEQ ID NO: 1142488 - DNA, 15 bp, Homo sapiens
acactctctgcagcc

SEQ ID NO: 1142489 - DNA, 21 bp, Homo sapiens
acactctctgcagcccagcct

SEQ ID NO: 1142490 - DNA, 13 bp, Homo sapiens
acactctgctctg

SEQ ID NO: 1142491 - DNA, 13 bp, Homo sapiens
acactctgtaatt

SEQ ID NO: 1142492 - DNA, 23 bp, Homo sapiens
acactctgtattgaaaatggctt

SEQ ID NO: 1142493 - DNA, 13 bp, Homo sapiens
acactcttcttga

SEQ ID NO: 1142494 - DNA, 12 bp, Homo sapiens
acactctttgta

SEQ ID NO: 1142495 - DNA, 20 bp, Homo sapiens
acactgaaaaaatactacct

SEQ ID NO: 1142496 - DNA, 12 bp, Homo sapiens
acactgaaaatg

SEQ ID NO: 1142497 - DNA, 14 bp, Homo sapiens
acactgaaagtttt

SEQ ID NO: 1142498 - DNA, 23 bp, Homo sapiens
acactgaaagttttgtaaaagaa

SEQ ID NO: 1142499 - DNA, 12 bp, Homo sapiens
acactgaaataa

SEQ ID NO: 1142500 - DNA, 11 bp, Homo sapiens
acactgagccc

SEQ ID NO: 1142501 - DNA, 14 bp, Homo sapiens
acactgagccccac

SEQ ID NO: 1142502 - DNA, 21 bp, Homo sapiens
acactgagccccacctctcca

SEQ ID NO: 1142503 - DNA, 20 bp, Homo sapiens
acactgagtcagaattcttc

SEQ ID NO: 1142504 - DNA, 19 bp, Homo sapiens
acactgagttctatcagtt

SEQ ID NO: 1142505 - DNA, 20 bp, Homo sapiens
acactgagttctatcagtta

SEQ ID NO: 1142506 - DNA, 15 bp, Homo sapiens
acactgataaaagtt

SEQ ID NO: 1142507 - DNA, 19 bp, Homo sapiens
acactgatgagtttcactg

SEQ ID NO: 1142508 - DNA, 22 bp, Homo sapiens
acactgatgcttagatgttcca

SEQ ID NO: 1142509 - DNA, 13 bp, Homo sapiens
acactgatgggct

SEQ ID NO: 1142510 - DNA, 14 bp, Homo sapiens
acactgatgggctg

SEQ ID NO: 1142511 - DNA, 13 bp, Homo sapiens
acactgcactttg

SEQ ID NO: 1142512 - DNA, 23 bp, Homo sapiens
acactgcactttgtttagaaaaa

SEQ ID NO: 1142513 - DNA, 14 bp, Homo sapiens
acactgcagacttg

SEQ ID NO: 1142514 - DNA, 15 bp, Homo sapiens
acactgcatgtttgt

SEQ ID NO: 1142515 - DNA, 14 bp, Homo sapiens
acactgccaccttg

SEQ ID NO: 1142516 - DNA, 19 bp, Homo sapiens
acactgccgacatcagcat

SEQ ID NO: 1142517 - DNA, 15 bp, Homo sapiens
acactgcctctgagt

SEQ ID NO: 1142518 - DNA, 21 bp, Homo sapiens
acactgccttagcctcttgga

SEQ ID NO: 1142519 - DNA, 23 bp, Homo sapiens
acactgcgccccgcctgacctgg

SEQ ID NO: 1142520 - DNA, 23 bp, Homo sapiens
acactgctaggtgggccagcccc

SEQ ID NO: 1142521 - DNA, 20 bp, Homo sapiens
acactgctctaacagccctc

SEQ ID NO: 1142522 - DNA, 15 bp, Homo sapiens
acactgctgcaccag

SEQ ID NO: 1142523 - DNA, 14 bp, Homo sapiens
acactgctgtccac

SEQ ID NO: 1142524 - DNA, 19 bp, Homo sapiens
acactgctgtcctctcccc

SEQ ID NO: 1142525 - DNA, 17 bp, Homo sapiens
acactggaatataaaac

SEQ ID NO: 1142526 - DNA, 21 bp, Homo sapiens
acactggaatataaaacagtc

SEQ ID NO: 1142527 - DNA, 18 bp, Homo sapiens
acactggacatggcccat

SEQ ID NO: 1142528 - DNA, 18 bp, Homo sapiens
acactggaccccactggc

SEQ ID NO: 1142529 - DNA, 15 bp, Homo sapiens
acactggacctgggg

SEQ ID NO: 1142530 - DNA, 17 bp, Homo sapiens
acactggacctgggggt

SEQ ID NO: 1142531 - DNA, 20 bp, Homo sapiens
acactggagaagaatatcaa

SEQ ID NO: 1142532 - DNA, 14 bp, Homo sapiens
acactggatatgtt

SEQ ID NO: 1142533 - DNA, 16 bp, Homo sapiens
acactggccccacagg

SEQ ID NO: 1142534 - DNA, 12 bp, Homo sapiens
acactggcccct

SEQ ID NO: 1142535 - DNA, 17 bp, Homo sapiens
acactggctaaagataa

SEQ ID NO: 1142536 - DNA, 22 bp, Homo sapiens
acactgggcagcaaggctgctg

SEQ ID NO: 1142537 - DNA, 18 bp, Homo sapiens
acactgggtggtggcctg

SEQ ID NO: 1142538 - DNA, 11 bp, Homo sapiens
acactggtcta

SEQ ID NO: 1142539 - DNA, 15 bp, Homo sapiens
acactggtctgctgt

SEQ ID NO: 1142540 - DNA, 14 bp, Homo sapiens
acactggtgactgc

SEQ ID NO: 1142541 - DNA, 20 bp, Homo sapiens
acactggtgggcagctgagg

SEQ ID NO: 1142542 - DNA, 21 bp, Homo sapiens
acactggtgggcagctgagga

SEQ ID NO: 1142543 - DNA, 21 bp, Homo sapiens
acactggttctcaatgaaaaa

SEQ ID NO: 1142544 - DNA, 22 bp, Homo sapiens
acactggtttggtcagttacaa

SEQ ID NO: 1142545 - DNA, 13 bp, Homo sapiens
acactgtagtttt

SEQ ID NO: 1142546 - DNA, 18 bp, Homo sapiens
acactgtagtttttgaaa

SEQ ID NO: 1142547 - DNA, 21 bp, Homo sapiens
acactgtatttgtatctctga

SEQ ID NO: 1142548 - DNA, 21 bp, Homo sapiens
acactgtcatgcttcatcatt

SEQ ID NO: 1142549 - DNA, 13 bp, Homo sapiens
acactgtcttccc

SEQ ID NO: 1142550 - DNA, 19 bp, Homo sapiens
acactgtgaactcaatctc

SEQ ID NO: 1142551 - DNA, 12 bp, Homo sapiens
acactgtgaagg

SEQ ID NO: 1142552 - DNA, 21 bp, Homo sapiens
acactgtgaagggtacagatt

SEQ ID NO: 1142553 - DNA, 16 bp, Homo sapiens
acactgtgaccaggct

SEQ ID NO: 1142554 - DNA, 17 bp, Homo sapiens
acactgtgagagttgtc

SEQ ID NO: 1142555 - DNA, 20 bp, Homo sapiens
acactgtgagagttgtctct

SEQ ID NO: 1142556 - DNA, 22 bp, Homo sapiens
acactgtgcccagcccggacct

SEQ ID NO: 1142557 - DNA, 15 bp, Homo sapiens
acactgtgccctggt

SEQ ID NO: 1142558 - DNA, 17 bp, Homo sapiens
acactgtgccctggtgg

SEQ ID NO: 1142559 - DNA, 23 bp, Homo sapiens
acactgtggaactaataaataca

SEQ ID NO: 1142560 - DNA, 18 bp, Homo sapiens
acactgtgtactgcagtt

SEQ ID NO: 1142561 - DNA, 19 bp, Homo sapiens
acactgtgtcctggtgctc

SEQ ID NO: 1142562 - DNA, 22 bp, Homo sapiens
acactgtgtcctggtgctctct

SEQ ID NO: 1142563 - DNA, 14 bp, Homo sapiens
acactgttctgaaa

SEQ ID NO: 1142564 - DNA, 20 bp, Homo sapiens
acactgttctgaaagtgact

SEQ ID NO: 1142565 - DNA, 23 bp, Homo sapiens
acactgtttacaagaaaaaatga

SEQ ID NO: 1142566 - DNA, 15 bp, Homo sapiens
acactgtttcaaact

SEQ ID NO: 1142567 - DNA, 23 bp, Homo sapiens
acactgtttcaaactttactatg

SEQ ID NO: 1142568 - DNA, 14 bp, Homo sapiens
atgcatttcattca

SEQ ID NO: 1142569 - DNA, 13 bp, Homo sapiens
atgcatttgaggt

SEQ ID NO: 1142570 - DNA, 14 bp, Homo sapiens
atgcatttgcattt

SEQ ID NO: 1142571 - DNA, 22 bp, Homo sapiens
atgcattttaaagttaaacatt

SEQ ID NO: 1142572 - DNA, 13 bp, Homo sapiens
atgcattttcttc

SEQ ID NO: 1142573 - DNA, 16 bp, Homo sapiens
atgcattttcttcaca

SEQ ID NO: 1142574 - DNA, 12 bp, Homo sapiens
atgcattttgca

SEQ ID NO: 1142575 - DNA, 19 bp, Homo sapiens
atgccaaaaaaaaatacat

SEQ ID NO: 1142576 - DNA, 18 bp, Homo sapiens
atgccaaaaaaagacagg

SEQ ID NO: 1142577 - DNA, 19 bp, Homo sapiens
atgccaaaatgactttata

SEQ ID NO: 1142578 - DNA, 14 bp, Homo sapiens
atgccaaagatgtt

SEQ ID NO: 1142579 - DNA, 20 bp, Homo sapiens
atgccaaagatgtttgaaaa

SEQ ID NO: 1142580 - DNA, 22 bp, Homo sapiens
atgccaaagctagggtggccct

SEQ ID NO: 1142581 - DNA, 18 bp, Homo sapiens
atgccaacttcccacacg

SEQ ID NO: 1142582 - DNA, 22 bp, Homo sapiens
atgccaacttcccacacggcag

SEQ ID NO: 1142583 - DNA, 14 bp, Homo sapiens
atgccaacttgtcc

SEQ ID NO: 1142584 - DNA, 23 bp, Homo sapiens
atgccaagaagtttaaggaatat

SEQ ID NO: 1142585 - DNA, 21 bp, Homo sapiens
atgccaagggggtgactggaa

SEQ ID NO: 1142586 - DNA, 16 bp, Homo sapiens
atgccaagtgcctgct

SEQ ID NO: 1142587 - DNA, 22 bp, Homo sapiens
atgccaattagcaattgactgt

SEQ ID NO: 1142588 - DNA, 17 bp, Homo sapiens
atgccaatttcctctcc

SEQ ID NO: 1142589 - DNA, 18 bp, Homo sapiens
atgccacacagagtggtc

SEQ ID NO: 1142590 - DNA, 17 bp, Homo sapiens
atgccacacctggcctt

SEQ ID NO: 1142591 - DNA, 15 bp, Homo sapiens
atgccacattcaaaa

SEQ ID NO: 1142592 - DNA, 19 bp, Homo sapiens
atgccacccccgctggagg

SEQ ID NO: 1142593 - DNA, 23 bp, Homo sapiens
atgccaccctcacacacacagct

SEQ ID NO: 1142594 - DNA, 23 bp, Homo sapiens
atgccaccggcctgtgggtctct

SEQ ID NO: 1142595 - DNA, 17 bp, Homo sapiens
atgccacgggaagttta

SEQ ID NO: 1142596 - DNA, 14 bp, Homo sapiens
atgccacgttccac

SEQ ID NO: 1142597 - DNA, 13 bp, Homo sapiens
atgccactcccta

SEQ ID NO: 1142598 - DNA, 16 bp, Homo sapiens
atgccactccctaccc

SEQ ID NO: 1142599 - DNA, 22 bp, Homo sapiens
acagacgttaggcatttcctgc

SEQ ID NO: 1142600 - DNA, 23 bp, Homo sapiens
acagacgttaggcatttcctgct

SEQ ID NO: 1142601 - DNA, 21 bp, Homo sapiens
acagactagaagtatttgtgg

SEQ ID NO: 1142602 - DNA, 17 bp, Homo sapiens
acagactatttttagat

SEQ ID NO: 1142603 - DNA, 23 bp, Homo sapiens
acagactcctgaggacagctgtc

SEQ ID NO: 1142604 - DNA, 22 bp, Homo sapiens
acagactcgattcatattgaat

SEQ ID NO: 1142605 - DNA, 13 bp, Homo sapiens
acagactgcagac

SEQ ID NO: 1142606 - DNA, 23 bp, Homo sapiens
acagactgcgatttgtcccaggt

SEQ ID NO: 1142607 - DNA, 18 bp, Homo sapiens
acagacttctggaaggct

SEQ ID NO: 1142608 - DNA, 20 bp, Homo sapiens
acagacttctggaaggctgg

SEQ ID NO: 1142609 - DNA, 22 bp, Homo sapiens
acagacttctggaaggctggct

SEQ ID NO: 1142610 - DNA, 16 bp, Homo sapiens
acagagaaaatgaatt

SEQ ID NO: 1142611 - DNA, 12 bp, Homo sapiens
acagagaaagaa

SEQ ID NO: 1142612 - DNA, 15 bp, Homo sapiens
acagagaaagaaaag

SEQ ID NO: 1142613 - DNA, 19 bp, Homo sapiens
acagagaaagaaaaggcaa

SEQ ID NO: 1142614 - DNA, 21 bp, Homo sapiens
acagagaaagggtaatttcct

SEQ ID NO: 1142615 - DNA, 18 bp, Homo sapiens
acagagaaatacaaaata

SEQ ID NO: 1142616 - DNA, 18 bp, Homo sapiens
acagagaaattctgtggt

SEQ ID NO: 1142617 - DNA, 21 bp, Homo sapiens
acagagaaattctgtggtggg

SEQ ID NO: 1142618 - DNA, 14 bp, Homo sapiens
acagagaagctggg

SEQ ID NO: 1142619 - DNA, 17 bp, Homo sapiens
acagagaagctggggag

SEQ ID NO: 1142620 - DNA, 13 bp, Homo sapiens
acagagaataact

SEQ ID NO: 1142621 - DNA, 16 bp, Homo sapiens
acagagacacctgcac

SEQ ID NO: 1142622 - DNA, 17 bp, Homo sapiens
acagagacacctgcacc

SEQ ID NO: 1142623 - DNA, 21 bp, Homo sapiens
acagagacaggcccaagagat

SEQ ID NO: 1142624 - DNA, 11 bp, Homo sapiens
acagagaccta

SEQ ID NO: 1142625 - DNA, 22 bp, Homo sapiens
acagagacctgccctcaagagc

SEQ ID NO: 1142626 - DNA, 21 bp, Homo sapiens
acagagactcagatgaggaca

SEQ ID NO: 1142627 - DNA, 23 bp, Homo sapiens
acagagactcagatgaggacaga

SEQ ID NO: 1142628 - DNA, 20 bp, Homo sapiens
acagagactgaatagatatg

SEQ ID NO: 1142629 - DNA, 23 bp, Homo sapiens
acagagagacagacttgagaact

SEQ ID NO: 1142630 - DNA, 14 bp, Homo sapiens
acagagaggagaaa

SEQ ID NO: 1142631 - DNA, 19 bp, Homo sapiens
acagagaggatacatttaa

SEQ ID NO: 1142632 - DNA, 12 bp, Homo sapiens
acagagagggac

SEQ ID NO: 1142633 - DNA, 22 bp, Homo sapiens
acagagagggacacatgcccct

SEQ ID NO: 1142634 - DNA, 17 bp, Homo sapiens
acagagatatacaaata

SEQ ID NO: 1142635 - DNA, 21 bp, Homo sapiens
acagagatgcatgcgcaggct

SEQ ID NO: 1142636 - DNA, 22 bp, Homo sapiens
acagagatgcatgcgcaggctc

SEQ ID NO: 1142637 - DNA, 22 bp, Homo sapiens
acagagattactttgctgcctt

SEQ ID NO: 1142638 - DNA, 14 bp, Homo sapiens
acagagattctgga

SEQ ID NO: 1142639 - DNA, 23 bp, Homo sapiens
acagagcaaagcgcccacccagg

SEQ ID NO: 1142640 - DNA, 18 bp, Homo sapiens
acagagcacacttattta

SEQ ID NO: 1142641 - DNA, 21 bp, Homo sapiens
acagagcacacttatttatga

SEQ ID NO: 1142642 - DNA, 22 bp, Homo sapiens
acagagcacacttatttatgaa

SEQ ID NO: 1142643 - DNA, 23 bp, Homo sapiens
acagagcagctaactccgagagc

SEQ ID NO: 1142644 - DNA, 17 bp, Homo sapiens
acagagcatacaacaga

SEQ ID NO: 1142645 - DNA, 12 bp, Homo sapiens
acagagccaccc

SEQ ID NO: 1142646 - DNA, 18 bp, Homo sapiens
acagagccaccccatgag

SEQ ID NO: 1142647 - DNA, 14 bp, Homo sapiens
acagagccaggaga

SEQ ID NO: 1142648 - DNA, 23 bp, Homo sapiens
acagagccctgaggggctgggct

SEQ ID NO: 1142649 - DNA, 13 bp, Homo sapiens
acagagcctggct

SEQ ID NO: 1142650 - DNA, 23 bp, Homo sapiens
acagagctggagatgaggccaga

SEQ ID NO: 1142651 - DNA, 22 bp, Homo sapiens
acagagctgtcacttttgctcc

SEQ ID NO: 1142652 - DNA, 12 bp, Homo sapiens
acagagctttcc

SEQ ID NO: 1142653 - DNA, 22 bp, Homo sapiens
acagagctttcttttgtattaa

SEQ ID NO: 1142654 - DNA, 12 bp, Homo sapiens
acagaggaaagg

SEQ ID NO: 1142655 - DNA, 21 bp, Homo sapiens
acagaggaaagggctggctcc

SEQ ID NO: 1142656 - DNA, 16 bp, Homo sapiens
acagaggacacagaga

SEQ ID NO: 1142657 - DNA, 18 bp, Homo sapiens
acagaggaggcctcaaag

SEQ ID NO: 1142658 - DNA, 20 bp, Homo sapiens
acagaggagggcgtgactca

SEQ ID NO: 1142659 - DNA, 15 bp, Homo sapiens
acagaggagtgcagc

SEQ ID NO: 1142660 - DNA, 17 bp, Homo sapiens
acagaggccaaggactg

SEQ ID NO: 1142661 - DNA, 17 bp, Homo sapiens
acagaggccatggcaga

SEQ ID NO: 1142662 - DNA, 13 bp, Homo sapiens
acagaggccctgc

SEQ ID NO: 1142663 - DNA, 21 bp, Homo sapiens
acagaggctgcacccctgggc

SEQ ID NO: 1142664 - DNA, 24 bp, Homo sapiens
acagaggctgcacccctgggccag

SEQ ID NO: 1142665 - DNA, 14 bp, Homo sapiens
acagagggaagcca

SEQ ID NO: 1142666 - DNA, 17 bp, Homo sapiens
acagagggaagccatgt

SEQ ID NO: 1142667 - DNA, 19 bp, Homo sapiens
acagagggagacagggctg

SEQ ID NO: 1142668 - DNA, 14 bp, Homo sapiens
acagagggagttta

SEQ ID NO: 1142669 - DNA, 13 bp, Homo sapiens
acagagggccaga

SEQ ID NO: 1142670 - DNA, 23 bp, Homo sapiens
acagagggccagagctagggctg

SEQ ID NO: 1142671 - DNA, 20 bp, Homo sapiens
acagagggctagggaggtgg

SEQ ID NO: 1142672 - DNA, 16 bp, Homo sapiens
acagaggggactctgg

SEQ ID NO: 1142673 - DNA, 20 bp, Homo sapiens
acagaggggactctgggcta

SEQ ID NO: 1142674 - DNA, 24 bp, Homo sapiens
acagaggtagtctcactgcttgaa

SEQ ID NO: 1142675 - DNA, 19 bp, Homo sapiens
acagagtagccaggttctg

SEQ ID NO: 1142676 - DNA, 23 bp, Homo sapiens
acagagtatgaacacctgggctt

SEQ ID NO: 1142677 - DNA, 19 bp, Homo sapiens
acagagtgagccagtgagg

SEQ ID NO: 1142678 - DNA, 19 bp, Homo sapiens
acagagtggcccctcacct

SEQ ID NO: 1142679 - DNA, 14 bp, Homo sapiens
acagagtggccgtc

SEQ ID NO: 1142680 - DNA, 18 bp, Homo sapiens
acagagtggcctccctgc

SEQ ID NO: 1142681 - DNA, 21 bp, Homo sapiens
acagagtggcctccctgctgt

SEQ ID NO: 1142682 - DNA, 24 bp, Homo sapiens
acagagtggtctttctggagaggt

SEQ ID NO: 1142683 - DNA, 16 bp, Homo sapiens
acagagttgatttttt

SEQ ID NO: 1142684 - DNA, 16 bp, Homo sapiens
acagagttgttacatt

SEQ ID NO: 1142685 - DNA, 21 bp, Homo sapiens
acagagttgttacatttttaa

SEQ ID NO: 1142686 - DNA, 15 bp, Homo sapiens
acagataagcaagag

SEQ ID NO: 1142687 - DNA, 18 bp, Homo sapiens
acagataattcatttgta

SEQ ID NO: 1142688 - DNA, 17 bp, Homo sapiens
atgcctcactttcttct

SEQ ID NO: 1142689 - DNA, 23 bp, Homo sapiens
atgcctcactttcttctagctga

SEQ ID NO: 1142690 - DNA, 23 bp, Homo sapiens
atgcctcagccacttgcctgtgc

SEQ ID NO: 1142691 - DNA, 24 bp, Homo sapiens
atgcctcagccctgaccctgtgga

SEQ ID NO: 1142692 - DNA, 18 bp, Homo sapiens
atgcctcatgccacacct

SEQ ID NO: 1142693 - DNA, 21 bp, Homo sapiens
atgcctccctgggccacctcc

SEQ ID NO: 1142694 - DNA, 18 bp, Homo sapiens
atgcctctgccaaaggat

SEQ ID NO: 1142695 - DNA, 22 bp, Homo sapiens
atgcctctgccaaaggatgtga

SEQ ID NO: 1142696 - DNA, 20 bp, Homo sapiens
atgcctgaccccttgctccc

SEQ ID NO: 1142697 - DNA, 19 bp, Homo sapiens
atgcctgactaatttttgt

SEQ ID NO: 1142698 - DNA, 12 bp, Homo sapiens
atgcctgagggt

SEQ ID NO: 1142699 - DNA, 20 bp, Homo sapiens
atgcctgattcggacggcca

SEQ ID NO: 1142700 - DNA, 14 bp, Homo sapiens
atgcctgcactggg

SEQ ID NO: 1142701 - DNA, 23 bp, Homo sapiens
atgcctgcgcctgctgcctgctg

SEQ ID NO: 1142702 - DNA, 16 bp, Homo sapiens
atgcctgcttgataat

SEQ ID NO: 1142703 - DNA, 18 bp, Homo sapiens
atgcctgctttttggaaa

SEQ ID NO: 1142704 - DNA, 19 bp, Homo sapiens
atgcctgctttttggaaag

SEQ ID NO: 1142705 - DNA, 11 bp, Homo sapiens
atgcctggagg

SEQ ID NO: 1142706 - DNA, 15 bp, Homo sapiens
atgcctggcccaggt

SEQ ID NO: 1142707 - DNA, 18 bp, Homo sapiens
atgcctggtctttcctct

SEQ ID NO: 1142708 - DNA, 20 bp, Homo sapiens
atgcctgtcagtttcatgga

SEQ ID NO: 1142709 - DNA, 16 bp, Homo sapiens
atgcctgtccagcctg

SEQ ID NO: 1142710 - DNA, 16 bp, Homo sapiens
atgcctgtctctagct

SEQ ID NO: 1142711 - DNA, 23 bp, Homo sapiens
atgcctgtggtgaagtgtggctg

SEQ ID NO: 1142712 - DNA, 16 bp, Homo sapiens
atgcctgttaatttat

SEQ ID NO: 1142713 - DNA, 19 bp, Homo sapiens
atgcctgttaatttataat

SEQ ID NO: 1142714 - DNA, 21 bp, Homo sapiens
atgcctgttaatttataatgt

SEQ ID NO: 1142715 - DNA, 23 bp, Homo sapiens
atgcctgttaatttataatgtat

SEQ ID NO: 1142716 - DNA, 13 bp, Homo sapiens
atgccttaagcag

SEQ ID NO: 1142717 - DNA, 20 bp, Homo sapiens
atgccttaagcagaacaaat

SEQ ID NO: 1142718 - DNA, 21 bp, Homo sapiens
atgccttaagcagaacaaatg

SEQ ID NO: 1142719 - DNA, 17 bp, Homo sapiens
atgccttgataaatata

SEQ ID NO: 1142720 - DNA, 18 bp, Homo sapiens
atgccttggtgccggtca

SEQ ID NO: 1142721 - DNA, 12 bp, Homo sapiens
atgccttgtata

SEQ ID NO: 1142722 - DNA, 14 bp, Homo sapiens
atgccttgtataaa

SEQ ID NO: 1142723 - DNA, 22 bp, Homo sapiens
atgcctttaaagtatgaatcta

SEQ ID NO: 1142724 - DNA, 14 bp, Homo sapiens
acagattgtttgca

SEQ ID NO: 1142725 - DNA, 15 bp, Homo sapiens
acagattgtttgcaa

SEQ ID NO: 1142726 - DNA, 18 bp, Homo sapiens
acagatttcagtaatgtc

SEQ ID NO: 1142727 - DNA, 15 bp, Homo sapiens
acagatttcatacct

SEQ ID NO: 1142728 - DNA, 22 bp, Homo sapiens
acagatttgagctcagccctgg

SEQ ID NO: 1142729 - DNA, 21 bp, Homo sapiens
acagatttggaaagactggac

SEQ ID NO: 1142730 - DNA, 14 bp, Homo sapiens
acagattttaccta

SEQ ID NO: 1142731 - DNA, 17 bp, Homo sapiens
acagattttatttatgc

SEQ ID NO: 1142732 - DNA, 18 bp, Homo sapiens
acagattttatttatgcg

SEQ ID NO: 1142733 - DNA, 16 bp, Homo sapiens
acagatttttacaaat

SEQ ID NO: 1142734 - DNA, 22 bp, Homo sapiens
acagatttttatgttttctttc

SEQ ID NO: 1142735 - DNA, 21 bp, Homo sapiens
acagcaaaaccattgcttcac

SEQ ID NO: 1142736 - DNA, 19 bp, Homo sapiens
acagcaaaatgttgaagaa

SEQ ID NO: 1142737 - DNA, 17 bp, Homo sapiens
acagcaacaatttatga

SEQ ID NO: 1142738 - DNA, 19 bp, Homo sapiens
acagcaacagcaagaaata

SEQ ID NO: 1142739 - DNA, 15 bp, Homo sapiens
acagcaactgacctg

SEQ ID NO: 1142740 - DNA, 14 bp, Homo sapiens
acagcaagaaataa

SEQ ID NO: 1142741 - DNA, 20 bp, Homo sapiens
acagcaagatgaattttatc

SEQ ID NO: 1142742 - DNA, 22 bp, Homo sapiens
acagcaagccggccccccctct

SEQ ID NO: 1142743 - DNA, 17 bp, Homo sapiens
acagcaattcctcaggc

SEQ ID NO: 1142744 - DNA, 17 bp, Homo sapiens
acagcacaccagccgct

SEQ ID NO: 1142745 - DNA, 18 bp, Homo sapiens
acagcacaccagccgctg

SEQ ID NO: 1142746 - DNA, 17 bp, Homo sapiens
acagcacctccccgctg

SEQ ID NO: 1142747 - DNA, 17 bp, Homo sapiens
acagcactactctgtgc

SEQ ID NO: 1142748 - DNA, 18 bp, Homo sapiens
acagcactactgggtgtc

SEQ ID NO: 1142749 - DNA, 21 bp, Homo sapiens
acagcactactgggtgtcatt

SEQ ID NO: 1142750 - DNA, 22 bp, Homo sapiens
acagcactactgggtgtcattt

SEQ ID NO: 1142751 - DNA, 20 bp, Homo sapiens
acagcactggctctctccag

SEQ ID NO: 1142752 - DNA, 14 bp, Homo sapiens
acagcactggggag

SEQ ID NO: 1142753 - DNA, 12 bp, Homo sapiens
acagcagaagcc

SEQ ID NO: 1142754 - DNA, 15 bp, Homo sapiens
acagcagaggttctt

SEQ ID NO: 1142755 - DNA, 15 bp, Homo sapiens
acagcagattccaca

SEQ ID NO: 1142756 - DNA, 18 bp, Homo sapiens
acagcagcctctgaagtt

SEQ ID NO: 1142757 - DNA, 14 bp, Homo sapiens
acagcagcctgtga

SEQ ID NO: 1142758 - DNA, 22 bp, Homo sapiens
acagcagcttataatgggctct

SEQ ID NO: 1142759 - DNA, 14 bp, Homo sapiens
acagcaggacctgt

SEQ ID NO: 1142760 - DNA, 18 bp, Homo sapiens
acagcaggacctgtgctt

SEQ ID NO: 1142761 - DNA, 22 bp, Homo sapiens
acagcagtgtgaatagcctggc

SEQ ID NO: 1142762 - DNA, 19 bp, Homo sapiens
acagcagtgttccccatct

SEQ ID NO: 1142763 - DNA, 15 bp, Homo sapiens
acagcataagggaat

SEQ ID NO: 1142764 - DNA, 22 bp, Homo sapiens
acagcatatgatttcttgcttt

SEQ ID NO: 1142765 - DNA, 15 bp, Homo sapiens
acagcatgaataaaa

SEQ ID NO: 1142766 - DNA, 14 bp, Homo sapiens
acagcatgcccctt

SEQ ID NO: 1142767 - DNA, 21 bp, Homo sapiens
acagcatgccccttggctgga

SEQ ID NO: 1142768 - DNA, 17 bp, Homo sapiens
acagcatgctgctttgc

SEQ ID NO: 1142769 - DNA, 21 bp, Homo sapiens
acagcatgtacggattttcag

SEQ ID NO: 1142770 - DNA, 14 bp, Homo sapiens
acagcatgtgccaa

SEQ ID NO: 1142771 - DNA, 11 bp, Homo sapiens
acagcattgct

SEQ ID NO: 1142772 - DNA, 12 bp, Homo sapiens
acagcattgctt

SEQ ID NO: 1142773 - DNA, 13 bp, Homo sapiens
acagcattgcttt

SEQ ID NO: 1142774 - DNA, 15 bp, Homo sapiens
acagcattgctttct

SEQ ID NO: 1142775 - DNA, 18 bp, Homo sapiens
acagcattgtctttgctg

SEQ ID NO: 1142776 - DNA, 19 bp, Homo sapiens
acagcattgtctttgctgt

SEQ ID NO: 1142777 - DNA, 20 bp, Homo sapiens
acagccaacacgcacctgcc

SEQ ID NO: 1142778 - DNA, 24 bp, Homo sapiens
acagccaacacgcacctgcctcag

SEQ ID NO: 1142779 - DNA, 19 bp, Homo sapiens
acagccaactagcccctgg

SEQ ID NO: 1142780 - DNA, 20 bp, Homo sapiens
acagccaagattttcctctt

SEQ ID NO: 1142781 - DNA, 16 bp, Homo sapiens
acagccacctccgcca

SEQ ID NO: 1142782 - DNA, 24 bp, Homo sapiens
acagccagaaggggctgcttgctt

SEQ ID NO: 1142783 - DNA, 19 bp, Homo sapiens
acagccagagctgggtggg

SEQ ID NO: 1142784 - DNA, 15 bp, Homo sapiens
acagccagaggaggg

SEQ ID NO: 1142785 - DNA, 13 bp, Homo sapiens
acagccagcacct

SEQ ID NO: 1142786 - DNA, 14 bp, Homo sapiens
acagccagggggat

SEQ ID NO: 1142787 - DNA, 16 bp, Homo sapiens
acagccatgcccgcat

SEQ ID NO: 1142788 - DNA, 18 bp, Homo sapiens
acagccatgcgtggccac

SEQ ID NO: 1142789 - DNA, 16 bp, Homo sapiens
acagccatgtccaagt

SEQ ID NO: 1142790 - DNA, 19 bp, Homo sapiens
acagcccaagaggactgag

SEQ ID NO: 1142791 - DNA, 21 bp, Homo sapiens
acagcccacggggatcacagc

SEQ ID NO: 1142792 - DNA, 10 bp, Homo sapiens
acagcccaga

SEQ ID NO: 1142793 - DNA, 15 bp, Homo sapiens
acagcccaggatact

SEQ ID NO: 1142794 - DNA, 18 bp, Homo sapiens
acagcccatcacctctaa

SEQ ID NO: 1142795 - DNA, 16 bp, Homo sapiens
acagcccccgggacac

SEQ ID NO: 1142796 - DNA, 20 bp, Homo sapiens
acagcccgctctctggctgt

SEQ ID NO: 1142797 - DNA, 18 bp, Homo sapiens
acagccctccactccagc

SEQ ID NO: 1142798 - DNA, 15 bp, Homo sapiens
acagccctcggcctc

SEQ ID NO: 1142799 - DNA, 15 bp, Homo sapiens
acagccctgcctgag

SEQ ID NO: 1142800 - DNA, 21 bp, Homo sapiens
acagccctgcctgagaagccc

SEQ ID NO: 1142801 - DNA, 12 bp, Homo sapiens
acagccctggga

SEQ ID NO: 1142802 - DNA, 12 bp, Homo sapiens
acagccctgtca

SEQ ID NO: 1142803 - DNA, 23 bp, Homo sapiens
acagcccttatgcggttaatttt

SEQ ID NO: 1142804 - DNA, 22 bp, Homo sapiens
acagccgcagcctccctctgac

SEQ ID NO: 1142805 - DNA, 14 bp, Homo sapiens
acagccgctcctgt

SEQ ID NO: 1142806 - DNA, 19 bp, Homo sapiens
acagccgctcctgtctgcc

SEQ ID NO: 1142807 - DNA, 20 bp, Homo sapiens
acagccgctcctgtctgcca

SEQ ID NO: 1142808 - DNA, 24 bp, Homo sapiens
acagccgctcctgtctgccagcca

SEQ ID NO: 1142809 - DNA, 23 bp, Homo sapiens
atggactcaggatccagtgacat

SEQ ID NO: 1142810 - DNA, 18 bp, Homo sapiens
atggactctgaaaaacat

SEQ ID NO: 1142811 - DNA, 14 bp, Homo sapiens
atggactgctcagg

SEQ ID NO: 1142812 - DNA, 16 bp, Homo sapiens
atggactgtgaatttc

SEQ ID NO: 1142813 - DNA, 17 bp, Homo sapiens
atggacttgtatatttg

SEQ ID NO: 1142814 - DNA, 14 bp, Homo sapiens
atggagaaaccctg

SEQ ID NO: 1142815 - DNA, 13 bp, Homo sapiens
atggagaaagaag

SEQ ID NO: 1142816 - DNA, 21 bp, Homo sapiens
atggagaaagaagtggagaca

SEQ ID NO: 1142817 - DNA, 22 bp, Homo sapiens
atggagaaagtaagtctttttt

SEQ ID NO: 1142818 - DNA, 15 bp, Homo sapiens
atggagaagctgcag

SEQ ID NO: 1142819 - DNA, 15 bp, Homo sapiens
atggagaagggttct

SEQ ID NO: 1142820 - DNA, 20 bp, Homo sapiens
atggagacgtggtgggactc

SEQ ID NO: 1142821 - DNA, 18 bp, Homo sapiens
atggagactcctgccctg

SEQ ID NO: 1142822 - DNA, 20 bp, Homo sapiens
atggagactcctgccctgtt

SEQ ID NO: 1142823 - DNA, 18 bp, Homo sapiens
atggagactgtctcaaga

SEQ ID NO: 1142824 - DNA, 17 bp, Homo sapiens
atggagactttgctgtt

SEQ ID NO: 1142825 - DNA, 16 bp, Homo sapiens
atggagaggacagagc

SEQ ID NO: 1142826 - DNA, 16 bp, Homo sapiens
atggagaggcggcctc

SEQ ID NO: 1142827 - DNA, 18 bp, Homo sapiens
atggagagtggggagagg

SEQ ID NO: 1142828 - DNA, 15 bp, Homo sapiens
atggagatgggaagg

SEQ ID NO: 1142829 - DNA, 19 bp, Homo sapiens
atggagatttggaattgaa

SEQ ID NO: 1142830 - DNA, 15 bp, Homo sapiens
atggagccagctccc

SEQ ID NO: 1142831 - DNA, 18 bp, Homo sapiens
atggagccagctccctct

SEQ ID NO: 1142832 - DNA, 15 bp, Homo sapiens
atggagcccccagat

SEQ ID NO: 1142833 - DNA, 14 bp, Homo sapiens
atggagctgggcta

SEQ ID NO: 1142834 - DNA, 12 bp, Homo sapiens
atggaggaaaaa

SEQ ID NO: 1142835 - DNA, 22 bp, Homo sapiens
atggaggaaaaccaagccgtgg

SEQ ID NO: 1142836 - DNA, 21 bp, Homo sapiens
atggaggactccaggcagcag

SEQ ID NO: 1142837 - DNA, 11 bp, Homo sapiens
atggaggagaa

SEQ ID NO: 1142838 - DNA, 17 bp, Homo sapiens
atggaggagaagaattt

SEQ ID NO: 1142839 - DNA, 19 bp, Homo sapiens
atggaggatctctaaagag

SEQ ID NO: 1142840 - DNA, 17 bp, Homo sapiens
atggaggattctttccc

SEQ ID NO: 1142841 - DNA, 14 bp, Homo sapiens
atggaggccagagt

SEQ ID NO: 1142842 - DNA, 15 bp, Homo sapiens
atggaggccagagtc

SEQ ID NO: 1142843 - DNA, 16 bp, Homo sapiens
atggagggaataatac

SEQ ID NO: 1142844 - DNA, 18 bp, Homo sapiens
atggagggcttggcccag

SEQ ID NO: 1142845 - DNA, 19 bp, Homo sapiens
atggagggcttggcccagc

SEQ ID NO: 1142846 - DNA, 15 bp, Homo sapiens
atggaggttctcaga

SEQ ID NO: 1142847 - DNA, 18 bp, Homo sapiens
atggaggttctcagagcc

SEQ ID NO: 1142848 - DNA, 22 bp, Homo sapiens
atggaggttctcagagccaagt

SEQ ID NO: 1142849 - DNA, 22 bp, Homo sapiens
atggaggtttaccggttgttta

SEQ ID NO: 1142850 - DNA, 17 bp, Homo sapiens
atggagtaatggtcacg

SEQ ID NO: 1142851 - DNA, 21 bp, Homo sapiens
atggagtcatttgagtctctt

SEQ ID NO: 1142852 - DNA, 20 bp, Homo sapiens
atggagtccagggaagagaa

SEQ ID NO: 1142853 - DNA, 20 bp, Homo sapiens
atggagtcttttctgttatt

SEQ ID NO: 1142854 - DNA, 22 bp, Homo sapiens
atggagtgagtcacctgctcca

SEQ ID NO: 1142855 - DNA, 18 bp, Homo sapiens
atggagtgcaccaaagag

SEQ ID NO: 1142856 - DNA, 20 bp, Homo sapiens
atggagtgcaccaaagagaa

SEQ ID NO: 1142857 - DNA, 12 bp, Homo sapiens
atggagtgctgt

SEQ ID NO: 1142858 - DNA, 13 bp, Homo sapiens
atggataaactga

SEQ ID NO: 1142859 - DNA, 16 bp, Homo sapiens
atggataaactgagcc

SEQ ID NO: 1142860 - DNA, 17 bp, Homo sapiens
atggataaactgagcct

SEQ ID NO: 1142861 - DNA, 13 bp, Homo sapiens
atggatatttctc

SEQ ID NO: 1142862 - DNA, 13 bp, Homo sapiens
atggatcagagga

SEQ ID NO: 1142863 - DNA, 14 bp, Homo sapiens
atggatcagatctg

SEQ ID NO: 1142864 - DNA, 20 bp, Homo sapiens
atggatgaatctcccactcc

SEQ ID NO: 1142865 - DNA, 22 bp, Homo sapiens
atggatgaatctcccactccag

SEQ ID NO: 1142866 - DNA, 17 bp, Homo sapiens
atggatgagtcagacac

SEQ ID NO: 1142867 - DNA, 18 bp, Homo sapiens
atggatgattcagaaatt

SEQ ID NO: 1142868 - DNA, 23 bp, Homo sapiens
atggatgccaatattaaatctgc

SEQ ID NO: 1142869 - DNA, 14 bp, Homo sapiens
atggatggcacaat

SEQ ID NO: 1142870 - DNA, 13 bp, Homo sapiens
atggatggggaga

SEQ ID NO: 1142871 - DNA, 12 bp, Homo sapiens
atggatgtgctt

SEQ ID NO: 1142872 - DNA, 17 bp, Homo sapiens
atggatgtggggtcccc

SEQ ID NO: 1142873 - DNA, 19 bp, Homo sapiens
atggattacttctctataa

SEQ ID NO: 1142874 - DNA, 18 bp, Homo sapiens
atggattataatcagaat

SEQ ID NO: 1142875 - DNA, 14 bp, Homo sapiens
atggattatgttga

SEQ ID NO: 1142876 - DNA, 22 bp, Homo sapiens
atggattatgttgacattttct

SEQ ID NO: 1142877 - DNA, 18 bp, Homo sapiens
atggattctaaaatgcct

SEQ ID NO: 1142878 - DNA, 18 bp, Homo sapiens
atggattctcagatattt

SEQ ID NO: 1142879 - DNA, 22 bp, Homo sapiens
atggattctcagatatttatat

SEQ ID NO: 1142880 - DNA, 16 bp, Homo sapiens
atggattgccacagct

SEQ ID NO: 1142881 - DNA, 17 bp, Homo sapiens
atggatttcagaagcct

SEQ ID NO: 1142882 - DNA, 19 bp, Homo sapiens
atggatttcgtttttcttg

SEQ ID NO: 1142883 - DNA, 21 bp, Homo sapiens
atggatttgcctgtgccaccc

SEQ ID NO: 1142884 - DNA, 21 bp, Homo sapiens
atggattttggataaatcatt

SEQ ID NO: 1142885 - DNA, 19 bp, Homo sapiens
atggatttttctttaactg

SEQ ID NO: 1142886 - DNA, 18 bp, Homo sapiens
atggcaaatcaggggcca

SEQ ID NO: 1142887 - DNA, 15 bp, Homo sapiens
atggcaaccattata

SEQ ID NO: 1142888 - DNA, 19 bp, Homo sapiens
atggcaaggactgcaggga

SEQ ID NO: 1142889 - DNA, 21 bp, Homo sapiens
atggcaagtgatatcacctct

SEQ ID NO: 1142890 - DNA, 14 bp, Homo sapiens
atggcaattctgga

SEQ ID NO: 1142891 - DNA, 12 bp, Homo sapiens
atggcacaatga

SEQ ID NO: 1142892 - DNA, 23 bp, Homo sapiens
atggcacatcagcacgatttctg

SEQ ID NO: 1142893 - DNA, 14 bp, Homo sapiens
atggcaccagaggc

SEQ ID NO: 1142894 - DNA, 17 bp, Homo sapiens
atggcaccagccccctg

SEQ ID NO: 1142895 - DNA, 20 bp, Homo sapiens
atggcaccagccccctggat

SEQ ID NO: 1142896 - DNA, 20 bp, Homo sapiens
atggcacctctgcccttccc

SEQ ID NO: 1142897 - DNA, 13 bp, Homo sapiens
atggcagaaaagt

SEQ ID NO: 1142898 - DNA, 20 bp, Homo sapiens
atggcagaaggcaaacccat

SEQ ID NO: 1142899 - DNA, 21 bp, Homo sapiens
atggcagactctttaataaat

SEQ ID NO: 1142900 - DNA, 12 bp, Homo sapiens
atggcagagcca

SEQ ID NO: 1142901 - DNA, 17 bp, Homo sapiens
atggcagagttgtaaat

SEQ ID NO: 1142902 - DNA, 21 bp, Homo sapiens
atggcagagttgtaaatatat

SEQ ID NO: 1142903 - DNA, 19 bp, Homo sapiens
atggcagagtttgtgtgtt

SEQ ID NO: 1142904 - DNA, 22 bp, Homo sapiens
atggcagagtttgtgtgttgtc

SEQ ID NO: 1142905 - DNA, 19 bp, Homo sapiens
atggcagcaatggcgctgt

SEQ ID NO: 1142906 - DNA, 16 bp, Homo sapiens
atggcagcccggctgc

SEQ ID NO: 1142907 - DNA, 24 bp, Homo sapiens
atggcagcccggctgctgcttgga

SEQ ID NO: 1142908 - DNA, 18 bp, Homo sapiens
atggcagctgtttctcat

SEQ ID NO: 1142909 - DNA, 16 bp, Homo sapiens
atggcaggactcctgg

SEQ ID NO: 1142910 - DNA, 19 bp, Homo sapiens
atggcaggactcctggcag

SEQ ID NO: 1142911 - DNA, 20 bp, Homo sapiens
atggcaggactcctggcagg

SEQ ID NO: 1142912 - DNA, 16 bp, Homo sapiens
atggcaggagaatcag

SEQ ID NO: 1142913 - DNA, 16 bp, Homo sapiens
atggcagggcctcatc

SEQ ID NO: 1142914 - DNA, 16 bp, Homo sapiens
atggcataacctgtct

SEQ ID NO: 1142915 - DNA, 17 bp, Homo sapiens
atggcataacctgtctc

SEQ ID NO: 1142916 - DNA, 21 bp, Homo sapiens
atggcatagccccggcccccc

SEQ ID NO: 1142917 - DNA, 17 bp, Homo sapiens
atggcatccctttttca

SEQ ID NO: 1142918 - DNA, 17 bp, Homo sapiens
atggcatcctgtgaagt

SEQ ID NO: 1142919 - DNA, 23 bp, Homo sapiens
atggcatgattagattgcaaagc

SEQ ID NO: 1142920 - DNA, 23 bp, Homo sapiens
atggcatggagtatagtgcaaat

SEQ ID NO: 1142921 - DNA, 19 bp, Homo sapiens
atggcattgcactgcttat

SEQ ID NO: 1142922 - DNA, 23 bp, Homo sapiens
atggcatttctctttaaactatg

SEQ ID NO: 1142923 - DNA, 22 bp, Homo sapiens
atggccaccccgtgccacccgt

SEQ ID NO: 1142924 - DNA, 17 bp, Homo sapiens
atggccagagcctctgg

SEQ ID NO: 1142925 - DNA, 11 bp, Homo sapiens
atggccagagg

SEQ ID NO: 1142926 - DNA, 13 bp, Homo sapiens
atggccagaggaa

SEQ ID NO: 1142927 - DNA, 14 bp, Homo sapiens
atggccagcccctg

SEQ ID NO: 1142928 - DNA, 16 bp, Homo sapiens
atggccaggtggccac

SEQ ID NO: 1142929 - DNA, 19 bp, Homo sapiens
atggccatagaggcccagg

SEQ ID NO: 1142930 - DNA, 21 bp, Homo sapiens
acagggtgggcttcctgccct

SEQ ID NO: 1142931 - DNA, 16 bp, Homo sapiens
acagggttcaaaatgt

SEQ ID NO: 1142932 - DNA, 14 bp, Homo sapiens
acagggttgggccc

SEQ ID NO: 1142933 - DNA, 14 bp, Homo sapiens
acagggttttgtat

SEQ ID NO: 1142934 - DNA, 13 bp, Homo sapiens
acaggtagcacag

SEQ ID NO: 1142935 - DNA, 17 bp, Homo sapiens
acaggtatttttttaaa

SEQ ID NO: 1142936 - DNA, 19 bp, Homo sapiens
acaggtatttttttaaatc

SEQ ID NO: 1142937 - DNA, 19 bp, Homo sapiens
acaggtcccacctccagcc

SEQ ID NO: 1142938 - DNA, 20 bp, Homo sapiens
acaggtcccacctccagccc

SEQ ID NO: 1142939 - DNA, 16 bp, Homo sapiens
acaggtcttcatcgaa

SEQ ID NO: 1142940 - DNA, 13 bp, Homo sapiens
acaggtcttgggg

SEQ ID NO: 1142941 - DNA, 14 bp, Homo sapiens
acaggtgatgctct

SEQ ID NO: 1142942 - DNA, 16 bp, Homo sapiens
acaggtgatgctctgg

SEQ ID NO: 1142943 - DNA, 19 bp, Homo sapiens
acaggtggacaaatgttgt

SEQ ID NO: 1142944 - DNA, 19 bp, Homo sapiens
acaggtggcaggaccagga

SEQ ID NO: 1142945 - DNA, 13 bp, Homo sapiens
acaggtggctgtt

SEQ ID NO: 1142946 - DNA, 18 bp, Homo sapiens
acaggtgggcctggcggc

SEQ ID NO: 1142947 - DNA, 16 bp, Homo sapiens
acaggtggggcctcag

SEQ ID NO: 1142948 - DNA, 15 bp, Homo sapiens
acaggtgtctgccta

SEQ ID NO: 1142949 - DNA, 15 bp, Homo sapiens
acaggtgtgagccac

SEQ ID NO: 1142950 - DNA, 17 bp, Homo sapiens
acaggtgtgagccactg

SEQ ID NO: 1142951 - DNA, 18 bp, Homo sapiens
acaggtgtggggacacag

SEQ ID NO: 1142952 - DNA, 20 bp, Homo sapiens
acaggttactaccctcaccc

SEQ ID NO: 1142953 - DNA, 21 bp, Homo sapiens
acaggttactaccctcaccct

SEQ ID NO: 1142954 - DNA, 13 bp, Homo sapiens
acaggttgtgaaa

SEQ ID NO: 1142955 - DNA, 22 bp, Homo sapiens
acagtaaaaacttgtactatgt

SEQ ID NO: 1142956 - DNA, 13 bp, Homo sapiens
acagtaaaaataa

SEQ ID NO: 1142957 - DNA, 20 bp, Homo sapiens
acagtaaaagtaaagactat

SEQ ID NO: 1142958 - DNA, 18 bp, Homo sapiens
acagtaaaccactgaaaa

SEQ ID NO: 1142959 - DNA, 19 bp, Homo sapiens
acagtaaaccactgaaaaa

SEQ ID NO: 1142960 - DNA, 20 bp, Homo sapiens
acagtaaaccactgaaaaaa

SEQ ID NO: 1142961 - DNA, 19 bp, Homo sapiens
acagtaactttatgtgtaa

SEQ ID NO: 1142962 - DNA, 21 bp, Homo sapiens
acagtaactttatgtgtaaat

SEQ ID NO: 1142963 - DNA, 17 bp, Homo sapiens
acagtaatatgtttaat

SEQ ID NO: 1142964 - DNA, 22 bp, Homo sapiens
acagtaatcagagttaccatta

SEQ ID NO: 1142965 - DNA, 18 bp, Homo sapiens
acagtaatctaggtgtgg

SEQ ID NO: 1142966 - DNA, 16 bp, Homo sapiens
acagtaatctatgtgt

SEQ ID NO: 1142967 - DNA, 12 bp, Homo sapiens
acagtaatgaaa

SEQ ID NO: 1142968 - DNA, 13 bp, Homo sapiens
acagtaattgtga

SEQ ID NO: 1142969 - DNA, 15 bp, Homo sapiens
acagtaattgtgaca

SEQ ID NO: 1142970 - DNA, 11 bp, Homo sapiens
acagtacaatc

SEQ ID NO: 1142971 - DNA, 15 bp, Homo sapiens
acagtacagaaggca

SEQ ID NO: 1142972 - DNA, 15 bp, Homo sapiens
acagtacccaaactg

SEQ ID NO: 1142973 - DNA, 23 bp, Homo sapiens
acagtacctatgacttttttaaa

SEQ ID NO: 1142974 - DNA, 17 bp, Homo sapiens
acagtacctgattgtat

SEQ ID NO: 1142975 - DNA, 19 bp, Homo sapiens
acagtacctgattgtattt

SEQ ID NO: 1142976 - DNA, 18 bp, Homo sapiens
acagtactcactttttcc

SEQ ID NO: 1142977 - DNA, 14 bp, Homo sapiens
acagtactttattg

SEQ ID NO: 1142978 - DNA, 17 bp, Homo sapiens
acagtactttattgtac

SEQ ID NO: 1142979 - DNA, 13 bp, Homo sapiens
acagtagaactgt

SEQ ID NO: 1142980 - DNA, 16 bp, Homo sapiens
acagtagagccagctt

SEQ ID NO: 1142981 - DNA, 19 bp, Homo sapiens
acagtagccaagttatatt

SEQ ID NO: 1142982 - DNA, 15 bp, Homo sapiens
acagtaggatgtgga

SEQ ID NO: 1142983 - DNA, 23 bp, Homo sapiens
acagtagttagaattatatcact

SEQ ID NO: 1142984 - DNA, 21 bp, Homo sapiens
acagtagttgtattcttctgt

SEQ ID NO: 1142985 - DNA, 23 bp, Homo sapiens
acagtagtttctcagggtcactg

SEQ ID NO: 1142986 - DNA, 21 bp, Homo sapiens
acagtatatgtcatgcctcac

SEQ ID NO: 1142987 - DNA, 18 bp, Homo sapiens
acagtatattctttggtt

SEQ ID NO: 1142988 - DNA, 15 bp, Homo sapiens
acagtatatttgaaa

SEQ ID NO: 1142989 - DNA, 17 bp, Homo sapiens
acagtatgatgaaaata

SEQ ID NO: 1142990 - DNA, 20 bp, Homo sapiens
acagtatgggggttgtaaat

SEQ ID NO: 1142991 - DNA, 21 bp, Homo sapiens
acagtatgggggttgtaaatt

SEQ ID NO: 1142992 - DNA, 23 bp, Homo sapiens
acagtatgggggttgtaaattgg

SEQ ID NO: 1142993 - DNA, 13 bp, Homo sapiens
acagtattaaggg

SEQ ID NO: 1142994 - DNA, 21 bp, Homo sapiens
atggggcaagacagaaaagtg

SEQ ID NO: 1142995 - DNA, 15 bp, Homo sapiens
atggggcaagccagg

SEQ ID NO: 1142996 - DNA, 18 bp, Homo sapiens
atggggcaagccagggcc

SEQ ID NO: 1142997 - DNA, 14 bp, Homo sapiens
atggggcagaagag

SEQ ID NO: 1142998 - DNA, 15 bp, Homo sapiens
atggggcagaagaga

SEQ ID NO: 1142999 - DNA, 20 bp, Homo sapiens
atggggcagaagagaaagga

SEQ ID NO: 1143000 - DNA, 17 bp, Homo sapiens
atggggctcccgcccgt

SEQ ID NO: 1143001 - DNA, 18 bp, Homo sapiens
atgggggaaggcgctggg

SEQ ID NO: 1143002 - DNA, 18 bp, Homo sapiens
atgggggatgggccaggg

SEQ ID NO: 1143003 - DNA, 17 bp, Homo sapiens
atgggggcactgaggac

SEQ ID NO: 1143004 - DNA, 16 bp, Homo sapiens
atgggggcagggctgt

SEQ ID NO: 1143005 - DNA, 18 bp, Homo sapiens
atgggggcatctcttccc

SEQ ID NO: 1143006 - DNA, 15 bp, Homo sapiens
atgggggcctggatt

SEQ ID NO: 1143007 - DNA, 18 bp, Homo sapiens
atgggggcttcttcctca

SEQ ID NO: 1143008 - DNA, 21 bp, Homo sapiens
atgggggctttcggggagggc

SEQ ID NO: 1143009 - DNA, 22 bp, Homo sapiens
atggggggccaacaccagggat

SEQ ID NO: 1143010 - DNA, 17 bp, Homo sapiens
atggggggcgggccagg

SEQ ID NO: 1143011 - DNA, 22 bp, Homo sapiens
atggggggcgggccagggtggg

SEQ ID NO: 1143012 - DNA, 16 bp, Homo sapiens
atgggggtagcagctg

SEQ ID NO: 1143013 - DNA, 18 bp, Homo sapiens
atgggggtagcagctgga

SEQ ID NO: 1143014 - DNA, 14 bp, Homo sapiens
atgggggtttcacc

SEQ ID NO: 1143015 - DNA, 22 bp, Homo sapiens
atggggtagaaacattgtaaat

SEQ ID NO: 1143016 - DNA, 14 bp, Homo sapiens
atggggtcagcccc

SEQ ID NO: 1143017 - DNA, 22 bp, Homo sapiens
atggggtccatccccttccccc

SEQ ID NO: 1143018 - DNA, 16 bp, Homo sapiens
atggggtctgtaaata

SEQ ID NO: 1143019 - DNA, 18 bp, Homo sapiens
atggggtctgtgactgga

SEQ ID NO: 1143020 - DNA, 19 bp, Homo sapiens
atggggtctgtgactggat

SEQ ID NO: 1143021 - DNA, 13 bp, Homo sapiens
atggggttcctgc

SEQ ID NO: 1143022 - DNA, 16 bp, Homo sapiens
atggggttgttgtctc

SEQ ID NO: 1143023 - DNA, 20 bp, Homo sapiens
atggggtttcagttgcgaaa

SEQ ID NO: 1143024 - DNA, 15 bp, Homo sapiens
atgggtattaaactt

SEQ ID NO: 1143025 - DNA, 22 bp, Homo sapiens
atgggtattaaacttgtcagaa

SEQ ID NO: 1143026 - DNA, 13 bp, Homo sapiens
atgggtcagagct

SEQ ID NO: 1143027 - DNA, 12 bp, Homo sapiens
atgggtccaggg

SEQ ID NO: 1143028 - DNA, 19 bp, Homo sapiens
atgggtctggctgagctga

SEQ ID NO: 1143029 - DNA, 22 bp, Homo sapiens
atgggtgaagggagagccagct

SEQ ID NO: 1143030 - DNA, 20 bp, Homo sapiens
atgggtgtatataattttat

SEQ ID NO: 1143031 - DNA, 13 bp, Homo sapiens
atgggtgtgccct

SEQ ID NO: 1143032 - DNA, 20 bp, Homo sapiens
atgggtgtgcccttggggta

SEQ ID NO: 1143033 - DNA, 23 bp, Homo sapiens
atgggttatttttattaaatgta

SEQ ID NO: 1143034 - DNA, 16 bp, Homo sapiens
atgggttggtgcttct

SEQ ID NO: 1143035 - DNA, 18 bp, Homo sapiens
atggtaaaaaatttataa

SEQ ID NO: 1143036 - DNA, 16 bp, Homo sapiens
atggtaaaataaaatg

SEQ ID NO: 1143037 - DNA, 15 bp, Homo sapiens
atggtaactgctttc

SEQ ID NO: 1143038 - DNA, 13 bp, Homo sapiens
atggtaagagaaa

SEQ ID NO: 1143039 - DNA, 17 bp, Homo sapiens
atggtaatctacagctc

SEQ ID NO: 1143040 - DNA, 18 bp, Homo sapiens
atggtacatgtcttccat

SEQ ID NO: 1143041 - DNA, 13 bp, Homo sapiens
atggtagaaaaat

SEQ ID NO: 1143042 - DNA, 14 bp, Homo sapiens
atggtagaagtgag

SEQ ID NO: 1143043 - DNA, 23 bp, Homo sapiens
atggtagacgagctgtctgctgc

SEQ ID NO: 1143044 - DNA, 15 bp, Homo sapiens
atggtagattctgtt

SEQ ID NO: 1143045 - DNA, 14 bp, Homo sapiens
atggtagttttttc

SEQ ID NO: 1143046 - DNA, 18 bp, Homo sapiens
atggtagttttttcatct

SEQ ID NO: 1143047 - DNA, 13 bp, Homo sapiens
atggtataaacag

SEQ ID NO: 1143048 - DNA, 21 bp, Homo sapiens
atggtatatttggtactgtat

SEQ ID NO: 1143049 - DNA, 18 bp, Homo sapiens
atggtatcaaaattacat

SEQ ID NO: 1143050 - DNA, 21 bp, Homo sapiens
atggtatcaaaattacatata

SEQ ID NO: 1143051 - DNA, 14 bp, Homo sapiens
atggtatgagctga

SEQ ID NO: 1143052 - DNA, 20 bp, Homo sapiens
acagtttcaggcttttatga

SEQ ID NO: 1143053 - DNA, 21 bp, Homo sapiens
acagtttcaggcttttatgag

SEQ ID NO: 1143054 - DNA, 14 bp, Homo sapiens
acagtttccaaatt

SEQ ID NO: 1143055 - DNA, 18 bp, Homo sapiens
acagtttcttttgtgttc

SEQ ID NO: 1143056 - DNA, 22 bp, Homo sapiens
acagtttcttttgtgttcctat

SEQ ID NO: 1143057 - DNA, 19 bp, Homo sapiens
acagtttgactttttggaa

SEQ ID NO: 1143058 - DNA, 14 bp, Homo sapiens
acagtttgctctag

SEQ ID NO: 1143059 - DNA, 12 bp, Homo sapiens
acagttttcatt

SEQ ID NO: 1143060 - DNA, 17 bp, Homo sapiens
acagttttccatgaaaa

SEQ ID NO: 1143061 - DNA, 18 bp, Homo sapiens
acagttttccatgaaaac

SEQ ID NO: 1143062 - DNA, 23 bp, Homo sapiens
acagttttccatgaaaacgtttt

SEQ ID NO: 1143063 - DNA, 23 bp, Homo sapiens
acagttttgtcagtctttcttag

SEQ ID NO: 1143064 - DNA, 23 bp, Homo sapiens
acataaaaaagaagcactttgat

SEQ ID NO: 1143065 - DNA, 14 bp, Homo sapiens
acataaaaaggaca

SEQ ID NO: 1143066 - DNA, 19 bp, Homo sapiens
acataaaaatgatctaaac

SEQ ID NO: 1143067 - DNA, 17 bp, Homo sapiens
acataaaatctgtgaat

SEQ ID NO: 1143068 - DNA, 23 bp, Homo sapiens
acataaacaagaccacgtttcta

SEQ ID NO: 1143069 - DNA, 22 bp, Homo sapiens
acataaaccatttttgttactc

SEQ ID NO: 1143070 - DNA, 20 bp, Homo sapiens
acataaagactaagtagccc

SEQ ID NO: 1143071 - DNA, 13 bp, Homo sapiens
acataaagactgt

SEQ ID NO: 1143072 - DNA, 17 bp, Homo sapiens
acataaagagagcccta

SEQ ID NO: 1143073 - DNA, 15 bp, Homo sapiens
acataaagcaaatag

SEQ ID NO: 1143074 - DNA, 18 bp, Homo sapiens
acataaagcaaatagaca

SEQ ID NO: 1143075 - DNA, 23 bp, Homo sapiens
acataaataaattaaataaaata

SEQ ID NO: 1143076 - DNA, 17 bp, Homo sapiens
acataacaacaacagtt

SEQ ID NO: 1143077 - DNA, 20 bp, Homo sapiens
acataactgaaaatgtgcta

SEQ ID NO: 1143078 - DNA, 16 bp, Homo sapiens
acataactgcttcttg

SEQ ID NO: 1143079 - DNA, 12 bp, Homo sapiens
acataactggat

SEQ ID NO: 1143080 - DNA, 18 bp, Homo sapiens
acataactggattttgaa

SEQ ID NO: 1143081 - DNA, 15 bp, Homo sapiens
acataagaaggcaat

SEQ ID NO: 1143082 - DNA, 23 bp, Homo sapiens
acataagagagatgagaaagctt

SEQ ID NO: 1143083 - DNA, 16 bp, Homo sapiens
acataagataaatgtg

SEQ ID NO: 1143084 - DNA, 15 bp, Homo sapiens
acataagccattatt

SEQ ID NO: 1143085 - DNA, 13 bp, Homo sapiens
acataaggctgga

SEQ ID NO: 1143086 - DNA, 18 bp, Homo sapiens
acataagtccattaactg

SEQ ID NO: 1143087 - DNA, 20 bp, Homo sapiens
acataataaagtggtgattt

SEQ ID NO: 1143088 - DNA, 14 bp, Homo sapiens
acataataataatg

SEQ ID NO: 1143089 - DNA, 23 bp, Homo sapiens
acataatcttctgccttctcatg

SEQ ID NO: 1143090 - DNA, 23 bp, Homo sapiens
acataatgcgtgcataccacttt

SEQ ID NO: 1143091 - DNA, 19 bp, Homo sapiens
acataatgggccactgaaa

SEQ ID NO: 1143092 - DNA, 21 bp, Homo sapiens
acataatgggccactgaaatc

SEQ ID NO: 1143093 - DNA, 22 bp, Homo sapiens
acataatggttgtgaaatgtaa

SEQ ID NO: 1143094 - DNA, 20 bp, Homo sapiens
acataatgtattgttggtaa

SEQ ID NO: 1143095 - DNA, 20 bp, Homo sapiens
acataatgtttttcctttct

SEQ ID NO: 1143096 - DNA, 21 bp, Homo sapiens
acataatgtttttcctttctt

SEQ ID NO: 1143097 - DNA, 22 bp, Homo sapiens
acataatgtttttcctttctta

SEQ ID NO: 1143098 - DNA, 17 bp, Homo sapiens
acataattccagtcaca

SEQ ID NO: 1143099 - DNA, 12 bp, Homo sapiens
acataattgatt

SEQ ID NO: 1143100 - DNA, 16 bp, Homo sapiens
acataattgattaaaa

SEQ ID NO: 1143101 - DNA, 17 bp, Homo sapiens
acataattgattaaaat

SEQ ID NO: 1143102 - DNA, 14 bp, Homo sapiens
acataatttttgta

SEQ ID NO: 1143103 - DNA, 12 bp, Homo sapiens
acataatttttt

SEQ ID NO: 1143104 - DNA, 21 bp, Homo sapiens
acataattttttttttttaac

SEQ ID NO: 1143105 - DNA, 13 bp, Homo sapiens
acatacaagaaaa

SEQ ID NO: 1143106 - DNA, 22 bp, Homo sapiens
acatacaattatttttacagtt

SEQ ID NO: 1143107 - DNA, 16 bp, Homo sapiens
acatacacatacatac

SEQ ID NO: 1143108 - DNA, 14 bp, Homo sapiens
acatacaccagcat

SEQ ID NO: 1143109 - DNA, 15 bp, Homo sapiens
acatacaccagcatt

SEQ ID NO: 1143110 - DNA, 23 bp, Homo sapiens
acatacagaggatgccttttctg

SEQ ID NO: 1143111 - DNA, 14 bp, Homo sapiens
acatacagatttta

SEQ ID NO: 1143112 - DNA, 12 bp, Homo sapiens
acatacatacat

SEQ ID NO: 1143113 - DNA, 17 bp, Homo sapiens
acatacatacatatata

SEQ ID NO: 1143114 - DNA, 18 bp, Homo sapiens
acatacatacatatatat

SEQ ID NO: 1143115 - DNA, 13 bp, Homo sapiens
acatacatatata

SEQ ID NO: 1143116 - DNA, 19 bp, Homo sapiens
acatacatgatacattttt

SEQ ID NO: 1143117 - DNA, 21 bp, Homo sapiens
acataccatgtggatgcagca

SEQ ID NO: 1143118 - DNA, 15 bp, Homo sapiens
acatacgcttttaat

SEQ ID NO: 1143119 - DNA, 14 bp, Homo sapiens
acatacggtcaggt

SEQ ID NO: 1143120 - DNA, 20 bp, Homo sapiens
acatacggtcaggtttaaca

SEQ ID NO: 1143121 - DNA, 13 bp, Homo sapiens
acatactaaccag

SEQ ID NO: 1143122 - DNA, 22 bp, Homo sapiens
acatactaaccagcagaaatgc

SEQ ID NO: 1143123 - DNA, 17 bp, Homo sapiens
acatactcatttttcat

SEQ ID NO: 1143124 - DNA, 14 bp, Homo sapiens
acatactggcctct

SEQ ID NO: 1143125 - DNA, 18 bp, Homo sapiens
acatactggcctggactg

SEQ ID NO: 1143126 - DNA, 21 bp, Homo sapiens
atgtacagcattaaaatttta

SEQ ID NO: 1143127 - DNA, 13 bp, Homo sapiens
atgtacagtctgt

SEQ ID NO: 1143128 - DNA, 14 bp, Homo sapiens
atgtacagtctgtc

SEQ ID NO: 1143129 - DNA, 16 bp, Homo sapiens
atgtacagtctgtcat

SEQ ID NO: 1143130 - DNA, 17 bp, Homo sapiens
atgtacagtctgtcatg

SEQ ID NO: 1143131 - DNA, 16 bp, Homo sapiens
atgtacagttgaaata

SEQ ID NO: 1143132 - DNA, 14 bp, Homo sapiens
atgtacagtttatt

SEQ ID NO: 1143133 - DNA, 19 bp, Homo sapiens
atgtacataaactgtcact

SEQ ID NO: 1143134 - DNA, 22 bp, Homo sapiens
atgtacatagttatttttctct

SEQ ID NO: 1143135 - DNA, 15 bp, Homo sapiens
atgtacatgagaagg

SEQ ID NO: 1143136 - DNA, 14 bp, Homo sapiens
atgtacattaatta

SEQ ID NO: 1143137 - DNA, 13 bp, Homo sapiens
atgtaccatcaat

SEQ ID NO: 1143138 - DNA, 15 bp, Homo sapiens
atgtaccatgtacat

SEQ ID NO: 1143139 - DNA, 21 bp, Homo sapiens
atgtaccatgtacatgaagaa

SEQ ID NO: 1143140 - DNA, 16 bp, Homo sapiens
atgtaccccctttccc

SEQ ID NO: 1143141 - DNA, 16 bp, Homo sapiens
atgtaccgtaggcttt

SEQ ID NO: 1143142 - DNA, 21 bp, Homo sapiens
atgtacctcagatctctctct

SEQ ID NO: 1143143 - DNA, 17 bp, Homo sapiens
atgtacctcccctgcct

SEQ ID NO: 1143144 - DNA, 23 bp, Homo sapiens
atgtacctcccctgccttgctgt

SEQ ID NO: 1143145 - DNA, 18 bp, Homo sapiens
atgtactagtgttctgtt

SEQ ID NO: 1143146 - DNA, 20 bp, Homo sapiens
atgtactatgtctgaacata

SEQ ID NO: 1143147 - DNA, 15 bp, Homo sapiens
atgtactgtacataa

SEQ ID NO: 1143148 - DNA, 16 bp, Homo sapiens
atgtactgtacataaa

SEQ ID NO: 1143149 - DNA, 20 bp, Homo sapiens
atgtactgtacataaattcc

SEQ ID NO: 1143150 - DNA, 12 bp, Homo sapiens
atgtacttaaat

SEQ ID NO: 1143151 - DNA, 20 bp, Homo sapiens
atgtacttagctgtactata

SEQ ID NO: 1143152 - DNA, 21 bp, Homo sapiens
atgtacttagctgtactataa

SEQ ID NO: 1143153 - DNA, 17 bp, Homo sapiens
atgtacttgtcaaagaa

SEQ ID NO: 1143154 - DNA, 17 bp, Homo sapiens
atgtacttgtttgaata

SEQ ID NO: 1143155 - DNA, 14 bp, Homo sapiens
atgtactttttaaa

SEQ ID NO: 1143156 - DNA, 20 bp, Homo sapiens
atgtagaaagttgtaaaata

SEQ ID NO: 1143157 - DNA, 14 bp, Homo sapiens
atgtagaactcagc

SEQ ID NO: 1143158 - DNA, 20 bp, Homo sapiens
atgtagaactcagcagttga

SEQ ID NO: 1143159 - DNA, 23 bp, Homo sapiens
atgtagaacttcaagaagtaaga

SEQ ID NO: 1143160 - DNA, 17 bp, Homo sapiens
atgtagaataaatgaag

SEQ ID NO: 1143161 - DNA, 18 bp, Homo sapiens
atgtagataaactcagaa

SEQ ID NO: 1143162 - DNA, 19 bp, Homo sapiens
atgtagataaactcagaaa

SEQ ID NO: 1143163 - DNA, 22 bp, Homo sapiens
atgtagatattgtgaagtacat

SEQ ID NO: 1143164 - DNA, 16 bp, Homo sapiens
atgtagatttatttca

SEQ ID NO: 1143165 - DNA, 17 bp, Homo sapiens
atgtagatttatttcat

SEQ ID NO: 1143166 - DNA, 20 bp, Homo sapiens
atgtagcactactacagaaa

SEQ ID NO: 1143167 - DNA, 18 bp, Homo sapiens
atgtagcacttacgtaaa

SEQ ID NO: 1143168 - DNA, 14 bp, Homo sapiens
atgtagcattgttc

SEQ ID NO: 1143169 - DNA, 24 bp, Homo sapiens
atgtagcattgttccacacattta

SEQ ID NO: 1143170 - DNA, 14 bp, Homo sapiens
atgtagccacccaa

SEQ ID NO: 1143171 - DNA, 19 bp, Homo sapiens
atgtagccagttaaggaaa

SEQ ID NO: 1143172 - DNA, 19 bp, Homo sapiens
atgtagccccctggcctct

SEQ ID NO: 1143173 - DNA, 11 bp, Homo sapiens
acatctccaga

SEQ ID NO: 1143174 - DNA, 21 bp, Homo sapiens
acatctccagaaaaatgaaaa

SEQ ID NO: 1143175 - DNA, 22 bp, Homo sapiens
acatctccagaaaaatgaaaag

SEQ ID NO: 1143176 - DNA, 23 bp, Homo sapiens
acatctccagaaaaatgaaaagc

SEQ ID NO: 1143177 - DNA, 14 bp, Homo sapiens
acatctccagtgtg

SEQ ID NO: 1143178 - DNA, 14 bp, Homo sapiens
acatctctctggct

SEQ ID NO: 1143179 - DNA, 15 bp, Homo sapiens
acatctctctggctt

SEQ ID NO: 1143180 - DNA, 17 bp, Homo sapiens
acatctctctggcttct

SEQ ID NO: 1143181 - DNA, 22 bp, Homo sapiens
acatctctgcaccctggggcct

SEQ ID NO: 1143182 - DNA, 16 bp, Homo sapiens
acatctctggagccag

SEQ ID NO: 1143183 - DNA, 22 bp, Homo sapiens
acatctctggcccagaaagcct

SEQ ID NO: 1143184 - DNA, 14 bp, Homo sapiens
acatctctttgaat

SEQ ID NO: 1143185 - DNA, 23 bp, Homo sapiens
acatctctttgaattttctgtgt

SEQ ID NO: 1143186 - DNA, 13 bp, Homo sapiens
acatctgaaagcc

SEQ ID NO: 1143187 - DNA, 21 bp, Homo sapiens
acatctgaggttttatttcat

SEQ ID NO: 1143188 - DNA, 20 bp, Homo sapiens
acatctgcaatatgaattca

SEQ ID NO: 1143189 - DNA, 14 bp, Homo sapiens
acatctgctctagg

SEQ ID NO: 1143190 - DNA, 13 bp, Homo sapiens
acatctgctgtgt

SEQ ID NO: 1143191 - DNA, 14 bp, Homo sapiens
acatctgctgtgtg

SEQ ID NO: 1143192 - DNA, 12 bp, Homo sapiens
acatctggccct

SEQ ID NO: 1143193 - DNA, 21 bp, Homo sapiens
acatctggccctgacttctgg

SEQ ID NO: 1143194 - DNA, 22 bp, Homo sapiens
acatctggctggaaagcagagc

SEQ ID NO: 1143195 - DNA, 21 bp, Homo sapiens
acatctgggatcatgatagac

SEQ ID NO: 1143196 - DNA, 14 bp, Homo sapiens
acatctgtaaagaa

SEQ ID NO: 1143197 - DNA, 16 bp, Homo sapiens
acatctgtaaagaaaa

SEQ ID NO: 1143198 - DNA, 17 bp, Homo sapiens
acatctgtaaagaaaac

SEQ ID NO: 1143199 - DNA, 12 bp, Homo sapiens
acatctgtcctc

SEQ ID NO: 1143200 - DNA, 17 bp, Homo sapiens
acatctgtgtttcaagt

SEQ ID NO: 1143201 - DNA, 20 bp, Homo sapiens
acatcttaaatctaaacaaa

SEQ ID NO: 1143202 - DNA, 14 bp, Homo sapiens
acatcttacctctc

SEQ ID NO: 1143203 - DNA, 16 bp, Homo sapiens
acatcttacctctcat

SEQ ID NO: 1143204 - DNA, 23 bp, Homo sapiens
acatcttccctagagggttcctg

SEQ ID NO: 1143205 - DNA, 21 bp, Homo sapiens
acatcttctcaaccttatcaa

SEQ ID NO: 1143206 - DNA, 20 bp, Homo sapiens
acatcttctgtgaaatataa

SEQ ID NO: 1143207 - DNA, 19 bp, Homo sapiens
acatcttgcctacttttct

SEQ ID NO: 1143208 - DNA, 12 bp, Homo sapiens
acatcttgtagg

SEQ ID NO: 1143209 - DNA, 21 bp, Homo sapiens
acatcttgttggtacctttct

SEQ ID NO: 1143210 - DNA, 20 bp, Homo sapiens
acatctttaaggggaggaac

SEQ ID NO: 1143211 - DNA, 16 bp, Homo sapiens
acatctttacgtactg

SEQ ID NO: 1143212 - DNA, 18 bp, Homo sapiens
acatctttacgtactgta

SEQ ID NO: 1143213 - DNA, 13 bp, Homo sapiens
acatctttatccg

SEQ ID NO: 1143214 - DNA, 18 bp, Homo sapiens
acatctttattgaaattc

SEQ ID NO: 1143215 - DNA, 12 bp, Homo sapiens
acatctttcaca

SEQ ID NO: 1143216 - DNA, 20 bp, Homo sapiens
acatctttcctcaagtatct

SEQ ID NO: 1143217 - DNA, 19 bp, Homo sapiens
acatctttgtttttaaaat

SEQ ID NO: 1143218 - DNA, 17 bp, Homo sapiens
acatgaaaaacaaacaa

SEQ ID NO: 1143219 - DNA, 15 bp, Homo sapiens
acatgaaaaatttta

SEQ ID NO: 1143220 - DNA, 18 bp, Homo sapiens
acatgaaaacacattttt

SEQ ID NO: 1143221 - DNA, 22 bp, Homo sapiens
acatgaaaacacatttttctta

SEQ ID NO: 1143222 - DNA, 23 bp, Homo sapiens
acatgaaaacacatttttcttag

SEQ ID NO: 1143223 - DNA, 14 bp, Homo sapiens
acatgaaaatttta

SEQ ID NO: 1143224 - DNA, 16 bp, Homo sapiens
acatgaaaattttaaa

SEQ ID NO: 1143225 - DNA, 23 bp, Homo sapiens
acatgaaacctacacactgtcat

SEQ ID NO: 1143226 - DNA, 24 bp, Homo sapiens
acatgaaacggaggcagatggaga

SEQ ID NO: 1143227 - DNA, 22 bp, Homo sapiens
acatgaaagaacccaagacatc

SEQ ID NO: 1143228 - DNA, 22 bp, Homo sapiens
acatgaaatgccctcctaaatg

SEQ ID NO: 1143229 - DNA, 20 bp, Homo sapiens
acatgaagaatgcattcaaa

SEQ ID NO: 1143230 - DNA, 11 bp, Homo sapiens
acatgaagcat

SEQ ID NO: 1143231 - DNA, 19 bp, Homo sapiens
acatgaagctgttgtgtga

SEQ ID NO: 1143232 - DNA, 16 bp, Homo sapiens
acatgaagcttcatgc

SEQ ID NO: 1143233 - DNA, 20 bp, Homo sapiens
acatgaagcttcatgcactt

SEQ ID NO: 1143234 - DNA, 15 bp, Homo sapiens
acatgaaggtaaata

SEQ ID NO: 1143235 - DNA, 21 bp, Homo sapiens
acatgaaggtaaataaaaaga

SEQ ID NO: 1143236 - DNA, 17 bp, Homo sapiens
acatgaattattacagt

SEQ ID NO: 1143237 - DNA, 13 bp, Homo sapiens
acatgacaatgca

SEQ ID NO: 1143238 - DNA, 17 bp, Homo sapiens
acatgacatcaaaatga

SEQ ID NO: 1143239 - DNA, 19 bp, Homo sapiens
acatgacatcaaaatgagt

SEQ ID NO: 1143240 - DNA, 13 bp, Homo sapiens
acatgacatccag

SEQ ID NO: 1143241 - DNA, 15 bp, Homo sapiens
acatgacatccagag

SEQ ID NO: 1143242 - DNA, 15 bp, Homo sapiens
acatgacccagcctg

SEQ ID NO: 1143243 - DNA, 17 bp, Homo sapiens
acatgacccagcctgaa

SEQ ID NO: 1143244 - DNA, 16 bp, Homo sapiens
acatgaccctctgtcc

SEQ ID NO: 1143245 - DNA, 14 bp, Homo sapiens
acatgaccctgggc

SEQ ID NO: 1143246 - DNA, 20 bp, Homo sapiens
acatgaccctgggcttctgt

SEQ ID NO: 1143247 - DNA, 14 bp, Homo sapiens
acatgacctccatt

SEQ ID NO: 1143248 - DNA, 23 bp, Homo sapiens
acatgacgccagataaaatgttc

SEQ ID NO: 1143249 - DNA, 15 bp, Homo sapiens
acatgactctttatt

SEQ ID NO: 1143250 - DNA, 20 bp, Homo sapiens
acatgactctttattgtctg

SEQ ID NO: 1143251 - DNA, 22 bp, Homo sapiens
acatgactctttattgtctgta

SEQ ID NO: 1143252 - DNA, 13 bp, Homo sapiens
acatgactgggcc

SEQ ID NO: 1143253 - DNA, 14 bp, Homo sapiens
acatgactgtttct

SEQ ID NO: 1143254 - DNA, 16 bp, Homo sapiens
acatgactgtttcttt

SEQ ID NO: 1143255 - DNA, 20 bp, Homo sapiens
acatgactgtttcttttgta

SEQ ID NO: 1143256 - DNA, 21 bp, Homo sapiens
acatgactgtttcttttgtaa

SEQ ID NO: 1143257 - DNA, 22 bp, Homo sapiens
acatgagaaagggagaggaaga

SEQ ID NO: 1143258 - DNA, 18 bp, Homo sapiens
acatgagatggagaggct

SEQ ID NO: 1143259 - DNA, 19 bp, Homo sapiens
acatgaggactcatatatt

SEQ ID NO: 1143260 - DNA, 14 bp, Homo sapiens
atgtctatttaagc

SEQ ID NO: 1143261 - DNA, 23 bp, Homo sapiens
atgtctatttaagcctcatattt

SEQ ID NO: 1143262 - DNA, 16 bp, Homo sapiens
atgtctcactgttctg

SEQ ID NO: 1143263 - DNA, 18 bp, Homo sapiens
atgtctcactgttctgca

SEQ ID NO: 1143264 - DNA, 21 bp, Homo sapiens
atgtctcactgttctgcaaag

SEQ ID NO: 1143265 - DNA, 23 bp, Homo sapiens
atgtctcaggtttgttttgtgaa

SEQ ID NO: 1143266 - DNA, 17 bp, Homo sapiens
atgtctcatgtaatttg

SEQ ID NO: 1143267 - DNA, 23 bp, Homo sapiens
atgtctcctcaagcctgtgggca

SEQ ID NO: 1143268 - DNA, 17 bp, Homo sapiens
atgtctctaaactgcgg

SEQ ID NO: 1143269 - DNA, 18 bp, Homo sapiens
atgtctctaaactgcggt

SEQ ID NO: 1143270 - DNA, 13 bp, Homo sapiens
atgtctctcagaa

SEQ ID NO: 1143271 - DNA, 17 bp, Homo sapiens
atgtctctcagaattct

SEQ ID NO: 1143272 - DNA, 21 bp, Homo sapiens
atgtctctcagaattcttcag

SEQ ID NO: 1143273 - DNA, 19 bp, Homo sapiens
atgtctctggggcagatcc

SEQ ID NO: 1143274 - DNA, 15 bp, Homo sapiens
atgtctcttcctctg

SEQ ID NO: 1143275 - DNA, 13 bp, Homo sapiens
atgtctcttctga

SEQ ID NO: 1143276 - DNA, 16 bp, Homo sapiens
atgtctcttgagcatc

SEQ ID NO: 1143277 - DNA, 15 bp, Homo sapiens
atgtctctttaagtt

SEQ ID NO: 1143278 - DNA, 21 bp, Homo sapiens
atgtctgaagtacaaacatga

SEQ ID NO: 1143279 - DNA, 23 bp, Homo sapiens
atgtctgaagtacaaacatgaaa

SEQ ID NO: 1143280 - DNA, 15 bp, Homo sapiens
atgtctgagtgaacc

SEQ ID NO: 1143281 - DNA, 21 bp, Homo sapiens
atgtctgccttcgaccacagc

SEQ ID NO: 1143282 - DNA, 20 bp, Homo sapiens
atgtctgcttctgtccagga

SEQ ID NO: 1143283 - DNA, 19 bp, Homo sapiens
atgtctgtagctcctcaac

SEQ ID NO: 1143284 - DNA, 18 bp, Homo sapiens
atgtctgtatactcctgt

SEQ ID NO: 1143285 - DNA, 19 bp, Homo sapiens
atgtctgtcctcagagcag

SEQ ID NO: 1143286 - DNA, 14 bp, Homo sapiens
atgtctgttctaca

SEQ ID NO: 1143287 - DNA, 13 bp, Homo sapiens
atgtctgttcttc

SEQ ID NO: 1143288 - DNA, 18 bp, Homo sapiens
atgtctgtttttgtatct

SEQ ID NO: 1143289 - DNA, 17 bp, Homo sapiens
atgtcttaaataaaact

SEQ ID NO: 1143290 - DNA, 22 bp, Homo sapiens
atgtcttaaataaaactattta

SEQ ID NO: 1143291 - DNA, 18 bp, Homo sapiens
atgtcttaaatgctcata

SEQ ID NO: 1143292 - DNA, 23 bp, Homo sapiens
atgtcttcatcacttcttccact

SEQ ID NO: 1143293 - DNA, 20 bp, Homo sapiens
atgtcttcatttcattgtat

SEQ ID NO: 1143294 - DNA, 19 bp, Homo sapiens
acattaatgcccagccagc

SEQ ID NO: 1143295 - DNA, 23 bp, Homo sapiens
acattaatgcccagccagccacc

SEQ ID NO: 1143296 - DNA, 15 bp, Homo sapiens
acattaattttgtgc

SEQ ID NO: 1143297 - DNA, 18 bp, Homo sapiens
acattaattttgtgcatt

SEQ ID NO: 1143298 - DNA, 19 bp, Homo sapiens
acattaattttgtgcattc

SEQ ID NO: 1143299 - DNA, 20 bp, Homo sapiens
acattaattttgtgcattct

SEQ ID NO: 1143300 - DNA, 23 bp, Homo sapiens
acattaattttgtgcattctttg

SEQ ID NO: 1143301 - DNA, 22 bp, Homo sapiens
acattaccattcatagtaagaa

SEQ ID NO: 1143302 - DNA, 17 bp, Homo sapiens
acattacggtacagaca

SEQ ID NO: 1143303 - DNA, 16 bp, Homo sapiens
acattactatagcata

SEQ ID NO: 1143304 - DNA, 19 bp, Homo sapiens
acattactctgcctctgta

SEQ ID NO: 1143305 - DNA, 14 bp, Homo sapiens
acattacttattta

SEQ ID NO: 1143306 - DNA, 22 bp, Homo sapiens
acattagcagtttgctttgtat

SEQ ID NO: 1143307 - DNA, 20 bp, Homo sapiens
acattaggaattgtttatac

SEQ ID NO: 1143308 - DNA, 14 bp, Homo sapiens
acattagtctcagt

SEQ ID NO: 1143309 - DNA, 20 bp, Homo sapiens
acattagtgaaaattctgtt

SEQ ID NO: 1143310 - DNA, 19 bp, Homo sapiens
acattagttttaatctctt

SEQ ID NO: 1143311 - DNA, 13 bp, Homo sapiens
acattattaaacg

SEQ ID NO: 1143312 - DNA, 14 bp, Homo sapiens
acattatttatatg

SEQ ID NO: 1143313 - DNA, 16 bp, Homo sapiens
acattatttattcagc

SEQ ID NO: 1143314 - DNA, 13 bp, Homo sapiens
acattatttgcat

SEQ ID NO: 1143315 - DNA, 13 bp, Homo sapiens
acattatttttag

SEQ ID NO: 1143316 - DNA, 19 bp, Homo sapiens
acattattttttatttctg

SEQ ID NO: 1143317 - DNA, 13 bp, Homo sapiens
acattcaaggcat

SEQ ID NO: 1143318 - DNA, 15 bp, Homo sapiens
acattcacagcccag

SEQ ID NO: 1143319 - DNA, 16 bp, Homo sapiens
acattcacagcccaga

SEQ ID NO: 1143320 - DNA, 13 bp, Homo sapiens
acattcacttttg

SEQ ID NO: 1143321 - DNA, 16 bp, Homo sapiens
acattcacttttgtta

SEQ ID NO: 1143322 - DNA, 10 bp, Homo sapiens
acattcatgt

SEQ ID NO: 1143323 - DNA, 14 bp, Homo sapiens
acattcatgtaact

SEQ ID NO: 1143324 - DNA, 12 bp, Homo sapiens
acattccagcca

SEQ ID NO: 1143325 - DNA, 15 bp, Homo sapiens
acattccagccaggc

SEQ ID NO: 1143326 - DNA, 17 bp, Homo sapiens
acattccagccaggccc

SEQ ID NO: 1143327 - DNA, 18 bp, Homo sapiens
acattccagccaggccca

SEQ ID NO: 1143328 - DNA, 21 bp, Homo sapiens
acattccagccaggcccaggc

SEQ ID NO: 1143329 - DNA, 13 bp, Homo sapiens
acattccagggct

SEQ ID NO: 1143330 - DNA, 14 bp, Homo sapiens
acattccagggctg

SEQ ID NO: 1143331 - DNA, 15 bp, Homo sapiens
acattccagggctgg

SEQ ID NO: 1143332 - DNA, 16 bp, Homo sapiens
acattccagggctggg

SEQ ID NO: 1143333 - DNA, 13 bp, Homo sapiens
acattcccctccc

SEQ ID NO: 1143334 - DNA, 23 bp, Homo sapiens
acattcccctccccactcctctc

SEQ ID NO: 1143335 - DNA, 18 bp, Homo sapiens
acattccctctaatttga

SEQ ID NO: 1143336 - DNA, 19 bp, Homo sapiens
acattccctctaatttgaa

SEQ ID NO: 1143337 - DNA, 15 bp, Homo sapiens
acattccgaagaggg

SEQ ID NO: 1143338 - DNA, 23 bp, Homo sapiens
acattccgacaaccgatgctcca

SEQ ID NO: 1143339 - DNA, 17 bp, Homo sapiens
acattcctcagctgcca

SEQ ID NO: 1143340 - DNA, 19 bp, Homo sapiens
acattcctcagctgccaag

SEQ ID NO: 1143341 - DNA, 17 bp, Homo sapiens
acattcctccagcctcc

SEQ ID NO: 1143342 - DNA, 14 bp, Homo sapiens
acattcctggcccc

SEQ ID NO: 1143343 - DNA, 11 bp, Homo sapiens
acattccttct

SEQ ID NO: 1143344 - DNA, 19 bp, Homo sapiens
acattccttgtcaccagca

SEQ ID NO: 1143345 - DNA, 22 bp, Homo sapiens
acattcgaggtgtcaccctgca

SEQ ID NO: 1143346 - DNA, 20 bp, Homo sapiens
acattcgggaccaatatata

SEQ ID NO: 1143347 - DNA, 16 bp, Homo sapiens
acattcgtgagctggg

SEQ ID NO: 1143348 - DNA, 18 bp, Homo sapiens
acattcgtgagctgggga

SEQ ID NO: 1143349 - DNA, 18 bp, Homo sapiens
acattctatgacattttt

SEQ ID NO: 1143350 - DNA, 18 bp, Homo sapiens
acattctcacataagccc

SEQ ID NO: 1143351 - DNA, 11 bp, Homo sapiens
acattctgaat

SEQ ID NO: 1143352 - DNA, 14 bp, Homo sapiens
acattctgaatcaa

SEQ ID NO: 1143353 - DNA, 18 bp, Homo sapiens
acattctgcctagagtgt

SEQ ID NO: 1143354 - DNA, 18 bp, Homo sapiens
acattctgctttcatctt

SEQ ID NO: 1143355 - DNA, 18 bp, Homo sapiens
acattctggatctgaccc

SEQ ID NO: 1143356 - DNA, 17 bp, Homo sapiens
acattctggtctcgtct

SEQ ID NO: 1143357 - DNA, 22 bp, Homo sapiens
acattctggtctcgtcttccgt

SEQ ID NO: 1143358 - DNA, 11 bp, Homo sapiens
acattctgtgt

SEQ ID NO: 1143359 - DNA, 17 bp, Homo sapiens
acattcttattaattct

SEQ ID NO: 1143360 - DNA, 22 bp, Homo sapiens
acattcttggcttaatcatttt

SEQ ID NO: 1143361 - DNA, 23 bp, Homo sapiens
acattcttggcttaatcattttc

SEQ ID NO: 1143362 - DNA, 19 bp, Homo sapiens
acattcttggttgttaatt

SEQ ID NO: 1143363 - DNA, 22 bp, Homo sapiens
acattcttggttgttaatttag

SEQ ID NO: 1143364 - DNA, 21 bp, Homo sapiens
acattcttttaacttctttct

SEQ ID NO: 1143365 - DNA, 19 bp, Homo sapiens
acattgaaaccctccaaat

SEQ ID NO: 1143366 - DNA, 18 bp, Homo sapiens
acattgaagtaatgaatt

SEQ ID NO: 1143367 - DNA, 20 bp, Homo sapiens
acattgaagtaatgaatttt

SEQ ID NO: 1143368 - DNA, 14 bp, Homo sapiens
acattgaattcatt

SEQ ID NO: 1143369 - DNA, 16 bp, Homo sapiens
acattgaattcattat

SEQ ID NO: 1143370 - DNA, 22 bp, Homo sapiens
acattgacagtggtgggcgggg

SEQ ID NO: 1143371 - DNA, 19 bp, Homo sapiens
acattgaccaagaactgca

SEQ ID NO: 1143372 - DNA, 16 bp, Homo sapiens
acattgacttcttggt

SEQ ID NO: 1143373 - DNA, 15 bp, Homo sapiens
acattgagcatttga

SEQ ID NO: 1143374 - DNA, 22 bp, Homo sapiens
acattgatgtaaggactgtaaa

SEQ ID NO: 1143375 - DNA, 21 bp, Homo sapiens
acattgcactttataaacact

SEQ ID NO: 1143376 - DNA, 12 bp, Homo sapiens
acattgcctcat

SEQ ID NO: 1143377 - DNA, 13 bp, Homo sapiens
acattgcctcatt

SEQ ID NO: 1143378 - DNA, 21 bp, Homo sapiens
acattgcctgttctgcttcga

SEQ ID NO: 1143379 - DNA, 16 bp, Homo sapiens
acattgcctttgaatg

SEQ ID NO: 1143380 - DNA, 18 bp, Homo sapiens
acattgcctttgaatgtt

SEQ ID NO: 1143381 - DNA, 15 bp, Homo sapiens
acattgcgtttgacc

SEQ ID NO: 1143382 - DNA, 18 bp, Homo sapiens
acattgctctatgtctgc

SEQ ID NO: 1143383 - DNA, 18 bp, Homo sapiens
acattgctggtcatcctt

SEQ ID NO: 1143384 - DNA, 13 bp, Homo sapiens
acattgcttaaaa

SEQ ID NO: 1143385 - DNA, 17 bp, Homo sapiens
acattgcttaaaatata

SEQ ID NO: 1143386 - DNA, 20 bp, Homo sapiens
acattgcttgtgccacaccc

SEQ ID NO: 1143387 - DNA, 13 bp, Homo sapiens
acattgcttttga

SEQ ID NO: 1143388 - DNA, 16 bp, Homo sapiens
acattggaatgccttg

SEQ ID NO: 1143389 - DNA, 15 bp, Homo sapiens
acattggaatgttct

SEQ ID NO: 1143390 - DNA, 15 bp, Homo sapiens
acattgggaagggga

SEQ ID NO: 1143391 - DNA, 22 bp, Homo sapiens
acattggttctttcatttgctt

SEQ ID NO: 1143392 - DNA, 22 bp, Homo sapiens
atgtgtgtgtatataaatacat

SEQ ID NO: 1143393 - DNA, 21 bp, Homo sapiens
atgtgtgtgtatgtttgcaca

SEQ ID NO: 1143394 - DNA, 14 bp, Homo sapiens
atgtgtgtgtctgt

SEQ ID NO: 1143395 - DNA, 19 bp, Homo sapiens
atgtgtgtgtgggtgtgtg

SEQ ID NO: 1143396 - DNA, 20 bp, Homo sapiens
atgtgtgtgtgggtgtgtgc

SEQ ID NO: 1143397 - DNA, 13 bp, Homo sapiens
atgtgtgttcatg

SEQ ID NO: 1143398 - DNA, 12 bp, Homo sapiens
atgtgtgtttaa

SEQ ID NO: 1143399 - DNA, 15 bp, Homo sapiens
atgtgtgtttaaata

SEQ ID NO: 1143400 - DNA, 16 bp, Homo sapiens
atgtgtgtttaaataa

SEQ ID NO: 1143401 - DNA, 17 bp, Homo sapiens
atgtgtgtttaaataaa

SEQ ID NO: 1143402 - DNA, 14 bp, Homo sapiens
atgtgtgtttctgt

SEQ ID NO: 1143403 - DNA, 14 bp, Homo sapiens
atgtgtgttttttc

SEQ ID NO: 1143404 - DNA, 17 bp, Homo sapiens
atgtgttaatcttaatg

SEQ ID NO: 1143405 - DNA, 20 bp, Homo sapiens
atgtgttaatcttaatgtat

SEQ ID NO: 1143406 - DNA, 22 bp, Homo sapiens
atgtgttaatcttaatgtatat

SEQ ID NO: 1143407 - DNA, 15 bp, Homo sapiens
atgtgttacattatt

SEQ ID NO: 1143408 - DNA, 17 bp, Homo sapiens
atgtgttagcactgata

SEQ ID NO: 1143409 - DNA, 18 bp, Homo sapiens
atgtgttcattcaagcta

SEQ ID NO: 1143410 - DNA, 21 bp, Homo sapiens
atgtgttcttttctcctttac

SEQ ID NO: 1143411 - DNA, 23 bp, Homo sapiens
atgtgttcttttctcctttacca

SEQ ID NO: 1143412 - DNA, 13 bp, Homo sapiens
atgtgttggaaac

SEQ ID NO: 1143413 - DNA, 20 bp, Homo sapiens
atgtgttggggagacatcaa

SEQ ID NO: 1143414 - DNA, 18 bp, Homo sapiens
atgtgtttatgtgagctg

SEQ ID NO: 1143415 - DNA, 19 bp, Homo sapiens
atgtgtttctgtaacaaat

SEQ ID NO: 1143416 - DNA, 16 bp, Homo sapiens
atgttgctgaatttgt

SEQ ID NO: 1143417 - DNA, 20 bp, Homo sapiens
atgttgctgaggagtgagga

SEQ ID NO: 1143418 - DNA, 17 bp, Homo sapiens
atgttgcttctgaatca

SEQ ID NO: 1143419 - DNA, 20 bp, Homo sapiens
atgttggacagacactgttg

SEQ ID NO: 1143420 - DNA, 22 bp, Homo sapiens
atgttggacagacactgttgca

SEQ ID NO: 1143421 - DNA, 16 bp, Homo sapiens
atgttggataaggaat

SEQ ID NO: 1143422 - DNA, 14 bp, Homo sapiens
atgttggcaaatca

SEQ ID NO: 1143423 - DNA, 15 bp, Homo sapiens
atgttggccaggctg

SEQ ID NO: 1143424 - DNA, 20 bp, Homo sapiens
atgttggccaggctgttctc

SEQ ID NO: 1143425 - DNA, 12 bp, Homo sapiens
atgttggctgcg

SEQ ID NO: 1143426 - DNA, 22 bp, Homo sapiens
atgttggctgcgtactccactg

SEQ ID NO: 1143427 - DNA, 22 bp, Homo sapiens
atgttggcttggggcaacagat

SEQ ID NO: 1143428 - DNA, 12 bp, Homo sapiens
atgttgggactg

SEQ ID NO: 1143429 - DNA, 12 bp, Homo sapiens
atgttggtcagg

SEQ ID NO: 1143430 - DNA, 15 bp, Homo sapiens
atgttggtcaggctg

SEQ ID NO: 1143431 - DNA, 19 bp, Homo sapiens
atgttggtcaggctggtct

SEQ ID NO: 1143432 - DNA, 14 bp, Homo sapiens
atgttggtttcagt

SEQ ID NO: 1143433 - DNA, 12 bp, Homo sapiens
atgttgtaaata

SEQ ID NO: 1143434 - DNA, 14 bp, Homo sapiens
atgttgtaatgctg

SEQ ID NO: 1143435 - DNA, 18 bp, Homo sapiens
atgttgtaatgctgcact

SEQ ID NO: 1143436 - DNA, 15 bp, Homo sapiens
atgttgtacttgaaa

SEQ ID NO: 1143437 - DNA, 14 bp, Homo sapiens
atgttgtcaaagag

SEQ ID NO: 1143438 - DNA, 14 bp, Homo sapiens
atgttgtcataaca

SEQ ID NO: 1143439 - DNA, 15 bp, Homo sapiens
atgttgtcataacat

SEQ ID NO: 1143440 - DNA, 18 bp, Homo sapiens
atgttgtcataacattta

SEQ ID NO: 1143441 - DNA, 16 bp, Homo sapiens
atgttgtccaacaata

SEQ ID NO: 1143442 - DNA, 13 bp, Homo sapiens
atgttgtgtgcat

SEQ ID NO: 1143443 - DNA, 16 bp, Homo sapiens
atgttgtgttctaata

SEQ ID NO: 1143444 - DNA, 13 bp, Homo sapiens
atgttgttaaaca

SEQ ID NO: 1143445 - DNA, 20 bp, Homo sapiens
atgttgttgaggctgtcaca

SEQ ID NO: 1143446 - DNA, 21 bp, Homo sapiens
atgttgttgtgtgtatatgta

SEQ ID NO: 1143447 - DNA, 20 bp, Homo sapiens
atgtttaaaagaaatatatt

SEQ ID NO: 1143448 - DNA, 12 bp, Homo sapiens
atgtttaaaata

SEQ ID NO: 1143449 - DNA, 20 bp, Homo sapiens
atgtttaaactttgtgcctt

SEQ ID NO: 1143450 - DNA, 22 bp, Homo sapiens
atgtttaaactttgtgcctttg

SEQ ID NO: 1143451 - DNA, 17 bp, Homo sapiens
atgtttaaatcatgtat

SEQ ID NO: 1143452 - DNA, 15 bp, Homo sapiens
atgtttacaatgatg

SEQ ID NO: 1143453 - DNA, 16 bp, Homo sapiens
atgtttacactctttg

SEQ ID NO: 1143454 - DNA, 18 bp, Homo sapiens
atgtttacactctttgta

SEQ ID NO: 1143455 - DNA, 19 bp, Homo sapiens
atgtttacactctttgtaa

SEQ ID NO: 1143456 - DNA, 22 bp, Homo sapiens
atgtttacaggtggacacacaa

SEQ ID NO: 1143457 - DNA, 20 bp, Homo sapiens
atgtttacatatcacctcat

SEQ ID NO: 1143458 - DNA, 21 bp, Homo sapiens
atgtttaggttactaaaacag

SEQ ID NO: 1143459 - DNA, 20 bp, Homo sapiens
atgtttagtgaatgactttt

SEQ ID NO: 1143460 - DNA, 15 bp, Homo sapiens
atgtttataaactga

SEQ ID NO: 1143461 - DNA, 17 bp, Homo sapiens
atgtttataaactgaga

SEQ ID NO: 1143462 - DNA, 18 bp, Homo sapiens
atgtttataaactgagag

SEQ ID NO: 1143463 - DNA, 22 bp, Homo sapiens
atgtttatgcaaggaaggaaag

SEQ ID NO: 1143464 - DNA, 17 bp, Homo sapiens
atgtttattaaatgctt

SEQ ID NO: 1143465 - DNA, 18 bp, Homo sapiens
atgtttattcctgataat

SEQ ID NO: 1143466 - DNA, 18 bp, Homo sapiens
atgtttattccttctgta

SEQ ID NO: 1143467 - DNA, 14 bp, Homo sapiens
atgtttattctagt

SEQ ID NO: 1143468 - DNA, 21 bp, Homo sapiens
atgtttatttattctgcattt

SEQ ID NO: 1143469 - DNA, 21 bp, Homo sapiens
atgtttcacaccggaaggttt

SEQ ID NO: 1143470 - DNA, 21 bp, Homo sapiens
atgtttcacataaaacctcat

SEQ ID NO: 1143471 - DNA, 12 bp, Homo sapiens
atgtttcatatt

SEQ ID NO: 1143472 - DNA, 22 bp, Homo sapiens
atgtttcatgttttgtgactat

SEQ ID NO: 1143473 - DNA, 19 bp, Homo sapiens
atgtttccccatctctgtc

SEQ ID NO: 1143474 - DNA, 19 bp, Homo sapiens
atgtttcctaactgtgatt

SEQ ID NO: 1143475 - DNA, 20 bp, Homo sapiens
atgtttcgtgaagtatactg

SEQ ID NO: 1143476 - DNA, 23 bp, Homo sapiens
atgtttcgtgaagtatactgtat

SEQ ID NO: 1143477 - DNA, 13 bp, Homo sapiens
atgtttctatctg

SEQ ID NO: 1143478 - DNA, 20 bp, Homo sapiens
atgtttctgggtcctgaaga

SEQ ID NO: 1143479 - DNA, 18 bp, Homo sapiens
atgtttcttcatttctct

SEQ ID NO: 1143480 - DNA, 15 bp, Homo sapiens
atgtttcttctaggt

SEQ ID NO: 1143481 - DNA, 20 bp, Homo sapiens
atgtttcttctttcttttaa

SEQ ID NO: 1143482 - DNA, 22 bp, Homo sapiens
atgtttcttctttcttttaagc

SEQ ID NO: 1143483 - DNA, 18 bp, Homo sapiens
atgtttcttttgtatgta

SEQ ID NO: 1143484 - DNA, 18 bp, Homo sapiens
atgtttgaaaatgctctt

SEQ ID NO: 1143485 - DNA, 22 bp, Homo sapiens
atgtttgaaatgaggtctgttt

SEQ ID NO: 1143486 - DNA, 13 bp, Homo sapiens
atgtttgaacaaa

SEQ ID NO: 1143487 - DNA, 18 bp, Homo sapiens
atgtttgaatttttctct

SEQ ID NO: 1143488 - DNA, 23 bp, Homo sapiens
atgtttgagcagtggcctacaaa

SEQ ID NO: 1143489 - DNA, 21 bp, Homo sapiens
atgtttgatagattttctgct

SEQ ID NO: 1143490 - DNA, 18 bp, Homo sapiens
atgtttgatgtccccaaa

SEQ ID NO: 1143491 - DNA, 15 bp, Homo sapiens
atgtttgatttagta

SEQ ID NO: 1143492 - DNA, 16 bp, Homo sapiens
atgtttgcacttgtga

SEQ ID NO: 1143493 - DNA, 23 bp, Homo sapiens
atgtttgctcttgtttttattaa

SEQ ID NO: 1143494 - DNA, 20 bp, Homo sapiens
atgtttgcttcataaatgaa

SEQ ID NO: 1143495 - DNA, 18 bp, Homo sapiens
atgtttgggggaaaaaaa

SEQ ID NO: 1143496 - DNA, 20 bp, Homo sapiens
atgtttgggggaaaaaaaag

SEQ ID NO: 1143497 - DNA, 20 bp, Homo sapiens
atgtttggttgtaaatgctc

SEQ ID NO: 1143498 - DNA, 18 bp, Homo sapiens
atgtttgtgatattaaat

SEQ ID NO: 1143499 - DNA, 13 bp, Homo sapiens
atgtttgtgcctt

SEQ ID NO: 1143500 - DNA, 16 bp, Homo sapiens
atgtttgtggcctcag

SEQ ID NO: 1143501 - DNA, 12 bp, Homo sapiens
atgttttaaaga

SEQ ID NO: 1143502 - DNA, 14 bp, Homo sapiens
atgttttaaatgta

SEQ ID NO: 1143503 - DNA, 18 bp, Homo sapiens
atgttttaaatgtacaga

SEQ ID NO: 1143504 - DNA, 18 bp, Homo sapiens
atgttttacgcaaggaag

SEQ ID NO: 1143505 - DNA, 17 bp, Homo sapiens
atgttttacgtgcaaac

SEQ ID NO: 1143506 - DNA, 16 bp, Homo sapiens
atgttttactgtgaaa

SEQ ID NO: 1143507 - DNA, 14 bp, Homo sapiens
atgttttatttatc

SEQ ID NO: 1143508 - DNA, 16 bp, Homo sapiens
atgttttccattgttt

SEQ ID NO: 1143509 - DNA, 18 bp, Homo sapiens
atgttttcgaaaatcaaa

SEQ ID NO: 1143510 - DNA, 22 bp, Homo sapiens
atgttttcgaaaatcaaatggt

SEQ ID NO: 1143511 - DNA, 14 bp, Homo sapiens
atgttttcttcaac

SEQ ID NO: 1143512 - DNA, 15 bp, Homo sapiens
atgttttctttctca

SEQ ID NO: 1143513 - DNA, 21 bp, Homo sapiens
atgttttctttgcaaagtatt

SEQ ID NO: 1143514 - DNA, 18 bp, Homo sapiens
atgttttctttgtttcct

SEQ ID NO: 1143515 - DNA, 18 bp, Homo sapiens
atgttttgaatgtggata

SEQ ID NO: 1143516 - DNA, 22 bp, Homo sapiens
atgttttgatatttatttcctg

SEQ ID NO: 1143517 - DNA, 13 bp, Homo sapiens
atgttttgcttaa

SEQ ID NO: 1143518 - DNA, 23 bp, Homo sapiens
atgttttggccaatgcacctaaa

SEQ ID NO: 1143519 - DNA, 21 bp, Homo sapiens
atgttttgggatcaggagccc

SEQ ID NO: 1143520 - DNA, 15 bp, Homo sapiens
atgttttgtgcattt

SEQ ID NO: 1143521 - DNA, 16 bp, Homo sapiens
atgttttgtgcatttg

SEQ ID NO: 1143522 - DNA, 23 bp, Homo sapiens
accaaaagttacatgtttgcacc

SEQ ID NO: 1143523 - DNA, 17 bp, Homo sapiens
accaaacaacttcagaa

SEQ ID NO: 1143524 - DNA, 13 bp, Homo sapiens
accaaacccagcc

SEQ ID NO: 1143525 - DNA, 15 bp, Homo sapiens
accaaacccagccac

SEQ ID NO: 1143526 - DNA, 16 bp, Homo sapiens
accaaacttgttcatt

SEQ ID NO: 1143527 - DNA, 18 bp, Homo sapiens
accaaacttgttcattta

SEQ ID NO: 1143528 - DNA, 12 bp, Homo sapiens
accaaagaagaa

SEQ ID NO: 1143529 - DNA, 13 bp, Homo sapiens
accaaagacatca

SEQ ID NO: 1143530 - DNA, 18 bp, Homo sapiens
accaaagagactggagca

SEQ ID NO: 1143531 - DNA, 21 bp, Homo sapiens
accaaagagactggagcatct

SEQ ID NO: 1143532 - DNA, 22 bp, Homo sapiens
accaaagatatatacacaggat

SEQ ID NO: 1143533 - DNA, 13 bp, Homo sapiens
accaaagcatcaa

SEQ ID NO: 1143534 - DNA, 14 bp, Homo sapiens
accaaagctgcctg

SEQ ID NO: 1143535 - DNA, 21 bp, Homo sapiens
accaaagggaagtgaggccca

SEQ ID NO: 1143536 - DNA, 15 bp, Homo sapiens
accaaaggtcaatgt

SEQ ID NO: 1143537 - DNA, 18 bp, Homo sapiens
accaaaggtgaaggaata

SEQ ID NO: 1143538 - DNA, 22 bp, Homo sapiens
attaagacaaaaagccttgaag

SEQ ID NO: 1143539 - DNA, 19 bp, Homo sapiens
attaagacagtgtacaaaa

SEQ ID NO: 1143540 - DNA, 16 bp, Homo sapiens
attaagatacaaatta

SEQ ID NO: 1143541 - DNA, 14 bp, Homo sapiens
attaagatacttag

SEQ ID NO: 1143542 - DNA, 13 bp, Homo sapiens
attaagatcctaa

SEQ ID NO: 1143543 - DNA, 17 bp, Homo sapiens
attaagatcctaaactc

SEQ ID NO: 1143544 - DNA, 20 bp, Homo sapiens
attaagatggattctcagat

SEQ ID NO: 1143545 - DNA, 17 bp, Homo sapiens
attaagattgaggcctg

SEQ ID NO: 1143546 - DNA, 13 bp, Homo sapiens
attaagatttcca

SEQ ID NO: 1143547 - DNA, 17 bp, Homo sapiens
attaagattttacttta

SEQ ID NO: 1143548 - DNA, 19 bp, Homo sapiens
attaagcacacacatctgg

SEQ ID NO: 1143549 - DNA, 15 bp, Homo sapiens
attaagcattctttc

SEQ ID NO: 1143550 - DNA, 20 bp, Homo sapiens
attaagccacttaaaatgtt

SEQ ID NO: 1143551 - DNA, 20 bp, Homo sapiens
attaagccaggaaacatgaa

SEQ ID NO: 1143552 - DNA, 15 bp, Homo sapiens
attaagcccttattt

SEQ ID NO: 1143553 - DNA, 20 bp, Homo sapiens
attaagctttttttttttga

SEQ ID NO: 1143554 - DNA, 17 bp, Homo sapiens
attaagggcattttacc

SEQ ID NO: 1143555 - DNA, 23 bp, Homo sapiens
attaaggtatttcgaaactgcca

SEQ ID NO: 1143556 - DNA, 21 bp, Homo sapiens
attaagtaatctttttacagt

SEQ ID NO: 1143557 - DNA, 21 bp, Homo sapiens
attaagtagaacaaaaaaccc

SEQ ID NO: 1143558 - DNA, 20 bp, Homo sapiens
attaagtcagtggctttgca

SEQ ID NO: 1143559 - DNA, 22 bp, Homo sapiens
attaagtcagtggctttgcata

SEQ ID NO: 1143560 - DNA, 17 bp, Homo sapiens
attaagtgactgaccat

SEQ ID NO: 1143561 - DNA, 18 bp, Homo sapiens
attaagtggctttttaac

SEQ ID NO: 1143562 - DNA, 23 bp, Homo sapiens
attaagtggggtagactgaggga

SEQ ID NO: 1143563 - DNA, 20 bp, Homo sapiens
attaagttgttaataaaagt

SEQ ID NO: 1143564 - DNA, 18 bp, Homo sapiens
attaagttttaaataaac

SEQ ID NO: 1143565 - DNA, 19 bp, Homo sapiens
attaataaaaaatggaaag

SEQ ID NO: 1143566 - DNA, 22 bp, Homo sapiens
attaataaaaaatggaaagaat

SEQ ID NO: 1143567 - DNA, 18 bp, Homo sapiens
attaataaagaaaaagaa

SEQ ID NO: 1143568 - DNA, 16 bp, Homo sapiens
attaataaagcattct

SEQ ID NO: 1143569 - DNA, 15 bp, Homo sapiens
attaataacctgcca

SEQ ID NO: 1143570 - DNA, 22 bp, Homo sapiens
attaataacctgccagtcccag

SEQ ID NO: 1143571 - DNA, 13 bp, Homo sapiens
attaataatctta

SEQ ID NO: 1143572 - DNA, 16 bp, Homo sapiens
attaataccaaatatt

SEQ ID NO: 1143573 - DNA, 18 bp, Homo sapiens
attaatagcagcctttct

SEQ ID NO: 1143574 - DNA, 20 bp, Homo sapiens
attaatagtaatttgtaaag

SEQ ID NO: 1143575 - DNA, 21 bp, Homo sapiens
attaatagtaatttgtaaagt

SEQ ID NO: 1143576 - DNA, 16 bp, Homo sapiens
attaatatatgtatta

SEQ ID NO: 1143577 - DNA, 21 bp, Homo sapiens
attaatatatgtattatttat

SEQ ID NO: 1143578 - DNA, 13 bp, Homo sapiens
attaatatattaa

SEQ ID NO: 1143579 - DNA, 16 bp, Homo sapiens
attaatatcaactctg

SEQ ID NO: 1143580 - DNA, 18 bp, Homo sapiens
attaatatcaactctgaa

SEQ ID NO: 1143581 - DNA, 18 bp, Homo sapiens
attaatatccctacatgt

SEQ ID NO: 1143582 - DNA, 12 bp, Homo sapiens
attaatatgaaa

SEQ ID NO: 1143583 - DNA, 15 bp, Homo sapiens
attaatatgaaaact

SEQ ID NO: 1143584 - DNA, 12 bp, Homo sapiens
attaatatttaa

SEQ ID NO: 1143585 - DNA, 16 bp, Homo sapiens
attaatcaaaattgtc

SEQ ID NO: 1143586 - DNA, 13 bp, Homo sapiens
attaatcaagaga

SEQ ID NO: 1143587 - DNA, 22 bp, Homo sapiens
attaatcaagagaaacttcaaa

SEQ ID NO: 1143588 - DNA, 22 bp, Homo sapiens
attaatcaccctaccaacttta

SEQ ID NO: 1143589 - DNA, 13 bp, Homo sapiens
attaatcactatt

SEQ ID NO: 1143590 - DNA, 23 bp, Homo sapiens
attaatcagccccagagtgcttt

SEQ ID NO: 1143591 - DNA, 16 bp, Homo sapiens
attaatcagttcatta

SEQ ID NO: 1143592 - DNA, 18 bp, Homo sapiens
attaatcatacaaactct

SEQ ID NO: 1143593 - DNA, 21 bp, Homo sapiens
attaatcatacaaactctcac

SEQ ID NO: 1143594 - DNA, 18 bp, Homo sapiens
attaatccacatgtttca

SEQ ID NO: 1143595 - DNA, 19 bp, Homo sapiens
attaatccccatcattact

SEQ ID NO: 1143596 - DNA, 21 bp, Homo sapiens
attaatccccatcattactgg

SEQ ID NO: 1143597 - DNA, 14 bp, Homo sapiens
attaatctaaaaaa

SEQ ID NO: 1143598 - DNA, 13 bp, Homo sapiens
attaatctcaaag

SEQ ID NO: 1143599 - DNA, 19 bp, Homo sapiens
attaatcttagtgtatgat

SEQ ID NO: 1143600 - DNA, 20 bp, Homo sapiens
attaatcttagtgtatgatt

SEQ ID NO: 1143601 - DNA, 21 bp, Homo sapiens
attaatcttagtgtatgatta

SEQ ID NO: 1143602 - DNA, 18 bp, Homo sapiens
attaatctttctttacct

SEQ ID NO: 1143603 - DNA, 21 bp, Homo sapiens
attaatgaaatgataaagact

SEQ ID NO: 1143604 - DNA, 23 bp, Homo sapiens
attaatgaaatgataaagacttt

SEQ ID NO: 1143605 - DNA, 12 bp, Homo sapiens
attaatgcactt

SEQ ID NO: 1143606 - DNA, 14 bp, Homo sapiens
attaatgcactttc

SEQ ID NO: 1143607 - DNA, 18 bp, Homo sapiens
attaatgcctttaaagta

SEQ ID NO: 1143608 - DNA, 23 bp, Homo sapiens
attaatgtacttgtttctctgtt

SEQ ID NO: 1143609 - DNA, 21 bp, Homo sapiens
attaatgtcctcttgctgtct

SEQ ID NO: 1143610 - DNA, 12 bp, Homo sapiens
attaatgttaat

SEQ ID NO: 1143611 - DNA, 14 bp, Homo sapiens
attaatgttttgta

SEQ ID NO: 1143612 - DNA, 15 bp, Homo sapiens
attaatgttttgtac

SEQ ID NO: 1143613 - DNA, 21 bp, Homo sapiens
attaattaaatgaacttatgt

SEQ ID NO: 1143614 - DNA, 16 bp, Homo sapiens
attaattatatttcta

SEQ ID NO: 1143615 - DNA, 19 bp, Homo sapiens
attaattcaccttccagtg

SEQ ID NO: 1143616 - DNA, 21 bp, Homo sapiens
attaattgcctgttaaatata

SEQ ID NO: 1143617 - DNA, 22 bp, Homo sapiens
attaattgcctgttaaatatac

SEQ ID NO: 1143618 - DNA, 22 bp, Homo sapiens
attaattgggccagcttttcaa

SEQ ID NO: 1143619 - DNA, 20 bp, Homo sapiens
attaattgtaatctgaataa

SEQ ID NO: 1143620 - DNA, 14 bp, Homo sapiens
attaattgtcatta

SEQ ID NO: 1143621 - DNA, 20 bp, Homo sapiens
attaattgtcctgtgtctat

SEQ ID NO: 1143622 - DNA, 12 bp, Homo sapiens
attaattgtctt

SEQ ID NO: 1143623 - DNA, 19 bp, Homo sapiens
attaatttgagaattattc

SEQ ID NO: 1143624 - DNA, 13 bp, Homo sapiens
attaatttgtgaa

SEQ ID NO: 1143625 - DNA, 18 bp, Homo sapiens
attaattttagtttttca

SEQ ID NO: 1143626 - DNA, 18 bp, Homo sapiens
attaattttcagccatgt

SEQ ID NO: 1143627 - DNA, 16 bp, Homo sapiens
attaattttgtgcatt

SEQ ID NO: 1143628 - DNA, 18 bp, Homo sapiens
attaattttgtgcattct

SEQ ID NO: 1143629 - DNA, 12 bp, Homo sapiens
attacaaacaag

SEQ ID NO: 1143630 - DNA, 14 bp, Homo sapiens
attacaaatattgt

SEQ ID NO: 1143631 - DNA, 23 bp, Homo sapiens
attacaaatcagaagtcatcttg

SEQ ID NO: 1143632 - DNA, 18 bp, Homo sapiens
attacaaatgcaaatttc

SEQ ID NO: 1143633 - DNA, 19 bp, Homo sapiens
attacaaattttcactgct

SEQ ID NO: 1143634 - DNA, 18 bp, Homo sapiens
attacaactgaccaagtt

SEQ ID NO: 1143635 - DNA, 14 bp, Homo sapiens
attacaagtatttt

SEQ ID NO: 1143636 - DNA, 19 bp, Homo sapiens
attacaagtatttttaatt

SEQ ID NO: 1143637 - DNA, 16 bp, Homo sapiens
attacaagtggctccc

SEQ ID NO: 1143638 - DNA, 19 bp, Homo sapiens
attacacaataaagcagtc

SEQ ID NO: 1143639 - DNA, 14 bp, Homo sapiens
attacacccaaaga

SEQ ID NO: 1143640 - DNA, 18 bp, Homo sapiens
attacactgtatttgtat

SEQ ID NO: 1143641 - DNA, 19 bp, Homo sapiens
attacactgtgccttttcc

SEQ ID NO: 1143642 - DNA, 23 bp, Homo sapiens
attacagaaatgtttttaacact

SEQ ID NO: 1143643 - DNA, 12 bp, Homo sapiens
attacagagagg

SEQ ID NO: 1143644 - DNA, 15 bp, Homo sapiens
attacagagaggaga

SEQ ID NO: 1143645 - DNA, 17 bp, Homo sapiens
attacagagaggagaaa

SEQ ID NO: 1143646 - DNA, 17 bp, Homo sapiens
attacagaggaagttat

SEQ ID NO: 1143647 - DNA, 21 bp, Homo sapiens
attacagatctgcaccaccat

SEQ ID NO: 1143648 - DNA, 17 bp, Homo sapiens
attacaggcttgagcct

SEQ ID NO: 1143649 - DNA, 17 bp, Homo sapiens
attacataatcaaagct

SEQ ID NO: 1143650 - DNA, 19 bp, Homo sapiens
attacataatcaaagctac

SEQ ID NO: 1143651 - DNA, 18 bp, Homo sapiens
attacataatctgtacaa

SEQ ID NO: 1143652 - DNA, 21 bp, Homo sapiens
attacataatctgtacaatga

SEQ ID NO: 1143653 - DNA, 23 bp, Homo sapiens
attacataatttagttgtttcta

SEQ ID NO: 1143654 - DNA, 22 bp, Homo sapiens
accactggtacttcctttctcc

SEQ ID NO: 1143655 - DNA, 22 bp, Homo sapiens
accactggttaaaataaagcct

SEQ ID NO: 1143656 - DNA, 20 bp, Homo sapiens
accactgtacacacccgcct

SEQ ID NO: 1143657 - DNA, 23 bp, Homo sapiens
accactgtctccacccaccttga

SEQ ID NO: 1143658 - DNA, 17 bp, Homo sapiens
accactgtgccactgac

SEQ ID NO: 1143659 - DNA, 20 bp, Homo sapiens
accatctcagacctttactg

SEQ ID NO: 1143660 - DNA, 15 bp, Homo sapiens
accatctcaggccac

SEQ ID NO: 1143661 - DNA, 14 bp, Homo sapiens
accatctgctgcag

SEQ ID NO: 1143662 - DNA, 13 bp, Homo sapiens
accatctgtttga

SEQ ID NO: 1143663 - DNA, 23 bp, Homo sapiens
attaggacaatcagtcccctccc

SEQ ID NO: 1143664 - DNA, 19 bp, Homo sapiens
attaggatttgccccttcc

SEQ ID NO: 1143665 - DNA, 17 bp, Homo sapiens
attaggcaaagtacaaa

SEQ ID NO: 1143666 - DNA, 19 bp, Homo sapiens
attaggcaaagtacaaaat

SEQ ID NO: 1143667 - DNA, 17 bp, Homo sapiens
attaggctgtaactact

SEQ ID NO: 1143668 - DNA, 11 bp, Homo sapiens
attaggctgtt

SEQ ID NO: 1143669 - DNA, 16 bp, Homo sapiens
attagggagaaaattc

SEQ ID NO: 1143670 - DNA, 23 bp, Homo sapiens
attagggagaaaattcaattgta

SEQ ID NO: 1143671 - DNA, 15 bp, Homo sapiens
attagggccctgtgt

SEQ ID NO: 1143672 - DNA, 17 bp, Homo sapiens
attaggggattcttctt

SEQ ID NO: 1143673 - DNA, 22 bp, Homo sapiens
attaggggttaaagcagacagt

SEQ ID NO: 1143674 - DNA, 18 bp, Homo sapiens
attaggtagactttgctt

SEQ ID NO: 1143675 - DNA, 13 bp, Homo sapiens
attaggtattttg

SEQ ID NO: 1143676 - DNA, 22 bp, Homo sapiens
attaggtcttaaagtagttact

SEQ ID NO: 1143677 - DNA, 15 bp, Homo sapiens
attaggtggaaattt

SEQ ID NO: 1143678 - DNA, 16 bp, Homo sapiens
attaggtgtgactgaa

SEQ ID NO: 1143679 - DNA, 21 bp, Homo sapiens
attaggttatgctatttggac

SEQ ID NO: 1143680 - DNA, 19 bp, Homo sapiens
attaggttgaaacatatct

SEQ ID NO: 1143681 - DNA, 23 bp, Homo sapiens
attaggttgaaacatatctctta

SEQ ID NO: 1143682 - DNA, 14 bp, Homo sapiens
attagtaaatatgt

SEQ ID NO: 1143683 - DNA, 16 bp, Homo sapiens
attagtaacatgtgtt

SEQ ID NO: 1143684 - DNA, 12 bp, Homo sapiens
attagtaagatc

SEQ ID NO: 1143685 - DNA, 19 bp, Homo sapiens
attagtatgtctgtttttg

SEQ ID NO: 1143686 - DNA, 17 bp, Homo sapiens
attagtattcaggcact

SEQ ID NO: 1143687 - DNA, 15 bp, Homo sapiens
attagtcatgtttat

SEQ ID NO: 1143688 - DNA, 16 bp, Homo sapiens
attagtccaaatgtga

SEQ ID NO: 1143689 - DNA, 23 bp, Homo sapiens
attagtccaaatgtgatcaactg

SEQ ID NO: 1143690 - DNA, 13 bp, Homo sapiens
attagtgattctg

SEQ ID NO: 1143691 - DNA, 16 bp, Homo sapiens
attagtgattctgatt

SEQ ID NO: 1143692 - DNA, 19 bp, Homo sapiens
attagtgccagaattttag

SEQ ID NO: 1143693 - DNA, 18 bp, Homo sapiens
attagtggtcataaaata

SEQ ID NO: 1143694 - DNA, 23 bp, Homo sapiens
attagtgtccccccttgaagcaa

SEQ ID NO: 1143695 - DNA, 22 bp, Homo sapiens
attagtgtgacagtttccaaat

SEQ ID NO: 1143696 - DNA, 14 bp, Homo sapiens
attagttaatatat

SEQ ID NO: 1143697 - DNA, 12 bp, Homo sapiens
attagttatata

SEQ ID NO: 1143698 - DNA, 19 bp, Homo sapiens
attagttccagtttctcct

SEQ ID NO: 1143699 - DNA, 21 bp, Homo sapiens
attagttccagtttctccttg

SEQ ID NO: 1143700 - DNA, 20 bp, Homo sapiens
attagttccccaaatacaaa

SEQ ID NO: 1143701 - DNA, 18 bp, Homo sapiens
attagttggctttcataa

SEQ ID NO: 1143702 - DNA, 14 bp, Homo sapiens
attagttgggatgc

SEQ ID NO: 1143703 - DNA, 17 bp, Homo sapiens
attagttggtttgtgtg

SEQ ID NO: 1143704 - DNA, 15 bp, Homo sapiens
attagtttaaaatgc

SEQ ID NO: 1143705 - DNA, 12 bp, Homo sapiens
attagtttcctt

SEQ ID NO: 1143706 - DNA, 17 bp, Homo sapiens
attagtttcctttttaa

SEQ ID NO: 1143707 - DNA, 17 bp, Homo sapiens
attagttttaatctctt

SEQ ID NO: 1143708 - DNA, 19 bp, Homo sapiens
attataaaaaatgtaacat

SEQ ID NO: 1143709 - DNA, 19 bp, Homo sapiens
attataaaaacacttatag

SEQ ID NO: 1143710 - DNA, 22 bp, Homo sapiens
attataaaaatattaagacaat

SEQ ID NO: 1143711 - DNA, 13 bp, Homo sapiens
attataaaaatta

SEQ ID NO: 1143712 - DNA, 20 bp, Homo sapiens
attataaaagctcagatgac

SEQ ID NO: 1143713 - DNA, 22 bp, Homo sapiens
attataaaagctcagatgacat

SEQ ID NO: 1143714 - DNA, 12 bp, Homo sapiens
attataaactat

SEQ ID NO: 1143715 - DNA, 14 bp, Homo sapiens
attataaactataa

SEQ ID NO: 1143716 - DNA, 20 bp, Homo sapiens
attataaactataaacttaa

SEQ ID NO: 1143717 - DNA, 19 bp, Homo sapiens
attataaagccttcagagg

SEQ ID NO: 1143718 - DNA, 14 bp, Homo sapiens
attataaatgtttg

SEQ ID NO: 1143719 - DNA, 22 bp, Homo sapiens
attataaatgtttggaaaggtt

SEQ ID NO: 1143720 - DNA, 12 bp, Homo sapiens
attataacagtt

SEQ ID NO: 1143721 - DNA, 14 bp, Homo sapiens
attataacagttat

SEQ ID NO: 1143722 - DNA, 16 bp, Homo sapiens
attataacagttatat

SEQ ID NO: 1143723 - DNA, 17 bp, Homo sapiens
attataacagttatatt

SEQ ID NO: 1143724 - DNA, 21 bp, Homo sapiens
attataactctgtataataga

SEQ ID NO: 1143725 - DNA, 16 bp, Homo sapiens
attataacttaaaata

SEQ ID NO: 1143726 - DNA, 19 bp, Homo sapiens
attataagccctgcataat

SEQ ID NO: 1143727 - DNA, 22 bp, Homo sapiens
attataagccctgcataatgtt

SEQ ID NO: 1143728 - DNA, 17 bp, Homo sapiens
attataagtcttacata

SEQ ID NO: 1143729 - DNA, 17 bp, Homo sapiens
attataataagcaaaaa

SEQ ID NO: 1143730 - DNA, 15 bp, Homo sapiens
attataatctcaaag

SEQ ID NO: 1143731 - DNA, 18 bp, Homo sapiens
attataatctcaaaggag

SEQ ID NO: 1143732 - DNA, 12 bp, Homo sapiens
attataattcag

SEQ ID NO: 1143733 - DNA, 12 bp, Homo sapiens
attataattgtt

SEQ ID NO: 1143734 - DNA, 17 bp, Homo sapiens
attataatttaatgcat

SEQ ID NO: 1143735 - DNA, 22 bp, Homo sapiens
attataatttttttcaatattt

SEQ ID NO: 1143736 - DNA, 15 bp, Homo sapiens
attataccacttata

SEQ ID NO: 1143737 - DNA, 20 bp, Homo sapiens
attataccagatgaacattt

SEQ ID NO: 1143738 - DNA, 19 bp, Homo sapiens
attataccatgtgtgctaa

SEQ ID NO: 1143739 - DNA, 20 bp, Homo sapiens
attataccatgtgtgctaat

SEQ ID NO: 1143740 - DNA, 19 bp, Homo sapiens
attataccccctgcaaagc

SEQ ID NO: 1143741 - DNA, 17 bp, Homo sapiens
attatactaacttattt

SEQ ID NO: 1143742 - DNA, 15 bp, Homo sapiens
attatactaagaaaa

SEQ ID NO: 1143743 - DNA, 16 bp, Homo sapiens
attatacttgagattt

SEQ ID NO: 1143744 - DNA, 11 bp, Homo sapiens
attatagaaaa

SEQ ID NO: 1143745 - DNA, 16 bp, Homo sapiens
attatagcaactaatg

SEQ ID NO: 1143746 - DNA, 15 bp, Homo sapiens
attatagcaacttta

SEQ ID NO: 1143747 - DNA, 23 bp, Homo sapiens
attatagtgatgtaatcttgaat

SEQ ID NO: 1143748 - DNA, 16 bp, Homo sapiens
attatataaatatata

SEQ ID NO: 1143749 - DNA, 16 bp, Homo sapiens
attatataactctttg

SEQ ID NO: 1143750 - DNA, 15 bp, Homo sapiens
attatataactgtat

SEQ ID NO: 1143751 - DNA, 20 bp, Homo sapiens
attatatacatactgcatct

SEQ ID NO: 1143752 - DNA, 23 bp, Homo sapiens
attatatcattggaacaactgat

SEQ ID NO: 1143753 - DNA, 12 bp, Homo sapiens
attatatgaagt

SEQ ID NO: 1143754 - DNA, 23 bp, Homo sapiens
attatatgaagtttaaattctag

SEQ ID NO: 1143755 - DNA, 22 bp, Homo sapiens
attatatgtggactaaatatct

SEQ ID NO: 1143756 - DNA, 14 bp, Homo sapiens
attatattaaaata

SEQ ID NO: 1143757 - DNA, 22 bp, Homo sapiens
attatattggtgcgtttttaca

SEQ ID NO: 1143758 - DNA, 14 bp, Homo sapiens
attatatttgacat

SEQ ID NO: 1143759 - DNA, 15 bp, Homo sapiens
attatatttgacatg

SEQ ID NO: 1143760 - DNA, 12 bp, Homo sapiens
attatatttgca

SEQ ID NO: 1143761 - DNA, 15 bp, Homo sapiens
attatatttgcatta

SEQ ID NO: 1143762 - DNA, 22 bp, Homo sapiens
attatattttgagtagaactct

SEQ ID NO: 1143763 - DNA, 18 bp, Homo sapiens
attatcaatattgaggat

SEQ ID NO: 1143764 - DNA, 14 bp, Homo sapiens
attatcacatcaag

SEQ ID NO: 1143765 - DNA, 21 bp, Homo sapiens
attatcacatgattatagaag

SEQ ID NO: 1143766 - DNA, 20 bp, Homo sapiens
attatcacattaatctcaaa

SEQ ID NO: 1143767 - DNA, 16 bp, Homo sapiens
attatcatgggaaaag

SEQ ID NO: 1143768 - DNA, 17 bp, Homo sapiens
attatccatattgagtc

SEQ ID NO: 1143769 - DNA, 21 bp, Homo sapiens
attatccattacgtgcattta

SEQ ID NO: 1143770 - DNA, 18 bp, Homo sapiens
attatcctcctgttctga

SEQ ID NO: 1143771 - DNA, 16 bp, Homo sapiens
attatccttgctatga

SEQ ID NO: 1143772 - DNA, 17 bp, Homo sapiens
attatcctttattttat

SEQ ID NO: 1143773 - DNA, 23 bp, Homo sapiens
attatcgctttatgtttttggtt

SEQ ID NO: 1143774 - DNA, 16 bp, Homo sapiens
attatcggaagcagtg

SEQ ID NO: 1143775 - DNA, 18 bp, Homo sapiens
attatcgggaacagtgtt

SEQ ID NO: 1143776 - DNA, 19 bp, Homo sapiens
attatcgggaacagtgttt

SEQ ID NO: 1143777 - DNA, 16 bp, Homo sapiens
attatcgggagcagtg

SEQ ID NO: 1143778 - DNA, 21 bp, Homo sapiens
attatcgggagcagtgtcttc

SEQ ID NO: 1143779 - DNA, 14 bp, Homo sapiens
attatctagatact

SEQ ID NO: 1143780 - DNA, 22 bp, Homo sapiens
attatctatacatatctttatt

SEQ ID NO: 1143781 - DNA, 19 bp, Homo sapiens
acccaggctgcactgcagt

SEQ ID NO: 1143782 - DNA, 14 bp, Homo sapiens
acccagggcctagg

SEQ ID NO: 1143783 - DNA, 16 bp, Homo sapiens
acccagggcctgactt

SEQ ID NO: 1143784 - DNA, 21 bp, Homo sapiens
acccagggcctgacttgagcc

SEQ ID NO: 1143785 - DNA, 22 bp, Homo sapiens
acccagggctagtataaacatg

SEQ ID NO: 1143786 - DNA, 20 bp, Homo sapiens
acccagggctccctcctgga

SEQ ID NO: 1143787 - DNA, 21 bp, Homo sapiens
acccagggctccctcctggag

SEQ ID NO: 1143788 - DNA, 15 bp, Homo sapiens
acccagggctctgcc

SEQ ID NO: 1143789 - DNA, 19 bp, Homo sapiens
acccagggctctgccccag

SEQ ID NO: 1143790 - DNA, 15 bp, Homo sapiens
acccagggtcccctc

SEQ ID NO: 1143791 - DNA, 21 bp, Homo sapiens
acccaggtcccccgactgcct

SEQ ID NO: 1143792 - DNA, 17 bp, Homo sapiens
acccaggtgatttcctc

SEQ ID NO: 1143793 - DNA, 16 bp, Homo sapiens
acccagtccacaaaat

SEQ ID NO: 1143794 - DNA, 16 bp, Homo sapiens
attcaaaaagtgttta

SEQ ID NO: 1143795 - DNA, 15 bp, Homo sapiens
attcaaaaatttcac

SEQ ID NO: 1143796 - DNA, 22 bp, Homo sapiens
attcaaaacctgcagttaacag

SEQ ID NO: 1143797 - DNA, 18 bp, Homo sapiens
attcaaaagtattgaaag

SEQ ID NO: 1143798 - DNA, 21 bp, Homo sapiens
attcaaaagtattgaaagcca

SEQ ID NO: 1143799 - DNA, 20 bp, Homo sapiens
attcaaaatagggtatattt

SEQ ID NO: 1143800 - DNA, 19 bp, Homo sapiens
attcaaaatataacaggtg

SEQ ID NO: 1143801 - DNA, 16 bp, Homo sapiens
attcaaaatatttaaa

SEQ ID NO: 1143802 - DNA, 16 bp, Homo sapiens
attcaaacatattctt

SEQ ID NO: 1143803 - DNA, 20 bp, Homo sapiens
attcaaaccaaagctgcctg

SEQ ID NO: 1143804 - DNA, 17 bp, Homo sapiens
attcaaactggggcctc

SEQ ID NO: 1143805 - DNA, 14 bp, Homo sapiens
attcaaagagaaaa

SEQ ID NO: 1143806 - DNA, 19 bp, Homo sapiens
attcaaagcaccaaaataa

SEQ ID NO: 1143807 - DNA, 12 bp, Homo sapiens
attcaaagtgtt

SEQ ID NO: 1143808 - DNA, 22 bp, Homo sapiens
attcaaagtgttgtgttcctgg

SEQ ID NO: 1143809 - DNA, 15 bp, Homo sapiens
attcaaatcagtgat

SEQ ID NO: 1143810 - DNA, 18 bp, Homo sapiens
attcaaatcagtgatcta

SEQ ID NO: 1143811 - DNA, 13 bp, Homo sapiens
attcaaatgaagg

SEQ ID NO: 1143812 - DNA, 21 bp, Homo sapiens
attcaaattgctgcttggatt

SEQ ID NO: 1143813 - DNA, 14 bp, Homo sapiens
attcaaatttgtac

SEQ ID NO: 1143814 - DNA, 15 bp, Homo sapiens
attcaaatttgtaca

SEQ ID NO: 1143815 - DNA, 22 bp, Homo sapiens
attcaaatttgtacaggactgt

SEQ ID NO: 1143816 - DNA, 12 bp, Homo sapiens
attcaacaaaca

SEQ ID NO: 1143817 - DNA, 15 bp, Homo sapiens
attcaacaatttcaa

SEQ ID NO: 1143818 - DNA, 16 bp, Homo sapiens
attcaacaatttcaat

SEQ ID NO: 1143819 - DNA, 16 bp, Homo sapiens
attcaacatcaaaact

SEQ ID NO: 1143820 - DNA, 19 bp, Homo sapiens
attcaacttttctaagaaa

SEQ ID NO: 1143821 - DNA, 18 bp, Homo sapiens
attcaagaaaataaaact

SEQ ID NO: 1143822 - DNA, 13 bp, Homo sapiens
attcaagaaagga

SEQ ID NO: 1143823 - DNA, 16 bp, Homo sapiens
attcaagaatgaaaaa

SEQ ID NO: 1143824 - DNA, 18 bp, Homo sapiens
attcaagaatgaaaaata

SEQ ID NO: 1143825 - DNA, 21 bp, Homo sapiens
attcaagaatgccagtagaaa

SEQ ID NO: 1143826 - DNA, 20 bp, Homo sapiens
attcaagagctagaaaaata

SEQ ID NO: 1143827 - DNA, 13 bp, Homo sapiens
attcaagctattt

SEQ ID NO: 1143828 - DNA, 22 bp, Homo sapiens
attcaaggaatttcttaacttc

SEQ ID NO: 1143829 - DNA, 16 bp, Homo sapiens
attcaaggccttccaa

SEQ ID NO: 1143830 - DNA, 20 bp, Homo sapiens
attcaaggctttaaaagtca

SEQ ID NO: 1143831 - DNA, 21 bp, Homo sapiens
attcaagtgacacattaatga

SEQ ID NO: 1143832 - DNA, 21 bp, Homo sapiens
attcaagtgcctcttgttgca

SEQ ID NO: 1143833 - DNA, 21 bp, Homo sapiens
attcaataaaaaaaagaaatg

SEQ ID NO: 1143834 - DNA, 12 bp, Homo sapiens
attcaataatga

SEQ ID NO: 1143835 - DNA, 20 bp, Homo sapiens
attcaataccgctcagtatt

SEQ ID NO: 1143836 - DNA, 21 bp, Homo sapiens
attcaataccgctcagtattt

SEQ ID NO: 1143837 - DNA, 15 bp, Homo sapiens
attcaatattatgaa

SEQ ID NO: 1143838 - DNA, 14 bp, Homo sapiens
attcaatattgaat

SEQ ID NO: 1143839 - DNA, 17 bp, Homo sapiens
attcaatattgacattt

SEQ ID NO: 1143840 - DNA, 21 bp, Homo sapiens
attcaatattgacatttgtag

SEQ ID NO: 1143841 - DNA, 20 bp, Homo sapiens
attcaatcagagctccagtt

SEQ ID NO: 1143842 - DNA, 19 bp, Homo sapiens
attcaatcatttattcatt

SEQ ID NO: 1143843 - DNA, 22 bp, Homo sapiens
attcaatctgtaaactgtgtat

SEQ ID NO: 1143844 - DNA, 13 bp, Homo sapiens
attcaatgcaagt

SEQ ID NO: 1143845 - DNA, 12 bp, Homo sapiens
attcaattagtg

SEQ ID NO: 1143846 - DNA, 21 bp, Homo sapiens
attcaattagtggtcataaaa

SEQ ID NO: 1143847 - DNA, 14 bp, Homo sapiens
attcaattcctctg

SEQ ID NO: 1143848 - DNA, 13 bp, Homo sapiens
attcaattgtaaa

SEQ ID NO: 1143849 - DNA, 18 bp, Homo sapiens
attcaattgtaaattgaa

SEQ ID NO: 1143850 - DNA, 17 bp, Homo sapiens
attcacaaacttttata

SEQ ID NO: 1143851 - DNA, 22 bp, Homo sapiens
attcacaaacttttatactctt

SEQ ID NO: 1143852 - DNA, 17 bp, Homo sapiens
attcacaaagtaatttg

SEQ ID NO: 1143853 - DNA, 20 bp, Homo sapiens
attcacaacctcaccaaact

SEQ ID NO: 1143854 - DNA, 18 bp, Homo sapiens
attcacacagggctcttt

SEQ ID NO: 1143855 - DNA, 15 bp, Homo sapiens
attcacacctgactc

SEQ ID NO: 1143856 - DNA, 14 bp, Homo sapiens
attcacagcccaga

SEQ ID NO: 1143857 - DNA, 18 bp, Homo sapiens
attcacagcccagaacca

SEQ ID NO: 1143858 - DNA, 16 bp, Homo sapiens
attcacatagtcctca

SEQ ID NO: 1143859 - DNA, 15 bp, Homo sapiens
attcacatttagaaa

SEQ ID NO: 1143860 - DNA, 17 bp, Homo sapiens
attcacatttgatgtac

SEQ ID NO: 1143861 - DNA, 23 bp, Homo sapiens
attcacatttgatgtacatgtgt

SEQ ID NO: 1143862 - DNA, 16 bp, Homo sapiens
attcaccaaaattatc

SEQ ID NO: 1143863 - DNA, 16 bp, Homo sapiens
attcaccagtgttcct

SEQ ID NO: 1143864 - DNA, 17 bp, Homo sapiens
attcaccccacacccag

SEQ ID NO: 1143865 - DNA, 17 bp, Homo sapiens
attcacccgaagcgctt

SEQ ID NO: 1143866 - DNA, 17 bp, Homo sapiens
attcaccctccacttcc

SEQ ID NO: 1143867 - DNA, 16 bp, Homo sapiens
attcaccctgggcagt

SEQ ID NO: 1143868 - DNA, 20 bp, Homo sapiens
attcacctatgttattttgt

SEQ ID NO: 1143869 - DNA, 12 bp, Homo sapiens
attcacctcagc

SEQ ID NO: 1143870 - DNA, 18 bp, Homo sapiens
attcacctcctaaaacaa

SEQ ID NO: 1143871 - DNA, 19 bp, Homo sapiens
attcacctcctaaaacaac

SEQ ID NO: 1143872 - DNA, 21 bp, Homo sapiens
attcacctcctaaaacaacag

SEQ ID NO: 1143873 - DNA, 14 bp, Homo sapiens
attcacctcttcct

SEQ ID NO: 1143874 - DNA, 17 bp, Homo sapiens
attcacctcttcctctg

SEQ ID NO: 1143875 - DNA, 24 bp, Homo sapiens
attcacctcttcctctggttcctt

SEQ ID NO: 1143876 - DNA, 14 bp, Homo sapiens
attcacctgtaaaa

SEQ ID NO: 1143877 - DNA, 21 bp, Homo sapiens
attcacgccattggttggaag

SEQ ID NO: 1143878 - DNA, 12 bp, Homo sapiens
attcactcccac

SEQ ID NO: 1143879 - DNA, 21 bp, Homo sapiens
attcactcccacacccaagaa

SEQ ID NO: 1143880 - DNA, 15 bp, Homo sapiens
attcactgcccccag

SEQ ID NO: 1143881 - DNA, 13 bp, Homo sapiens
attcactggcccc

SEQ ID NO: 1143882 - DNA, 19 bp, Homo sapiens
attcactggttttacacag

SEQ ID NO: 1143883 - DNA, 20 bp, Homo sapiens
attcactggttttacacaga

SEQ ID NO: 1143884 - DNA, 14 bp, Homo sapiens
attcactgtaagtt

SEQ ID NO: 1143885 - DNA, 23 bp, Homo sapiens
attcactgtgcactttgctcaaa

SEQ ID NO: 1143886 - DNA, 17 bp, Homo sapiens
attcactgtttcactga

SEQ ID NO: 1143887 - DNA, 20 bp, Homo sapiens
attcactttgacacttttca

SEQ ID NO: 1143888 - DNA, 19 bp, Homo sapiens
attcagaaaatgttctgtt

SEQ ID NO: 1143889 - DNA, 22 bp, Homo sapiens
attcagaaaatgttctgtttgc

SEQ ID NO: 1143890 - DNA, 14 bp, Homo sapiens
attcagaaattaaa

SEQ ID NO: 1143891 - DNA, 19 bp, Homo sapiens
attcagaaattaaaatatt

SEQ ID NO: 1143892 - DNA, 22 bp, Homo sapiens
attcagaaattaaaatattatt

SEQ ID NO: 1143893 - DNA, 14 bp, Homo sapiens
attcagaaattgga

SEQ ID NO: 1143894 - DNA, 20 bp, Homo sapiens
attcagaactaaatttttca

SEQ ID NO: 1143895 - DNA, 13 bp, Homo sapiens
attcagacaagca

SEQ ID NO: 1143896 - DNA, 14 bp, Homo sapiens
attcagacaggcaa

SEQ ID NO: 1143897 - DNA, 19 bp, Homo sapiens
attcagagactgcccttct

SEQ ID NO: 1143898 - DNA, 22 bp, Homo sapiens
attcagaggaagacatctgtag

SEQ ID NO: 1143899 - DNA, 12 bp, Homo sapiens
attcagaggcag

SEQ ID NO: 1143900 - DNA, 19 bp, Homo sapiens
attcagagtatgtttttaa

SEQ ID NO: 1143901 - DNA, 19 bp, Homo sapiens
attcagatcaaaatgcctt

SEQ ID NO: 1143902 - DNA, 16 bp, Homo sapiens
attcagatcactgaat

SEQ ID NO: 1143903 - DNA, 17 bp, Homo sapiens
acccctaccccctcatc

SEQ ID NO: 1143904 - DNA, 21 bp, Homo sapiens
acccctaccccctcatccccc

SEQ ID NO: 1143905 - DNA, 11 bp, Homo sapiens
acccctcacca

SEQ ID NO: 1143906 - DNA, 16 bp, Homo sapiens
acccctcaccttgcaa

SEQ ID NO: 1143907 - DNA, 23 bp, Homo sapiens
acccctcaccttgcaacacacag

SEQ ID NO: 1143908 - DNA, 15 bp, Homo sapiens
acccctcactctggc

SEQ ID NO: 1143909 - DNA, 18 bp, Homo sapiens
acccctcactctggcctc

SEQ ID NO: 1143910 - DNA, 11 bp, Homo sapiens
acccctccacg

SEQ ID NO: 1143911 - DNA, 16 bp, Homo sapiens
acccctccacgtgtcc

SEQ ID NO: 1143912 - DNA, 16 bp, Homo sapiens
acccctcccaacctca

SEQ ID NO: 1143913 - DNA, 19 bp, Homo sapiens
acccctcccattaggacaa

SEQ ID NO: 1143914 - DNA, 21 bp, Homo sapiens
acccctcccttgctcagtgcc

SEQ ID NO: 1143915 - DNA, 16 bp, Homo sapiens
acccctcgactcagca

SEQ ID NO: 1143916 - DNA, 17 bp, Homo sapiens
acccctcgactcagcac

SEQ ID NO: 1143917 - DNA, 20 bp, Homo sapiens
acccctcgcaaccctgcctg

SEQ ID NO: 1143918 - DNA, 18 bp, Homo sapiens
acccctcgccacctttca

SEQ ID NO: 1143919 - DNA, 14 bp, Homo sapiens
acccctctggccag

SEQ ID NO: 1143920 - DNA, 12 bp, Homo sapiens
acccctcttcca

SEQ ID NO: 1143921 - DNA, 15 bp, Homo sapiens
acccctgagcttgca

SEQ ID NO: 1143922 - DNA, 12 bp, Homo sapiens
acccctgccact

SEQ ID NO: 1143923 - DNA, 13 bp, Homo sapiens
acccctgccactc

SEQ ID NO: 1143924 - DNA, 16 bp, Homo sapiens
acccctgccactcacc

SEQ ID NO: 1143925 - DNA, 17 bp, Homo sapiens
acccctgccactcaccc

SEQ ID NO: 1143926 - DNA, 12 bp, Homo sapiens
acccctgccccc

SEQ ID NO: 1143927 - DNA, 13 bp, Homo sapiens
acccctgccccca

SEQ ID NO: 1143928 - DNA, 16 bp, Homo sapiens
attccagggctggggt

SEQ ID NO: 1143929 - DNA, 21 bp, Homo sapiens
attccaggtgtgcacagaaaa

SEQ ID NO: 1143930 - DNA, 16 bp, Homo sapiens
attccagtaacttttt

SEQ ID NO: 1143931 - DNA, 19 bp, Homo sapiens
attccagtaacttttttgt

SEQ ID NO: 1143932 - DNA, 20 bp, Homo sapiens
attccagtgctagaaaattt

SEQ ID NO: 1143933 - DNA, 17 bp, Homo sapiens
attccatatttattcaa

SEQ ID NO: 1143934 - DNA, 14 bp, Homo sapiens
attccatcttgtaa

SEQ ID NO: 1143935 - DNA, 13 bp, Homo sapiens
attccatgaatgt

SEQ ID NO: 1143936 - DNA, 17 bp, Homo sapiens
attccatgaatgtatca

SEQ ID NO: 1143937 - DNA, 17 bp, Homo sapiens
attccatgcccgagtcc

SEQ ID NO: 1143938 - DNA, 21 bp, Homo sapiens
attccatgtcagataagtgta

SEQ ID NO: 1143939 - DNA, 20 bp, Homo sapiens
attccattgcctagctcttt

SEQ ID NO: 1143940 - DNA, 16 bp, Homo sapiens
attccattgtgtgagt

SEQ ID NO: 1143941 - DNA, 14 bp, Homo sapiens
attcccaacatttc

SEQ ID NO: 1143942 - DNA, 18 bp, Homo sapiens
attcccaacatttcttaa

SEQ ID NO: 1143943 - DNA, 22 bp, Homo sapiens
attcccaacatttcttaaatta

SEQ ID NO: 1143944 - DNA, 17 bp, Homo sapiens
attcccaagtatgcctt

SEQ ID NO: 1143945 - DNA, 18 bp, Homo sapiens
attcccaagtatgcctta

SEQ ID NO: 1143946 - DNA, 22 bp, Homo sapiens
attcccacccaattcaaaacat

SEQ ID NO: 1143947 - DNA, 16 bp, Homo sapiens
attcccactcaccagc

SEQ ID NO: 1143948 - DNA, 17 bp, Homo sapiens
attcccactcaccagcc

SEQ ID NO: 1143949 - DNA, 19 bp, Homo sapiens
attcccactcaccagccct

SEQ ID NO: 1143950 - DNA, 21 bp, Homo sapiens
attcccactcaccagccctag

SEQ ID NO: 1143951 - DNA, 23 bp, Homo sapiens
attcccagaccttaagacactgt

SEQ ID NO: 1143952 - DNA, 12 bp, Homo sapiens
attcccagagac

SEQ ID NO: 1143953 - DNA, 16 bp, Homo sapiens
attcccagagacagga

SEQ ID NO: 1143954 - DNA, 20 bp, Homo sapiens
attccccaacggggtgggga

SEQ ID NO: 1143955 - DNA, 22 bp, Homo sapiens
attccccaggtggctgacccag

SEQ ID NO: 1143956 - DNA, 21 bp, Homo sapiens
attcccccccctttcctaaag

SEQ ID NO: 1143957 - DNA, 19 bp, Homo sapiens
attccccctgccctgtgcc

SEQ ID NO: 1143958 - DNA, 21 bp, Homo sapiens
attccccctgccctgtgccgc

SEQ ID NO: 1143959 - DNA, 16 bp, Homo sapiens
attcccccttaaactt

SEQ ID NO: 1143960 - DNA, 20 bp, Homo sapiens
attcccccttaaacttccaa

SEQ ID NO: 1143961 - DNA, 21 bp, Homo sapiens
attcccctatctctagaattt

SEQ ID NO: 1143962 - DNA, 20 bp, Homo sapiens
attcccctccccactcctct

SEQ ID NO: 1143963 - DNA, 22 bp, Homo sapiens
attcccctctgctgctgtccct

SEQ ID NO: 1143964 - DNA, 18 bp, Homo sapiens
attcccgttttgtcactt

SEQ ID NO: 1143965 - DNA, 21 bp, Homo sapiens
attcccgttttgtcacttttt

SEQ ID NO: 1143966 - DNA, 23 bp, Homo sapiens
attcccgttttgtcactttttct

SEQ ID NO: 1143967 - DNA, 21 bp, Homo sapiens
attccctatcttttagtttta

SEQ ID NO: 1143968 - DNA, 17 bp, Homo sapiens
attccctccccctcctt

SEQ ID NO: 1143969 - DNA, 18 bp, Homo sapiens
attccctctcctgcccag

SEQ ID NO: 1143970 - DNA, 17 bp, Homo sapiens
attccctgatttaatat

SEQ ID NO: 1143971 - DNA, 21 bp, Homo sapiens
attccctgcccaaacccttaa

SEQ ID NO: 1143972 - DNA, 21 bp, Homo sapiens
attcccttcagggattccctg

SEQ ID NO: 1143973 - DNA, 14 bp, Homo sapiens
attcccttcctgtt

SEQ ID NO: 1143974 - DNA, 12 bp, Homo sapiens
attcccttctgg

SEQ ID NO: 1143975 - DNA, 15 bp, Homo sapiens
attcccttctgggct

SEQ ID NO: 1143976 - DNA, 18 bp, Homo sapiens
attcccttgaattgtgta

SEQ ID NO: 1143977 - DNA, 14 bp, Homo sapiens
attcccttgtattt

SEQ ID NO: 1143978 - DNA, 17 bp, Homo sapiens
attcccttgtattttgt

SEQ ID NO: 1143979 - DNA, 13 bp, Homo sapiens
attcccttttaat

SEQ ID NO: 1143980 - DNA, 23 bp, Homo sapiens
attcccttttcaccttttcagga

SEQ ID NO: 1143981 - DNA, 19 bp, Homo sapiens
attcccttttgactcttcc

SEQ ID NO: 1143982 - DNA, 21 bp, Homo sapiens
attccgacaaccgatgctcca

SEQ ID NO: 1143983 - DNA, 13 bp, Homo sapiens
attccgagcattc

SEQ ID NO: 1143984 - DNA, 15 bp, Homo sapiens
attccgagcattcca

SEQ ID NO: 1143985 - DNA, 23 bp, Homo sapiens
attccgattagacctttatccag

SEQ ID NO: 1143986 - DNA, 23 bp, Homo sapiens
attccggccacatcattctgtgt

SEQ ID NO: 1143987 - DNA, 17 bp, Homo sapiens
attcctaaagaaaaata

SEQ ID NO: 1143988 - DNA, 18 bp, Homo sapiens
attcctaaagaaaaatat

SEQ ID NO: 1143989 - DNA, 14 bp, Homo sapiens
attcctaactagaa

SEQ ID NO: 1143990 - DNA, 18 bp, Homo sapiens
attcctaactagaattag

SEQ ID NO: 1143991 - DNA, 21 bp, Homo sapiens
attcctaagagtggaggagga

SEQ ID NO: 1143992 - DNA, 13 bp, Homo sapiens
attcctacagcac

SEQ ID NO: 1143993 - DNA, 14 bp, Homo sapiens
attcctacccctct

SEQ ID NO: 1143994 - DNA, 18 bp, Homo sapiens
attcctacccctcttcca

SEQ ID NO: 1143995 - DNA, 22 bp, Homo sapiens
attcctacccctcttccagctt

SEQ ID NO: 1143996 - DNA, 13 bp, Homo sapiens
attcctactccct

SEQ ID NO: 1143997 - DNA, 14 bp, Homo sapiens
attcctactccctc

SEQ ID NO: 1143998 - DNA, 20 bp, Homo sapiens
attcctactccctcttccaa

SEQ ID NO: 1143999 - DNA, 22 bp, Homo sapiens
attcctactccctcttccaaat

SEQ ID NO: 1144000 - DNA, 15 bp, Homo sapiens
attcctagataaaaa

SEQ ID NO: 1144001 - DNA, 20 bp, Homo sapiens
attcctagcaaatttctctc

SEQ ID NO: 1144002 - DNA, 21 bp, Homo sapiens
attcctatacgcagcgtgctt

SEQ ID NO: 1144003 - DNA, 22 bp, Homo sapiens
attcctatgatggatggcagac

SEQ ID NO: 1144004 - DNA, 16 bp, Homo sapiens
attcctcagattgctg

SEQ ID NO: 1144005 - DNA, 11 bp, Homo sapiens
attcctccctc

SEQ ID NO: 1144006 - DNA, 13 bp, Homo sapiens
attcctcctgctc

SEQ ID NO: 1144007 - DNA, 16 bp, Homo sapiens
attcctcctgctcata

SEQ ID NO: 1144008 - DNA, 10 bp, Homo sapiens
attcctcctt

SEQ ID NO: 1144009 - DNA, 12 bp, Homo sapiens
attcctccttcc

SEQ ID NO: 1144010 - DNA, 23 bp, Homo sapiens
attcctcgcgacatcttctcaac

SEQ ID NO: 1144011 - DNA, 23 bp, Homo sapiens
attcctctgataatatattttca

SEQ ID NO: 1144012 - DNA, 14 bp, Homo sapiens
attcctcttattgg

SEQ ID NO: 1144013 - DNA, 16 bp, Homo sapiens
attcctgaagccagat

SEQ ID NO: 1144014 - DNA, 19 bp, Homo sapiens
attcctgaatgaaatatca

SEQ ID NO: 1144015 - DNA, 12 bp, Homo sapiens
attcctggactt

SEQ ID NO: 1144016 - DNA, 16 bp, Homo sapiens
attcctggcatgacac

SEQ ID NO: 1144017 - DNA, 21 bp, Homo sapiens
attcctggcatgacactctag

SEQ ID NO: 1144018 - DNA, 16 bp, Homo sapiens
attcctggctctaccc

SEQ ID NO: 1144019 - DNA, 17 bp, Homo sapiens
attcctgggaaatattc

SEQ ID NO: 1144020 - DNA, 22 bp, Homo sapiens
attcctgggaaatattccctag

SEQ ID NO: 1144021 - DNA, 10 bp, Homo sapiens
attcctgggc

SEQ ID NO: 1144022 - DNA, 16 bp, Homo sapiens
attcctgtagcatctt

SEQ ID NO: 1144023 - DNA, 23 bp, Homo sapiens
attcctgtagcatcttctggagt

SEQ ID NO: 1144024 - DNA, 13 bp, Homo sapiens
attcctgtatgtt

SEQ ID NO: 1144025 - DNA, 16 bp, Homo sapiens
tctgacatcccttcct

SEQ ID NO: 1144026 - DNA, 17 bp, Homo sapiens
tctgacatcccttcctg

SEQ ID NO: 1144027 - DNA, 23 bp, Homo sapiens
tctgacatcccttcctggaaaca

SEQ ID NO: 1144028 - DNA, 23 bp, Homo sapiens
tctgacatgtaagaaaatgttac

SEQ ID NO: 1144029 - DNA, 18 bp, Homo sapiens
tctgacattaacagtttt

SEQ ID NO: 1144030 - DNA, 21 bp, Homo sapiens
tctgacattaacagttttcca

SEQ ID NO: 1144031 - DNA, 23 bp, Homo sapiens
tctgacattaacagttttccatg

SEQ ID NO: 1144032 - DNA, 16 bp, Homo sapiens
tctgaccagcagcgcc

SEQ ID NO: 1144033 - DNA, 21 bp, Homo sapiens
tctgaccatgaggtgggggtt

SEQ ID NO: 1144034 - DNA, 18 bp, Homo sapiens
tctgaccatttcaggggt

SEQ ID NO: 1144035 - DNA, 18 bp, Homo sapiens
tctgaccccacttatgct

SEQ ID NO: 1144036 - DNA, 21 bp, Homo sapiens
tctgaccccacttatgctgct

SEQ ID NO: 1144037 - DNA, 23 bp, Homo sapiens
tctgaccccacttatgctgctgt

SEQ ID NO: 1144038 - DNA, 22 bp, Homo sapiens
tctgaccccagtggaaaacaaa

SEQ ID NO: 1144039 - DNA, 12 bp, Homo sapiens
tctgaccctcct

SEQ ID NO: 1144040 - DNA, 17 bp, Homo sapiens
tctgaccctccttctat

SEQ ID NO: 1144041 - DNA, 16 bp, Homo sapiens
tctgaccctctcccca

SEQ ID NO: 1144042 - DNA, 12 bp, Homo sapiens
tctgacctctgc

SEQ ID NO: 1144043 - DNA, 14 bp, Homo sapiens
tctgacctctgctg

SEQ ID NO: 1144044 - DNA, 15 bp, Homo sapiens
tctgacctctgctga

SEQ ID NO: 1144045 - DNA, 22 bp, Homo sapiens
tctgacctctgctgagtgctgg

SEQ ID NO: 1144046 - DNA, 15 bp, Homo sapiens
tctgacctgcaggcc

SEQ ID NO: 1144047 - DNA, 19 bp, Homo sapiens
tctgacctgcaggccaaga

SEQ ID NO: 1144048 - DNA, 21 bp, Homo sapiens
tctgacctgcaggccaagagc

SEQ ID NO: 1144049 - DNA, 18 bp, Homo sapiens
tctgaccttccagagccc

SEQ ID NO: 1144050 - DNA, 21 bp, Homo sapiens
tctgaccttccagagcccaag

SEQ ID NO: 1144051 - DNA, 15 bp, Homo sapiens
tctgaccttgctgcc

SEQ ID NO: 1144052 - DNA, 22 bp, Homo sapiens
tctgacgcaccactgccaatgc

SEQ ID NO: 1144053 - DNA, 23 bp, Homo sapiens
tctgacgtcagcgcaccaaaact

SEQ ID NO: 1144054 - DNA, 13 bp, Homo sapiens
tctgactaattag

SEQ ID NO: 1144055 - DNA, 15 bp, Homo sapiens
tctgactaattaggc

SEQ ID NO: 1144056 - DNA, 21 bp, Homo sapiens
tctgactagtagatttctatg

SEQ ID NO: 1144057 - DNA, 14 bp, Homo sapiens
tctgactcacaaga

SEQ ID NO: 1144058 - DNA, 19 bp, Homo sapiens
tctgactcatatcccctat

SEQ ID NO: 1144059 - DNA, 16 bp, Homo sapiens
tctgactcatccccac

SEQ ID NO: 1144060 - DNA, 21 bp, Homo sapiens
tctgactccagagtctgagcc

SEQ ID NO: 1144061 - DNA, 18 bp, Homo sapiens
ttaaatgtttatactgta

SEQ ID NO: 1144062 - DNA, 16 bp, Homo sapiens
ttaaattaagtcattt

SEQ ID NO: 1144063 - DNA, 16 bp, Homo sapiens
ttaaattaatatcttt

SEQ ID NO: 1144064 - DNA, 12 bp, Homo sapiens
ttaaattacaat

SEQ ID NO: 1144065 - DNA, 17 bp, Homo sapiens
ttaaattacaattttat

SEQ ID NO: 1144066 - DNA, 11 bp, Homo sapiens
ttaaattacct

SEQ ID NO: 1144067 - DNA, 15 bp, Homo sapiens
ttaaattatgtttta

SEQ ID NO: 1144068 - DNA, 21 bp, Homo sapiens
ttaaattcagtcctaagaaag

SEQ ID NO: 1144069 - DNA, 13 bp, Homo sapiens
ttaaattcatttt

SEQ ID NO: 1144070 - DNA, 23 bp, Homo sapiens
ttaaattctctctcttgcaggaa

SEQ ID NO: 1144071 - DNA, 14 bp, Homo sapiens
ttaaattctgggtg

SEQ ID NO: 1144072 - DNA, 16 bp, Homo sapiens
ttaaattgcttttgtt

SEQ ID NO: 1144073 - DNA, 16 bp, Homo sapiens
ttaaattgtaaatttt

SEQ ID NO: 1144074 - DNA, 18 bp, Homo sapiens
ttaaattgtttcatatct

SEQ ID NO: 1144075 - DNA, 19 bp, Homo sapiens
ttaaattgtttcatatctg

SEQ ID NO: 1144076 - DNA, 15 bp, Homo sapiens
ttaaatttctaccgc

SEQ ID NO: 1144077 - DNA, 22 bp, Homo sapiens
ttaaatttcttatgtgacatta

SEQ ID NO: 1144078 - DNA, 23 bp, Homo sapiens
ttaaatttcttggcaaattttaa

SEQ ID NO: 1144079 - DNA, 15 bp, Homo sapiens
ttaaattttaattta

SEQ ID NO: 1144080 - DNA, 16 bp, Homo sapiens
ttaaattttacatgac

SEQ ID NO: 1144081 - DNA, 20 bp, Homo sapiens
ttaaattttaccctttagac

SEQ ID NO: 1144082 - DNA, 11 bp, Homo sapiens
ttaaattttat

SEQ ID NO: 1144083 - DNA, 14 bp, Homo sapiens
ttaaattttgtaat

SEQ ID NO: 1144084 - DNA, 22 bp, Homo sapiens
ttaaattttgttttctttttct

SEQ ID NO: 1144085 - DNA, 16 bp, Homo sapiens
ttaacttacatttgta

SEQ ID NO: 1144086 - DNA, 14 bp, Homo sapiens
ttaacttctctgga

SEQ ID NO: 1144087 - DNA, 21 bp, Homo sapiens
ttaacttcttcataattttag

SEQ ID NO: 1144088 - DNA, 14 bp, Homo sapiens
ttaacttcttgctt

SEQ ID NO: 1144089 - DNA, 17 bp, Homo sapiens
ttaacttcttgcttctt

SEQ ID NO: 1144090 - DNA, 19 bp, Homo sapiens
ttaacttgtttggtagtta

SEQ ID NO: 1144091 - DNA, 15 bp, Homo sapiens
ttaactttaaaactg

SEQ ID NO: 1144092 - DNA, 16 bp, Homo sapiens
ttaactttaaaactgt

SEQ ID NO: 1144093 - DNA, 19 bp, Homo sapiens
ttaactttaaaactgtatt

SEQ ID NO: 1144094 - DNA, 13 bp, Homo sapiens
ttaactttaccat

SEQ ID NO: 1144095 - DNA, 14 bp, Homo sapiens
ttaacttttaatgg

SEQ ID NO: 1144096 - DNA, 12 bp, Homo sapiens
ttaacttttata

SEQ ID NO: 1144097 - DNA, 14 bp, Homo sapiens
ttaacttttataaa

SEQ ID NO: 1144098 - DNA, 15 bp, Homo sapiens
ttaacttttataaac

SEQ ID NO: 1144099 - DNA, 13 bp, Homo sapiens
ttaagaaaaacaa

SEQ ID NO: 1144100 - DNA, 19 bp, Homo sapiens
ttaagaaaaaggatgcaca

SEQ ID NO: 1144101 - DNA, 21 bp, Homo sapiens
ttaagaaaaaggatgcacaga

SEQ ID NO: 1144102 - DNA, 16 bp, Homo sapiens
ttaagaaaaattcaca

SEQ ID NO: 1144103 - DNA, 13 bp, Homo sapiens
ttaagaaaacaag

SEQ ID NO: 1144104 - DNA, 22 bp, Homo sapiens
ttaagaaaatcatattgcttct

SEQ ID NO: 1144105 - DNA, 12 bp, Homo sapiens
ttaagaaacact

SEQ ID NO: 1144106 - DNA, 11 bp, Homo sapiens
ttaagaaagag

SEQ ID NO: 1144107 - DNA, 22 bp, Homo sapiens
ttaagaaatagacagcatgaga

SEQ ID NO: 1144108 - DNA, 12 bp, Homo sapiens
ttaagaactgct

SEQ ID NO: 1144109 - DNA, 13 bp, Homo sapiens
ttaagaactgctt

SEQ ID NO: 1144110 - DNA, 12 bp, Homo sapiens
ttaagaactgtg

SEQ ID NO: 1144111 - DNA, 21 bp, Homo sapiens
ttaagaagccctgcagagcac

SEQ ID NO: 1144112 - DNA, 16 bp, Homo sapiens
ttaagaatcttagata

SEQ ID NO: 1144113 - DNA, 14 bp, Homo sapiens
ttaagacactgtga

SEQ ID NO: 1144114 - DNA, 14 bp, Homo sapiens
ttaagaccagcctg

SEQ ID NO: 1144115 - DNA, 21 bp, Homo sapiens
ttaagactgagcacctgcttc

SEQ ID NO: 1144116 - DNA, 21 bp, Homo sapiens
ttaagactgataattttacaa

SEQ ID NO: 1144117 - DNA, 18 bp, Homo sapiens
ttaagactgattttaata

SEQ ID NO: 1144118 - DNA, 13 bp, Homo sapiens
ttaagactgtaat

SEQ ID NO: 1144119 - DNA, 18 bp, Homo sapiens
ttaagagacagagaatct

SEQ ID NO: 1144120 - DNA, 13 bp, Homo sapiens
ttaagagctattt

SEQ ID NO: 1144121 - DNA, 17 bp, Homo sapiens
ttaagtgtaaatgaagt

SEQ ID NO: 1144122 - DNA, 22 bp, Homo sapiens
ttaagttacacatttttcagat

SEQ ID NO: 1144123 - DNA, 14 bp, Homo sapiens
ttaagttatgtgtg

SEQ ID NO: 1144124 - DNA, 22 bp, Homo sapiens
ttaagttctttgatttgtacca

SEQ ID NO: 1144125 - DNA, 11 bp, Homo sapiens
ttaagttgaga

SEQ ID NO: 1144126 - DNA, 16 bp, Homo sapiens
ttaagttgtcaaagaa

SEQ ID NO: 1144127 - DNA, 22 bp, Homo sapiens
ttaagtttcaaacttactattt

SEQ ID NO: 1144128 - DNA, 13 bp, Homo sapiens
ttaagtttgtagt

SEQ ID NO: 1144129 - DNA, 18 bp, Homo sapiens
ttaagtttgtagtaaaag

SEQ ID NO: 1144130 - DNA, 19 bp, Homo sapiens
ttaagttttaaataaacct

SEQ ID NO: 1144131 - DNA, 12 bp, Homo sapiens
ttaagtttttca

SEQ ID NO: 1144132 - DNA, 13 bp, Homo sapiens
ttaataaaaagga

SEQ ID NO: 1144133 - DNA, 14 bp, Homo sapiens
ttaataaaaaggaa

SEQ ID NO: 1144134 - DNA, 20 bp, Homo sapiens
ttaataaaactgcacagtgc

SEQ ID NO: 1144135 - DNA, 21 bp, Homo sapiens
ttaataaaactgcacagtgct

SEQ ID NO: 1144136 - DNA, 16 bp, Homo sapiens
ttaataaaagtacatg

SEQ ID NO: 1144137 - DNA, 21 bp, Homo sapiens
ttaataaaatattcgaaattc

SEQ ID NO: 1144138 - DNA, 17 bp, Homo sapiens
ttaataaacatgtcaca

SEQ ID NO: 1144139 - DNA, 13 bp, Homo sapiens
ttaataaagaaat

SEQ ID NO: 1144140 - DNA, 21 bp, Homo sapiens
ttaataaagaattaacagaga

SEQ ID NO: 1144141 - DNA, 14 bp, Homo sapiens
ttaataaagatgag

SEQ ID NO: 1144142 - DNA, 16 bp, Homo sapiens
ttaataaagatgagtt

SEQ ID NO: 1144143 - DNA, 11 bp, Homo sapiens
ttaataaagca

SEQ ID NO: 1144144 - DNA, 12 bp, Homo sapiens
ttaataaagcat

SEQ ID NO: 1144145 - DNA, 13 bp, Homo sapiens
ttaataaagcatt

SEQ ID NO: 1144146 - DNA, 16 bp, Homo sapiens
ttaataaagcattctt

SEQ ID NO: 1144147 - DNA, 15 bp, Homo sapiens
ttaataaatatgtaa

SEQ ID NO: 1144148 - DNA, 13 bp, Homo sapiens
ttaataaattgct

SEQ ID NO: 1144149 - DNA, 22 bp, Homo sapiens
ttaataacaaggagatttctta

SEQ ID NO: 1144150 - DNA, 16 bp, Homo sapiens
ttaataacttgtccta

SEQ ID NO: 1144151 - DNA, 17 bp, Homo sapiens
ttaataagaacagatca

SEQ ID NO: 1144152 - DNA, 22 bp, Homo sapiens
ttaataagctactagcaaaata

SEQ ID NO: 1144153 - DNA, 14 bp, Homo sapiens
ttaataatatcaaa

SEQ ID NO: 1144154 - DNA, 24 bp, Homo sapiens
ttaataatcagcaagaatttgatc

SEQ ID NO: 1144155 - DNA, 17 bp, Homo sapiens
ttaataccaaatatttt

SEQ ID NO: 1144156 - DNA, 21 bp, Homo sapiens
ttaatactcaaatgagtaaca

SEQ ID NO: 1144157 - DNA, 17 bp, Homo sapiens
ttaatagacttctctta

SEQ ID NO: 1144158 - DNA, 20 bp, Homo sapiens
ttaatagacttctcttacat

SEQ ID NO: 1144159 - DNA, 21 bp, Homo sapiens
ttaatagacttctcttacatt

SEQ ID NO: 1144160 - DNA, 17 bp, Homo sapiens
ttaatagattatttcat

SEQ ID NO: 1144161 - DNA, 18 bp, Homo sapiens
ttaatagattatttcata

SEQ ID NO: 1144162 - DNA, 15 bp, Homo sapiens
cattcaaatttgtct

SEQ ID NO: 1144163 - DNA, 22 bp, Homo sapiens
cattcaactttagtatttttac

SEQ ID NO: 1144164 - DNA, 23 bp, Homo sapiens
cattcaactttagtatttttact

SEQ ID NO: 1144165 - DNA, 19 bp, Homo sapiens
cattcaagtgtaaaatatt

SEQ ID NO: 1144166 - DNA, 20 bp, Homo sapiens
cattcaagtgtaaaatattt

SEQ ID NO: 1144167 - DNA, 21 bp, Homo sapiens
cattcaagtgtaaaatatttt

SEQ ID NO: 1144168 - DNA, 22 bp, Homo sapiens
cattcaattagtggtcataaaa

SEQ ID NO: 1144169 - DNA, 20 bp, Homo sapiens
cattcaatttattcaagaaa

SEQ ID NO: 1144170 - DNA, 16 bp, Homo sapiens
cattcacaagcctcct

SEQ ID NO: 1144171 - DNA, 11 bp, Homo sapiens
cattcacagcc

SEQ ID NO: 1144172 - DNA, 12 bp, Homo sapiens
cattcacagccc

SEQ ID NO: 1144173 - DNA, 13 bp, Homo sapiens
cattcacagccca

SEQ ID NO: 1144174 - DNA, 14 bp, Homo sapiens
cattcacagcccag

SEQ ID NO: 1144175 - DNA, 19 bp, Homo sapiens
cattcacagcccagaacca

SEQ ID NO: 1144176 - DNA, 21 bp, Homo sapiens
cattcacatttgatgtacatg

SEQ ID NO: 1144177 - DNA, 13 bp, Homo sapiens
cattcacctgccc

SEQ ID NO: 1144178 - DNA, 13 bp, Homo sapiens
cattcactcttcc

SEQ ID NO: 1144179 - DNA, 13 bp, Homo sapiens
cattcactgtgca

SEQ ID NO: 1144180 - DNA, 18 bp, Homo sapiens
cattcacttgcatttctt

SEQ ID NO: 1144181 - DNA, 13 bp, Homo sapiens
cattcagaaaaaa

SEQ ID NO: 1144182 - DNA, 14 bp, Homo sapiens
cattcagaaaactt

SEQ ID NO: 1144183 - DNA, 14 bp, Homo sapiens
cattcagaaagctt

SEQ ID NO: 1144184 - DNA, 17 bp, Homo sapiens
cattcagagactgccct

SEQ ID NO: 1144185 - DNA, 22 bp, Homo sapiens
cattcagagactgcccttctca

SEQ ID NO: 1144186 - DNA, 15 bp, Homo sapiens
cattcagcaagacaa

SEQ ID NO: 1144187 - DNA, 13 bp, Homo sapiens
cattcaggaaaac

SEQ ID NO: 1144188 - DNA, 14 bp, Homo sapiens
cattcaggcagcac

SEQ ID NO: 1144189 - DNA, 18 bp, Homo sapiens
cattcagtatataaaata

SEQ ID NO: 1144190 - DNA, 16 bp, Homo sapiens
cattcatattaagaca

SEQ ID NO: 1144191 - DNA, 19 bp, Homo sapiens
cattcatccaggactgaga

SEQ ID NO: 1144192 - DNA, 21 bp, Homo sapiens
cattcatccaggactgagatg

SEQ ID NO: 1144193 - DNA, 22 bp, Homo sapiens
cattcatccaggactgagatgc

SEQ ID NO: 1144194 - DNA, 16 bp, Homo sapiens
cattcatgacaacatg

SEQ ID NO: 1144195 - DNA, 14 bp, Homo sapiens
cattcatgtaactc

SEQ ID NO: 1144196 - DNA, 15 bp, Homo sapiens
cattcatgtaactct

SEQ ID NO: 1144197 - DNA, 13 bp, Homo sapiens
cattcatttttat

SEQ ID NO: 1144198 - DNA, 16 bp, Homo sapiens
cattcatttttatagc

SEQ ID NO: 1144199 - DNA, 16 bp, Homo sapiens
cattccaaagctttat

SEQ ID NO: 1144200 - DNA, 18 bp, Homo sapiens
cattccaacaatggggtg

SEQ ID NO: 1144201 - DNA, 14 bp, Homo sapiens
cattccaagcctga

SEQ ID NO: 1144202 - DNA, 18 bp, Homo sapiens
cattccaagtcaacactc

SEQ ID NO: 1144203 - DNA, 20 bp, Homo sapiens
cattccaattctaaatccga

SEQ ID NO: 1144204 - DNA, 22 bp, Homo sapiens
cattccaccttcccatgccctg

SEQ ID NO: 1144205 - DNA, 14 bp, Homo sapiens
cattccacgtgccc

SEQ ID NO: 1144206 - DNA, 15 bp, Homo sapiens
cattccacgtgcccc

SEQ ID NO: 1144207 - DNA, 12 bp, Homo sapiens
cattccactcca

SEQ ID NO: 1144208 - DNA, 18 bp, Homo sapiens
cattccactgttggtatt

SEQ ID NO: 1144209 - DNA, 15 bp, Homo sapiens
cattccagcagctgc

SEQ ID NO: 1144210 - DNA, 16 bp, Homo sapiens
cattccagcagctgca

SEQ ID NO: 1144211 - DNA, 18 bp, Homo sapiens
cattccagcagctgcacc

SEQ ID NO: 1144212 - DNA, 17 bp, Homo sapiens
cattccagccaggccca

SEQ ID NO: 1144213 - DNA, 20 bp, Homo sapiens
cattccagccaggcccaggc

SEQ ID NO: 1144214 - DNA, 18 bp, Homo sapiens
cattccagctctgccccc

SEQ ID NO: 1144215 - DNA, 19 bp, Homo sapiens
cattccagctctgcccccg

SEQ ID NO: 1144216 - DNA, 23 bp, Homo sapiens
cattccagtaacttttttgtgta

SEQ ID NO: 1144217 - DNA, 21 bp, Homo sapiens
cattccagtacagtattcttt

SEQ ID NO: 1144218 - DNA, 19 bp, Homo sapiens
cattccagtgctagaaaat

SEQ ID NO: 1144219 - DNA, 18 bp, Homo sapiens
cattccatggaaataaaa

SEQ ID NO: 1144220 - DNA, 14 bp, Homo sapiens
cattcccaccaaca

SEQ ID NO: 1144221 - DNA, 12 bp, Homo sapiens
cattcccactgc

SEQ ID NO: 1144222 - DNA, 17 bp, Homo sapiens
cattcccagagtcagag

SEQ ID NO: 1144223 - DNA, 14 bp, Homo sapiens
cattcccagcccag

SEQ ID NO: 1144224 - DNA, 14 bp, Homo sapiens
cattcccaggaaaa

SEQ ID NO: 1144225 - DNA, 15 bp, Homo sapiens
cattcccatggtggc

SEQ ID NO: 1144226 - DNA, 14 bp, Homo sapiens
cattccccagagtg

SEQ ID NO: 1144227 - DNA, 17 bp, Homo sapiens
cattccccaggtggctg

SEQ ID NO: 1144228 - DNA, 11 bp, Homo sapiens
cattcccctcg

SEQ ID NO: 1144229 - DNA, 21 bp, Homo sapiens
cattccctctcatctcaggta

SEQ ID NO: 1144230 - DNA, 20 bp, Homo sapiens
cattccctctcctgcccaga

SEQ ID NO: 1144231 - DNA, 19 bp, Homo sapiens
cattccctgaatctgtgcc

SEQ ID NO: 1144232 - DNA, 11 bp, Homo sapiens
cattccctgag

SEQ ID NO: 1144233 - DNA, 12 bp, Homo sapiens
cattccctggga

SEQ ID NO: 1144234 - DNA, 20 bp, Homo sapiens
cattcctaacacagcatgtg

SEQ ID NO: 1144235 - DNA, 23 bp, Homo sapiens
cattcctaacacagcatgtgtat

SEQ ID NO: 1144236 - DNA, 14 bp, Homo sapiens
cattcctaactaga

SEQ ID NO: 1144237 - DNA, 22 bp, Homo sapiens
cattcctaactagaattagtat

SEQ ID NO: 1144238 - DNA, 15 bp, Homo sapiens
cattcctcagctgcc

SEQ ID NO: 1144239 - DNA, 16 bp, Homo sapiens
cattcctcagctgcca

SEQ ID NO: 1144240 - DNA, 17 bp, Homo sapiens
cattcctccagcctccc

SEQ ID NO: 1144241 - DNA, 19 bp, Homo sapiens
cattcctccagcctcccct

SEQ ID NO: 1144242 - DNA, 19 bp, Homo sapiens
cattcctgcctttaagcca

SEQ ID NO: 1144243 - DNA, 12 bp, Homo sapiens
cattcctggccc

SEQ ID NO: 1144244 - DNA, 18 bp, Homo sapiens
cattcctggtacccagcc

SEQ ID NO: 1144245 - DNA, 16 bp, Homo sapiens
cattccttacttgcac

SEQ ID NO: 1144246 - DNA, 17 bp, Homo sapiens
cattccttacttgcact

SEQ ID NO: 1144247 - DNA, 16 bp, Homo sapiens
cattccttcaaataaa

SEQ ID NO: 1144248 - DNA, 17 bp, Homo sapiens
cattccttctggcctct

SEQ ID NO: 1144249 - DNA, 23 bp, Homo sapiens
cattcgacctataagaagcctta

SEQ ID NO: 1144250 - DNA, 18 bp, Homo sapiens
cattcgaggtgtcaccct

SEQ ID NO: 1144251 - DNA, 20 bp, Homo sapiens
cattcgaggtgtcaccctgc

SEQ ID NO: 1144252 - DNA, 22 bp, Homo sapiens
cattcgcctttgtcttgtactt

SEQ ID NO: 1144253 - DNA, 19 bp, Homo sapiens
cattcggctccctggagcc

SEQ ID NO: 1144254 - DNA, 13 bp, Homo sapiens
cattcggtgtgaa

SEQ ID NO: 1144255 - DNA, 20 bp, Homo sapiens
cattcggtgtgaacttttct

SEQ ID NO: 1144256 - DNA, 17 bp, Homo sapiens
ctgtggccgtctcctcc

SEQ ID NO: 1144257 - DNA, 18 bp, Homo sapiens
ctgtggccgtctcctccc

SEQ ID NO: 1144258 - DNA, 20 bp, Homo sapiens
ctgtggccgtctcctccctc

SEQ ID NO: 1144259 - DNA, 20 bp, Homo sapiens
ctgtggccgttatctggaag

SEQ ID NO: 1144260 - DNA, 13 bp, Homo sapiens
ctgtggcctgggc

SEQ ID NO: 1144261 - DNA, 14 bp, Homo sapiens
ctgtggcctgtgtc

SEQ ID NO: 1144262 - DNA, 23 bp, Homo sapiens
ctgtggcgactctgcagagtcac

SEQ ID NO: 1144263 - DNA, 17 bp, Homo sapiens
ctgtggcgccgtctcca

SEQ ID NO: 1144264 - DNA, 16 bp, Homo sapiens
ctgtggcggccttccg

SEQ ID NO: 1144265 - DNA, 14 bp, Homo sapiens
ctgtggctcagggg

SEQ ID NO: 1144266 - DNA, 14 bp, Homo sapiens
ctgtggctctgcat

SEQ ID NO: 1144267 - DNA, 12 bp, Homo sapiens
ctgtggctggtg

SEQ ID NO: 1144268 - DNA, 12 bp, Homo sapiens
ctgtgggaagat

SEQ ID NO: 1144269 - DNA, 20 bp, Homo sapiens
ctgtgggaaggccagctgcc

SEQ ID NO: 1144270 - DNA, 21 bp, Homo sapiens
ctgtgggaccgcctggccctc

SEQ ID NO: 1144271 - DNA, 16 bp, Homo sapiens
ctgtgggagagcgaag

SEQ ID NO: 1144272 - DNA, 14 bp, Homo sapiens
ctgtgggagcctgc

SEQ ID NO: 1144273 - DNA, 14 bp, Homo sapiens
ctgtgggcagcacc

SEQ ID NO: 1144274 - DNA, 17 bp, Homo sapiens
ctgtgggcagcaccctc

SEQ ID NO: 1144275 - DNA, 21 bp, Homo sapiens
ctgtgggcaggcaagcccttc

SEQ ID NO: 1144276 - DNA, 19 bp, Homo sapiens
ctgtgggcatggccgcttc

SEQ ID NO: 1144277 - DNA, 11 bp, Homo sapiens
ctgtgggcctc

SEQ ID NO: 1144278 - DNA, 20 bp, Homo sapiens
ctgtgggcctcaaggacttg

SEQ ID NO: 1144279 - DNA, 23 bp, Homo sapiens
ctgtgggctacatgctggggtca

SEQ ID NO: 1144280 - DNA, 15 bp, Homo sapiens
ctgtgggcttcagca

SEQ ID NO: 1144281 - DNA, 21 bp, Homo sapiens
ctgtggggaaccaattgcttt

SEQ ID NO: 1144282 - DNA, 18 bp, Homo sapiens
ctgtggggatttctccca

SEQ ID NO: 1144283 - DNA, 20 bp, Homo sapiens
ctgtggggatttctcccagc

SEQ ID NO: 1144284 - DNA, 18 bp, Homo sapiens
ctgtggggcaggagtgcc

SEQ ID NO: 1144285 - DNA, 12 bp, Homo sapiens
cattctcccagg

SEQ ID NO: 1144286 - DNA, 15 bp, Homo sapiens
cattctcccaggtac

SEQ ID NO: 1144287 - DNA, 23 bp, Homo sapiens
cattctcccaggtaccagctgcg

SEQ ID NO: 1144288 - DNA, 11 bp, Homo sapiens
cattctcctgc

SEQ ID NO: 1144289 - DNA, 20 bp, Homo sapiens
cattctccttgtgttactaa

SEQ ID NO: 1144290 - DNA, 15 bp, Homo sapiens
cattctccttgttgt

SEQ ID NO: 1144291 - DNA, 16 bp, Homo sapiens
cattctcgcttccctg

SEQ ID NO: 1144292 - DNA, 17 bp, Homo sapiens
cattctctcccatcctg

SEQ ID NO: 1144293 - DNA, 15 bp, Homo sapiens
cattctctctcctgt

SEQ ID NO: 1144294 - DNA, 12 bp, Homo sapiens
cattctctgaag

SEQ ID NO: 1144295 - DNA, 13 bp, Homo sapiens
cattctctgaaga

SEQ ID NO: 1144296 - DNA, 19 bp, Homo sapiens
cattctctgtctcatccat

SEQ ID NO: 1144297 - DNA, 23 bp, Homo sapiens
cattctctgtctcatccatcatc

SEQ ID NO: 1144298 - DNA, 16 bp, Homo sapiens
cattctgaaggagccc

SEQ ID NO: 1144299 - DNA, 22 bp, Homo sapiens
cattctgaatcaagcacactgt

SEQ ID NO: 1144300 - DNA, 15 bp, Homo sapiens
cattctgaatgcttc

SEQ ID NO: 1144301 - DNA, 12 bp, Homo sapiens
cattctgaatta

SEQ ID NO: 1144302 - DNA, 15 bp, Homo sapiens
cattctgactcatat

SEQ ID NO: 1144303 - DNA, 23 bp, Homo sapiens
cattctgactcggtttctccaaa

SEQ ID NO: 1144304 - DNA, 16 bp, Homo sapiens
cattctgataggaggg

SEQ ID NO: 1144305 - DNA, 19 bp, Homo sapiens
cattctgataggagggggc

SEQ ID NO: 1144306 - DNA, 23 bp, Homo sapiens
cattctgattcgaatgacactgt

SEQ ID NO: 1144307 - DNA, 11 bp, Homo sapiens
cattctgcaag

SEQ ID NO: 1144308 - DNA, 17 bp, Homo sapiens
cattctgcaagtatact

SEQ ID NO: 1144309 - DNA, 18 bp, Homo sapiens
cattctgcattgctagat

SEQ ID NO: 1144310 - DNA, 19 bp, Homo sapiens
cattctgcattgctagata

SEQ ID NO: 1144311 - DNA, 22 bp, Homo sapiens
cattctgccgccccctcctgaa

SEQ ID NO: 1144312 - DNA, 23 bp, Homo sapiens
cattctgccgccccctcctgaac

SEQ ID NO: 1144313 - DNA, 17 bp, Homo sapiens
cattctgcctagagtgt

SEQ ID NO: 1144314 - DNA, 15 bp, Homo sapiens
cattctgcctctcct

SEQ ID NO: 1144315 - DNA, 16 bp, Homo sapiens
cattctgcctgctcca

SEQ ID NO: 1144316 - DNA, 17 bp, Homo sapiens
cattctgcctgctccat

SEQ ID NO: 1144317 - DNA, 19 bp, Homo sapiens
cattctgcctgctccatcg

SEQ ID NO: 1144318 - DNA, 14 bp, Homo sapiens
cattctggaaactt

SEQ ID NO: 1144319 - DNA, 20 bp, Homo sapiens
cattctggaggggagagctt

SEQ ID NO: 1144320 - DNA, 23 bp, Homo sapiens
cattctggatctgaccctcccag

SEQ ID NO: 1144321 - DNA, 17 bp, Homo sapiens
cattctggtctcgtctt

SEQ ID NO: 1144322 - DNA, 18 bp, Homo sapiens
cattctggtctcgtcttc

SEQ ID NO: 1144323 - DNA, 19 bp, Homo sapiens
cattctggtgaccagactt

SEQ ID NO: 1144324 - DNA, 17 bp, Homo sapiens
cattctgtgtctctgca

SEQ ID NO: 1144325 - DNA, 17 bp, Homo sapiens
cattctgtgtgtatcta

SEQ ID NO: 1144326 - DNA, 17 bp, Homo sapiens
cattctgtttcctcttg

SEQ ID NO: 1144327 - DNA, 16 bp, Homo sapiens
cattctgttttccccc

SEQ ID NO: 1144328 - DNA, 22 bp, Homo sapiens
cattctgttttcccccagcaac

SEQ ID NO: 1144329 - DNA, 24 bp, Homo sapiens
cattcttacaattgcactgctgtt

SEQ ID NO: 1144330 - DNA, 19 bp, Homo sapiens
cattcttactaaaaagtat

SEQ ID NO: 1144331 - DNA, 22 bp, Homo sapiens
cattcttcaaaccagtgttttg

SEQ ID NO: 1144332 - DNA, 21 bp, Homo sapiens
cattcttcaggtcgtagcatt

SEQ ID NO: 1144333 - DNA, 14 bp, Homo sapiens
cattcttcagtgtc

SEQ ID NO: 1144334 - DNA, 15 bp, Homo sapiens
cattcttccatcatc

SEQ ID NO: 1144335 - DNA, 18 bp, Homo sapiens
cattcttccatcatcact

SEQ ID NO: 1144336 - DNA, 19 bp, Homo sapiens
cattcttccatcatcactg

SEQ ID NO: 1144337 - DNA, 23 bp, Homo sapiens
cattcttccatcatcactgtaaa

SEQ ID NO: 1144338 - DNA, 11 bp, Homo sapiens
cattcttcccg

SEQ ID NO: 1144339 - DNA, 14 bp, Homo sapiens
cattcttcttgcta

SEQ ID NO: 1144340 - DNA, 18 bp, Homo sapiens
cattcttgagttttgata

SEQ ID NO: 1144341 - DNA, 20 bp, Homo sapiens
cattcttgagttttgataaa

SEQ ID NO: 1144342 - DNA, 12 bp, Homo sapiens
cattcttggctt

SEQ ID NO: 1144343 - DNA, 16 bp, Homo sapiens
cattcttggttgttaa

SEQ ID NO: 1144344 - DNA, 19 bp, Homo sapiens
cattcttgtcacaataaat

SEQ ID NO: 1144345 - DNA, 23 bp, Homo sapiens
cattcttgtgggagacagcagcc

SEQ ID NO: 1144346 - DNA, 18 bp, Homo sapiens
cattctttataaaatgta

SEQ ID NO: 1144347 - DNA, 24 bp, Homo sapiens
cattctttataatcctctgtaaaa

SEQ ID NO: 1144348 - DNA, 15 bp, Homo sapiens
cattctttcagctgt

SEQ ID NO: 1144349 - DNA, 19 bp, Homo sapiens
cattctttcccctcagagc

SEQ ID NO: 1144350 - DNA, 19 bp, Homo sapiens
cattctttttctgttgaaa

SEQ ID NO: 1144351 - DNA, 16 bp, Homo sapiens
cattgaaagagaacca

SEQ ID NO: 1144352 - DNA, 19 bp, Homo sapiens
cattgaaagagaaccagtt

SEQ ID NO: 1144353 - DNA, 16 bp, Homo sapiens
cattgaaatacttttt

SEQ ID NO: 1144354 - DNA, 16 bp, Homo sapiens
cattgaaatcagcatg

SEQ ID NO: 1144355 - DNA, 21 bp, Homo sapiens
cattgaaatcagcatgacaaa

SEQ ID NO: 1144356 - DNA, 22 bp, Homo sapiens
cattgaaatctaggaaaattat

SEQ ID NO: 1144357 - DNA, 16 bp, Homo sapiens
cattgaaatgagcacc

SEQ ID NO: 1144358 - DNA, 14 bp, Homo sapiens
cattgaacacaaac

SEQ ID NO: 1144359 - DNA, 18 bp, Homo sapiens
cattgaacacaaactgta

SEQ ID NO: 1144360 - DNA, 13 bp, Homo sapiens
cattgaacagctg

SEQ ID NO: 1144361 - DNA, 20 bp, Homo sapiens
cattgaagaagaaccagccc

SEQ ID NO: 1144362 - DNA, 11 bp, Homo sapiens
cattgaagaga

SEQ ID NO: 1144363 - DNA, 18 bp, Homo sapiens
cattgaagcagatttctg

SEQ ID NO: 1144364 - DNA, 20 bp, Homo sapiens
cattgaagccgactctggcc

SEQ ID NO: 1144365 - DNA, 21 bp, Homo sapiens
cattgaagccgactctggccc

SEQ ID NO: 1144366 - DNA, 18 bp, Homo sapiens
cattgaagtaatgaattt

SEQ ID NO: 1144367 - DNA, 13 bp, Homo sapiens
cattgaagtatat

SEQ ID NO: 1144368 - DNA, 16 bp, Homo sapiens
cattgaattcattata

SEQ ID NO: 1144369 - DNA, 21 bp, Homo sapiens
cattgaattcttggttgagga

SEQ ID NO: 1144370 - DNA, 22 bp, Homo sapiens
cattgaattcttggttgaggaa

SEQ ID NO: 1144371 - DNA, 22 bp, Homo sapiens
cattgacagtggtgggcgggga

SEQ ID NO: 1144372 - DNA, 15 bp, Homo sapiens
cattgaccaagaact

SEQ ID NO: 1144373 - DNA, 21 bp, Homo sapiens
cattgaccaagaactgcatgg

SEQ ID NO: 1144374 - DNA, 13 bp, Homo sapiens
cattgacctcagc

SEQ ID NO: 1144375 - DNA, 17 bp, Homo sapiens
cattgacctcagctgca

SEQ ID NO: 1144376 - DNA, 18 bp, Homo sapiens
cattgactatcaaactga

SEQ ID NO: 1144377 - DNA, 22 bp, Homo sapiens
cattgactatcaaactgaagcc

SEQ ID NO: 1144378 - DNA, 23 bp, Homo sapiens
cattgactcctttccaatagaaa

SEQ ID NO: 1144379 - DNA, 15 bp, Homo sapiens
cattgagcatatttt

SEQ ID NO: 1144380 - DNA, 17 bp, Homo sapiens
cattgagtgctggggga

SEQ ID NO: 1144381 - DNA, 14 bp, Homo sapiens
cattgataatcttc

SEQ ID NO: 1144382 - DNA, 19 bp, Homo sapiens
ctgtgtgcgtggtgtggcc

SEQ ID NO: 1144383 - DNA, 21 bp, Homo sapiens
ctgtgtgcgtggtgtggcccg

SEQ ID NO: 1144384 - DNA, 15 bp, Homo sapiens
ctgtgtgcttggtct

SEQ ID NO: 1144385 - DNA, 12 bp, Homo sapiens
ctgtgtgcttgt

SEQ ID NO: 1144386 - DNA, 13 bp, Homo sapiens
ctgtgtgcttttt

SEQ ID NO: 1144387 - DNA, 22 bp, Homo sapiens
ctgtgtggatgctgagctgtga

SEQ ID NO: 1144388 - DNA, 19 bp, Homo sapiens
ctgtgtgggatacttagtg

SEQ ID NO: 1144389 - DNA, 20 bp, Homo sapiens
ctgtgtgggatacttagtgg

SEQ ID NO: 1144390 - DNA, 17 bp, Homo sapiens
ctgtgtgtgtcccctca

SEQ ID NO: 1144391 - DNA, 14 bp, Homo sapiens
ctgtgtgtgtgaat

SEQ ID NO: 1144392 - DNA, 21 bp, Homo sapiens
ctgtgtgtgtgaatgaacact

SEQ ID NO: 1144393 - DNA, 19 bp, Homo sapiens
ctgtgtgtttgacatgtga

SEQ ID NO: 1144394 - DNA, 16 bp, Homo sapiens
ctgtgtgttttcataa

SEQ ID NO: 1144395 - DNA, 18 bp, Homo sapiens
ctgtgtgttttcataata

SEQ ID NO: 1144396 - DNA, 19 bp, Homo sapiens
ctgtgtgttttcataataa

SEQ ID NO: 1144397 - DNA, 23 bp, Homo sapiens
ctgtgttactaaaaaaaagatga

SEQ ID NO: 1144398 - DNA, 14 bp, Homo sapiens
ctgtgttactgctt

SEQ ID NO: 1144399 - DNA, 22 bp, Homo sapiens
ctgtgttactgctttgcaaaga

SEQ ID NO: 1144400 - DNA, 20 bp, Homo sapiens
ctgtgttaggatgcggcttt

SEQ ID NO: 1144401 - DNA, 22 bp, Homo sapiens
ctgtgttaggatgcggctttct

SEQ ID NO: 1144402 - DNA, 14 bp, Homo sapiens
ctgtgttagtgtct

SEQ ID NO: 1144403 - DNA, 16 bp, Homo sapiens
ctgtgttagtgtctgt

SEQ ID NO: 1144404 - DNA, 13 bp, Homo sapiens
ctgtgttcccaga

SEQ ID NO: 1144405 - DNA, 12 bp, Homo sapiens
ctgtgttcctgg

SEQ ID NO: 1144406 - DNA, 22 bp, Homo sapiens
cggggtttcaccatgttggcca

SEQ ID NO: 1144407 - DNA, 11 bp, Homo sapiens
cgggtcactgc

SEQ ID NO: 1144408 - DNA, 14 bp, Homo sapiens
cgggtcagtaggga

SEQ ID NO: 1144409 - DNA, 16 bp, Homo sapiens
cgggtcctcagctgct

SEQ ID NO: 1144410 - DNA, 19 bp, Homo sapiens
cgggtcctcagctgctccc

SEQ ID NO: 1144411 - DNA, 15 bp, Homo sapiens
cgggtctatggggag

SEQ ID NO: 1144412 - DNA, 18 bp, Homo sapiens
cgggtctcgcagcctgaa

SEQ ID NO: 1144413 - DNA, 20 bp, Homo sapiens
cgggtctcgcagcctgaagc

SEQ ID NO: 1144414 - DNA, 20 bp, Homo sapiens
cgggtgaacaaagcagccac

SEQ ID NO: 1144415 - DNA, 17 bp, Homo sapiens
cgggtgacgcccacctt

SEQ ID NO: 1144416 - DNA, 22 bp, Homo sapiens
cgggtgacgcccaccttcgggc

SEQ ID NO: 1144417 - DNA, 18 bp, Homo sapiens
cgggtgatggccagcccc

SEQ ID NO: 1144418 - DNA, 20 bp, Homo sapiens
cgggtgcctcagagcaggct

SEQ ID NO: 1144419 - DNA, 23 bp, Homo sapiens
cgggtggaaaagaatccctgcag

SEQ ID NO: 1144420 - DNA, 19 bp, Homo sapiens
cgggtggatcacctgaggt

SEQ ID NO: 1144421 - DNA, 13 bp, Homo sapiens
cgggtgggcctgg

SEQ ID NO: 1144422 - DNA, 16 bp, Homo sapiens
cgggtgggcctggcct

SEQ ID NO: 1144423 - DNA, 18 bp, Homo sapiens
cgggtgggcctggcctga

SEQ ID NO: 1144424 - DNA, 12 bp, Homo sapiens
cgggtggtcccc

SEQ ID NO: 1144425 - DNA, 17 bp, Homo sapiens
cgggtgtgcctgccctg

SEQ ID NO: 1144426 - DNA, 19 bp, Homo sapiens
cgggtgtggcacgcacctg

SEQ ID NO: 1144427 - DNA, 21 bp, Homo sapiens
cgggtgtggcacgcacctgta

SEQ ID NO: 1144428 - DNA, 23 bp, Homo sapiens
cgggtgtggcacgcacctgtagt

SEQ ID NO: 1144429 - DNA, 14 bp, Homo sapiens
cgggtgtggcctca

SEQ ID NO: 1144430 - DNA, 15 bp, Homo sapiens
cgggtgtgggaaagc

SEQ ID NO: 1144431 - DNA, 20 bp, Homo sapiens
cgggttcaagtgactctcct

SEQ ID NO: 1144432 - DNA, 16 bp, Homo sapiens
cgggttccgcaggcag

SEQ ID NO: 1144433 - DNA, 19 bp, Homo sapiens
cgggttctagacgcccctc

SEQ ID NO: 1144434 - DNA, 23 bp, Homo sapiens
cgggtttggcgggccaaggactg

SEQ ID NO: 1144435 - DNA, 15 bp, Homo sapiens
cggtaactgtcctgt

SEQ ID NO: 1144436 - DNA, 13 bp, Homo sapiens
cggtaagtgttct

SEQ ID NO: 1144437 - DNA, 15 bp, Homo sapiens
cggtacaagttctgg

SEQ ID NO: 1144438 - DNA, 24 bp, Homo sapiens
cggtacaagttctggcaagagcag

SEQ ID NO: 1144439 - DNA, 18 bp, Homo sapiens
cggtaggcgaccaccgcc

SEQ ID NO: 1144440 - DNA, 19 bp, Homo sapiens
cggtatcctccctgcccat

SEQ ID NO: 1144441 - DNA, 16 bp, Homo sapiens
cggtcaggtttaacat

SEQ ID NO: 1144442 - DNA, 17 bp, Homo sapiens
cggtcatagtttcctga

SEQ ID NO: 1144443 - DNA, 13 bp, Homo sapiens
cggtccaaagtta

SEQ ID NO: 1144444 - DNA, 11 bp, Homo sapiens
cggtccagctg

SEQ ID NO: 1144445 - DNA, 14 bp, Homo sapiens
cggtccagctggcc

SEQ ID NO: 1144446 - DNA, 15 bp, Homo sapiens
cggtccagctggcct

SEQ ID NO: 1144447 - DNA, 16 bp, Homo sapiens
cggtccagctggcctg

SEQ ID NO: 1144448 - DNA, 14 bp, Homo sapiens
cggtcccacactgg

SEQ ID NO: 1144449 - DNA, 12 bp, Homo sapiens
cggtcccagctc

SEQ ID NO: 1144450 - DNA, 13 bp, Homo sapiens
cggtcccagctcc

SEQ ID NO: 1144451 - DNA, 21 bp, Homo sapiens
cggtcccagttttgttgcccc

SEQ ID NO: 1144452 - DNA, 22 bp, Homo sapiens
cggtccccacagactgccccag

SEQ ID NO: 1144453 - DNA, 21 bp, Homo sapiens
cggtcccttgagacctcagcc

SEQ ID NO: 1144454 - DNA, 23 bp, Homo sapiens
cggtcccttgagacctcagccat

SEQ ID NO: 1144455 - DNA, 15 bp, Homo sapiens
cggtccggcgccccg

SEQ ID NO: 1144456 - DNA, 21 bp, Homo sapiens
cggtcctttaggcagcctgcc

SEQ ID NO: 1144457 - DNA, 22 bp, Homo sapiens
cggtcctttaggcagcctgccg

SEQ ID NO: 1144458 - DNA, 16 bp, Homo sapiens
cggtcgggcagccagc

SEQ ID NO: 1144459 - DNA, 19 bp, Homo sapiens
cggtcgggcagccagcaga

SEQ ID NO: 1144460 - DNA, 20 bp, Homo sapiens
cggtctcccaaagtgctggg

SEQ ID NO: 1144461 - DNA, 14 bp, Homo sapiens
cggtctcccttccg

SEQ ID NO: 1144462 - DNA, 18 bp, Homo sapiens
cggtctcccttccgtcca

SEQ ID NO: 1144463 - DNA, 16 bp, Homo sapiens
cggtctgacagtcctt

SEQ ID NO: 1144464 - DNA, 14 bp, Homo sapiens
cggtgacacaggtc

SEQ ID NO: 1144465 - DNA, 17 bp, Homo sapiens
cggtgacacaggtcagg

SEQ ID NO: 1144466 - DNA, 20 bp, Homo sapiens
cggtgacacaggtcagggct

SEQ ID NO: 1144467 - DNA, 22 bp, Homo sapiens
cggtgaccccatcactcgcagg

SEQ ID NO: 1144468 - DNA, 12 bp, Homo sapiens
cggtgagccggg

SEQ ID NO: 1144469 - DNA, 16 bp, Homo sapiens
cggtgaggggaggggc

SEQ ID NO: 1144470 - DNA, 13 bp, Homo sapiens
cggtgcagtctgg

SEQ ID NO: 1144471 - DNA, 18 bp, Homo sapiens
cggtgcccaagccagagg

SEQ ID NO: 1144472 - DNA, 13 bp, Homo sapiens
cggtgcccacacc

SEQ ID NO: 1144473 - DNA, 19 bp, Homo sapiens
cggtgcctgggtggccatc

SEQ ID NO: 1144474 - DNA, 19 bp, Homo sapiens
cggtgcctgggtggggctg

SEQ ID NO: 1144475 - DNA, 11 bp, Homo sapiens
cggtgcctggt

SEQ ID NO: 1144476 - DNA, 17 bp, Homo sapiens
cggtgcggcagggaaga

SEQ ID NO: 1144477 - DNA, 18 bp, Homo sapiens
cggtgcgtggctgtggca

SEQ ID NO: 1144478 - DNA, 22 bp, Homo sapiens
cggtgctatttctattccttat

SEQ ID NO: 1144479 - DNA, 22 bp, Homo sapiens
cggtgctcactcccaagggaca

SEQ ID NO: 1144480 - DNA, 12 bp, Homo sapiens
cggtgctctggc

SEQ ID NO: 1144481 - DNA, 14 bp, Homo sapiens
cggtgctctggcgg

SEQ ID NO: 1144482 - DNA, 13 bp, Homo sapiens
cggtgctgcagga

SEQ ID NO: 1144483 - DNA, 19 bp, Homo sapiens
cggtgctgggggcacagct

SEQ ID NO: 1144484 - DNA, 17 bp, Homo sapiens
cggtgctgtcctcaggt

SEQ ID NO: 1144485 - DNA, 21 bp, Homo sapiens
cggtgctgtcctcaggtggcc

SEQ ID NO: 1144486 - DNA, 16 bp, Homo sapiens
cggtgctgtgagggag

SEQ ID NO: 1144487 - DNA, 19 bp, Homo sapiens
cggtgctgtgagggagggg

SEQ ID NO: 1144488 - DNA, 16 bp, Homo sapiens
cggtgcttctggaaac

SEQ ID NO: 1144489 - DNA, 13 bp, Homo sapiens
cggtggaggaagg

SEQ ID NO: 1144490 - DNA, 21 bp, Homo sapiens
cggtggaggaaggctctgtca

SEQ ID NO: 1144491 - DNA, 14 bp, Homo sapiens
cggtggaggccagg

SEQ ID NO: 1144492 - DNA, 14 bp, Homo sapiens
cggtggccacagcg

SEQ ID NO: 1144493 - DNA, 19 bp, Homo sapiens
cggtggcctattccaggaa

SEQ ID NO: 1144494 - DNA, 20 bp, Homo sapiens
cggtggcggctgcacaacag

SEQ ID NO: 1144495 - DNA, 21 bp, Homo sapiens
cggtggctagtcaagctcctc

SEQ ID NO: 1144496 - DNA, 22 bp, Homo sapiens
cggtggctagtcaagctcctcc

SEQ ID NO: 1144497 - DNA, 11 bp, Homo sapiens
cggtggctcac

SEQ ID NO: 1144498 - DNA, 20 bp, Homo sapiens
cggtggctcaggcctataac

SEQ ID NO: 1144499 - DNA, 14 bp, Homo sapiens
cggtggctctgggg

SEQ ID NO: 1144500 - DNA, 14 bp, Homo sapiens
cggtggctgccccg

SEQ ID NO: 1144501 - DNA, 18 bp, Homo sapiens
cggtgggcacccaccctg

SEQ ID NO: 1144502 - DNA, 23 bp, Homo sapiens
cggtgggcacccaccctgggacc

SEQ ID NO: 1144503 - DNA, 19 bp, Homo sapiens
cggtgggcatttgtgaggc

SEQ ID NO: 1144504 - DNA, 14 bp, Homo sapiens
cggtgggtcacaca

SEQ ID NO: 1144505 - DNA, 17 bp, Homo sapiens
cggtggtgcccgtgccc

SEQ ID NO: 1144506 - DNA, 20 bp, Homo sapiens
cggtggtgcccgtgcccgca

SEQ ID NO: 1144507 - DNA, 20 bp, Homo sapiens
cggtggtttgccatgtcgct

SEQ ID NO: 1144508 - DNA, 17 bp, Homo sapiens
cggtgtatcctggccct

SEQ ID NO: 1144509 - DNA, 21 bp, Homo sapiens
cggtgtatcctggccctgggg

SEQ ID NO: 1144510 - DNA, 17 bp, Homo sapiens
cggtgtcaggtcccagc

SEQ ID NO: 1144511 - DNA, 15 bp, Homo sapiens
cggtgtccatttata

SEQ ID NO: 1144512 - DNA, 15 bp, Homo sapiens
cggtgtgcaccaggg

SEQ ID NO: 1144513 - DNA, 18 bp, Homo sapiens
gccctcccttctccctgg

SEQ ID NO: 1144514 - DNA, 13 bp, Homo sapiens
gccctccgcctgg

SEQ ID NO: 1144515 - DNA, 15 bp, Homo sapiens
gccctccgcctggga

SEQ ID NO: 1144516 - DNA, 16 bp, Homo sapiens
gccctccgcctgggat

SEQ ID NO: 1144517 - DNA, 18 bp, Homo sapiens
gccctcctaccctgcgcc

SEQ ID NO: 1144518 - DNA, 16 bp, Homo sapiens
gccctcctctgcactc

SEQ ID NO: 1144519 - DNA, 16 bp, Homo sapiens
gccctcctgagcctcc

SEQ ID NO: 1144520 - DNA, 12 bp, Homo sapiens
gccctcctgccc

SEQ ID NO: 1144521 - DNA, 23 bp, Homo sapiens
gccctcctgcccacgggaggaca

SEQ ID NO: 1144522 - DNA, 10 bp, Homo sapiens
gccctcctgg

SEQ ID NO: 1144523 - DNA, 12 bp, Homo sapiens
gccctcctgtgc

SEQ ID NO: 1144524 - DNA, 10 bp, Homo sapiens
gccctccttc

SEQ ID NO: 1144525 - DNA, 16 bp, Homo sapiens
gccctccttccctcct

SEQ ID NO: 1144526 - DNA, 17 bp, Homo sapiens
gccctccttccctcctg

SEQ ID NO: 1144527 - DNA, 21 bp, Homo sapiens
gccctccttccctcctgtgcc

SEQ ID NO: 1144528 - DNA, 18 bp, Homo sapiens
cattaaatcaatcaggaa

SEQ ID NO: 1144529 - DNA, 13 bp, Homo sapiens
cattaaatccgca

SEQ ID NO: 1144530 - DNA, 13 bp, Homo sapiens
cattaaatggaat

SEQ ID NO: 1144531 - DNA, 22 bp, Homo sapiens
cattaaattactatagcaaagt

SEQ ID NO: 1144532 - DNA, 18 bp, Homo sapiens
cattaaattcacaaactt

SEQ ID NO: 1144533 - DNA, 16 bp, Homo sapiens
cattaacagttttcca

SEQ ID NO: 1144534 - DNA, 17 bp, Homo sapiens
cattaacagttttccat

SEQ ID NO: 1144535 - DNA, 20 bp, Homo sapiens
cattaacagttttccatgaa

SEQ ID NO: 1144536 - DNA, 16 bp, Homo sapiens
cattaacggtgctaaa

SEQ ID NO: 1144537 - DNA, 17 bp, Homo sapiens
cattaacggtgctaaaa

SEQ ID NO: 1144538 - DNA, 17 bp, Homo sapiens
cattaactaaatgctca

SEQ ID NO: 1144539 - DNA, 15 bp, Homo sapiens
cattaactcattaga

SEQ ID NO: 1144540 - DNA, 19 bp, Homo sapiens
cattaactccctccaccag

SEQ ID NO: 1144541 - DNA, 16 bp, Homo sapiens
cattaacttctctgga

SEQ ID NO: 1144542 - DNA, 13 bp, Homo sapiens
cattaagaaaatc

SEQ ID NO: 1144543 - DNA, 14 bp, Homo sapiens
cattaagaaaatca

SEQ ID NO: 1144544 - DNA, 13 bp, Homo sapiens
cattaagcacaca

SEQ ID NO: 1144545 - DNA, 24 bp, Homo sapiens
cattaagcacacacatctggccct

SEQ ID NO: 1144546 - DNA, 13 bp, Homo sapiens
cattaagcttttt

SEQ ID NO: 1144547 - DNA, 14 bp, Homo sapiens
cattaagctttttt

SEQ ID NO: 1144548 - DNA, 23 bp, Homo sapiens
cattaaggtatttcgaaactgcc

SEQ ID NO: 1144549 - DNA, 20 bp, Homo sapiens
cattaagtaatctttttaca

SEQ ID NO: 1144550 - DNA, 17 bp, Homo sapiens
cattaagtcagtggctt

SEQ ID NO: 1144551 - DNA, 23 bp, Homo sapiens
cattaagtggtagtaatttcctt

SEQ ID NO: 1144552 - DNA, 16 bp, Homo sapiens
cattaataaaaatcaa

SEQ ID NO: 1144553 - DNA, 18 bp, Homo sapiens
cattaatagcagcctttc

SEQ ID NO: 1144554 - DNA, 16 bp, Homo sapiens
cattaatatatggaat

SEQ ID NO: 1144555 - DNA, 22 bp, Homo sapiens
cattaatcaatcatctgtgtga

SEQ ID NO: 1144556 - DNA, 22 bp, Homo sapiens
cattaatccacatgtttcagag

SEQ ID NO: 1144557 - DNA, 13 bp, Homo sapiens
cattaatctcaaa

SEQ ID NO: 1144558 - DNA, 16 bp, Homo sapiens
cattaatctcaaagag

SEQ ID NO: 1144559 - DNA, 19 bp, Homo sapiens
cattaatgatgatcttcag

SEQ ID NO: 1144560 - DNA, 13 bp, Homo sapiens
cattaatgcccag

SEQ ID NO: 1144561 - DNA, 15 bp, Homo sapiens
cattaatgcccagcc

SEQ ID NO: 1144562 - DNA, 23 bp, Homo sapiens
cattaatgcctgctttttggaaa

SEQ ID NO: 1144563 - DNA, 21 bp, Homo sapiens
cattaatgttaattcagcact

SEQ ID NO: 1144564 - DNA, 23 bp, Homo sapiens
cattaatgttaattcagcactga

SEQ ID NO: 1144565 - DNA, 15 bp, Homo sapiens
cattaattacataca

SEQ ID NO: 1144566 - DNA, 20 bp, Homo sapiens
cattaattacatacagattt

SEQ ID NO: 1144567 - DNA, 16 bp, Homo sapiens
cattaattattaatac

SEQ ID NO: 1144568 - DNA, 20 bp, Homo sapiens
cattaattattattgctgtt

SEQ ID NO: 1144569 - DNA, 18 bp, Homo sapiens
cattaatttaaatgattt

SEQ ID NO: 1144570 - DNA, 14 bp, Homo sapiens
cattaattttgtgc

SEQ ID NO: 1144571 - DNA, 19 bp, Homo sapiens
cattaattttgtgcattct

SEQ ID NO: 1144572 - DNA, 17 bp, Homo sapiens
cattacaagtattttta

SEQ ID NO: 1144573 - DNA, 21 bp, Homo sapiens
cattacagagaggagaaacac

SEQ ID NO: 1144574 - DNA, 16 bp, Homo sapiens
cattacagcttaatca

SEQ ID NO: 1144575 - DNA, 22 bp, Homo sapiens
cattacagtatccaatgtcttt

SEQ ID NO: 1144576 - DNA, 21 bp, Homo sapiens
cattacagtgggtgcccccct

SEQ ID NO: 1144577 - DNA, 15 bp, Homo sapiens
cattacatagaacac

SEQ ID NO: 1144578 - DNA, 19 bp, Homo sapiens
cattacatgtttaaattgt

SEQ ID NO: 1144579 - DNA, 21 bp, Homo sapiens
cattacatgtttaaattgtaa

SEQ ID NO: 1144580 - DNA, 20 bp, Homo sapiens
cattaccaaaataataaaaa

SEQ ID NO: 1144581 - DNA, 23 bp, Homo sapiens
cattaccccataccccttattgc

SEQ ID NO: 1144582 - DNA, 19 bp, Homo sapiens
cattacccttccctgcact

SEQ ID NO: 1144583 - DNA, 22 bp, Homo sapiens
cattaccgcgttgtaaaatata

SEQ ID NO: 1144584 - DNA, 17 bp, Homo sapiens
cattactacactggtgt

SEQ ID NO: 1144585 - DNA, 13 bp, Homo sapiens
cattactactgta

SEQ ID NO: 1144586 - DNA, 14 bp, Homo sapiens
cattactactgtac

SEQ ID NO: 1144587 - DNA, 19 bp, Homo sapiens
cattactagatattaaaag

SEQ ID NO: 1144588 - DNA, 22 bp, Homo sapiens
cattactgaggggattctctac

SEQ ID NO: 1144589 - DNA, 13 bp, Homo sapiens
cattactgggcct

SEQ ID NO: 1144590 - DNA, 14 bp, Homo sapiens
cattactgtccttt

SEQ ID NO: 1144591 - DNA, 18 bp, Homo sapiens
cattacttgctttcaatt

SEQ ID NO: 1144592 - DNA, 15 bp, Homo sapiens
cattacttgtataaa

SEQ ID NO: 1144593 - DNA, 14 bp, Homo sapiens
cattagaaaaagag

SEQ ID NO: 1144594 - DNA, 18 bp, Homo sapiens
cattagaaatattttaaa

SEQ ID NO: 1144595 - DNA, 13 bp, Homo sapiens
cattagaatgtga

SEQ ID NO: 1144596 - DNA, 17 bp, Homo sapiens
cattagaatgtgatttt

SEQ ID NO: 1144597 - DNA, 18 bp, Homo sapiens
cattagaattaccatttg

SEQ ID NO: 1144598 - DNA, 14 bp, Homo sapiens
cattagatgtcatg

SEQ ID NO: 1144599 - DNA, 21 bp, Homo sapiens
cattaggaattaagttatctt

SEQ ID NO: 1144600 - DNA, 13 bp, Homo sapiens
cattaggaattgt

SEQ ID NO: 1144601 - DNA, 20 bp, Homo sapiens
cattaggaattgtttataca

SEQ ID NO: 1144602 - DNA, 22 bp, Homo sapiens
cattaggacaatcagtcccctc

SEQ ID NO: 1144603 - DNA, 21 bp, Homo sapiens
cattaggcaaagtacaaaatt

SEQ ID NO: 1144604 - DNA, 22 bp, Homo sapiens
cattaggtgtgactgaatttct

SEQ ID NO: 1144605 - DNA, 20 bp, Homo sapiens
cattagtgtccccccttgaa

SEQ ID NO: 1144606 - DNA, 16 bp, Homo sapiens
cattataaaaacactt

SEQ ID NO: 1144607 - DNA, 18 bp, Homo sapiens
cattataaccttaattta

SEQ ID NO: 1144608 - DNA, 22 bp, Homo sapiens
cattataatctcaaaggagaaa

SEQ ID NO: 1144609 - DNA, 15 bp, Homo sapiens
cattatatttgcatt

SEQ ID NO: 1144610 - DNA, 17 bp, Homo sapiens
cattatcgggagcagtg

SEQ ID NO: 1144611 - DNA, 23 bp, Homo sapiens
cattatcgggagcagtgtcttcc

SEQ ID NO: 1144612 - DNA, 24 bp, Homo sapiens
cattatctagttcattgaatcatt

SEQ ID NO: 1144613 - DNA, 16 bp, Homo sapiens
cattatctgagttgca

SEQ ID NO: 1144614 - DNA, 12 bp, Homo sapiens
cattatgaaaaa

SEQ ID NO: 1144615 - DNA, 23 bp, Homo sapiens
gcctgggcagccaggctgccaag

SEQ ID NO: 1144616 - DNA, 14 bp, Homo sapiens
gcctgggccagaga

SEQ ID NO: 1144617 - DNA, 20 bp, Homo sapiens
gcctgggccatgcgaggggc

SEQ ID NO: 1144618 - DNA, 23 bp, Homo sapiens
gcctgggcccatctccctgcttt

SEQ ID NO: 1144619 - DNA, 14 bp, Homo sapiens
gcctgggcccctcc

SEQ ID NO: 1144620 - DNA, 17 bp, Homo sapiens
gcctgggcccctcccct

SEQ ID NO: 1144621 - DNA, 18 bp, Homo sapiens
gcctgggcccctcccctc

SEQ ID NO: 1144622 - DNA, 23 bp, Homo sapiens
gcctgggcccctcccctcagagc

SEQ ID NO: 1144623 - DNA, 16 bp, Homo sapiens
gcctgggccgctgcca

SEQ ID NO: 1144624 - DNA, 18 bp, Homo sapiens
gcctgggccgctgccacg

SEQ ID NO: 1144625 - DNA, 19 bp, Homo sapiens
gcctgggccgtggcacagc

SEQ ID NO: 1144626 - DNA, 14 bp, Homo sapiens
gcctgggcctgctt

SEQ ID NO: 1144627 - DNA, 16 bp, Homo sapiens
gcctgggcctgtgcag

SEQ ID NO: 1144628 - DNA, 19 bp, Homo sapiens
gcctgggcctgtgcagcag

SEQ ID NO: 1144629 - DNA, 20 bp, Homo sapiens
gcctgggcctgtgcagcagc

SEQ ID NO: 1144630 - DNA, 15 bp, Homo sapiens
gcctgggcgacagag

SEQ ID NO: 1144631 - DNA, 22 bp, Homo sapiens
gcctgggctcactgtgctgggg

SEQ ID NO: 1144632 - DNA, 13 bp, Homo sapiens
gcctgggctccct

SEQ ID NO: 1144633 - DNA, 20 bp, Homo sapiens
gcctgggctccctcttgtgg

SEQ ID NO: 1144634 - DNA, 23 bp, Homo sapiens
gcctgggctcccttgtgcgtggg

SEQ ID NO: 1144635 - DNA, 15 bp, Homo sapiens
gcctgggctgggaaa

SEQ ID NO: 1144636 - DNA, 14 bp, Homo sapiens
gcctggggaggccc

SEQ ID NO: 1144637 - DNA, 14 bp, Homo sapiens
gcctggggcccaag

SEQ ID NO: 1144638 - DNA, 20 bp, Homo sapiens
gcctggggcctccagaagct

SEQ ID NO: 1144639 - DNA, 16 bp, Homo sapiens
gcctggggcctgagag

SEQ ID NO: 1144640 - DNA, 22 bp, Homo sapiens
gcctggggctcctttctccagc

SEQ ID NO: 1144641 - DNA, 15 bp, Homo sapiens
gcctggggctctctg

SEQ ID NO: 1144642 - DNA, 14 bp, Homo sapiens
gcctggggctggcc

SEQ ID NO: 1144643 - DNA, 20 bp, Homo sapiens
gcctgggggcagtgactggc

SEQ ID NO: 1144644 - DNA, 15 bp, Homo sapiens
gcctgggggtggggg

SEQ ID NO: 1144645 - DNA, 19 bp, Homo sapiens
tcctgcagccccagaagaa

SEQ ID NO: 1144646 - DNA, 18 bp, Homo sapiens
tcctgcagcctcctcctg

SEQ ID NO: 1144647 - DNA, 13 bp, Homo sapiens
tcctgcagcctgc

SEQ ID NO: 1144648 - DNA, 17 bp, Homo sapiens
tcctgcagcctgcagga

SEQ ID NO: 1144649 - DNA, 23 bp, Homo sapiens
tcctgcaggaacgagcactggcc

SEQ ID NO: 1144650 - DNA, 15 bp, Homo sapiens
tcctgcagggcttct

SEQ ID NO: 1144651 - DNA, 11 bp, Homo sapiens
tcctgcagggg

SEQ ID NO: 1144652 - DNA, 14 bp, Homo sapiens
tcctgcagtttggg

SEQ ID NO: 1144653 - DNA, 14 bp, Homo sapiens
tcctgcatgttctg

SEQ ID NO: 1144654 - DNA, 16 bp, Homo sapiens
tcctgcatttgtgaaa

SEQ ID NO: 1144655 - DNA, 18 bp, Homo sapiens
tcctgccacatggagccc

SEQ ID NO: 1144656 - DNA, 18 bp, Homo sapiens
tcctgccaccagcatcca

SEQ ID NO: 1144657 - DNA, 14 bp, Homo sapiens
tcctgccaccagtc

SEQ ID NO: 1144658 - DNA, 19 bp, Homo sapiens
tcctgccaccccttcctcc

SEQ ID NO: 1144659 - DNA, 12 bp, Homo sapiens
tcctgccagctg

SEQ ID NO: 1144660 - DNA, 15 bp, Homo sapiens
tcctgccagctgcct

SEQ ID NO: 1144661 - DNA, 22 bp, Homo sapiens
tcctgccaggcacacacagccc

SEQ ID NO: 1144662 - DNA, 14 bp, Homo sapiens
tcctgccaggcatg

SEQ ID NO: 1144663 - DNA, 13 bp, Homo sapiens
tcctgccaggccg

SEQ ID NO: 1144664 - DNA, 23 bp, Homo sapiens
tcctgcccaagcacttcacagct

SEQ ID NO: 1144665 - DNA, 15 bp, Homo sapiens
tcctgcccaccctac

SEQ ID NO: 1144666 - DNA, 16 bp, Homo sapiens
tcctgcccaccctacc

SEQ ID NO: 1144667 - DNA, 21 bp, Homo sapiens
tcctgcccaccctaccagctc

SEQ ID NO: 1144668 - DNA, 23 bp, Homo sapiens
tcctgcccaccctaccagctcct

SEQ ID NO: 1144669 - DNA, 18 bp, Homo sapiens
tcctgcccacgggaggac

SEQ ID NO: 1144670 - DNA, 14 bp, Homo sapiens
tcctgcccagctcc

SEQ ID NO: 1144671 - DNA, 19 bp, Homo sapiens
tcctgcccagctcctcaca

SEQ ID NO: 1144672 - DNA, 15 bp, Homo sapiens
tcctgcccaggactg

SEQ ID NO: 1144673 - DNA, 13 bp, Homo sapiens
tcctgcccaggag

SEQ ID NO: 1144674 - DNA, 14 bp, Homo sapiens
tcctgcccaggaga

SEQ ID NO: 1144675 - DNA, 18 bp, Homo sapiens
tcctgcccaggagagcca

SEQ ID NO: 1144676 - DNA, 13 bp, Homo sapiens
tcctgcccatgtg

SEQ ID NO: 1144677 - DNA, 19 bp, Homo sapiens
tcctgcccatgtgtcccct

SEQ ID NO: 1144678 - DNA, 14 bp, Homo sapiens
tcctgcccccaagt

SEQ ID NO: 1144679 - DNA, 15 bp, Homo sapiens
tcctgccccctgcca

SEQ ID NO: 1144680 - DNA, 23 bp, Homo sapiens
tcctgccctacagaggtctctgc

SEQ ID NO: 1144681 - DNA, 18 bp, Homo sapiens
tcctgccctccggaggag

SEQ ID NO: 1144682 - DNA, 23 bp, Homo sapiens
tcctgccctccggaggagcagcc

SEQ ID NO: 1144683 - DNA, 18 bp, Homo sapiens
tcctgccctctgctctgc

SEQ ID NO: 1144684 - DNA, 23 bp, Homo sapiens
tcctgccctctgctctgcctgga

SEQ ID NO: 1144685 - DNA, 14 bp, Homo sapiens
tcctgccctgcagc

SEQ ID NO: 1144686 - DNA, 14 bp, Homo sapiens
tcctgccctgtcca

SEQ ID NO: 1144687 - DNA, 18 bp, Homo sapiens
tcctgccctgtccctgtc

SEQ ID NO: 1144688 - DNA, 18 bp, Homo sapiens
tcctgccctgttgtgtat

SEQ ID NO: 1144689 - DNA, 10 bp, Homo sapiens
tcctgccctt

SEQ ID NO: 1144690 - DNA, 14 bp, Homo sapiens
tcctgcccttccct

SEQ ID NO: 1144691 - DNA, 22 bp, Homo sapiens
tcctgcccttccctctgggcac

SEQ ID NO: 1144692 - DNA, 19 bp, Homo sapiens
tcctgcccttcctcagttt

SEQ ID NO: 1144693 - DNA, 12 bp, Homo sapiens
tcctgcccttga

SEQ ID NO: 1144694 - DNA, 14 bp, Homo sapiens
tcctgccgactcct

SEQ ID NO: 1144695 - DNA, 15 bp, Homo sapiens
tcctgccgactcctg

SEQ ID NO: 1144696 - DNA, 16 bp, Homo sapiens
tcctgccggtgggacc

SEQ ID NO: 1144697 - DNA, 19 bp, Homo sapiens
tcctgcctcagcctcccaa

SEQ ID NO: 1144698 - DNA, 18 bp, Homo sapiens
tcctgcctcagccttcca

SEQ ID NO: 1144699 - DNA, 20 bp, Homo sapiens
tcctgcctcagccttctgag

SEQ ID NO: 1144700 - DNA, 13 bp, Homo sapiens
tcctgcctcctca

SEQ ID NO: 1144701 - DNA, 23 bp, Homo sapiens
tcctgcctcttgtttctgtgccc

SEQ ID NO: 1144702 - DNA, 20 bp, Homo sapiens
tcctgcctgagtttccagcc

SEQ ID NO: 1144703 - DNA, 14 bp, Homo sapiens
tcctgcctggccag

SEQ ID NO: 1144704 - DNA, 16 bp, Homo sapiens
tcctgcctgtctgccc

SEQ ID NO: 1144705 - DNA, 19 bp, Homo sapiens
tcctgcctgtctgccccag

SEQ ID NO: 1144706 - DNA, 12 bp, Homo sapiens
tcctgcctgtgc

SEQ ID NO: 1144707 - DNA, 14 bp, Homo sapiens
tcctgcctgtgctg

SEQ ID NO: 1144708 - DNA, 12 bp, Homo sapiens
tcctgcctgtgg

SEQ ID NO: 1144709 - DNA, 16 bp, Homo sapiens
tcctgccttcctcctg

SEQ ID NO: 1144710 - DNA, 14 bp, Homo sapiens
tcctgcctttaagc

SEQ ID NO: 1144711 - DNA, 23 bp, Homo sapiens
tcctgcctttaagccaaagaaac

SEQ ID NO: 1144712 - DNA, 19 bp, Homo sapiens
tcctgcggagtgaagaggg

SEQ ID NO: 1144713 - DNA, 16 bp, Homo sapiens
tcctgcggctcagcct

SEQ ID NO: 1144714 - DNA, 15 bp, Homo sapiens
tcctgcggctgcctg

SEQ ID NO: 1144715 - DNA, 23 bp, Homo sapiens
tcctgcgggcttttccccggtcc

SEQ ID NO: 1144716 - DNA, 13 bp, Homo sapiens
tcctgcgggtggg

SEQ ID NO: 1144717 - DNA, 16 bp, Homo sapiens
tcctgcgggttttaat

SEQ ID NO: 1144718 - DNA, 21 bp, Homo sapiens
tcctgcgggttttaatttatt

SEQ ID NO: 1144719 - DNA, 16 bp, Homo sapiens
tcctgcgtcctcctca

SEQ ID NO: 1144720 - DNA, 18 bp, Homo sapiens
tcctgctaagttaatgtt

SEQ ID NO: 1144721 - DNA, 18 bp, Homo sapiens
tcctgctacaagtgtttt

SEQ ID NO: 1144722 - DNA, 21 bp, Homo sapiens
tcctgctacctcccttgcctt

SEQ ID NO: 1144723 - DNA, 14 bp, Homo sapiens
tcctgctagcaggc

SEQ ID NO: 1144724 - DNA, 15 bp, Homo sapiens
tcctgctagcaggcc

SEQ ID NO: 1144725 - DNA, 16 bp, Homo sapiens
tcctgctagcaggccc

SEQ ID NO: 1144726 - DNA, 17 bp, Homo sapiens
tcctgctagcaggcccc

SEQ ID NO: 1144727 - DNA, 20 bp, Homo sapiens
tcctgctatattaacatcat

SEQ ID NO: 1144728 - DNA, 19 bp, Homo sapiens
tcctgctatgacagctggc

SEQ ID NO: 1144729 - DNA, 21 bp, Homo sapiens
tcctgctatgacagctggcta

SEQ ID NO: 1144730 - DNA, 15 bp, Homo sapiens
tcctgctcatattgt

SEQ ID NO: 1144731 - DNA, 22 bp, Homo sapiens
tcctgctcattatgccacttcc

SEQ ID NO: 1144732 - DNA, 14 bp, Homo sapiens
tcctgctccagtgt

SEQ ID NO: 1144733 - DNA, 20 bp, Homo sapiens
tcctgctccatgactggctg

SEQ ID NO: 1144734 - DNA, 20 bp, Homo sapiens
tcctgctccctgtggcactc

SEQ ID NO: 1144735 - DNA, 13 bp, Homo sapiens
tcctgctccgtgg

SEQ ID NO: 1144736 - DNA, 10 bp, Homo sapiens
tcctgctcct

SEQ ID NO: 1144737 - DNA, 22 bp, Homo sapiens
tcctgggcaggtgggagctgaa

SEQ ID NO: 1144738 - DNA, 23 bp, Homo sapiens
tcctgggccctctctgctctgcg

SEQ ID NO: 1144739 - DNA, 10 bp, Homo sapiens
tcctgggcct

SEQ ID NO: 1144740 - DNA, 15 bp, Homo sapiens
tcctgggcctgtccc

SEQ ID NO: 1144741 - DNA, 18 bp, Homo sapiens
tcctgggcctttgcaaga

SEQ ID NO: 1144742 - DNA, 16 bp, Homo sapiens
tcctgggcgccctgga

SEQ ID NO: 1144743 - DNA, 13 bp, Homo sapiens
tcctgggctcagg

SEQ ID NO: 1144744 - DNA, 19 bp, Homo sapiens
tcctgggctctgaacacac

SEQ ID NO: 1144745 - DNA, 19 bp, Homo sapiens
tcctggggagctcctggga

SEQ ID NO: 1144746 - DNA, 14 bp, Homo sapiens
tcctggggcagaga

SEQ ID NO: 1144747 - DNA, 22 bp, Homo sapiens
tcctggggcagagaagttcctt

SEQ ID NO: 1144748 - DNA, 20 bp, Homo sapiens
tcctggggcagcactcccca

SEQ ID NO: 1144749 - DNA, 15 bp, Homo sapiens
tcctggggccccgct

SEQ ID NO: 1144750 - DNA, 17 bp, Homo sapiens
tcctggggccccgctgg

SEQ ID NO: 1144751 - DNA, 20 bp, Homo sapiens
tcctggggccccgctgggat

SEQ ID NO: 1144752 - DNA, 13 bp, Homo sapiens
tcctggggccgcc

SEQ ID NO: 1144753 - DNA, 15 bp, Homo sapiens
tcctggggccgcctg

SEQ ID NO: 1144754 - DNA, 16 bp, Homo sapiens
tcctggggccgcctgc

SEQ ID NO: 1144755 - DNA, 21 bp, Homo sapiens
tcctggggccgcctgccctgc

SEQ ID NO: 1144756 - DNA, 21 bp, Homo sapiens
tcctggggcctcggagcctca

SEQ ID NO: 1144757 - DNA, 18 bp, Homo sapiens
tcctggggctctgtgcag

SEQ ID NO: 1144758 - DNA, 14 bp, Homo sapiens
tcctgggggacctt

SEQ ID NO: 1144759 - DNA, 16 bp, Homo sapiens
tcctgggggctggctc

SEQ ID NO: 1144760 - DNA, 21 bp, Homo sapiens
tcctgggggctggctcccagg

SEQ ID NO: 1144761 - DNA, 13 bp, Homo sapiens
tcctgggggtggc

SEQ ID NO: 1144762 - DNA, 22 bp, Homo sapiens
tcctgggtgggtggggtacagg

SEQ ID NO: 1144763 - DNA, 16 bp, Homo sapiens
tcctgggttggaggga

SEQ ID NO: 1144764 - DNA, 19 bp, Homo sapiens
tcctgggttgtttccagga

SEQ ID NO: 1144765 - DNA, 21 bp, Homo sapiens
tcctgggttttgtattctctg

SEQ ID NO: 1144766 - DNA, 16 bp, Homo sapiens
tcctggtaattaaaag

SEQ ID NO: 1144767 - DNA, 23 bp, Homo sapiens
tcctggtacagcagggtcttgct

SEQ ID NO: 1144768 - DNA, 15 bp, Homo sapiens
tcctggtacccagcc

SEQ ID NO: 1144769 - DNA, 13 bp, Homo sapiens
tcctggtcctgga

SEQ ID NO: 1144770 - DNA, 14 bp, Homo sapiens
tcctggtcctggac

SEQ ID NO: 1144771 - DNA, 23 bp, Homo sapiens
tcctggtcctggacacctcccag

SEQ ID NO: 1144772 - DNA, 20 bp, Homo sapiens
tcctggtcctggctgcactc

SEQ ID NO: 1144773 - DNA, 17 bp, Homo sapiens
tcctggtcttgagatgt

SEQ ID NO: 1144774 - DNA, 15 bp, Homo sapiens
gccttaaaacatact

SEQ ID NO: 1144775 - DNA, 17 bp, Homo sapiens
gccttaaaaccaaagag

SEQ ID NO: 1144776 - DNA, 20 bp, Homo sapiens
gccttaaaaggagagaagaa

SEQ ID NO: 1144777 - DNA, 22 bp, Homo sapiens
gccttaaaaggagagaagaaag

SEQ ID NO: 1144778 - DNA, 16 bp, Homo sapiens
gccttaaaaggggccc

SEQ ID NO: 1144779 - DNA, 15 bp, Homo sapiens
gccttaaacacacat

SEQ ID NO: 1144780 - DNA, 20 bp, Homo sapiens
gccttaaacactcaccttct

SEQ ID NO: 1144781 - DNA, 20 bp, Homo sapiens
gccttaaacctacctcccac

SEQ ID NO: 1144782 - DNA, 15 bp, Homo sapiens
gccttaaacctgaag

SEQ ID NO: 1144783 - DNA, 23 bp, Homo sapiens
gccttaaagagggacaggctgaa

SEQ ID NO: 1144784 - DNA, 21 bp, Homo sapiens
gccttaactaagactcccgcc

SEQ ID NO: 1144785 - DNA, 16 bp, Homo sapiens
gccttaagcagaacaa

SEQ ID NO: 1144786 - DNA, 14 bp, Homo sapiens
gccttaagctgatc

SEQ ID NO: 1144787 - DNA, 19 bp, Homo sapiens
gccttaataaaaaatgaaa

SEQ ID NO: 1144788 - DNA, 17 bp, Homo sapiens
gccttaataaatatgta

SEQ ID NO: 1144789 - DNA, 19 bp, Homo sapiens
gccttaataaatatgtaat

SEQ ID NO: 1144790 - DNA, 22 bp, Homo sapiens
gccttaataaatatgtaatata

SEQ ID NO: 1144791 - DNA, 23 bp, Homo sapiens
gccttaatacttttttattttgt

SEQ ID NO: 1144792 - DNA, 16 bp, Homo sapiens
gccttacatcttttct

SEQ ID NO: 1144793 - DNA, 19 bp, Homo sapiens
gccttaccctcatgttctt

SEQ ID NO: 1144794 - DNA, 12 bp, Homo sapiens
gccttacctcct

SEQ ID NO: 1144795 - DNA, 14 bp, Homo sapiens
gccttacctcctgc

SEQ ID NO: 1144796 - DNA, 16 bp, Homo sapiens
gccttacctcctgccc

SEQ ID NO: 1144797 - DNA, 20 bp, Homo sapiens
gccttagaaatgtaaactgc

SEQ ID NO: 1144798 - DNA, 22 bp, Homo sapiens
gccttagaaatgtaaactgcca

SEQ ID NO: 1144799 - DNA, 17 bp, Homo sapiens
gccttagaacctttctt

SEQ ID NO: 1144800 - DNA, 16 bp, Homo sapiens
gccttagcatgtgact

SEQ ID NO: 1144801 - DNA, 22 bp, Homo sapiens
gccttagcatgtgactcctgaa

SEQ ID NO: 1144802 - DNA, 18 bp, Homo sapiens
gccttagtctcagtttgt

SEQ ID NO: 1144803 - DNA, 12 bp, Homo sapiens
gccttagtgggc

SEQ ID NO: 1144804 - DNA, 16 bp, Homo sapiens
gccttagttaccctga

SEQ ID NO: 1144805 - DNA, 14 bp, Homo sapiens
gccttatcaagtgt

SEQ ID NO: 1144806 - DNA, 17 bp, Homo sapiens
gccttatcaagtgtctt

SEQ ID NO: 1144807 - DNA, 17 bp, Homo sapiens
gccttatcctctgatct

SEQ ID NO: 1144808 - DNA, 23 bp, Homo sapiens
gccttatgtgttacattattcca

SEQ ID NO: 1144809 - DNA, 19 bp, Homo sapiens
gccttattagagtgtcttt

SEQ ID NO: 1144810 - DNA, 13 bp, Homo sapiens
gccttatttccct

SEQ ID NO: 1144811 - DNA, 16 bp, Homo sapiens
gccttatttgtctgta

SEQ ID NO: 1144812 - DNA, 14 bp, Homo sapiens
gccttattttgagt

SEQ ID NO: 1144813 - DNA, 21 bp, Homo sapiens
gccttcaaggactgtttcagt

SEQ ID NO: 1144814 - DNA, 19 bp, Homo sapiens
gccttcacttttctgagtt

SEQ ID NO: 1144815 - DNA, 17 bp, Homo sapiens
gccttcagaaccatcca

SEQ ID NO: 1144816 - DNA, 23 bp, Homo sapiens
gccttcagacagagaggactgta

SEQ ID NO: 1144817 - DNA, 22 bp, Homo sapiens
gccttcagtaggaacaagctgg

SEQ ID NO: 1144818 - DNA, 22 bp, Homo sapiens
gccttcataggcggtcatgtgt

SEQ ID NO: 1144819 - DNA, 20 bp, Homo sapiens
gccttcatctgggacaaaac

SEQ ID NO: 1144820 - DNA, 21 bp, Homo sapiens
gccttcatctgggacaaaact

SEQ ID NO: 1144821 - DNA, 18 bp, Homo sapiens
gccttccacagtgaatgt

SEQ ID NO: 1144822 - DNA, 18 bp, Homo sapiens
gccttccagctgctgtct

SEQ ID NO: 1144823 - DNA, 14 bp, Homo sapiens
gccttccaggtcag

SEQ ID NO: 1144824 - DNA, 16 bp, Homo sapiens
gccttccaggtcagga

SEQ ID NO: 1144825 - DNA, 13 bp, Homo sapiens
gccttccataatt

SEQ ID NO: 1144826 - DNA, 14 bp, Homo sapiens
gccttccatgacct

SEQ ID NO: 1144827 - DNA, 17 bp, Homo sapiens
gccttccatgacctccc

SEQ ID NO: 1144828 - DNA, 21 bp, Homo sapiens
gccttccatgacctcccctcc

SEQ ID NO: 1144829 - DNA, 21 bp, Homo sapiens
gccttcccaagttgtgcttga

SEQ ID NO: 1144830 - DNA, 14 bp, Homo sapiens
gccttccccagctc

SEQ ID NO: 1144831 - DNA, 13 bp, Homo sapiens
gccttcccccaac

SEQ ID NO: 1144832 - DNA, 23 bp, Homo sapiens
gccttccccctcccagggccagg

SEQ ID NO: 1144833 - DNA, 18 bp, Homo sapiens
gccttccccttttgcctg

SEQ ID NO: 1144834 - DNA, 19 bp, Homo sapiens
gccttccccttttgcctgg

SEQ ID NO: 1144835 - DNA, 24 bp, Homo sapiens
gccttccccttttgcctggctgtg

SEQ ID NO: 1144836 - DNA, 17 bp, Homo sapiens
gccttccctcctgcttt

SEQ ID NO: 1144837 - DNA, 15 bp, Homo sapiens
gccttcctcatcccc

SEQ ID NO: 1144838 - DNA, 14 bp, Homo sapiens
gccttcctcctcca

SEQ ID NO: 1144839 - DNA, 19 bp, Homo sapiens
gccttcctcctccacagtg

SEQ ID NO: 1144840 - DNA, 20 bp, Homo sapiens
gccttcctcctccacagtgc

SEQ ID NO: 1144841 - DNA, 22 bp, Homo sapiens
gccttcctcctccacagtgctg

SEQ ID NO: 1144842 - DNA, 14 bp, Homo sapiens
gccttcctcctggg

SEQ ID NO: 1144843 - DNA, 19 bp, Homo sapiens
gccttcctcgtgcagagct

SEQ ID NO: 1144844 - DNA, 17 bp, Homo sapiens
gccttcctctctccaga

SEQ ID NO: 1144845 - DNA, 18 bp, Homo sapiens
gccttcctctctccagat

SEQ ID NO: 1144846 - DNA, 16 bp, Homo sapiens
gccttcctctctggat

SEQ ID NO: 1144847 - DNA, 13 bp, Homo sapiens
gccttcctctgag

SEQ ID NO: 1144848 - DNA, 18 bp, Homo sapiens
gccttcctctgaggacag

SEQ ID NO: 1144849 - DNA, 13 bp, Homo sapiens
gccttcctctgca

SEQ ID NO: 1144850 - DNA, 19 bp, Homo sapiens
gccttcctctgcagctgac

SEQ ID NO: 1144851 - DNA, 21 bp, Homo sapiens
gccttccttctgctcccaccc

SEQ ID NO: 1144852 - DNA, 20 bp, Homo sapiens
gccttcctttctccaggacc

SEQ ID NO: 1144853 - DNA, 16 bp, Homo sapiens
gccttcgaccacagca

SEQ ID NO: 1144854 - DNA, 18 bp, Homo sapiens
gccttcgaccacagcaag

SEQ ID NO: 1144855 - DNA, 18 bp, Homo sapiens
gccttcgatacaccgggc

SEQ ID NO: 1144856 - DNA, 23 bp, Homo sapiens
gccttcgatacaccgggcctgga

SEQ ID NO: 1144857 - DNA, 22 bp, Homo sapiens
gccttcgcttcttgcctctgtg

SEQ ID NO: 1144858 - DNA, 22 bp, Homo sapiens
gcctttcgttctgctgaccaaa

SEQ ID NO: 1144859 - DNA, 23 bp, Homo sapiens
gcctttctaagactcacttacat

SEQ ID NO: 1144860 - DNA, 19 bp, Homo sapiens
gcctttctcctccccacct

SEQ ID NO: 1144861 - DNA, 22 bp, Homo sapiens
gcctttcttaattttagggaca

SEQ ID NO: 1144862 - DNA, 11 bp, Homo sapiens
gcctttcttct

SEQ ID NO: 1144863 - DNA, 17 bp, Homo sapiens
gcctttcttctgccctt

SEQ ID NO: 1144864 - DNA, 16 bp, Homo sapiens
gcctttcttggggaga

SEQ ID NO: 1144865 - DNA, 14 bp, Homo sapiens
gcctttgaatgtta

SEQ ID NO: 1144866 - DNA, 15 bp, Homo sapiens
gcctttgaatgttaa

SEQ ID NO: 1144867 - DNA, 18 bp, Homo sapiens
gcctttgagcccacaaag

SEQ ID NO: 1144868 - DNA, 19 bp, Homo sapiens
gcctttgcaagatgcttgg

SEQ ID NO: 1144869 - DNA, 22 bp, Homo sapiens
gcctttgctgtttagcttcctc

SEQ ID NO: 1144870 - DNA, 23 bp, Homo sapiens
gcctttgctgtttagcttcctcc

SEQ ID NO: 1144871 - DNA, 14 bp, Homo sapiens
gcctttggacccag

SEQ ID NO: 1144872 - DNA, 21 bp, Homo sapiens
gcctttggacccagggcctga

SEQ ID NO: 1144873 - DNA, 13 bp, Homo sapiens
gcctttggcttca

SEQ ID NO: 1144874 - DNA, 15 bp, Homo sapiens
gcctttggggctggt

SEQ ID NO: 1144875 - DNA, 19 bp, Homo sapiens
gcctttgggtcctgggcag

SEQ ID NO: 1144876 - DNA, 11 bp, Homo sapiens
gcctttgtaac

SEQ ID NO: 1144877 - DNA, 15 bp, Homo sapiens
gcctttgtaagttat

SEQ ID NO: 1144878 - DNA, 19 bp, Homo sapiens
gcctttgtcttgtacttct

SEQ ID NO: 1144879 - DNA, 16 bp, Homo sapiens
gccttttatctgcaga

SEQ ID NO: 1144880 - DNA, 19 bp, Homo sapiens
gccttttcacgttttcttt

SEQ ID NO: 1144881 - DNA, 15 bp, Homo sapiens
gccttttcagccctt

SEQ ID NO: 1144882 - DNA, 20 bp, Homo sapiens
gccttttccctctttggctc

SEQ ID NO: 1144883 - DNA, 11 bp, Homo sapiens
gccttttctgg

SEQ ID NO: 1144884 - DNA, 20 bp, Homo sapiens
gccttttgacggccttcttg

SEQ ID NO: 1144885 - DNA, 18 bp, Homo sapiens
gccttttgcaaccaggaa

SEQ ID NO: 1144886 - DNA, 17 bp, Homo sapiens
gccttttgcacccctcc

SEQ ID NO: 1144887 - DNA, 20 bp, Homo sapiens
gccttttgcacccctcccat

SEQ ID NO: 1144888 - DNA, 16 bp, Homo sapiens
gccttttgcagaagag

SEQ ID NO: 1144889 - DNA, 22 bp, Homo sapiens
gccttttggtttcaccttccct

SEQ ID NO: 1144890 - DNA, 19 bp, Homo sapiens
gccttttgttttcattggt

SEQ ID NO: 1144891 - DNA, 20 bp, Homo sapiens
gcctttttagatgtattttt

SEQ ID NO: 1144892 - DNA, 15 bp, Homo sapiens
gcctttttcatttat

SEQ ID NO: 1144893 - DNA, 17 bp, Homo sapiens
gcctttttcatttatct

SEQ ID NO: 1144894 - DNA, 19 bp, Homo sapiens
gcctttttcatttatctat

SEQ ID NO: 1144895 - DNA, 20 bp, Homo sapiens
gcctttttccttatttcaag

SEQ ID NO: 1144896 - DNA, 19 bp, Homo sapiens
gccttttttcacagcccgg

SEQ ID NO: 1144897 - DNA, 23 bp, Homo sapiens
gccttttttcacggaagttttca

SEQ ID NO: 1144898 - DNA, 17 bp, Homo sapiens
gcgaacgtatttctcca

SEQ ID NO: 1144899 - DNA, 23 bp, Homo sapiens
gcgaacgtatttctccagaccca

SEQ ID NO: 1144900 - DNA, 13 bp, Homo sapiens
gcgaactgggttc

SEQ ID NO: 1144901 - DNA, 19 bp, Homo sapiens
gcgaagaccctcttgccca

SEQ ID NO: 1144902 - DNA, 14 bp, Homo sapiens
gcgaaggggccctg

SEQ ID NO: 1144903 - DNA, 13 bp, Homo sapiens
tccttagacactt

SEQ ID NO: 1144904 - DNA, 17 bp, Homo sapiens
tccttagaccttccata

SEQ ID NO: 1144905 - DNA, 21 bp, Homo sapiens
tccttagactccttctcccca

SEQ ID NO: 1144906 - DNA, 18 bp, Homo sapiens
tccttagataccttgaaa

SEQ ID NO: 1144907 - DNA, 20 bp, Homo sapiens
tccttagcttagacctcagc

SEQ ID NO: 1144908 - DNA, 22 bp, Homo sapiens
tccttagcttagacctcagcct

SEQ ID NO: 1144909 - DNA, 23 bp, Homo sapiens
tccttagcttagacctcagcctg

SEQ ID NO: 1144910 - DNA, 21 bp, Homo sapiens
tccttaggaaaatgcttctgt

SEQ ID NO: 1144911 - DNA, 15 bp, Homo sapiens
tccttaggttttctt

SEQ ID NO: 1144912 - DNA, 15 bp, Homo sapiens
tccttagtcttctca

SEQ ID NO: 1144913 - DNA, 16 bp, Homo sapiens
tccttagtcttctcat

SEQ ID NO: 1144914 - DNA, 17 bp, Homo sapiens
tccttatcaaaggacac

SEQ ID NO: 1144915 - DNA, 16 bp, Homo sapiens
tccttatttagcctag

SEQ ID NO: 1144916 - DNA, 15 bp, Homo sapiens
tccttatttctctct

SEQ ID NO: 1144917 - DNA, 22 bp, Homo sapiens
tccttatttctctctcctggtg

SEQ ID NO: 1144918 - DNA, 20 bp, Homo sapiens
tccttatttgcttcattgta

SEQ ID NO: 1144919 - DNA, 21 bp, Homo sapiens
tccttcaaagtttaataaatt

SEQ ID NO: 1144920 - DNA, 16 bp, Homo sapiens
tccttcaaataaagaa

SEQ ID NO: 1144921 - DNA, 19 bp, Homo sapiens
tccttcaagaactctgggc

SEQ ID NO: 1144922 - DNA, 23 bp, Homo sapiens
tccttcaagaactctgggctgct

SEQ ID NO: 1144923 - DNA, 19 bp, Homo sapiens
tccttcacaggcagtgcat

SEQ ID NO: 1144924 - DNA, 20 bp, Homo sapiens
tccttcacaggcagtgcatg

SEQ ID NO: 1144925 - DNA, 17 bp, Homo sapiens
tccttcacctcactgaa

SEQ ID NO: 1144926 - DNA, 13 bp, Homo sapiens
tccttcactgaac

SEQ ID NO: 1144927 - DNA, 14 bp, Homo sapiens
tccttcactgttcc

SEQ ID NO: 1144928 - DNA, 15 bp, Homo sapiens
tccttcactgttccc

SEQ ID NO: 1144929 - DNA, 23 bp, Homo sapiens
tccttcagagctcttcaagctgt

SEQ ID NO: 1144930 - DNA, 13 bp, Homo sapiens
tccttcagcacag

SEQ ID NO: 1144931 - DNA, 12 bp, Homo sapiens
tccttcaggact

SEQ ID NO: 1144932 - DNA, 13 bp, Homo sapiens
tccttcaggactc

SEQ ID NO: 1144933 - DNA, 13 bp, Homo sapiens
tccttcagggatt

SEQ ID NO: 1144934 - DNA, 13 bp, Homo sapiens
tccttcaggtttt

SEQ ID NO: 1144935 - DNA, 19 bp, Homo sapiens
tccttcagtgagcccctcc

SEQ ID NO: 1144936 - DNA, 23 bp, Homo sapiens
tccttcagtgagcccctccccag

SEQ ID NO: 1144937 - DNA, 21 bp, Homo sapiens
tccttcatttccaccaggccg

SEQ ID NO: 1144938 - DNA, 19 bp, Homo sapiens
tccttccaaggtcactctt

SEQ ID NO: 1144939 - DNA, 17 bp, Homo sapiens
tccttccacagttatct

SEQ ID NO: 1144940 - DNA, 17 bp, Homo sapiens
tccttccacatgtacat

SEQ ID NO: 1144941 - DNA, 14 bp, Homo sapiens
tccttccacctcag

SEQ ID NO: 1144942 - DNA, 15 bp, Homo sapiens
tccttccacctcagt

SEQ ID NO: 1144943 - DNA, 14 bp, Homo sapiens
tccttccacctccc

SEQ ID NO: 1144944 - DNA, 17 bp, Homo sapiens
tccttccacctccctcc

SEQ ID NO: 1144945 - DNA, 13 bp, Homo sapiens
tccttccaggccc

SEQ ID NO: 1144946 - DNA, 13 bp, Homo sapiens
tccttccagtggc

SEQ ID NO: 1144947 - DNA, 17 bp, Homo sapiens
tccttccatccctaccc

SEQ ID NO: 1144948 - DNA, 21 bp, Homo sapiens
tccttccatctagcagctggc

SEQ ID NO: 1144949 - DNA, 13 bp, Homo sapiens
tccttccatcttg

SEQ ID NO: 1144950 - DNA, 22 bp, Homo sapiens
tccttcccagggaccagcacct

SEQ ID NO: 1144951 - DNA, 18 bp, Homo sapiens
tccttcccatgcctgtct

SEQ ID NO: 1144952 - DNA, 15 bp, Homo sapiens
tccttccccatttcc

SEQ ID NO: 1144953 - DNA, 17 bp, Homo sapiens
tccttccccatttccac

SEQ ID NO: 1144954 - DNA, 18 bp, Homo sapiens
tccttccccccatctctg

SEQ ID NO: 1144955 - DNA, 22 bp, Homo sapiens
tccttccccctgtagactagtg

SEQ ID NO: 1144956 - DNA, 16 bp, Homo sapiens
tccttcccctgcacct

SEQ ID NO: 1144957 - DNA, 15 bp, Homo sapiens
tccttccccttcccc

SEQ ID NO: 1144958 - DNA, 14 bp, Homo sapiens
tccttccctcctgt

SEQ ID NO: 1144959 - DNA, 17 bp, Homo sapiens
tccttccctcctgtgcc

SEQ ID NO: 1144960 - DNA, 15 bp, Homo sapiens
tccttccctctctga

SEQ ID NO: 1144961 - DNA, 23 bp, Homo sapiens
tccttccctctctgatgtcccag

SEQ ID NO: 1144962 - DNA, 11 bp, Homo sapiens
tccttccctgc

SEQ ID NO: 1144963 - DNA, 15 bp, Homo sapiens
tccttccctgggaag

SEQ ID NO: 1144964 - DNA, 19 bp, Homo sapiens
tccttccctgttctccctt

SEQ ID NO: 1144965 - DNA, 16 bp, Homo sapiens
tccttccgctctgagg

SEQ ID NO: 1144966 - DNA, 12 bp, Homo sapiens
tccttcctatgc

SEQ ID NO: 1144967 - DNA, 16 bp, Homo sapiens
tccttcctctgagcct

SEQ ID NO: 1144968 - DNA, 17 bp, Homo sapiens
tccttcctctgagcctt

SEQ ID NO: 1144969 - DNA, 13 bp, Homo sapiens
tccttcctggcct

SEQ ID NO: 1144970 - DNA, 15 bp, Homo sapiens
tccttcctggcctga

SEQ ID NO: 1144971 - DNA, 13 bp, Homo sapiens
tccttcctgggac

SEQ ID NO: 1144972 - DNA, 16 bp, Homo sapiens
tccttccttccctggc

SEQ ID NO: 1144973 - DNA, 18 bp, Homo sapiens
tccttcgaaaggccttca

SEQ ID NO: 1144974 - DNA, 19 bp, Homo sapiens
tccttcgaaaggccttcag

SEQ ID NO: 1144975 - DNA, 21 bp, Homo sapiens
tccttcgaaaggccttcagac

SEQ ID NO: 1144976 - DNA, 20 bp, Homo sapiens
tccttctacagaacctgagg

SEQ ID NO: 1144977 - DNA, 23 bp, Homo sapiens
tccttctaccccaaggccagtag

SEQ ID NO: 1144978 - DNA, 17 bp, Homo sapiens
tccttctagtttcccac

SEQ ID NO: 1144979 - DNA, 18 bp, Homo sapiens
tccttctcccatctcttc

SEQ ID NO: 1144980 - DNA, 23 bp, Homo sapiens
cgtcctgacggcgcccccagtgt

SEQ ID NO: 1144981 - DNA, 13 bp, Homo sapiens
cgtcctgagaaag

SEQ ID NO: 1144982 - DNA, 12 bp, Homo sapiens
cgtcctgcagag

SEQ ID NO: 1144983 - DNA, 14 bp, Homo sapiens
cgtcctgcagagga

SEQ ID NO: 1144984 - DNA, 12 bp, Homo sapiens
cgtcctgccctg

SEQ ID NO: 1144985 - DNA, 13 bp, Homo sapiens
cgtcctgccctgc

SEQ ID NO: 1144986 - DNA, 15 bp, Homo sapiens
aatatgtttaaaata

SEQ ID NO: 1144987 - DNA, 18 bp, Homo sapiens
aatatgtttaatgttcat

SEQ ID NO: 1144988 - DNA, 14 bp, Homo sapiens
aatatgtttgtgcc

SEQ ID NO: 1144989 - DNA, 21 bp, Homo sapiens
aatatgttttttagatcaaat

SEQ ID NO: 1144990 - DNA, 22 bp, Homo sapiens
aatatgttttttagatcaaata

SEQ ID NO: 1144991 - DNA, 20 bp, Homo sapiens
aatattaaaaagtctgtatg

SEQ ID NO: 1144992 - DNA, 22 bp, Homo sapiens
aatattaaaatcactgtcaata

SEQ ID NO: 1144993 - DNA, 19 bp, Homo sapiens
aatattaaagctcttcatt

SEQ ID NO: 1144994 - DNA, 13 bp, Homo sapiens
aatattaaataca

SEQ ID NO: 1144995 - DNA, 22 bp, Homo sapiens
aatattaaatacagacactaag

SEQ ID NO: 1144996 - DNA, 18 bp, Homo sapiens
aatattaacttttaatgg

SEQ ID NO: 1144997 - DNA, 13 bp, Homo sapiens
aatattaagaaag

SEQ ID NO: 1144998 - DNA, 22 bp, Homo sapiens
aatattaatgcctttaaagtat

SEQ ID NO: 1144999 - DNA, 16 bp, Homo sapiens
aatattactgtcttta

SEQ ID NO: 1145000 - DNA, 18 bp, Homo sapiens
aatattagctttactgtt

SEQ ID NO: 1145001 - DNA, 15 bp, Homo sapiens
aatattagtgattct

SEQ ID NO: 1145002 - DNA, 17 bp, Homo sapiens
aatattagtgattctga

SEQ ID NO: 1145003 - DNA, 18 bp, Homo sapiens
aatattagtgattctgat

SEQ ID NO: 1145004 - DNA, 19 bp, Homo sapiens
aatattagtgattctgatt

SEQ ID NO: 1145005 - DNA, 22 bp, Homo sapiens
aatattagtgattctgatttca

SEQ ID NO: 1145006 - DNA, 16 bp, Homo sapiens
aatattatactaagaa

SEQ ID NO: 1145007 - DNA, 13 bp, Homo sapiens
aatattattatga

SEQ ID NO: 1145008 - DNA, 16 bp, Homo sapiens
aatattattcctcaaa

SEQ ID NO: 1145009 - DNA, 20 bp, Homo sapiens
aatattcaaaatggtttttg

SEQ ID NO: 1145010 - DNA, 15 bp, Homo sapiens
aatattcaagtaaca

SEQ ID NO: 1145011 - DNA, 20 bp, Homo sapiens
aatattcagacaaaatggat

SEQ ID NO: 1145012 - DNA, 23 bp, Homo sapiens
aatattcagacaaaatggataca

SEQ ID NO: 1145013 - DNA, 24 bp, Homo sapiens
aatattcagccagcttaaacccat

SEQ ID NO: 1145014 - DNA, 12 bp, Homo sapiens
aatattccaagc

SEQ ID NO: 1145015 - DNA, 16 bp, Homo sapiens
aatattccagaagaac

SEQ ID NO: 1145016 - DNA, 15 bp, Homo sapiens
aatattccctagaaa

SEQ ID NO: 1145017 - DNA, 17 bp, Homo sapiens
aatattccctagaaact

SEQ ID NO: 1145018 - DNA, 12 bp, Homo sapiens
aatattcctgaa

SEQ ID NO: 1145019 - DNA, 15 bp, Homo sapiens
aatattcctgaatga

SEQ ID NO: 1145020 - DNA, 20 bp, Homo sapiens
aatattcctttgcatattat

SEQ ID NO: 1145021 - DNA, 18 bp, Homo sapiens
aatattctctatttgaat

SEQ ID NO: 1145022 - DNA, 23 bp, Homo sapiens
aatattctgtaactattgggtga

SEQ ID NO: 1145023 - DNA, 13 bp, Homo sapiens
aatattctgtttt

SEQ ID NO: 1145024 - DNA, 21 bp, Homo sapiens
aatattcttgtccacattcta

SEQ ID NO: 1145025 - DNA, 16 bp, Homo sapiens
aatattcttttgtttc

SEQ ID NO: 1145026 - DNA, 18 bp, Homo sapiens
aatattcttttgtttcca

SEQ ID NO: 1145027 - DNA, 21 bp, Homo sapiens
aatattcttttgtttccatgg

SEQ ID NO: 1145028 - DNA, 21 bp, Homo sapiens
aatattgaaaattgaaaagta

SEQ ID NO: 1145029 - DNA, 24 bp, Homo sapiens
aatattgaagttgtttatcaactt

SEQ ID NO: 1145030 - DNA, 18 bp, Homo sapiens
aatattgaatttttccta

SEQ ID NO: 1145031 - DNA, 17 bp, Homo sapiens
aatattgacttgtatat

SEQ ID NO: 1145032 - DNA, 19 bp, Homo sapiens
aatattgagaaagaaacta

SEQ ID NO: 1145033 - DNA, 20 bp, Homo sapiens
aatattgagaaagaaactaa

SEQ ID NO: 1145034 - DNA, 13 bp, Homo sapiens
aatattgagaatc

SEQ ID NO: 1145035 - DNA, 21 bp, Homo sapiens
aatattgagaatcaggttgca

SEQ ID NO: 1145036 - DNA, 18 bp, Homo sapiens
aatattgatatgcttata

SEQ ID NO: 1145037 - DNA, 17 bp, Homo sapiens
aatattgcaaaatacat

SEQ ID NO: 1145038 - DNA, 13 bp, Homo sapiens
aatattgctaaaa

SEQ ID NO: 1145039 - DNA, 20 bp, Homo sapiens
aatattggtaattaaaagac

SEQ ID NO: 1145040 - DNA, 14 bp, Homo sapiens
aatattggttagta

SEQ ID NO: 1145041 - DNA, 21 bp, Homo sapiens
aatattgtaaatactggactc

SEQ ID NO: 1145042 - DNA, 17 bp, Homo sapiens
aatattgtacagttttt

SEQ ID NO: 1145043 - DNA, 14 bp, Homo sapiens
aatattgtatattt

SEQ ID NO: 1145044 - DNA, 13 bp, Homo sapiens
aatattgtcatct

SEQ ID NO: 1145045 - DNA, 21 bp, Homo sapiens
aatattgtcatctttttctag

SEQ ID NO: 1145046 - DNA, 13 bp, Homo sapiens
aatattgtccatt

SEQ ID NO: 1145047 - DNA, 13 bp, Homo sapiens
aatattgttctct

SEQ ID NO: 1145048 - DNA, 12 bp, Homo sapiens
aatattgtttct

SEQ ID NO: 1145049 - DNA, 17 bp, Homo sapiens
aatattgttttacaata

SEQ ID NO: 1145050 - DNA, 20 bp, Homo sapiens
agaataatccagtattgctg

SEQ ID NO: 1145051 - DNA, 17 bp, Homo sapiens
agaataatctcatcccc

SEQ ID NO: 1145052 - DNA, 19 bp, Homo sapiens
agaataatctcatcccccc

SEQ ID NO: 1145053 - DNA, 23 bp, Homo sapiens
agaataatctcatccccccaccc

SEQ ID NO: 1145054 - DNA, 22 bp, Homo sapiens
agaataatgtgggaagaaacaa

SEQ ID NO: 1145055 - DNA, 17 bp, Homo sapiens
agaataatgtgttaaac

SEQ ID NO: 1145056 - DNA, 18 bp, Homo sapiens
agaatacagaaagatgga

SEQ ID NO: 1145057 - DNA, 17 bp, Homo sapiens
agaatactgggttctta

SEQ ID NO: 1145058 - DNA, 16 bp, Homo sapiens
agaatactggtctcag

SEQ ID NO: 1145059 - DNA, 15 bp, Homo sapiens
agaatacttctcatt

SEQ ID NO: 1145060 - DNA, 18 bp, Homo sapiens
agaatacttgactcattt

SEQ ID NO: 1145061 - DNA, 16 bp, Homo sapiens
agaatactttgcttca

SEQ ID NO: 1145062 - DNA, 18 bp, Homo sapiens
agaatactttgcttcata

SEQ ID NO: 1145063 - DNA, 20 bp, Homo sapiens
agaatactttgcttcatagt

SEQ ID NO: 1145064 - DNA, 19 bp, Homo sapiens
agaatacttttttctagtt

SEQ ID NO: 1145065 - DNA, 12 bp, Homo sapiens
agaatagaaaca

SEQ ID NO: 1145066 - DNA, 22 bp, Homo sapiens
agaatagaaataaaggatgtga

SEQ ID NO: 1145067 - DNA, 16 bp, Homo sapiens
agaatagagctgccac

SEQ ID NO: 1145068 - DNA, 20 bp, Homo sapiens
agaatagagctgccactggg

SEQ ID NO: 1145069 - DNA, 20 bp, Homo sapiens
agaatagcttccaataaagc

SEQ ID NO: 1145070 - DNA, 13 bp, Homo sapiens
agaataggaaaac

SEQ ID NO: 1145071 - DNA, 17 bp, Homo sapiens
agaataggcactttaaa

SEQ ID NO: 1145072 - DNA, 22 bp, Homo sapiens
agaataggcactttaaaacact

SEQ ID NO: 1145073 - DNA, 16 bp, Homo sapiens
agaatatcaaataata

SEQ ID NO: 1145074 - DNA, 18 bp, Homo sapiens
agaatatcaaataataaa

SEQ ID NO: 1145075 - DNA, 18 bp, Homo sapiens
agaatatcgatataaatt

SEQ ID NO: 1145076 - DNA, 19 bp, Homo sapiens
agaatatcgatataaattg

SEQ ID NO: 1145077 - DNA, 15 bp, Homo sapiens
agaatatgtaatact

SEQ ID NO: 1145078 - DNA, 18 bp, Homo sapiens
agaatattcaaaattcca

SEQ ID NO: 1145079 - DNA, 23 bp, Homo sapiens
agaatattcagacaaaatggata

SEQ ID NO: 1145080 - DNA, 12 bp, Homo sapiens
agaatattcagg

SEQ ID NO: 1145081 - DNA, 18 bp, Homo sapiens
agaatattgcaaaataca

SEQ ID NO: 1145082 - DNA, 13 bp, Homo sapiens
agaatattgtatt

SEQ ID NO: 1145083 - DNA, 13 bp, Homo sapiens
agaatatttacta

SEQ ID NO: 1145084 - DNA, 21 bp, Homo sapiens
agaatatttactaactaaata

SEQ ID NO: 1145085 - DNA, 16 bp, Homo sapiens
agaatatttattacct

SEQ ID NO: 1145086 - DNA, 23 bp, Homo sapiens
agaatatttttatatttccttta

SEQ ID NO: 1145087 - DNA, 16 bp, Homo sapiens
agaatcacacaagttt

SEQ ID NO: 1145088 - DNA, 18 bp, Homo sapiens
agaatcactaggtaactt

SEQ ID NO: 1145089 - DNA, 13 bp, Homo sapiens
agaatcagcctag

SEQ ID NO: 1145090 - DNA, 14 bp, Homo sapiens
agaatcagtgttaa

SEQ ID NO: 1145091 - DNA, 18 bp, Homo sapiens
agaatcagtgttaaattc

SEQ ID NO: 1145092 - DNA, 17 bp, Homo sapiens
agaatcatacttaacat

SEQ ID NO: 1145093 - DNA, 19 bp, Homo sapiens
agaatcatacttaacattt

SEQ ID NO: 1145094 - DNA, 14 bp, Homo sapiens
agaatcatacttag

SEQ ID NO: 1145095 - DNA, 20 bp, Homo sapiens
agaatcatatgattctgctt

SEQ ID NO: 1145096 - DNA, 21 bp, Homo sapiens
agaatcatatgattctgcttt

SEQ ID NO: 1145097 - DNA, 15 bp, Homo sapiens
agaatcatggagaaa

SEQ ID NO: 1145098 - DNA, 18 bp, Homo sapiens
agaatcatgtgaacccgg

SEQ ID NO: 1145099 - DNA, 13 bp, Homo sapiens
agaatcattgctt

SEQ ID NO: 1145100 - DNA, 16 bp, Homo sapiens
agaatgtatttgctga

SEQ ID NO: 1145101 - DNA, 17 bp, Homo sapiens
agaatgtattttcatag

SEQ ID NO: 1145102 - DNA, 19 bp, Homo sapiens
agaatgtcagatttctggt

SEQ ID NO: 1145103 - DNA, 23 bp, Homo sapiens
agaatgtcattttggtactttgg

SEQ ID NO: 1145104 - DNA, 17 bp, Homo sapiens
agaatgtgaaaaaggaa

SEQ ID NO: 1145105 - DNA, 20 bp, Homo sapiens
agaatgtgattccttttgat

SEQ ID NO: 1145106 - DNA, 18 bp, Homo sapiens
agaatgtgctcatgcatt

SEQ ID NO: 1145107 - DNA, 14 bp, Homo sapiens
agaatgtggatttg

SEQ ID NO: 1145108 - DNA, 21 bp, Homo sapiens
agaatgtggatttgattcatt

SEQ ID NO: 1145109 - DNA, 17 bp, Homo sapiens
agaatgtgttcttttct

SEQ ID NO: 1145110 - DNA, 20 bp, Homo sapiens
agaatgtgttcttttctcct

SEQ ID NO: 1145111 - DNA, 21 bp, Homo sapiens
agaatgtgttcttttctcctt

SEQ ID NO: 1145112 - DNA, 17 bp, Homo sapiens
agaatgtgttttctgaa

SEQ ID NO: 1145113 - DNA, 18 bp, Homo sapiens
agaatgtgttttctgaat

SEQ ID NO: 1145114 - DNA, 18 bp, Homo sapiens
agaatgttgtacttgaaa

SEQ ID NO: 1145115 - DNA, 14 bp, Homo sapiens
agaattaaaactga

SEQ ID NO: 1145116 - DNA, 18 bp, Homo sapiens
agaattaaacttttaatt

SEQ ID NO: 1145117 - DNA, 22 bp, Homo sapiens
agaattaaacttttaattcatt

SEQ ID NO: 1145118 - DNA, 23 bp, Homo sapiens
agaattaagaaatactcatgtgc

SEQ ID NO: 1145119 - DNA, 20 bp, Homo sapiens
agaattaagttttaaataaa

SEQ ID NO: 1145120 - DNA, 15 bp, Homo sapiens
agaattaccattaat

SEQ ID NO: 1145121 - DNA, 19 bp, Homo sapiens
agaattaccattaattaca

SEQ ID NO: 1145122 - DNA, 17 bp, Homo sapiens
agaattactgagttttt

SEQ ID NO: 1145123 - DNA, 19 bp, Homo sapiens
agaattagtgccagaattt

SEQ ID NO: 1145124 - DNA, 16 bp, Homo sapiens
agaattatatatttct

SEQ ID NO: 1145125 - DNA, 22 bp, Homo sapiens
agaattatccattacgtgcatt

SEQ ID NO: 1145126 - DNA, 15 bp, Homo sapiens
agaattatctaattt

SEQ ID NO: 1145127 - DNA, 19 bp, Homo sapiens
agaattatgtaatatattg

SEQ ID NO: 1145128 - DNA, 21 bp, Homo sapiens
agaattatgtaatatattgta

SEQ ID NO: 1145129 - DNA, 23 bp, Homo sapiens
agaattatgtaatatattgtaca

SEQ ID NO: 1145130 - DNA, 19 bp, Homo sapiens
agaattatttttaaaaaga

SEQ ID NO: 1145131 - DNA, 23 bp, Homo sapiens
agaattatttttaaaaagaaatc

SEQ ID NO: 1145132 - DNA, 15 bp, Homo sapiens
agaattccaaagcaa

SEQ ID NO: 1145133 - DNA, 13 bp, Homo sapiens
agaattccaagga

SEQ ID NO: 1145134 - DNA, 19 bp, Homo sapiens
agaattcctgaagccagat

SEQ ID NO: 1145135 - DNA, 12 bp, Homo sapiens
agaattccttcg

SEQ ID NO: 1145136 - DNA, 21 bp, Homo sapiens
agaattccttcgaaaggcctt

SEQ ID NO: 1145137 - DNA, 14 bp, Homo sapiens
agaattcgaaggct

SEQ ID NO: 1145138 - DNA, 18 bp, Homo sapiens
agaattctctagtttgat

SEQ ID NO: 1145139 - DNA, 17 bp, Homo sapiens
agaattctcttatccaa

SEQ ID NO: 1145140 - DNA, 16 bp, Homo sapiens
agaattcttacatgtt

SEQ ID NO: 1145141 - DNA, 17 bp, Homo sapiens
agaattcttacatgttt

SEQ ID NO: 1145142 - DNA, 19 bp, Homo sapiens
agaattcttacatgttttc

SEQ ID NO: 1145143 - DNA, 23 bp, Homo sapiens
agaattcttacatgttttctttg

SEQ ID NO: 1145144 - DNA, 13 bp, Homo sapiens
agaattgaaaatg

SEQ ID NO: 1145145 - DNA, 15 bp, Homo sapiens
agaattgaaaatgca

SEQ ID NO: 1145146 - DNA, 16 bp, Homo sapiens
agaattgaacccagga

SEQ ID NO: 1145147 - DNA, 19 bp, Homo sapiens
agaattgaattctggaaac

SEQ ID NO: 1145148 - DNA, 21 bp, Homo sapiens
agaattgaccatctgctttta

SEQ ID NO: 1145149 - DNA, 21 bp, Homo sapiens
agaattgactgcagttgaaca

SEQ ID NO: 1145150 - DNA, 21 bp, Homo sapiens
agaattggagagtaaaaactg

SEQ ID NO: 1145151 - DNA, 16 bp, Homo sapiens
agaattggctcaataa

SEQ ID NO: 1145152 - DNA, 14 bp, Homo sapiens
agaattgggaagct

SEQ ID NO: 1145153 - DNA, 16 bp, Homo sapiens
agaattggtaaaaaca

SEQ ID NO: 1145154 - DNA, 15 bp, Homo sapiens
agaattgtatcattt

SEQ ID NO: 1145155 - DNA, 14 bp, Homo sapiens
agaattgtctctgg

SEQ ID NO: 1145156 - DNA, 13 bp, Homo sapiens
agaattgtcttgc

SEQ ID NO: 1145157 - DNA, 17 bp, Homo sapiens
agaattgttgagatact

SEQ ID NO: 1145158 - DNA, 17 bp, Homo sapiens
agaattgtttttgaatt

SEQ ID NO: 1145159 - DNA, 22 bp, Homo sapiens
agaattgtttttgaatttaaat

SEQ ID NO: 1145160 - DNA, 21 bp, Homo sapiens
agctgcttgtcctgggcctgc

SEQ ID NO: 1145161 - DNA, 18 bp, Homo sapiens
agctggaacatttgatat

SEQ ID NO: 1145162 - DNA, 15 bp, Homo sapiens
agctggaagcctgcc

SEQ ID NO: 1145163 - DNA, 15 bp, Homo sapiens
agctggaaggcaggg

SEQ ID NO: 1145164 - DNA, 19 bp, Homo sapiens
agctggaaggcagggcaga

SEQ ID NO: 1145165 - DNA, 12 bp, Homo sapiens
agctggacagag

SEQ ID NO: 1145166 - DNA, 18 bp, Homo sapiens
agctggacagaggggact

SEQ ID NO: 1145167 - DNA, 23 bp, Homo sapiens
agctggacagaggggactctggg

SEQ ID NO: 1145168 - DNA, 19 bp, Homo sapiens
agctggacatactgctgga

SEQ ID NO: 1145169 - DNA, 14 bp, Homo sapiens
agctggaccctgct

SEQ ID NO: 1145170 - DNA, 19 bp, Homo sapiens
agctggacgtcgcggtgtg

SEQ ID NO: 1145171 - DNA, 15 bp, Homo sapiens
agctggactacccac

SEQ ID NO: 1145172 - DNA, 16 bp, Homo sapiens
agctggactacccacg

SEQ ID NO: 1145173 - DNA, 19 bp, Homo sapiens
agctggactctgcatccca

SEQ ID NO: 1145174 - DNA, 15 bp, Homo sapiens
agctggagctcttgg

SEQ ID NO: 1145175 - DNA, 17 bp, Homo sapiens
agctggagctcttggaa

SEQ ID NO: 1145176 - DNA, 14 bp, Homo sapiens
agctggagtgctgc

SEQ ID NO: 1145177 - DNA, 15 bp, Homo sapiens
agctggagtgctgct

SEQ ID NO: 1145178 - DNA, 17 bp, Homo sapiens
agctggatataatgtat

SEQ ID NO: 1145179 - DNA, 14 bp, Homo sapiens
agctggcagaacgg

SEQ ID NO: 1145180 - DNA, 13 bp, Homo sapiens
agctggcaggaca

SEQ ID NO: 1145181 - DNA, 17 bp, Homo sapiens
agctggcaggacacatc

SEQ ID NO: 1145182 - DNA, 19 bp, Homo sapiens
agctggcaggacacatccc

SEQ ID NO: 1145183 - DNA, 20 bp, Homo sapiens
agctggcccccagccctggg

SEQ ID NO: 1145184 - DNA, 14 bp, Homo sapiens
agctggccccgccg

SEQ ID NO: 1145185 - DNA, 15 bp, Homo sapiens
agctggccccgccgc

SEQ ID NO: 1145186 - DNA, 18 bp, Homo sapiens
agctggccccgccgcctg

SEQ ID NO: 1145187 - DNA, 21 bp, Homo sapiens
agctggccgagggtcctggct

SEQ ID NO: 1145188 - DNA, 23 bp, Homo sapiens
agctggccgagggtcctggctcc

SEQ ID NO: 1145189 - DNA, 21 bp, Homo sapiens
agctggcctaatcactctgag

SEQ ID NO: 1145190 - DNA, 15 bp, Homo sapiens
agctggcctccccca

SEQ ID NO: 1145191 - DNA, 16 bp, Homo sapiens
agctggcctcccccaa

SEQ ID NO: 1145192 - DNA, 15 bp, Homo sapiens
agctggcctggacag

SEQ ID NO: 1145193 - DNA, 21 bp, Homo sapiens
agctggcctggaccattcctg

SEQ ID NO: 1145194 - DNA, 15 bp, Homo sapiens
agctggcgtctgtct

SEQ ID NO: 1145195 - DNA, 18 bp, Homo sapiens
agctggcgtctgtcttca

SEQ ID NO: 1145196 - DNA, 20 bp, Homo sapiens
agctggctgagacactgaag

SEQ ID NO: 1145197 - DNA, 22 bp, Homo sapiens
agctggctgtacctgttcctcc

SEQ ID NO: 1145198 - DNA, 15 bp, Homo sapiens
agctggctgtgcctg

SEQ ID NO: 1145199 - DNA, 17 bp, Homo sapiens
agctggctgtgcctgct

SEQ ID NO: 1145200 - DNA, 21 bp, Homo sapiens
agctgggacctaatgctggcc

SEQ ID NO: 1145201 - DNA, 13 bp, Homo sapiens
agctgggagacaa

SEQ ID NO: 1145202 - DNA, 14 bp, Homo sapiens
agctgggagacaaa

SEQ ID NO: 1145203 - DNA, 16 bp, Homo sapiens
agctgggagccaggct

SEQ ID NO: 1145204 - DNA, 15 bp, Homo sapiens
agctgggagccagtg

SEQ ID NO: 1145205 - DNA, 12 bp, Homo sapiens
agctgggaggaa

SEQ ID NO: 1145206 - DNA, 16 bp, Homo sapiens
agctgggaggcaagag

SEQ ID NO: 1145207 - DNA, 20 bp, Homo sapiens
agctgggaggcatggccctg

SEQ ID NO: 1145208 - DNA, 22 bp, Homo sapiens
agctgggaggcatggccctggg

SEQ ID NO: 1145209 - DNA, 10 bp, Homo sapiens
agctgggcaa

SEQ ID NO: 1145210 - DNA, 14 bp, Homo sapiens
agctgggcagggtg

SEQ ID NO: 1145211 - DNA, 18 bp, Homo sapiens
agctgggcagtgccagcc

SEQ ID NO: 1145212 - DNA, 22 bp, Homo sapiens
agctgggcccaaaggcccaggg

SEQ ID NO: 1145213 - DNA, 15 bp, Homo sapiens
agctgggcccagccc

SEQ ID NO: 1145214 - DNA, 16 bp, Homo sapiens
agctgggcccagcccc

SEQ ID NO: 1145215 - DNA, 17 bp, Homo sapiens
agctgggcccagcccct

SEQ ID NO: 1145216 - DNA, 18 bp, Homo sapiens
agctgggcccagcccctc

SEQ ID NO: 1145217 - DNA, 16 bp, Homo sapiens
agctgggccccaccta

SEQ ID NO: 1145218 - DNA, 19 bp, Homo sapiens
agctgggccccatgctctg

SEQ ID NO: 1145219 - DNA, 22 bp, Homo sapiens
agctgggcccctgcacaggcac

SEQ ID NO: 1145220 - DNA, 13 bp, Homo sapiens
agctgggcctgtg

SEQ ID NO: 1145221 - DNA, 18 bp, Homo sapiens
agctgggcctgtgcactg

SEQ ID NO: 1145222 - DNA, 17 bp, Homo sapiens
agctgggctaagtaaat

SEQ ID NO: 1145223 - DNA, 14 bp, Homo sapiens
agctgggctctgcc

SEQ ID NO: 1145224 - DNA, 14 bp, Homo sapiens
agctgggctgtctc

SEQ ID NO: 1145225 - DNA, 16 bp, Homo sapiens
agctgggctgtctctc

SEQ ID NO: 1145226 - DNA, 22 bp, Homo sapiens
agctgggctgtctctctccatg

SEQ ID NO: 1145227 - DNA, 22 bp, Homo sapiens
agctgggcttggcctggagagg

SEQ ID NO: 1145228 - DNA, 14 bp, Homo sapiens
agctggggacaact

SEQ ID NO: 1145229 - DNA, 19 bp, Homo sapiens
agctggggacaactgcggt

SEQ ID NO: 1145230 - DNA, 14 bp, Homo sapiens
agctggggacctgg

SEQ ID NO: 1145231 - DNA, 17 bp, Homo sapiens
agctggggactcaggga

SEQ ID NO: 1145232 - DNA, 19 bp, Homo sapiens
agctggggagatgggggct

SEQ ID NO: 1145233 - DNA, 20 bp, Homo sapiens
agctggggagatgggggctt

SEQ ID NO: 1145234 - DNA, 11 bp, Homo sapiens
agctggggagg

SEQ ID NO: 1145235 - DNA, 16 bp, Homo sapiens
agctggggccagaggc

SEQ ID NO: 1145236 - DNA, 18 bp, Homo sapiens
agctggggctgccagcct

SEQ ID NO: 1145237 - DNA, 19 bp, Homo sapiens
agctggggctgccagcctg

SEQ ID NO: 1145238 - DNA, 20 bp, Homo sapiens
agctggggcttatgggtggc

SEQ ID NO: 1145239 - DNA, 22 bp, Homo sapiens
agctggggcttcaccagtctgt

SEQ ID NO: 1145240 - DNA, 14 bp, Homo sapiens
agctggggtacagg

SEQ ID NO: 1145241 - DNA, 19 bp, Homo sapiens
agctggggtctgggcagtg

SEQ ID NO: 1145242 - DNA, 23 bp, Homo sapiens
agctggggtctgggcagtgccac

SEQ ID NO: 1145243 - DNA, 16 bp, Homo sapiens
agctgggtcaggcagg

SEQ ID NO: 1145244 - DNA, 10 bp, Homo sapiens
agctgggtgg

SEQ ID NO: 1145245 - DNA, 18 bp, Homo sapiens
agctgtaagggcagtgcc

SEQ ID NO: 1145246 - DNA, 24 bp, Homo sapiens
agctgtaagggcagtgcccatgtg

SEQ ID NO: 1145247 - DNA, 15 bp, Homo sapiens
agctgtaatttcgcc

SEQ ID NO: 1145248 - DNA, 13 bp, Homo sapiens
agctgtacaaata

SEQ ID NO: 1145249 - DNA, 17 bp, Homo sapiens
agctgtacaaatataag

SEQ ID NO: 1145250 - DNA, 18 bp, Homo sapiens
agctgtacgaaaaagagc

SEQ ID NO: 1145251 - DNA, 14 bp, Homo sapiens
agctgtactcagag

SEQ ID NO: 1145252 - DNA, 18 bp, Homo sapiens
agctgtactcagagcaga

SEQ ID NO: 1145253 - DNA, 21 bp, Homo sapiens
agctgtactcagagcagagca

SEQ ID NO: 1145254 - DNA, 20 bp, Homo sapiens
agctgtacttcttgaatata

SEQ ID NO: 1145255 - DNA, 16 bp, Homo sapiens
agctgtagaaatgtat

SEQ ID NO: 1145256 - DNA, 15 bp, Homo sapiens
agctgtagccatggc

SEQ ID NO: 1145257 - DNA, 19 bp, Homo sapiens
agctgtagccatggctcag

SEQ ID NO: 1145258 - DNA, 20 bp, Homo sapiens
agctgtagccatggctcagg

SEQ ID NO: 1145259 - DNA, 17 bp, Homo sapiens
agctgtagctcccgagc

SEQ ID NO: 1145260 - DNA, 21 bp, Homo sapiens
agctgtagtagccctttctgt

SEQ ID NO: 1145261 - DNA, 22 bp, Homo sapiens
agctgtagtagccctttctgtg

SEQ ID NO: 1145262 - DNA, 11 bp, Homo sapiens
agctgtagtgg

SEQ ID NO: 1145263 - DNA, 19 bp, Homo sapiens
agctgtagttttccctgca

SEQ ID NO: 1145264 - DNA, 14 bp, Homo sapiens
agctgtatgatttg

SEQ ID NO: 1145265 - DNA, 17 bp, Homo sapiens
agctgtatgatttgttt

SEQ ID NO: 1145266 - DNA, 22 bp, Homo sapiens
agctgtatgatttgttttgaat

SEQ ID NO: 1145267 - DNA, 20 bp, Homo sapiens
agctgtattaagtgactgac

SEQ ID NO: 1145268 - DNA, 12 bp, Homo sapiens
agctgtatttat

SEQ ID NO: 1145269 - DNA, 14 bp, Homo sapiens
agctgtatttatat

SEQ ID NO: 1145270 - DNA, 16 bp, Homo sapiens
agctgtcaaggctcag

SEQ ID NO: 1145271 - DNA, 18 bp, Homo sapiens
agctgtcacaacttgtgt

SEQ ID NO: 1145272 - DNA, 17 bp, Homo sapiens
agctgtcaccaaggaaa

SEQ ID NO: 1145273 - DNA, 15 bp, Homo sapiens
agctgtcacctgctc

SEQ ID NO: 1145274 - DNA, 20 bp, Homo sapiens
agctgtcacttttgctccga

SEQ ID NO: 1145275 - DNA, 23 bp, Homo sapiens
agctgtcccatctggtcatttgg

SEQ ID NO: 1145276 - DNA, 17 bp, Homo sapiens
agctgtcccctctccct

SEQ ID NO: 1145277 - DNA, 16 bp, Homo sapiens
agctgtcccctctgtc

SEQ ID NO: 1145278 - DNA, 17 bp, Homo sapiens
agctgtcccctctgtca

SEQ ID NO: 1145279 - DNA, 14 bp, Homo sapiens
agctgtcctgcagc

SEQ ID NO: 1145280 - DNA, 13 bp, Homo sapiens
agctgtcgtctga

SEQ ID NO: 1145281 - DNA, 18 bp, Homo sapiens
agctgtcgtctgactctg

SEQ ID NO: 1145282 - DNA, 22 bp, Homo sapiens
agctgtctcttcggcagggagg

SEQ ID NO: 1145283 - DNA, 15 bp, Homo sapiens
agctgtctgccaggc

SEQ ID NO: 1145284 - DNA, 16 bp, Homo sapiens
agctgtctgccaggca

SEQ ID NO: 1145285 - DNA, 12 bp, Homo sapiens
agctgtcttccc

SEQ ID NO: 1145286 - DNA, 20 bp, Homo sapiens
agctgtgacattgctggtca

SEQ ID NO: 1145287 - DNA, 18 bp, Homo sapiens
agctgtgagacagtggga

SEQ ID NO: 1145288 - DNA, 19 bp, Homo sapiens
agctgtgagacagtgggaa

SEQ ID NO: 1145289 - DNA, 21 bp, Homo sapiens
agctgtgagacagtgggaaat

SEQ ID NO: 1145290 - DNA, 19 bp, Homo sapiens
agctgtgagccatgcctcc

SEQ ID NO: 1145291 - DNA, 21 bp, Homo sapiens
agctgtgagccatgcctccct

SEQ ID NO: 1145292 - DNA, 22 bp, Homo sapiens
agctgtgagtgcgtgtgtgtga

SEQ ID NO: 1145293 - DNA, 17 bp, Homo sapiens
agctgtgcaggcatggt

SEQ ID NO: 1145294 - DNA, 12 bp, Homo sapiens
agctgtgcaggt

SEQ ID NO: 1145295 - DNA, 14 bp, Homo sapiens
agctgtgccagcag

SEQ ID NO: 1145296 - DNA, 20 bp, Homo sapiens
agctgtggtacaaatgtgat

SEQ ID NO: 1145297 - DNA, 24 bp, Homo sapiens
agctgtgtccttgcacctgcatcc

SEQ ID NO: 1145298 - DNA, 18 bp, Homo sapiens
agctgtgttaactgttca

SEQ ID NO: 1145299 - DNA, 12 bp, Homo sapiens
agctgttaaact

SEQ ID NO: 1145300 - DNA, 19 bp, Homo sapiens
agctgttaaactgttagca

SEQ ID NO: 1145301 - DNA, 16 bp, Homo sapiens
agctgttactgcaagt

SEQ ID NO: 1145302 - DNA, 15 bp, Homo sapiens
agctgttactttctt

SEQ ID NO: 1145303 - DNA, 16 bp, Homo sapiens
agctgttcctgttcag

SEQ ID NO: 1145304 - DNA, 18 bp, Homo sapiens
agctgttcctgttcagta

SEQ ID NO: 1145305 - DNA, 17 bp, Homo sapiens
agctgttcgctcctccc

SEQ ID NO: 1145306 - DNA, 16 bp, Homo sapiens
agctgttcttttttgt

SEQ ID NO: 1145307 - DNA, 15 bp, Homo sapiens
agctgttgagaaaac

SEQ ID NO: 1145308 - DNA, 16 bp, Homo sapiens
agctgttgagctgttt

SEQ ID NO: 1145309 - DNA, 13 bp, Homo sapiens
agctgttgcctca

SEQ ID NO: 1145310 - DNA, 19 bp, Homo sapiens
agctgttgtgagctttgaa

SEQ ID NO: 1145311 - DNA, 20 bp, Homo sapiens
agctgttgtgagctttgaag

SEQ ID NO: 1145312 - DNA, 18 bp, Homo sapiens
agctgtttatggcctcag

SEQ ID NO: 1145313 - DNA, 13 bp, Homo sapiens
agctgtttattta

SEQ ID NO: 1145314 - DNA, 17 bp, Homo sapiens
agctgtttatttattca

SEQ ID NO: 1145315 - DNA, 18 bp, Homo sapiens
agctgtttatttattcac

SEQ ID NO: 1145316 - DNA, 14 bp, Homo sapiens
agctgtttccatag

SEQ ID NO: 1145317 - DNA, 13 bp, Homo sapiens
agctgtttctcat

SEQ ID NO: 1145318 - DNA, 15 bp, Homo sapiens
agctgtttctcatga

SEQ ID NO: 1145319 - DNA, 23 bp, Homo sapiens
agctgtttgccaagctgaagcta

SEQ ID NO: 1145320 - DNA, 19 bp, Homo sapiens
agctgtttggatacagctg

SEQ ID NO: 1145321 - DNA, 21 bp, Homo sapiens
agctgtttggatacagctgct

SEQ ID NO: 1145322 - DNA, 19 bp, Homo sapiens
agctgttttagctgaggga

SEQ ID NO: 1145323 - DNA, 18 bp, Homo sapiens
agctgttttgtgtatatt

SEQ ID NO: 1145324 - DNA, 15 bp, Homo sapiens
agcttaaaaaaatta

SEQ ID NO: 1145325 - DNA, 18 bp, Homo sapiens
agcttaaaaaaattactg

SEQ ID NO: 1145326 - DNA, 22 bp, Homo sapiens
agcttaaaactttgaagttagc

SEQ ID NO: 1145327 - DNA, 13 bp, Homo sapiens
agcttaaaataca

SEQ ID NO: 1145328 - DNA, 18 bp, Homo sapiens
agcttaaaatacaagact

SEQ ID NO: 1145329 - DNA, 18 bp, Homo sapiens
agcttaaacccatacaat

SEQ ID NO: 1145330 - DNA, 20 bp, Homo sapiens
agcttaaacccatacaatgt

SEQ ID NO: 1145331 - DNA, 17 bp, Homo sapiens
agcttaaactgaatttg

SEQ ID NO: 1145332 - DNA, 12 bp, Homo sapiens
agcttaaagctt

SEQ ID NO: 1145333 - DNA, 18 bp, Homo sapiens
agcttaaagcttgatttg

SEQ ID NO: 1145334 - DNA, 16 bp, Homo sapiens
agcttaaattcctact

SEQ ID NO: 1145335 - DNA, 16 bp, Homo sapiens
agcttaactaatttga

SEQ ID NO: 1145336 - DNA, 14 bp, Homo sapiens
agcttaactttata

SEQ ID NO: 1145337 - DNA, 20 bp, Homo sapiens
agcttaagccactgcctctc

SEQ ID NO: 1145338 - DNA, 23 bp, Homo sapiens
agcttaagccactgcctctccct

SEQ ID NO: 1145339 - DNA, 17 bp, Homo sapiens
agcttaagcgttcatat

SEQ ID NO: 1145340 - DNA, 13 bp, Homo sapiens
agcttaattctcc

SEQ ID NO: 1145341 - DNA, 15 bp, Homo sapiens
agcttaattctcctt

SEQ ID NO: 1145342 - DNA, 13 bp, Homo sapiens
attaaaatctctt

SEQ ID NO: 1145343 - DNA, 14 bp, Homo sapiens
attaaaatctcttg

SEQ ID NO: 1145344 - DNA, 15 bp, Homo sapiens
attaaaatctcttga

SEQ ID NO: 1145345 - DNA, 15 bp, Homo sapiens
attaaaatctggaaa

SEQ ID NO: 1145346 - DNA, 17 bp, Homo sapiens
attaaaatctggaaatc

SEQ ID NO: 1145347 - DNA, 12 bp, Homo sapiens
attaaaatctta

SEQ ID NO: 1145348 - DNA, 19 bp, Homo sapiens
attaaaatgattgtaaaat

SEQ ID NO: 1145349 - DNA, 16 bp, Homo sapiens
attaaaatgcatggtg

SEQ ID NO: 1145350 - DNA, 14 bp, Homo sapiens
attaaaatgcttcc

SEQ ID NO: 1145351 - DNA, 22 bp, Homo sapiens
attaaaatgtcggatttatctt

SEQ ID NO: 1145352 - DNA, 23 bp, Homo sapiens
attaaaatgtcggatttatcttt

SEQ ID NO: 1145353 - DNA, 17 bp, Homo sapiens
attaaaatgtttgagca

SEQ ID NO: 1145354 - DNA, 15 bp, Homo sapiens
attaaaattacaaaa

SEQ ID NO: 1145355 - DNA, 17 bp, Homo sapiens
attaaaattctgaattt

SEQ ID NO: 1145356 - DNA, 14 bp, Homo sapiens
attaaacactgtaa

SEQ ID NO: 1145357 - DNA, 18 bp, Homo sapiens
attaaacagatttttaca

SEQ ID NO: 1145358 - DNA, 14 bp, Homo sapiens
attaaacatgctgt

SEQ ID NO: 1145359 - DNA, 13 bp, Homo sapiens
attaaacattttt

SEQ ID NO: 1145360 - DNA, 17 bp, Homo sapiens
attaaaccaagcagctt

SEQ ID NO: 1145361 - DNA, 17 bp, Homo sapiens
attaaacgagataatgt

SEQ ID NO: 1145362 - DNA, 18 bp, Homo sapiens
attaaacgtatgcatgtg

SEQ ID NO: 1145363 - DNA, 17 bp, Homo sapiens
attaaactgttaactta

SEQ ID NO: 1145364 - DNA, 19 bp, Homo sapiens
attaaacttaatctaaatg

SEQ ID NO: 1145365 - DNA, 13 bp, Homo sapiens
attaaacttgaag

SEQ ID NO: 1145366 - DNA, 18 bp, Homo sapiens
attaaacttttaattcat

SEQ ID NO: 1145367 - DNA, 19 bp, Homo sapiens
attaaacttttaattcatt

SEQ ID NO: 1145368 - DNA, 13 bp, Homo sapiens
attaaagacagag

SEQ ID NO: 1145369 - DNA, 15 bp, Homo sapiens
attaaagatgccata

SEQ ID NO: 1145370 - DNA, 21 bp, Homo sapiens
attaaagctcttcatttctgg

SEQ ID NO: 1145371 - DNA, 13 bp, Homo sapiens
attaaagtatgca

SEQ ID NO: 1145372 - DNA, 23 bp, Homo sapiens
attaaagtatgcaaaataaagaa

SEQ ID NO: 1145373 - DNA, 13 bp, Homo sapiens
attaaagtgactt

SEQ ID NO: 1145374 - DNA, 14 bp, Homo sapiens
attaaagtgacttt

SEQ ID NO: 1145375 - DNA, 13 bp, Homo sapiens
attaaataaaatg

SEQ ID NO: 1145376 - DNA, 15 bp, Homo sapiens
attaaataaactgtt

SEQ ID NO: 1145377 - DNA, 16 bp, Homo sapiens
attaaataaactgttt

SEQ ID NO: 1145378 - DNA, 22 bp, Homo sapiens
attaaataaactgttttcaagt

SEQ ID NO: 1145379 - DNA, 14 bp, Homo sapiens
attaaataaataaa

SEQ ID NO: 1145380 - DNA, 14 bp, Homo sapiens
attaaataatacaa

SEQ ID NO: 1145381 - DNA, 14 bp, Homo sapiens
attaaataatgtac

SEQ ID NO: 1145382 - DNA, 16 bp, Homo sapiens
attaaatacaaaactt

SEQ ID NO: 1145383 - DNA, 17 bp, Homo sapiens
attaaatacaaaacttc

SEQ ID NO: 1145384 - DNA, 12 bp, Homo sapiens
attaaatacaga

SEQ ID NO: 1145385 - DNA, 20 bp, Homo sapiens
attaaatacagacactaagt

SEQ ID NO: 1145386 - DNA, 23 bp, Homo sapiens
attaaatacatatggatgttact

SEQ ID NO: 1145387 - DNA, 22 bp, Homo sapiens
attaaatataaatatccccagg

SEQ ID NO: 1145388 - DNA, 15 bp, Homo sapiens
attaaatatatgtat

SEQ ID NO: 1145389 - DNA, 17 bp, Homo sapiens
attaaatatatgtatgt

SEQ ID NO: 1145390 - DNA, 15 bp, Homo sapiens
attaaatcttaaaca

SEQ ID NO: 1145391 - DNA, 21 bp, Homo sapiens
attaaatcttaaacaatgtat

SEQ ID NO: 1145392 - DNA, 22 bp, Homo sapiens
attaaatcttaaacaatgtata

SEQ ID NO: 1145393 - DNA, 22 bp, Homo sapiens
attaaatgtagcttcagtcatt

SEQ ID NO: 1145394 - DNA, 24 bp, Homo sapiens
attaaatgtagcttcagtcattaa

SEQ ID NO: 1145395 - DNA, 14 bp, Homo sapiens
attaaatgtattta

SEQ ID NO: 1145396 - DNA, 21 bp, Homo sapiens
attaaatgtctgacacattaa

SEQ ID NO: 1145397 - DNA, 10 bp, Homo sapiens
attaaatgtg

SEQ ID NO: 1145398 - DNA, 16 bp, Homo sapiens
attaaatgtggaagga

SEQ ID NO: 1145399 - DNA, 19 bp, Homo sapiens
attaaatgtggaaggaaaa

SEQ ID NO: 1145400 - DNA, 13 bp, Homo sapiens
attaaattaggaa

SEQ ID NO: 1145401 - DNA, 14 bp, Homo sapiens
attaaattcacaaa

SEQ ID NO: 1145402 - DNA, 17 bp, Homo sapiens
attaaattcacaaactt

SEQ ID NO: 1145403 - DNA, 14 bp, Homo sapiens
attaaattcttgca

SEQ ID NO: 1145404 - DNA, 15 bp, Homo sapiens
attaaatttaattag

SEQ ID NO: 1145405 - DNA, 17 bp, Homo sapiens
attaaattttttgttga

SEQ ID NO: 1145406 - DNA, 19 bp, Homo sapiens
attaaattttttgttgaca

SEQ ID NO: 1145407 - DNA, 19 bp, Homo sapiens
attaacaaaatgtatgtct

SEQ ID NO: 1145408 - DNA, 24 bp, Homo sapiens
attaacatacctaagaagtacatt

SEQ ID NO: 1145409 - DNA, 16 bp, Homo sapiens
attaacatattctaaa

SEQ ID NO: 1145410 - DNA, 20 bp, Homo sapiens
attaacatcagtgtctgttt

SEQ ID NO: 1145411 - DNA, 13 bp, Homo sapiens
attaacatcatct

SEQ ID NO: 1145412 - DNA, 12 bp, Homo sapiens
attaacattttt

SEQ ID NO: 1145413 - DNA, 17 bp, Homo sapiens
attaaccatttaataaa

SEQ ID NO: 1145414 - DNA, 23 bp, Homo sapiens
attaaccatttaataaagaaata

SEQ ID NO: 1145415 - DNA, 20 bp, Homo sapiens
attaaccctctgagtttttg

SEQ ID NO: 1145416 - DNA, 19 bp, Homo sapiens
cgtcctgcagaggaccaca

SEQ ID NO: 1145417 - DNA, 21 bp, Homo sapiens
cgtcctgcagaggaccacagt

SEQ ID NO: 1145418 - DNA, 14 bp, Homo sapiens
cgtcctgctggagt

SEQ ID NO: 1145419 - DNA, 17 bp, Homo sapiens
cgtcctgctgtccctgt

SEQ ID NO: 1145420 - DNA, 18 bp, Homo sapiens
cgtcctgctgtccctgtc

SEQ ID NO: 1145421 - DNA, 18 bp, Homo sapiens
cgtcctgctttggcagtg

SEQ ID NO: 1145422 - DNA, 22 bp, Homo sapiens
cgtcctgtagcacgctgcctgc

SEQ ID NO: 1145423 - DNA, 16 bp, Homo sapiens
cgtcctgtcactgatg

SEQ ID NO: 1145424 - DNA, 23 bp, Homo sapiens
cgtcctgtccacacccagctcag

SEQ ID NO: 1145425 - DNA, 21 bp, Homo sapiens
cgtccttccatatccctgccc

SEQ ID NO: 1145426 - DNA, 14 bp, Homo sapiens
cgtccttttggttt

SEQ ID NO: 1145427 - DNA, 16 bp, Homo sapiens
cgtcgaggggctctca

SEQ ID NO: 1145428 - DNA, 15 bp, Homo sapiens
cgtcgccccagtggc

SEQ ID NO: 1145429 - DNA, 16 bp, Homo sapiens
cgtcgccctcccaggc

SEQ ID NO: 1145430 - DNA, 14 bp, Homo sapiens
cgtcggaatggtaa

SEQ ID NO: 1145431 - DNA, 13 bp, Homo sapiens
cgtcggagctgcc

SEQ ID NO: 1145432 - DNA, 14 bp, Homo sapiens
cgtcggagctgcct

SEQ ID NO: 1145433 - DNA, 18 bp, Homo sapiens
cgtcggagctgcctgcag

SEQ ID NO: 1145434 - DNA, 19 bp, Homo sapiens
cgtctacatttcacattat

SEQ ID NO: 1145435 - DNA, 23 bp, Homo sapiens
cgtctcaaaaaaaaaaaaatgca

SEQ ID NO: 1145436 - DNA, 14 bp, Homo sapiens
cgtctcatcctcct

SEQ ID NO: 1145437 - DNA, 17 bp, Homo sapiens
cgtctcatcctcctttc

SEQ ID NO: 1145438 - DNA, 15 bp, Homo sapiens
cgtctcatcttctct

SEQ ID NO: 1145439 - DNA, 20 bp, Homo sapiens
cgtctccaggggctgcttcc

SEQ ID NO: 1145440 - DNA, 21 bp, Homo sapiens
cgtctccaggggctgcttcct

SEQ ID NO: 1145441 - DNA, 14 bp, Homo sapiens
cgtctcccccagag

SEQ ID NO: 1145442 - DNA, 20 bp, Homo sapiens
cgtctcccccagagtgctgt

SEQ ID NO: 1145443 - DNA, 22 bp, Homo sapiens
cgtctcccccgtgttcccctct

SEQ ID NO: 1145444 - DNA, 11 bp, Homo sapiens
cgtctccctcg

SEQ ID NO: 1145445 - DNA, 18 bp, Homo sapiens
cgtctcggcccctctgat

SEQ ID NO: 1145446 - DNA, 16 bp, Homo sapiens
cgtctctactaaaaat

SEQ ID NO: 1145447 - DNA, 13 bp, Homo sapiens
cgtctctgtcccg

SEQ ID NO: 1145448 - DNA, 13 bp, Homo sapiens
cgtctctgtcctc

SEQ ID NO: 1145449 - DNA, 14 bp, Homo sapiens
cgtctctgtcctcg

SEQ ID NO: 1145450 - DNA, 13 bp, Homo sapiens
cgtctctttttgg

SEQ ID NO: 1145451 - DNA, 15 bp, Homo sapiens
cgtctgaagcttgac

SEQ ID NO: 1145452 - DNA, 14 bp, Homo sapiens
cgtctgactccaga

SEQ ID NO: 1145453 - DNA, 20 bp, Homo sapiens
cgtctgactccctccccacc

SEQ ID NO: 1145454 - DNA, 21 bp, Homo sapiens
cgtctgactccctccccaccc

SEQ ID NO: 1145455 - DNA, 16 bp, Homo sapiens
cgtctgactctgggtt

SEQ ID NO: 1145456 - DNA, 23 bp, Homo sapiens
cgtctgaggcctgccccctgggc

SEQ ID NO: 1145457 - DNA, 23 bp, Homo sapiens
cgtctgcagggtgacgcctgaga

SEQ ID NO: 1145458 - DNA, 16 bp, Homo sapiens
cgtctgccaggcccat

SEQ ID NO: 1145459 - DNA, 18 bp, Homo sapiens
cgtctgccaggcccatct

SEQ ID NO: 1145460 - DNA, 23 bp, Homo sapiens
cgtctgccaggggtaacctggcc

SEQ ID NO: 1145461 - DNA, 18 bp, Homo sapiens
cgtctgccccaccctcaa

SEQ ID NO: 1145462 - DNA, 18 bp, Homo sapiens
cgtctggctccctgcccc

SEQ ID NO: 1145463 - DNA, 11 bp, Homo sapiens
cgtctgtctcg

SEQ ID NO: 1145464 - DNA, 13 bp, Homo sapiens
cgtctgtctgtct

SEQ ID NO: 1145465 - DNA, 12 bp, Homo sapiens
cgtcttcagagt

SEQ ID NO: 1145466 - DNA, 19 bp, Homo sapiens
cgtcttcatctccctgcca

SEQ ID NO: 1145467 - DNA, 17 bp, Homo sapiens
cgtcttccgcccctgcc

SEQ ID NO: 1145468 - DNA, 18 bp, Homo sapiens
cgtcttccgcccctgcct

SEQ ID NO: 1145469 - DNA, 11 bp, Homo sapiens
cgtcttccttc

SEQ ID NO: 1145470 - DNA, 18 bp, Homo sapiens
cgtcttcgccctctgaaa

SEQ ID NO: 1145471 - DNA, 14 bp, Homo sapiens
cgtcttgcccagca

SEQ ID NO: 1145472 - DNA, 15 bp, Homo sapiens
cgtcttgcccagcag

SEQ ID NO: 1145473 - DNA, 16 bp, Homo sapiens
cgtcttgcccagcagc

SEQ ID NO: 1145474 - DNA, 17 bp, Homo sapiens
cgtcttgcccagcagct

SEQ ID NO: 1145475 - DNA, 16 bp, Homo sapiens
cgtctttgtgtatggg

SEQ ID NO: 1145476 - DNA, 12 bp, Homo sapiens
cgtgaaacacac

SEQ ID NO: 1145477 - DNA, 22 bp, Homo sapiens
cgtgaaacacaccaggctgtgg

SEQ ID NO: 1145478 - DNA, 10 bp, Homo sapiens
cgtgaaatcc

SEQ ID NO: 1145479 - DNA, 17 bp, Homo sapiens
cgtgaaatttgcctctg

SEQ ID NO: 1145480 - DNA, 14 bp, Homo sapiens
cgtgaaccagaggg

SEQ ID NO: 1145481 - DNA, 19 bp, Homo sapiens
cgtgaacccaggaggcgga

SEQ ID NO: 1145482 - DNA, 19 bp, Homo sapiens
cgtgaagaaataaatgaaa

SEQ ID NO: 1145483 - DNA, 16 bp, Homo sapiens
cgtgaagcagtgcctc

SEQ ID NO: 1145484 - DNA, 22 bp, Homo sapiens
cgtgaatagtcttttgcatgtc

SEQ ID NO: 1145485 - DNA, 15 bp, Homo sapiens
cgtgacaacacaaat

SEQ ID NO: 1145486 - DNA, 13 bp, Homo sapiens
cgtgacaggctcg

SEQ ID NO: 1145487 - DNA, 22 bp, Homo sapiens
cgtgacaggctcgtcagccacc

SEQ ID NO: 1145488 - DNA, 16 bp, Homo sapiens
cgtgacagtgcctggg

SEQ ID NO: 1145489 - DNA, 13 bp, Homo sapiens
cgtgacagtggct

SEQ ID NO: 1145490 - DNA, 15 bp, Homo sapiens
cgtgacccgacctgg

SEQ ID NO: 1145491 - DNA, 16 bp, Homo sapiens
cgtgacccttcagggc

SEQ ID NO: 1145492 - DNA, 19 bp, Homo sapiens
cgtgacccttcagggccag

SEQ ID NO: 1145493 - DNA, 21 bp, Homo sapiens
cgtgacctctgcaagacaaag

SEQ ID NO: 1145494 - DNA, 16 bp, Homo sapiens
cgtgactcacccaagc

SEQ ID NO: 1145495 - DNA, 18 bp, Homo sapiens
cgtgactcacccaagcat

SEQ ID NO: 1145496 - DNA, 17 bp, Homo sapiens
cgtgactgccccaactc

SEQ ID NO: 1145497 - DNA, 17 bp, Homo sapiens
cgtgagagaatctgcct

SEQ ID NO: 1145498 - DNA, 14 bp, Homo sapiens
cgtgagccaccgcg

SEQ ID NO: 1145499 - DNA, 22 bp, Homo sapiens
cgtgagctgcccggcgcctgcc

SEQ ID NO: 1145500 - DNA, 15 bp, Homo sapiens
cgtgagctggggact

SEQ ID NO: 1145501 - DNA, 22 bp, Homo sapiens
cgtgagggcaagagggggacct

SEQ ID NO: 1145502 - DNA, 19 bp, Homo sapiens
cgtgagtgaaccatcatta

SEQ ID NO: 1145503 - DNA, 17 bp, Homo sapiens
cgtgagtgacatagcct

SEQ ID NO: 1145504 - DNA, 16 bp, Homo sapiens
cgtgataatttttgaa

SEQ ID NO: 1145505 - DNA, 16 bp, Homo sapiens
cgtgatcactgagcca

SEQ ID NO: 1145506 - DNA, 17 bp, Homo sapiens
cgtgatggagaggacag

SEQ ID NO: 1145507 - DNA, 21 bp, Homo sapiens
cgtgatgtggaggaagagcca

SEQ ID NO: 1145508 - DNA, 23 bp, Homo sapiens
cgtgatgtggaggaagagccacc

SEQ ID NO: 1145509 - DNA, 20 bp, Homo sapiens
cgtgatgttttgaatgtgga

SEQ ID NO: 1145510 - DNA, 21 bp, Homo sapiens
cgtgatttggaagagaggcac

SEQ ID NO: 1145511 - DNA, 17 bp, Homo sapiens
cgtgcaaacaacctgaa

SEQ ID NO: 1145512 - DNA, 20 bp, Homo sapiens
cgtgcaaacaacctgaatct

SEQ ID NO: 1145513 - DNA, 20 bp, Homo sapiens
cgtgcacgtggagagctggt

SEQ ID NO: 1145514 - DNA, 22 bp, Homo sapiens
cgtgcacgtggagagctggtgc

SEQ ID NO: 1145515 - DNA, 13 bp, Homo sapiens
cgtgcactctgct

SEQ ID NO: 1145516 - DNA, 17 bp, Homo sapiens
cgtgcactctgctaatc

SEQ ID NO: 1145517 - DNA, 12 bp, Homo sapiens
cgtgcactgaca

SEQ ID NO: 1145518 - DNA, 16 bp, Homo sapiens
ctctttaatgctgtct

SEQ ID NO: 1145519 - DNA, 18 bp, Homo sapiens
ctctttagtgttctgttt

SEQ ID NO: 1145520 - DNA, 17 bp, Homo sapiens
ctctttatgactgtttt

SEQ ID NO: 1145521 - DNA, 19 bp, Homo sapiens
ctctttatgcttgcttggg

SEQ ID NO: 1145522 - DNA, 20 bp, Homo sapiens
ctctttattgtctgtaaatc

SEQ ID NO: 1145523 - DNA, 20 bp, Homo sapiens
ctctttatttctagcagagt

SEQ ID NO: 1145524 - DNA, 17 bp, Homo sapiens
ctctttatttttctctt

SEQ ID NO: 1145525 - DNA, 14 bp, Homo sapiens
ctctttcaaagaaa

SEQ ID NO: 1145526 - DNA, 16 bp, Homo sapiens
ctctttcacattgttt

SEQ ID NO: 1145527 - DNA, 22 bp, Homo sapiens
ctctttcagagaggtctcaggt

SEQ ID NO: 1145528 - DNA, 14 bp, Homo sapiens
ctctttcatctgta

SEQ ID NO: 1145529 - DNA, 18 bp, Homo sapiens
ctctttcccctcctttgt

SEQ ID NO: 1145530 - DNA, 16 bp, Homo sapiens
ctctttccctaggaaa

SEQ ID NO: 1145531 - DNA, 14 bp, Homo sapiens
ctctttccctgcga

SEQ ID NO: 1145532 - DNA, 17 bp, Homo sapiens
ctctttcctaaagccaa

SEQ ID NO: 1145533 - DNA, 11 bp, Homo sapiens
ctctttccttg

SEQ ID NO: 1145534 - DNA, 22 bp, Homo sapiens
ctctttccttgagctgttgtga

SEQ ID NO: 1145535 - DNA, 21 bp, Homo sapiens
ctctttctacatgactgggcc

SEQ ID NO: 1145536 - DNA, 22 bp, Homo sapiens
ctctttctacatgactgggcct

SEQ ID NO: 1145537 - DNA, 14 bp, Homo sapiens
ctctttctcccttt

SEQ ID NO: 1145538 - DNA, 18 bp, Homo sapiens
ctctttctccttagtctt

SEQ ID NO: 1145539 - DNA, 15 bp, Homo sapiens
ctctttctctcccca

SEQ ID NO: 1145540 - DNA, 17 bp, Homo sapiens
ctctttctctcttccct

SEQ ID NO: 1145541 - DNA, 16 bp, Homo sapiens
ctctttctctgccagt

SEQ ID NO: 1145542 - DNA, 22 bp, Homo sapiens
ctctttctctggtggtcttcct

SEQ ID NO: 1145543 - DNA, 13 bp, Homo sapiens
ctctttctgctct

SEQ ID NO: 1145544 - DNA, 11 bp, Homo sapiens
ctctttctgta

SEQ ID NO: 1145545 - DNA, 23 bp, Homo sapiens
ctctttcttataatactctgttg

SEQ ID NO: 1145546 - DNA, 15 bp, Homo sapiens
ctctttcttcccatg

SEQ ID NO: 1145547 - DNA, 23 bp, Homo sapiens
ctctttcttcctttactttccct

SEQ ID NO: 1145548 - DNA, 17 bp, Homo sapiens
ctctttcttcctttcta

SEQ ID NO: 1145549 - DNA, 22 bp, Homo sapiens
ctctttgaagaaaagaaaaaac

SEQ ID NO: 1145550 - DNA, 10 bp, Homo sapiens
ctctttgaga

SEQ ID NO: 1145551 - DNA, 13 bp, Homo sapiens
ctctttgctgcag

SEQ ID NO: 1145552 - DNA, 16 bp, Homo sapiens
ctctttgctttctggt

SEQ ID NO: 1145553 - DNA, 14 bp, Homo sapiens
ctctttgctttgct

SEQ ID NO: 1145554 - DNA, 20 bp, Homo sapiens
ctctttgctttgctttctgc

SEQ ID NO: 1145555 - DNA, 15 bp, Homo sapiens
ctctttgggaatgtt

SEQ ID NO: 1145556 - DNA, 23 bp, Homo sapiens
ctctttggtctattttctgcaga

SEQ ID NO: 1145557 - DNA, 20 bp, Homo sapiens
ctctttgttctaaagatgga

SEQ ID NO: 1145558 - DNA, 12 bp, Homo sapiens
ctctttgtttct

SEQ ID NO: 1145559 - DNA, 19 bp, Homo sapiens
ctctttgtttctgtttctt

SEQ ID NO: 1145560 - DNA, 20 bp, Homo sapiens
ctctttgtttctgtttcttg

SEQ ID NO: 1145561 - DNA, 14 bp, Homo sapiens
ctcttttaaaatat

SEQ ID NO: 1145562 - DNA, 12 bp, Homo sapiens
ctcttttaccaa

SEQ ID NO: 1145563 - DNA, 20 bp, Homo sapiens
ctcttttaccaacttcctct

SEQ ID NO: 1145564 - DNA, 16 bp, Homo sapiens
ctcttttatatttgta

SEQ ID NO: 1145565 - DNA, 15 bp, Homo sapiens
ctcttttccctctct

SEQ ID NO: 1145566 - DNA, 14 bp, Homo sapiens
ctcttttcctctct

SEQ ID NO: 1145567 - DNA, 10 bp, Homo sapiens
ctcttttctt

SEQ ID NO: 1145568 - DNA, 16 bp, Homo sapiens
ctcttttgctttctgt

SEQ ID NO: 1145569 - DNA, 18 bp, Homo sapiens
ctcttttgtgatgaacat

SEQ ID NO: 1145570 - DNA, 24 bp, Homo sapiens
ctcttttgtgatgaacatattcat

SEQ ID NO: 1145571 - DNA, 16 bp, Homo sapiens
ctcttttgttgtcctt

SEQ ID NO: 1145572 - DNA, 17 bp, Homo sapiens
ctcttttgttgtccttg

SEQ ID NO: 1145573 - DNA, 20 bp, Homo sapiens
ctctttttatttaaatgtga

SEQ ID NO: 1145574 - DNA, 14 bp, Homo sapiens
ctctttttcctcct

SEQ ID NO: 1145575 - DNA, 15 bp, Homo sapiens
ctctttttcctcctg

SEQ ID NO: 1145576 - DNA, 13 bp, Homo sapiens
ctctttttccttc

SEQ ID NO: 1145577 - DNA, 15 bp, Homo sapiens
ctctttttccttctt

SEQ ID NO: 1145578 - DNA, 21 bp, Homo sapiens
ctctttttgggctcctttttc

SEQ ID NO: 1145579 - DNA, 20 bp, Homo sapiens
ctctttttggtaataacaaa

SEQ ID NO: 1145580 - DNA, 17 bp, Homo sapiens
ctcttttttattctgtt

SEQ ID NO: 1145581 - DNA, 17 bp, Homo sapiens
ctcttttttcgtttgtt

SEQ ID NO: 1145582 - DNA, 17 bp, Homo sapiens
ctcttttttgtttgttt

SEQ ID NO: 1145583 - DNA, 16 bp, Homo sapiens
ctctttttttgagtga

SEQ ID NO: 1145584 - DNA, 15 bp, Homo sapiens
ctgaaaaaaagttta

SEQ ID NO: 1145585 - DNA, 13 bp, Homo sapiens
ctgaaaaaatact

SEQ ID NO: 1145586 - DNA, 12 bp, Homo sapiens
ctgaaaaatcac

SEQ ID NO: 1145587 - DNA, 19 bp, Homo sapiens
ctgaaaaatctaagtgata

SEQ ID NO: 1145588 - DNA, 15 bp, Homo sapiens
ctgaaaaattccttt

SEQ ID NO: 1145589 - DNA, 20 bp, Homo sapiens
ctgaaaacctctcctcatgt

SEQ ID NO: 1145590 - DNA, 17 bp, Homo sapiens
ctgaaaacgaaggggcc

SEQ ID NO: 1145591 - DNA, 12 bp, Homo sapiens
ctgaaaagaagg

SEQ ID NO: 1145592 - DNA, 20 bp, Homo sapiens
ctgaaaagcaattgccctgt

SEQ ID NO: 1145593 - DNA, 21 bp, Homo sapiens
ctgaaaagcaattgccctgta

SEQ ID NO: 1145594 - DNA, 14 bp, Homo sapiens
ctgaaaagggcact

SEQ ID NO: 1145595 - DNA, 20 bp, Homo sapiens
ctgaaaagggcactcccaac

SEQ ID NO: 1145596 - DNA, 17 bp, Homo sapiens
ctgaaaaggtttatgaa

SEQ ID NO: 1145597 - DNA, 20 bp, Homo sapiens
ctgaaaatagaacttgcctt

SEQ ID NO: 1145598 - DNA, 17 bp, Homo sapiens
ctgaaaatattgtttta

SEQ ID NO: 1145599 - DNA, 21 bp, Homo sapiens
ctgaaaatcctcgcacacact

SEQ ID NO: 1145600 - DNA, 15 bp, Homo sapiens
ctgaaaatctaatat

SEQ ID NO: 1145601 - DNA, 20 bp, Homo sapiens
ctgaaaatctaatattaaaa

SEQ ID NO: 1145602 - DNA, 12 bp, Homo sapiens
ctgaaaatgtaa

SEQ ID NO: 1145603 - DNA, 13 bp, Homo sapiens
ctgaaaatgtaaa

SEQ ID NO: 1145604 - DNA, 15 bp, Homo sapiens
ctgaaaatgtaaatt

SEQ ID NO: 1145605 - DNA, 16 bp, Homo sapiens
ctgaaaatgtcacatt

SEQ ID NO: 1145606 - DNA, 17 bp, Homo sapiens
ctgaaaatgtcacattc

SEQ ID NO: 1145607 - DNA, 13 bp, Homo sapiens
ctgaaaattctgg

SEQ ID NO: 1145608 - DNA, 16 bp, Homo sapiens
ctgaaaattctggaag

SEQ ID NO: 1145609 - DNA, 15 bp, Homo sapiens
ctgaaacaaaatgtt

SEQ ID NO: 1145610 - DNA, 14 bp, Homo sapiens
agcaggtaccactg

SEQ ID NO: 1145611 - DNA, 17 bp, Homo sapiens
agcaggtagaagaaaag

SEQ ID NO: 1145612 - DNA, 13 bp, Homo sapiens
agcaggtgactgt

SEQ ID NO: 1145613 - DNA, 19 bp, Homo sapiens
agcaggtgactgtgctgtg

SEQ ID NO: 1145614 - DNA, 20 bp, Homo sapiens
agcaggtgattggaccaggc

SEQ ID NO: 1145615 - DNA, 23 bp, Homo sapiens
agcaggtgattggaccaggccat

SEQ ID NO: 1145616 - DNA, 14 bp, Homo sapiens
agcaggtgctacaa

SEQ ID NO: 1145617 - DNA, 15 bp, Homo sapiens
agcaggtgctgggct

SEQ ID NO: 1145618 - DNA, 16 bp, Homo sapiens
agcaggtggcatctct

SEQ ID NO: 1145619 - DNA, 13 bp, Homo sapiens
agcaggtggcttg

SEQ ID NO: 1145620 - DNA, 14 bp, Homo sapiens
agcaggtggcttgt

SEQ ID NO: 1145621 - DNA, 17 bp, Homo sapiens
agcaggtgggaaatggt

SEQ ID NO: 1145622 - DNA, 21 bp, Homo sapiens
agcaggtggtcctgagacctg

SEQ ID NO: 1145623 - DNA, 14 bp, Homo sapiens
agcaggtgtggtgg

SEQ ID NO: 1145624 - DNA, 19 bp, Homo sapiens
agcaggtgtggtggctcat

SEQ ID NO: 1145625 - DNA, 17 bp, Homo sapiens
agcaggttcccaagctc

SEQ ID NO: 1145626 - DNA, 15 bp, Homo sapiens
agcaggttcttgatg

SEQ ID NO: 1145627 - DNA, 20 bp, Homo sapiens
agcaggttgaggggctcctg

SEQ ID NO: 1145628 - DNA, 21 bp, Homo sapiens
agcaggttgaggggctcctgg

SEQ ID NO: 1145629 - DNA, 22 bp, Homo sapiens
agcaggtttcactattcctatg

SEQ ID NO: 1145630 - DNA, 20 bp, Homo sapiens
agcagtaaatttgctagcag

SEQ ID NO: 1145631 - DNA, 17 bp, Homo sapiens
agcagtaactgacaact

SEQ ID NO: 1145632 - DNA, 14 bp, Homo sapiens
agcagtatatgtta

SEQ ID NO: 1145633 - DNA, 15 bp, Homo sapiens
agcagtatattagta

SEQ ID NO: 1145634 - DNA, 13 bp, Homo sapiens
agcagtattttgg

SEQ ID NO: 1145635 - DNA, 16 bp, Homo sapiens
agcagtcagagtccag

SEQ ID NO: 1145636 - DNA, 13 bp, Homo sapiens
agcagtcagccct

SEQ ID NO: 1145637 - DNA, 23 bp, Homo sapiens
agcagtcaggggtcaggtgtcag

SEQ ID NO: 1145638 - DNA, 20 bp, Homo sapiens
agcagtcccagtattctcag

SEQ ID NO: 1145639 - DNA, 19 bp, Homo sapiens
agcagtcctgcctcagcct

SEQ ID NO: 1145640 - DNA, 14 bp, Homo sapiens
agcagtcgtgcctg

SEQ ID NO: 1145641 - DNA, 17 bp, Homo sapiens
agcagtctaccctgtcc

SEQ ID NO: 1145642 - DNA, 15 bp, Homo sapiens
agcagtcttgctctg

SEQ ID NO: 1145643 - DNA, 18 bp, Homo sapiens
agcagtgaatgctagaca

SEQ ID NO: 1145644 - DNA, 22 bp, Homo sapiens
agcagtgagaaaaagctcctgt

SEQ ID NO: 1145645 - DNA, 14 bp, Homo sapiens
agcagtgagccgca

SEQ ID NO: 1145646 - DNA, 24 bp, Homo sapiens
agcagtgagtattggaagacttgg

SEQ ID NO: 1145647 - DNA, 21 bp, Homo sapiens
agcagtgcacatttcatagtt

SEQ ID NO: 1145648 - DNA, 19 bp, Homo sapiens
agcagtgcctcgaggcacc

SEQ ID NO: 1145649 - DNA, 15 bp, Homo sapiens
agcagtggacaccag

SEQ ID NO: 1145650 - DNA, 19 bp, Homo sapiens
agcagtggacaccaggagt

SEQ ID NO: 1145651 - DNA, 22 bp, Homo sapiens
agcagtggcctttttctgagat

SEQ ID NO: 1145652 - DNA, 12 bp, Homo sapiens
agcagtggctgg

SEQ ID NO: 1145653 - DNA, 13 bp, Homo sapiens
agcagtggctggt

SEQ ID NO: 1145654 - DNA, 18 bp, Homo sapiens
agcagtggctggtccagg

SEQ ID NO: 1145655 - DNA, 19 bp, Homo sapiens
agcagtggctggtccaggg

SEQ ID NO: 1145656 - DNA, 21 bp, Homo sapiens
agcagtggctggtgcccatga

SEQ ID NO: 1145657 - DNA, 22 bp, Homo sapiens
agcagtggctggtgcccatgaa

SEQ ID NO: 1145658 - DNA, 14 bp, Homo sapiens
agcagtgggcaggt

SEQ ID NO: 1145659 - DNA, 23 bp, Homo sapiens
agcagtgtcctgtgctttctgca

SEQ ID NO: 1145660 - DNA, 20 bp, Homo sapiens
agcagtgtgaatagcctggc

SEQ ID NO: 1145661 - DNA, 15 bp, Homo sapiens
agcagtgtgaggcca

SEQ ID NO: 1145662 - DNA, 22 bp, Homo sapiens
agcagtgtgctttgcattttct

SEQ ID NO: 1145663 - DNA, 19 bp, Homo sapiens
agcagtgttacttgcaggt

SEQ ID NO: 1145664 - DNA, 22 bp, Homo sapiens
agcagttaactttaagactgag

SEQ ID NO: 1145665 - DNA, 19 bp, Homo sapiens
agcagttaatttatatatt

SEQ ID NO: 1145666 - DNA, 21 bp, Homo sapiens
agcagttatggtgatgactta

SEQ ID NO: 1145667 - DNA, 16 bp, Homo sapiens
agcagttctgcaaata

SEQ ID NO: 1145668 - DNA, 23 bp, Homo sapiens
agcagttctgcaaatagaaaaca

SEQ ID NO: 1145669 - DNA, 20 bp, Homo sapiens
agcagttgacatccaaatct

SEQ ID NO: 1145670 - DNA, 15 bp, Homo sapiens
agcagttgctcacat

SEQ ID NO: 1145671 - DNA, 20 bp, Homo sapiens
agcagttgctcacatgtctt

SEQ ID NO: 1145672 - DNA, 16 bp, Homo sapiens
agcagttggggccctc

SEQ ID NO: 1145673 - DNA, 17 bp, Homo sapiens
agcagttggggccctct

SEQ ID NO: 1145674 - DNA, 18 bp, Homo sapiens
agcagttggggccctctt

SEQ ID NO: 1145675 - DNA, 19 bp, Homo sapiens
agcagttggggccctcttg

SEQ ID NO: 1145676 - DNA, 22 bp, Homo sapiens
agcagttggggccctcttgcca

SEQ ID NO: 1145677 - DNA, 14 bp, Homo sapiens
agcagtttgtgaat

SEQ ID NO: 1145678 - DNA, 17 bp, Homo sapiens
agcagttttcaagtcaa

SEQ ID NO: 1145679 - DNA, 17 bp, Homo sapiens
agcagttttcccctggc

SEQ ID NO: 1145680 - DNA, 18 bp, Homo sapiens
agcagttttcccctggcc

SEQ ID NO: 1145681 - DNA, 19 bp, Homo sapiens
agcagttttcccctggcct

SEQ ID NO: 1145682 - DNA, 21 bp, Homo sapiens
agcataaaaacattttaaaaa

SEQ ID NO: 1145683 - DNA, 19 bp, Homo sapiens
agcataaaaattagccaag

SEQ ID NO: 1145684 - DNA, 14 bp, Homo sapiens
agcataaaatgaaa

SEQ ID NO: 1145685 - DNA, 18 bp, Homo sapiens
agcataaagctcaaatga

SEQ ID NO: 1145686 - DNA, 17 bp, Homo sapiens
agcataaataaaactga

SEQ ID NO: 1145687 - DNA, 22 bp, Homo sapiens
agcataactgtagctcaagttt

SEQ ID NO: 1145688 - DNA, 17 bp, Homo sapiens
agcataagtttctggga

SEQ ID NO: 1145689 - DNA, 23 bp, Homo sapiens
agcataagtttctgggacctcag

SEQ ID NO: 1145690 - DNA, 13 bp, Homo sapiens
agcataatatgaa

SEQ ID NO: 1145691 - DNA, 21 bp, Homo sapiens
agcataatgctcccatctcct

SEQ ID NO: 1145692 - DNA, 22 bp, Homo sapiens
agcataatgctcccatctcctg

SEQ ID NO: 1145693 - DNA, 21 bp, Homo sapiens
agcataatttaaaaatatatt

SEQ ID NO: 1145694 - DNA, 15 bp, Homo sapiens
agcataatttgttta

SEQ ID NO: 1145695 - DNA, 13 bp, Homo sapiens
agcatacatttat

SEQ ID NO: 1145696 - DNA, 17 bp, Homo sapiens
agcatacgtacacattt

SEQ ID NO: 1145697 - DNA, 18 bp, Homo sapiens
agcatacgtacacatttt

SEQ ID NO: 1145698 - DNA, 13 bp, Homo sapiens
agcatacttcaaa

SEQ ID NO: 1145699 - DNA, 16 bp, Homo sapiens
agcatagccagcattc

SEQ ID NO: 1145700 - DNA, 15 bp, Homo sapiens
agcatagcctgcctg

SEQ ID NO: 1145701 - DNA, 17 bp, Homo sapiens
agcataggggggagggt

SEQ ID NO: 1145702 - DNA, 15 bp, Homo sapiens
agcatagtgaacaca

SEQ ID NO: 1145703 - DNA, 12 bp, Homo sapiens
agcatatactgg

SEQ ID NO: 1145704 - DNA, 20 bp, Homo sapiens
agcatatctggtatatgtca

SEQ ID NO: 1145705 - DNA, 23 bp, Homo sapiens
agcatatctggtatatgtcatta

SEQ ID NO: 1145706 - DNA, 19 bp, Homo sapiens
agcatatgatttcttgctt

SEQ ID NO: 1145707 - DNA, 21 bp, Homo sapiens
agcatatgatttcttgctttg

SEQ ID NO: 1145708 - DNA, 20 bp, Homo sapiens
agcatatgtgtaaagattta

SEQ ID NO: 1145709 - DNA, 21 bp, Homo sapiens
agcatatttgtatagttgctt

SEQ ID NO: 1145710 - DNA, 22 bp, Homo sapiens
agcatatttgtatagttgcttg

SEQ ID NO: 1145711 - DNA, 22 bp, Homo sapiens
agcatattttctctaggctttt

SEQ ID NO: 1145712 - DNA, 14 bp, Homo sapiens
agcatattttctta

SEQ ID NO: 1145713 - DNA, 15 bp, Homo sapiens
agcatattttcttac

SEQ ID NO: 1145714 - DNA, 13 bp, Homo sapiens
agcatcaatcttg

SEQ ID NO: 1145715 - DNA, 14 bp, Homo sapiens
agcatcaatcttgt

SEQ ID NO: 1145716 - DNA, 16 bp, Homo sapiens
agcatcacctcaggcc

SEQ ID NO: 1145717 - DNA, 22 bp, Homo sapiens
agcatcagccagtgaatctgtt

SEQ ID NO: 1145718 - DNA, 22 bp, Homo sapiens
agcatcagggttaagaagactt

SEQ ID NO: 1145719 - DNA, 16 bp, Homo sapiens
agcatcattttgcatt

SEQ ID NO: 1145720 - DNA, 18 bp, Homo sapiens
agcatcattttgcattca

SEQ ID NO: 1145721 - DNA, 20 bp, Homo sapiens
agcatcattttgcattcaaa

SEQ ID NO: 1145722 - DNA, 23 bp, Homo sapiens
agcatccactggaaaaggtgaaa

SEQ ID NO: 1145723 - DNA, 12 bp, Homo sapiens
agcatcccagcc

SEQ ID NO: 1145724 - DNA, 16 bp, Homo sapiens
agcatcccccaaagtt

SEQ ID NO: 1145725 - DNA, 19 bp, Homo sapiens
agcatccccctcctctccc

SEQ ID NO: 1145726 - DNA, 22 bp, Homo sapiens
agcatccccctcctctccctgt

SEQ ID NO: 1145727 - DNA, 14 bp, Homo sapiens
agcatcccggagga

SEQ ID NO: 1145728 - DNA, 13 bp, Homo sapiens
agcatccctggag

SEQ ID NO: 1145729 - DNA, 20 bp, Homo sapiens
agcatccctggagcaggagc

SEQ ID NO: 1145730 - DNA, 19 bp, Homo sapiens
agcatccggccaaatgcaa

SEQ ID NO: 1145731 - DNA, 22 bp, Homo sapiens
agcatttccaacaccacagaca

SEQ ID NO: 1145732 - DNA, 23 bp, Homo sapiens
agcatttccaacaccacagacac

SEQ ID NO: 1145733 - DNA, 21 bp, Homo sapiens
agcatttccagagcagagcct

SEQ ID NO: 1145734 - DNA, 14 bp, Homo sapiens
agcatttctcatca

SEQ ID NO: 1145735 - DNA, 18 bp, Homo sapiens
agcatttctcatcagtag

SEQ ID NO: 1145736 - DNA, 17 bp, Homo sapiens
agcatttgcacctctgt

SEQ ID NO: 1145737 - DNA, 14 bp, Homo sapiens
agcatttggtgcct

SEQ ID NO: 1145738 - DNA, 14 bp, Homo sapiens
agcatttgtatttt

SEQ ID NO: 1145739 - DNA, 13 bp, Homo sapiens
agcatttgtcctt

SEQ ID NO: 1145740 - DNA, 14 bp, Homo sapiens
agcatttgtttcta

SEQ ID NO: 1145741 - DNA, 15 bp, Homo sapiens
agcattttaattctc

SEQ ID NO: 1145742 - DNA, 14 bp, Homo sapiens
agcattttcacatt

SEQ ID NO: 1145743 - DNA, 18 bp, Homo sapiens
agcattttcctgtttact

SEQ ID NO: 1145744 - DNA, 15 bp, Homo sapiens
agcattttgctaaat

SEQ ID NO: 1145745 - DNA, 14 bp, Homo sapiens
agcatttttaaggg

SEQ ID NO: 1145746 - DNA, 12 bp, Homo sapiens
agcatttttcaa

SEQ ID NO: 1145747 - DNA, 16 bp, Homo sapiens
agcatttttgatttat

SEQ ID NO: 1145748 - DNA, 15 bp, Homo sapiens
agcattttttaacct

SEQ ID NO: 1145749 - DNA, 18 bp, Homo sapiens
agccaaaaatagctaaat

SEQ ID NO: 1145750 - DNA, 15 bp, Homo sapiens
agccaaaactgagca

SEQ ID NO: 1145751 - DNA, 14 bp, Homo sapiens
agccaaaagtccct

SEQ ID NO: 1145752 - DNA, 15 bp, Homo sapiens
agccaaaagtccctc

SEQ ID NO: 1145753 - DNA, 17 bp, Homo sapiens
agccaaaagtccctccc

SEQ ID NO: 1145754 - DNA, 22 bp, Homo sapiens
agccaaaagtccctccctgcct

SEQ ID NO: 1145755 - DNA, 23 bp, Homo sapiens
agccaaaagtccctccctgcctg

SEQ ID NO: 1145756 - DNA, 17 bp, Homo sapiens
agccaaaatgtaggctt

SEQ ID NO: 1145757 - DNA, 14 bp, Homo sapiens
agccaaacaaaact

SEQ ID NO: 1145758 - DNA, 18 bp, Homo sapiens
agccaaacccatgaggca

SEQ ID NO: 1145759 - DNA, 14 bp, Homo sapiens
agccaaaccctgtc

SEQ ID NO: 1145760 - DNA, 15 bp, Homo sapiens
agccaaaccctgtct

SEQ ID NO: 1145761 - DNA, 18 bp, Homo sapiens
agccaaagaaacaagctg

SEQ ID NO: 1145762 - DNA, 19 bp, Homo sapiens
agccaaagaaacaagctgt

SEQ ID NO: 1145763 - DNA, 18 bp, Homo sapiens
agccaaaggggagccaga

SEQ ID NO: 1145764 - DNA, 10 bp, Homo sapiens
agccaaagtt

SEQ ID NO: 1145765 - DNA, 21 bp, Homo sapiens
agccaaagttttcaaactgct

SEQ ID NO: 1145766 - DNA, 19 bp, Homo sapiens
agccaaatttaaaactgtt

SEQ ID NO: 1145767 - DNA, 14 bp, Homo sapiens
agccaaattttatc

SEQ ID NO: 1145768 - DNA, 19 bp, Homo sapiens
agccaacaactctgccttt

SEQ ID NO: 1145769 - DNA, 14 bp, Homo sapiens
agccaacaagaccg

SEQ ID NO: 1145770 - DNA, 21 bp, Homo sapiens
agccaacaagaccgccccagg

SEQ ID NO: 1145771 - DNA, 24 bp, Homo sapiens
agccaacaagaccgccccagggct

SEQ ID NO: 1145772 - DNA, 22 bp, Homo sapiens
agccaacacgcacctgcctcag

SEQ ID NO: 1145773 - DNA, 21 bp, Homo sapiens
agccaacaggtggcaggacca

SEQ ID NO: 1145774 - DNA, 15 bp, Homo sapiens
agccaaccagccttt

SEQ ID NO: 1145775 - DNA, 16 bp, Homo sapiens
agccaacctaagcaag

SEQ ID NO: 1145776 - DNA, 18 bp, Homo sapiens
agccaacctcggcttgtg

SEQ ID NO: 1145777 - DNA, 21 bp, Homo sapiens
agccaacgacaaagccaaact

SEQ ID NO: 1145778 - DNA, 17 bp, Homo sapiens
agccaacttgatgtgaa

SEQ ID NO: 1145779 - DNA, 21 bp, Homo sapiens
agccaagaaacactgcctgcc

SEQ ID NO: 1145780 - DNA, 16 bp, Homo sapiens
agccaagaaagatgta

SEQ ID NO: 1145781 - DNA, 21 bp, Homo sapiens
agccaagacccaacaggtgct

SEQ ID NO: 1145782 - DNA, 20 bp, Homo sapiens
agccaagattttcctcttgt

SEQ ID NO: 1145783 - DNA, 20 bp, Homo sapiens
agccaagcaaaccaatggtg

SEQ ID NO: 1145784 - DNA, 22 bp, Homo sapiens
agccaagccctaagcctgtccc

SEQ ID NO: 1145785 - DNA, 17 bp, Homo sapiens
agccaagctccctggag

SEQ ID NO: 1145786 - DNA, 20 bp, Homo sapiens
agccaagctccctggagccc

SEQ ID NO: 1145787 - DNA, 13 bp, Homo sapiens
agccaagctgcac

SEQ ID NO: 1145788 - DNA, 16 bp, Homo sapiens
agccaagctttaaatt

SEQ ID NO: 1145789 - DNA, 14 bp, Homo sapiens
agccaaggaatgtg

SEQ ID NO: 1145790 - DNA, 18 bp, Homo sapiens
agccaaggaatgtgtcca

SEQ ID NO: 1145791 - DNA, 23 bp, Homo sapiens
agccaaggaatgtgtccaagaca

SEQ ID NO: 1145792 - DNA, 21 bp, Homo sapiens
agccaaggagtcactgagacc

SEQ ID NO: 1145793 - DNA, 22 bp, Homo sapiens
agccaaggatagaagctgcagt

SEQ ID NO: 1145794 - DNA, 12 bp, Homo sapiens
agccaaggccac

SEQ ID NO: 1145795 - DNA, 22 bp, Homo sapiens
agccaaggccgaagctctggct

SEQ ID NO: 1145796 - DNA, 16 bp, Homo sapiens
agccaagggaacctgt

SEQ ID NO: 1145797 - DNA, 22 bp, Homo sapiens
agccaaggggctgcgctagcag

SEQ ID NO: 1145798 - DNA, 17 bp, Homo sapiens
agccaagggtatccaag

SEQ ID NO: 1145799 - DNA, 20 bp, Homo sapiens
agccaaggtgggctgagccc

SEQ ID NO: 1145800 - DNA, 22 bp, Homo sapiens
agccaaggttttataaggctga

SEQ ID NO: 1145801 - DNA, 18 bp, Homo sapiens
agccaagtccagatttac

SEQ ID NO: 1145802 - DNA, 16 bp, Homo sapiens
agccaagtcctccctc

SEQ ID NO: 1145803 - DNA, 16 bp, Homo sapiens
agccaagtggggtgct

SEQ ID NO: 1145804 - DNA, 18 bp, Homo sapiens
agccaatcccctccttgg

SEQ ID NO: 1145805 - DNA, 20 bp, Homo sapiens
agccaatcccctccttgggc

SEQ ID NO: 1145806 - DNA, 21 bp, Homo sapiens
agccaatcccctccttgggca

SEQ ID NO: 1145807 - DNA, 22 bp, Homo sapiens
agccaatcccctccttgggcac

SEQ ID NO: 1145808 - DNA, 19 bp, Homo sapiens
agccaattaaaaacatgaa

SEQ ID NO: 1145809 - DNA, 16 bp, Homo sapiens
agccaattcagacagg

SEQ ID NO: 1145810 - DNA, 19 bp, Homo sapiens
agccacaagaaatttgatt

SEQ ID NO: 1145811 - DNA, 12 bp, Homo sapiens
agccacaagctg

SEQ ID NO: 1145812 - DNA, 14 bp, Homo sapiens
agccacaagctgca

SEQ ID NO: 1145813 - DNA, 15 bp, Homo sapiens
agccacaaggctggc

SEQ ID NO: 1145814 - DNA, 17 bp, Homo sapiens
agccacaaggctggcca

SEQ ID NO: 1145815 - DNA, 15 bp, Homo sapiens
agccacaagtcttcc

SEQ ID NO: 1145816 - DNA, 16 bp, Homo sapiens
agccacaagtcttcca

SEQ ID NO: 1145817 - DNA, 12 bp, Homo sapiens
agccacacgcag

SEQ ID NO: 1145818 - DNA, 20 bp, Homo sapiens
agccacacggagaggccact

SEQ ID NO: 1145819 - DNA, 12 bp, Homo sapiens
agccacagaagc

SEQ ID NO: 1145820 - DNA, 17 bp, Homo sapiens
agccacagaagccagga

SEQ ID NO: 1145821 - DNA, 19 bp, Homo sapiens
agccacagaagccaggagc

SEQ ID NO: 1145822 - DNA, 22 bp, Homo sapiens
agccacagaagccaggagcaaa

SEQ ID NO: 1145823 - DNA, 13 bp, Homo sapiens
agccacagctgct

SEQ ID NO: 1145824 - DNA, 21 bp, Homo sapiens
agccacagctgctgttctcag

SEQ ID NO: 1145825 - DNA, 22 bp, Homo sapiens
agccacagctgctgttctcagg

SEQ ID NO: 1145826 - DNA, 15 bp, Homo sapiens
agccacaggaacggc

SEQ ID NO: 1145827 - DNA, 21 bp, Homo sapiens
agccacaggaacggccctgca

SEQ ID NO: 1145828 - DNA, 15 bp, Homo sapiens
agccacaggaaggag

SEQ ID NO: 1145829 - DNA, 22 bp, Homo sapiens
agccacaggaaggaggggagag

SEQ ID NO: 1145830 - DNA, 17 bp, Homo sapiens
agccacaggactgagcc

SEQ ID NO: 1145831 - DNA, 22 bp, Homo sapiens
agccacaggactgagccctctc

SEQ ID NO: 1145832 - DNA, 23 bp, Homo sapiens
agccacaggactgagccctctca

SEQ ID NO: 1145833 - DNA, 22 bp, Homo sapiens
agccacaggcaggggtgagagc

SEQ ID NO: 1145834 - DNA, 17 bp, Homo sapiens
agccacaggccctggct

SEQ ID NO: 1145835 - DNA, 23 bp, Homo sapiens
agccacatccctttgaaacaaga

SEQ ID NO: 1145836 - DNA, 22 bp, Homo sapiens
agccacattgagactttcttct

SEQ ID NO: 1145837 - DNA, 15 bp, Homo sapiens
agccacatttggaat

SEQ ID NO: 1145838 - DNA, 22 bp, Homo sapiens
agccacatttggaatacttttt

SEQ ID NO: 1145839 - DNA, 23 bp, Homo sapiens
agccacatttggaatactttttg

SEQ ID NO: 1145840 - DNA, 13 bp, Homo sapiens
agccaccaccctc

SEQ ID NO: 1145841 - DNA, 16 bp, Homo sapiens
agccaccaccctcagg

SEQ ID NO: 1145842 - DNA, 21 bp, Homo sapiens
agccaccaccctcaggtgcct

SEQ ID NO: 1145843 - DNA, 18 bp, Homo sapiens
agccaccagggagtggcc

SEQ ID NO: 1145844 - DNA, 14 bp, Homo sapiens
agccaccagtggac

SEQ ID NO: 1145845 - DNA, 18 bp, Homo sapiens
agccaccatccccaccct

SEQ ID NO: 1145846 - DNA, 23 bp, Homo sapiens
agccaccatgcttgcctgaagct

SEQ ID NO: 1145847 - DNA, 18 bp, Homo sapiens
agccacccaagcctgctg

SEQ ID NO: 1145848 - DNA, 20 bp, Homo sapiens
agccacccaagcctgctggc

SEQ ID NO: 1145849 - DNA, 17 bp, Homo sapiens
agccaccccatgagctc

SEQ ID NO: 1145850 - DNA, 22 bp, Homo sapiens
agccaccccatgagctcggggt

SEQ ID NO: 1145851 - DNA, 15 bp, Homo sapiens
agccacccccaggca

SEQ ID NO: 1145852 - DNA, 15 bp, Homo sapiens
agcccactccctgcc

SEQ ID NO: 1145853 - DNA, 16 bp, Homo sapiens
agcccactccctgcct

SEQ ID NO: 1145854 - DNA, 17 bp, Homo sapiens
agcccactccctgccta

SEQ ID NO: 1145855 - DNA, 13 bp, Homo sapiens
agcccactgtgga

SEQ ID NO: 1145856 - DNA, 24 bp, Homo sapiens
agcccagaaagtgataagtgcagg

SEQ ID NO: 1145857 - DNA, 20 bp, Homo sapiens
agcccagaacaaaaagaaat

SEQ ID NO: 1145858 - DNA, 16 bp, Homo sapiens
agcccagaaccacaga

SEQ ID NO: 1145859 - DNA, 17 bp, Homo sapiens
agcccagaaccacagat

SEQ ID NO: 1145860 - DNA, 12 bp, Homo sapiens
agcccagacaaa

SEQ ID NO: 1145861 - DNA, 18 bp, Homo sapiens
agcccagacccccagtgt

SEQ ID NO: 1145862 - DNA, 23 bp, Homo sapiens
agcccagacccccagtgtatttt

SEQ ID NO: 1145863 - DNA, 14 bp, Homo sapiens
agcccagactctga

SEQ ID NO: 1145864 - DNA, 11 bp, Homo sapiens
agcccagagaa

SEQ ID NO: 1145865 - DNA, 15 bp, Homo sapiens
agcccagagaacagc

SEQ ID NO: 1145866 - DNA, 20 bp, Homo sapiens
agcccagattcccctgtgtc

SEQ ID NO: 1145867 - DNA, 21 bp, Homo sapiens
agcccagcactgcttgaggaa

SEQ ID NO: 1145868 - DNA, 15 bp, Homo sapiens
agcccagcagggcct

SEQ ID NO: 1145869 - DNA, 16 bp, Homo sapiens
agcccagcagtgtgga

SEQ ID NO: 1145870 - DNA, 15 bp, Homo sapiens
agcccagccagaaag

SEQ ID NO: 1145871 - DNA, 12 bp, Homo sapiens
agcccagccagg

SEQ ID NO: 1145872 - DNA, 14 bp, Homo sapiens
agcccagccaggcc

SEQ ID NO: 1145873 - DNA, 15 bp, Homo sapiens
agcccagccaggcca

SEQ ID NO: 1145874 - DNA, 20 bp, Homo sapiens
agcccagccaggccaacagc

SEQ ID NO: 1145875 - DNA, 21 bp, Homo sapiens
agcccagccattaccatggag

SEQ ID NO: 1145876 - DNA, 16 bp, Homo sapiens
agcccagcccagctgg

SEQ ID NO: 1145877 - DNA, 14 bp, Homo sapiens
agcccagccccgcc

SEQ ID NO: 1145878 - DNA, 12 bp, Homo sapiens
agcccagcccct

SEQ ID NO: 1145879 - DNA, 17 bp, Homo sapiens
agcccagcccctactgc

SEQ ID NO: 1145880 - DNA, 19 bp, Homo sapiens
agcccagcccctactgctg

SEQ ID NO: 1145881 - DNA, 17 bp, Homo sapiens
agcccagcctgccccct

SEQ ID NO: 1145882 - DNA, 17 bp, Homo sapiens
agcccagcctgggagcc

SEQ ID NO: 1145883 - DNA, 15 bp, Homo sapiens
agcccagctacattc

SEQ ID NO: 1145884 - DNA, 17 bp, Homo sapiens
agcccagctacattcct

SEQ ID NO: 1145885 - DNA, 20 bp, Homo sapiens
agcccagctacattcctcag

SEQ ID NO: 1145886 - DNA, 13 bp, Homo sapiens
agcccagctctgg

SEQ ID NO: 1145887 - DNA, 19 bp, Homo sapiens
agcccagctgggtcaggca

SEQ ID NO: 1145888 - DNA, 16 bp, Homo sapiens
agcccagctggtggga

SEQ ID NO: 1145889 - DNA, 17 bp, Homo sapiens
agcccagcttcctggtg

SEQ ID NO: 1145890 - DNA, 23 bp, Homo sapiens
agcccagcttgaaaccttcactt

SEQ ID NO: 1145891 - DNA, 12 bp, Homo sapiens
agcccaggagca

SEQ ID NO: 1145892 - DNA, 21 bp, Homo sapiens
agcccaggagcaacagcctaa

SEQ ID NO: 1145893 - DNA, 21 bp, Homo sapiens
agcccaggagctgagtcacct

SEQ ID NO: 1145894 - DNA, 23 bp, Homo sapiens
agcccaggagctgagtcacctcc

SEQ ID NO: 1145895 - DNA, 11 bp, Homo sapiens
agcccaggagt

SEQ ID NO: 1145896 - DNA, 22 bp, Homo sapiens
agcccaggagttcaagaccagc

SEQ ID NO: 1145897 - DNA, 21 bp, Homo sapiens
agcccaggatactggcacaga

SEQ ID NO: 1145898 - DNA, 19 bp, Homo sapiens
agcccaggcatctccttgg

SEQ ID NO: 1145899 - DNA, 22 bp, Homo sapiens
agcccaggccggggtggagcat

SEQ ID NO: 1145900 - DNA, 22 bp, Homo sapiens
agcccaggctcggaggaccctg

SEQ ID NO: 1145901 - DNA, 12 bp, Homo sapiens
agcccagggcct

SEQ ID NO: 1145902 - DNA, 15 bp, Homo sapiens
agcccagggcctgca

SEQ ID NO: 1145903 - DNA, 16 bp, Homo sapiens
agcccagggctcctgc

SEQ ID NO: 1145904 - DNA, 14 bp, Homo sapiens
agcccaggggagaa

SEQ ID NO: 1145905 - DNA, 17 bp, Homo sapiens
agcccagggttccccca

SEQ ID NO: 1145906 - DNA, 18 bp, Homo sapiens
agcccagggttcccccag

SEQ ID NO: 1145907 - DNA, 19 bp, Homo sapiens
agcccagggttcccccagc

SEQ ID NO: 1145908 - DNA, 21 bp, Homo sapiens
agcccagggttcccccagccc

SEQ ID NO: 1145909 - DNA, 17 bp, Homo sapiens
agcccaggtcagctgtt

SEQ ID NO: 1145910 - DNA, 23 bp, Homo sapiens
agcccaggtcctctgatacccag

SEQ ID NO: 1145911 - DNA, 18 bp, Homo sapiens
agcccagtcgagacctca

SEQ ID NO: 1145912 - DNA, 17 bp, Homo sapiens
agcccagtgaagcctct

SEQ ID NO: 1145913 - DNA, 17 bp, Homo sapiens
agcccagtgctgctgta

SEQ ID NO: 1145914 - DNA, 15 bp, Homo sapiens
agcccagtgggctgc

SEQ ID NO: 1145915 - DNA, 19 bp, Homo sapiens
agcccagtgggctgcacgc

SEQ ID NO: 1145916 - DNA, 19 bp, Homo sapiens
agcccagtggtgaggaaag

SEQ ID NO: 1145917 - DNA, 21 bp, Homo sapiens
agcccataaagtctgagaaat

SEQ ID NO: 1145918 - DNA, 22 bp, Homo sapiens
agcccataaagtctgagaaata

SEQ ID NO: 1145919 - DNA, 23 bp, Homo sapiens
agcccataaagtctgagaaatag

SEQ ID NO: 1145920 - DNA, 19 bp, Homo sapiens
agcccatactcagcctgct

SEQ ID NO: 1145921 - DNA, 21 bp, Homo sapiens
agcccatccattaggccagca

SEQ ID NO: 1145922 - DNA, 23 bp, Homo sapiens
agcccatccattaggccagcaac

SEQ ID NO: 1145923 - DNA, 18 bp, Homo sapiens
agcccatggcccccaata

SEQ ID NO: 1145924 - DNA, 21 bp, Homo sapiens
agcccatggcccccaataaag

SEQ ID NO: 1145925 - DNA, 16 bp, Homo sapiens
agcccatgggtatgac

SEQ ID NO: 1145926 - DNA, 16 bp, Homo sapiens
agcccatgtcttctgc

SEQ ID NO: 1145927 - DNA, 21 bp, Homo sapiens
agcccatgtcttctgctgttc

SEQ ID NO: 1145928 - DNA, 16 bp, Homo sapiens
agcccatgttctgccc

SEQ ID NO: 1145929 - DNA, 20 bp, Homo sapiens
agcccatgttctgcccccag

SEQ ID NO: 1145930 - DNA, 14 bp, Homo sapiens
agcccattcccacc

SEQ ID NO: 1145931 - DNA, 15 bp, Homo sapiens
agcccattctctctc

SEQ ID NO: 1145932 - DNA, 16 bp, Homo sapiens
agcccattctctctcc

SEQ ID NO: 1145933 - DNA, 19 bp, Homo sapiens
agcccattctctctcctgt

SEQ ID NO: 1145934 - DNA, 20 bp, Homo sapiens
agcccattctctctcctgtc

SEQ ID NO: 1145935 - DNA, 21 bp, Homo sapiens
agcccattctctctcctgtcc

SEQ ID NO: 1145936 - DNA, 15 bp, Homo sapiens
agcccattgaagaag

SEQ ID NO: 1145937 - DNA, 16 bp, Homo sapiens
agcccattgctgccaa

SEQ ID NO: 1145938 - DNA, 16 bp, Homo sapiens
agcccattggccgagc

SEQ ID NO: 1145939 - DNA, 21 bp, Homo sapiens
agcccattggccgagctcctg

SEQ ID NO: 1145940 - DNA, 13 bp, Homo sapiens
agcccatttcaat

SEQ ID NO: 1145941 - DNA, 13 bp, Homo sapiens
agccccaagctgg

SEQ ID NO: 1145942 - DNA, 19 bp, Homo sapiens
agccccaagctgggccgag

SEQ ID NO: 1145943 - DNA, 15 bp, Homo sapiens
agccccaagtcctga

SEQ ID NO: 1145944 - DNA, 15 bp, Homo sapiens
agccccacacggagg

SEQ ID NO: 1145945 - DNA, 24 bp, Homo sapiens
agccccacagtcccattcctccac

SEQ ID NO: 1145946 - DNA, 20 bp, Homo sapiens
agccccaccacatagcatgc

SEQ ID NO: 1145947 - DNA, 16 bp, Homo sapiens
agccccacccaggagg

SEQ ID NO: 1145948 - DNA, 22 bp, Homo sapiens
agccccacccccagccaggcta

SEQ ID NO: 1145949 - DNA, 15 bp, Homo sapiens
agccccacctctcca

SEQ ID NO: 1145950 - DNA, 19 bp, Homo sapiens
agccccacctctccaagtc

SEQ ID NO: 1145951 - DNA, 13 bp, Homo sapiens
agccccactcctc

SEQ ID NO: 1145952 - DNA, 12 bp, Homo sapiens
agccccacttca

SEQ ID NO: 1145953 - DNA, 14 bp, Homo sapiens
agccccacttctgg

SEQ ID NO: 1145954 - DNA, 12 bp, Homo sapiens
agccccagactg

SEQ ID NO: 1145955 - DNA, 19 bp, Homo sapiens
agccccagactgggcccag

SEQ ID NO: 1145956 - DNA, 21 bp, Homo sapiens
agccccagactgggcccaggc

SEQ ID NO: 1145957 - DNA, 22 bp, Homo sapiens
agccccagactgggcccaggca

SEQ ID NO: 1145958 - DNA, 12 bp, Homo sapiens
agccccagcaag

SEQ ID NO: 1145959 - DNA, 17 bp, Homo sapiens
agccccaggcctggcct

SEQ ID NO: 1145960 - DNA, 20 bp, Homo sapiens
agccccaggcctggcctcgc

SEQ ID NO: 1145961 - DNA, 16 bp, Homo sapiens
agccccaggggacaag

SEQ ID NO: 1145962 - DNA, 20 bp, Homo sapiens
agccccagggtcttccctac

SEQ ID NO: 1145963 - DNA, 16 bp, Homo sapiens
agccccagtcttcctt

SEQ ID NO: 1145964 - DNA, 20 bp, Homo sapiens
agccccatcagaacctgagc

SEQ ID NO: 1145965 - DNA, 21 bp, Homo sapiens
agccccatcgccccaactcca

SEQ ID NO: 1145966 - DNA, 19 bp, Homo sapiens
agccccatgtgccttgtcc

SEQ ID NO: 1145967 - DNA, 15 bp, Homo sapiens
agccccatttcctca

SEQ ID NO: 1145968 - DNA, 20 bp, Homo sapiens
agcccccaaccccgcggtgc

SEQ ID NO: 1145969 - DNA, 13 bp, Homo sapiens
agcccccaccagc

SEQ ID NO: 1145970 - DNA, 16 bp, Homo sapiens
agcccccaccagcagc

SEQ ID NO: 1145971 - DNA, 17 bp, Homo sapiens
agcccccaccagcagca

SEQ ID NO: 1145972 - DNA, 20 bp, Homo sapiens
agcccccaccaggggaagga

SEQ ID NO: 1145973 - DNA, 19 bp, Homo sapiens
agcccccaccggaactggg

SEQ ID NO: 1145974 - DNA, 13 bp, Homo sapiens
ccagttctgctcc

SEQ ID NO: 1145975 - DNA, 14 bp, Homo sapiens
ccagttctgctcct

SEQ ID NO: 1145976 - DNA, 19 bp, Homo sapiens
ccagttctgctcctctcca

SEQ ID NO: 1145977 - DNA, 18 bp, Homo sapiens
ccagttgaataaaagtgc

SEQ ID NO: 1145978 - DNA, 17 bp, Homo sapiens
ccagttgatctgctctg

SEQ ID NO: 1145979 - DNA, 18 bp, Homo sapiens
ccagttgcactcaggtga

SEQ ID NO: 1145980 - DNA, 19 bp, Homo sapiens
ccagttgccctagcccaga

SEQ ID NO: 1145981 - DNA, 17 bp, Homo sapiens
ccagttggatctctggt

SEQ ID NO: 1145982 - DNA, 17 bp, Homo sapiens
ccagttgggagcactgg

SEQ ID NO: 1145983 - DNA, 22 bp, Homo sapiens
ccagttggtgactgggaaagtt

SEQ ID NO: 1145984 - DNA, 18 bp, Homo sapiens
ccagttggttatctgaat

SEQ ID NO: 1145985 - DNA, 21 bp, Homo sapiens
ccagttgtagcaggtttcact

SEQ ID NO: 1145986 - DNA, 19 bp, Homo sapiens
ccagttgtgttgacacata

SEQ ID NO: 1145987 - DNA, 17 bp, Homo sapiens
ccagtttattctgtggt

SEQ ID NO: 1145988 - DNA, 23 bp, Homo sapiens
ccagtttgcagaaaagcacctgc

SEQ ID NO: 1145989 - DNA, 22 bp, Homo sapiens
ccagtttgcatgattcttctct

SEQ ID NO: 1145990 - DNA, 17 bp, Homo sapiens
ccagtttggggtgccaa

SEQ ID NO: 1145991 - DNA, 13 bp, Homo sapiens
ccagttttcattt

SEQ ID NO: 1145992 - DNA, 17 bp, Homo sapiens
ccagttttgagtgtact

SEQ ID NO: 1145993 - DNA, 21 bp, Homo sapiens
ccagttttggatctttttaaa

SEQ ID NO: 1145994 - DNA, 18 bp, Homo sapiens
ccagtttttaaaatgctg

SEQ ID NO: 1145995 - DNA, 15 bp, Homo sapiens
ccagtttttgaggag

SEQ ID NO: 1145996 - DNA, 23 bp, Homo sapiens
ccagtttttgtttttgcatgaaa

SEQ ID NO: 1145997 - DNA, 12 bp, Homo sapiens
ccataaaacatt

SEQ ID NO: 1145998 - DNA, 14 bp, Homo sapiens
ccataaaagcattg

SEQ ID NO: 1145999 - DNA, 23 bp, Homo sapiens
ccataaagggtgtaggggccacc

SEQ ID NO: 1146000 - DNA, 18 bp, Homo sapiens
ccataaatttggactgtc

SEQ ID NO: 1146001 - DNA, 15 bp, Homo sapiens
ccataacagccaaca

SEQ ID NO: 1146002 - DNA, 16 bp, Homo sapiens
ccataacgtgccccca

SEQ ID NO: 1146003 - DNA, 17 bp, Homo sapiens
ccataactgacaagaga

SEQ ID NO: 1146004 - DNA, 15 bp, Homo sapiens
ccataagggactgtg

SEQ ID NO: 1146005 - DNA, 14 bp, Homo sapiens
ccataagtctgatt

SEQ ID NO: 1146006 - DNA, 18 bp, Homo sapiens
ccataagtgacaccaata

SEQ ID NO: 1146007 - DNA, 22 bp, Homo sapiens
ccataagtgacaccaataaatg

SEQ ID NO: 1146008 - DNA, 22 bp, Homo sapiens
ccataagtttaactttaaaact

SEQ ID NO: 1146009 - DNA, 19 bp, Homo sapiens
ccataataaaaggctttga

SEQ ID NO: 1146010 - DNA, 15 bp, Homo sapiens
ccataataaccctgc

SEQ ID NO: 1146011 - DNA, 18 bp, Homo sapiens
ccataataaccctgccag

SEQ ID NO: 1146012 - DNA, 17 bp, Homo sapiens
ccataattttcttcatg

SEQ ID NO: 1146013 - DNA, 20 bp, Homo sapiens
ccataattttttttttcctt

SEQ ID NO: 1146014 - DNA, 21 bp, Homo sapiens
ccatacaatgtatgtacaata

SEQ ID NO: 1146015 - DNA, 12 bp, Homo sapiens
ccatacacacac

SEQ ID NO: 1146016 - DNA, 12 bp, Homo sapiens
ccatacacagag

SEQ ID NO: 1146017 - DNA, 17 bp, Homo sapiens
ccatacactttgttgca

SEQ ID NO: 1146018 - DNA, 14 bp, Homo sapiens
ccatacagcctcta

SEQ ID NO: 1146019 - DNA, 20 bp, Homo sapiens
ccataccccttattgctgcc

SEQ ID NO: 1146020 - DNA, 23 bp, Homo sapiens
ccataccccttattgctgccaaa

SEQ ID NO: 1146021 - DNA, 16 bp, Homo sapiens
ccatacctgcccctgc

SEQ ID NO: 1146022 - DNA, 14 bp, Homo sapiens
ccatactaatgatg

SEQ ID NO: 1146023 - DNA, 15 bp, Homo sapiens
ccatactaatgatga

SEQ ID NO: 1146024 - DNA, 12 bp, Homo sapiens
ccatactaatta

SEQ ID NO: 1146025 - DNA, 13 bp, Homo sapiens
ccatactaattat

SEQ ID NO: 1146026 - DNA, 22 bp, Homo sapiens
ccatactcaaatggtgtcatgg

SEQ ID NO: 1146027 - DNA, 14 bp, Homo sapiens
ccatactcagcctg

SEQ ID NO: 1146028 - DNA, 21 bp, Homo sapiens
ccatactcagcctgctgccca

SEQ ID NO: 1146029 - DNA, 15 bp, Homo sapiens
ccatactgagcctgc

SEQ ID NO: 1146030 - DNA, 18 bp, Homo sapiens
ccatactgtctctggagt

SEQ ID NO: 1146031 - DNA, 13 bp, Homo sapiens
ccatacttctctc

SEQ ID NO: 1146032 - DNA, 14 bp, Homo sapiens
ccatacttctctca

SEQ ID NO: 1146033 - DNA, 23 bp, Homo sapiens
ccatacttgcatacaccactgca

SEQ ID NO: 1146034 - DNA, 17 bp, Homo sapiens
ccatacttttgagaggg

SEQ ID NO: 1146035 - DNA, 18 bp, Homo sapiens
ccatacttttgagagggg

SEQ ID NO: 1146036 - DNA, 16 bp, Homo sapiens
ccatagaccctgaggc

SEQ ID NO: 1146037 - DNA, 13 bp, Homo sapiens
ccatagaggccca

SEQ ID NO: 1146038 - DNA, 14 bp, Homo sapiens
ccatagaggcccag

SEQ ID NO: 1146039 - DNA, 19 bp, Homo sapiens
ccatagaggcccaggcacc

SEQ ID NO: 1146040 - DNA, 17 bp, Homo sapiens
ccatagagtttaacaca

SEQ ID NO: 1146041 - DNA, 14 bp, Homo sapiens
ccatagcaccctgc

SEQ ID NO: 1146042 - DNA, 23 bp, Homo sapiens
ccatagcaccctgccctcatggg

SEQ ID NO: 1146043 - DNA, 23 bp, Homo sapiens
ccatagcataatatgaagccttt

SEQ ID NO: 1146044 - DNA, 17 bp, Homo sapiens
ccatagccttggggttg

SEQ ID NO: 1146045 - DNA, 18 bp, Homo sapiens
ccatagctattttccttg

SEQ ID NO: 1146046 - DNA, 21 bp, Homo sapiens
ccataggaagacataaaactt

SEQ ID NO: 1146047 - DNA, 16 bp, Homo sapiens
ccatagggggctgcac

SEQ ID NO: 1146048 - DNA, 15 bp, Homo sapiens
ccatagtaccattta

SEQ ID NO: 1146049 - DNA, 14 bp, Homo sapiens
ccatagtagtatga

SEQ ID NO: 1146050 - DNA, 15 bp, Homo sapiens
ccatagtcttaactg

SEQ ID NO: 1146051 - DNA, 21 bp, Homo sapiens
ccatagtggaccacttggaaa

SEQ ID NO: 1146052 - DNA, 15 bp, Homo sapiens
ccatagtggggcctg

SEQ ID NO: 1146053 - DNA, 19 bp, Homo sapiens
ccatagtggggcctgggag

SEQ ID NO: 1146054 - DNA, 15 bp, Homo sapiens
ccatataagtttgaa

SEQ ID NO: 1146055 - DNA, 16 bp, Homo sapiens
ccatatagtctattca

SEQ ID NO: 1146056 - DNA, 21 bp, Homo sapiens
ccatatataacagatacattt

SEQ ID NO: 1146057 - DNA, 20 bp, Homo sapiens
ccatatatgaccagaagcct

SEQ ID NO: 1146058 - DNA, 14 bp, Homo sapiens
ccatatatgctgta

SEQ ID NO: 1146059 - DNA, 21 bp, Homo sapiens
ccatatatgctgtatttcttt

SEQ ID NO: 1146060 - DNA, 19 bp, Homo sapiens
ccatatatttaatatgtca

SEQ ID NO: 1146061 - DNA, 18 bp, Homo sapiens
ccatatccttaccctcct

SEQ ID NO: 1146062 - DNA, 18 bp, Homo sapiens
ccatatctccatggccct

SEQ ID NO: 1146063 - DNA, 14 bp, Homo sapiens
ccatatctccttcc

SEQ ID NO: 1146064 - DNA, 16 bp, Homo sapiens
ccatatcttaaagaaa

SEQ ID NO: 1146065 - DNA, 15 bp, Homo sapiens
ccatatcttgccttc

SEQ ID NO: 1146066 - DNA, 12 bp, Homo sapiens
ccatatgatatt

SEQ ID NO: 1146067 - DNA, 16 bp, Homo sapiens
ccatatgcagaaatag

SEQ ID NO: 1146068 - DNA, 16 bp, Homo sapiens
ccatatggaggactgt

SEQ ID NO: 1146069 - DNA, 16 bp, Homo sapiens
ccatatggaggcctga

SEQ ID NO: 1146070 - DNA, 15 bp, Homo sapiens
ccatatgtctgcttc

SEQ ID NO: 1146071 - DNA, 17 bp, Homo sapiens
ccatatgtctgcttctg

SEQ ID NO: 1146072 - DNA, 19 bp, Homo sapiens
ccatatgtctgcttctgtc

SEQ ID NO: 1146073 - DNA, 14 bp, Homo sapiens
ccatatgttacact

SEQ ID NO: 1146074 - DNA, 15 bp, Homo sapiens
ccatattcacacctc

SEQ ID NO: 1146075 - DNA, 16 bp, Homo sapiens
ccatattcacacctca

SEQ ID NO: 1146076 - DNA, 23 bp, Homo sapiens
ccatattctaagttagactcttc

SEQ ID NO: 1146077 - DNA, 12 bp, Homo sapiens
ccatatttattc

SEQ ID NO: 1146078 - DNA, 23 bp, Homo sapiens
ccatatttgtcataatttttcct

SEQ ID NO: 1146079 - DNA, 22 bp, Homo sapiens
ccatattttgtatccaaggatc

SEQ ID NO: 1146080 - DNA, 23 bp, Homo sapiens
ccatcaaaggaatataagaaaag

SEQ ID NO: 1146081 - DNA, 18 bp, Homo sapiens
ccatcaaggtccagtgga

SEQ ID NO: 1146082 - DNA, 13 bp, Homo sapiens
ccatcacagggtt

SEQ ID NO: 1146083 - DNA, 14 bp, Homo sapiens
ccatcaccctcacc

SEQ ID NO: 1146084 - DNA, 20 bp, Homo sapiens
ccatcaccctcacccactct

SEQ ID NO: 1146085 - DNA, 13 bp, Homo sapiens
ccatcaccctctt

SEQ ID NO: 1146086 - DNA, 16 bp, Homo sapiens
ccatcaccctcttcct

SEQ ID NO: 1146087 - DNA, 20 bp, Homo sapiens
ccatcaccctcttcctgtga

SEQ ID NO: 1146088 - DNA, 15 bp, Homo sapiens
ccatcaccgctgggt

SEQ ID NO: 1146089 - DNA, 19 bp, Homo sapiens
ccatcaccgctgggtggtt

SEQ ID NO: 1146090 - DNA, 20 bp, Homo sapiens
ccatcacctgaaacactgga

SEQ ID NO: 1146091 - DNA, 21 bp, Homo sapiens
ccatcacctgaaacactggac

SEQ ID NO: 1146092 - DNA, 16 bp, Homo sapiens
ccatcactagaagaaa

SEQ ID NO: 1146093 - DNA, 15 bp, Homo sapiens
ccatcactcagcccc

SEQ ID NO: 1146094 - DNA, 20 bp, Homo sapiens
ccatcactcagcccctaccc

SEQ ID NO: 1146095 - DNA, 14 bp, Homo sapiens
ccatcactggagca

SEQ ID NO: 1146096 - DNA, 16 bp, Homo sapiens
ccatgtagcaggactg

SEQ ID NO: 1146097 - DNA, 19 bp, Homo sapiens
ccatgtattatgaaaaaga

SEQ ID NO: 1146098 - DNA, 20 bp, Homo sapiens
ccatgtattatgaaaaagat

SEQ ID NO: 1146099 - DNA, 16 bp, Homo sapiens
ccatgtatttatctct

SEQ ID NO: 1146100 - DNA, 22 bp, Homo sapiens
ccatgtatttatctctatttaa

SEQ ID NO: 1146101 - DNA, 18 bp, Homo sapiens
ccatgtatttcagggacc

SEQ ID NO: 1146102 - DNA, 22 bp, Homo sapiens
ccatgtcaagagtcgctgtgcc

SEQ ID NO: 1146103 - DNA, 13 bp, Homo sapiens
ccatgtcacctgg

SEQ ID NO: 1146104 - DNA, 16 bp, Homo sapiens
ccatgtcacctggctg

SEQ ID NO: 1146105 - DNA, 15 bp, Homo sapiens
ccatgtcagacacag

SEQ ID NO: 1146106 - DNA, 21 bp, Homo sapiens
ccatgtcagacacagattggc

SEQ ID NO: 1146107 - DNA, 19 bp, Homo sapiens
ccatgtcaggccagcctgt

SEQ ID NO: 1146108 - DNA, 19 bp, Homo sapiens
ccatgtccaaagaggctgc

SEQ ID NO: 1146109 - DNA, 20 bp, Homo sapiens
ccatgtccaaagaggctgcc

SEQ ID NO: 1146110 - DNA, 15 bp, Homo sapiens
ccatgtccaagttct

SEQ ID NO: 1146111 - DNA, 21 bp, Homo sapiens
ccatgtccaagttcttcacct

SEQ ID NO: 1146112 - DNA, 12 bp, Homo sapiens
ccatgtcgcctc

SEQ ID NO: 1146113 - DNA, 17 bp, Homo sapiens
ccatgtcgcctctgcat

SEQ ID NO: 1146114 - DNA, 19 bp, Homo sapiens
ccatgtcgcctctgcattc

SEQ ID NO: 1146115 - DNA, 14 bp, Homo sapiens
ccatgtcgcttttg

SEQ ID NO: 1146116 - DNA, 14 bp, Homo sapiens
ccatgtcttctgct

SEQ ID NO: 1146117 - DNA, 18 bp, Homo sapiens
ccatgtgaaactctaccc

SEQ ID NO: 1146118 - DNA, 13 bp, Homo sapiens
ccatgtgagccac

SEQ ID NO: 1146119 - DNA, 20 bp, Homo sapiens
ccatgtgatggacactccag

SEQ ID NO: 1146120 - DNA, 17 bp, Homo sapiens
ccatgtgattaatgttt

SEQ ID NO: 1146121 - DNA, 19 bp, Homo sapiens
ccatgtgccatctgtacat

SEQ ID NO: 1146122 - DNA, 20 bp, Homo sapiens
ccatgtgccatctgtacata

SEQ ID NO: 1146123 - DNA, 17 bp, Homo sapiens
ccatgtggagacttcat

SEQ ID NO: 1146124 - DNA, 15 bp, Homo sapiens
ccatgtggcagccca

SEQ ID NO: 1146125 - DNA, 16 bp, Homo sapiens
ccatgtggcagcccat

SEQ ID NO: 1146126 - DNA, 12 bp, Homo sapiens
ccatgtggccac

SEQ ID NO: 1146127 - DNA, 14 bp, Homo sapiens
ccatgtggcctgcc

SEQ ID NO: 1146128 - DNA, 17 bp, Homo sapiens
ccatgtggcctgcccag

SEQ ID NO: 1146129 - DNA, 20 bp, Homo sapiens
ccatgtggcctgcccagcct

SEQ ID NO: 1146130 - DNA, 22 bp, Homo sapiens
ccatgtggcctgcccagcctca

SEQ ID NO: 1146131 - DNA, 21 bp, Homo sapiens
ccatgtggggttgctgaagat

SEQ ID NO: 1146132 - DNA, 22 bp, Homo sapiens
ccatgtgtacattctgcctaga

SEQ ID NO: 1146133 - DNA, 12 bp, Homo sapiens
ccatgtgtcact

SEQ ID NO: 1146134 - DNA, 14 bp, Homo sapiens
ccatgtgtcccctc

SEQ ID NO: 1146135 - DNA, 20 bp, Homo sapiens
ccatgtgtcccctcactctg

SEQ ID NO: 1146136 - DNA, 14 bp, Homo sapiens
ccatgtgtcctggt

SEQ ID NO: 1146137 - DNA, 22 bp, Homo sapiens
ccatgtgtggtggtgttttttg

SEQ ID NO: 1146138 - DNA, 19 bp, Homo sapiens
ccatgtgtgtgcaagtgtg

SEQ ID NO: 1146139 - DNA, 22 bp, Homo sapiens
ccatgtgttaaaatactcagtg

SEQ ID NO: 1146140 - DNA, 13 bp, Homo sapiens
ccatgttaaatga

SEQ ID NO: 1146141 - DNA, 18 bp, Homo sapiens
ccatgttcattataatct

SEQ ID NO: 1146142 - DNA, 19 bp, Homo sapiens
ccatgttctgcccccagcc

SEQ ID NO: 1146143 - DNA, 20 bp, Homo sapiens
ccatgttctgcccccagccc

SEQ ID NO: 1146144 - DNA, 22 bp, Homo sapiens
ccatgttctgcccccagcccaa

SEQ ID NO: 1146145 - DNA, 19 bp, Homo sapiens
ccatgttgcatgcctatgt

SEQ ID NO: 1146146 - DNA, 13 bp, Homo sapiens
ccatgttgcccct

SEQ ID NO: 1146147 - DNA, 23 bp, Homo sapiens
ccatgttggccaggctggtctca

SEQ ID NO: 1146148 - DNA, 17 bp, Homo sapiens
ccatgttggtcaggctg

SEQ ID NO: 1146149 - DNA, 18 bp, Homo sapiens
ccatgttggtcaggctgg

SEQ ID NO: 1146150 - DNA, 18 bp, Homo sapiens
ccatgtttagattccagg

SEQ ID NO: 1146151 - DNA, 22 bp, Homo sapiens
ccatgtttagattccaggatca

SEQ ID NO: 1146152 - DNA, 22 bp, Homo sapiens
ccatgtttagtgaatgactttt

SEQ ID NO: 1146153 - DNA, 12 bp, Homo sapiens
ccatgtttattg

SEQ ID NO: 1146154 - DNA, 17 bp, Homo sapiens
ccatgtttgagctcaga

SEQ ID NO: 1146155 - DNA, 21 bp, Homo sapiens
ccatgtttggttgtaaatgct

SEQ ID NO: 1146156 - DNA, 20 bp, Homo sapiens
ccatgtttttcccctgctcc

SEQ ID NO: 1146157 - DNA, 15 bp, Homo sapiens
ccattaaaataaaac

SEQ ID NO: 1146158 - DNA, 19 bp, Homo sapiens
ccattaaaataaaacaagc

SEQ ID NO: 1146159 - DNA, 22 bp, Homo sapiens
ccattaaaataaaacaagcctt

SEQ ID NO: 1146160 - DNA, 14 bp, Homo sapiens
ccattaacattttt

SEQ ID NO: 1146161 - DNA, 18 bp, Homo sapiens
ccattaatcatttcccca

SEQ ID NO: 1146162 - DNA, 13 bp, Homo sapiens
ccattaattacat

SEQ ID NO: 1146163 - DNA, 14 bp, Homo sapiens
ccattaccaaaata

SEQ ID NO: 1146164 - DNA, 15 bp, Homo sapiens
ccattacgtgcattt

SEQ ID NO: 1146165 - DNA, 16 bp, Homo sapiens
ccattacgtgcattta

SEQ ID NO: 1146166 - DNA, 22 bp, Homo sapiens
ccattacgtgcatttaaactct

SEQ ID NO: 1146167 - DNA, 12 bp, Homo sapiens
ccattactactg

SEQ ID NO: 1146168 - DNA, 14 bp, Homo sapiens
ccattactactgta

SEQ ID NO: 1146169 - DNA, 15 bp, Homo sapiens
ccattactactgtac

SEQ ID NO: 1146170 - DNA, 17 bp, Homo sapiens
ccattacttgccagggg

SEQ ID NO: 1146171 - DNA, 14 bp, Homo sapiens
ccattagaatgtga

SEQ ID NO: 1146172 - DNA, 17 bp, Homo sapiens
ccattagccagatttgt

SEQ ID NO: 1146173 - DNA, 22 bp, Homo sapiens
ccattaggacaatcagtcccct

SEQ ID NO: 1146174 - DNA, 16 bp, Homo sapiens
ccattaggccagcaac

SEQ ID NO: 1146175 - DNA, 19 bp, Homo sapiens
ccattattaacccattttt

SEQ ID NO: 1146176 - DNA, 17 bp, Homo sapiens
ccattattgagttcctc

SEQ ID NO: 1146177 - DNA, 22 bp, Homo sapiens
ccattcacatttgatgtacatg

SEQ ID NO: 1146178 - DNA, 18 bp, Homo sapiens
ccattcatctctaacata

SEQ ID NO: 1146179 - DNA, 21 bp, Homo sapiens
ccattcattaattagttccag

SEQ ID NO: 1146180 - DNA, 11 bp, Homo sapiens
ccattccaaaa

SEQ ID NO: 1146181 - DNA, 13 bp, Homo sapiens
ccattccaaaata

SEQ ID NO: 1146182 - DNA, 19 bp, Homo sapiens
ccattccaaaatacaatgt

SEQ ID NO: 1146183 - DNA, 21 bp, Homo sapiens
ccattccaaaatattatgccc

SEQ ID NO: 1146184 - DNA, 14 bp, Homo sapiens
ccattccaaagctt

SEQ ID NO: 1146185 - DNA, 22 bp, Homo sapiens
ccattccaaagctttattacca

SEQ ID NO: 1146186 - DNA, 15 bp, Homo sapiens
ccattccactccact

SEQ ID NO: 1146187 - DNA, 13 bp, Homo sapiens
ccattccaggtag

SEQ ID NO: 1146188 - DNA, 20 bp, Homo sapiens
ccattccagtacagtattct

SEQ ID NO: 1146189 - DNA, 22 bp, Homo sapiens
ccattccccaacggggtgggga

SEQ ID NO: 1146190 - DNA, 17 bp, Homo sapiens
ccattcccccatgtggc

SEQ ID NO: 1146191 - DNA, 16 bp, Homo sapiens
ccattccctagtcatt

SEQ ID NO: 1146192 - DNA, 12 bp, Homo sapiens
ccattccctggg

SEQ ID NO: 1146193 - DNA, 16 bp, Homo sapiens
ccattcctcagggaca

SEQ ID NO: 1146194 - DNA, 13 bp, Homo sapiens
ccattcctccctc

SEQ ID NO: 1146195 - DNA, 13 bp, Homo sapiens
ccattcctgcctt

SEQ ID NO: 1146196 - DNA, 22 bp, Homo sapiens
ccattcctgggaaatattccct

SEQ ID NO: 1146197 - DNA, 20 bp, Homo sapiens
ccattcctggtacccagcca

SEQ ID NO: 1146198 - DNA, 24 bp, Homo sapiens
ccattcctggtacccagccatctg

SEQ ID NO: 1146199 - DNA, 23 bp, Homo sapiens
ccattccttagctatttatccct

SEQ ID NO: 1146200 - DNA, 16 bp, Homo sapiens
ccattccttcaaataa

SEQ ID NO: 1146201 - DNA, 18 bp, Homo sapiens
ccattcgacctataagaa

SEQ ID NO: 1146202 - DNA, 16 bp, Homo sapiens
ccattcgtctgtccca

SEQ ID NO: 1146203 - DNA, 17 bp, Homo sapiens
ccattctattttagaat

SEQ ID NO: 1146204 - DNA, 22 bp, Homo sapiens
ccattctcatctgcacccttct

SEQ ID NO: 1146205 - DNA, 15 bp, Homo sapiens
ccattctccacagca

SEQ ID NO: 1146206 - DNA, 16 bp, Homo sapiens
ccattctccacagcaa

SEQ ID NO: 1146207 - DNA, 11 bp, Homo sapiens
ccattctccca

SEQ ID NO: 1146208 - DNA, 12 bp, Homo sapiens
ccattctcccag

SEQ ID NO: 1146209 - DNA, 22 bp, Homo sapiens
ccattctcccaggtaccagctg

SEQ ID NO: 1146210 - DNA, 16 bp, Homo sapiens
ccattctcccagtctc

SEQ ID NO: 1146211 - DNA, 19 bp, Homo sapiens
ccattctctctcctgtcca

SEQ ID NO: 1146212 - DNA, 20 bp, Homo sapiens
ccattctctctcctgtccaa

SEQ ID NO: 1146213 - DNA, 13 bp, Homo sapiens
ccattctgactcg

SEQ ID NO: 1146214 - DNA, 13 bp, Homo sapiens
ccattctgcacca

SEQ ID NO: 1146215 - DNA, 15 bp, Homo sapiens
ccattctgcctctcc

SEQ ID NO: 1146216 - DNA, 12 bp, Homo sapiens
ccattcttcagt

SEQ ID NO: 1146217 - DNA, 20 bp, Homo sapiens
ccattcttcagtgtctctgt

SEQ ID NO: 1146218 - DNA, 20 bp, Homo sapiens
gcacacagggctcacagggc

SEQ ID NO: 1146219 - DNA, 23 bp, Homo sapiens
gcacacagggctcacagggcagg

SEQ ID NO: 1146220 - DNA, 19 bp, Homo sapiens
gcacacatcttacctctca

SEQ ID NO: 1146221 - DNA, 20 bp, Homo sapiens
gcacacatcttacctctcat

SEQ ID NO: 1146222 - DNA, 18 bp, Homo sapiens
gcacaccaagtggctggg

SEQ ID NO: 1146223 - DNA, 15 bp, Homo sapiens
gcacaccactgccct

SEQ ID NO: 1146224 - DNA, 23 bp, Homo sapiens
gcacaccagccgctgcagggctc

SEQ ID NO: 1146225 - DNA, 15 bp, Homo sapiens
gcacacccaggtttg

SEQ ID NO: 1146226 - DNA, 19 bp, Homo sapiens
gcacacctgaatcagctgg

SEQ ID NO: 1146227 - DNA, 22 bp, Homo sapiens
gcacacctgaatcagctggaca

SEQ ID NO: 1146228 - DNA, 23 bp, Homo sapiens
gcacacgcacacatcttacctct

SEQ ID NO: 1146229 - DNA, 22 bp, Homo sapiens
gcacacggctggtcactctgcc

SEQ ID NO: 1146230 - DNA, 14 bp, Homo sapiens
gcacacgggcgagc

SEQ ID NO: 1146231 - DNA, 13 bp, Homo sapiens
gcacacgtgtgta

SEQ ID NO: 1146232 - DNA, 18 bp, Homo sapiens
gcacacttatttatgaat

SEQ ID NO: 1146233 - DNA, 23 bp, Homo sapiens
gcacacttctgaccttgctgcca

SEQ ID NO: 1146234 - DNA, 20 bp, Homo sapiens
gcacagaaacttgaactcca

SEQ ID NO: 1146235 - DNA, 16 bp, Homo sapiens
gcacagaagggctctt

SEQ ID NO: 1146236 - DNA, 15 bp, Homo sapiens
gcacagaatttgtat

SEQ ID NO: 1146237 - DNA, 18 bp, Homo sapiens
gcacagacttctggaagg

SEQ ID NO: 1146238 - DNA, 22 bp, Homo sapiens
gcacagacttctggaaggctgg

SEQ ID NO: 1146239 - DNA, 14 bp, Homo sapiens
gcacagagaagctg

SEQ ID NO: 1146240 - DNA, 14 bp, Homo sapiens
gcacagagagggac

SEQ ID NO: 1146241 - DNA, 21 bp, Homo sapiens
gcacagagagggacacatgcc

SEQ ID NO: 1146242 - DNA, 16 bp, Homo sapiens
gcacagagcacactta

SEQ ID NO: 1146243 - DNA, 19 bp, Homo sapiens
gcacagagcacacttattt

SEQ ID NO: 1146244 - DNA, 23 bp, Homo sapiens
gcacagagcacacttatttatga

SEQ ID NO: 1146245 - DNA, 16 bp, Homo sapiens
gcacagagccctgagg

SEQ ID NO: 1146246 - DNA, 20 bp, Homo sapiens
gcacagagcctggccccagg

SEQ ID NO: 1146247 - DNA, 22 bp, Homo sapiens
gcacagagcgtccttccccctg

SEQ ID NO: 1146248 - DNA, 17 bp, Homo sapiens
gcacagagggctaggga

SEQ ID NO: 1146249 - DNA, 17 bp, Homo sapiens
gcacagatgaccaaagt

SEQ ID NO: 1146250 - DNA, 14 bp, Homo sapiens
gcacagatgaggag

SEQ ID NO: 1146251 - DNA, 13 bp, Homo sapiens
gcacagatggatt

SEQ ID NO: 1146252 - DNA, 13 bp, Homo sapiens
gcacagattgaag

SEQ ID NO: 1146253 - DNA, 14 bp, Homo sapiens
gcacagattgaaga

SEQ ID NO: 1146254 - DNA, 15 bp, Homo sapiens
gcacagattgaagaa

SEQ ID NO: 1146255 - DNA, 12 bp, Homo sapiens
gcacagcaaaag

SEQ ID NO: 1146256 - DNA, 13 bp, Homo sapiens
gcacagcagcatc

SEQ ID NO: 1146257 - DNA, 14 bp, Homo sapiens
gcacagcaggacct

SEQ ID NO: 1146258 - DNA, 19 bp, Homo sapiens
gcacagccaacgagacaca

SEQ ID NO: 1146259 - DNA, 20 bp, Homo sapiens
gcacagccaacgagacacat

SEQ ID NO: 1146260 - DNA, 15 bp, Homo sapiens
gcacagccacctccg

SEQ ID NO: 1146261 - DNA, 16 bp, Homo sapiens
gcacagccacctccgc

SEQ ID NO: 1146262 - DNA, 19 bp, Homo sapiens
gcacagccacctccgccag

SEQ ID NO: 1146263 - DNA, 11 bp, Homo sapiens
gcacagcccag

SEQ ID NO: 1146264 - DNA, 13 bp, Homo sapiens
gcacagccctggg

SEQ ID NO: 1146265 - DNA, 11 bp, Homo sapiens
gcacagccctt

SEQ ID NO: 1146266 - DNA, 15 bp, Homo sapiens
gcacagctaattcta

SEQ ID NO: 1146267 - DNA, 12 bp, Homo sapiens
gcacagctcagg

SEQ ID NO: 1146268 - DNA, 14 bp, Homo sapiens
gcacagctcctgcc

SEQ ID NO: 1146269 - DNA, 15 bp, Homo sapiens
gcacagctcctgcca

SEQ ID NO: 1146270 - DNA, 23 bp, Homo sapiens
gcacagctgccctgctgccacag

SEQ ID NO: 1146271 - DNA, 13 bp, Homo sapiens
gcacagctgcttg

SEQ ID NO: 1146272 - DNA, 16 bp, Homo sapiens
gcacagctgtagtggg

SEQ ID NO: 1146273 - DNA, 19 bp, Homo sapiens
gcacagctgtctgccaggc

SEQ ID NO: 1146274 - DNA, 22 bp, Homo sapiens
gcacagctgtctgccaggcact

SEQ ID NO: 1146275 - DNA, 15 bp, Homo sapiens
gcacagcttagattt

SEQ ID NO: 1146276 - DNA, 16 bp, Homo sapiens
gcacagcttagatttc

SEQ ID NO: 1146277 - DNA, 17 bp, Homo sapiens
gcacagcttagatttca

SEQ ID NO: 1146278 - DNA, 17 bp, Homo sapiens
gcacagcttgggtcagg

SEQ ID NO: 1146279 - DNA, 21 bp, Homo sapiens
gcacaggacatgcggtagcca

SEQ ID NO: 1146280 - DNA, 21 bp, Homo sapiens
gcacaggagactccaaggagc

SEQ ID NO: 1146281 - DNA, 20 bp, Homo sapiens
gcacaggagtgtcctcttcc

SEQ ID NO: 1146282 - DNA, 15 bp, Homo sapiens
gcacaggatgctggc

SEQ ID NO: 1146283 - DNA, 17 bp, Homo sapiens
gcacaggatgctggcct

SEQ ID NO: 1146284 - DNA, 22 bp, Homo sapiens
gcacaggcactgaacaggctgg

SEQ ID NO: 1146285 - DNA, 14 bp, Homo sapiens
gcacaggccccctt

SEQ ID NO: 1146286 - DNA, 14 bp, Homo sapiens
gcacaggccctagc

SEQ ID NO: 1146287 - DNA, 15 bp, Homo sapiens
gcacaggctaatttt

SEQ ID NO: 1146288 - DNA, 16 bp, Homo sapiens
gcacaggctaattttt

SEQ ID NO: 1146289 - DNA, 15 bp, Homo sapiens
gcacaggctgttgaa

SEQ ID NO: 1146290 - DNA, 17 bp, Homo sapiens
gcacagggtctgctctt

SEQ ID NO: 1146291 - DNA, 13 bp, Homo sapiens
gcacaggtcccac

SEQ ID NO: 1146292 - DNA, 14 bp, Homo sapiens
gcacaggtcccacc

SEQ ID NO: 1146293 - DNA, 19 bp, Homo sapiens
gcacaggtcccacctccag

SEQ ID NO: 1146294 - DNA, 22 bp, Homo sapiens
gcacaggtcccacctccagccc

SEQ ID NO: 1146295 - DNA, 23 bp, Homo sapiens
gcacaggtcccacctccagcccg

SEQ ID NO: 1146296 - DNA, 16 bp, Homo sapiens
gcacaggtgtctgcct

SEQ ID NO: 1146297 - DNA, 23 bp, Homo sapiens
gcacagtattatttctccatccc

SEQ ID NO: 1146298 - DNA, 15 bp, Homo sapiens
gcacagtatttgtaa

SEQ ID NO: 1146299 - DNA, 16 bp, Homo sapiens
gcacagtcaggggctg

SEQ ID NO: 1146300 - DNA, 17 bp, Homo sapiens
gcacagtcaggggctgg

SEQ ID NO: 1146301 - DNA, 15 bp, Homo sapiens
gcacagtccacagct

SEQ ID NO: 1146302 - DNA, 19 bp, Homo sapiens
gcacagtgacttctgagat

SEQ ID NO: 1146303 - DNA, 23 bp, Homo sapiens
gcacagtgatgccgggcgccagg

SEQ ID NO: 1146304 - DNA, 12 bp, Homo sapiens
gcacagtgattt

SEQ ID NO: 1146305 - DNA, 18 bp, Homo sapiens
gcacagtgcatctcagcc

SEQ ID NO: 1146306 - DNA, 20 bp, Homo sapiens
gcacagtgcatctcagccca

SEQ ID NO: 1146307 - DNA, 21 bp, Homo sapiens
gcacagtgcatctcagcccac

SEQ ID NO: 1146308 - DNA, 15 bp, Homo sapiens
gcacagtgctgcccc

SEQ ID NO: 1146309 - DNA, 20 bp, Homo sapiens
gcacagtgctgccccttgca

SEQ ID NO: 1146310 - DNA, 12 bp, Homo sapiens
gcacagtggctt

SEQ ID NO: 1146311 - DNA, 21 bp, Homo sapiens
gcacagtgggagctgagctgg

SEQ ID NO: 1146312 - DNA, 17 bp, Homo sapiens
gcacagtgtgtgactta

SEQ ID NO: 1146313 - DNA, 20 bp, Homo sapiens
gcacagtgttaaatgaaatt

SEQ ID NO: 1146314 - DNA, 22 bp, Homo sapiens
gcacagttagttgtgaaagaaa

SEQ ID NO: 1146315 - DNA, 13 bp, Homo sapiens
gcacagtttgaac

SEQ ID NO: 1146316 - DNA, 16 bp, Homo sapiens
gcacataccttcatgt

SEQ ID NO: 1146317 - DNA, 14 bp, Homo sapiens
gcacatagagaggg

SEQ ID NO: 1146318 - DNA, 21 bp, Homo sapiens
gcacatagctatcaagtgtgc

SEQ ID NO: 1146319 - DNA, 20 bp, Homo sapiens
gcacatagtgtcctgcccac

SEQ ID NO: 1146320 - DNA, 22 bp, Homo sapiens
gcacatattagtgcagccaagt

SEQ ID NO: 1146321 - DNA, 14 bp, Homo sapiens
gcacatcacctctt

SEQ ID NO: 1146322 - DNA, 21 bp, Homo sapiens
gcacatcagcacgatttctgt

SEQ ID NO: 1146323 - DNA, 23 bp, Homo sapiens
gcacatcagcacgatttctgttt

SEQ ID NO: 1146324 - DNA, 14 bp, Homo sapiens
gcacatctctctgc

SEQ ID NO: 1146325 - DNA, 15 bp, Homo sapiens
gcacatctctctgcc

SEQ ID NO: 1146326 - DNA, 20 bp, Homo sapiens
gcacatctggatgccttccc

SEQ ID NO: 1146327 - DNA, 18 bp, Homo sapiens
gcacatctgtgtcttgtt

SEQ ID NO: 1146328 - DNA, 14 bp, Homo sapiens
gcacatgaaagttt

SEQ ID NO: 1146329 - DNA, 20 bp, Homo sapiens
gcacatgctgtctggccctg

SEQ ID NO: 1146330 - DNA, 22 bp, Homo sapiens
gcacatgctgtctggccctggg

SEQ ID NO: 1146331 - DNA, 22 bp, Homo sapiens
gcacatggaggagcttggggga

SEQ ID NO: 1146332 - DNA, 15 bp, Homo sapiens
gcacatggccataga

SEQ ID NO: 1146333 - DNA, 23 bp, Homo sapiens
gcacatggccatagaggcccagg

SEQ ID NO: 1146334 - DNA, 15 bp, Homo sapiens
gcacatggtgtgggg

SEQ ID NO: 1146335 - DNA, 23 bp, Homo sapiens
gcacatggttcaccatgcagtgg

SEQ ID NO: 1146336 - DNA, 15 bp, Homo sapiens
gcacatgtgccacac

SEQ ID NO: 1146337 - DNA, 21 bp, Homo sapiens
gcacatgtgccacacagtgac

SEQ ID NO: 1146338 - DNA, 12 bp, Homo sapiens
gcacatgtgtgc

SEQ ID NO: 1146339 - DNA, 18 bp, Homo sapiens
gcacattcctggccccgg

SEQ ID NO: 1146340 - DNA, 21 bp, Homo sapiens
tccagaagaatattcaggact

SEQ ID NO: 1146341 - DNA, 15 bp, Homo sapiens
tccagaagagcccat

SEQ ID NO: 1146342 - DNA, 21 bp, Homo sapiens
tccagaagatgccagcttctc

SEQ ID NO: 1146343 - DNA, 16 bp, Homo sapiens
tccagaagcctctggc

SEQ ID NO: 1146344 - DNA, 12 bp, Homo sapiens
tccagaagctgc

SEQ ID NO: 1146345 - DNA, 14 bp, Homo sapiens
tccagaaggcagca

SEQ ID NO: 1146346 - DNA, 21 bp, Homo sapiens
tccagaagttttaacttccag

SEQ ID NO: 1146347 - DNA, 17 bp, Homo sapiens
tccagaatcttgacttt

SEQ ID NO: 1146348 - DNA, 18 bp, Homo sapiens
tccagaatgctgtacatc

SEQ ID NO: 1146349 - DNA, 14 bp, Homo sapiens
tccagaatgtaaga

SEQ ID NO: 1146350 - DNA, 22 bp, Homo sapiens
tccagaatgtaagaaaacaaaa

SEQ ID NO: 1146351 - DNA, 12 bp, Homo sapiens
tccagaccccca

SEQ ID NO: 1146352 - DNA, 16 bp, Homo sapiens
tccagacccccacccc

SEQ ID NO: 1146353 - DNA, 21 bp, Homo sapiens
tccagacccccaccccttccc

SEQ ID NO: 1146354 - DNA, 22 bp, Homo sapiens
tccagacccccaccccttcccc

SEQ ID NO: 1146355 - DNA, 17 bp, Homo sapiens
tccagacccctggcttt

SEQ ID NO: 1146356 - DNA, 16 bp, Homo sapiens
tccagaccctgcctga

SEQ ID NO: 1146357 - DNA, 23 bp, Homo sapiens
tccagactgcttccaattttctg

SEQ ID NO: 1146358 - DNA, 12 bp, Homo sapiens
tccagactgtaa

SEQ ID NO: 1146359 - DNA, 12 bp, Homo sapiens
tccagagaactg

SEQ ID NO: 1146360 - DNA, 15 bp, Homo sapiens
tccagagaactgcag

SEQ ID NO: 1146361 - DNA, 15 bp, Homo sapiens
tccagagaccacacc

SEQ ID NO: 1146362 - DNA, 23 bp, Homo sapiens
tccagagagagaagtgcccctgc

SEQ ID NO: 1146363 - DNA, 12 bp, Homo sapiens
tccagagagcag

SEQ ID NO: 1146364 - DNA, 23 bp, Homo sapiens
tccagagattcattttctagata

SEQ ID NO: 1146365 - DNA, 14 bp, Homo sapiens
tccagagcagagcc

SEQ ID NO: 1146366 - DNA, 20 bp, Homo sapiens
tccagagcagagcctacaga

SEQ ID NO: 1146367 - DNA, 18 bp, Homo sapiens
tccagagcccaaggtcag

SEQ ID NO: 1146368 - DNA, 22 bp, Homo sapiens
tccagagcccaaggtcagggag

SEQ ID NO: 1146369 - DNA, 17 bp, Homo sapiens
tccagagccggcatcct

SEQ ID NO: 1146370 - DNA, 21 bp, Homo sapiens
tccagagcggaggctgtgtgc

SEQ ID NO: 1146371 - DNA, 13 bp, Homo sapiens
tccagagcttttc

SEQ ID NO: 1146372 - DNA, 16 bp, Homo sapiens
tccagaggaataaaaa

SEQ ID NO: 1146373 - DNA, 15 bp, Homo sapiens
tccagaggacagctc

SEQ ID NO: 1146374 - DNA, 17 bp, Homo sapiens
tccagaggacagctctg

SEQ ID NO: 1146375 - DNA, 18 bp, Homo sapiens
tccagaggacagctctgg

SEQ ID NO: 1146376 - DNA, 21 bp, Homo sapiens
tccagaggacagctctggggt

SEQ ID NO: 1146377 - DNA, 12 bp, Homo sapiens
tccagaggacct

SEQ ID NO: 1146378 - DNA, 20 bp, Homo sapiens
tccagaggctattattttca

SEQ ID NO: 1146379 - DNA, 16 bp, Homo sapiens
tccagagggacagggt

SEQ ID NO: 1146380 - DNA, 17 bp, Homo sapiens
tccagagggcactctgc

SEQ ID NO: 1146381 - DNA, 18 bp, Homo sapiens
tccagagtgtgcagactg

SEQ ID NO: 1146382 - DNA, 19 bp, Homo sapiens
tccagagtgtgcagactga

SEQ ID NO: 1146383 - DNA, 20 bp, Homo sapiens
tccagagtgtgcagactgat

SEQ ID NO: 1146384 - DNA, 18 bp, Homo sapiens
tccagataactctctttc

SEQ ID NO: 1146385 - DNA, 21 bp, Homo sapiens
tccagataactctctttcctt

SEQ ID NO: 1146386 - DNA, 22 bp, Homo sapiens
tccagatagtgtagctgaggag

SEQ ID NO: 1146387 - DNA, 23 bp, Homo sapiens
tccagatatccacataaatgctc

SEQ ID NO: 1146388 - DNA, 16 bp, Homo sapiens
tccagatcactgccac

SEQ ID NO: 1146389 - DNA, 19 bp, Homo sapiens
tccagatgcagggcagtca

SEQ ID NO: 1146390 - DNA, 15 bp, Homo sapiens
tccagattctgatgc

SEQ ID NO: 1146391 - DNA, 17 bp, Homo sapiens
tccagattgacgacaag

SEQ ID NO: 1146392 - DNA, 22 bp, Homo sapiens
tccagattggcacccctttcta

SEQ ID NO: 1146393 - DNA, 12 bp, Homo sapiens
tccagattggtg

SEQ ID NO: 1146394 - DNA, 16 bp, Homo sapiens
tccagatttacactgg

SEQ ID NO: 1146395 - DNA, 18 bp, Homo sapiens
tccagatttacactggga

SEQ ID NO: 1146396 - DNA, 19 bp, Homo sapiens
tccagatttacactgggag

SEQ ID NO: 1146397 - DNA, 20 bp, Homo sapiens
tccagcaaaatggaagcaaa

SEQ ID NO: 1146398 - DNA, 17 bp, Homo sapiens
tccagcaactgcccttc

SEQ ID NO: 1146399 - DNA, 20 bp, Homo sapiens
tccagcaactgcccttccag

SEQ ID NO: 1146400 - DNA, 20 bp, Homo sapiens
tccagcaacttcttctccat

SEQ ID NO: 1146401 - DNA, 23 bp, Homo sapiens
tccagcaagcagtctaccctgtc

SEQ ID NO: 1146402 - DNA, 14 bp, Homo sapiens
tccagcaataagaa

SEQ ID NO: 1146403 - DNA, 17 bp, Homo sapiens
tccagcaataagaaatg

SEQ ID NO: 1146404 - DNA, 19 bp, Homo sapiens
tccagcaataagaaatgaa

SEQ ID NO: 1146405 - DNA, 23 bp, Homo sapiens
tccagcaataagaaatgaacaaa

SEQ ID NO: 1146406 - DNA, 22 bp, Homo sapiens
tccagcaccttctttctggact

SEQ ID NO: 1146407 - DNA, 23 bp, Homo sapiens
tccagcaccttctttctggactg

SEQ ID NO: 1146408 - DNA, 12 bp, Homo sapiens
tccagcactggt

SEQ ID NO: 1146409 - DNA, 12 bp, Homo sapiens
tccagcagctgc

SEQ ID NO: 1146410 - DNA, 14 bp, Homo sapiens
tccagcagctgcac

SEQ ID NO: 1146411 - DNA, 23 bp, Homo sapiens
tccagcagctgcgggtctgaagg

SEQ ID NO: 1146412 - DNA, 22 bp, Homo sapiens
tccagcagtgaaacttgtgcta

SEQ ID NO: 1146413 - DNA, 14 bp, Homo sapiens
tccagcatccagcc

SEQ ID NO: 1146414 - DNA, 15 bp, Homo sapiens
tccagcatccagcct

SEQ ID NO: 1146415 - DNA, 17 bp, Homo sapiens
tccagcatccagcctgt

SEQ ID NO: 1146416 - DNA, 22 bp, Homo sapiens
tccagccaaagaaatgggcctg

SEQ ID NO: 1146417 - DNA, 20 bp, Homo sapiens
tccagccaacccctgtggag

SEQ ID NO: 1146418 - DNA, 22 bp, Homo sapiens
tccagccacggagggaggcacc

SEQ ID NO: 1146419 - DNA, 10 bp, Homo sapiens
tccagccagc

SEQ ID NO: 1146420 - DNA, 12 bp, Homo sapiens
tccagccagcgc

SEQ ID NO: 1146421 - DNA, 23 bp, Homo sapiens
tccagccagcgcctccctccacc

SEQ ID NO: 1146422 - DNA, 13 bp, Homo sapiens
tccagccaggccc

SEQ ID NO: 1146423 - DNA, 17 bp, Homo sapiens
tccagccaggcccaggc

SEQ ID NO: 1146424 - DNA, 18 bp, Homo sapiens
tccagccaggcccaggcc

SEQ ID NO: 1146425 - DNA, 21 bp, Homo sapiens
tccagccaggcccaggccagc

SEQ ID NO: 1146426 - DNA, 14 bp, Homo sapiens
tccagccattgtaa

SEQ ID NO: 1146427 - DNA, 12 bp, Homo sapiens
tccagcccagac

SEQ ID NO: 1146428 - DNA, 11 bp, Homo sapiens
tccagcccatc

SEQ ID NO: 1146429 - DNA, 18 bp, Homo sapiens
tccagcccatctcggagc

SEQ ID NO: 1146430 - DNA, 21 bp, Homo sapiens
tccagcccctcttggagaagt

SEQ ID NO: 1146431 - DNA, 12 bp, Homo sapiens
tccagcccctgt

SEQ ID NO: 1146432 - DNA, 20 bp, Homo sapiens
tccagcccctgtcccacccc

SEQ ID NO: 1146433 - DNA, 23 bp, Homo sapiens
tccagcccctgtcccaccccctt

SEQ ID NO: 1146434 - DNA, 17 bp, Homo sapiens
tccagccccttctcaga

SEQ ID NO: 1146435 - DNA, 18 bp, Homo sapiens
tccagccccttctcagaa

SEQ ID NO: 1146436 - DNA, 21 bp, Homo sapiens
tccagccccttctcagaatct

SEQ ID NO: 1146437 - DNA, 16 bp, Homo sapiens
tccagcccctttgcct

SEQ ID NO: 1146438 - DNA, 19 bp, Homo sapiens
tccagcccctttgcctctg

SEQ ID NO: 1146439 - DNA, 21 bp, Homo sapiens
tccagcccctttgcctctgtc

SEQ ID NO: 1146440 - DNA, 22 bp, Homo sapiens
tccagcccctttgcctctgtcc

SEQ ID NO: 1146441 - DNA, 14 bp, Homo sapiens
tccagcccgggagc

SEQ ID NO: 1146442 - DNA, 13 bp, Homo sapiens
tccagccctgccg

SEQ ID NO: 1146443 - DNA, 20 bp, Homo sapiens
tccagccctggttctggctg

SEQ ID NO: 1146444 - DNA, 16 bp, Homo sapiens
tccagccgccattgcc

SEQ ID NO: 1146445 - DNA, 22 bp, Homo sapiens
tccagccgccattgccaccagg

SEQ ID NO: 1146446 - DNA, 12 bp, Homo sapiens
tccagcctcccc

SEQ ID NO: 1146447 - DNA, 15 bp, Homo sapiens
tccagcctcccctcc

SEQ ID NO: 1146448 - DNA, 13 bp, Homo sapiens
tccagcctccctg

SEQ ID NO: 1146449 - DNA, 19 bp, Homo sapiens
tccagcctccctgtctcca

SEQ ID NO: 1146450 - DNA, 20 bp, Homo sapiens
tccagcctccctgtctccag

SEQ ID NO: 1146451 - DNA, 21 bp, Homo sapiens
tccagcctgctagtctgccct

SEQ ID NO: 1146452 - DNA, 20 bp, Homo sapiens
tccagcctgggacacacaca

SEQ ID NO: 1146453 - DNA, 20 bp, Homo sapiens
tccagcctgggcaacagagc

SEQ ID NO: 1146454 - DNA, 23 bp, Homo sapiens
tccagcctgggcagccaggctgc

SEQ ID NO: 1146455 - DNA, 20 bp, Homo sapiens
tccagcctgggcgacagagc

SEQ ID NO: 1146456 - DNA, 19 bp, Homo sapiens
tccagcctggggctgaggc

SEQ ID NO: 1146457 - DNA, 24 bp, Homo sapiens
tccagcctgggtgacagagcaagt

SEQ ID NO: 1146458 - DNA, 20 bp, Homo sapiens
tccagcctggtttagcctgg

SEQ ID NO: 1146459 - DNA, 13 bp, Homo sapiens
tccagcctgtgtg

SEQ ID NO: 1146460 - DNA, 24 bp, Homo sapiens
tccagcctttccaagtcactagaa

SEQ ID NO: 1146461 - DNA, 14 bp, Homo sapiens
tcccaaactttaaa

SEQ ID NO: 1146462 - DNA, 22 bp, Homo sapiens
tcccaaaggatgagaatgtgac

SEQ ID NO: 1146463 - DNA, 19 bp, Homo sapiens
tcccaaagtcctctgctcc

SEQ ID NO: 1146464 - DNA, 11 bp, Homo sapiens
tcccaaagtgc

SEQ ID NO: 1146465 - DNA, 20 bp, Homo sapiens
tcccaaagtgctgagattac

SEQ ID NO: 1146466 - DNA, 15 bp, Homo sapiens
tcccaaagtgctggg

SEQ ID NO: 1146467 - DNA, 21 bp, Homo sapiens
tcccaaagtgctgggattaca

SEQ ID NO: 1146468 - DNA, 19 bp, Homo sapiens
tcccaaatttgattgattt

SEQ ID NO: 1146469 - DNA, 15 bp, Homo sapiens
tcccaacagccatgc

SEQ ID NO: 1146470 - DNA, 17 bp, Homo sapiens
tcccaacagccatgccc

SEQ ID NO: 1146471 - DNA, 16 bp, Homo sapiens
tcccaaccaaccagca

SEQ ID NO: 1146472 - DNA, 18 bp, Homo sapiens
tcccaaccaaccagcagg

SEQ ID NO: 1146473 - DNA, 15 bp, Homo sapiens
tcccaaccaggcacc

SEQ ID NO: 1146474 - DNA, 21 bp, Homo sapiens
tcccaacccccctcctgctcc

SEQ ID NO: 1146475 - DNA, 21 bp, Homo sapiens
tcccaacctcaatgccctgcc

SEQ ID NO: 1146476 - DNA, 22 bp, Homo sapiens
tcccaacctcaatgccctgcca

SEQ ID NO: 1146477 - DNA, 17 bp, Homo sapiens
tcccaacgagcctcctc

SEQ ID NO: 1146478 - DNA, 13 bp, Homo sapiens
tcccaagaaaatc

SEQ ID NO: 1146479 - DNA, 22 bp, Homo sapiens
tcccaagacagtgagacagtct

SEQ ID NO: 1146480 - DNA, 16 bp, Homo sapiens
tcccaagaccctgccc

SEQ ID NO: 1146481 - DNA, 13 bp, Homo sapiens
tcccaagctaggc

SEQ ID NO: 1146482 - DNA, 20 bp, Homo sapiens
tcccaagctatctaaagttt

SEQ ID NO: 1146483 - DNA, 18 bp, Homo sapiens
tcccaaggaaagccccag

SEQ ID NO: 1146484 - DNA, 21 bp, Homo sapiens
tcccaaggaagctccttcctg

SEQ ID NO: 1146485 - DNA, 22 bp, Homo sapiens
tcccaaggctctgagcaaatgt

SEQ ID NO: 1146486 - DNA, 13 bp, Homo sapiens
tcccaagggacag

SEQ ID NO: 1146487 - DNA, 22 bp, Homo sapiens
tcccaagggacagcaagtgagc

SEQ ID NO: 1146488 - DNA, 20 bp, Homo sapiens
tcccaagtaactgggattac

SEQ ID NO: 1146489 - DNA, 20 bp, Homo sapiens
tcccaagtaccctgagatac

SEQ ID NO: 1146490 - DNA, 20 bp, Homo sapiens
tcccaagtagctgggattac

SEQ ID NO: 1146491 - DNA, 16 bp, Homo sapiens
tcccaagtatgcctta

SEQ ID NO: 1146492 - DNA, 20 bp, Homo sapiens
tcccaagtatgccttaagca

SEQ ID NO: 1146493 - DNA, 23 bp, Homo sapiens
tcccaagtatgccttaagcagaa

SEQ ID NO: 1146494 - DNA, 18 bp, Homo sapiens
tcccaagttttaggacaa

SEQ ID NO: 1146495 - DNA, 17 bp, Homo sapiens
tcccaataaaagtgact

SEQ ID NO: 1146496 - DNA, 12 bp, Homo sapiens
tcccaatacaaa

SEQ ID NO: 1146497 - DNA, 18 bp, Homo sapiens
tcccaatacaaagatgac

SEQ ID NO: 1146498 - DNA, 21 bp, Homo sapiens
tcccaatcaaagaattacagt

SEQ ID NO: 1146499 - DNA, 14 bp, Homo sapiens
tcccaatcagcttt

SEQ ID NO: 1146500 - DNA, 23 bp, Homo sapiens
tcccaatctctacccctttcttc

SEQ ID NO: 1146501 - DNA, 19 bp, Homo sapiens
tcccaatctttctatataa

SEQ ID NO: 1146502 - DNA, 13 bp, Homo sapiens
tcccaatgaaata

SEQ ID NO: 1146503 - DNA, 15 bp, Homo sapiens
tcccaattaggaagt

SEQ ID NO: 1146504 - DNA, 19 bp, Homo sapiens
tcccaattaggaagtgtaa

SEQ ID NO: 1146505 - DNA, 20 bp, Homo sapiens
tcccaattaggaagtgtaac

SEQ ID NO: 1146506 - DNA, 15 bp, Homo sapiens
tcccaattcacatct

SEQ ID NO: 1146507 - DNA, 16 bp, Homo sapiens
tcccacaaaggagagc

SEQ ID NO: 1146508 - DNA, 14 bp, Homo sapiens
tcccacaagtggtg

SEQ ID NO: 1146509 - DNA, 13 bp, Homo sapiens
tcccacaccctgg

SEQ ID NO: 1146510 - DNA, 17 bp, Homo sapiens
tcccacacggcagcccc

SEQ ID NO: 1146511 - DNA, 23 bp, Homo sapiens
tcccacactgaaaccaaaacata

SEQ ID NO: 1146512 - DNA, 18 bp, Homo sapiens
tcccacactggtgactgc

SEQ ID NO: 1146513 - DNA, 21 bp, Homo sapiens
tcccacactgtgcagacccag

SEQ ID NO: 1146514 - DNA, 22 bp, Homo sapiens
tcccacactgtgcagacccagt

SEQ ID NO: 1146515 - DNA, 14 bp, Homo sapiens
tcccacactgtggc

SEQ ID NO: 1146516 - DNA, 13 bp, Homo sapiens
tcccacacttgct

SEQ ID NO: 1146517 - DNA, 14 bp, Homo sapiens
tcccacacttgctg

SEQ ID NO: 1146518 - DNA, 18 bp, Homo sapiens
tcccacacttgtgccagc

SEQ ID NO: 1146519 - DNA, 16 bp, Homo sapiens
tcccacagacctgcag

SEQ ID NO: 1146520 - DNA, 18 bp, Homo sapiens
tcccacagacctgcagtg

SEQ ID NO: 1146521 - DNA, 19 bp, Homo sapiens
tcccacagagtgctggact

SEQ ID NO: 1146522 - DNA, 16 bp, Homo sapiens
tcccacagcttcctga

SEQ ID NO: 1146523 - DNA, 14 bp, Homo sapiens
tcccacaggagggc

SEQ ID NO: 1146524 - DNA, 17 bp, Homo sapiens
tcccacaggagggccag

SEQ ID NO: 1146525 - DNA, 21 bp, Homo sapiens
tcccacaggcccttcctctcc

SEQ ID NO: 1146526 - DNA, 19 bp, Homo sapiens
tcccacatccaactccagc

SEQ ID NO: 1146527 - DNA, 23 bp, Homo sapiens
tcccacatccaactccagcaact

SEQ ID NO: 1146528 - DNA, 17 bp, Homo sapiens
tcccacatcccactgga

SEQ ID NO: 1146529 - DNA, 13 bp, Homo sapiens
tcccacatgaggc

SEQ ID NO: 1146530 - DNA, 23 bp, Homo sapiens
tcccacatgaggccatctcagga

SEQ ID NO: 1146531 - DNA, 15 bp, Homo sapiens
tcccacatgcctgcg

SEQ ID NO: 1146532 - DNA, 19 bp, Homo sapiens
tcccacattaaagaagacc

SEQ ID NO: 1146533 - DNA, 22 bp, Homo sapiens
tcccacattaaagaagacctga

SEQ ID NO: 1146534 - DNA, 21 bp, Homo sapiens
tcccaccaaatcatcctgaat

SEQ ID NO: 1146535 - DNA, 19 bp, Homo sapiens
tcccaccaaccctcagagc

SEQ ID NO: 1146536 - DNA, 13 bp, Homo sapiens
tcccaccaactct

SEQ ID NO: 1146537 - DNA, 20 bp, Homo sapiens
tcccaccaactctgcactcc

SEQ ID NO: 1146538 - DNA, 15 bp, Homo sapiens
tcccaccacagcagg

SEQ ID NO: 1146539 - DNA, 13 bp, Homo sapiens
tcccaccacccca

SEQ ID NO: 1146540 - DNA, 14 bp, Homo sapiens
tcccaccaccccat

SEQ ID NO: 1146541 - DNA, 16 bp, Homo sapiens
tcccaccagagccggg

SEQ ID NO: 1146542 - DNA, 19 bp, Homo sapiens
tcccaccagagccgggagg

SEQ ID NO: 1146543 - DNA, 16 bp, Homo sapiens
tcccaccagccccggc

SEQ ID NO: 1146544 - DNA, 15 bp, Homo sapiens
tcccaccagcttcac

SEQ ID NO: 1146545 - DNA, 19 bp, Homo sapiens
tcccaccattcctgccttt

SEQ ID NO: 1146546 - DNA, 16 bp, Homo sapiens
tcccacccaacagctc

SEQ ID NO: 1146547 - DNA, 23 bp, Homo sapiens
tcccacccaacagctcagagatg

SEQ ID NO: 1146548 - DNA, 19 bp, Homo sapiens
tcccacccaattcaaaaca

SEQ ID NO: 1146549 - DNA, 21 bp, Homo sapiens
tcccacccacacagctgccct

SEQ ID NO: 1146550 - DNA, 16 bp, Homo sapiens
tcccaccccaccccct

SEQ ID NO: 1146551 - DNA, 16 bp, Homo sapiens
tcccaccccagaaatc

SEQ ID NO: 1146552 - DNA, 20 bp, Homo sapiens
tcccaccccagaaatcactg

SEQ ID NO: 1146553 - DNA, 20 bp, Homo sapiens
tcccaccccattttctgtgg

SEQ ID NO: 1146554 - DNA, 20 bp, Homo sapiens
tcccacccccaacccccaga

SEQ ID NO: 1146555 - DNA, 18 bp, Homo sapiens
tcccacccccacccccag

SEQ ID NO: 1146556 - DNA, 13 bp, Homo sapiens
tcccacccccagc

SEQ ID NO: 1146557 - DNA, 14 bp, Homo sapiens
tcccacccccagcc

SEQ ID NO: 1146558 - DNA, 15 bp, Homo sapiens
tcccacccccagccc

SEQ ID NO: 1146559 - DNA, 22 bp, Homo sapiens
tcccaccccctcctcccccagt

SEQ ID NO: 1146560 - DNA, 19 bp, Homo sapiens
tcccacccccttctctgct

SEQ ID NO: 1146561 - DNA, 15 bp, Homo sapiens
tcccaccccgccgtt

SEQ ID NO: 1146562 - DNA, 13 bp, Homo sapiens
tcccaccccttgg

SEQ ID NO: 1146563 - DNA, 15 bp, Homo sapiens
tcccaccccttggcc

SEQ ID NO: 1146564 - DNA, 20 bp, Homo sapiens
tcccaccccttggcccctca

SEQ ID NO: 1146565 - DNA, 18 bp, Homo sapiens
tcccacccggacaggtgg

SEQ ID NO: 1146566 - DNA, 21 bp, Homo sapiens
tcccacccggacaggtggggc

SEQ ID NO: 1146567 - DNA, 17 bp, Homo sapiens
tcccaccgcccccaccc

SEQ ID NO: 1146568 - DNA, 16 bp, Homo sapiens
tcccacctactgcact

SEQ ID NO: 1146569 - DNA, 17 bp, Homo sapiens
tcccacctagcagcacc

SEQ ID NO: 1146570 - DNA, 20 bp, Homo sapiens
tcccacctagtgccccagac

SEQ ID NO: 1146571 - DNA, 16 bp, Homo sapiens
tcccacctccagcccg

SEQ ID NO: 1146572 - DNA, 17 bp, Homo sapiens
tcccacctccagcccgg

SEQ ID NO: 1146573 - DNA, 13 bp, Homo sapiens
tcccacctccctt

SEQ ID NO: 1146574 - DNA, 20 bp, Homo sapiens
tcccacctctccttttgagg

SEQ ID NO: 1146575 - DNA, 22 bp, Homo sapiens
tcccacctcttctcttcctgta

SEQ ID NO: 1146576 - DNA, 13 bp, Homo sapiens
tcccacctgacac

SEQ ID NO: 1146577 - DNA, 23 bp, Homo sapiens
tcccacctgacacaccaggcgct

SEQ ID NO: 1146578 - DNA, 17 bp, Homo sapiens
tcccacctggctccccc

SEQ ID NO: 1146579 - DNA, 17 bp, Homo sapiens
tcccacctgtttctgga

SEQ ID NO: 1146580 - DNA, 18 bp, Homo sapiens
tcccacgagggtgccgtg

SEQ ID NO: 1146581 - DNA, 14 bp, Homo sapiens
tcccacgtctggcc

SEQ ID NO: 1146582 - DNA, 17 bp, Homo sapiens
tgggagctgaaccaaag

SEQ ID NO: 1146583 - DNA, 20 bp, Homo sapiens
tgggagctgaaccacagaaa

SEQ ID NO: 1146584 - DNA, 19 bp, Homo sapiens
tgggagctgagcagcctct

SEQ ID NO: 1146585 - DNA, 18 bp, Homo sapiens
tgggagctggttagaaat

SEQ ID NO: 1146586 - DNA, 19 bp, Homo sapiens
tgggagctggttagaaatg

SEQ ID NO: 1146587 - DNA, 20 bp, Homo sapiens
tgggaggaaaagaaaagagg

SEQ ID NO: 1146588 - DNA, 11 bp, Homo sapiens
tgggaggaagc

SEQ ID NO: 1146589 - DNA, 24 bp, Homo sapiens
tgggaggaagcaggttgaggggct

SEQ ID NO: 1146590 - DNA, 15 bp, Homo sapiens
tgggaggacaggcag

SEQ ID NO: 1146591 - DNA, 23 bp, Homo sapiens
tgggaggacatgcgtgtgtcagg

SEQ ID NO: 1146592 - DNA, 11 bp, Homo sapiens
tgggaggagac

SEQ ID NO: 1146593 - DNA, 12 bp, Homo sapiens
tgggaggagagc

SEQ ID NO: 1146594 - DNA, 21 bp, Homo sapiens
tgggaggaggaaaagaaacct

SEQ ID NO: 1146595 - DNA, 14 bp, Homo sapiens
tgggaggagggaga

SEQ ID NO: 1146596 - DNA, 20 bp, Homo sapiens
tgggaggatcctgagctgct

SEQ ID NO: 1146597 - DNA, 16 bp, Homo sapiens
tgggaggatctcttga

SEQ ID NO: 1146598 - DNA, 21 bp, Homo sapiens
tgggaggattgcttgagctca

SEQ ID NO: 1146599 - DNA, 15 bp, Homo sapiens
tgggaggcaagaaaa

SEQ ID NO: 1146600 - DNA, 18 bp, Homo sapiens
tgggaggcaagaggggtg

SEQ ID NO: 1146601 - DNA, 16 bp, Homo sapiens
tgggaggcagaaacct

SEQ ID NO: 1146602 - DNA, 18 bp, Homo sapiens
tgggaggcatggccctgg

SEQ ID NO: 1146603 - DNA, 11 bp, Homo sapiens
tgggaggccaa

SEQ ID NO: 1146604 - DNA, 12 bp, Homo sapiens
tgggaggccaag

SEQ ID NO: 1146605 - DNA, 16 bp, Homo sapiens
tgggaggccaaggcag

SEQ ID NO: 1146606 - DNA, 20 bp, Homo sapiens
tgggaggccaaggtgggagg

SEQ ID NO: 1146607 - DNA, 23 bp, Homo sapiens
tgggaggccaggcgagcctgact

SEQ ID NO: 1146608 - DNA, 18 bp, Homo sapiens
tgggaggcctaggcgggc

SEQ ID NO: 1146609 - DNA, 21 bp, Homo sapiens
tgggaggcgtgcccccctcct

SEQ ID NO: 1146610 - DNA, 22 bp, Homo sapiens
tgggaggcgtgcccccctcctc

SEQ ID NO: 1146611 - DNA, 13 bp, Homo sapiens
tgggaggctcacc

SEQ ID NO: 1146612 - DNA, 18 bp, Homo sapiens
tgggagggagcagacagg

SEQ ID NO: 1146613 - DNA, 19 bp, Homo sapiens
tgggagggagcagacagga

SEQ ID NO: 1146614 - DNA, 13 bp, Homo sapiens
tgggagggatcag

SEQ ID NO: 1146615 - DNA, 18 bp, Homo sapiens
tgggagggatcagccccg

SEQ ID NO: 1146616 - DNA, 20 bp, Homo sapiens
tgggagggatcagccccgcc

SEQ ID NO: 1146617 - DNA, 23 bp, Homo sapiens
tgggagggcgtcaggcagaggca

SEQ ID NO: 1146618 - DNA, 18 bp, Homo sapiens
tgggaggggcaggctgac

SEQ ID NO: 1146619 - DNA, 15 bp, Homo sapiens
tgggagggggaggaa

SEQ ID NO: 1146620 - DNA, 17 bp, Homo sapiens
tgggagggggaggaagt

SEQ ID NO: 1146621 - DNA, 21 bp, Homo sapiens
tgggaggtaggctgtggggtg

SEQ ID NO: 1146622 - DNA, 20 bp, Homo sapiens
tgggaggtataggggtcctg

SEQ ID NO: 1146623 - DNA, 17 bp, Homo sapiens
tgggaggtcaggaaact

SEQ ID NO: 1146624 - DNA, 14 bp, Homo sapiens
tgggaggtgcgtgt

SEQ ID NO: 1146625 - DNA, 23 bp, Homo sapiens
tgggaggtgcgtgttcagcagaa

SEQ ID NO: 1146626 - DNA, 22 bp, Homo sapiens
tgggaggtggaagaagggagaa

SEQ ID NO: 1146627 - DNA, 20 bp, Homo sapiens
tgggaggttgggaggctgtg

SEQ ID NO: 1146628 - DNA, 22 bp, Homo sapiens
tgggagtagcatggactctggg

SEQ ID NO: 1146629 - DNA, 18 bp, Homo sapiens
tgggagtatgttgtcata

SEQ ID NO: 1146630 - DNA, 20 bp, Homo sapiens
tgggagtatgttgtcataac

SEQ ID NO: 1146631 - DNA, 17 bp, Homo sapiens
tgggatttaatttccag

SEQ ID NO: 1146632 - DNA, 21 bp, Homo sapiens
tgggcaaagccacaaggctgg

SEQ ID NO: 1146633 - DNA, 22 bp, Homo sapiens
tgggcaaagccacaaggctggc

SEQ ID NO: 1146634 - DNA, 15 bp, Homo sapiens
tgggcaaagcctagt

SEQ ID NO: 1146635 - DNA, 23 bp, Homo sapiens
tgggcaaagcttgtcaaagatgc

SEQ ID NO: 1146636 - DNA, 16 bp, Homo sapiens
tgggcaaaggcagggc

SEQ ID NO: 1146637 - DNA, 16 bp, Homo sapiens
tgggcaaagggaagta

SEQ ID NO: 1146638 - DNA, 15 bp, Homo sapiens
tgggcaacagagcaa

SEQ ID NO: 1146639 - DNA, 20 bp, Homo sapiens
tgggcaacgagtgaaactcc

SEQ ID NO: 1146640 - DNA, 16 bp, Homo sapiens
tgggcaagtagcagga

SEQ ID NO: 1146641 - DNA, 19 bp, Homo sapiens
tgggcaagtagcaggacta

SEQ ID NO: 1146642 - DNA, 17 bp, Homo sapiens
tgggcacacacacccgc

SEQ ID NO: 1146643 - DNA, 16 bp, Homo sapiens
tgggcacagattgaag

SEQ ID NO: 1146644 - DNA, 18 bp, Homo sapiens
tgggcacagattgaagaa

SEQ ID NO: 1146645 - DNA, 13 bp, Homo sapiens
tgggcacagtgct

SEQ ID NO: 1146646 - DNA, 17 bp, Homo sapiens
tgggcacagtgctgccc

SEQ ID NO: 1146647 - DNA, 18 bp, Homo sapiens
tgggcacagtgctgcccc

SEQ ID NO: 1146648 - DNA, 19 bp, Homo sapiens
tgggcacagtgctgcccct

SEQ ID NO: 1146649 - DNA, 15 bp, Homo sapiens
tgggcacatgctcag

SEQ ID NO: 1146650 - DNA, 16 bp, Homo sapiens
tgggcacatgctcagg

SEQ ID NO: 1146651 - DNA, 16 bp, Homo sapiens
tgggcaccacaaaata

SEQ ID NO: 1146652 - DNA, 22 bp, Homo sapiens
tgggcaccacctctgtgggcac

SEQ ID NO: 1146653 - DNA, 19 bp, Homo sapiens
tgggcaccgtgtcctcctc

SEQ ID NO: 1146654 - DNA, 17 bp, Homo sapiens
tgggcacctggggagtg

SEQ ID NO: 1146655 - DNA, 20 bp, Homo sapiens
tgggcacctggggagtggga

SEQ ID NO: 1146656 - DNA, 22 bp, Homo sapiens
tgggcactccgcgccgatgcca

SEQ ID NO: 1146657 - DNA, 13 bp, Homo sapiens
tgggcactgctcc

SEQ ID NO: 1146658 - DNA, 15 bp, Homo sapiens
tgggcactggcccag

SEQ ID NO: 1146659 - DNA, 15 bp, Homo sapiens
tgggcactgggatga

SEQ ID NO: 1146660 - DNA, 20 bp, Homo sapiens
tgggcactggtgggtcggcc

SEQ ID NO: 1146661 - DNA, 17 bp, Homo sapiens
tgggcagaagggagaag

SEQ ID NO: 1146662 - DNA, 19 bp, Homo sapiens
tgggcagaagggagaagga

SEQ ID NO: 1146663 - DNA, 14 bp, Homo sapiens
tgggcagaagtgag

SEQ ID NO: 1146664 - DNA, 14 bp, Homo sapiens
tgggcagagcccaa

SEQ ID NO: 1146665 - DNA, 13 bp, Homo sapiens
tgggcagagcctg

SEQ ID NO: 1146666 - DNA, 16 bp, Homo sapiens
tgggcagagcctgtcc

SEQ ID NO: 1146667 - DNA, 18 bp, Homo sapiens
tgggcagagctggctctg

SEQ ID NO: 1146668 - DNA, 23 bp, Homo sapiens
tgggcagaggaccaggctgtagg

SEQ ID NO: 1146669 - DNA, 14 bp, Homo sapiens
tgggcagagggcct

SEQ ID NO: 1146670 - DNA, 14 bp, Homo sapiens
tgggcagcaccctc

SEQ ID NO: 1146671 - DNA, 17 bp, Homo sapiens
tgggcagcaccctcccc

SEQ ID NO: 1146672 - DNA, 21 bp, Homo sapiens
tgggcagcagcatcccagcct

SEQ ID NO: 1146673 - DNA, 22 bp, Homo sapiens
tgggcagcagcatcccagcctt

SEQ ID NO: 1146674 - DNA, 23 bp, Homo sapiens
tgggcagcagcatcccagccttg

SEQ ID NO: 1146675 - DNA, 21 bp, Homo sapiens
tgggcagccagaccagcaggc

SEQ ID NO: 1146676 - DNA, 23 bp, Homo sapiens
tgggcagccaggagtgcccccgg

SEQ ID NO: 1146677 - DNA, 14 bp, Homo sapiens
tgggcagccaggct

SEQ ID NO: 1146678 - DNA, 13 bp, Homo sapiens
tgggcagccccac

SEQ ID NO: 1146679 - DNA, 16 bp, Homo sapiens
tgggcagctcctccct

SEQ ID NO: 1146680 - DNA, 17 bp, Homo sapiens
tgggcagctcctccctg

SEQ ID NO: 1146681 - DNA, 24 bp, Homo sapiens
tgggcagctcctccctgtgccccc

SEQ ID NO: 1146682 - DNA, 12 bp, Homo sapiens
tgggcaggaagg

SEQ ID NO: 1146683 - DNA, 16 bp, Homo sapiens
tgggcaggaccctgct

SEQ ID NO: 1146684 - DNA, 16 bp, Homo sapiens
tgggcaggacctcaga

SEQ ID NO: 1146685 - DNA, 21 bp, Homo sapiens
tgggcaggatctcaagccagc

SEQ ID NO: 1146686 - DNA, 20 bp, Homo sapiens
tgggcctgccgggctgaggg

SEQ ID NO: 1146687 - DNA, 12 bp, Homo sapiens
tgggcctgcctg

SEQ ID NO: 1146688 - DNA, 21 bp, Homo sapiens
tgggcctgcctgcctccaccc

SEQ ID NO: 1146689 - DNA, 14 bp, Homo sapiens
tgggcctgctgagg

SEQ ID NO: 1146690 - DNA, 21 bp, Homo sapiens
tgggcctgctgaggccttctc

SEQ ID NO: 1146691 - DNA, 20 bp, Homo sapiens
tgggcctgcttttccaggat

SEQ ID NO: 1146692 - DNA, 13 bp, Homo sapiens
tgggcctggcctg

SEQ ID NO: 1146693 - DNA, 14 bp, Homo sapiens
tgggcctggcctga

SEQ ID NO: 1146694 - DNA, 16 bp, Homo sapiens
tgggcctggcctgagc

SEQ ID NO: 1146695 - DNA, 20 bp, Homo sapiens
tgggcctggcctgagctggg

SEQ ID NO: 1146696 - DNA, 12 bp, Homo sapiens
tgggcctgggcc

SEQ ID NO: 1146697 - DNA, 17 bp, Homo sapiens
tgggcctgtcgtgccag

SEQ ID NO: 1146698 - DNA, 21 bp, Homo sapiens
tgggcctgtcgtgccagtcct

SEQ ID NO: 1146699 - DNA, 22 bp, Homo sapiens
tgggcctgtcgtgccagtcctg

SEQ ID NO: 1146700 - DNA, 14 bp, Homo sapiens
tgggcctgtgcact

SEQ ID NO: 1146701 - DNA, 20 bp, Homo sapiens
tgggcctgtgcactgggcag

SEQ ID NO: 1146702 - DNA, 21 bp, Homo sapiens
tgggcctgtgcactgggcagg

SEQ ID NO: 1146703 - DNA, 20 bp, Homo sapiens
tgggcctgtgcagcagccca

SEQ ID NO: 1146704 - DNA, 22 bp, Homo sapiens
tgggcctgtgcagcagcccagc

SEQ ID NO: 1146705 - DNA, 19 bp, Homo sapiens
tgggccttagtgggccagg

SEQ ID NO: 1146706 - DNA, 17 bp, Homo sapiens
tgggccttgctttgggc

SEQ ID NO: 1146707 - DNA, 15 bp, Homo sapiens
tgggccttggctggg

SEQ ID NO: 1146708 - DNA, 16 bp, Homo sapiens
tgggccttggctgggc

SEQ ID NO: 1146709 - DNA, 23 bp, Homo sapiens
tgggccttggggctcagccacag

SEQ ID NO: 1146710 - DNA, 13 bp, Homo sapiens
tgggcctttccag

SEQ ID NO: 1146711 - DNA, 14 bp, Homo sapiens
tgggcctttcctgt

SEQ ID NO: 1146712 - DNA, 19 bp, Homo sapiens
tgggcgatttgggggctcg

SEQ ID NO: 1146713 - DNA, 23 bp, Homo sapiens
tgggcgatttgggggctcgggga

SEQ ID NO: 1146714 - DNA, 16 bp, Homo sapiens
tgggcgcaaaggtgcc

SEQ ID NO: 1146715 - DNA, 16 bp, Homo sapiens
tgggcgcaggcccagt

SEQ ID NO: 1146716 - DNA, 17 bp, Homo sapiens
tgggcgcaggcccagtg

SEQ ID NO: 1146717 - DNA, 18 bp, Homo sapiens
tgggcgcaggcccagtga

SEQ ID NO: 1146718 - DNA, 17 bp, Homo sapiens
tgggcgcagtggctcac

SEQ ID NO: 1146719 - DNA, 23 bp, Homo sapiens
tgggcgcggtggctcacgcctgt

SEQ ID NO: 1146720 - DNA, 14 bp, Homo sapiens
tgggcgctgcttcc

SEQ ID NO: 1146721 - DNA, 14 bp, Homo sapiens
tgggcggctgagag

SEQ ID NO: 1146722 - DNA, 21 bp, Homo sapiens
tgggcgtccagctcagccctg

SEQ ID NO: 1146723 - DNA, 15 bp, Homo sapiens
tgggcgtctccccca

SEQ ID NO: 1146724 - DNA, 20 bp, Homo sapiens
tgggcgtctgactccctccc

SEQ ID NO: 1146725 - DNA, 14 bp, Homo sapiens
tgggcgtctgttct

SEQ ID NO: 1146726 - DNA, 22 bp, Homo sapiens
tgggcgtggtagtgcaagctga

SEQ ID NO: 1146727 - DNA, 20 bp, Homo sapiens
tgggcgtgtgtgacactgat

SEQ ID NO: 1146728 - DNA, 16 bp, Homo sapiens
tgggcgtttggggccc

SEQ ID NO: 1146729 - DNA, 20 bp, Homo sapiens
tgggctactgccactgtgtg

SEQ ID NO: 1146730 - DNA, 13 bp, Homo sapiens
tgggctactggca

SEQ ID NO: 1146731 - DNA, 19 bp, Homo sapiens
tgggctactggcagctcct

SEQ ID NO: 1146732 - DNA, 23 bp, Homo sapiens
tgggctagattacagagggctca

SEQ ID NO: 1146733 - DNA, 19 bp, Homo sapiens
tgggctagtgtgagtggca

SEQ ID NO: 1146734 - DNA, 14 bp, Homo sapiens
tgggctatggacac

SEQ ID NO: 1146735 - DNA, 17 bp, Homo sapiens
tgggctatggacacagg

SEQ ID NO: 1146736 - DNA, 19 bp, Homo sapiens
tgggctatttggactcagg

SEQ ID NO: 1146737 - DNA, 14 bp, Homo sapiens
tgggctcaaagccc

SEQ ID NO: 1146738 - DNA, 21 bp, Homo sapiens
tgggctcaagcaatcctcctg

SEQ ID NO: 1146739 - DNA, 20 bp, Homo sapiens
tgggctcaagtgatcctcac

SEQ ID NO: 1146740 - DNA, 13 bp, Homo sapiens
tgggctcagggct

SEQ ID NO: 1146741 - DNA, 19 bp, Homo sapiens
tgggctccacgggcagggg

SEQ ID NO: 1146742 - DNA, 16 bp, Homo sapiens
tgaaactgctgttttc

SEQ ID NO: 1146743 - DNA, 16 bp, Homo sapiens
tgaaacttacacacaa

SEQ ID NO: 1146744 - DNA, 13 bp, Homo sapiens
tgaaacttgtgct

SEQ ID NO: 1146745 - DNA, 15 bp, Homo sapiens
tgaaacttgtgctat

SEQ ID NO: 1146746 - DNA, 16 bp, Homo sapiens
tgaaacttgtgctata

SEQ ID NO: 1146747 - DNA, 16 bp, Homo sapiens
tgaaacttttctagaa

SEQ ID NO: 1146748 - DNA, 21 bp, Homo sapiens
tgaaacttttctagaattatt

SEQ ID NO: 1146749 - DNA, 23 bp, Homo sapiens
tgaaacttttctagaattatttt

SEQ ID NO: 1146750 - DNA, 21 bp, Homo sapiens
tgaaacttttttcattttgaa

SEQ ID NO: 1146751 - DNA, 11 bp, Homo sapiens
tgaaagaactt

SEQ ID NO: 1146752 - DNA, 18 bp, Homo sapiens
tgaaagaattatttttgt

SEQ ID NO: 1146753 - DNA, 20 bp, Homo sapiens
tgaaagaattatttttgtgt

SEQ ID NO: 1146754 - DNA, 17 bp, Homo sapiens
tgaaagaccagatcctt

SEQ ID NO: 1146755 - DNA, 12 bp, Homo sapiens
tgaaagaccttc

SEQ ID NO: 1146756 - DNA, 17 bp, Homo sapiens
tgaaagaccttctccaa

SEQ ID NO: 1146757 - DNA, 16 bp, Homo sapiens
tgaaagactgaagaaa

SEQ ID NO: 1146758 - DNA, 13 bp, Homo sapiens
tgaaagactgtac

SEQ ID NO: 1146759 - DNA, 18 bp, Homo sapiens
tgaaagactgtacaaagt

SEQ ID NO: 1146760 - DNA, 19 bp, Homo sapiens
tgaaagactgtacaaagta

SEQ ID NO: 1146761 - DNA, 14 bp, Homo sapiens
tgaaagagaaacac

SEQ ID NO: 1146762 - DNA, 18 bp, Homo sapiens
tgaaagagaaccagtttc

SEQ ID NO: 1146763 - DNA, 18 bp, Homo sapiens
tgaaagagaagatggcca

SEQ ID NO: 1146764 - DNA, 18 bp, Homo sapiens
tgaaagagattacttaaa

SEQ ID NO: 1146765 - DNA, 22 bp, Homo sapiens
tgaaagaggaggacccctgcct

SEQ ID NO: 1146766 - DNA, 17 bp, Homo sapiens
tgaaagagtctgggacc

SEQ ID NO: 1146767 - DNA, 19 bp, Homo sapiens
tgaaagatggctgtgcctc

SEQ ID NO: 1146768 - DNA, 21 bp, Homo sapiens
tgaaagatggctgtgcctctg

SEQ ID NO: 1146769 - DNA, 14 bp, Homo sapiens
tgaaagattttatt

SEQ ID NO: 1146770 - DNA, 20 bp, Homo sapiens
tgaaagattttattgtataa

SEQ ID NO: 1146771 - DNA, 16 bp, Homo sapiens
tgaaagcagcagctag

SEQ ID NO: 1146772 - DNA, 16 bp, Homo sapiens
tgaaagcataacatgg

SEQ ID NO: 1146773 - DNA, 23 bp, Homo sapiens
tgaaagccaacaactctgccttt

SEQ ID NO: 1146774 - DNA, 12 bp, Homo sapiens
tgaaagccaagg

SEQ ID NO: 1146775 - DNA, 14 bp, Homo sapiens
tgaaagccaaggca

SEQ ID NO: 1146776 - DNA, 13 bp, Homo sapiens
tgaaagccatgga

SEQ ID NO: 1146777 - DNA, 14 bp, Homo sapiens
tgaaagccatttgt

SEQ ID NO: 1146778 - DNA, 13 bp, Homo sapiens
tgaaagctagaga

SEQ ID NO: 1146779 - DNA, 16 bp, Homo sapiens
tgaaagctgatttttt

SEQ ID NO: 1146780 - DNA, 11 bp, Homo sapiens
tgaaagctgtg

SEQ ID NO: 1146781 - DNA, 16 bp, Homo sapiens
tgaaaggaacactggc

SEQ ID NO: 1146782 - DNA, 17 bp, Homo sapiens
tgaaaggaacatttttt

SEQ ID NO: 1146783 - DNA, 20 bp, Homo sapiens
tgaaaggacagttaagtatt

SEQ ID NO: 1146784 - DNA, 15 bp, Homo sapiens
tgaaaggcaggaagg

SEQ ID NO: 1146785 - DNA, 19 bp, Homo sapiens
tgaaaggcaggcctatttc

SEQ ID NO: 1146786 - DNA, 20 bp, Homo sapiens
tgaaaggcaggcctatttca

SEQ ID NO: 1146787 - DNA, 21 bp, Homo sapiens
tgaaaggcaggcctatttcat

SEQ ID NO: 1146788 - DNA, 22 bp, Homo sapiens
tgaaaggcaggcctatttcatc

SEQ ID NO: 1146789 - DNA, 19 bp, Homo sapiens
tgaaaggcattctctgaag

SEQ ID NO: 1146790 - DNA, 17 bp, Homo sapiens
tgaaaggccaacagcaa

SEQ ID NO: 1146791 - DNA, 16 bp, Homo sapiens
tgaaaggcctcaagaa

SEQ ID NO: 1146792 - DNA, 20 bp, Homo sapiens
tgaaagggagctatcaggaa

SEQ ID NO: 1146793 - DNA, 22 bp, Homo sapiens
tgaaagggagctatcaggaaca

SEQ ID NO: 1146794 - DNA, 19 bp, Homo sapiens
tgaaagggcacttaatttg

SEQ ID NO: 1146795 - DNA, 22 bp, Homo sapiens
tgaaagggcacttaatttgtaa

SEQ ID NO: 1146796 - DNA, 19 bp, Homo sapiens
tgaaaggggacacctgtac

SEQ ID NO: 1146797 - DNA, 22 bp, Homo sapiens
tgaaaggggacacctgtacatt

SEQ ID NO: 1146798 - DNA, 19 bp, Homo sapiens
tgaaaggtactatatttgc

SEQ ID NO: 1146799 - DNA, 15 bp, Homo sapiens
tgaaaggtagacttt

SEQ ID NO: 1146800 - DNA, 19 bp, Homo sapiens
tgaaaggttagagaataaa

SEQ ID NO: 1146801 - DNA, 15 bp, Homo sapiens
tgaaaggtttacatt

SEQ ID NO: 1146802 - DNA, 17 bp, Homo sapiens
tgaaagtagagctagct

SEQ ID NO: 1146803 - DNA, 23 bp, Homo sapiens
tgaaagtagagctagctgccact

SEQ ID NO: 1146804 - DNA, 15 bp, Homo sapiens
tgaaagtataactga

SEQ ID NO: 1146805 - DNA, 15 bp, Homo sapiens
tgaaagtattcagaa

SEQ ID NO: 1146806 - DNA, 18 bp, Homo sapiens
tgaaagtattcagaaatt

SEQ ID NO: 1146807 - DNA, 21 bp, Homo sapiens
tgaaagtattcagaaattaaa

SEQ ID NO: 1146808 - DNA, 16 bp, Homo sapiens
tgaaagtccagaaact

SEQ ID NO: 1146809 - DNA, 11 bp, Homo sapiens
tgaaagtgact

SEQ ID NO: 1146810 - DNA, 17 bp, Homo sapiens
tgaaagtgttttactct

SEQ ID NO: 1146811 - DNA, 14 bp, Homo sapiens
tttccttccctttt

SEQ ID NO: 1146812 - DNA, 18 bp, Homo sapiens
tttccttcccttttctgt

SEQ ID NO: 1146813 - DNA, 16 bp, Homo sapiens
tttccttccttccctg

SEQ ID NO: 1146814 - DNA, 18 bp, Homo sapiens
tttccttctcatctgtga

SEQ ID NO: 1146815 - DNA, 15 bp, Homo sapiens
tttccttctgttaag

SEQ ID NO: 1146816 - DNA, 18 bp, Homo sapiens
tttccttctgttaagaaa

SEQ ID NO: 1146817 - DNA, 23 bp, Homo sapiens
tttccttctgttaagaaaggata

SEQ ID NO: 1146818 - DNA, 16 bp, Homo sapiens
tttccttcttcagcag

SEQ ID NO: 1146819 - DNA, 12 bp, Homo sapiens
tttccttctttg

SEQ ID NO: 1146820 - DNA, 18 bp, Homo sapiens
tttccttgttggtcagag

SEQ ID NO: 1146821 - DNA, 21 bp, Homo sapiens
tttcctttaactgacaagcca

SEQ ID NO: 1146822 - DNA, 15 bp, Homo sapiens
tttcctttactcctg

SEQ ID NO: 1146823 - DNA, 17 bp, Homo sapiens
tttcctttatgtgaatt

SEQ ID NO: 1146824 - DNA, 19 bp, Homo sapiens
tttcctttatgtgaatttt

SEQ ID NO: 1146825 - DNA, 12 bp, Homo sapiens
tttcctttctca

SEQ ID NO: 1146826 - DNA, 15 bp, Homo sapiens
tttcctttctggccc

SEQ ID NO: 1146827 - DNA, 13 bp, Homo sapiens
tttcctttcttaa

SEQ ID NO: 1146828 - DNA, 22 bp, Homo sapiens
tttcctttcttaattttgtctt

SEQ ID NO: 1146829 - DNA, 12 bp, Homo sapiens
tttcctttggag

SEQ ID NO: 1146830 - DNA, 16 bp, Homo sapiens
tttcctttgtcatcat

SEQ ID NO: 1146831 - DNA, 9 bp, Homo sapiens
tttcctttt

SEQ ID NO: 1146832 - DNA, 15 bp, Homo sapiens
tttccttttcatctg

SEQ ID NO: 1146833 - DNA, 22 bp, Homo sapiens
tttccttttttcccataagaca

SEQ ID NO: 1146834 - DNA, 16 bp, Homo sapiens
tttccttttttgttat

SEQ ID NO: 1146835 - DNA, 17 bp, Homo sapiens
tttccttttttgttatt

SEQ ID NO: 1146836 - DNA, 14 bp, Homo sapiens
tttcgactggtcca

SEQ ID NO: 1146837 - DNA, 19 bp, Homo sapiens
tttcgccgttgaagaggaa

SEQ ID NO: 1146838 - DNA, 20 bp, Homo sapiens
tttcggaaaaaaaaaaagaa

SEQ ID NO: 1146839 - DNA, 17 bp, Homo sapiens
tttcggattttttccaa

SEQ ID NO: 1146840 - DNA, 16 bp, Homo sapiens
tttcgtaacacagcat

SEQ ID NO: 1146841 - DNA, 14 bp, Homo sapiens
tttcgtaccttccc

SEQ ID NO: 1146842 - DNA, 13 bp, Homo sapiens
tttcgtcacgagc

SEQ ID NO: 1146843 - DNA, 19 bp, Homo sapiens
tttcgtgtagtggaagagc

SEQ ID NO: 1146844 - DNA, 19 bp, Homo sapiens
tttcgttaacattgaccaa

SEQ ID NO: 1146845 - DNA, 14 bp, Homo sapiens
tttcgtttctgtat

SEQ ID NO: 1146846 - DNA, 14 bp, Homo sapiens
tttcgtttgtttgt

SEQ ID NO: 1146847 - DNA, 23 bp, Homo sapiens
tttctaaaaagctatgtatcgct

SEQ ID NO: 1146848 - DNA, 17 bp, Homo sapiens
tttctaaaaagtcagat

SEQ ID NO: 1146849 - DNA, 16 bp, Homo sapiens
tttctaaaatctaaaa

SEQ ID NO: 1146850 - DNA, 13 bp, Homo sapiens
tttctaaacaaga

SEQ ID NO: 1146851 - DNA, 14 bp, Homo sapiens
tttctaaaggctac

SEQ ID NO: 1146852 - DNA, 18 bp, Homo sapiens
tttctaaaggctaccttt

SEQ ID NO: 1146853 - DNA, 21 bp, Homo sapiens
tttctaaaggctacctttgta

SEQ ID NO: 1146854 - DNA, 12 bp, Homo sapiens
tttctaaagtaa

SEQ ID NO: 1146855 - DNA, 13 bp, Homo sapiens
tttctaaagtgtt

SEQ ID NO: 1146856 - DNA, 14 bp, Homo sapiens
tttctaaataaaaa

SEQ ID NO: 1146857 - DNA, 19 bp, Homo sapiens
tttctaaatctccaaaata

SEQ ID NO: 1146858 - DNA, 14 bp, Homo sapiens
tttctaaccttgaa

SEQ ID NO: 1146859 - DNA, 15 bp, Homo sapiens
tttctaaccttgaat

SEQ ID NO: 1146860 - DNA, 22 bp, Homo sapiens
tttctaaccttgaatgctgcca

SEQ ID NO: 1146861 - DNA, 23 bp, Homo sapiens
tttctaaccttgaatgctgccag

SEQ ID NO: 1146862 - DNA, 14 bp, Homo sapiens
tttctaactatata

SEQ ID NO: 1146863 - DNA, 15 bp, Homo sapiens
tttctaactctatta

SEQ ID NO: 1146864 - DNA, 15 bp, Homo sapiens
tttctaagaaataga

SEQ ID NO: 1146865 - DNA, 17 bp, Homo sapiens
tttctaagaaatagagc

SEQ ID NO: 1146866 - DNA, 15 bp, Homo sapiens
tttctaagtatttaa

SEQ ID NO: 1146867 - DNA, 19 bp, Homo sapiens
tttctaagtgtaacctcag

SEQ ID NO: 1146868 - DNA, 18 bp, Homo sapiens
tttctaatagagagatta

SEQ ID NO: 1146869 - DNA, 19 bp, Homo sapiens
tttctaatgaggagagaaa

SEQ ID NO: 1146870 - DNA, 18 bp, Homo sapiens
tttctacaaaataacatt

SEQ ID NO: 1146871 - DNA, 18 bp, Homo sapiens
tttctacaatgtgaactt

SEQ ID NO: 1146872 - DNA, 16 bp, Homo sapiens
tttctaccatttcaga

SEQ ID NO: 1146873 - DNA, 15 bp, Homo sapiens
tttctaccctagcca

SEQ ID NO: 1146874 - DNA, 17 bp, Homo sapiens
tttctaccctagccatt

SEQ ID NO: 1146875 - DNA, 17 bp, Homo sapiens
tttctaccttaaaggga

SEQ ID NO: 1146876 - DNA, 16 bp, Homo sapiens
tttctaccttgaggtc

SEQ ID NO: 1146877 - DNA, 23 bp, Homo sapiens
tttctacgtcatgtattttatga

SEQ ID NO: 1146878 - DNA, 16 bp, Homo sapiens
tttctactatatacat

SEQ ID NO: 1146879 - DNA, 18 bp, Homo sapiens
tttctactatatacatat

SEQ ID NO: 1146880 - DNA, 17 bp, Homo sapiens
tttctactctgaactaa

SEQ ID NO: 1146881 - DNA, 19 bp, Homo sapiens
tttctactgtaagaagagc

SEQ ID NO: 1146882 - DNA, 14 bp, Homo sapiens
tttctacttcccct

SEQ ID NO: 1146883 - DNA, 16 bp, Homo sapiens
tttctacttcccctgg

SEQ ID NO: 1146884 - DNA, 13 bp, Homo sapiens
tttctagaaagag

SEQ ID NO: 1146885 - DNA, 18 bp, Homo sapiens
tttctagaacagtaaaag

SEQ ID NO: 1146886 - DNA, 16 bp, Homo sapiens
tttctagactttctgt

SEQ ID NO: 1146887 - DNA, 15 bp, Homo sapiens
tttctagatacaata

SEQ ID NO: 1146888 - DNA, 16 bp, Homo sapiens
tttctagatacaataa

SEQ ID NO: 1146889 - DNA, 18 bp, Homo sapiens
tttctagatacaataaat

SEQ ID NO: 1146890 - DNA, 20 bp, Homo sapiens
tttctagcaattttctttgt

SEQ ID NO: 1146891 - DNA, 22 bp, Homo sapiens
tttctagcaattttctttgttt

SEQ ID NO: 1146892 - DNA, 21 bp, Homo sapiens
tttctagcgaacgtatttctc

SEQ ID NO: 1146893 - DNA, 18 bp, Homo sapiens
tttctagctttttaatta

SEQ ID NO: 1146894 - DNA, 20 bp, Homo sapiens
tttctaggccaaaaatggtg

SEQ ID NO: 1146895 - DNA, 18 bp, Homo sapiens
tttctagggaaatgaaag

SEQ ID NO: 1146896 - DNA, 17 bp, Homo sapiens
tttctaggtaggaaatg

SEQ ID NO: 1146897 - DNA, 19 bp, Homo sapiens
tttctagtgtatactctgt

SEQ ID NO: 1146898 - DNA, 21 bp, Homo sapiens
tttctagtttcagtaaataat

SEQ ID NO: 1146899 - DNA, 13 bp, Homo sapiens
tttctataaatca

SEQ ID NO: 1146900 - DNA, 20 bp, Homo sapiens
tttctataaatcagtatttt

SEQ ID NO: 1146901 - DNA, 19 bp, Homo sapiens
tttctataaatttaagaaa

SEQ ID NO: 1146902 - DNA, 23 bp, Homo sapiens
tttctataaatttaagaaaacaa

SEQ ID NO: 1146903 - DNA, 14 bp, Homo sapiens
tttctataagttgt

SEQ ID NO: 1146904 - DNA, 21 bp, Homo sapiens
tttctatataaaatgtattca

SEQ ID NO: 1146905 - DNA, 18 bp, Homo sapiens
tttctatcagaagttgta

SEQ ID NO: 1146906 - DNA, 22 bp, Homo sapiens
tttctatcatggaatatttata

SEQ ID NO: 1146907 - DNA, 17 bp, Homo sapiens
tttctatcccccttaaa

SEQ ID NO: 1146908 - DNA, 13 bp, Homo sapiens
tttctatgacaaa

SEQ ID NO: 1146909 - DNA, 14 bp, Homo sapiens
tttctatgacaaat

SEQ ID NO: 1146910 - DNA, 23 bp, Homo sapiens
tttctatgcataaaaaaatgatg

SEQ ID NO: 1146911 - DNA, 18 bp, Homo sapiens
tttctatgtaaattattg

SEQ ID NO: 1146912 - DNA, 21 bp, Homo sapiens
tttctattaatatcaactctg

SEQ ID NO: 1146913 - DNA, 13 bp, Homo sapiens
tttctattccaaa

SEQ ID NO: 1146914 - DNA, 22 bp, Homo sapiens
tttctattccttatgggatcat

SEQ ID NO: 1146915 - DNA, 15 bp, Homo sapiens
tttctattttaagac

SEQ ID NO: 1146916 - DNA, 13 bp, Homo sapiens
tttctatttttat

SEQ ID NO: 1146917 - DNA, 22 bp, Homo sapiens
tttctcacaaaaaggcaaatat

SEQ ID NO: 1146918 - DNA, 17 bp, Homo sapiens
tttctcacccaggcaat

SEQ ID NO: 1146919 - DNA, 23 bp, Homo sapiens
tttctcagccgcttctgactgct

SEQ ID NO: 1146920 - DNA, 20 bp, Homo sapiens
tttctcagcctggttcagaa

SEQ ID NO: 1146921 - DNA, 17 bp, Homo sapiens
tttctcagggtcactgt

SEQ ID NO: 1146922 - DNA, 17 bp, Homo sapiens
tttctcagtgatttcct

SEQ ID NO: 1146923 - DNA, 14 bp, Homo sapiens
tttctcattaacaa

SEQ ID NO: 1146924 - DNA, 18 bp, Homo sapiens
tttctcatttctttctaa

SEQ ID NO: 1146925 - DNA, 18 bp, Homo sapiens
tttctccagccagcaatg

SEQ ID NO: 1146926 - DNA, 12 bp, Homo sapiens
tttctccagctg

SEQ ID NO: 1146927 - DNA, 16 bp, Homo sapiens
tttctccatcccctcc

SEQ ID NO: 1146928 - DNA, 14 bp, Homo sapiens
taaagataattgct

SEQ ID NO: 1146929 - DNA, 20 bp, Homo sapiens
taaagatatcagagctctta

SEQ ID NO: 1146930 - DNA, 18 bp, Homo sapiens
taaagatcaagtgggcct

SEQ ID NO: 1146931 - DNA, 11 bp, Homo sapiens
taaagatgatc

SEQ ID NO: 1146932 - DNA, 13 bp, Homo sapiens
taaagatgatcta

SEQ ID NO: 1146933 - DNA, 21 bp, Homo sapiens
taaagatgatctactcagaaa

SEQ ID NO: 1146934 - DNA, 22 bp, Homo sapiens
taaagatgcaaggaccaggact

SEQ ID NO: 1146935 - DNA, 14 bp, Homo sapiens
taaagatgggagga

SEQ ID NO: 1146936 - DNA, 17 bp, Homo sapiens
taaagatggtcgtgtgt

SEQ ID NO: 1146937 - DNA, 16 bp, Homo sapiens
taaagatgttaaatgg

SEQ ID NO: 1146938 - DNA, 17 bp, Homo sapiens
taaagatttctagtagg

SEQ ID NO: 1146939 - DNA, 13 bp, Homo sapiens
taaagatttgggt

SEQ ID NO: 1146940 - DNA, 12 bp, Homo sapiens
taaagatttttt

SEQ ID NO: 1146941 - DNA, 17 bp, Homo sapiens
taaagattttttaataa

SEQ ID NO: 1146942 - DNA, 20 bp, Homo sapiens
taaagattttttaataattt

SEQ ID NO: 1146943 - DNA, 11 bp, Homo sapiens
taaagcaaaat

SEQ ID NO: 1146944 - DNA, 12 bp, Homo sapiens
taaagcaaaata

SEQ ID NO: 1146945 - DNA, 17 bp, Homo sapiens
taaagcaaaatagtatt

SEQ ID NO: 1146946 - DNA, 22 bp, Homo sapiens
taaagcaactgttatgaaataa

SEQ ID NO: 1146947 - DNA, 12 bp, Homo sapiens
taaagcacactt

SEQ ID NO: 1146948 - DNA, 22 bp, Homo sapiens
taaagcacagtctgatgacaca

SEQ ID NO: 1146949 - DNA, 14 bp, Homo sapiens
taaagcactgagca

SEQ ID NO: 1146950 - DNA, 19 bp, Homo sapiens
taaagcactggtttcaaga

SEQ ID NO: 1146951 - DNA, 16 bp, Homo sapiens
taaagcactttgcact

SEQ ID NO: 1146952 - DNA, 15 bp, Homo sapiens
taaagcagaagcccc

SEQ ID NO: 1146953 - DNA, 13 bp, Homo sapiens
taaagcagacagt

SEQ ID NO: 1146954 - DNA, 14 bp, Homo sapiens
taaagcagagccaa

SEQ ID NO: 1146955 - DNA, 17 bp, Homo sapiens
taaagcagagccaaggc

SEQ ID NO: 1146956 - DNA, 20 bp, Homo sapiens
taaagcagagggactttgta

SEQ ID NO: 1146957 - DNA, 17 bp, Homo sapiens
taaagcaggttcttgtt

SEQ ID NO: 1146958 - DNA, 16 bp, Homo sapiens
taaagcagtagacaat

SEQ ID NO: 1146959 - DNA, 13 bp, Homo sapiens
tgaaaactttgta

SEQ ID NO: 1146960 - DNA, 22 bp, Homo sapiens
tgaaaagaaaaatgagcctggc

SEQ ID NO: 1146961 - DNA, 23 bp, Homo sapiens
tgaaaagaggggaccagaagcca

SEQ ID NO: 1146962 - DNA, 18 bp, Homo sapiens
tgaaaagagtatgtagtg

SEQ ID NO: 1146963 - DNA, 14 bp, Homo sapiens
tgaaaagcaatatt

SEQ ID NO: 1146964 - DNA, 16 bp, Homo sapiens
tgaaaagcaatattgt

SEQ ID NO: 1146965 - DNA, 13 bp, Homo sapiens
tgaaaagcacaca

SEQ ID NO: 1146966 - DNA, 13 bp, Homo sapiens
tgaaaagcacaga

SEQ ID NO: 1146967 - DNA, 16 bp, Homo sapiens
tgaaaagcagacattt

SEQ ID NO: 1146968 - DNA, 23 bp, Homo sapiens
tgaaaagcctccgcctgctgtgt

SEQ ID NO: 1146969 - DNA, 17 bp, Homo sapiens
tgaaaagctagaattga

SEQ ID NO: 1146970 - DNA, 19 bp, Homo sapiens
tgaaaagctccatcaatga

SEQ ID NO: 1146971 - DNA, 14 bp, Homo sapiens
tgaaaagctttcct

SEQ ID NO: 1146972 - DNA, 22 bp, Homo sapiens
tgaaaaggatattatctacctg

SEQ ID NO: 1146973 - DNA, 16 bp, Homo sapiens
tgaaaaggcaaaaagc

SEQ ID NO: 1146974 - DNA, 14 bp, Homo sapiens
tgaaaagggcactc

SEQ ID NO: 1146975 - DNA, 19 bp, Homo sapiens
tgaaaaggtttatgaaaaa

SEQ ID NO: 1146976 - DNA, 22 bp, Homo sapiens
tgaaaaggtttatgaaaaagaa

SEQ ID NO: 1146977 - DNA, 21 bp, Homo sapiens
tgaaaagtatattgataacct

SEQ ID NO: 1146978 - DNA, 18 bp, Homo sapiens
tgaaaagtattggttact

SEQ ID NO: 1146979 - DNA, 15 bp, Homo sapiens
tgaaaagttggaagg

SEQ ID NO: 1146980 - DNA, 21 bp, Homo sapiens
tgaaaagttggaaggatctgc

SEQ ID NO: 1146981 - DNA, 16 bp, Homo sapiens
tgaaaataagaataga

SEQ ID NO: 1146982 - DNA, 17 bp, Homo sapiens
tgaaaataatgctgttc

SEQ ID NO: 1146983 - DNA, 23 bp, Homo sapiens
tgaaaatacaacttaaataataa

SEQ ID NO: 1146984 - DNA, 17 bp, Homo sapiens
tgaaaataccataggaa

SEQ ID NO: 1146985 - DNA, 13 bp, Homo sapiens
tgaaaatagtgta

SEQ ID NO: 1146986 - DNA, 22 bp, Homo sapiens
tgaaaatagtgtaagaactgta

SEQ ID NO: 1146987 - DNA, 15 bp, Homo sapiens
tgaaaatatagacat

SEQ ID NO: 1146988 - DNA, 23 bp, Homo sapiens
tgaaaatattgttttacaatagt

SEQ ID NO: 1146989 - DNA, 14 bp, Homo sapiens
tgaaaatatttcta

SEQ ID NO: 1146990 - DNA, 16 bp, Homo sapiens
tgaaaatatttctatg

SEQ ID NO: 1146991 - DNA, 21 bp, Homo sapiens
tgaaaatatttctatgtaaat

SEQ ID NO: 1146992 - DNA, 23 bp, Homo sapiens
tgaaaatattttttatatataca

SEQ ID NO: 1146993 - DNA, 20 bp, Homo sapiens
tgaaaatcatcactcaagat

SEQ ID NO: 1146994 - DNA, 21 bp, Homo sapiens
tgaaaatcatgaaaagaggaa

SEQ ID NO: 1146995 - DNA, 17 bp, Homo sapiens
tgaaaatcctatatctg

SEQ ID NO: 1146996 - DNA, 15 bp, Homo sapiens
tgaaaatctaatatt

SEQ ID NO: 1146997 - DNA, 21 bp, Homo sapiens
tgaaaatgaatatctattaat

SEQ ID NO: 1146998 - DNA, 15 bp, Homo sapiens
tgaaaatgagccctg

SEQ ID NO: 1146999 - DNA, 18 bp, Homo sapiens
tgaaaatgattataagcc

SEQ ID NO: 1147000 - DNA, 19 bp, Homo sapiens
tgaaaatgattcctggaca

SEQ ID NO: 1147001 - DNA, 12 bp, Homo sapiens
tgaaaatgctgg

SEQ ID NO: 1147002 - DNA, 22 bp, Homo sapiens
tgaaaatggtttcaagttattc

SEQ ID NO: 1147003 - DNA, 13 bp, Homo sapiens
tgaaaatggtttt

SEQ ID NO: 1147004 - DNA, 12 bp, Homo sapiens
tgaaaatgtaaa

SEQ ID NO: 1147005 - DNA, 16 bp, Homo sapiens
tgaaaatgtactgaga

SEQ ID NO: 1147006 - DNA, 18 bp, Homo sapiens
tgaaaatgtatttcctga

SEQ ID NO: 1147007 - DNA, 20 bp, Homo sapiens
tgaaaatgtccaggaaagtg

SEQ ID NO: 1147008 - DNA, 20 bp, Homo sapiens
tgaaaatgtgctatactgca

SEQ ID NO: 1147009 - DNA, 22 bp, Homo sapiens
tgaaaatgtttaagtattaact

SEQ ID NO: 1147010 - DNA, 14 bp, Homo sapiens
tgaaaatgttttat

SEQ ID NO: 1147011 - DNA, 19 bp, Homo sapiens
tgaaaattacgttcttaca

SEQ ID NO: 1147012 - DNA, 19 bp, Homo sapiens
tgaaaattatgcaaaagca

SEQ ID NO: 1147013 - DNA, 14 bp, Homo sapiens
tgaaaattatttaa

SEQ ID NO: 1147014 - DNA, 15 bp, Homo sapiens
tgaaaattatttgaa

SEQ ID NO: 1147015 - DNA, 16 bp, Homo sapiens
tgaaaattattttaaa

SEQ ID NO: 1147016 - DNA, 23 bp, Homo sapiens
tgaaaattcaaaaagtgtttatt

SEQ ID NO: 1147017 - DNA, 20 bp, Homo sapiens
tgaaaattccagaaaggata

SEQ ID NO: 1147018 - DNA, 22 bp, Homo sapiens
tgaaaattctaacccaagacat

SEQ ID NO: 1147019 - DNA, 13 bp, Homo sapiens
tgaaaattgtata

SEQ ID NO: 1147020 - DNA, 22 bp, Homo sapiens
tgaaaattgtataccaatgtgt

SEQ ID NO: 1147021 - DNA, 18 bp, Homo sapiens
tgaaaattttacttccat

SEQ ID NO: 1147022 - DNA, 19 bp, Homo sapiens
tgaaaattttgatgtttta

SEQ ID NO: 1147023 - DNA, 23 bp, Homo sapiens
gtggaggagctgagggagggagc

SEQ ID NO: 1147024 - DNA, 20 bp, Homo sapiens
gtggaggaggaggaggagcc

SEQ ID NO: 1147025 - DNA, 17 bp, Homo sapiens
gtggaggaggagggagg

SEQ ID NO: 1147026 - DNA, 18 bp, Homo sapiens
gtggaggaggagggaggc

SEQ ID NO: 1147027 - DNA, 15 bp, Homo sapiens
gtggaggcagccagg

SEQ ID NO: 1147028 - DNA, 11 bp, Homo sapiens
gtggaggcctg

SEQ ID NO: 1147029 - DNA, 12 bp, Homo sapiens
gtggaggcctga

SEQ ID NO: 1147030 - DNA, 15 bp, Homo sapiens
gtggaggcttcctgc

SEQ ID NO: 1147031 - DNA, 23 bp, Homo sapiens
gtggagggaaggataaagccact

SEQ ID NO: 1147032 - DNA, 19 bp, Homo sapiens
gtggagggcacttcaggtc

SEQ ID NO: 1147033 - DNA, 19 bp, Homo sapiens
gtggaggggcgcccagggt

SEQ ID NO: 1147034 - DNA, 12 bp, Homo sapiens
gtggaggggtgt

SEQ ID NO: 1147035 - DNA, 20 bp, Homo sapiens
gtggaggttctgtattttaa

SEQ ID NO: 1147036 - DNA, 15 bp, Homo sapiens
gtggaggttgtgcat

SEQ ID NO: 1147037 - DNA, 13 bp, Homo sapiens
gtggagtctgagt

SEQ ID NO: 1147038 - DNA, 18 bp, Homo sapiens
gtggagtctgagtctgag

SEQ ID NO: 1147039 - DNA, 14 bp, Homo sapiens
gtggagtttctctg

SEQ ID NO: 1147040 - DNA, 15 bp, Homo sapiens
gtggagtttctctgt

SEQ ID NO: 1147041 - DNA, 22 bp, Homo sapiens
gtggagtttgacaccttagaga

SEQ ID NO: 1147042 - DNA, 15 bp, Homo sapiens
gtggagtttgtattt

SEQ ID NO: 1147043 - DNA, 17 bp, Homo sapiens
gtggataaaactgtgta

SEQ ID NO: 1147044 - DNA, 18 bp, Homo sapiens
gtggataaaactgtgtaa

SEQ ID NO: 1147045 - DNA, 20 bp, Homo sapiens
gtggataatcaggaaaaatg

SEQ ID NO: 1147046 - DNA, 15 bp, Homo sapiens
gtggatacagagcca

SEQ ID NO: 1147047 - DNA, 16 bp, Homo sapiens
gtggatacagagccac

SEQ ID NO: 1147048 - DNA, 23 bp, Homo sapiens
gtggatcacaaagtggaacgaaa

SEQ ID NO: 1147049 - DNA, 23 bp, Homo sapiens
gtggatcacacctcagtgggaag

SEQ ID NO: 1147050 - DNA, 13 bp, Homo sapiens
gtggatcacagag

SEQ ID NO: 1147051 - DNA, 14 bp, Homo sapiens
gtggatcacagagg

SEQ ID NO: 1147052 - DNA, 21 bp, Homo sapiens
gtggatcagagatgcaccacc

SEQ ID NO: 1147053 - DNA, 19 bp, Homo sapiens
gtggatctatttcatgttt

SEQ ID NO: 1147054 - DNA, 15 bp, Homo sapiens
gtggatgatgtttcg

SEQ ID NO: 1147055 - DNA, 17 bp, Homo sapiens
gtggatgctccagggca

SEQ ID NO: 1147056 - DNA, 19 bp, Homo sapiens
gtggatgctccagggcagc

SEQ ID NO: 1147057 - DNA, 20 bp, Homo sapiens
gtggatgctccagggcagcc

SEQ ID NO: 1147058 - DNA, 14 bp, Homo sapiens
gtggatgctgagct

SEQ ID NO: 1147059 - DNA, 21 bp, Homo sapiens
gtggatggcccagcaggcagg

SEQ ID NO: 1147060 - DNA, 12 bp, Homo sapiens
gtggatgggcaa

SEQ ID NO: 1147061 - DNA, 16 bp, Homo sapiens
gtggatgtcttccttg

SEQ ID NO: 1147062 - DNA, 16 bp, Homo sapiens
gtggatgttatgaaca

SEQ ID NO: 1147063 - DNA, 23 bp, Homo sapiens
gtggattataaaaaatgtaacat

SEQ ID NO: 1147064 - DNA, 18 bp, Homo sapiens
gtggattccgagtggtga

SEQ ID NO: 1147065 - DNA, 22 bp, Homo sapiens
gtggattgtttaaagaagctct

SEQ ID NO: 1147066 - DNA, 18 bp, Homo sapiens
gtggatttaacagaaatg

SEQ ID NO: 1147067 - DNA, 18 bp, Homo sapiens
gtggatttgattcatttt

SEQ ID NO: 1147068 - DNA, 18 bp, Homo sapiens
gtggattttaaaaaatca

SEQ ID NO: 1147069 - DNA, 12 bp, Homo sapiens
gtggattttcta

SEQ ID NO: 1147070 - DNA, 16 bp, Homo sapiens
gtggattttgtagatg

SEQ ID NO: 1147071 - DNA, 15 bp, Homo sapiens
gtggcaaagtgctgt

SEQ ID NO: 1147072 - DNA, 14 bp, Homo sapiens
gtggcacagctggg

SEQ ID NO: 1147073 - DNA, 15 bp, Homo sapiens
gtggcacagctggga

SEQ ID NO: 1147074 - DNA, 14 bp, Homo sapiens
gtggcacaggcact

SEQ ID NO: 1147075 - DNA, 21 bp, Homo sapiens
gtggcacaggcactgaacagg

SEQ ID NO: 1147076 - DNA, 12 bp, Homo sapiens
gtggcacaggcc

SEQ ID NO: 1147077 - DNA, 19 bp, Homo sapiens
gtggcaccagaggtgcttc

SEQ ID NO: 1147078 - DNA, 14 bp, Homo sapiens
gtggcaccagatgc

SEQ ID NO: 1147079 - DNA, 20 bp, Homo sapiens
gtggcaccagatgcaacctc

SEQ ID NO: 1147080 - DNA, 19 bp, Homo sapiens
gtggcaccagcagcctgga

SEQ ID NO: 1147081 - DNA, 16 bp, Homo sapiens
gtggcacctcttccga

SEQ ID NO: 1147082 - DNA, 16 bp, Homo sapiens
gtggcacgcacctgta

SEQ ID NO: 1147083 - DNA, 23 bp, Homo sapiens
gtggcacgcacctgtagtcccag

SEQ ID NO: 1147084 - DNA, 15 bp, Homo sapiens
gtggcacgggccctc

SEQ ID NO: 1147085 - DNA, 18 bp, Homo sapiens
gtggcacgtattgctgtg

SEQ ID NO: 1147086 - DNA, 14 bp, Homo sapiens
gtggcactgagccc

SEQ ID NO: 1147087 - DNA, 18 bp, Homo sapiens
gtggcactggggaaacat

SEQ ID NO: 1147088 - DNA, 24 bp, Homo sapiens
gtggcagaaaagaggagaccctgg

SEQ ID NO: 1147089 - DNA, 21 bp, Homo sapiens
gtggcagataatcagcctctt

SEQ ID NO: 1147090 - DNA, 13 bp, Homo sapiens
gtggcagccacac

SEQ ID NO: 1147091 - DNA, 14 bp, Homo sapiens
gtggcagccatgcc

SEQ ID NO: 1147092 - DNA, 16 bp, Homo sapiens
gtggcagccatgcctc

SEQ ID NO: 1147093 - DNA, 19 bp, Homo sapiens
gtggcagccatgcctcatg

SEQ ID NO: 1147094 - DNA, 13 bp, Homo sapiens
gtggcagccctgt

SEQ ID NO: 1147095 - DNA, 20 bp, Homo sapiens
gtggcagccgtcccaggcca

SEQ ID NO: 1147096 - DNA, 23 bp, Homo sapiens
gtggcaggcacacagcagccccc

SEQ ID NO: 1147097 - DNA, 18 bp, Homo sapiens
gtggcaggggacaggagt

SEQ ID NO: 1147098 - DNA, 20 bp, Homo sapiens
gtggcaggggacaggagtcc

SEQ ID NO: 1147099 - DNA, 23 bp, Homo sapiens
gtggcagggggccccgccagggc

SEQ ID NO: 1147100 - DNA, 21 bp, Homo sapiens
gtggcaggtcactgtcactgc

SEQ ID NO: 1147101 - DNA, 16 bp, Homo sapiens
gtggcatcccagtggc

SEQ ID NO: 1147102 - DNA, 18 bp, Homo sapiens
gtggcatctttgccttgg

SEQ ID NO: 1147103 - DNA, 16 bp, Homo sapiens
gtggcatgtgctgtga

SEQ ID NO: 1147104 - DNA, 14 bp, Homo sapiens
gtggcatgtggcct

SEQ ID NO: 1147105 - DNA, 22 bp, Homo sapiens
gtggccaaataggagggagact

SEQ ID NO: 1147106 - DNA, 14 bp, Homo sapiens
gtggccaaccagga

SEQ ID NO: 1147107 - DNA, 16 bp, Homo sapiens
gtggccaaccaggacc

SEQ ID NO: 1147108 - DNA, 21 bp, Homo sapiens
gtggccaaccaggacccaggg

SEQ ID NO: 1147109 - DNA, 22 bp, Homo sapiens
gtggccaaccaggacccagggt

SEQ ID NO: 1147110 - DNA, 15 bp, Homo sapiens
gtggccaagaagcag

SEQ ID NO: 1147111 - DNA, 21 bp, Homo sapiens
gtggccaagcctgctgtgtcc

SEQ ID NO: 1147112 - DNA, 15 bp, Homo sapiens
gtggccaaggagctg

SEQ ID NO: 1147113 - DNA, 19 bp, Homo sapiens
gtggccaaggagctgctat

SEQ ID NO: 1147114 - DNA, 14 bp, Homo sapiens
gtggccaagttctt

SEQ ID NO: 1147115 - DNA, 17 bp, Homo sapiens
gtggccacaactgctgt

SEQ ID NO: 1147116 - DNA, 21 bp, Homo sapiens
gtggccacaactgctgtggcc

SEQ ID NO: 1147117 - DNA, 11 bp, Homo sapiens
gtggccacagc

SEQ ID NO: 1147118 - DNA, 16 bp, Homo sapiens
gtggccacagccccct

SEQ ID NO: 1147119 - DNA, 21 bp, Homo sapiens
gtggccacagcgccagcctca

SEQ ID NO: 1147120 - DNA, 14 bp, Homo sapiens
gtggccacagcgtg

SEQ ID NO: 1147121 - DNA, 20 bp, Homo sapiens
gtggccacaggctagatccc

SEQ ID NO: 1147122 - DNA, 13 bp, Homo sapiens
gtggccaccagta

SEQ ID NO: 1147123 - DNA, 19 bp, Homo sapiens
gtggccaccgggggtggct

SEQ ID NO: 1147124 - DNA, 22 bp, Homo sapiens
gtggccacgggggcagtgtgag

SEQ ID NO: 1147125 - DNA, 17 bp, Homo sapiens
ggtggaggggcgcccag

SEQ ID NO: 1147126 - DNA, 15 bp, Homo sapiens
ggtggagttgaaaga

SEQ ID NO: 1147127 - DNA, 23 bp, Homo sapiens
ggtggatcacacctcagtgggaa

SEQ ID NO: 1147128 - DNA, 17 bp, Homo sapiens
ggtggatcacagaggct

SEQ ID NO: 1147129 - DNA, 22 bp, Homo sapiens
ggtggatggccccagcacagct

SEQ ID NO: 1147130 - DNA, 19 bp, Homo sapiens
ggtggattccgagtggtga

SEQ ID NO: 1147131 - DNA, 21 bp, Homo sapiens
ggtggatttggagaccgaaga

SEQ ID NO: 1147132 - DNA, 13 bp, Homo sapiens
ggtggcaagagcc

SEQ ID NO: 1147133 - DNA, 12 bp, Homo sapiens
ggtggcaagtgc

SEQ ID NO: 1147134 - DNA, 14 bp, Homo sapiens
ggtggcacaggcac

SEQ ID NO: 1147135 - DNA, 17 bp, Homo sapiens
ggtggcacaggccccct

SEQ ID NO: 1147136 - DNA, 18 bp, Homo sapiens
ggtggcacaggccccctt

SEQ ID NO: 1147137 - DNA, 20 bp, Homo sapiens
ggtggcaccagatgcaacct

SEQ ID NO: 1147138 - DNA, 21 bp, Homo sapiens
ggtggcaccagatgcaacctc

SEQ ID NO: 1147139 - DNA, 13 bp, Homo sapiens
ggtggcacctcct

SEQ ID NO: 1147140 - DNA, 20 bp, Homo sapiens
ggtggcacgggccctccctc

SEQ ID NO: 1147141 - DNA, 22 bp, Homo sapiens
ggtggcacgggccctccctccc

SEQ ID NO: 1147142 - DNA, 15 bp, Homo sapiens
ggtggcactgagccc

SEQ ID NO: 1147143 - DNA, 18 bp, Homo sapiens
ggtggcagccctgtaggg

SEQ ID NO: 1147144 - DNA, 21 bp, Homo sapiens
ggtggcaggcacacagcagcc

SEQ ID NO: 1147145 - DNA, 23 bp, Homo sapiens
ggtggcaggcacacagcagcccc

SEQ ID NO: 1147146 - DNA, 13 bp, Homo sapiens
ggtggcatcccag

SEQ ID NO: 1147147 - DNA, 19 bp, Homo sapiens
ggtggcatgtgcctatagt

SEQ ID NO: 1147148 - DNA, 12 bp, Homo sapiens
ggtggccacagt

SEQ ID NO: 1147149 - DNA, 21 bp, Homo sapiens
ggtggccactccagacccctg

SEQ ID NO: 1147150 - DNA, 22 bp, Homo sapiens
ggtggccacttcattccagcag

SEQ ID NO: 1147151 - DNA, 12 bp, Homo sapiens
ggtggccagggc

SEQ ID NO: 1147152 - DNA, 13 bp, Homo sapiens
ggtggccagggct

SEQ ID NO: 1147153 - DNA, 14 bp, Homo sapiens
ggtggccagggctt

SEQ ID NO: 1147154 - DNA, 18 bp, Homo sapiens
ggtggccatccctgggcc

SEQ ID NO: 1147155 - DNA, 22 bp, Homo sapiens
ggtggccatccctgggcccctc

SEQ ID NO: 1147156 - DNA, 20 bp, Homo sapiens
ggtggccatgcctcagccct

SEQ ID NO: 1147157 - DNA, 16 bp, Homo sapiens
ggtggcccaggccccc

SEQ ID NO: 1147158 - DNA, 23 bp, Homo sapiens
ggtggcccctgctgtctctctgg

SEQ ID NO: 1147159 - DNA, 19 bp, Homo sapiens
ggtggcccgacagcctggc

SEQ ID NO: 1147160 - DNA, 21 bp, Homo sapiens
ggtggccctgactgtcaggga

SEQ ID NO: 1147161 - DNA, 23 bp, Homo sapiens
ggtggccctgactgtcagggagg

SEQ ID NO: 1147162 - DNA, 16 bp, Homo sapiens
ggtggccctgtgcctg

SEQ ID NO: 1147163 - DNA, 23 bp, Homo sapiens
ggtggccgcccacccgcccgagg

SEQ ID NO: 1147164 - DNA, 17 bp, Homo sapiens
ggtggccgctcctccct

SEQ ID NO: 1147165 - DNA, 16 bp, Homo sapiens
ggtggccgtcacgctt

SEQ ID NO: 1147166 - DNA, 11 bp, Homo sapiens
ggtggcctcag

SEQ ID NO: 1147167 - DNA, 19 bp, Homo sapiens
ggtggcctcctggcccgcc

SEQ ID NO: 1147168 - DNA, 17 bp, Homo sapiens
ggtggcctctgcctggg

SEQ ID NO: 1147169 - DNA, 14 bp, Homo sapiens
ggtggcctggccct

SEQ ID NO: 1147170 - DNA, 18 bp, Homo sapiens
ggtggcctggccctcctg

SEQ ID NO: 1147171 - DNA, 19 bp, Homo sapiens
ggtggcctggccctcctgg

SEQ ID NO: 1147172 - DNA, 21 bp, Homo sapiens
ggtggcctggccctcctggct

SEQ ID NO: 1147173 - DNA, 19 bp, Homo sapiens
ggtggcgggcacctatagt

SEQ ID NO: 1147174 - DNA, 20 bp, Homo sapiens
ggtggcgtgagcctgtagtc

SEQ ID NO: 1147175 - DNA, 16 bp, Homo sapiens
ggtggctagtcagaga

SEQ ID NO: 1147176 - DNA, 14 bp, Homo sapiens
ggtggctcactact

SEQ ID NO: 1147177 - DNA, 19 bp, Homo sapiens
ggtggctccccctctgctt

SEQ ID NO: 1147178 - DNA, 12 bp, Homo sapiens
ggtggctctggg

SEQ ID NO: 1147179 - DNA, 18 bp, Homo sapiens
ggtggctgacccagtccc

SEQ ID NO: 1147180 - DNA, 18 bp, Homo sapiens
ggtggctgccccggcctc

SEQ ID NO: 1147181 - DNA, 12 bp, Homo sapiens
ggtggctgcctt

SEQ ID NO: 1147182 - DNA, 20 bp, Homo sapiens
ggtggctgcgcccccagctt

SEQ ID NO: 1147183 - DNA, 15 bp, Homo sapiens
ggtggctgtgtctct

SEQ ID NO: 1147184 - DNA, 16 bp, Homo sapiens
ggtggctgtgtctctc

SEQ ID NO: 1147185 - DNA, 22 bp, Homo sapiens
ggtggctgtttcttgtctgtta

SEQ ID NO: 1147186 - DNA, 18 bp, Homo sapiens
ggtggcttaagtgagcag

SEQ ID NO: 1147187 - DNA, 23 bp, Homo sapiens
ggtggcttaagtgagcagaacag

SEQ ID NO: 1147188 - DNA, 16 bp, Homo sapiens
ggtggcttgagctaga

SEQ ID NO: 1147189 - DNA, 19 bp, Homo sapiens
ggtggctttcaaggctggg

SEQ ID NO: 1147190 - DNA, 23 bp, Homo sapiens
ggtggctttcaaggctggggcat

SEQ ID NO: 1147191 - DNA, 12 bp, Homo sapiens
ggtgggaaggaa

SEQ ID NO: 1147192 - DNA, 20 bp, Homo sapiens
ggtgggagacgaacggaagg

SEQ ID NO: 1147193 - DNA, 13 bp, Homo sapiens
ggtgggagagcca

SEQ ID NO: 1147194 - DNA, 22 bp, Homo sapiens
ggtgggagccgggaccctcagg

SEQ ID NO: 1147195 - DNA, 20 bp, Homo sapiens
ggtgggaggatctcttgagc

SEQ ID NO: 1147196 - DNA, 15 bp, Homo sapiens
ggtgggaggccaggc

SEQ ID NO: 1147197 - DNA, 16 bp, Homo sapiens
ggtgggagggcgtcag

SEQ ID NO: 1147198 - DNA, 17 bp, Homo sapiens
ggtgggatttgtaaagc

SEQ ID NO: 1147199 - DNA, 22 bp, Homo sapiens
ggtgggattttttcccttttta

SEQ ID NO: 1147200 - DNA, 17 bp, Homo sapiens
ggtgggcacccaccctg

SEQ ID NO: 1147201 - DNA, 20 bp, Homo sapiens
ggtgggcagatcacgaggtc

SEQ ID NO: 1147202 - DNA, 16 bp, Homo sapiens
ggtgggcaggtggtgg

SEQ ID NO: 1147203 - DNA, 16 bp, Homo sapiens
ggtgggccagagctga

SEQ ID NO: 1147204 - DNA, 14 bp, Homo sapiens
ggtgggcccagaac

SEQ ID NO: 1147205 - DNA, 21 bp, Homo sapiens
ggtgggcccagaccactgtct

SEQ ID NO: 1147206 - DNA, 17 bp, Homo sapiens
ggtgggcccaggaccag

SEQ ID NO: 1147207 - DNA, 20 bp, Homo sapiens
ggtgggcccaggaccagctg

SEQ ID NO: 1147208 - DNA, 16 bp, Homo sapiens
ggtgggcctgactgtt

SEQ ID NO: 1147209 - DNA, 19 bp, Homo sapiens
ggtgggcctggcctgagct

SEQ ID NO: 1147210 - DNA, 13 bp, Homo sapiens
ggtgggcctggga

SEQ ID NO: 1147211 - DNA, 17 bp, Homo sapiens
ggtgggcggacaaaagg

SEQ ID NO: 1147212 - DNA, 20 bp, Homo sapiens
ggtgggcggatcacaaggtc

SEQ ID NO: 1147213 - DNA, 16 bp, Homo sapiens
ggtgggctctgtgcag

SEQ ID NO: 1147214 - DNA, 18 bp, Homo sapiens
ggtgggctgagccctggc

SEQ ID NO: 1147215 - DNA, 16 bp, Homo sapiens
ggtgggctggcccagc

SEQ ID NO: 1147216 - DNA, 14 bp, Homo sapiens
ggtgggctggggac

SEQ ID NO: 1147217 - DNA, 16 bp, Homo sapiens
ggtgggctggtatctc

SEQ ID NO: 1147218 - DNA, 11 bp, Homo sapiens
ggtggggaggc

SEQ ID NO: 1147219 - DNA, 19 bp, Homo sapiens
ggtggggaggcccaaatga

SEQ ID NO: 1147220 - DNA, 12 bp, Homo sapiens
ggtggggagggg

SEQ ID NO: 1147221 - DNA, 13 bp, Homo sapiens
ggtggggaggggc

SEQ ID NO: 1147222 - DNA, 12 bp, Homo sapiens
ggtggggagggt

SEQ ID NO: 1147223 - DNA, 14 bp, Homo sapiens
ggtggggatcctgc

SEQ ID NO: 1147224 - DNA, 21 bp, Homo sapiens
ggtggggcagcacacctctgg

SEQ ID NO: 1147225 - DNA, 16 bp, Homo sapiens
ggtggggcctcagcct

SEQ ID NO: 1147226 - DNA, 13 bp, Homo sapiens
ggtggggctgctc

SEQ ID NO: 1147227 - DNA, 12 bp, Homo sapiens
ggtgggggccag

SEQ ID NO: 1147228 - DNA, 21 bp, Homo sapiens
ggtgggggctgtggccctgcc

SEQ ID NO: 1147229 - DNA, 17 bp, Homo sapiens
ggtgggggttctggcag

SEQ ID NO: 1147230 - DNA, 19 bp, Homo sapiens
ggtggggtcatgccctcct

SEQ ID NO: 1147231 - DNA, 14 bp, Homo sapiens
ggtggggtcctgga

SEQ ID NO: 1147232 - DNA, 14 bp, Homo sapiens
ggtggggtctggga

SEQ ID NO: 1147233 - DNA, 14 bp, Homo sapiens
ggtgggtaggagcc

SEQ ID NO: 1147234 - DNA, 21 bp, Homo sapiens
ggtgggtaggagcccttctct

SEQ ID NO: 1147235 - DNA, 16 bp, Homo sapiens
gagcctgtgaccttgg

SEQ ID NO: 1147236 - DNA, 13 bp, Homo sapiens
gagcctgtgcctt

SEQ ID NO: 1147237 - DNA, 18 bp, Homo sapiens
gagcctgtgccttcctcc

SEQ ID NO: 1147238 - DNA, 18 bp, Homo sapiens
gagcctgtgttagtgtct

SEQ ID NO: 1147239 - DNA, 23 bp, Homo sapiens
gagccttagaggtctttaatcat

SEQ ID NO: 1147240 - DNA, 22 bp, Homo sapiens
gagccttcagaatgctcctgag

SEQ ID NO: 1147241 - DNA, 13 bp, Homo sapiens
gagccttcagcct

SEQ ID NO: 1147242 - DNA, 13 bp, Homo sapiens
gagccttctcaga

SEQ ID NO: 1147243 - DNA, 17 bp, Homo sapiens
gagccttctcagaagca

SEQ ID NO: 1147244 - DNA, 21 bp, Homo sapiens
gagccttgcagatatctgcat

SEQ ID NO: 1147245 - DNA, 15 bp, Homo sapiens
gagccttgcatgtac

SEQ ID NO: 1147246 - DNA, 18 bp, Homo sapiens
gagccttgctgggccagg

SEQ ID NO: 1147247 - DNA, 19 bp, Homo sapiens
gagccttggtgtccacctg

SEQ ID NO: 1147248 - DNA, 20 bp, Homo sapiens
gagccttgtgagatccttca

SEQ ID NO: 1147249 - DNA, 18 bp, Homo sapiens
gagccttttatctgcaga

SEQ ID NO: 1147250 - DNA, 13 bp, Homo sapiens
gagcgaaactccg

SEQ ID NO: 1147251 - DNA, 14 bp, Homo sapiens
gagcgacggctcct

SEQ ID NO: 1147252 - DNA, 16 bp, Homo sapiens
gagcgacggctcctcc

SEQ ID NO: 1147253 - DNA, 23 bp, Homo sapiens
gagcgacgtttatttcatctctt

SEQ ID NO: 1147254 - DNA, 19 bp, Homo sapiens
gagcgagagatcaaagatg

SEQ ID NO: 1147255 - DNA, 18 bp, Homo sapiens
gagcgaggagatgctcct

SEQ ID NO: 1147256 - DNA, 21 bp, Homo sapiens
gagcgaggagatgctccttgg

SEQ ID NO: 1147257 - DNA, 21 bp, Homo sapiens
gagcgatcatttatttcatga

SEQ ID NO: 1147258 - DNA, 13 bp, Homo sapiens
gagcgcaggcagc

SEQ ID NO: 1147259 - DNA, 15 bp, Homo sapiens
gagcgcaggcagcgc

SEQ ID NO: 1147260 - DNA, 16 bp, Homo sapiens
gagcgcatcaggcctg

SEQ ID NO: 1147261 - DNA, 15 bp, Homo sapiens
gagcgcatggcaagt

SEQ ID NO: 1147262 - DNA, 14 bp, Homo sapiens
gagcgccaggaagc

SEQ ID NO: 1147263 - DNA, 16 bp, Homo sapiens
gagcgccaggaagcca

SEQ ID NO: 1147264 - DNA, 17 bp, Homo sapiens
gagcgccaggaagccag

SEQ ID NO: 1147265 - DNA, 18 bp, Homo sapiens
gagcgccaggaagccaga

SEQ ID NO: 1147266 - DNA, 19 bp, Homo sapiens
gagcgccaggaagccagag

SEQ ID NO: 1147267 - DNA, 17 bp, Homo sapiens
gagcgcccccgagccct

SEQ ID NO: 1147268 - DNA, 20 bp, Homo sapiens
gagcgcccgccgtctgctcc

SEQ ID NO: 1147269 - DNA, 17 bp, Homo sapiens
gagcgcccgcgcccgcg

SEQ ID NO: 1147270 - DNA, 19 bp, Homo sapiens
gagcgcctccatccaaggc

SEQ ID NO: 1147271 - DNA, 15 bp, Homo sapiens
gagcgcctcttcctc

SEQ ID NO: 1147272 - DNA, 17 bp, Homo sapiens
gagcgcctcttcctctg

SEQ ID NO: 1147273 - DNA, 23 bp, Homo sapiens
gagcgcctcttcctctgggcagc

SEQ ID NO: 1147274 - DNA, 15 bp, Homo sapiens
gagcgcttgggcgcc

SEQ ID NO: 1147275 - DNA, 13 bp, Homo sapiens
gagcggagcccga

SEQ ID NO: 1147276 - DNA, 17 bp, Homo sapiens
gagcggaggaggaagtc

SEQ ID NO: 1147277 - DNA, 13 bp, Homo sapiens
gagcggaggttgc

SEQ ID NO: 1147278 - DNA, 18 bp, Homo sapiens
gagcggatgggcacacac

SEQ ID NO: 1147279 - DNA, 13 bp, Homo sapiens
gagcgggaggcag

SEQ ID NO: 1147280 - DNA, 14 bp, Homo sapiens
gagcgggaggcaga

SEQ ID NO: 1147281 - DNA, 16 bp, Homo sapiens
gagcgggaggcagagt

SEQ ID NO: 1147282 - DNA, 20 bp, Homo sapiens
gagcgggagggagtctcagg

SEQ ID NO: 1147283 - DNA, 15 bp, Homo sapiens
gagcgggcagggccg

SEQ ID NO: 1147284 - DNA, 16 bp, Homo sapiens
gagcggggtatgaaga

SEQ ID NO: 1147285 - DNA, 18 bp, Homo sapiens
gagcggggtcccctctgt

SEQ ID NO: 1147286 - DNA, 19 bp, Homo sapiens
gagcggtgctgtcctcagg

SEQ ID NO: 1147287 - DNA, 13 bp, Homo sapiens
gagcggtggggga

SEQ ID NO: 1147288 - DNA, 15 bp, Homo sapiens
gagcgtggccttggg

SEQ ID NO: 1147289 - DNA, 21 bp, Homo sapiens
gagcgtggccttgggaggaca

SEQ ID NO: 1147290 - DNA, 18 bp, Homo sapiens
gagctaaactccttcctg

SEQ ID NO: 1147291 - DNA, 19 bp, Homo sapiens
gagctaaattacaattgtc

SEQ ID NO: 1147292 - DNA, 19 bp, Homo sapiens
gagctaaccccaagctgcc

SEQ ID NO: 1147293 - DNA, 23 bp, Homo sapiens
gagctaagggtgggtgctcagaa

SEQ ID NO: 1147294 - DNA, 15 bp, Homo sapiens
gagctactctcttgc

SEQ ID NO: 1147295 - DNA, 20 bp, Homo sapiens
gagctactctcttgccagca

SEQ ID NO: 1147296 - DNA, 19 bp, Homo sapiens
gagctagcctccagctttg

SEQ ID NO: 1147297 - DNA, 14 bp, Homo sapiens
gagctagcgctgcc

SEQ ID NO: 1147298 - DNA, 19 bp, Homo sapiens
gagctagcgctgccgcacc

SEQ ID NO: 1147299 - DNA, 20 bp, Homo sapiens
gagctagctagcgcaccgcc

SEQ ID NO: 1147300 - DNA, 14 bp, Homo sapiens
gagctagctgccac

SEQ ID NO: 1147301 - DNA, 15 bp, Homo sapiens
gagctagctgccact

SEQ ID NO: 1147302 - DNA, 19 bp, Homo sapiens
gagctatggcccagaaaca

SEQ ID NO: 1147303 - DNA, 16 bp, Homo sapiens
gagctattcacctcag

SEQ ID NO: 1147304 - DNA, 13 bp, Homo sapiens
gagctattgctgt

SEQ ID NO: 1147305 - DNA, 14 bp, Homo sapiens
gagctattttcctc

SEQ ID NO: 1147306 - DNA, 16 bp, Homo sapiens
gagctcaaggccacct

SEQ ID NO: 1147307 - DNA, 22 bp, Homo sapiens
gagctcacactccagtggcaga

SEQ ID NO: 1147308 - DNA, 19 bp, Homo sapiens
gagctcacatgggactggg

SEQ ID NO: 1147309 - DNA, 22 bp, Homo sapiens
gagctcaccctgcccgctccca

SEQ ID NO: 1147310 - DNA, 16 bp, Homo sapiens
gagctcactcggcacc

SEQ ID NO: 1147311 - DNA, 14 bp, Homo sapiens
gagctcagaccccc

SEQ ID NO: 1147312 - DNA, 18 bp, Homo sapiens
gagctcagacccccactc

SEQ ID NO: 1147313 - DNA, 22 bp, Homo sapiens
gagctcatcccccctgctgccc

SEQ ID NO: 1147314 - DNA, 12 bp, Homo sapiens
gagctcattctg

SEQ ID NO: 1147315 - DNA, 11 bp, Homo sapiens
gagctccacct

SEQ ID NO: 1147316 - DNA, 22 bp, Homo sapiens
gagctccactctgcttctctga

SEQ ID NO: 1147317 - DNA, 15 bp, Homo sapiens
gagctccagaccccc

SEQ ID NO: 1147318 - DNA, 22 bp, Homo sapiens
gagctccagacccccagcaacc

SEQ ID NO: 1147319 - DNA, 13 bp, Homo sapiens
gagctcccacctc

SEQ ID NO: 1147320 - DNA, 21 bp, Homo sapiens
gagctcccacctcccttccca

SEQ ID NO: 1147321 - DNA, 14 bp, Homo sapiens
gagctccccagatc

SEQ ID NO: 1147322 - DNA, 19 bp, Homo sapiens
gagctccccagatctccca

SEQ ID NO: 1147323 - DNA, 22 bp, Homo sapiens
gagctcccctccacagctgcag

SEQ ID NO: 1147324 - DNA, 16 bp, Homo sapiens
gagctcccctgtttgc

SEQ ID NO: 1147325 - DNA, 15 bp, Homo sapiens
gagctcctctgggca

SEQ ID NO: 1147326 - DNA, 22 bp, Homo sapiens
gagctcctctgggcaggacctc

SEQ ID NO: 1147327 - DNA, 11 bp, Homo sapiens
gagctcctggc

SEQ ID NO: 1147328 - DNA, 22 bp, Homo sapiens
gagctcctggggagctcctggg

SEQ ID NO: 1147329 - DNA, 14 bp, Homo sapiens
gagctcgcagcccc

SEQ ID NO: 1147330 - DNA, 15 bp, Homo sapiens
gagctcgcccctccc

SEQ ID NO: 1147331 - DNA, 17 bp, Homo sapiens
gagctcgcccctcccct

SEQ ID NO: 1147332 - DNA, 16 bp, Homo sapiens
gagctcgtgtatcctg

SEQ ID NO: 1147333 - DNA, 20 bp, Homo sapiens
gagctcgtgtatcctggggc

SEQ ID NO: 1147334 - DNA, 21 bp, Homo sapiens
gagctcgtgtatcctggggct

SEQ ID NO: 1147335 - DNA, 23 bp, Homo sapiens
gagctcgtgtatcctggggctcc

SEQ ID NO: 1147336 - DNA, 15 bp, Homo sapiens
gagctctatccccat

SEQ ID NO: 1147337 - DNA, 21 bp, Homo sapiens
gagctctcaaatccctctcca

SEQ ID NO: 1147338 - DNA, 14 bp, Homo sapiens
gagctctccaggcc

SEQ ID NO: 1147339 - DNA, 16 bp, Homo sapiens
gagctctccaggccag

SEQ ID NO: 1147340 - DNA, 18 bp, Homo sapiens
gagctctccaggccaggt

SEQ ID NO: 1147341 - DNA, 15 bp, Homo sapiens
gagctctcccccttg

SEQ ID NO: 1147342 - DNA, 20 bp, Homo sapiens
gagctctcccctcctgctgg

SEQ ID NO: 1147343 - DNA, 21 bp, Homo sapiens
gagctctcccctcctgctggg

SEQ ID NO: 1147344 - DNA, 13 bp, Homo sapiens
gccgcctgccctg

SEQ ID NO: 1147345 - DNA, 19 bp, Homo sapiens
gccgcctgccctgccttgc

SEQ ID NO: 1147346 - DNA, 19 bp, Homo sapiens
gccgcctgcgggctgcccc

SEQ ID NO: 1147347 - DNA, 15 bp, Homo sapiens
gccgccttaagctga

SEQ ID NO: 1147348 - DNA, 15 bp, Homo sapiens
gccgcgcctggctta

SEQ ID NO: 1147349 - DNA, 13 bp, Homo sapiens
gccgcggcccaga

SEQ ID NO: 1147350 - DNA, 14 bp, Homo sapiens
gccgcggcccagac

SEQ ID NO: 1147351 - DNA, 17 bp, Homo sapiens
gccgttttcctcatcct

SEQ ID NO: 1147352 - DNA, 18 bp, Homo sapiens
gcctaaaaattcccttcc

SEQ ID NO: 1147353 - DNA, 16 bp, Homo sapiens
gcctaaaagtaaacat

SEQ ID NO: 1147354 - DNA, 20 bp, Homo sapiens
gcctaaaattgtatgaaaat

SEQ ID NO: 1147355 - DNA, 15 bp, Homo sapiens
gcctaaacctcagtt

SEQ ID NO: 1147356 - DNA, 15 bp, Homo sapiens
gcctaaatttcttct

SEQ ID NO: 1147357 - DNA, 19 bp, Homo sapiens
gcctaagacatgtgaggag

SEQ ID NO: 1147358 - DNA, 23 bp, Homo sapiens
gcctaaggaagccagtcaccttc

SEQ ID NO: 1147359 - DNA, 16 bp, Homo sapiens
gcctaatccctgggca

SEQ ID NO: 1147360 - DNA, 22 bp, Homo sapiens
gcctaatgagagtgcactgctc

SEQ ID NO: 1147361 - DNA, 19 bp, Homo sapiens
gcctaatggctttcacttt

SEQ ID NO: 1147362 - DNA, 15 bp, Homo sapiens
gcctaattcctggca

SEQ ID NO: 1147363 - DNA, 17 bp, Homo sapiens
gcctaattcctggcatg

SEQ ID NO: 1147364 - DNA, 13 bp, Homo sapiens
gcctacaataaaa

SEQ ID NO: 1147365 - DNA, 20 bp, Homo sapiens
gcctacagaacttcagaaag

SEQ ID NO: 1147366 - DNA, 21 bp, Homo sapiens
gcctacagaacttcagaaaga

SEQ ID NO: 1147367 - DNA, 15 bp, Homo sapiens
gcctacagaggaggc

SEQ ID NO: 1147368 - DNA, 12 bp, Homo sapiens
gcctacagccag

SEQ ID NO: 1147369 - DNA, 15 bp, Homo sapiens
gcctacattctttat

SEQ ID NO: 1147370 - DNA, 20 bp, Homo sapiens
gcctacattttagtttctaa

SEQ ID NO: 1147371 - DNA, 21 bp, Homo sapiens
gcctaccgtatttcagccatg

SEQ ID NO: 1147372 - DNA, 21 bp, Homo sapiens
gcctacctcaagttcttggac

SEQ ID NO: 1147373 - DNA, 16 bp, Homo sapiens
gcctacctcagcctcc

SEQ ID NO: 1147374 - DNA, 14 bp, Homo sapiens
gcctacctgtatgt

SEQ ID NO: 1147375 - DNA, 16 bp, Homo sapiens
gcctaccttcaccacc

SEQ ID NO: 1147376 - DNA, 18 bp, Homo sapiens
gcctaccttcaccaccta

SEQ ID NO: 1147377 - DNA, 19 bp, Homo sapiens
gcctactgttactctaaat

SEQ ID NO: 1147378 - DNA, 17 bp, Homo sapiens
gcctagaaaatgcaaaa

SEQ ID NO: 1147379 - DNA, 18 bp, Homo sapiens
gcctagaacatccctggg

SEQ ID NO: 1147380 - DNA, 17 bp, Homo sapiens
gcctagaagctggtggc

SEQ ID NO: 1147381 - DNA, 14 bp, Homo sapiens
gcctagaccagcag

SEQ ID NO: 1147382 - DNA, 22 bp, Homo sapiens
gcctagaccagcagacagagcc

SEQ ID NO: 1147383 - DNA, 18 bp, Homo sapiens
gcctagacttcccaacag

SEQ ID NO: 1147384 - DNA, 21 bp, Homo sapiens
gcctagacttcccaacagcct

SEQ ID NO: 1147385 - DNA, 14 bp, Homo sapiens
gcctagagtgtagc

SEQ ID NO: 1147386 - DNA, 16 bp, Homo sapiens
gcctagagtgtagcct

SEQ ID NO: 1147387 - DNA, 23 bp, Homo sapiens
gcctagatccacacacagaggaa

SEQ ID NO: 1147388 - DNA, 21 bp, Homo sapiens
gcctagatccacgtgtggcct

SEQ ID NO: 1147389 - DNA, 23 bp, Homo sapiens
gcctagatccacgtgtggcctcc

SEQ ID NO: 1147390 - DNA, 20 bp, Homo sapiens
gcctagattaggtagacttt

SEQ ID NO: 1147391 - DNA, 14 bp, Homo sapiens
gcctagcacagcag

SEQ ID NO: 1147392 - DNA, 19 bp, Homo sapiens
gcctagcatacgtacacat

SEQ ID NO: 1147393 - DNA, 21 bp, Homo sapiens
gcctagcatacgtacacattt

SEQ ID NO: 1147394 - DNA, 22 bp, Homo sapiens
gcctagcatacgtacacatttt

SEQ ID NO: 1147395 - DNA, 23 bp, Homo sapiens
gcctagcatacgtacacatttta

SEQ ID NO: 1147396 - DNA, 20 bp, Homo sapiens
gcctagcatggggtcagccc

SEQ ID NO: 1147397 - DNA, 13 bp, Homo sapiens
gcctagccctccc

SEQ ID NO: 1147398 - DNA, 18 bp, Homo sapiens
gcctagccgacctcagcc

SEQ ID NO: 1147399 - DNA, 14 bp, Homo sapiens
gcctagcctggctc

SEQ ID NO: 1147400 - DNA, 17 bp, Homo sapiens
gcctagcctggctctgc

SEQ ID NO: 1147401 - DNA, 20 bp, Homo sapiens
gcctagcgatctctcctggc

SEQ ID NO: 1147402 - DNA, 22 bp, Homo sapiens
gcctagcgatctctcctggcct

SEQ ID NO: 1147403 - DNA, 19 bp, Homo sapiens
gcctagcggagcccagcct

SEQ ID NO: 1147404 - DNA, 20 bp, Homo sapiens
gcctagcggagcccagcctg

SEQ ID NO: 1147405 - DNA, 21 bp, Homo sapiens
gcctagcggagcccagcctgg

SEQ ID NO: 1147406 - DNA, 13 bp, Homo sapiens
gcctagctgctgt

SEQ ID NO: 1147407 - DNA, 15 bp, Homo sapiens
gcctaggaccactca

SEQ ID NO: 1147408 - DNA, 18 bp, Homo sapiens
gcctaggaccactcagcc

SEQ ID NO: 1147409 - DNA, 22 bp, Homo sapiens
gcctaggaccactcagccccta

SEQ ID NO: 1147410 - DNA, 11 bp, Homo sapiens
gcctaggagat

SEQ ID NO: 1147411 - DNA, 18 bp, Homo sapiens
gcctaggagatatctgag

SEQ ID NO: 1147412 - DNA, 20 bp, Homo sapiens
gcctaggagatatctgaggg

SEQ ID NO: 1147413 - DNA, 19 bp, Homo sapiens
gcctaggccaaatgcacaa

SEQ ID NO: 1147414 - DNA, 16 bp, Homo sapiens
gcctaggcctcagcca

SEQ ID NO: 1147415 - DNA, 12 bp, Homo sapiens
gcctagggagcc

SEQ ID NO: 1147416 - DNA, 17 bp, Homo sapiens
gcctagggcagacaata

SEQ ID NO: 1147417 - DNA, 20 bp, Homo sapiens
gcctagggtcttgggggtca

SEQ ID NO: 1147418 - DNA, 21 bp, Homo sapiens
gcctaggtcacgttggccctc

SEQ ID NO: 1147419 - DNA, 15 bp, Homo sapiens
gcctaggtcccttcc

SEQ ID NO: 1147420 - DNA, 17 bp, Homo sapiens
gcctaggtgcagctcct

SEQ ID NO: 1147421 - DNA, 15 bp, Homo sapiens
gcctaggtggaggca

SEQ ID NO: 1147422 - DNA, 22 bp, Homo sapiens
gcctagtgaaggcttctctctg

SEQ ID NO: 1147423 - DNA, 23 bp, Homo sapiens
gcctagtgaaggcttctctctgt

SEQ ID NO: 1147424 - DNA, 15 bp, Homo sapiens
gcctagtgggagtta

SEQ ID NO: 1147425 - DNA, 17 bp, Homo sapiens
gcctagttcatccaatc

SEQ ID NO: 1147426 - DNA, 16 bp, Homo sapiens
gcctagtttactgttt

SEQ ID NO: 1147427 - DNA, 13 bp, Homo sapiens
gcctatagtccca

SEQ ID NO: 1147428 - DNA, 18 bp, Homo sapiens
gcctatccgctgccagcc

SEQ ID NO: 1147429 - DNA, 14 bp, Homo sapiens
gcctatctttaaac

SEQ ID NO: 1147430 - DNA, 16 bp, Homo sapiens
gcctatgagcatcctg

SEQ ID NO: 1147431 - DNA, 21 bp, Homo sapiens
gcctatgagcatcctgagccc

SEQ ID NO: 1147432 - DNA, 18 bp, Homo sapiens
gcctatgatcccagcact

SEQ ID NO: 1147433 - DNA, 20 bp, Homo sapiens
gcctatgcagacatctctgg

SEQ ID NO: 1147434 - DNA, 22 bp, Homo sapiens
gcctatgcagacatctctggag

SEQ ID NO: 1147435 - DNA, 19 bp, Homo sapiens
gcctatgccctgcccttcc

SEQ ID NO: 1147436 - DNA, 21 bp, Homo sapiens
gcctatgccctgcccttcctc

SEQ ID NO: 1147437 - DNA, 18 bp, Homo sapiens
gcctatgtggtctaaggt

SEQ ID NO: 1147438 - DNA, 11 bp, Homo sapiens
gcctatttcat

SEQ ID NO: 1147439 - DNA, 17 bp, Homo sapiens
gcctattttggtgaggt

SEQ ID NO: 1147440 - DNA, 16 bp, Homo sapiens
gcctcaaaacagaagc

SEQ ID NO: 1147441 - DNA, 20 bp, Homo sapiens
gcctcaaaacgggtcagtat

SEQ ID NO: 1147442 - DNA, 18 bp, Homo sapiens
gcctcaaagcaacccgct

SEQ ID NO: 1147443 - DNA, 15 bp, Homo sapiens
gcctcaaaggcccgc

SEQ ID NO: 1147444 - DNA, 18 bp, Homo sapiens
gcctcaaccctccctcag

SEQ ID NO: 1147445 - DNA, 23 bp, Homo sapiens
gcctcaaccctccctcagcccct

SEQ ID NO: 1147446 - DNA, 19 bp, Homo sapiens
gcctcaagaaaggcccgga

SEQ ID NO: 1147447 - DNA, 22 bp, Homo sapiens
gcctcaagaaaggcccggaagc

SEQ ID NO: 1147448 - DNA, 20 bp, Homo sapiens
gcctcaagcaatccacctgc

SEQ ID NO: 1147449 - DNA, 14 bp, Homo sapiens
gcctcaatgccagt

SEQ ID NO: 1147450 - DNA, 21 bp, Homo sapiens
gcctcaatgtgaatcagaccc

SEQ ID NO: 1147451 - DNA, 21 bp, Homo sapiens
gcctcaatgtggttgcaaggc

SEQ ID NO: 1147452 - DNA, 22 bp, Homo sapiens
gcctcaatttctgaacaccata

SEQ ID NO: 1147453 - DNA, 23 bp, Homo sapiens
gcctcaccaggcccacgaggagc

SEQ ID NO: 1147454 - DNA, 22 bp, Homo sapiens
gcctcacctgcccctctgttct

SEQ ID NO: 1147455 - DNA, 15 bp, Homo sapiens
gcctcacgcccccag

SEQ ID NO: 1147456 - DNA, 18 bp, Homo sapiens
gcctcacgcccccaggaa

SEQ ID NO: 1147457 - DNA, 23 bp, Homo sapiens
gcctcacggggttggctgttcca

SEQ ID NO: 1147458 - DNA, 20 bp, Homo sapiens
gcctcactggctcatgcccc

SEQ ID NO: 1147459 - DNA, 13 bp, Homo sapiens
gcctcactggctg

SEQ ID NO: 1147460 - DNA, 16 bp, Homo sapiens
gcctcactggctgggg

SEQ ID NO: 1147461 - DNA, 20 bp, Homo sapiens
gcctcacttgaatgtgtcac

SEQ ID NO: 1147462 - DNA, 21 bp, Homo sapiens
gcctcacttgattcatctctg

SEQ ID NO: 1147463 - DNA, 22 bp, Homo sapiens
gcctcacttgattcatctctgg

SEQ ID NO: 1147464 - DNA, 16 bp, Homo sapiens
gcctcagaaagggatt

SEQ ID NO: 1147465 - DNA, 17 bp, Homo sapiens
gcctcagaaggccccag

SEQ ID NO: 1147466 - DNA, 20 bp, Homo sapiens
gcctcagaaggccccagaga

SEQ ID NO: 1147467 - DNA, 23 bp, Homo sapiens
gcctcagaattgatcattttccc

SEQ ID NO: 1147468 - DNA, 18 bp, Homo sapiens
gcctcagaccccctcagc

SEQ ID NO: 1147469 - DNA, 19 bp, Homo sapiens
gcctcagaccccctcagcc

SEQ ID NO: 1147470 - DNA, 17 bp, Homo sapiens
gcctcagacgttgcctg

SEQ ID NO: 1147471 - DNA, 12 bp, Homo sapiens
gcctcagagacc

SEQ ID NO: 1147472 - DNA, 15 bp, Homo sapiens
gcctcagagaccagg

SEQ ID NO: 1147473 - DNA, 17 bp, Homo sapiens
gcctcagagaccagggc

SEQ ID NO: 1147474 - DNA, 17 bp, Homo sapiens
agcatcagggggaagaa

SEQ ID NO: 1147475 - DNA, 20 bp, Homo sapiens
agcatcagggggaagaagca

SEQ ID NO: 1147476 - DNA, 14 bp, Homo sapiens
agcatcccagcctt

SEQ ID NO: 1147477 - DNA, 20 bp, Homo sapiens
agcatcccccaaagttcaca

SEQ ID NO: 1147478 - DNA, 13 bp, Homo sapiens
agcatcccggagg

SEQ ID NO: 1147479 - DNA, 20 bp, Homo sapiens
agcatccctgaggagccagg

SEQ ID NO: 1147480 - DNA, 21 bp, Homo sapiens
agcatccctggagcaggagcc

SEQ ID NO: 1147481 - DNA, 14 bp, Homo sapiens
agcatcccttccca

SEQ ID NO: 1147482 - DNA, 20 bp, Homo sapiens
agcatcccttcccacatgcc

SEQ ID NO: 1147483 - DNA, 21 bp, Homo sapiens
agcatccgcaggtgctggtcc

SEQ ID NO: 1147484 - DNA, 15 bp, Homo sapiens
agcatccgtgtattt

SEQ ID NO: 1147485 - DNA, 19 bp, Homo sapiens
agcatcctgagccccgccc

SEQ ID NO: 1147486 - DNA, 22 bp, Homo sapiens
agcatcggacaagacccccagc

SEQ ID NO: 1147487 - DNA, 12 bp, Homo sapiens
agcatcgggagc

SEQ ID NO: 1147488 - DNA, 18 bp, Homo sapiens
agcatcgggagcacccag

SEQ ID NO: 1147489 - DNA, 20 bp, Homo sapiens
agcatcgggagcacccagag

SEQ ID NO: 1147490 - DNA, 21 bp, Homo sapiens
agcatcgggggcctgcaaatc

SEQ ID NO: 1147491 - DNA, 19 bp, Homo sapiens
agcatcgtgacccttcagg

SEQ ID NO: 1147492 - DNA, 20 bp, Homo sapiens
agcatcgtgacccttcaggg

SEQ ID NO: 1147493 - DNA, 17 bp, Homo sapiens
agcatcgtgatcactga

SEQ ID NO: 1147494 - DNA, 20 bp, Homo sapiens
agcatctactctaaagaaaa

SEQ ID NO: 1147495 - DNA, 15 bp, Homo sapiens
agcatctatctcatc

SEQ ID NO: 1147496 - DNA, 12 bp, Homo sapiens
agcatctcccag

SEQ ID NO: 1147497 - DNA, 17 bp, Homo sapiens
agcatctcccagcaaga

SEQ ID NO: 1147498 - DNA, 14 bp, Homo sapiens
agcatctcttcttc

SEQ ID NO: 1147499 - DNA, 21 bp, Homo sapiens
agcatctcttcttccctgtca

SEQ ID NO: 1147500 - DNA, 22 bp, Homo sapiens
agcatctcttgaggccaggagt

SEQ ID NO: 1147501 - DNA, 15 bp, Homo sapiens
agcatctggtcttgt

SEQ ID NO: 1147502 - DNA, 18 bp, Homo sapiens
agcatcttcacttctaaa

SEQ ID NO: 1147503 - DNA, 20 bp, Homo sapiens
agcatcttcacttctaaatg

SEQ ID NO: 1147504 - DNA, 14 bp, Homo sapiens
agcatgaaaaagca

SEQ ID NO: 1147505 - DNA, 17 bp, Homo sapiens
agcatgaaataaaatat

SEQ ID NO: 1147506 - DNA, 19 bp, Homo sapiens
agcatgaataacatttaaa

SEQ ID NO: 1147507 - DNA, 22 bp, Homo sapiens
agcatgaatggtatggaactct

SEQ ID NO: 1147508 - DNA, 19 bp, Homo sapiens
agcatgacaacttttaaag

SEQ ID NO: 1147509 - DNA, 20 bp, Homo sapiens
agcatgacaacttttaaaga

SEQ ID NO: 1147510 - DNA, 20 bp, Homo sapiens
agcatgacaagccccaggca

SEQ ID NO: 1147511 - DNA, 14 bp, Homo sapiens
agcatgacagcctg

SEQ ID NO: 1147512 - DNA, 18 bp, Homo sapiens
agcatgacctgtgaccag

SEQ ID NO: 1147513 - DNA, 15 bp, Homo sapiens
agcatgagactttct

SEQ ID NO: 1147514 - DNA, 18 bp, Homo sapiens
agcatgaggtatctaagg

SEQ ID NO: 1147515 - DNA, 14 bp, Homo sapiens
agcatgatgggaaa

SEQ ID NO: 1147516 - DNA, 19 bp, Homo sapiens
agcatgatgggaaaatatt

SEQ ID NO: 1147517 - DNA, 19 bp, Homo sapiens
agcatgattctttaataga

SEQ ID NO: 1147518 - DNA, 18 bp, Homo sapiens
agcatgattttaagaggc

SEQ ID NO: 1147519 - DNA, 19 bp, Homo sapiens
agcatgcaagcttggtcaa

SEQ ID NO: 1147520 - DNA, 23 bp, Homo sapiens
agcatgcaagcttggtcaaactt

SEQ ID NO: 1147521 - DNA, 21 bp, Homo sapiens
agcatgcaataatgtgcaaat

SEQ ID NO: 1147522 - DNA, 21 bp, Homo sapiens
agcatgcatatcattaaacaa

SEQ ID NO: 1147523 - DNA, 12 bp, Homo sapiens
agcatgcccctt

SEQ ID NO: 1147524 - DNA, 19 bp, Homo sapiens
tcatagctcactgcagcct

SEQ ID NO: 1147525 - DNA, 21 bp, Homo sapiens
tcatagctcactgcagcctca

SEQ ID NO: 1147526 - DNA, 15 bp, Homo sapiens
tcatagctcactgta

SEQ ID NO: 1147527 - DNA, 17 bp, Homo sapiens
tcatagctccttggagc

SEQ ID NO: 1147528 - DNA, 20 bp, Homo sapiens
tcataggaagggaccaaggc

SEQ ID NO: 1147529 - DNA, 17 bp, Homo sapiens
tcataggaagtggctgg

SEQ ID NO: 1147530 - DNA, 21 bp, Homo sapiens
tcataggaattggtaaggcct

SEQ ID NO: 1147531 - DNA, 15 bp, Homo sapiens
tcataggagactgcg

SEQ ID NO: 1147532 - DNA, 19 bp, Homo sapiens
tcataggcggtcatgtgtg

SEQ ID NO: 1147533 - DNA, 22 bp, Homo sapiens
tcatagggaaaggttttgtatt

SEQ ID NO: 1147534 - DNA, 19 bp, Homo sapiens
tcatagggatgctgtgagc

SEQ ID NO: 1147535 - DNA, 13 bp, Homo sapiens
tcataggggcagg

SEQ ID NO: 1147536 - DNA, 14 bp, Homo sapiens
tcataggggcaggt

SEQ ID NO: 1147537 - DNA, 20 bp, Homo sapiens
tcatagggtctcttcaggtt

SEQ ID NO: 1147538 - DNA, 21 bp, Homo sapiens
tcatagggtctcttcaggttc

SEQ ID NO: 1147539 - DNA, 22 bp, Homo sapiens
tcataggtctgaaatttttctt

SEQ ID NO: 1147540 - DNA, 21 bp, Homo sapiens
tcataggttaaaaaaaaaagt

SEQ ID NO: 1147541 - DNA, 15 bp, Homo sapiens
tcataggttgagcaa

SEQ ID NO: 1147542 - DNA, 15 bp, Homo sapiens
tcatagtaacttctt

SEQ ID NO: 1147543 - DNA, 18 bp, Homo sapiens
tcatagtagtttttacag

SEQ ID NO: 1147544 - DNA, 17 bp, Homo sapiens
tcatagtatccatattt

SEQ ID NO: 1147545 - DNA, 16 bp, Homo sapiens
tcatagtattggagca

SEQ ID NO: 1147546 - DNA, 13 bp, Homo sapiens
tcatagtgccttt

SEQ ID NO: 1147547 - DNA, 18 bp, Homo sapiens
tcatagtgtcaagaagga

SEQ ID NO: 1147548 - DNA, 20 bp, Homo sapiens
tcatataaaagctatggtga

SEQ ID NO: 1147549 - DNA, 13 bp, Homo sapiens
tcatataaagtat

SEQ ID NO: 1147550 - DNA, 18 bp, Homo sapiens
tcatataaattttttgtg

SEQ ID NO: 1147551 - DNA, 15 bp, Homo sapiens
tcatataataaatgt

SEQ ID NO: 1147552 - DNA, 15 bp, Homo sapiens
tcatatactataatt

SEQ ID NO: 1147553 - DNA, 22 bp, Homo sapiens
tcatatagcattgataatcttc

SEQ ID NO: 1147554 - DNA, 23 bp, Homo sapiens
tcatatagcattgataatcttca

SEQ ID NO: 1147555 - DNA, 20 bp, Homo sapiens
tcatatagttagctaataaa

SEQ ID NO: 1147556 - DNA, 16 bp, Homo sapiens
tcatatatacatacat

SEQ ID NO: 1147557 - DNA, 18 bp, Homo sapiens
tcatatatggggggccaa

SEQ ID NO: 1147558 - DNA, 15 bp, Homo sapiens
tcatatcatactgtt

SEQ ID NO: 1147559 - DNA, 18 bp, Homo sapiens
tcatatcccctatttaac

SEQ ID NO: 1147560 - DNA, 19 bp, Homo sapiens
tcatatctcttgcccttcc

SEQ ID NO: 1147561 - DNA, 11 bp, Homo sapiens
tcatatgaaaa

SEQ ID NO: 1147562 - DNA, 12 bp, Homo sapiens
tcatatgaaaaa

SEQ ID NO: 1147563 - DNA, 13 bp, Homo sapiens
tcatatgccaccc

SEQ ID NO: 1147564 - DNA, 12 bp, Homo sapiens
tcatatgctctg

SEQ ID NO: 1147565 - DNA, 15 bp, Homo sapiens
tcatatgctctgctt

SEQ ID NO: 1147566 - DNA, 20 bp, Homo sapiens
tcatatggagctcatgtcag

SEQ ID NO: 1147567 - DNA, 18 bp, Homo sapiens
tcatatgtcacctttgct

SEQ ID NO: 1147568 - DNA, 16 bp, Homo sapiens
tcatattaagacagtg

SEQ ID NO: 1147569 - DNA, 18 bp, Homo sapiens
tcatattaagacagtgta

SEQ ID NO: 1147570 - DNA, 18 bp, Homo sapiens
tcatattctaaaaccatt

SEQ ID NO: 1147571 - DNA, 18 bp, Homo sapiens
tcatattctattgtttac

SEQ ID NO: 1147572 - DNA, 18 bp, Homo sapiens
tcatattgtatgtaagta

SEQ ID NO: 1147573 - DNA, 14 bp, Homo sapiens
tcatattgtgccaa

SEQ ID NO: 1147574 - DNA, 15 bp, Homo sapiens
tcatattgtgccaat

SEQ ID NO: 1147575 - DNA, 22 bp, Homo sapiens
tcatattgtgccaatatgtatt

SEQ ID NO: 1147576 - DNA, 20 bp, Homo sapiens
tcatatttcgctatagattt

SEQ ID NO: 1147577 - DNA, 22 bp, Homo sapiens
tcatatttcttatcaccacagt

SEQ ID NO: 1147578 - DNA, 17 bp, Homo sapiens
tcatcaaagaacaaaca

SEQ ID NO: 1147579 - DNA, 17 bp, Homo sapiens
tcatcaaagcagaagtc

SEQ ID NO: 1147580 - DNA, 22 bp, Homo sapiens
tcatcaatatccctcttgtaag

SEQ ID NO: 1147581 - DNA, 21 bp, Homo sapiens
tcatcaatcaaataagtattt

SEQ ID NO: 1147582 - DNA, 19 bp, Homo sapiens
tcatcaatggggccagtca

SEQ ID NO: 1147583 - DNA, 15 bp, Homo sapiens
tcatcacaagaacac

SEQ ID NO: 1147584 - DNA, 14 bp, Homo sapiens
tcatcaccatttcc

SEQ ID NO: 1147585 - DNA, 13 bp, Homo sapiens
tcatcactggact

SEQ ID NO: 1147586 - DNA, 11 bp, Homo sapiens
tcatcactgta

SEQ ID NO: 1147587 - DNA, 17 bp, Homo sapiens
tcatcactgtaaagaca

SEQ ID NO: 1147588 - DNA, 19 bp, Homo sapiens
tcatcactgtaaagacaaa

SEQ ID NO: 1147589 - DNA, 21 bp, Homo sapiens
tcatcagaggggagcagcggc

SEQ ID NO: 1147590 - DNA, 20 bp, Homo sapiens
tcatcagatgcctgcttgat

SEQ ID NO: 1147591 - DNA, 18 bp, Homo sapiens
tcatcagccaccatccta

SEQ ID NO: 1147592 - DNA, 14 bp, Homo sapiens
tcatcaggatgaac

SEQ ID NO: 1147593 - DNA, 22 bp, Homo sapiens
tcatcaggatgaacccaggacg

SEQ ID NO: 1147594 - DNA, 14 bp, Homo sapiens
tcatcaggctctgt

SEQ ID NO: 1147595 - DNA, 13 bp, Homo sapiens
tcatcagggaggg

SEQ ID NO: 1147596 - DNA, 16 bp, Homo sapiens
tcatcagggcctgggg

SEQ ID NO: 1147597 - DNA, 19 bp, Homo sapiens
tcatcagtaaagtaccttt

SEQ ID NO: 1147598 - DNA, 19 bp, Homo sapiens
tcatcagtgttaaaaaatt

SEQ ID NO: 1147599 - DNA, 14 bp, Homo sapiens
tcatcatattatac

SEQ ID NO: 1147600 - DNA, 13 bp, Homo sapiens
tcatcatattcca

SEQ ID NO: 1147601 - DNA, 16 bp, Homo sapiens
tcatcatccacccgct

SEQ ID NO: 1147602 - DNA, 16 bp, Homo sapiens
tcatcatccagatgtg

SEQ ID NO: 1147603 - DNA, 16 bp, Homo sapiens
tcatcatgcttatgtt

SEQ ID NO: 1147604 - DNA, 14 bp, Homo sapiens
tcatcattccctct

SEQ ID NO: 1147605 - DNA, 18 bp, Homo sapiens
tcatcattctctgtctca

SEQ ID NO: 1147606 - DNA, 22 bp, Homo sapiens
tcatcattctctgtctcatcca

SEQ ID NO: 1147607 - DNA, 12 bp, Homo sapiens
tcatcatttcag

SEQ ID NO: 1147608 - DNA, 19 bp, Homo sapiens
gccagcgacctctctgcct

SEQ ID NO: 1147609 - DNA, 22 bp, Homo sapiens
gccagcgcctccctccacccca

SEQ ID NO: 1147610 - DNA, 23 bp, Homo sapiens
gccagcggtgaccagcctgtcac

SEQ ID NO: 1147611 - DNA, 13 bp, Homo sapiens
gccagcgtcctcc

SEQ ID NO: 1147612 - DNA, 15 bp, Homo sapiens
gccagcgtgtggagc

SEQ ID NO: 1147613 - DNA, 18 bp, Homo sapiens
gccagcgtgtggagcaga

SEQ ID NO: 1147614 - DNA, 22 bp, Homo sapiens
gccagctaatttttgtattttt

SEQ ID NO: 1147615 - DNA, 15 bp, Homo sapiens
gccagctactcagga

SEQ ID NO: 1147616 - DNA, 16 bp, Homo sapiens
gccagctcagtcccat

SEQ ID NO: 1147617 - DNA, 13 bp, Homo sapiens
gccagctccagtg

SEQ ID NO: 1147618 - DNA, 16 bp, Homo sapiens
gccagctctagttttc

SEQ ID NO: 1147619 - DNA, 14 bp, Homo sapiens
gccagctctcagcc

SEQ ID NO: 1147620 - DNA, 23 bp, Homo sapiens
gccagctctgaggggaggcacct

SEQ ID NO: 1147621 - DNA, 15 bp, Homo sapiens
gccagctctgtatca

SEQ ID NO: 1147622 - DNA, 15 bp, Homo sapiens
gccagctgcagggca

SEQ ID NO: 1147623 - DNA, 16 bp, Homo sapiens
gccagctgcagggcac

SEQ ID NO: 1147624 - DNA, 23 bp, Homo sapiens
gccagctgcagggcacggggacc

SEQ ID NO: 1147625 - DNA, 15 bp, Homo sapiens
gccagctgccctatg

SEQ ID NO: 1147626 - DNA, 22 bp, Homo sapiens
gccagctgccctatgggcctgc

SEQ ID NO: 1147627 - DNA, 15 bp, Homo sapiens
gccagctgccgacca

SEQ ID NO: 1147628 - DNA, 13 bp, Homo sapiens
gccagctgccttc

SEQ ID NO: 1147629 - DNA, 22 bp, Homo sapiens
gccagctgccttcctcatcccc

SEQ ID NO: 1147630 - DNA, 13 bp, Homo sapiens
gccagctgcttga

SEQ ID NO: 1147631 - DNA, 13 bp, Homo sapiens
gccagctggcctt

SEQ ID NO: 1147632 - DNA, 14 bp, Homo sapiens
gccagctgggagca

SEQ ID NO: 1147633 - DNA, 17 bp, Homo sapiens
gccagctgggagcactg

SEQ ID NO: 1147634 - DNA, 17 bp, Homo sapiens
gccagctgtgcactttc

SEQ ID NO: 1147635 - DNA, 12 bp, Homo sapiens
gccagctgttta

SEQ ID NO: 1147636 - DNA, 22 bp, Homo sapiens
gccagcttaaacccatacaatg

SEQ ID NO: 1147637 - DNA, 17 bp, Homo sapiens
gccagcttcgtgctgga

SEQ ID NO: 1147638 - DNA, 22 bp, Homo sapiens
gccagcttctctctccagggtg

SEQ ID NO: 1147639 - DNA, 13 bp, Homo sapiens
gccagcttggctc

SEQ ID NO: 1147640 - DNA, 17 bp, Homo sapiens
gccagcttttcctccct

SEQ ID NO: 1147641 - DNA, 13 bp, Homo sapiens
gccaggaagccag

SEQ ID NO: 1147642 - DNA, 23 bp, Homo sapiens
tccctctgtcttttctcctccgc

SEQ ID NO: 1147643 - DNA, 20 bp, Homo sapiens
tccctctgttaggtccattt

SEQ ID NO: 1147644 - DNA, 14 bp, Homo sapiens
tccctctgtttctc

SEQ ID NO: 1147645 - DNA, 15 bp, Homo sapiens
tccctcttcactccc

SEQ ID NO: 1147646 - DNA, 14 bp, Homo sapiens
tccctcttctcaag

SEQ ID NO: 1147647 - DNA, 13 bp, Homo sapiens
tccctcttctctc

SEQ ID NO: 1147648 - DNA, 18 bp, Homo sapiens
tccctcttctctcctcag

SEQ ID NO: 1147649 - DNA, 22 bp, Homo sapiens
tccctcttgtaagtcatctact

SEQ ID NO: 1147650 - DNA, 16 bp, Homo sapiens
tccctctttcccaccc

SEQ ID NO: 1147651 - DNA, 18 bp, Homo sapiens
tccctctttggctcccct

SEQ ID NO: 1147652 - DNA, 14 bp, Homo sapiens
tccctcttttctta

SEQ ID NO: 1147653 - DNA, 19 bp, Homo sapiens
tgtcctggtgctctctgcc

SEQ ID NO: 1147654 - DNA, 15 bp, Homo sapiens
tgtcctggttcccgt

SEQ ID NO: 1147655 - DNA, 15 bp, Homo sapiens
tgtcctgtaaaggtt

SEQ ID NO: 1147656 - DNA, 16 bp, Homo sapiens
tgtcctgtaactgtta

SEQ ID NO: 1147657 - DNA, 20 bp, Homo sapiens
tgtcctgtaactgttacagt

SEQ ID NO: 1147658 - DNA, 16 bp, Homo sapiens
tgtcctgtacattgtg

SEQ ID NO: 1147659 - DNA, 13 bp, Homo sapiens
tgtcctgtagctt

SEQ ID NO: 1147660 - DNA, 23 bp, Homo sapiens
tgtcctgtgagatgtgtatcagt

SEQ ID NO: 1147661 - DNA, 23 bp, Homo sapiens
tgtcctgtgctttctgcatgctt

SEQ ID NO: 1147662 - DNA, 13 bp, Homo sapiens
tgtcctgtgtcta

SEQ ID NO: 1147663 - DNA, 17 bp, Homo sapiens
tgtcctgtgtctatgta

SEQ ID NO: 1147664 - DNA, 12 bp, Homo sapiens
tgtccttagaac

SEQ ID NO: 1147665 - DNA, 19 bp, Homo sapiens
tgtccttagactccttctc

SEQ ID NO: 1147666 - DNA, 14 bp, Homo sapiens
tgtccttcagagct

SEQ ID NO: 1147667 - DNA, 13 bp, Homo sapiens
tgtccttcccctt

SEQ ID NO: 1147668 - DNA, 16 bp, Homo sapiens
tgtccttccccttccc

SEQ ID NO: 1147669 - DNA, 14 bp, Homo sapiens
tgtccttccctgca

SEQ ID NO: 1147670 - DNA, 15 bp, Homo sapiens
tgtccttgaactgag

SEQ ID NO: 1147671 - DNA, 20 bp, Homo sapiens
tgtccttgaaggactaatag

SEQ ID NO: 1147672 - DNA, 16 bp, Homo sapiens
tgtccttgccccactc

SEQ ID NO: 1147673 - DNA, 17 bp, Homo sapiens
tgtccttgccccactcc

SEQ ID NO: 1147674 - DNA, 22 bp, Homo sapiens
tgtccttgttcatggagagctg

SEQ ID NO: 1147675 - DNA, 18 bp, Homo sapiens
tgtcctttaaaaaagaaa

SEQ ID NO: 1147676 - DNA, 19 bp, Homo sapiens
tgtcctttaaaaaagaaaa

SEQ ID NO: 1147677 - DNA, 14 bp, Homo sapiens
tgtccttttaggaa

SEQ ID NO: 1147678 - DNA, 17 bp, Homo sapiens
tgtccttttatttctcc

SEQ ID NO: 1147679 - DNA, 13 bp, Homo sapiens
tgtccttttcata

SEQ ID NO: 1147680 - DNA, 18 bp, Homo sapiens
tgtccttttctcccattt

SEQ ID NO: 1147681 - DNA, 21 bp, Homo sapiens
tgtccttttctcccatttctt

SEQ ID NO: 1147682 - DNA, 15 bp, Homo sapiens
tgtcctttttcactt

SEQ ID NO: 1147683 - DNA, 20 bp, Homo sapiens
tgtcctttttcactttgaaa

SEQ ID NO: 1147684 - DNA, 23 bp, Homo sapiens
tgtcctttttcactttgaaaagt

SEQ ID NO: 1147685 - DNA, 14 bp, Homo sapiens
tgtcgatgcacagt

SEQ ID NO: 1147686 - DNA, 15 bp, Homo sapiens
tgtcgatgcacagta

SEQ ID NO: 1147687 - DNA, 18 bp, Homo sapiens
tgtcgattagactggaca

SEQ ID NO: 1147688 - DNA, 15 bp, Homo sapiens
tgtcgccccaggccc

SEQ ID NO: 1147689 - DNA, 16 bp, Homo sapiens
tgtcgccccaggccct

SEQ ID NO: 1147690 - DNA, 23 bp, Homo sapiens
tgtcgccccaggccctccctgac

SEQ ID NO: 1147691 - DNA, 22 bp, Homo sapiens
tgtcgcccttctcccggccctc

SEQ ID NO: 1147692 - DNA, 16 bp, Homo sapiens
tgtcgcgcgtctccca

SEQ ID NO: 1147693 - DNA, 16 bp, Homo sapiens
tgtcgctatgtgactt

SEQ ID NO: 1147694 - DNA, 18 bp, Homo sapiens
tgtcgggaccacatctgt

SEQ ID NO: 1147695 - DNA, 23 bp, Homo sapiens
tgtcgggaccacatctgtcctca

SEQ ID NO: 1147696 - DNA, 15 bp, Homo sapiens
tgtcgggcaccagcc

SEQ ID NO: 1147697 - DNA, 12 bp, Homo sapiens
tgtcgggccctt

SEQ ID NO: 1147698 - DNA, 22 bp, Homo sapiens
tgtcgggcccttcttgctgccc

SEQ ID NO: 1147699 - DNA, 21 bp, Homo sapiens
tgtcggggttggggtgggagg

SEQ ID NO: 1147700 - DNA, 23 bp, Homo sapiens
tgtcgtagaattccttcgaaagg

SEQ ID NO: 1147701 - DNA, 18 bp, Homo sapiens
tgtcgtctgactctgggt

SEQ ID NO: 1147702 - DNA, 14 bp, Homo sapiens
tgtcgtgggatggc

SEQ ID NO: 1147703 - DNA, 16 bp, Homo sapiens
tgtcgtgggatggcat

SEQ ID NO: 1147704 - DNA, 14 bp, Homo sapiens
tgtcgtggttctta

SEQ ID NO: 1147705 - DNA, 19 bp, Homo sapiens
tgtcgtggttcttaaatgt

SEQ ID NO: 1147706 - DNA, 21 bp, Homo sapiens
tgtcgtggttcttaaatgttt

SEQ ID NO: 1147707 - DNA, 15 bp, Homo sapiens
tgtcgtttttattcc

SEQ ID NO: 1147708 - DNA, 11 bp, Homo sapiens
tgtctaaactg

SEQ ID NO: 1147709 - DNA, 18 bp, Homo sapiens
tgtctaactcagaattat

SEQ ID NO: 1147710 - DNA, 20 bp, Homo sapiens
tgtctaactcagaattattt

SEQ ID NO: 1147711 - DNA, 14 bp, Homo sapiens
tgtctaattttctt

SEQ ID NO: 1147712 - DNA, 15 bp, Homo sapiens
tgtctacatgtgcca

SEQ ID NO: 1147713 - DNA, 15 bp, Homo sapiens
tgtctactaagtgat

SEQ ID NO: 1147714 - DNA, 15 bp, Homo sapiens
tgtctactcctagaa

SEQ ID NO: 1147715 - DNA, 17 bp, Homo sapiens
tgtctactcctagaaga

SEQ ID NO: 1147716 - DNA, 18 bp, Homo sapiens
tgtctactcctagaagaa

SEQ ID NO: 1147717 - DNA, 14 bp, Homo sapiens
tgtctactttttaa

SEQ ID NO: 1147718 - DNA, 15 bp, Homo sapiens
tgtctagaatgtgga

SEQ ID NO: 1147719 - DNA, 22 bp, Homo sapiens
tgtctagagtcatgtgagcctc

SEQ ID NO: 1147720 - DNA, 19 bp, Homo sapiens
tgtctaggactgcagtgtg

SEQ ID NO: 1147721 - DNA, 20 bp, Homo sapiens
tgtctaggactgcagtgtgg

SEQ ID NO: 1147722 - DNA, 14 bp, Homo sapiens
tgtctataaagcat

SEQ ID NO: 1147723 - DNA, 21 bp, Homo sapiens
tgtctatatacacagacatgc

SEQ ID NO: 1147724 - DNA, 19 bp, Homo sapiens
tgtctatgaagttgctgtt

SEQ ID NO: 1147725 - DNA, 21 bp, Homo sapiens
tgtctatgaagttgctgttta

SEQ ID NO: 1147726 - DNA, 18 bp, Homo sapiens
tgtctattatcacattaa

SEQ ID NO: 1147727 - DNA, 18 bp, Homo sapiens
tgtctattctgagccttg

SEQ ID NO: 1147728 - DNA, 11 bp, Homo sapiens
tgtctatttta

SEQ ID NO: 1147729 - DNA, 21 bp, Homo sapiens
tgtctcaaaaaaagaaaaaga

SEQ ID NO: 1147730 - DNA, 14 bp, Homo sapiens
tgtctcaaaaggat

SEQ ID NO: 1147731 - DNA, 19 bp, Homo sapiens
tgtctcaaaggagctttct

SEQ ID NO: 1147732 - DNA, 20 bp, Homo sapiens
tgtctcaagagggcactggt

SEQ ID NO: 1147733 - DNA, 14 bp, Homo sapiens
tgtctcacatggga

SEQ ID NO: 1147734 - DNA, 13 bp, Homo sapiens
tgtctcactgttc

SEQ ID NO: 1147735 - DNA, 18 bp, Homo sapiens
tgtctcactgttctgcaa

SEQ ID NO: 1147736 - DNA, 14 bp, Homo sapiens
tgtctcagcctccc

SEQ ID NO: 1147737 - DNA, 15 bp, Homo sapiens
tgtctcagcctccca

SEQ ID NO: 1147738 - DNA, 13 bp, Homo sapiens
tgtctcagggccg

SEQ ID NO: 1147739 - DNA, 16 bp, Homo sapiens
tgtctcaggtccctgc

SEQ ID NO: 1147740 - DNA, 17 bp, Homo sapiens
tgtctcaggtccctgca

SEQ ID NO: 1147741 - DNA, 12 bp, Homo sapiens
tgtctcatccca

SEQ ID NO: 1147742 - DNA, 16 bp, Homo sapiens
tgtctcatccccaggg

SEQ ID NO: 1147743 - DNA, 18 bp, Homo sapiens
tgtctcatcctcctggaa

SEQ ID NO: 1147744 - DNA, 15 bp, Homo sapiens
tgtctcattttggtc

SEQ ID NO: 1147745 - DNA, 21 bp, Homo sapiens
tgtctcattttggtctgtttt

SEQ ID NO: 1147746 - DNA, 17 bp, Homo sapiens
tgtctccagacccccac

SEQ ID NO: 1147747 - DNA, 22 bp, Homo sapiens
tgtctccagacccccacccctt

SEQ ID NO: 1147748 - DNA, 23 bp, Homo sapiens
tgtctccagacccccaccccttc

SEQ ID NO: 1147749 - DNA, 12 bp, Homo sapiens
tgtctccagctg

SEQ ID NO: 1147750 - DNA, 15 bp, Homo sapiens
tgtctccagctgcct

SEQ ID NO: 1147751 - DNA, 18 bp, Homo sapiens
tgtctccagctgcctggg

SEQ ID NO: 1147752 - DNA, 19 bp, Homo sapiens
tgtctccaggccatgatgg

SEQ ID NO: 1147753 - DNA, 20 bp, Homo sapiens
tgtctccatcgtctcatcct

SEQ ID NO: 1147754 - DNA, 15 bp, Homo sapiens
tgtctccatgctgga

SEQ ID NO: 1147755 - DNA, 14 bp, Homo sapiens
tgtctccattttct

SEQ ID NO: 1147756 - DNA, 20 bp, Homo sapiens
tgtctcccaacatgggaggg

SEQ ID NO: 1147757 - DNA, 11 bp, Homo sapiens
tgtctcccaca

SEQ ID NO: 1147758 - DNA, 13 bp, Homo sapiens
tgtctcccacacc

SEQ ID NO: 1147759 - DNA, 15 bp, Homo sapiens
tgtctcccaggctgg

SEQ ID NO: 1147760 - DNA, 23 bp, Homo sapiens
tgtctcccctgttcccctctccc

SEQ ID NO: 1147761 - DNA, 24 bp, Homo sapiens
tgtctcccgccccccacacttccc

SEQ ID NO: 1147762 - DNA, 23 bp, Homo sapiens
tgtctccctccccaaatggctgc

SEQ ID NO: 1147763 - DNA, 23 bp, Homo sapiens
tgtctccctcccctctcagaaca

SEQ ID NO: 1147764 - DNA, 22 bp, Homo sapiens
tgtctccctcgggggctcttcc

SEQ ID NO: 1147765 - DNA, 19 bp, Homo sapiens
gtgtggcctgtgccagcac

SEQ ID NO: 1147766 - DNA, 15 bp, Homo sapiens
gtgtggctcccctct

SEQ ID NO: 1147767 - DNA, 12 bp, Homo sapiens
gtgtggctcctg

SEQ ID NO: 1147768 - DNA, 14 bp, Homo sapiens
gtgtggctgatgat

SEQ ID NO: 1147769 - DNA, 18 bp, Homo sapiens
gtgtggctggtgtcccct

SEQ ID NO: 1147770 - DNA, 11 bp, Homo sapiens
gtgtggctttc

SEQ ID NO: 1147771 - DNA, 12 bp, Homo sapiens
gtgtgggaaagc

SEQ ID NO: 1147772 - DNA, 21 bp, Homo sapiens
gtgtgggacacctgggagaag

SEQ ID NO: 1147773 - DNA, 21 bp, Homo sapiens
gtgtgggccgtggcttgggct

SEQ ID NO: 1147774 - DNA, 20 bp, Homo sapiens
gtgtggggacacagcagtga

SEQ ID NO: 1147775 - DNA, 23 bp, Homo sapiens
gtgttgtatctacagtaatgaaa

SEQ ID NO: 1147776 - DNA, 20 bp, Homo sapiens
gtgttgtgatagctaacatt

SEQ ID NO: 1147777 - DNA, 15 bp, Homo sapiens
gtgttgtgttcctgg

SEQ ID NO: 1147778 - DNA, 17 bp, Homo sapiens
gtgttgtgttcctggct

SEQ ID NO: 1147779 - DNA, 21 bp, Homo sapiens
gtgtttaaaaattgaaaaaag

SEQ ID NO: 1147780 - DNA, 14 bp, Homo sapiens
gtgtttaaataaag

SEQ ID NO: 1147781 - DNA, 19 bp, Homo sapiens
gtgtttaacattcacagcc

SEQ ID NO: 1147782 - DNA, 23 bp, Homo sapiens
gtgtttaacattcacagcccaga

SEQ ID NO: 1147783 - DNA, 20 bp, Homo sapiens
gtgtttacttcctgcagtga

SEQ ID NO: 1147784 - DNA, 20 bp, Homo sapiens
gtgtttactttttggctgga

SEQ ID NO: 1147785 - DNA, 19 bp, Homo sapiens
gtgtttaggatcatctctg

SEQ ID NO: 1147786 - DNA, 22 bp, Homo sapiens
gtgtttaggcctcatttctttg

SEQ ID NO: 1147787 - DNA, 15 bp, Homo sapiens
gtgtttagttgcaga

SEQ ID NO: 1147788 - DNA, 19 bp, Homo sapiens
gtgtttattaaaattctga

SEQ ID NO: 1147789 - DNA, 10 bp, Homo sapiens
gtgtttattt

SEQ ID NO: 1147790 - DNA, 12 bp, Homo sapiens
gtgtttccagaa

SEQ ID NO: 1147791 - DNA, 15 bp, Homo sapiens
gtgtttctagggaaa

SEQ ID NO: 1147792 - DNA, 15 bp, Homo sapiens
gtgtttctgtaacaa

SEQ ID NO: 1147793 - DNA, 21 bp, Homo sapiens
gtgtttctgtcctgtaactgt

SEQ ID NO: 1147794 - DNA, 13 bp, Homo sapiens
gtgtttctttagt

SEQ ID NO: 1147795 - DNA, 16 bp, Homo sapiens
gtgtttctttagtttt

SEQ ID NO: 1147796 - DNA, 20 bp, Homo sapiens
gtgtttggatacatctgctg

SEQ ID NO: 1147797 - DNA, 15 bp, Homo sapiens
gtgtttggcttggcc

SEQ ID NO: 1147798 - DNA, 16 bp, Homo sapiens
gtgtttgtcctgggtt

SEQ ID NO: 1147799 - DNA, 16 bp, Homo sapiens
gtgtttgtgagcatgg

SEQ ID NO: 1147800 - DNA, 15 bp, Homo sapiens
gtgttttaattccaa

SEQ ID NO: 1147801 - DNA, 14 bp, Homo sapiens
gtgttttagatgtt

SEQ ID NO: 1147802 - DNA, 17 bp, Homo sapiens
gtgttttagatgttact

SEQ ID NO: 1147803 - DNA, 14 bp, Homo sapiens
gtgttttagggtga

SEQ ID NO: 1147804 - DNA, 12 bp, Homo sapiens
gtgttttcaagg

SEQ ID NO: 1147805 - DNA, 14 bp, Homo sapiens
gtgttttctgtaga

SEQ ID NO: 1147806 - DNA, 14 bp, Homo sapiens
gtgttttggagaaa

SEQ ID NO: 1147807 - DNA, 19 bp, Homo sapiens
gtgttttgtcagacttcca

SEQ ID NO: 1147808 - DNA, 12 bp, Homo sapiens
gtgtttttctca

SEQ ID NO: 1147809 - DNA, 15 bp, Homo sapiens
gtgtttttgaaatat

SEQ ID NO: 1147810 - DNA, 14 bp, Homo sapiens
gtgttttttaagat

SEQ ID NO: 1147811 - DNA, 15 bp, Homo sapiens
gtgttttttaagatg

SEQ ID NO: 1147812 - DNA, 23 bp, Homo sapiens
gtgttttttctttttttttaagt

SEQ ID NO: 1147813 - DNA, 19 bp, Homo sapiens
gtgtttttttaatttctaa

SEQ ID NO: 1147814 - DNA, 19 bp, Homo sapiens
gtgtttttttatgaatggg

SEQ ID NO: 1147815 - DNA, 15 bp, Homo sapiens
gtgtttttttctaaa

SEQ ID NO: 1147816 - DNA, 22 bp, Homo sapiens
gttaaaaaagaaatctgtttca

SEQ ID NO: 1147817 - DNA, 14 bp, Homo sapiens
gttaaaaagaaaag

SEQ ID NO: 1147818 - DNA, 15 bp, Homo sapiens
gttaaaaaggccaaa

SEQ ID NO: 1147819 - DNA, 21 bp, Homo sapiens
gttaaaaatggctcaagtaga

SEQ ID NO: 1147820 - DNA, 20 bp, Homo sapiens
gttaaaactgtacatttaaa

SEQ ID NO: 1147821 - DNA, 23 bp, Homo sapiens
gttaaaactgtacatttaaaatt

SEQ ID NO: 1147822 - DNA, 17 bp, Homo sapiens
gttaaaagatggttgta

SEQ ID NO: 1147823 - DNA, 22 bp, Homo sapiens
gttaaaagcattttaatactaa

SEQ ID NO: 1147824 - DNA, 20 bp, Homo sapiens
gttaaaatcacattttaagt

SEQ ID NO: 1147825 - DNA, 21 bp, Homo sapiens
gttaaaatcacattttaagtg

SEQ ID NO: 1147826 - DNA, 14 bp, Homo sapiens
gttaaaatgtacac

SEQ ID NO: 1147827 - DNA, 19 bp, Homo sapiens
gttaaaatgtgaggaagaa

SEQ ID NO: 1147828 - DNA, 14 bp, Homo sapiens
gttaaaatgtgatt

SEQ ID NO: 1147829 - DNA, 13 bp, Homo sapiens
gttaaacaaaatg

SEQ ID NO: 1147830 - DNA, 21 bp, Homo sapiens
gttaaacaaaatgaaaatatc

SEQ ID NO: 1147831 - DNA, 12 bp, Homo sapiens
gttaaacagaga

SEQ ID NO: 1147832 - DNA, 15 bp, Homo sapiens
gttaaactaaaaaaa

SEQ ID NO: 1147833 - DNA, 17 bp, Homo sapiens
gttaaactctgttgtaa

SEQ ID NO: 1147834 - DNA, 13 bp, Homo sapiens
gttaaactgttag

SEQ ID NO: 1147835 - DNA, 22 bp, Homo sapiens
gttaaactgttagcactgttga

SEQ ID NO: 1147836 - DNA, 17 bp, Homo sapiens
gttaaagcatcagagat

SEQ ID NO: 1147837 - DNA, 11 bp, Homo sapiens
gttaaagctaa

SEQ ID NO: 1147838 - DNA, 15 bp, Homo sapiens
gttaaagctgtacac

SEQ ID NO: 1147839 - DNA, 18 bp, Homo sapiens
gttaaaggttttctctaa

SEQ ID NO: 1147840 - DNA, 16 bp, Homo sapiens
gttaaatacaggaaac

SEQ ID NO: 1147841 - DNA, 22 bp, Homo sapiens
gttaaatactgtgcagaataat

SEQ ID NO: 1147842 - DNA, 18 bp, Homo sapiens
gttaaatgacttgattgt

SEQ ID NO: 1147843 - DNA, 19 bp, Homo sapiens
gttaaattacatttttaag

SEQ ID NO: 1147844 - DNA, 13 bp, Homo sapiens
gttaacaaggaat

SEQ ID NO: 1147845 - DNA, 19 bp, Homo sapiens
gttaacaaggaatgcctgt

SEQ ID NO: 1147846 - DNA, 19 bp, Homo sapiens
gttaacaatgcctattgta

SEQ ID NO: 1147847 - DNA, 21 bp, Homo sapiens
gttaacacactaccgaatgtg

SEQ ID NO: 1147848 - DNA, 23 bp, Homo sapiens
gttaacatctagcctaaagtata

SEQ ID NO: 1147849 - DNA, 15 bp, Homo sapiens
gttaacattgaccaa

SEQ ID NO: 1147850 - DNA, 16 bp, Homo sapiens
gttaaccttaaataca

SEQ ID NO: 1147851 - DNA, 14 bp, Homo sapiens
gttaactgaatacc

SEQ ID NO: 1147852 - DNA, 20 bp, Homo sapiens
gttaactgaataccactctg

SEQ ID NO: 1147853 - DNA, 21 bp, Homo sapiens
gttaacttattcaaagagaaa

SEQ ID NO: 1147854 - DNA, 17 bp, Homo sapiens
gttaactttaagactga

SEQ ID NO: 1147855 - DNA, 22 bp, Homo sapiens
gttaactttgtggtctaaagtg

SEQ ID NO: 1147856 - DNA, 14 bp, Homo sapiens
gttaagaaaggata

SEQ ID NO: 1147857 - DNA, 18 bp, Homo sapiens
gttaagaactgtgaaatt

SEQ ID NO: 1147858 - DNA, 17 bp, Homo sapiens
gttaagacatgatttcc

SEQ ID NO: 1147859 - DNA, 15 bp, Homo sapiens
gttaagacttgacag

SEQ ID NO: 1147860 - DNA, 17 bp, Homo sapiens
gttaagcttctattttt

SEQ ID NO: 1147861 - DNA, 11 bp, Homo sapiens
gttaaggcctg

SEQ ID NO: 1147862 - DNA, 17 bp, Homo sapiens
gttaagtcctccctgac

SEQ ID NO: 1147863 - DNA, 23 bp, Homo sapiens
gttaagtcctccctgacttttct

SEQ ID NO: 1147864 - DNA, 21 bp, Homo sapiens
gttaagtctatctggtattaa

SEQ ID NO: 1147865 - DNA, 15 bp, Homo sapiens
gttaataacagctcc

SEQ ID NO: 1147866 - DNA, 16 bp, Homo sapiens
gttaataacagctcct

SEQ ID NO: 1147867 - DNA, 18 bp, Homo sapiens
gttaataacagctccttt

SEQ ID NO: 1147868 - DNA, 24 bp, Homo sapiens
gttaataacttgtcctatgtcaat

SEQ ID NO: 1147869 - DNA, 20 bp, Homo sapiens
gttaatacacagtactttat

SEQ ID NO: 1147870 - DNA, 14 bp, Homo sapiens
gttaatagacagta

SEQ ID NO: 1147871 - DNA, 19 bp, Homo sapiens
gttaatagattatttcata

SEQ ID NO: 1147872 - DNA, 22 bp, Homo sapiens
gttaatagattatttcatatac

SEQ ID NO: 1147873 - DNA, 15 bp, Homo sapiens
gttaatagccagata

SEQ ID NO: 1147874 - DNA, 12 bp, Homo sapiens
gttaatataccc

SEQ ID NO: 1147875 - DNA, 18 bp, Homo sapiens
gttaatatcactcattaa

SEQ ID NO: 1147876 - DNA, 16 bp, Homo sapiens
gttaatccctttgtct

SEQ ID NO: 1147877 - DNA, 23 bp, Homo sapiens
gttaatgatggttgatgggttct

SEQ ID NO: 1147878 - DNA, 17 bp, Homo sapiens
gttaatgctctatgttt

SEQ ID NO: 1147879 - DNA, 20 bp, Homo sapiens
gttaatgctctatgtttgta

SEQ ID NO: 1147880 - DNA, 22 bp, Homo sapiens
gttaatgctctatgtttgtatt

SEQ ID NO: 1147881 - DNA, 19 bp, Homo sapiens
gttaatgtagtatggtata

SEQ ID NO: 1147882 - DNA, 16 bp, Homo sapiens
gttaatgtatataaaa

SEQ ID NO: 1147883 - DNA, 22 bp, Homo sapiens
gttaatgtcattgctaaaaaat

SEQ ID NO: 1147884 - DNA, 23 bp, Homo sapiens
gttaatgtcattgctaaaaaata

SEQ ID NO: 1147885 - DNA, 23 bp, Homo sapiens
gttaatgttatatcatatgtata

SEQ ID NO: 1147886 - DNA, 18 bp, Homo sapiens
gttaattcagcactgatt

SEQ ID NO: 1147887 - DNA, 15 bp, Homo sapiens
gttaattcctatgaa

SEQ ID NO: 1147888 - DNA, 19 bp, Homo sapiens
gttaatttagaaaacttta

SEQ ID NO: 1147889 - DNA, 23 bp, Homo sapiens
gttaatttattttgctccctctg

SEQ ID NO: 1147890 - DNA, 18 bp, Homo sapiens
gttaatttgtgtgttttt

SEQ ID NO: 1147891 - DNA, 22 bp, Homo sapiens
gttaattttgaagtgctgttta

SEQ ID NO: 1147892 - DNA, 14 bp, Homo sapiens
gttaatttttccaa

SEQ ID NO: 1147893 - DNA, 14 bp, Homo sapiens
gttaatttttccta

SEQ ID NO: 1147894 - DNA, 23 bp, Homo sapiens
tgtctgtttgtttcaagaacctg

SEQ ID NO: 1147895 - DNA, 21 bp, Homo sapiens
tgtcttaaaaccagagaatct

SEQ ID NO: 1147896 - DNA, 21 bp, Homo sapiens
tccatcccccttcttcctccc

SEQ ID NO: 1147897 - DNA, 23 bp, Homo sapiens
tccatcccctccctgcctgctcc

SEQ ID NO: 1147898 - DNA, 20 bp, Homo sapiens
tccatcccgaaaatctctcg

SEQ ID NO: 1147899 - DNA, 13 bp, Homo sapiens
tccatccctagaa

SEQ ID NO: 1147900 - DNA, 15 bp, Homo sapiens
tccatcctcccagga

SEQ ID NO: 1147901 - DNA, 23 bp, Homo sapiens
tccatcgcgccagcgacctctct

SEQ ID NO: 1147902 - DNA, 23 bp, Homo sapiens
tccatcgtctcatcctcctttca

SEQ ID NO: 1147903 - DNA, 18 bp, Homo sapiens
tccatctagcagctggcc

SEQ ID NO: 1147904 - DNA, 20 bp, Homo sapiens
tccatctagcagctggccta

SEQ ID NO: 1147905 - DNA, 21 bp, Homo sapiens
tccatctcctataatctgtca

SEQ ID NO: 1147906 - DNA, 16 bp, Homo sapiens
tccatctctcatcctc

SEQ ID NO: 1147907 - DNA, 14 bp, Homo sapiens
tccatctgacaaaa

SEQ ID NO: 1147908 - DNA, 12 bp, Homo sapiens
tccatctgtctg

SEQ ID NO: 1147909 - DNA, 19 bp, Homo sapiens
tccatctgtctgtcctacc

SEQ ID NO: 1147910 - DNA, 18 bp, Homo sapiens
tccatctgtttgtttttt

SEQ ID NO: 1147911 - DNA, 15 bp, Homo sapiens
tccatgaaaacgttt

SEQ ID NO: 1147912 - DNA, 19 bp, Homo sapiens
tccatgaaaacgttttatt

SEQ ID NO: 1147913 - DNA, 21 bp, Homo sapiens
tccatgaaaacgttttattgt

SEQ ID NO: 1147914 - DNA, 12 bp, Homo sapiens
tccatgaaaata

SEQ ID NO: 1147915 - DNA, 13 bp, Homo sapiens
tccatgaaaatac

SEQ ID NO: 1147916 - DNA, 16 bp, Homo sapiens
tccatgaaaataccat

SEQ ID NO: 1147917 - DNA, 21 bp, Homo sapiens
tccatgaagagcttgtgtcct

SEQ ID NO: 1147918 - DNA, 22 bp, Homo sapiens
tccatgaagagcttgtgtcctg

SEQ ID NO: 1147919 - DNA, 14 bp, Homo sapiens
tccatgaatgtatc

SEQ ID NO: 1147920 - DNA, 15 bp, Homo sapiens
tccatgaatgtatca

SEQ ID NO: 1147921 - DNA, 16 bp, Homo sapiens
tccatgaccagaaaca

SEQ ID NO: 1147922 - DNA, 20 bp, Homo sapiens
tccatgacctagttttccat

SEQ ID NO: 1147923 - DNA, 15 bp, Homo sapiens
tccatgactggctgt

SEQ ID NO: 1147924 - DNA, 19 bp, Homo sapiens
tccatgactggctgtctgc

SEQ ID NO: 1147925 - DNA, 13 bp, Homo sapiens
tccatgagcaccc

SEQ ID NO: 1147926 - DNA, 18 bp, Homo sapiens
tccatgagtgtctgtgag

SEQ ID NO: 1147927 - DNA, 16 bp, Homo sapiens
tccatgccccagctct

SEQ ID NO: 1147928 - DNA, 21 bp, Homo sapiens
tccatgccctcccaggaccct

SEQ ID NO: 1147929 - DNA, 18 bp, Homo sapiens
tccatgccctgggatgcc

SEQ ID NO: 1147930 - DNA, 23 bp, Homo sapiens
tccatgccctgggatgcctcacc

SEQ ID NO: 1147931 - DNA, 19 bp, Homo sapiens
tccatgcctctggaggcct

SEQ ID NO: 1147932 - DNA, 13 bp, Homo sapiens
tccatgcctgagg

SEQ ID NO: 1147933 - DNA, 21 bp, Homo sapiens
tccatgcgtgtttctgactct

SEQ ID NO: 1147934 - DNA, 21 bp, Homo sapiens
tccatgctcctcacctgtcta

SEQ ID NO: 1147935 - DNA, 17 bp, Homo sapiens
tccatgctccttgagag

SEQ ID NO: 1147936 - DNA, 17 bp, Homo sapiens
tccatgctgcaaaggag

SEQ ID NO: 1147937 - DNA, 19 bp, Homo sapiens
tccatgctgcaaaggagaa

SEQ ID NO: 1147938 - DNA, 15 bp, Homo sapiens
tccatgctgcctcca

SEQ ID NO: 1147939 - DNA, 22 bp, Homo sapiens
tccatgctgtgcgcccagggct

SEQ ID NO: 1147940 - DNA, 9 bp, Homo sapiens
tccatgctt

SEQ ID NO: 1147941 - DNA, 16 bp, Homo sapiens
tccatggcaaatgggc

SEQ ID NO: 1147942 - DNA, 17 bp, Homo sapiens
tccatggcaaatgggca

SEQ ID NO: 1147943 - DNA, 12 bp, Homo sapiens
tccatggccacc

SEQ ID NO: 1147944 - DNA, 21 bp, Homo sapiens
tccatggccaccccgtgccac

SEQ ID NO: 1147945 - DNA, 14 bp, Homo sapiens
tccatggccctgtc

SEQ ID NO: 1147946 - DNA, 17 bp, Homo sapiens
tccatggccctgtccca

SEQ ID NO: 1147947 - DNA, 15 bp, Homo sapiens
tccatggcttcctga

SEQ ID NO: 1147948 - DNA, 17 bp, Homo sapiens
tccatggcttcctgaga

SEQ ID NO: 1147949 - DNA, 20 bp, Homo sapiens
tccatgggcccgctgcctct

SEQ ID NO: 1147950 - DNA, 17 bp, Homo sapiens
tccatggggttcgagac

SEQ ID NO: 1147951 - DNA, 21 bp, Homo sapiens
tccatggtactgtagcagggg

SEQ ID NO: 1147952 - DNA, 21 bp, Homo sapiens
tccatggtcctgtctgtcctt

SEQ ID NO: 1147953 - DNA, 14 bp, Homo sapiens
tccatggtggaagg

SEQ ID NO: 1147954 - DNA, 18 bp, Homo sapiens
tccatgtaataagcactt

SEQ ID NO: 1147955 - DNA, 16 bp, Homo sapiens
tccatgtactgtagtt

SEQ ID NO: 1147956 - DNA, 15 bp, Homo sapiens
tccatgtagcaggac

SEQ ID NO: 1147957 - DNA, 18 bp, Homo sapiens
tccatgtcagataagtgt

SEQ ID NO: 1147958 - DNA, 15 bp, Homo sapiens
tccatgtcaggccag

SEQ ID NO: 1147959 - DNA, 17 bp, Homo sapiens
tccatgtgaccattctg

SEQ ID NO: 1147960 - DNA, 18 bp, Homo sapiens
tccatgtgaccattctgc

SEQ ID NO: 1147961 - DNA, 19 bp, Homo sapiens
tccatgtgaccattctgcc

SEQ ID NO: 1147962 - DNA, 14 bp, Homo sapiens
tccatgtgcatata

SEQ ID NO: 1147963 - DNA, 20 bp, Homo sapiens
tccatgtgtggtggtgtttt

SEQ ID NO: 1147964 - DNA, 19 bp, Homo sapiens
tccatgttagtttttactt

SEQ ID NO: 1147965 - DNA, 15 bp, Homo sapiens
tccatgttctatttt

SEQ ID NO: 1147966 - DNA, 14 bp, Homo sapiens
tccatgttgctgcc

SEQ ID NO: 1147967 - DNA, 17 bp, Homo sapiens
tccatgttgctgccaac

SEQ ID NO: 1147968 - DNA, 22 bp, Homo sapiens
tccatgttggcctgtcaccaga

SEQ ID NO: 1147969 - DNA, 19 bp, Homo sapiens
tccatgtttgtaaaactac

SEQ ID NO: 1147970 - DNA, 21 bp, Homo sapiens
tccattaatttaaatgattta

SEQ ID NO: 1147971 - DNA, 14 bp, Homo sapiens
tccattacgtgcat

SEQ ID NO: 1147972 - DNA, 16 bp, Homo sapiens
tccattacgtgcattt

SEQ ID NO: 1147973 - DNA, 14 bp, Homo sapiens
tccattaggccagc

SEQ ID NO: 1147974 - DNA, 15 bp, Homo sapiens
tccattatgattctt

SEQ ID NO: 1147975 - DNA, 14 bp, Homo sapiens
tccattatttatat

SEQ ID NO: 1147976 - DNA, 20 bp, Homo sapiens
tccattcacaagcctcctgt

SEQ ID NO: 1147977 - DNA, 13 bp, Homo sapiens
tccattcagaaag

SEQ ID NO: 1147978 - DNA, 16 bp, Homo sapiens
tccattcagaaagctt

SEQ ID NO: 1147979 - DNA, 14 bp, Homo sapiens
tccattccatggaa

SEQ ID NO: 1147980 - DNA, 17 bp, Homo sapiens
tccattccatggaaata

SEQ ID NO: 1147981 - DNA, 19 bp, Homo sapiens
tccattccatggaaataaa

SEQ ID NO: 1147982 - DNA, 12 bp, Homo sapiens
tccattcctcag

SEQ ID NO: 1147983 - DNA, 18 bp, Homo sapiens
tccccagtgcctgccact

SEQ ID NO: 1147984 - DNA, 22 bp, Homo sapiens
tccccagtgcctgccactctct

SEQ ID NO: 1147985 - DNA, 21 bp, Homo sapiens
tccccatacacacacaaacca

SEQ ID NO: 1147986 - DNA, 15 bp, Homo sapiens
tccccatcagctccc

SEQ ID NO: 1147987 - DNA, 16 bp, Homo sapiens
tccccatcagctccca

SEQ ID NO: 1147988 - DNA, 17 bp, Homo sapiens
tccccatcagctcccaa

SEQ ID NO: 1147989 - DNA, 18 bp, Homo sapiens
tccccatccccttcctaa

SEQ ID NO: 1147990 - DNA, 19 bp, Homo sapiens
tccccatccctgtcatttt

SEQ ID NO: 1147991 - DNA, 15 bp, Homo sapiens
tccccatcctccagc

SEQ ID NO: 1147992 - DNA, 18 bp, Homo sapiens
tccccatcctccagcttc

SEQ ID NO: 1147993 - DNA, 15 bp, Homo sapiens
tccccatcggccctg

SEQ ID NO: 1147994 - DNA, 21 bp, Homo sapiens
tccccatcggccctgtcccct

SEQ ID NO: 1147995 - DNA, 15 bp, Homo sapiens
tccccatctccctgc

SEQ ID NO: 1147996 - DNA, 19 bp, Homo sapiens
tccccatctccctgcctgg

SEQ ID NO: 1147997 - DNA, 16 bp, Homo sapiens
tccccatctctgtctg

SEQ ID NO: 1147998 - DNA, 17 bp, Homo sapiens
tccccatctctgtctgg

SEQ ID NO: 1147999 - DNA, 20 bp, Homo sapiens
tccccatctctgtctggggc

SEQ ID NO: 1148000 - DNA, 20 bp, Homo sapiens
tccccatctttgatccttct

SEQ ID NO: 1148001 - DNA, 21 bp, Homo sapiens
tccccatctttgatccttctg

SEQ ID NO: 1148002 - DNA, 20 bp, Homo sapiens
tccccatgccacgttccaca

SEQ ID NO: 1148003 - DNA, 19 bp, Homo sapiens
tccccatgggcacagtggt

SEQ ID NO: 1148004 - DNA, 17 bp, Homo sapiens
tccccattcttcctagt

SEQ ID NO: 1148005 - DNA, 17 bp, Homo sapiens
tccccatttctgcctcg

SEQ ID NO: 1148006 - DNA, 23 bp, Homo sapiens
tcccccaaacatctggcatggct

SEQ ID NO: 1148007 - DNA, 12 bp, Homo sapiens
tcccccaaagtt

SEQ ID NO: 1148008 - DNA, 21 bp, Homo sapiens
tcccccaaccaaggaaggagc

SEQ ID NO: 1148009 - DNA, 14 bp, Homo sapiens
tcccccaaccccca

SEQ ID NO: 1148010 - DNA, 21 bp, Homo sapiens
tcccccaacccccaccccaca

SEQ ID NO: 1148011 - DNA, 22 bp, Homo sapiens
tcccccaacccccaccccacac

SEQ ID NO: 1148012 - DNA, 17 bp, Homo sapiens
tcccccaactctgagcc

SEQ ID NO: 1148013 - DNA, 18 bp, Homo sapiens
tcccccaactctgagccc

SEQ ID NO: 1148014 - DNA, 17 bp, Homo sapiens
tcccccaccacactgaa

SEQ ID NO: 1148015 - DNA, 16 bp, Homo sapiens
tcccccaccactcagg

SEQ ID NO: 1148016 - DNA, 17 bp, Homo sapiens
tcccccaccactcaggc

SEQ ID NO: 1148017 - DNA, 15 bp, Homo sapiens
tcccccacccacctc

SEQ ID NO: 1148018 - DNA, 18 bp, Homo sapiens
tcccccaccccctcccca

SEQ ID NO: 1148019 - DNA, 17 bp, Homo sapiens
tcccccacccctccacg

SEQ ID NO: 1148020 - DNA, 18 bp, Homo sapiens
tcccccacccctccacgt

SEQ ID NO: 1148021 - DNA, 22 bp, Homo sapiens
tcccccaccctactccctccaa

SEQ ID NO: 1148022 - DNA, 17 bp, Homo sapiens
tcccccaccctccatgc

SEQ ID NO: 1148023 - DNA, 21 bp, Homo sapiens
tcccccaccggtccagctggc

SEQ ID NO: 1148024 - DNA, 15 bp, Homo sapiens
tcccccacctgacaa

SEQ ID NO: 1148025 - DNA, 24 bp, Homo sapiens
tcccccactactgcagcacctcca

SEQ ID NO: 1148026 - DNA, 20 bp, Homo sapiens
tcccccactctctcacccac

SEQ ID NO: 1148027 - DNA, 19 bp, Homo sapiens
tcccccactgctaaggctg

SEQ ID NO: 1148028 - DNA, 22 bp, Homo sapiens
tcccccactgctaaggctgctg

SEQ ID NO: 1148029 - DNA, 16 bp, Homo sapiens
tcccccacttcccctc

SEQ ID NO: 1148030 - DNA, 16 bp, Homo sapiens
tcccccagagtgctgt

SEQ ID NO: 1148031 - DNA, 17 bp, Homo sapiens
tcccccagagtgctgtc

SEQ ID NO: 1148032 - DNA, 23 bp, Homo sapiens
tcccccagccatgccagctggcc

SEQ ID NO: 1148033 - DNA, 13 bp, Homo sapiens
tcccccagccctg

SEQ ID NO: 1148034 - DNA, 16 bp, Homo sapiens
tcccccagccctgtgg

SEQ ID NO: 1148035 - DNA, 12 bp, Homo sapiens
tcccccagcctc

SEQ ID NO: 1148036 - DNA, 14 bp, Homo sapiens
tcccccagtacctc

SEQ ID NO: 1148037 - DNA, 21 bp, Homo sapiens
tcccccagtatgtccttttct

SEQ ID NO: 1148038 - DNA, 18 bp, Homo sapiens
tcccccatagcaccctgc

SEQ ID NO: 1148039 - DNA, 16 bp, Homo sapiens
tcccccatcatgtggc

SEQ ID NO: 1148040 - DNA, 17 bp, Homo sapiens
tcccccatgggggtgag

SEQ ID NO: 1148041 - DNA, 14 bp, Homo sapiens
tcccccatgtggct

SEQ ID NO: 1148042 - DNA, 12 bp, Homo sapiens
tccccccactgc

SEQ ID NO: 1148043 - DNA, 13 bp, Homo sapiens
tccccccagactc

SEQ ID NO: 1148044 - DNA, 16 bp, Homo sapiens
tccccccatcccaggg

SEQ ID NO: 1148045 - DNA, 18 bp, Homo sapiens
tccccccccaacctttcc

SEQ ID NO: 1148046 - DNA, 19 bp, Homo sapiens
tccccccccaacctttccc

SEQ ID NO: 1148047 - DNA, 13 bp, Homo sapiens
tccccccccaggc

SEQ ID NO: 1148048 - DNA, 14 bp, Homo sapiens
tccccccccaggcc

SEQ ID NO: 1148049 - DNA, 17 bp, Homo sapiens
tcccccccctgtatagt

SEQ ID NO: 1148050 - DNA, 19 bp, Homo sapiens
tccccccgcccacccacgc

SEQ ID NO: 1148051 - DNA, 14 bp, Homo sapiens
tcccccctctcctc

SEQ ID NO: 1148052 - DNA, 22 bp, Homo sapiens
tcccccctctcctcccagctgc

SEQ ID NO: 1148053 - DNA, 13 bp, Homo sapiens
tcccccctgctgc

SEQ ID NO: 1148054 - DNA, 18 bp, Homo sapiens
tcccccctgctgcccagt

SEQ ID NO: 1148055 - DNA, 20 bp, Homo sapiens
tcccccctgctgcccagtgc

SEQ ID NO: 1148056 - DNA, 18 bp, Homo sapiens
tcccccgacactgctgca

SEQ ID NO: 1148057 - DNA, 14 bp, Homo sapiens
tcccccgactgcct

SEQ ID NO: 1148058 - DNA, 21 bp, Homo sapiens
tcccccgcagtccccagccct

SEQ ID NO: 1148059 - DNA, 14 bp, Homo sapiens
tcccccgccactcc

SEQ ID NO: 1148060 - DNA, 19 bp, Homo sapiens
tcccccggctgggcctcct

SEQ ID NO: 1148061 - DNA, 14 bp, Homo sapiens
tccccctacccacc

SEQ ID NO: 1148062 - DNA, 20 bp, Homo sapiens
tccccctatttattgacttt

SEQ ID NO: 1148063 - DNA, 21 bp, Homo sapiens
tccccctccccaggctggaga

SEQ ID NO: 1148064 - DNA, 17 bp, Homo sapiens
tccccctcccctcccag

SEQ ID NO: 1148065 - DNA, 14 bp, Homo sapiens
tccccctccctgcc

SEQ ID NO: 1148066 - DNA, 17 bp, Homo sapiens
tccccctccctgcccaa

SEQ ID NO: 1148067 - DNA, 19 bp, Homo sapiens
tccccctcctagggggtgt

SEQ ID NO: 1148068 - DNA, 20 bp, Homo sapiens
tccccctcctccagggaagg

SEQ ID NO: 1148069 - DNA, 14 bp, Homo sapiens
tccccctctgcttc

SEQ ID NO: 1148070 - DNA, 12 bp, Homo sapiens
tccccctctgtc

SEQ ID NO: 1148071 - DNA, 15 bp, Homo sapiens
tccccctctgtccag

SEQ ID NO: 1148072 - DNA, 11 bp, Homo sapiens
tccccctgcaa

SEQ ID NO: 1148073 - DNA, 12 bp, Homo sapiens
tccccctgcaac

SEQ ID NO: 1148074 - DNA, 23 bp, Homo sapiens
tccccctgccctcgtggccagcc

SEQ ID NO: 1148075 - DNA, 14 bp, Homo sapiens
tccccctgccctgt

SEQ ID NO: 1148076 - DNA, 14 bp, Homo sapiens
tccccctgggctct

SEQ ID NO: 1148077 - DNA, 15 bp, Homo sapiens
tccccctgggctctg

SEQ ID NO: 1148078 - DNA, 23 bp, Homo sapiens
tccccctgggctctgccccagct

SEQ ID NO: 1148079 - DNA, 18 bp, Homo sapiens
tccccctgtagactagtg

SEQ ID NO: 1148080 - DNA, 13 bp, Homo sapiens
tccccctgttctg

SEQ ID NO: 1148081 - DNA, 17 bp, Homo sapiens
tccccctgttttctgtt

SEQ ID NO: 1148082 - DNA, 21 bp, Homo sapiens
tccccctgtttttagagcttc

SEQ ID NO: 1148083 - DNA, 19 bp, Homo sapiens
tcccccttaaacttccaaa

SEQ ID NO: 1148084 - DNA, 21 bp, Homo sapiens
tcccccttaaagaaaattgca

SEQ ID NO: 1148085 - DNA, 14 bp, Homo sapiens
tcccccttcacaaa

SEQ ID NO: 1148086 - DNA, 16 bp, Homo sapiens
tcccccttcagctcct

SEQ ID NO: 1148087 - DNA, 16 bp, Homo sapiens
tcccccttcccgcctt

SEQ ID NO: 1148088 - DNA, 19 bp, Homo sapiens
tcccccttcccgccttcca

SEQ ID NO: 1148089 - DNA, 15 bp, Homo sapiens
tcccccttcttcctc

SEQ ID NO: 1148090 - DNA, 19 bp, Homo sapiens
tcccccttcttcctcccct

SEQ ID NO: 1148091 - DNA, 13 bp, Homo sapiens
tcccccttgatcg

SEQ ID NO: 1148092 - DNA, 9 bp, Homo sapiens
tcccccttt

SEQ ID NO: 1148093 - DNA, 19 bp, Homo sapiens
tccccctttcacactggat

SEQ ID NO: 1148094 - DNA, 14 bp, Homo sapiens
tcccccttttttgt

SEQ ID NO: 1148095 - DNA, 21 bp, Homo sapiens
tcccccttttttgtcccccaa

SEQ ID NO: 1148096 - DNA, 18 bp, Homo sapiens
tccccgaagagtcagccc

SEQ ID NO: 1148097 - DNA, 14 bp, Homo sapiens
tccccgacagtggc

SEQ ID NO: 1148098 - DNA, 15 bp, Homo sapiens
tccccgacagtggct

SEQ ID NO: 1148099 - DNA, 16 bp, Homo sapiens
tcatcgggcccaggga

SEQ ID NO: 1148100 - DNA, 17 bp, Homo sapiens
tcatcgttccccacccc

SEQ ID NO: 1148101 - DNA, 18 bp, Homo sapiens
tcatctaataaatcagtg

SEQ ID NO: 1148102 - DNA, 22 bp, Homo sapiens
tcatctaatgtattatgagcca

SEQ ID NO: 1148103 - DNA, 19 bp, Homo sapiens
tcatctactgaatgacctc

SEQ ID NO: 1148104 - DNA, 18 bp, Homo sapiens
tcatctagcgcaattgaa

SEQ ID NO: 1148105 - DNA, 13 bp, Homo sapiens
tcatctataaaga

SEQ ID NO: 1148106 - DNA, 15 bp, Homo sapiens
tcatctattctagca

SEQ ID NO: 1148107 - DNA, 11 bp, Homo sapiens
tcatctatttc

SEQ ID NO: 1148108 - DNA, 15 bp, Homo sapiens
tcatctatttctgag

SEQ ID NO: 1148109 - DNA, 18 bp, Homo sapiens
tcatctatttctgagaag

SEQ ID NO: 1148110 - DNA, 11 bp, Homo sapiens
tcatctcacct

SEQ ID NO: 1148111 - DNA, 20 bp, Homo sapiens
tcatctcatttaagggaaaa

SEQ ID NO: 1148112 - DNA, 18 bp, Homo sapiens
tcatctccagcctcccca

SEQ ID NO: 1148113 - DNA, 23 bp, Homo sapiens
tcatctccctgccatccccctct

SEQ ID NO: 1148114 - DNA, 22 bp, Homo sapiens
tcatctcctgaccctcccactc

SEQ ID NO: 1148115 - DNA, 15 bp, Homo sapiens
tcatctctctacctc

SEQ ID NO: 1148116 - DNA, 18 bp, Homo sapiens
tcatctctctacctccac

SEQ ID NO: 1148117 - DNA, 19 bp, Homo sapiens
tcatctctctacctccacc

SEQ ID NO: 1148118 - DNA, 21 bp, Homo sapiens
tcatctctctggggccctggg

SEQ ID NO: 1148119 - DNA, 14 bp, Homo sapiens
tcatctctgaaaat

SEQ ID NO: 1148120 - DNA, 19 bp, Homo sapiens
tcatctctgaaaattctgg

SEQ ID NO: 1148121 - DNA, 19 bp, Homo sapiens
tcatctcttcaggttctca

SEQ ID NO: 1148122 - DNA, 23 bp, Homo sapiens
tcatctgaaggggcaaattcttt

SEQ ID NO: 1148123 - DNA, 16 bp, Homo sapiens
tcatctgagaggctct

SEQ ID NO: 1148124 - DNA, 21 bp, Homo sapiens
tcatctgatcacttcatgttt

SEQ ID NO: 1148125 - DNA, 22 bp, Homo sapiens
tcatctgcacccttcttttctc

SEQ ID NO: 1148126 - DNA, 16 bp, Homo sapiens
tcatctgcatgtctac

SEQ ID NO: 1148127 - DNA, 17 bp, Homo sapiens
tcatctgcatgtctact

SEQ ID NO: 1148128 - DNA, 17 bp, Homo sapiens
tcatctgcattcctgat

SEQ ID NO: 1148129 - DNA, 20 bp, Homo sapiens
tcatctgctaagtaatttag

SEQ ID NO: 1148130 - DNA, 13 bp, Homo sapiens
tcatctgctggtc

SEQ ID NO: 1148131 - DNA, 19 bp, Homo sapiens
tcatctggcaacatcttta

SEQ ID NO: 1148132 - DNA, 13 bp, Homo sapiens
tcatctgggaaag

SEQ ID NO: 1148133 - DNA, 15 bp, Homo sapiens
tcatctgggacaaaa

SEQ ID NO: 1148134 - DNA, 16 bp, Homo sapiens
tcatctggggacctgg

SEQ ID NO: 1148135 - DNA, 21 bp, Homo sapiens
tcatctgggtctcccaggaca

SEQ ID NO: 1148136 - DNA, 17 bp, Homo sapiens
tcatctgtagatactag

SEQ ID NO: 1148137 - DNA, 17 bp, Homo sapiens
tcatctgtgtgaaaatg

SEQ ID NO: 1148138 - DNA, 16 bp, Homo sapiens
tcatcttcctgtgtcc

SEQ ID NO: 1148139 - DNA, 19 bp, Homo sapiens
tcatcttcctgtgtcctga

SEQ ID NO: 1148140 - DNA, 13 bp, Homo sapiens
tcatcttctctgg

SEQ ID NO: 1148141 - DNA, 13 bp, Homo sapiens
tcatcttctggaa

SEQ ID NO: 1148142 - DNA, 11 bp, Homo sapiens
tcatcttgcta

SEQ ID NO: 1148143 - DNA, 17 bp, Homo sapiens
tcatcttgctaccagta

SEQ ID NO: 1148144 - DNA, 17 bp, Homo sapiens
tcatcttggagcttttt

SEQ ID NO: 1148145 - DNA, 22 bp, Homo sapiens
tcatcttggtactactagatgt

SEQ ID NO: 1148146 - DNA, 15 bp, Homo sapiens
tcatcttttgaagag

SEQ ID NO: 1148147 - DNA, 21 bp, Homo sapiens
tcatgaaaaagctgcttctta

SEQ ID NO: 1148148 - DNA, 18 bp, Homo sapiens
tcatgaaaagaggaacag

SEQ ID NO: 1148149 - DNA, 15 bp, Homo sapiens
tcatgaaaccaaaaa

SEQ ID NO: 1148150 - DNA, 18 bp, Homo sapiens
tcatgaacttggctgtaa

SEQ ID NO: 1148151 - DNA, 16 bp, Homo sapiens
tcatgaagcaggaggc

SEQ ID NO: 1148152 - DNA, 13 bp, Homo sapiens
tcatgaagccttg

SEQ ID NO: 1148153 - DNA, 13 bp, Homo sapiens
tcatgaatgcttt

SEQ ID NO: 1148154 - DNA, 14 bp, Homo sapiens
tcatgaatgtgctg

SEQ ID NO: 1148155 - DNA, 22 bp, Homo sapiens
tcatgaatgtgctggtgaacac

SEQ ID NO: 1148156 - DNA, 23 bp, Homo sapiens
tcatgaatttattgcacattgtt

SEQ ID NO: 1148157 - DNA, 12 bp, Homo sapiens
tcatgaatttta

SEQ ID NO: 1148158 - DNA, 16 bp, Homo sapiens
tcatgaattttaaagt

SEQ ID NO: 1148159 - DNA, 14 bp, Homo sapiens
tcatgacagcctcc

SEQ ID NO: 1148160 - DNA, 23 bp, Homo sapiens
tcatgacagtgcttgcatcctat

SEQ ID NO: 1148161 - DNA, 18 bp, Homo sapiens
tcatgaccactgggcctg

SEQ ID NO: 1148162 - DNA, 20 bp, Homo sapiens
tcatgaccactgggcctgct

SEQ ID NO: 1148163 - DNA, 16 bp, Homo sapiens
tcatgagaagccaagc

SEQ ID NO: 1148164 - DNA, 14 bp, Homo sapiens
tcatgagcccacca

SEQ ID NO: 1148165 - DNA, 14 bp, Homo sapiens
tcatgagcctgctg

SEQ ID NO: 1148166 - DNA, 17 bp, Homo sapiens
tcatgaggaaactactg

SEQ ID NO: 1148167 - DNA, 19 bp, Homo sapiens
tcatgaggaccagggtgga

SEQ ID NO: 1148168 - DNA, 19 bp, Homo sapiens
tcatgaggagggtggggga

SEQ ID NO: 1148169 - DNA, 19 bp, Homo sapiens
tcatgaggggaaagggaga

SEQ ID NO: 1148170 - DNA, 14 bp, Homo sapiens
tcatgaggggagag

SEQ ID NO: 1148171 - DNA, 23 bp, Homo sapiens
tcatgagtctacctgagcattca

SEQ ID NO: 1148172 - DNA, 13 bp, Homo sapiens
tcatgatctccct

SEQ ID NO: 1148173 - DNA, 16 bp, Homo sapiens
tcatgatctccctgcc

SEQ ID NO: 1148174 - DNA, 17 bp, Homo sapiens
tcatgatctccctgccg

SEQ ID NO: 1148175 - DNA, 22 bp, Homo sapiens
tcatgatctccctgccgcctca

SEQ ID NO: 1148176 - DNA, 18 bp, Homo sapiens
tcatgatcttgtgacata

SEQ ID NO: 1148177 - DNA, 16 bp, Homo sapiens
tcatgattagcaagtt

SEQ ID NO: 1148178 - DNA, 23 bp, Homo sapiens
tccagcgaggtgggagaggcctc

SEQ ID NO: 1148179 - DNA, 17 bp, Homo sapiens
tccagctatacaggaag

SEQ ID NO: 1148180 - DNA, 13 bp, Homo sapiens
tccagctcagccc

SEQ ID NO: 1148181 - DNA, 14 bp, Homo sapiens
tccagctcagccct

SEQ ID NO: 1148182 - DNA, 16 bp, Homo sapiens
tccagctcagccctgg

SEQ ID NO: 1148183 - DNA, 21 bp, Homo sapiens
tccagctcagccctggcctgg

SEQ ID NO: 1148184 - DNA, 10 bp, Homo sapiens
tccagctccc

SEQ ID NO: 1148185 - DNA, 15 bp, Homo sapiens
tccagctccctagac

SEQ ID NO: 1148186 - DNA, 21 bp, Homo sapiens
tccagctcctctaggggcagc

SEQ ID NO: 1148187 - DNA, 23 bp, Homo sapiens
tccagctcctctaggggcagcct

SEQ ID NO: 1148188 - DNA, 13 bp, Homo sapiens
tccagctctgaca

SEQ ID NO: 1148189 - DNA, 15 bp, Homo sapiens
tccagctctgacatc

SEQ ID NO: 1148190 - DNA, 16 bp, Homo sapiens
tccagctctgacatcc

SEQ ID NO: 1148191 - DNA, 20 bp, Homo sapiens
tccagctctgacatcccttc

SEQ ID NO: 1148192 - DNA, 21 bp, Homo sapiens
tccagctctgacatcccttcc

SEQ ID NO: 1148193 - DNA, 23 bp, Homo sapiens
tccagctctgacatcccttcctg

SEQ ID NO: 1148194 - DNA, 16 bp, Homo sapiens
tccagctctgcccccg

SEQ ID NO: 1148195 - DNA, 13 bp, Homo sapiens
tccagctctggag

SEQ ID NO: 1148196 - DNA, 20 bp, Homo sapiens
tccagctctggaggggaggg

SEQ ID NO: 1148197 - DNA, 16 bp, Homo sapiens
tccagctgagcgccag

SEQ ID NO: 1148198 - DNA, 16 bp, Homo sapiens
tccagctgcaccagag

SEQ ID NO: 1148199 - DNA, 13 bp, Homo sapiens
tccagctgccccg

SEQ ID NO: 1148200 - DNA, 15 bp, Homo sapiens
tccagctgcccctcc

SEQ ID NO: 1148201 - DNA, 17 bp, Homo sapiens
tccagctgctgtcttct

SEQ ID NO: 1148202 - DNA, 11 bp, Homo sapiens
tccagctggcc

SEQ ID NO: 1148203 - DNA, 15 bp, Homo sapiens
tccagctggccggga

SEQ ID NO: 1148204 - DNA, 17 bp, Homo sapiens
tccagctggcctggaca

SEQ ID NO: 1148205 - DNA, 18 bp, Homo sapiens
tccagctggcctggacag

SEQ ID NO: 1148206 - DNA, 18 bp, Homo sapiens
tccagctgggaagccctt

SEQ ID NO: 1148207 - DNA, 16 bp, Homo sapiens
tccagctgggacctaa

SEQ ID NO: 1148208 - DNA, 21 bp, Homo sapiens
tccagctgggacctaatgctg

SEQ ID NO: 1148209 - DNA, 23 bp, Homo sapiens
tccagctgggacctaatgctggc

SEQ ID NO: 1148210 - DNA, 21 bp, Homo sapiens
tccagctgtcgtctgactctg

SEQ ID NO: 1148211 - DNA, 16 bp, Homo sapiens
tccagcttcagctcaa

SEQ ID NO: 1148212 - DNA, 19 bp, Homo sapiens
tccagcttctggtactctc

SEQ ID NO: 1148213 - DNA, 22 bp, Homo sapiens
tccagctttggggacttccgct

SEQ ID NO: 1148214 - DNA, 20 bp, Homo sapiens
tccaggaaaaaataaaaaga

SEQ ID NO: 1148215 - DNA, 21 bp, Homo sapiens
tccaggaaactccacatctgc

SEQ ID NO: 1148216 - DNA, 23 bp, Homo sapiens
tccaggaaactccacatctgcct

SEQ ID NO: 1148217 - DNA, 20 bp, Homo sapiens
tccaggaaagagcagtcaga

SEQ ID NO: 1148218 - DNA, 21 bp, Homo sapiens
tccaggaaagagcagtcagag

SEQ ID NO: 1148219 - DNA, 20 bp, Homo sapiens
tccaggaaggcagctgctct

SEQ ID NO: 1148220 - DNA, 21 bp, Homo sapiens
tccaggaaggcagctgctctt

SEQ ID NO: 1148221 - DNA, 23 bp, Homo sapiens
tccaggaatgctgggcccccagc

SEQ ID NO: 1148222 - DNA, 22 bp, Homo sapiens
tccaggaattcctcttttgctt

SEQ ID NO: 1148223 - DNA, 15 bp, Homo sapiens
tccaggacatgatac

SEQ ID NO: 1148224 - DNA, 10 bp, Homo sapiens
tccaggactc

SEQ ID NO: 1148225 - DNA, 18 bp, Homo sapiens
tccaggagaaacctcaca

SEQ ID NO: 1148226 - DNA, 23 bp, Homo sapiens
tccaggagaaagccgggggaggg

SEQ ID NO: 1148227 - DNA, 23 bp, Homo sapiens
tccaggagaaggccaattcctat

SEQ ID NO: 1148228 - DNA, 23 bp, Homo sapiens
tccaggagaagggggctctgccc

SEQ ID NO: 1148229 - DNA, 16 bp, Homo sapiens
tccaggagacatatat

SEQ ID NO: 1148230 - DNA, 16 bp, Homo sapiens
tccaggagagagccag

SEQ ID NO: 1148231 - DNA, 21 bp, Homo sapiens
tccaggagataattgtttcat

SEQ ID NO: 1148232 - DNA, 13 bp, Homo sapiens
tccaggagcctgg

SEQ ID NO: 1148233 - DNA, 12 bp, Homo sapiens
tccaggagctca

SEQ ID NO: 1148234 - DNA, 21 bp, Homo sapiens
tccaggagctcaggaagaaga

SEQ ID NO: 1148235 - DNA, 19 bp, Homo sapiens
tccaggagggctaattaga

SEQ ID NO: 1148236 - DNA, 11 bp, Homo sapiens
tccaggagggg

SEQ ID NO: 1148237 - DNA, 13 bp, Homo sapiens
tccaggaggggcc

SEQ ID NO: 1148238 - DNA, 18 bp, Homo sapiens
tccaggaggggcctgggc

SEQ ID NO: 1148239 - DNA, 22 bp, Homo sapiens
tccaggaggggcctgggcagcc

SEQ ID NO: 1148240 - DNA, 18 bp, Homo sapiens
tccaggataaggagactg

SEQ ID NO: 1148241 - DNA, 19 bp, Homo sapiens
tccaggataaggagactga

SEQ ID NO: 1148242 - DNA, 23 bp, Homo sapiens
tccaggataaggagactgaggct

SEQ ID NO: 1148243 - DNA, 15 bp, Homo sapiens
tccaggatccagaag

SEQ ID NO: 1148244 - DNA, 18 bp, Homo sapiens
tccaggatcctgcaggaa

SEQ ID NO: 1148245 - DNA, 22 bp, Homo sapiens
tccaggatctccactgataaga

SEQ ID NO: 1148246 - DNA, 14 bp, Homo sapiens
tccaggatggaatt

SEQ ID NO: 1148247 - DNA, 21 bp, Homo sapiens
tccaggatggaattcttcctc

SEQ ID NO: 1148248 - DNA, 15 bp, Homo sapiens
tccaggatggagggt

SEQ ID NO: 1148249 - DNA, 16 bp, Homo sapiens
tccaggatggagggtc

SEQ ID NO: 1148250 - DNA, 15 bp, Homo sapiens
tccaggatttataaa

SEQ ID NO: 1148251 - DNA, 17 bp, Homo sapiens
tccaggatttataaagc

SEQ ID NO: 1148252 - DNA, 18 bp, Homo sapiens
tccaggatttataaagca

SEQ ID NO: 1148253 - DNA, 20 bp, Homo sapiens
tccaggatttataaagcaaa

SEQ ID NO: 1148254 - DNA, 19 bp, Homo sapiens
tccaggattttaatttcag

SEQ ID NO: 1148255 - DNA, 21 bp, Homo sapiens
tccaggattttaatttcagga

SEQ ID NO: 1148256 - DNA, 17 bp, Homo sapiens
tcccaaacttcggaaac

SEQ ID NO: 1148257 - DNA, 16 bp, Homo sapiens
tcccaaactttaaaat

SEQ ID NO: 1148258 - DNA, 17 bp, Homo sapiens
tcccaaactttaaaatg

SEQ ID NO: 1148259 - DNA, 20 bp, Homo sapiens
tcccaaactttaaaatgcga

SEQ ID NO: 1148260 - DNA, 21 bp, Homo sapiens
tcccaaactttaaaatgcgaa

SEQ ID NO: 1148261 - DNA, 19 bp, Homo sapiens
tcccaaagcacttttaaaa

SEQ ID NO: 1148262 - DNA, 16 bp, Homo sapiens
tcccaaagtcctctgc

SEQ ID NO: 1148263 - DNA, 18 bp, Homo sapiens
tcccaaagtcctctgctc

SEQ ID NO: 1148264 - DNA, 21 bp, Homo sapiens
tcccaaagtgctaggattaca

SEQ ID NO: 1148265 - DNA, 16 bp, Homo sapiens
tcccaaagtgctggga

SEQ ID NO: 1148266 - DNA, 20 bp, Homo sapiens
tcccaaagtgctgggattac

SEQ ID NO: 1148267 - DNA, 23 bp, Homo sapiens
tcccaaagtgctgggattacaga

SEQ ID NO: 1148268 - DNA, 14 bp, Homo sapiens
tcccaaatgagcca

SEQ ID NO: 1148269 - DNA, 20 bp, Homo sapiens
tcccaaatttgattgatttg

SEQ ID NO: 1148270 - DNA, 22 bp, Homo sapiens
tcccaaatttgattgatttgaa

SEQ ID NO: 1148271 - DNA, 16 bp, Homo sapiens
tcccaacagccatgcc

SEQ ID NO: 1148272 - DNA, 12 bp, Homo sapiens
tcccaacatggg

SEQ ID NO: 1148273 - DNA, 16 bp, Homo sapiens
tcccaacatgggaggg

SEQ ID NO: 1148274 - DNA, 17 bp, Homo sapiens
tcccaacattctgcaat

SEQ ID NO: 1148275 - DNA, 14 bp, Homo sapiens
tcccaacccccctc

SEQ ID NO: 1148276 - DNA, 15 bp, Homo sapiens
tcccaacccccctcc

SEQ ID NO: 1148277 - DNA, 23 bp, Homo sapiens
tcccaacctcaatgccctgccat

SEQ ID NO: 1148278 - DNA, 22 bp, Homo sapiens
tcccaacctctttttcctcctg

SEQ ID NO: 1148279 - DNA, 21 bp, Homo sapiens
tcccaacgagcctcctcaggg

SEQ ID NO: 1148280 - DNA, 17 bp, Homo sapiens
tcccaactctagctggg

SEQ ID NO: 1148281 - DNA, 21 bp, Homo sapiens
tcccaacttctcttgctttct

SEQ ID NO: 1148282 - DNA, 24 bp, Homo sapiens
tcccaagaccctgccccctgccag

SEQ ID NO: 1148283 - DNA, 18 bp, Homo sapiens
tcccaagctagtgagcaa

SEQ ID NO: 1148284 - DNA, 16 bp, Homo sapiens
tcccaagctcagaggc

SEQ ID NO: 1148285 - DNA, 22 bp, Homo sapiens
tcccaaggaagctccttcctgt

SEQ ID NO: 1148286 - DNA, 22 bp, Homo sapiens
tcccaaggagctgatttccagg

SEQ ID NO: 1148287 - DNA, 23 bp, Homo sapiens
tcccaaggagctgatttccaggc

SEQ ID NO: 1148288 - DNA, 20 bp, Homo sapiens
tcccaagggacagcaagtga

SEQ ID NO: 1148289 - DNA, 18 bp, Homo sapiens
tcccaaggtcctctcagt

SEQ ID NO: 1148290 - DNA, 20 bp, Homo sapiens
tcccaaggttggagcccagg

SEQ ID NO: 1148291 - DNA, 21 bp, Homo sapiens
tcccaagtaactgggattaca

SEQ ID NO: 1148292 - DNA, 15 bp, Homo sapiens
tcccaagtagctggg

SEQ ID NO: 1148293 - DNA, 21 bp, Homo sapiens
tcccaagtagctgggattaca

SEQ ID NO: 1148294 - DNA, 15 bp, Homo sapiens
tcccaagtatgcctt

SEQ ID NO: 1148295 - DNA, 21 bp, Homo sapiens
tcccaagtatgccttaagcag

SEQ ID NO: 1148296 - DNA, 21 bp, Homo sapiens
tcccaagtttccatagcaaca

SEQ ID NO: 1148297 - DNA, 22 bp, Homo sapiens
tcccaagtttccatagcaacag

SEQ ID NO: 1148298 - DNA, 14 bp, Homo sapiens
tcccaataaaagtg

SEQ ID NO: 1148299 - DNA, 15 bp, Homo sapiens
tcccaataaaagtga

SEQ ID NO: 1148300 - DNA, 16 bp, Homo sapiens
tcccaataaaagtgac

SEQ ID NO: 1148301 - DNA, 18 bp, Homo sapiens
tcccaatcaaagaattac

SEQ ID NO: 1148302 - DNA, 13 bp, Homo sapiens
tcccaatcagctt

SEQ ID NO: 1148303 - DNA, 22 bp, Homo sapiens
tcccaatcagcttttgttctag

SEQ ID NO: 1148304 - DNA, 20 bp, Homo sapiens
tcccaatctctacccctttc

SEQ ID NO: 1148305 - DNA, 21 bp, Homo sapiens
tcccaatctctacccctttct

SEQ ID NO: 1148306 - DNA, 22 bp, Homo sapiens
tcccaatctctacccctttctt

SEQ ID NO: 1148307 - DNA, 15 bp, Homo sapiens
tcccaatctgaaatt

SEQ ID NO: 1148308 - DNA, 21 bp, Homo sapiens
tcccaatctgaaattcaaaat

SEQ ID NO: 1148309 - DNA, 15 bp, Homo sapiens
tcccaatcttaccag

SEQ ID NO: 1148310 - DNA, 14 bp, Homo sapiens
tcccaatctttcta

SEQ ID NO: 1148311 - DNA, 15 bp, Homo sapiens
tcccaatctttctat

SEQ ID NO: 1148312 - DNA, 13 bp, Homo sapiens
tcccaattaaaat

SEQ ID NO: 1148313 - DNA, 16 bp, Homo sapiens
tcccaattcggggcct

SEQ ID NO: 1148314 - DNA, 17 bp, Homo sapiens
tcccaattcggggcctg

SEQ ID NO: 1148315 - DNA, 22 bp, Homo sapiens
tcccaattcggggcctgctgga

SEQ ID NO: 1148316 - DNA, 16 bp, Homo sapiens
tcccacaagtggtggt

SEQ ID NO: 1148317 - DNA, 23 bp, Homo sapiens
tcccacaatataaaactgtactt

SEQ ID NO: 1148318 - DNA, 14 bp, Homo sapiens
tcccacacccaccc

SEQ ID NO: 1148319 - DNA, 14 bp, Homo sapiens
tcccacacggcagc

SEQ ID NO: 1148320 - DNA, 23 bp, Homo sapiens
tcccacacggcagcccccccctc

SEQ ID NO: 1148321 - DNA, 22 bp, Homo sapiens
tcccacactgctaggtgggcca

SEQ ID NO: 1148322 - DNA, 21 bp, Homo sapiens
tcccacacttcccacccccag

SEQ ID NO: 1148323 - DNA, 17 bp, Homo sapiens
tcccacacttgctgggg

SEQ ID NO: 1148324 - DNA, 17 bp, Homo sapiens
tcccacacttgtgccag

SEQ ID NO: 1148325 - DNA, 19 bp, Homo sapiens
tcccacacttgtgccagcc

SEQ ID NO: 1148326 - DNA, 20 bp, Homo sapiens
tcccacacttgtgccagccc

SEQ ID NO: 1148327 - DNA, 21 bp, Homo sapiens
tcccacacttgtgccagcccg

SEQ ID NO: 1148328 - DNA, 15 bp, Homo sapiens
tcccacagagtgctg

SEQ ID NO: 1148329 - DNA, 17 bp, Homo sapiens
tcccacagagtgctgga

SEQ ID NO: 1148330 - DNA, 21 bp, Homo sapiens
tcccacagagtgctggactgt

SEQ ID NO: 1148331 - DNA, 18 bp, Homo sapiens
tcccacaggacatttctc

SEQ ID NO: 1148332 - DNA, 13 bp, Homo sapiens
tcccacatgggcc

SEQ ID NO: 1148333 - DNA, 16 bp, Homo sapiens
tcccacatgggcccag

SEQ ID NO: 1148334 - DNA, 14 bp, Homo sapiens
tcccaccaacaaaa

SEQ ID NO: 1148335 - DNA, 18 bp, Homo sapiens
tcccaccaacctccagtg

SEQ ID NO: 1148336 - DNA, 21 bp, Homo sapiens
tcccaccaactctgcactcca

SEQ ID NO: 1148337 - DNA, 23 bp, Homo sapiens
tcccaccaactctgcactccatg

SEQ ID NO: 1148338 - DNA, 20 bp, Homo sapiens
tcccaccaccttggactcct

SEQ ID NO: 1148339 - DNA, 19 bp, Homo sapiens
tcccaccagaacgcacccc

SEQ ID NO: 1148340 - DNA, 15 bp, Homo sapiens
tcccaccattcctgc

SEQ ID NO: 1148341 - DNA, 22 bp, Homo sapiens
tcccacccacccgccgcctccc

SEQ ID NO: 1148342 - DNA, 13 bp, Homo sapiens
tcccaccccaccc

SEQ ID NO: 1148343 - DNA, 18 bp, Homo sapiens
tcccaccccacccccttc

SEQ ID NO: 1148344 - DNA, 22 bp, Homo sapiens
tccttttgacactgctctaaca

SEQ ID NO: 1148345 - DNA, 18 bp, Homo sapiens
tccttttgaccttcattt

SEQ ID NO: 1148346 - DNA, 14 bp, Homo sapiens
tccttttgatgggg

SEQ ID NO: 1148347 - DNA, 17 bp, Homo sapiens
tccttttgatggggaga

SEQ ID NO: 1148348 - DNA, 17 bp, Homo sapiens
tccttttgcctgcaggt

SEQ ID NO: 1148349 - DNA, 14 bp, Homo sapiens
tccttttgctgtct

SEQ ID NO: 1148350 - DNA, 16 bp, Homo sapiens
tccttttgctgtcttt

SEQ ID NO: 1148351 - DNA, 20 bp, Homo sapiens
tccttttgctgtctttctct

SEQ ID NO: 1148352 - DNA, 16 bp, Homo sapiens
tccttttggaacattt

SEQ ID NO: 1148353 - DNA, 19 bp, Homo sapiens
tccttttggaacatttctt

SEQ ID NO: 1148354 - DNA, 16 bp, Homo sapiens
tcctttttaaatgtga

SEQ ID NO: 1148355 - DNA, 12 bp, Homo sapiens
tcctttttaata

SEQ ID NO: 1148356 - DNA, 17 bp, Homo sapiens
tcctttttaatatgctt

SEQ ID NO: 1148357 - DNA, 20 bp, Homo sapiens
tcctttttccaatgttttat

SEQ ID NO: 1148358 - DNA, 18 bp, Homo sapiens
tcctttttcccaataaat

SEQ ID NO: 1148359 - DNA, 14 bp, Homo sapiens
tcctttttgacact

SEQ ID NO: 1148360 - DNA, 16 bp, Homo sapiens
tcctttttgacactga

SEQ ID NO: 1148361 - DNA, 17 bp, Homo sapiens
tcctttttgacactgaa

SEQ ID NO: 1148362 - DNA, 18 bp, Homo sapiens
tccttttttcaatatgca

SEQ ID NO: 1148363 - DNA, 12 bp, Homo sapiens
tccttttttccc

SEQ ID NO: 1148364 - DNA, 22 bp, Homo sapiens
tccttttttcccataagacaat

SEQ ID NO: 1148365 - DNA, 13 bp, Homo sapiens
tccttttttctct

SEQ ID NO: 1148366 - DNA, 19 bp, Homo sapiens
tccttttttgtctatgaag

SEQ ID NO: 1148367 - DNA, 14 bp, Homo sapiens
tcctttttttgtac

SEQ ID NO: 1148368 - DNA, 12 bp, Homo sapiens
tcgaaaaaataa

SEQ ID NO: 1148369 - DNA, 13 bp, Homo sapiens
tcgaaacacagaa

SEQ ID NO: 1148370 - DNA, 19 bp, Homo sapiens
tcgaaacctgggattcagg

SEQ ID NO: 1148371 - DNA, 13 bp, Homo sapiens
tcgaaactgccaa

SEQ ID NO: 1148372 - DNA, 17 bp, Homo sapiens
tcgaaactgccaagggt

SEQ ID NO: 1148373 - DNA, 19 bp, Homo sapiens
tcgaaatttgttgtttgtt

SEQ ID NO: 1148374 - DNA, 19 bp, Homo sapiens
tcgaaccaaggcagcctcc

SEQ ID NO: 1148375 - DNA, 17 bp, Homo sapiens
tcgaactcctggcctcg

SEQ ID NO: 1148376 - DNA, 14 bp, Homo sapiens
tcgaacttcacaac

SEQ ID NO: 1148377 - DNA, 15 bp, Homo sapiens
tcgaagatatacaaa

SEQ ID NO: 1148378 - DNA, 23 bp, Homo sapiens
tcgaagccttgcctaaatttaat

SEQ ID NO: 1148379 - DNA, 18 bp, Homo sapiens
tcgaagctcagcccaccc

SEQ ID NO: 1148380 - DNA, 19 bp, Homo sapiens
tcgaagtgtttatgtaata

SEQ ID NO: 1148381 - DNA, 23 bp, Homo sapiens
tcgaatagggaagtaaaaaaaca

SEQ ID NO: 1148382 - DNA, 17 bp, Homo sapiens
tcgaatatagttctgtg

SEQ ID NO: 1148383 - DNA, 17 bp, Homo sapiens
tcgaatgaaattaactg

SEQ ID NO: 1148384 - DNA, 15 bp, Homo sapiens
tcgaatgacactgtt

SEQ ID NO: 1148385 - DNA, 21 bp, Homo sapiens
tcgaattaatagcttttattg

SEQ ID NO: 1148386 - DNA, 16 bp, Homo sapiens
tcgaattctcagacga

SEQ ID NO: 1148387 - DNA, 13 bp, Homo sapiens
tcgacaccccccc

SEQ ID NO: 1148388 - DNA, 18 bp, Homo sapiens
tcgacacccccccaaccc

SEQ ID NO: 1148389 - DNA, 18 bp, Homo sapiens
tcgacagggcctggagcc

SEQ ID NO: 1148390 - DNA, 21 bp, Homo sapiens
tcgacagggcctggagcccca

SEQ ID NO: 1148391 - DNA, 17 bp, Homo sapiens
tcgaccaattcaaccct

SEQ ID NO: 1148392 - DNA, 22 bp, Homo sapiens
tcgaccacagcaagccatcatc

SEQ ID NO: 1148393 - DNA, 21 bp, Homo sapiens
tcgactactgctcctgtggca

SEQ ID NO: 1148394 - DNA, 23 bp, Homo sapiens
tcgactactgctcctgtggcagg

SEQ ID NO: 1148395 - DNA, 14 bp, Homo sapiens
tcgactcagcacca

SEQ ID NO: 1148396 - DNA, 15 bp, Homo sapiens
tcgactcagcaccac

SEQ ID NO: 1148397 - DNA, 16 bp, Homo sapiens
tcgactcaggatccag

SEQ ID NO: 1148398 - DNA, 21 bp, Homo sapiens
tcgactcaggatccagtccct

SEQ ID NO: 1148399 - DNA, 17 bp, Homo sapiens
tcgactggtccagctct

SEQ ID NO: 1148400 - DNA, 19 bp, Homo sapiens
tcgactggtccagctctga

SEQ ID NO: 1148401 - DNA, 20 bp, Homo sapiens
tcgactggtccagctctgac

SEQ ID NO: 1148402 - DNA, 16 bp, Homo sapiens
tcgacttatttcttaa

SEQ ID NO: 1148403 - DNA, 19 bp, Homo sapiens
tcgagaaagaggcaccagg

SEQ ID NO: 1148404 - DNA, 21 bp, Homo sapiens
tcgagaaagaggcaccaggaa

SEQ ID NO: 1148405 - DNA, 18 bp, Homo sapiens
tcgagaccaacctgacca

SEQ ID NO: 1148406 - DNA, 13 bp, Homo sapiens
tcgagaccagcct

SEQ ID NO: 1148407 - DNA, 16 bp, Homo sapiens
tcgagaccagcctggc

SEQ ID NO: 1148408 - DNA, 14 bp, Homo sapiens
tcgagaccagtctg

SEQ ID NO: 1148409 - DNA, 15 bp, Homo sapiens
tcgagaccatcctgg

SEQ ID NO: 1148410 - DNA, 20 bp, Homo sapiens
tcgagaccatcctggccaac

SEQ ID NO: 1148411 - DNA, 18 bp, Homo sapiens
tcgagaccatcctggccc

SEQ ID NO: 1148412 - DNA, 21 bp, Homo sapiens
tcgagaccatcctggcccctc

SEQ ID NO: 1148413 - DNA, 20 bp, Homo sapiens
tcgagagaggcgggccccag

SEQ ID NO: 1148414 - DNA, 21 bp, Homo sapiens
tcgagcagtcctgcctcagcc

SEQ ID NO: 1148415 - DNA, 19 bp, Homo sapiens
tcgagcatgttgttttttc

SEQ ID NO: 1148416 - DNA, 15 bp, Homo sapiens
tcgagccctccccca

SEQ ID NO: 1148417 - DNA, 17 bp, Homo sapiens
tcgaggagtaacaatac

SEQ ID NO: 1148418 - DNA, 20 bp, Homo sapiens
tcgaggcaccggcgctgcag

SEQ ID NO: 1148419 - DNA, 22 bp, Homo sapiens
tcgaggcaccggcgctgcaggt

SEQ ID NO: 1148420 - DNA, 16 bp, Homo sapiens
tcgaggcctacagagg

SEQ ID NO: 1148421 - DNA, 11 bp, Homo sapiens
tcgaggcctga

SEQ ID NO: 1148422 - DNA, 14 bp, Homo sapiens
tcgagggccgcctg

SEQ ID NO: 1148423 - DNA, 15 bp, Homo sapiens
tcgagggccgcctgc

SEQ ID NO: 1148424 - DNA, 20 bp, Homo sapiens
tcgaggggtgggctggtatc

SEQ ID NO: 1148425 - DNA, 18 bp, Homo sapiens
tcgagtcacattctgctt

SEQ ID NO: 1148426 - DNA, 16 bp, Homo sapiens
tccttgatatcattca

SEQ ID NO: 1148427 - DNA, 16 bp, Homo sapiens
tccttgatctgtatat

SEQ ID NO: 1148428 - DNA, 15 bp, Homo sapiens
tccttgatgccagag

SEQ ID NO: 1148429 - DNA, 17 bp, Homo sapiens
tccttgatgccagaggg

SEQ ID NO: 1148430 - DNA, 18 bp, Homo sapiens
tccttgatgccagagggc

SEQ ID NO: 1148431 - DNA, 15 bp, Homo sapiens
tccttgcaaccaggc

SEQ ID NO: 1148432 - DNA, 21 bp, Homo sapiens
tccttgcaaccaggcagctga

SEQ ID NO: 1148433 - DNA, 21 bp, Homo sapiens
tccttgcaaggttaagcaagg

SEQ ID NO: 1148434 - DNA, 24 bp, Homo sapiens
tccttgcacccctcactctggcct

SEQ ID NO: 1148435 - DNA, 15 bp, Homo sapiens
tccttgcagcagggc

SEQ ID NO: 1148436 - DNA, 18 bp, Homo sapiens
tccttgcctcctgtgtaa

SEQ ID NO: 1148437 - DNA, 18 bp, Homo sapiens
tccttgcctgaactccag

SEQ ID NO: 1148438 - DNA, 13 bp, Homo sapiens
tccttgcctgtct

SEQ ID NO: 1148439 - DNA, 12 bp, Homo sapiens
tccttgccttaa

SEQ ID NO: 1148440 - DNA, 16 bp, Homo sapiens
tccttgcgcctcagcc

SEQ ID NO: 1148441 - DNA, 21 bp, Homo sapiens
tccttgcgtcccatgaggtct

SEQ ID NO: 1148442 - DNA, 15 bp, Homo sapiens
tccttgctatgatga

SEQ ID NO: 1148443 - DNA, 14 bp, Homo sapiens
tccttgctctccct

SEQ ID NO: 1148444 - DNA, 16 bp, Homo sapiens
tccttgctgaccccag

SEQ ID NO: 1148445 - DNA, 14 bp, Homo sapiens
tccttgctgcagct

SEQ ID NO: 1148446 - DNA, 12 bp, Homo sapiens
tccttggaaacc

SEQ ID NO: 1148447 - DNA, 22 bp, Homo sapiens
tccttggaaaccgtgtgtccag

SEQ ID NO: 1148448 - DNA, 16 bp, Homo sapiens
tccttggagagcagct

SEQ ID NO: 1148449 - DNA, 22 bp, Homo sapiens
tccttggatcctgaatctgtgc

SEQ ID NO: 1148450 - DNA, 13 bp, Homo sapiens
tccttggcacccc

SEQ ID NO: 1148451 - DNA, 18 bp, Homo sapiens
tccttggcacccccatgc

SEQ ID NO: 1148452 - DNA, 19 bp, Homo sapiens
tccttggcacccccatgct

SEQ ID NO: 1148453 - DNA, 20 bp, Homo sapiens
tccttggcatcacagggcag

SEQ ID NO: 1148454 - DNA, 15 bp, Homo sapiens
tccttggccacagac

SEQ ID NO: 1148455 - DNA, 17 bp, Homo sapiens
tccttggcggacactgg

SEQ ID NO: 1148456 - DNA, 19 bp, Homo sapiens
tccttggctgtctgtgggc

SEQ ID NO: 1148457 - DNA, 17 bp, Homo sapiens
tccttggcttgcctggt

SEQ ID NO: 1148458 - DNA, 22 bp, Homo sapiens
tccttggctttcagagccagcc

SEQ ID NO: 1148459 - DNA, 18 bp, Homo sapiens
tccttgggcgtctccccc

SEQ ID NO: 1148460 - DNA, 19 bp, Homo sapiens
tccttgggcgtctccccca

SEQ ID NO: 1148461 - DNA, 20 bp, Homo sapiens
tccttgggcgtctcccccag

SEQ ID NO: 1148462 - DNA, 22 bp, Homo sapiens
tccttgggcgtctcccccagag

SEQ ID NO: 1148463 - DNA, 23 bp, Homo sapiens
tccttgggcgtctcccccagagt

SEQ ID NO: 1148464 - DNA, 17 bp, Homo sapiens
tccttggtgtggaggtg

SEQ ID NO: 1148465 - DNA, 16 bp, Homo sapiens
tccttggttatatttt

SEQ ID NO: 1148466 - DNA, 16 bp, Homo sapiens
tccttggttatgtgca

SEQ ID NO: 1148467 - DNA, 19 bp, Homo sapiens
tccttgtcaatactgagcc

SEQ ID NO: 1148468 - DNA, 19 bp, Homo sapiens
tccttgtcttttgagctat

SEQ ID NO: 1148469 - DNA, 21 bp, Homo sapiens
tccttgtggactggctgtgcc

SEQ ID NO: 1148470 - DNA, 14 bp, Homo sapiens
tccttgtgttacta

SEQ ID NO: 1148471 - DNA, 18 bp, Homo sapiens
tccttgttggtcagagga

SEQ ID NO: 1148472 - DNA, 14 bp, Homo sapiens
tccttgttgttggt

SEQ ID NO: 1148473 - DNA, 20 bp, Homo sapiens
tccttgtttatcagatacat

SEQ ID NO: 1148474 - DNA, 20 bp, Homo sapiens
tcctttacaactaaataaca

SEQ ID NO: 1148475 - DNA, 23 bp, Homo sapiens
tcctttacaactaaataacacag

SEQ ID NO: 1148476 - DNA, 22 bp, Homo sapiens
tcctttacacattcggctccct

SEQ ID NO: 1148477 - DNA, 15 bp, Homo sapiens
tcctttaccttttct

SEQ ID NO: 1148478 - DNA, 16 bp, Homo sapiens
tcctttactgaatgta

SEQ ID NO: 1148479 - DNA, 13 bp, Homo sapiens
tcctttactttcc

SEQ ID NO: 1148480 - DNA, 18 bp, Homo sapiens
tcctttactttcccttgc

SEQ ID NO: 1148481 - DNA, 17 bp, Homo sapiens
tcctttaggcagcctgc

SEQ ID NO: 1148482 - DNA, 21 bp, Homo sapiens
tcctttaggcagcctgccgcc

SEQ ID NO: 1148483 - DNA, 16 bp, Homo sapiens
tcctttaggtaagaag

SEQ ID NO: 1148484 - DNA, 12 bp, Homo sapiens
tcctttatagag

SEQ ID NO: 1148485 - DNA, 18 bp, Homo sapiens
tcctttatattttttgtc

SEQ ID NO: 1148486 - DNA, 18 bp, Homo sapiens
tcctttatccacttttct

SEQ ID NO: 1148487 - DNA, 15 bp, Homo sapiens
tcctttatctgtaat

SEQ ID NO: 1148488 - DNA, 15 bp, Homo sapiens
tcctttatgtgaatt

SEQ ID NO: 1148489 - DNA, 20 bp, Homo sapiens
tcctttatgtgaatttttaa

SEQ ID NO: 1148490 - DNA, 23 bp, Homo sapiens
tcctttatgtgaatttttaagct

SEQ ID NO: 1148491 - DNA, 18 bp, Homo sapiens
tcctttattattctgtat

SEQ ID NO: 1148492 - DNA, 15 bp, Homo sapiens
tcctttattgcagtt

SEQ ID NO: 1148493 - DNA, 12 bp, Homo sapiens
tcctttatttag

SEQ ID NO: 1148494 - DNA, 19 bp, Homo sapiens
tcctttcacaaccttctgt

SEQ ID NO: 1148495 - DNA, 16 bp, Homo sapiens
tcctttcacacatctg

SEQ ID NO: 1148496 - DNA, 21 bp, Homo sapiens
tcctttcagggaatttcagga

SEQ ID NO: 1148497 - DNA, 21 bp, Homo sapiens
tcctttccaatagaaagaaac

SEQ ID NO: 1148498 - DNA, 13 bp, Homo sapiens
tcctttccctctc

SEQ ID NO: 1148499 - DNA, 17 bp, Homo sapiens
tcctttccctctcccag

SEQ ID NO: 1148500 - DNA, 15 bp, Homo sapiens
tcctttccctggagc

SEQ ID NO: 1148501 - DNA, 13 bp, Homo sapiens
tcctcttcctctg

SEQ ID NO: 1148502 - DNA, 16 bp, Homo sapiens
tcctcttcctctgagg

SEQ ID NO: 1148503 - DNA, 17 bp, Homo sapiens
tcctcttctgacgtgcc

SEQ ID NO: 1148504 - DNA, 13 bp, Homo sapiens
tcctcttgactct

SEQ ID NO: 1148505 - DNA, 20 bp, Homo sapiens
tcctcttgatctcaaagcac

SEQ ID NO: 1148506 - DNA, 21 bp, Homo sapiens
tcctcttgattcctggtttga

SEQ ID NO: 1148507 - DNA, 13 bp, Homo sapiens
tcctcttgctcaa

SEQ ID NO: 1148508 - DNA, 19 bp, Homo sapiens
tcctcttggcaagatgttt

SEQ ID NO: 1148509 - DNA, 16 bp, Homo sapiens
tcctcttggtgggtgt

SEQ ID NO: 1148510 - DNA, 23 bp, Homo sapiens
tcctcttggtgggtgtggccagc

SEQ ID NO: 1148511 - DNA, 21 bp, Homo sapiens
tcctcttgtatacttgtattc

SEQ ID NO: 1148512 - DNA, 17 bp, Homo sapiens
tcctctttactctgggc

SEQ ID NO: 1148513 - DNA, 15 bp, Homo sapiens
tcctctttctgctct

SEQ ID NO: 1148514 - DNA, 15 bp, Homo sapiens
tcctctttgctttgc

SEQ ID NO: 1148515 - DNA, 21 bp, Homo sapiens
tcctcttttcctggcagctgc

SEQ ID NO: 1148516 - DNA, 22 bp, Homo sapiens
tcctcttttcctggcagctgct

SEQ ID NO: 1148517 - DNA, 21 bp, Homo sapiens
tcctcttttgtgctgcttctc

SEQ ID NO: 1148518 - DNA, 23 bp, Homo sapiens
tcctgaaaaggtttatgaaaaag

SEQ ID NO: 1148519 - DNA, 20 bp, Homo sapiens
tcctgaaacccaaagccctg

SEQ ID NO: 1148520 - DNA, 22 bp, Homo sapiens
tcctgaaacccaaagccctggt

SEQ ID NO: 1148521 - DNA, 23 bp, Homo sapiens
tcctgaaacccaaagccctggta

SEQ ID NO: 1148522 - DNA, 18 bp, Homo sapiens
tcctgaaagaaacagtta

SEQ ID NO: 1148523 - DNA, 16 bp, Homo sapiens
tcctgaaagggcactt

SEQ ID NO: 1148524 - DNA, 13 bp, Homo sapiens
tcctgaaatataa

SEQ ID NO: 1148525 - DNA, 18 bp, Homo sapiens
tcctgaaatgccaagtgc

SEQ ID NO: 1148526 - DNA, 18 bp, Homo sapiens
tcctgaaccgactgaccc

SEQ ID NO: 1148527 - DNA, 23 bp, Homo sapiens
tcctgaaccgactgaccctgagg

SEQ ID NO: 1148528 - DNA, 19 bp, Homo sapiens
tcctgaaccgcacagctca

SEQ ID NO: 1148529 - DNA, 22 bp, Homo sapiens
tcctgaaccgcacagctcagga

SEQ ID NO: 1148530 - DNA, 23 bp, Homo sapiens
tcctgaaccgcacagctcaggag

SEQ ID NO: 1148531 - DNA, 17 bp, Homo sapiens
tcctgaactttctccct

SEQ ID NO: 1148532 - DNA, 19 bp, Homo sapiens
tcctgaactttctccctca

SEQ ID NO: 1148533 - DNA, 21 bp, Homo sapiens
tcctgaactttctccctcatc

SEQ ID NO: 1148534 - DNA, 21 bp, Homo sapiens
tcctgaagaggcgggccagcc

SEQ ID NO: 1148535 - DNA, 22 bp, Homo sapiens
tcctgaagaggcgggccagcca

SEQ ID NO: 1148536 - DNA, 19 bp, Homo sapiens
tcctgaagatcaagccagt

SEQ ID NO: 1148537 - DNA, 21 bp, Homo sapiens
tcctgaagccagatccaccct

SEQ ID NO: 1148538 - DNA, 13 bp, Homo sapiens
tcctgaagcctct

SEQ ID NO: 1148539 - DNA, 17 bp, Homo sapiens
tcctgaagcctctgccc

SEQ ID NO: 1148540 - DNA, 15 bp, Homo sapiens
tcctgaagctgctgt

SEQ ID NO: 1148541 - DNA, 16 bp, Homo sapiens
tcctgaagctgctgtg

SEQ ID NO: 1148542 - DNA, 19 bp, Homo sapiens
tcctgaagctgctgtgtcc

SEQ ID NO: 1148543 - DNA, 15 bp, Homo sapiens
tcctgaagggaaggc

SEQ ID NO: 1148544 - DNA, 16 bp, Homo sapiens
tcctgaagttgctgct

SEQ ID NO: 1148545 - DNA, 16 bp, Homo sapiens
tcctgaatacaagcct

SEQ ID NO: 1148546 - DNA, 14 bp, Homo sapiens
tcctgaatctgtgc

SEQ ID NO: 1148547 - DNA, 16 bp, Homo sapiens
tcctgaatctgtgcaa

SEQ ID NO: 1148548 - DNA, 14 bp, Homo sapiens
tcctgaatgaaata

SEQ ID NO: 1148549 - DNA, 13 bp, Homo sapiens
tcctgacaaatat

SEQ ID NO: 1148550 - DNA, 22 bp, Homo sapiens
tcctgacaagttcctaggaaaa

SEQ ID NO: 1148551 - DNA, 16 bp, Homo sapiens
tcctgacagaaggtgc

SEQ ID NO: 1148552 - DNA, 20 bp, Homo sapiens
tcctgacatattcaagtgat

SEQ ID NO: 1148553 - DNA, 20 bp, Homo sapiens
tcctgaccaagactgagcca

SEQ ID NO: 1148554 - DNA, 13 bp, Homo sapiens
tcctgaccaccct

SEQ ID NO: 1148555 - DNA, 20 bp, Homo sapiens
tcctgaccaccctcccctct

SEQ ID NO: 1148556 - DNA, 16 bp, Homo sapiens
tcctgacccaggccgc

SEQ ID NO: 1148557 - DNA, 23 bp, Homo sapiens
tcctgacccctccctgcaggggc

SEQ ID NO: 1148558 - DNA, 15 bp, Homo sapiens
tcctgacccctgcct

SEQ ID NO: 1148559 - DNA, 12 bp, Homo sapiens
tcctgaccctcc

SEQ ID NO: 1148560 - DNA, 19 bp, Homo sapiens
tcctgaccctcccactccc

SEQ ID NO: 1148561 - DNA, 16 bp, Homo sapiens
tcctgacctccgccat

SEQ ID NO: 1148562 - DNA, 20 bp, Homo sapiens
tcctgacctccgccatccac

SEQ ID NO: 1148563 - DNA, 23 bp, Homo sapiens
tcctgacctgcgggtcctcagct

SEQ ID NO: 1148564 - DNA, 22 bp, Homo sapiens
tcctgacgaaactggccccgga

SEQ ID NO: 1148565 - DNA, 13 bp, Homo sapiens
tcctgacgccctg

SEQ ID NO: 1148566 - DNA, 20 bp, Homo sapiens
tcctgactctcacctgtact

SEQ ID NO: 1148567 - DNA, 17 bp, Homo sapiens
tcctgacttgagtgttc

SEQ ID NO: 1148568 - DNA, 17 bp, Homo sapiens
tcctgactttgccccct

SEQ ID NO: 1148569 - DNA, 19 bp, Homo sapiens
tcctgagaaaaaaggttcc

SEQ ID NO: 1148570 - DNA, 18 bp, Homo sapiens
tcctggggccccgctggg

SEQ ID NO: 1148571 - DNA, 19 bp, Homo sapiens
tcctggggccccgctggga

SEQ ID NO: 1148572 - DNA, 21 bp, Homo sapiens
tcctggggccccgctgggatt

SEQ ID NO: 1148573 - DNA, 18 bp, Homo sapiens
tcctggggccgcctgccc

SEQ ID NO: 1148574 - DNA, 22 bp, Homo sapiens
tcctggggcctcggagcctcat

SEQ ID NO: 1148575 - DNA, 16 bp, Homo sapiens
tcctggggctcccttc

SEQ ID NO: 1148576 - DNA, 22 bp, Homo sapiens
tcctggggctggaatgctgggt

SEQ ID NO: 1148577 - DNA, 23 bp, Homo sapiens
tcctgggggcctgggttgggggc

SEQ ID NO: 1148578 - DNA, 14 bp, Homo sapiens
tcctgggggctggc

SEQ ID NO: 1148579 - DNA, 15 bp, Homo sapiens
tcctgggggctggct

SEQ ID NO: 1148580 - DNA, 23 bp, Homo sapiens
tcctgggggttctttcttcctct

SEQ ID NO: 1148581 - DNA, 16 bp, Homo sapiens
tcctgggtgggtgggg

SEQ ID NO: 1148582 - DNA, 23 bp, Homo sapiens
tcctgggttcaagcaatcctcct

SEQ ID NO: 1148583 - DNA, 18 bp, Homo sapiens
tcctgggttctggggcat

SEQ ID NO: 1148584 - DNA, 17 bp, Homo sapiens
tcctgggttggagggaa

SEQ ID NO: 1148585 - DNA, 20 bp, Homo sapiens
tcctgggtttcatgttctgt

SEQ ID NO: 1148586 - DNA, 17 bp, Homo sapiens
tcctgggttttgtattc

SEQ ID NO: 1148587 - DNA, 20 bp, Homo sapiens
tcctgggttttgtattctct

SEQ ID NO: 1148588 - DNA, 18 bp, Homo sapiens
tcctggtacccagccatc

SEQ ID NO: 1148589 - DNA, 19 bp, Homo sapiens
tcctggtcctggctgcact

SEQ ID NO: 1148590 - DNA, 22 bp, Homo sapiens
tcctggtcggggcttggaagag

SEQ ID NO: 1148591 - DNA, 14 bp, Homo sapiens
tcctggtctgtgaa

SEQ ID NO: 1148592 - DNA, 20 bp, Homo sapiens
tcctggtcttgagatgtctt

SEQ ID NO: 1148593 - DNA, 17 bp, Homo sapiens
tcctggtctttgtttga

SEQ ID NO: 1148594 - DNA, 13 bp, Homo sapiens
tcctggtcttttt

SEQ ID NO: 1148595 - DNA, 22 bp, Homo sapiens
tcctggtgaggcccagcctgtc

SEQ ID NO: 1148596 - DNA, 24 bp, Homo sapiens
tcctggtgaggcccagcctgtcct

SEQ ID NO: 1148597 - DNA, 21 bp, Homo sapiens
tcctggtgccaatttcaagtt

SEQ ID NO: 1148598 - DNA, 12 bp, Homo sapiens
tcctggtgccct

SEQ ID NO: 1148599 - DNA, 13 bp, Homo sapiens
tcctggtgccctg

SEQ ID NO: 1148600 - DNA, 16 bp, Homo sapiens
tcctggtgctctctgc

SEQ ID NO: 1148601 - DNA, 19 bp, Homo sapiens
tcctggtgctctctgccac

SEQ ID NO: 1148602 - DNA, 16 bp, Homo sapiens
tcctggtggtattttc

SEQ ID NO: 1148603 - DNA, 23 bp, Homo sapiens
tcctggttcccgtttctccacct

SEQ ID NO: 1148604 - DNA, 10 bp, Homo sapiens
tcctggtttc

SEQ ID NO: 1148605 - DNA, 22 bp, Homo sapiens
tcctggtttcataacttcctgt

SEQ ID NO: 1148606 - DNA, 18 bp, Homo sapiens
tcctgtaaataagagttg

SEQ ID NO: 1148607 - DNA, 21 bp, Homo sapiens
tcctgtaacacaagccacaga

SEQ ID NO: 1148608 - DNA, 23 bp, Homo sapiens
tcctgtaacacaagccacagaag

SEQ ID NO: 1148609 - DNA, 13 bp, Homo sapiens
tcctgtaactgtt

SEQ ID NO: 1148610 - DNA, 19 bp, Homo sapiens
tcctgtaactgttacagta

SEQ ID NO: 1148611 - DNA, 17 bp, Homo sapiens
tcctgtacactgaatat

SEQ ID NO: 1148612 - DNA, 18 bp, Homo sapiens
tcctgtacttgtcctcag

SEQ ID NO: 1148613 - DNA, 19 bp, Homo sapiens
tcctgtacttgtcctcagc

SEQ ID NO: 1148614 - DNA, 21 bp, Homo sapiens
tcctgtacttgtcctcagctt

SEQ ID NO: 1148615 - DNA, 22 bp, Homo sapiens
tcctgtagccttctgtaggaat

SEQ ID NO: 1148616 - DNA, 21 bp, Homo sapiens
tcctgtagctttaaaaccaca

SEQ ID NO: 1148617 - DNA, 14 bp, Homo sapiens
tcctgtataagcac

SEQ ID NO: 1148618 - DNA, 17 bp, Homo sapiens
tcctgtcactcactgag

SEQ ID NO: 1148619 - DNA, 20 bp, Homo sapiens
tcctgtcactcactgaggcc

SEQ ID NO: 1148620 - DNA, 24 bp, Homo sapiens
tcctgtcactgagcacagtcaggg

SEQ ID NO: 1148621 - DNA, 15 bp, Homo sapiens
tcctgtcactgatgg

SEQ ID NO: 1148622 - DNA, 16 bp, Homo sapiens
tcctgtcactgatgga

SEQ ID NO: 1148623 - DNA, 14 bp, Homo sapiens
tcctgtcattcctc

SEQ ID NO: 1148624 - DNA, 22 bp, Homo sapiens
tcctgtccacacccagctcagc

SEQ ID NO: 1148625 - DNA, 14 bp, Homo sapiens
tcctgtcccagagg

SEQ ID NO: 1148626 - DNA, 15 bp, Homo sapiens
tcctgtcccagaggt

SEQ ID NO: 1148627 - DNA, 18 bp, Homo sapiens
tcctgtcccgccttcctc

SEQ ID NO: 1148628 - DNA, 12 bp, Homo sapiens
tcctgtccctga

SEQ ID NO: 1148629 - DNA, 12 bp, Homo sapiens
tcctgtccctgt

SEQ ID NO: 1148630 - DNA, 13 bp, Homo sapiens
tcctgtccctgta

SEQ ID NO: 1148631 - DNA, 16 bp, Homo sapiens
tcctgtccctgtagct

SEQ ID NO: 1148632 - DNA, 18 bp, Homo sapiens
tcctgtcccttctcttaa

SEQ ID NO: 1148633 - DNA, 19 bp, Homo sapiens
tccgcgggctgactgggcc

SEQ ID NO: 1148634 - DNA, 23 bp, Homo sapiens
tccgcgggctgactgggccacag

SEQ ID NO: 1148635 - DNA, 16 bp, Homo sapiens
tccgctaaatatttac

SEQ ID NO: 1148636 - DNA, 14 bp, Homo sapiens
tccgctcccaccgc

SEQ ID NO: 1148637 - DNA, 13 bp, Homo sapiens
tccgctctcttcc

SEQ ID NO: 1148638 - DNA, 19 bp, Homo sapiens
tccgctgaggggtctcgga

SEQ ID NO: 1148639 - DNA, 23 bp, Homo sapiens
tccgctgccaccacgtctgccag

SEQ ID NO: 1148640 - DNA, 14 bp, Homo sapiens
tccgctgccagcct

SEQ ID NO: 1148641 - DNA, 16 bp, Homo sapiens
tccgctgccagccttg

SEQ ID NO: 1148642 - DNA, 13 bp, Homo sapiens
tccgctgctcctt

SEQ ID NO: 1148643 - DNA, 16 bp, Homo sapiens
tccgcttatcctgcta

SEQ ID NO: 1148644 - DNA, 15 bp, Homo sapiens
tccgcttgccagagg

SEQ ID NO: 1148645 - DNA, 16 bp, Homo sapiens
tccggaatagatgtct

SEQ ID NO: 1148646 - DNA, 15 bp, Homo sapiens
tccggagatgtagca

SEQ ID NO: 1148647 - DNA, 22 bp, Homo sapiens
tccggagcctcatgttctcttc

SEQ ID NO: 1148648 - DNA, 23 bp, Homo sapiens
tccggagcctcatgttctcttcc

SEQ ID NO: 1148649 - DNA, 13 bp, Homo sapiens
tccggaggactga

SEQ ID NO: 1148650 - DNA, 16 bp, Homo sapiens
tccggaggactgagcc

SEQ ID NO: 1148651 - DNA, 19 bp, Homo sapiens
tccggaggactgagccccc

SEQ ID NO: 1148652 - DNA, 16 bp, Homo sapiens
tccggaggagcagcct

SEQ ID NO: 1148653 - DNA, 17 bp, Homo sapiens
tccggaggagcagcctc

SEQ ID NO: 1148654 - DNA, 18 bp, Homo sapiens
tccggaggagcagcctcg

SEQ ID NO: 1148655 - DNA, 15 bp, Homo sapiens
tccggagtagctggg

SEQ ID NO: 1148656 - DNA, 13 bp, Homo sapiens
tccggatttctaa

SEQ ID NO: 1148657 - DNA, 20 bp, Homo sapiens
tccggatttctaacagtcct

SEQ ID NO: 1148658 - DNA, 16 bp, Homo sapiens
tccggccatactgcct

SEQ ID NO: 1148659 - DNA, 20 bp, Homo sapiens
tccggcccagtgccactgcc

SEQ ID NO: 1148660 - DNA, 23 bp, Homo sapiens
tccggccctcctaccctgcgccc

SEQ ID NO: 1148661 - DNA, 22 bp, Homo sapiens
tcctcgcccctcttctctccct

SEQ ID NO: 1148662 - DNA, 14 bp, Homo sapiens
tcctcgccctgggt

SEQ ID NO: 1148663 - DNA, 15 bp, Homo sapiens
tcctcgcctgacaac

SEQ ID NO: 1148664 - DNA, 22 bp, Homo sapiens
tcctcgctcctccttcccaggg

SEQ ID NO: 1148665 - DNA, 14 bp, Homo sapiens
tcctcggaaccgct

SEQ ID NO: 1148666 - DNA, 18 bp, Homo sapiens
tcctcggagagcagcagc

SEQ ID NO: 1148667 - DNA, 19 bp, Homo sapiens
tcctcggagagcagcagca

SEQ ID NO: 1148668 - DNA, 13 bp, Homo sapiens
tcctcggagctgg

SEQ ID NO: 1148669 - DNA, 18 bp, Homo sapiens
tcctcggagctggttcct

SEQ ID NO: 1148670 - DNA, 19 bp, Homo sapiens
tcctcggatcaccgagagt

SEQ ID NO: 1148671 - DNA, 15 bp, Homo sapiens
tcctcggtactccca

SEQ ID NO: 1148672 - DNA, 17 bp, Homo sapiens
tcctcggtctcccttcc

SEQ ID NO: 1148673 - DNA, 23 bp, Homo sapiens
tcctcggtctcccttccgtccat

SEQ ID NO: 1148674 - DNA, 13 bp, Homo sapiens
tcctcggtggctc

SEQ ID NO: 1148675 - DNA, 20 bp, Homo sapiens
tcctcggtggctctggggta

SEQ ID NO: 1148676 - DNA, 15 bp, Homo sapiens
tcctcgtgcagagct

SEQ ID NO: 1148677 - DNA, 20 bp, Homo sapiens
tcctctaactcactgcctag

SEQ ID NO: 1148678 - DNA, 20 bp, Homo sapiens
tcctctaagccactcttcca

SEQ ID NO: 1148679 - DNA, 18 bp, Homo sapiens
tcctctactaacaatcag

SEQ ID NO: 1148680 - DNA, 16 bp, Homo sapiens
tcctctagaagccaag

SEQ ID NO: 1148681 - DNA, 18 bp, Homo sapiens
tcctctagaagccaaggg

SEQ ID NO: 1148682 - DNA, 18 bp, Homo sapiens
tcctctagccatcccttg

SEQ ID NO: 1148683 - DNA, 21 bp, Homo sapiens
tcctctagccatcccttgggg

SEQ ID NO: 1148684 - DNA, 22 bp, Homo sapiens
tcctctagccatcccttgggga

SEQ ID NO: 1148685 - DNA, 15 bp, Homo sapiens
tcctctagctgtggg

SEQ ID NO: 1148686 - DNA, 16 bp, Homo sapiens
tcctctagcttttcta

SEQ ID NO: 1148687 - DNA, 19 bp, Homo sapiens
tcctctaggggcagcctcc

SEQ ID NO: 1148688 - DNA, 16 bp, Homo sapiens
tcctctagtaagatgc

SEQ ID NO: 1148689 - DNA, 16 bp, Homo sapiens
tcctctatacatctct

SEQ ID NO: 1148690 - DNA, 17 bp, Homo sapiens
tcctctatacatctctc

SEQ ID NO: 1148691 - DNA, 21 bp, Homo sapiens
tcctctatacatctctcccca

SEQ ID NO: 1148692 - DNA, 12 bp, Homo sapiens
tcctctattttg

SEQ ID NO: 1148693 - DNA, 17 bp, Homo sapiens
tcctctcacctcagcct

SEQ ID NO: 1148694 - DNA, 18 bp, Homo sapiens
tcctctcacctctccctc

SEQ ID NO: 1148695 - DNA, 15 bp, Homo sapiens
tcctctcaggctctt

SEQ ID NO: 1148696 - DNA, 17 bp, Homo sapiens
tcctctcagttctctcc

SEQ ID NO: 1148697 - DNA, 15 bp, Homo sapiens
tcctctccaccagac

SEQ ID NO: 1148698 - DNA, 13 bp, Homo sapiens
tcctctccactcc

SEQ ID NO: 1148699 - DNA, 16 bp, Homo sapiens
tcctctccactgcctt

SEQ ID NO: 1148700 - DNA, 17 bp, Homo sapiens
tcctctccactgccttc

SEQ ID NO: 1148701 - DNA, 18 bp, Homo sapiens
tcctctccactgccttcg

SEQ ID NO: 1148702 - DNA, 15 bp, Homo sapiens
tcctctccactgctg

SEQ ID NO: 1148703 - DNA, 17 bp, Homo sapiens
tcctctccactgctgga

SEQ ID NO: 1148704 - DNA, 20 bp, Homo sapiens
tcctctccactgctggacat

SEQ ID NO: 1148705 - DNA, 12 bp, Homo sapiens
tcctctccaggc

SEQ ID NO: 1148706 - DNA, 21 bp, Homo sapiens
tcctctccatacctgcccctg

SEQ ID NO: 1148707 - DNA, 17 bp, Homo sapiens
tcctctccatgcacagt

SEQ ID NO: 1148708 - DNA, 17 bp, Homo sapiens
tcctctcccaagtccac

SEQ ID NO: 1148709 - DNA, 22 bp, Homo sapiens
tcctctcccacagagtgctgga

SEQ ID NO: 1148710 - DNA, 19 bp, Homo sapiens
tcctctcccatccccctgc

SEQ ID NO: 1148711 - DNA, 22 bp, Homo sapiens
tcctctcccccaaccccctgca

SEQ ID NO: 1148712 - DNA, 18 bp, Homo sapiens
tcctctcccccttcagct

SEQ ID NO: 1148713 - DNA, 20 bp, Homo sapiens
tcctctcccccttcagctcc

SEQ ID NO: 1148714 - DNA, 22 bp, Homo sapiens
tcctctcccccttcagctcctg

SEQ ID NO: 1148715 - DNA, 11 bp, Homo sapiens
tcctctccctt

SEQ ID NO: 1148716 - DNA, 12 bp, Homo sapiens
tcctctcccttc

SEQ ID NO: 1148717 - DNA, 20 bp, Homo sapiens
tcctctccgcagttcctgtc

SEQ ID NO: 1148718 - DNA, 16 bp, Homo sapiens
tcctctccgcgccctc

SEQ ID NO: 1148719 - DNA, 16 bp, Homo sapiens
tcctctcctcctcagc

SEQ ID NO: 1148720 - DNA, 14 bp, Homo sapiens
tcctctccttgggc

SEQ ID NO: 1148721 - DNA, 20 bp, Homo sapiens
tcctctccttgggctcctgg

SEQ ID NO: 1148722 - DNA, 16 bp, Homo sapiens
tcctctcgagcccaga

SEQ ID NO: 1148723 - DNA, 22 bp, Homo sapiens
tcctctcgagcccagatggaaa

SEQ ID NO: 1148724 - DNA, 16 bp, Homo sapiens
tcctctcggctggaag

SEQ ID NO: 1148725 - DNA, 21 bp, Homo sapiens
tcctctcggctggaagaacat

SEQ ID NO: 1148726 - DNA, 23 bp, Homo sapiens
tcctctcggctggaagaacatca

SEQ ID NO: 1148727 - DNA, 17 bp, Homo sapiens
tcctctctaccccccac

SEQ ID NO: 1148728 - DNA, 19 bp, Homo sapiens
tcctctctaccccccacct

SEQ ID NO: 1148729 - DNA, 15 bp, Homo sapiens
tcctctctagggcag

SEQ ID NO: 1148730 - DNA, 13 bp, Homo sapiens
tcctctctcccac

SEQ ID NO: 1148731 - DNA, 14 bp, Homo sapiens
tcctctctcccacc

SEQ ID NO: 1148732 - DNA, 13 bp, Homo sapiens
tcctctctctctc

SEQ ID NO: 1148733 - DNA, 11 bp, Homo sapiens
tcctctctgcc

SEQ ID NO: 1148734 - DNA, 14 bp, Homo sapiens
tcctctctgggcct

SEQ ID NO: 1148735 - DNA, 21 bp, Homo sapiens
tcctctctgtctgtctctccc

SEQ ID NO: 1148736 - DNA, 15 bp, Homo sapiens
tcctctgaccctcct

SEQ ID NO: 1148737 - DNA, 17 bp, Homo sapiens
tcctctgactcagggct

SEQ ID NO: 1148738 - DNA, 18 bp, Homo sapiens
tccctcaggggcaggtgg

SEQ ID NO: 1148739 - DNA, 14 bp, Homo sapiens
tccctcattcatct

SEQ ID NO: 1148740 - DNA, 16 bp, Homo sapiens
tccctcattcatcttg

SEQ ID NO: 1148741 - DNA, 23 bp, Homo sapiens
tccctcattccaccttcccatgc

SEQ ID NO: 1148742 - DNA, 15 bp, Homo sapiens
tccctccaacacaga

SEQ ID NO: 1148743 - DNA, 16 bp, Homo sapiens
tccctccaagcctggc

SEQ ID NO: 1148744 - DNA, 21 bp, Homo sapiens
tccctccaagcctggcaccca

SEQ ID NO: 1148745 - DNA, 23 bp, Homo sapiens
tccctccaagcctggcacccacc

SEQ ID NO: 1148746 - DNA, 18 bp, Homo sapiens
tccctccaattccccctt

SEQ ID NO: 1148747 - DNA, 21 bp, Homo sapiens
tccctccaccccacagaacct

SEQ ID NO: 1148748 - DNA, 17 bp, Homo sapiens
tccctccaccccaggac

SEQ ID NO: 1148749 - DNA, 14 bp, Homo sapiens
tccctcccacactt

SEQ ID NO: 1148750 - DNA, 23 bp, Homo sapiens
tccctcccagaaaaactggctct

SEQ ID NO: 1148751 - DNA, 13 bp, Homo sapiens
tccctcccagctg

SEQ ID NO: 1148752 - DNA, 22 bp, Homo sapiens
tccctcccatcctccagccctg

SEQ ID NO: 1148753 - DNA, 15 bp, Homo sapiens
tccctccccaaatgg

SEQ ID NO: 1148754 - DNA, 19 bp, Homo sapiens
tccctccccaaatggctgc

SEQ ID NO: 1148755 - DNA, 13 bp, Homo sapiens
tccctccccagaa

SEQ ID NO: 1148756 - DNA, 17 bp, Homo sapiens
tccctccccagaaacag

SEQ ID NO: 1148757 - DNA, 16 bp, Homo sapiens
tccctccccagctccg

SEQ ID NO: 1148758 - DNA, 12 bp, Homo sapiens
tccctccccctc

SEQ ID NO: 1148759 - DNA, 14 bp, Homo sapiens
tccctccccctcct

SEQ ID NO: 1148760 - DNA, 15 bp, Homo sapiens
tccctccccgctgcc

SEQ ID NO: 1148761 - DNA, 17 bp, Homo sapiens
tccctccccgctgccct

SEQ ID NO: 1148762 - DNA, 20 bp, Homo sapiens
tccctcccggcatgggaaag

SEQ ID NO: 1148763 - DNA, 20 bp, Homo sapiens
tccctcccggctgcccccat

SEQ ID NO: 1148764 - DNA, 20 bp, Homo sapiens
tccctcccgtagtctcctgg

SEQ ID NO: 1148765 - DNA, 21 bp, Homo sapiens
tccctcccgtagtctcctggg

SEQ ID NO: 1148766 - DNA, 21 bp, Homo sapiens
tccctcccgtgtgtggttgga

SEQ ID NO: 1148767 - DNA, 16 bp, Homo sapiens
tccctccctagccctt

SEQ ID NO: 1148768 - DNA, 23 bp, Homo sapiens
tccctccctagcccttccagcct

SEQ ID NO: 1148769 - DNA, 15 bp, Homo sapiens
tccctccctctccgc

SEQ ID NO: 1148770 - DNA, 12 bp, Homo sapiens
tccctccctctt

SEQ ID NO: 1148771 - DNA, 13 bp, Homo sapiens
tccctcccttcct

SEQ ID NO: 1148772 - DNA, 14 bp, Homo sapiens
tccctcccttcctt

SEQ ID NO: 1148773 - DNA, 13 bp, Homo sapiens
tccctcccttggg

SEQ ID NO: 1148774 - DNA, 15 bp, Homo sapiens
tccctccgactccag

SEQ ID NO: 1148775 - DNA, 16 bp, Homo sapiens
tccctccgcctcccat

SEQ ID NO: 1148776 - DNA, 15 bp, Homo sapiens
tccctccgccttctc

SEQ ID NO: 1148777 - DNA, 14 bp, Homo sapiens
tccctccgggacct

SEQ ID NO: 1148778 - DNA, 15 bp, Homo sapiens
tccctccgggacctg

SEQ ID NO: 1148779 - DNA, 13 bp, Homo sapiens
tccctccgggcag

SEQ ID NO: 1148780 - DNA, 15 bp, Homo sapiens
tccctccgggcaggg

SEQ ID NO: 1148781 - DNA, 16 bp, Homo sapiens
tccctcctagctctcc

SEQ ID NO: 1148782 - DNA, 14 bp, Homo sapiens
tccctcctccaggc

SEQ ID NO: 1148783 - DNA, 16 bp, Homo sapiens
tccctcctccaggcct

SEQ ID NO: 1148784 - DNA, 16 bp, Homo sapiens
tccctcctcccatgtc

SEQ ID NO: 1148785 - DNA, 12 bp, Homo sapiens
tccctcctctgg

SEQ ID NO: 1148786 - DNA, 15 bp, Homo sapiens
tccctcctgagtgcc

SEQ ID NO: 1148787 - DNA, 19 bp, Homo sapiens
tccctcctgagtgccccac

SEQ ID NO: 1148788 - DNA, 14 bp, Homo sapiens
tccctcctgcacac

SEQ ID NO: 1148789 - DNA, 14 bp, Homo sapiens
tccctcctgcagct

SEQ ID NO: 1148790 - DNA, 18 bp, Homo sapiens
tccctcctgcccaggact

SEQ ID NO: 1148791 - DNA, 19 bp, Homo sapiens
tccctcctgcccaggactg

SEQ ID NO: 1148792 - DNA, 18 bp, Homo sapiens
tccctcctggagcatccc

SEQ ID NO: 1148793 - DNA, 19 bp, Homo sapiens
tccctcctggagctctgtg

SEQ ID NO: 1148794 - DNA, 23 bp, Homo sapiens
tccctcctggtcctggacacctc

SEQ ID NO: 1148795 - DNA, 17 bp, Homo sapiens
tccctcctgtgccccag

SEQ ID NO: 1148796 - DNA, 19 bp, Homo sapiens
tccctcctgtgccccagct

SEQ ID NO: 1148797 - DNA, 22 bp, Homo sapiens
tccctcctgtgccccagctgcc

SEQ ID NO: 1148798 - DNA, 23 bp, Homo sapiens
tccctcgacttgaccctttcctc

SEQ ID NO: 1148799 - DNA, 16 bp, Homo sapiens
tccctcggacccacca

SEQ ID NO: 1148800 - DNA, 18 bp, Homo sapiens
tccctcggagctgccagc

SEQ ID NO: 1148801 - DNA, 15 bp, Homo sapiens
tccctcggccccacc

SEQ ID NO: 1148802 - DNA, 17 bp, Homo sapiens
tccctcgggggctcttc

SEQ ID NO: 1148803 - DNA, 19 bp, Homo sapiens
tccctcgtccacaggggca

SEQ ID NO: 1148804 - DNA, 15 bp, Homo sapiens
tccctcgtccgtctg

SEQ ID NO: 1148805 - DNA, 19 bp, Homo sapiens
tccctcgtccgtctgtctc

SEQ ID NO: 1148806 - DNA, 24 bp, Homo sapiens
tccctcgtccgtctgtctcgatgc

SEQ ID NO: 1148807 - DNA, 15 bp, Homo sapiens
tccctcgtgggcttg

SEQ ID NO: 1148808 - DNA, 22 bp, Homo sapiens
tccctcgtgggcttgtgctcgg

SEQ ID NO: 1148809 - DNA, 16 bp, Homo sapiens
tccctctaatgagact

SEQ ID NO: 1148810 - DNA, 13 bp, Homo sapiens
tccctctagtgcc

SEQ ID NO: 1148811 - DNA, 13 bp, Homo sapiens
tccctctatttat

SEQ ID NO: 1148812 - DNA, 19 bp, Homo sapiens
tccctctatttatgtttgc

SEQ ID NO: 1148813 - DNA, 15 bp, Homo sapiens
tccctctcagaggcc

SEQ ID NO: 1148814 - DNA, 13 bp, Homo sapiens
tccctctcatgtc

SEQ ID NO: 1148815 - DNA, 23 bp, Homo sapiens
tccctctcatgtccctccaggga

SEQ ID NO: 1148816 - DNA, 16 bp, Homo sapiens
tccctctcccagtcca

SEQ ID NO: 1148817 - DNA, 18 bp, Homo sapiens
tccctctcccagtccatt

SEQ ID NO: 1148818 - DNA, 12 bp, Homo sapiens
tccctctcggaa

SEQ ID NO: 1148819 - DNA, 22 bp, Homo sapiens
tccctctcggaaggctggctgg

SEQ ID NO: 1148820 - DNA, 15 bp, Homo sapiens
tccctctctcactcc

SEQ ID NO: 1148821 - DNA, 16 bp, Homo sapiens
tccctctctcttctgc

SEQ ID NO: 1148822 - DNA, 12 bp, Homo sapiens
tccctctctgat

SEQ ID NO: 1148823 - DNA, 13 bp, Homo sapiens
tccctctctggtt

SEQ ID NO: 1148824 - DNA, 15 bp, Homo sapiens
tccctctctggtttc

SEQ ID NO: 1148825 - DNA, 15 bp, Homo sapiens
tccctctcttccggg

SEQ ID NO: 1148826 - DNA, 17 bp, Homo sapiens
tccctctgacctgcagg

SEQ ID NO: 1148827 - DNA, 21 bp, Homo sapiens
tccctctgagaattccaagga

SEQ ID NO: 1148828 - DNA, 22 bp, Homo sapiens
tccctctgagaattccaaggag

SEQ ID NO: 1148829 - DNA, 21 bp, Homo sapiens
tccctctgccccaagcagcca

SEQ ID NO: 1148830 - DNA, 15 bp, Homo sapiens
tccctctgcccctcc

SEQ ID NO: 1148831 - DNA, 18 bp, Homo sapiens
tccctctgcctgtccctc

SEQ ID NO: 1148832 - DNA, 15 bp, Homo sapiens
tccctctgctcctgg

SEQ ID NO: 1148833 - DNA, 20 bp, Homo sapiens
tccctctgctcctggagcct

SEQ ID NO: 1148834 - DNA, 16 bp, Homo sapiens
tccctctggccctgcc

SEQ ID NO: 1148835 - DNA, 14 bp, Homo sapiens
tccctctggcttcc

SEQ ID NO: 1148836 - DNA, 17 bp, Homo sapiens
tccctctgggcacgcct

SEQ ID NO: 1148837 - DNA, 14 bp, Homo sapiens
tccctctggtccca

SEQ ID NO: 1148838 - DNA, 16 bp, Homo sapiens
tccctctggtcccaca

SEQ ID NO: 1148839 - DNA, 16 bp, Homo sapiens
tccctctgtcttttct

SEQ ID NO: 1148840 - DNA, 18 bp, Homo sapiens
tccctctgtcttttctcc

SEQ ID NO: 1148841 - DNA, 13 bp, Homo sapiens
tccctctgtttct

SEQ ID NO: 1148842 - DNA, 12 bp, Homo sapiens
tccctcttcact

SEQ ID NO: 1148843 - DNA, 18 bp, Homo sapiens
tccctcttcactgtggcc

SEQ ID NO: 1148844 - DNA, 17 bp, Homo sapiens
tccctcttctcaagtgc

SEQ ID NO: 1148845 - DNA, 19 bp, Homo sapiens
tccctcttctcaagtgcct

SEQ ID NO: 1148846 - DNA, 17 bp, Homo sapiens
tccctcttctctcctca

SEQ ID NO: 1148847 - DNA, 19 bp, Homo sapiens
tccctcttctctcctcagt

SEQ ID NO: 1148848 - DNA, 12 bp, Homo sapiens
tccctcttgtaa

SEQ ID NO: 1148849 - DNA, 13 bp, Homo sapiens
tccctcttgtggg

SEQ ID NO: 1148850 - DNA, 19 bp, Homo sapiens
tccctcttgtgggataatg

SEQ ID NO: 1148851 - DNA, 21 bp, Homo sapiens
tccctctttcatctcctgagt

SEQ ID NO: 1148852 - DNA, 16 bp, Homo sapiens
tccctctttggaacag

SEQ ID NO: 1148853 - DNA, 13 bp, Homo sapiens
tccctcttttctt

SEQ ID NO: 1148854 - DNA, 18 bp, Homo sapiens
tccctgaaaacccagaga

SEQ ID NO: 1148855 - DNA, 13 bp, Homo sapiens
tcctacctccctg

SEQ ID NO: 1148856 - DNA, 20 bp, Homo sapiens
tcctacctggggactcctca

SEQ ID NO: 1148857 - DNA, 17 bp, Homo sapiens
tcctaccttttgtctct

SEQ ID NO: 1148858 - DNA, 15 bp, Homo sapiens
tcctactccgttcct

SEQ ID NO: 1148859 - DNA, 16 bp, Homo sapiens
tcctactccgttcctg

SEQ ID NO: 1148860 - DNA, 17 bp, Homo sapiens
tcctactcctcatagca

SEQ ID NO: 1148861 - DNA, 17 bp, Homo sapiens
tcctactgcgcgttttc

SEQ ID NO: 1148862 - DNA, 15 bp, Homo sapiens
tcctactgtcctgga

SEQ ID NO: 1148863 - DNA, 20 bp, Homo sapiens
tcctacttagggaagaaaaa

SEQ ID NO: 1148864 - DNA, 19 bp, Homo sapiens
tcctacttctgactttact

SEQ ID NO: 1148865 - DNA, 17 bp, Homo sapiens
tcctagaagaaccaaat

SEQ ID NO: 1148866 - DNA, 20 bp, Homo sapiens
tcctagaagaaccaaatacc

SEQ ID NO: 1148867 - DNA, 17 bp, Homo sapiens
tcctagagggaggggcc

SEQ ID NO: 1148868 - DNA, 20 bp, Homo sapiens
tcctagagggaggggcctag

SEQ ID NO: 1148869 - DNA, 15 bp, Homo sapiens
tcctagaggtgggca

SEQ ID NO: 1148870 - DNA, 14 bp, Homo sapiens
tcctagataaaaag

SEQ ID NO: 1148871 - DNA, 17 bp, Homo sapiens
tcctagataaaaagatg

SEQ ID NO: 1148872 - DNA, 20 bp, Homo sapiens
tcctagcaaatttctctctt

SEQ ID NO: 1148873 - DNA, 20 bp, Homo sapiens
tcctagcacaaggagtgccc

SEQ ID NO: 1148874 - DNA, 15 bp, Homo sapiens
tcctagcagacagaa

SEQ ID NO: 1148875 - DNA, 18 bp, Homo sapiens
tcctagcccctctctcac

SEQ ID NO: 1148876 - DNA, 15 bp, Homo sapiens
tcctagcccttccct

SEQ ID NO: 1148877 - DNA, 21 bp, Homo sapiens
tcctagcctgtgcctctggga

SEQ ID NO: 1148878 - DNA, 19 bp, Homo sapiens
tcctagccttatcctctga

SEQ ID NO: 1148879 - DNA, 15 bp, Homo sapiens
tcctagctctcccag

SEQ ID NO: 1148880 - DNA, 14 bp, Homo sapiens
tcctagctcttaca

SEQ ID NO: 1148881 - DNA, 14 bp, Homo sapiens
tcctagctgacgcc

SEQ ID NO: 1148882 - DNA, 17 bp, Homo sapiens
tcctagctgtgtgaata

SEQ ID NO: 1148883 - DNA, 21 bp, Homo sapiens
tcctaggaaaccagctcgtgg

SEQ ID NO: 1148884 - DNA, 14 bp, Homo sapiens
tcctaggagagcca

SEQ ID NO: 1148885 - DNA, 23 bp, Homo sapiens
tcctaggagagccaacctcggct

SEQ ID NO: 1148886 - DNA, 20 bp, Homo sapiens
tcctaggaggtaatgaccat

SEQ ID NO: 1148887 - DNA, 19 bp, Homo sapiens
tcctaggcatttgctgaat

SEQ ID NO: 1148888 - DNA, 15 bp, Homo sapiens
tcctaggcccaggcc

SEQ ID NO: 1148889 - DNA, 16 bp, Homo sapiens
tcctaggctggaagcc

SEQ ID NO: 1148890 - DNA, 17 bp, Homo sapiens
tcctaggctggaagcca

SEQ ID NO: 1148891 - DNA, 16 bp, Homo sapiens
tcctaggggaaggggg

SEQ ID NO: 1148892 - DNA, 22 bp, Homo sapiens
tcctagtggatgactgttgatg

SEQ ID NO: 1148893 - DNA, 19 bp, Homo sapiens
tcctagtgtttctttgtgg

SEQ ID NO: 1148894 - DNA, 17 bp, Homo sapiens
tcctagttttcctactt

SEQ ID NO: 1148895 - DNA, 20 bp, Homo sapiens
tcctagttttctcctcccag

SEQ ID NO: 1148896 - DNA, 17 bp, Homo sapiens
tcctataaggaagattt

SEQ ID NO: 1148897 - DNA, 21 bp, Homo sapiens
tcctataaggaagatttggaa

SEQ ID NO: 1148898 - DNA, 14 bp, Homo sapiens
tcctataaggagag

SEQ ID NO: 1148899 - DNA, 22 bp, Homo sapiens
tcctataatctgtcaaaacact

SEQ ID NO: 1148900 - DNA, 18 bp, Homo sapiens
tcctatacgcagcgtgct

SEQ ID NO: 1148901 - DNA, 18 bp, Homo sapiens
tcctatatagtttattga

SEQ ID NO: 1148902 - DNA, 15 bp, Homo sapiens
tcctatatatttcta

SEQ ID NO: 1148903 - DNA, 18 bp, Homo sapiens
tcctatatcctgtgactg

SEQ ID NO: 1148904 - DNA, 18 bp, Homo sapiens
tcctatatctgtttgtat

SEQ ID NO: 1148905 - DNA, 23 bp, Homo sapiens
tcctatattgttttcagtgtaca

SEQ ID NO: 1148906 - DNA, 16 bp, Homo sapiens
tcctatcacctcccct

SEQ ID NO: 1148907 - DNA, 13 bp, Homo sapiens
tcctatcctccta

SEQ ID NO: 1148908 - DNA, 19 bp, Homo sapiens
tcctatgaagttggcacat

SEQ ID NO: 1148909 - DNA, 13 bp, Homo sapiens
tcctatgatggat

SEQ ID NO: 1148910 - DNA, 20 bp, Homo sapiens
tcctatgatggatggcagac

SEQ ID NO: 1148911 - DNA, 21 bp, Homo sapiens
tcctatgatggatggcagact

SEQ ID NO: 1148912 - DNA, 21 bp, Homo sapiens
tcctatgctattgacaataaa

SEQ ID NO: 1148913 - DNA, 21 bp, Homo sapiens
tcctatgctggggtacacagt

SEQ ID NO: 1148914 - DNA, 23 bp, Homo sapiens
tcctatgcttaataaaagaacat

SEQ ID NO: 1148915 - DNA, 16 bp, Homo sapiens
tcctatggaaacattt

SEQ ID NO: 1148916 - DNA, 16 bp, Homo sapiens
tcctatggaatgtaaa

SEQ ID NO: 1148917 - DNA, 16 bp, Homo sapiens
tcctatggacaactta

SEQ ID NO: 1148918 - DNA, 21 bp, Homo sapiens
tcctatgtacagagctttctt

SEQ ID NO: 1148919 - DNA, 22 bp, Homo sapiens
tcctatgtcaatttgtatatca

SEQ ID NO: 1148920 - DNA, 12 bp, Homo sapiens
tcctatgtgtaa

SEQ ID NO: 1148921 - DNA, 18 bp, Homo sapiens
tcctatgtttttgttcaa

SEQ ID NO: 1148922 - DNA, 14 bp, Homo sapiens
tcctattctcacca

SEQ ID NO: 1148923 - DNA, 16 bp, Homo sapiens
tcctattctcctgcca

SEQ ID NO: 1148924 - DNA, 21 bp, Homo sapiens
tcctatttatgaaaaccatat

SEQ ID NO: 1148925 - DNA, 18 bp, Homo sapiens
tcctatttggggcttgca

SEQ ID NO: 1148926 - DNA, 14 bp, Homo sapiens
tcctatttgttttc

SEQ ID NO: 1148927 - DNA, 14 bp, Homo sapiens
tcctcaaaccactt

SEQ ID NO: 1148928 - DNA, 17 bp, Homo sapiens
tcctcaaaccacttgcc

SEQ ID NO: 1148929 - DNA, 20 bp, Homo sapiens
tcctcaaaccacttgcctgg

SEQ ID NO: 1148930 - DNA, 16 bp, Homo sapiens
tcctcaaacccagtct

SEQ ID NO: 1148931 - DNA, 20 bp, Homo sapiens
tcctcaaacgacagaggagc

SEQ ID NO: 1148932 - DNA, 18 bp, Homo sapiens
tcctcaaagaaagtgtat

SEQ ID NO: 1148933 - DNA, 19 bp, Homo sapiens
tcctcaaattttttgactt

SEQ ID NO: 1148934 - DNA, 23 bp, Homo sapiens
tcctcaactcacctaatgtttat

SEQ ID NO: 1148935 - DNA, 12 bp, Homo sapiens
tcctcaagactt

SEQ ID NO: 1148936 - DNA, 19 bp, Homo sapiens
tcctcaagcaataattgtt

SEQ ID NO: 1148937 - DNA, 18 bp, Homo sapiens
tcctcaaggcccagccat

SEQ ID NO: 1148938 - DNA, 12 bp, Homo sapiens
tcctcaatccag

SEQ ID NO: 1148939 - DNA, 14 bp, Homo sapiens
tcctcacacccctg

SEQ ID NO: 1148940 - DNA, 15 bp, Homo sapiens
tcctcacacttttgg

SEQ ID NO: 1148941 - DNA, 13 bp, Homo sapiens
tcctcacccacct

SEQ ID NO: 1148942 - DNA, 15 bp, Homo sapiens
tcctcacccacctct

SEQ ID NO: 1148943 - DNA, 13 bp, Homo sapiens
tcctcacccagat

SEQ ID NO: 1148944 - DNA, 20 bp, Homo sapiens
tcctcacccccagctttgct

SEQ ID NO: 1148945 - DNA, 23 bp, Homo sapiens
tcctcacccctcgccacctttca

SEQ ID NO: 1148946 - DNA, 14 bp, Homo sapiens
tcctcaccctgtgg

SEQ ID NO: 1148947 - DNA, 16 bp, Homo sapiens
tcctcaccctgtggga

SEQ ID NO: 1148948 - DNA, 19 bp, Homo sapiens
tcctcaccctgtgggaccg

SEQ ID NO: 1148949 - DNA, 23 bp, Homo sapiens
tcctcaccctgtgggaccgcctg

SEQ ID NO: 1148950 - DNA, 13 bp, Homo sapiens
tcctcacctctgg

SEQ ID NO: 1148951 - DNA, 15 bp, Homo sapiens
tcctcacctctggac

SEQ ID NO: 1148952 - DNA, 13 bp, Homo sapiens
tcctcacctggtt

SEQ ID NO: 1148953 - DNA, 18 bp, Homo sapiens
tcctcacgccccctgtga

SEQ ID NO: 1148954 - DNA, 21 bp, Homo sapiens
tcctcacgccccctgtgactt

SEQ ID NO: 1148955 - DNA, 16 bp, Homo sapiens
tcctcacgtgcaggac

SEQ ID NO: 1148956 - DNA, 18 bp, Homo sapiens
tcctcacgtgcaggacag

SEQ ID NO: 1148957 - DNA, 12 bp, Homo sapiens
tcctcactccca

SEQ ID NO: 1148958 - DNA, 13 bp, Homo sapiens
tcctcactcccag

SEQ ID NO: 1148959 - DNA, 14 bp, Homo sapiens
tcctcactctgtcc

SEQ ID NO: 1148960 - DNA, 22 bp, Homo sapiens
tcctcactctgtccctgtcctt

SEQ ID NO: 1148961 - DNA, 15 bp, Homo sapiens
tcctcactgggtggg

SEQ ID NO: 1148962 - DNA, 14 bp, Homo sapiens
tcctcactgtatcc

SEQ ID NO: 1148963 - DNA, 22 bp, Homo sapiens
tcctcacttccatacagctcta

SEQ ID NO: 1148964 - DNA, 14 bp, Homo sapiens
tcctcagagcgcca

SEQ ID NO: 1148965 - DNA, 15 bp, Homo sapiens
tcctcagagcgccag

SEQ ID NO: 1148966 - DNA, 20 bp, Homo sapiens
tcctcagagcgccaggaagc

SEQ ID NO: 1148967 - DNA, 23 bp, Homo sapiens
tcctcagagcgccaggaagccag

SEQ ID NO: 1148968 - DNA, 22 bp, Homo sapiens
tcctcagaggctgagccctgta

SEQ ID NO: 1148969 - DNA, 21 bp, Homo sapiens
tcctcagatccccagctttct

SEQ ID NO: 1148970 - DNA, 15 bp, Homo sapiens
tcctcagattgctga

SEQ ID NO: 1148971 - DNA, 16 bp, Homo sapiens
tcctcagattgctgaa

SEQ ID NO: 1148972 - DNA, 13 bp, Homo sapiens
tcctcagccccca

SEQ ID NO: 1148973 - DNA, 18 bp, Homo sapiens
tcctcagcccccaggcca

SEQ ID NO: 1148974 - DNA, 19 bp, Homo sapiens
tcctcagcccccaggccag

SEQ ID NO: 1148975 - DNA, 18 bp, Homo sapiens
tcctcagcctccaaagtg

SEQ ID NO: 1148976 - DNA, 13 bp, Homo sapiens
tcctcagcctccc

SEQ ID NO: 1148977 - DNA, 23 bp, Homo sapiens
tcctcagcctctgcaactgcaag

SEQ ID NO: 1148978 - DNA, 19 bp, Homo sapiens
tcctcagcgagaggcagca

SEQ ID NO: 1148979 - DNA, 17 bp, Homo sapiens
tcctcagctgcatggag

SEQ ID NO: 1148980 - DNA, 20 bp, Homo sapiens
tcctcagctgcatggagcct

SEQ ID NO: 1148981 - DNA, 14 bp, Homo sapiens
tcctcagctgccaa

SEQ ID NO: 1148982 - DNA, 14 bp, Homo sapiens
tcctcagcttgggc

SEQ ID NO: 1148983 - DNA, 16 bp, Homo sapiens
tcctcaggaaggacat

SEQ ID NO: 1148984 - DNA, 15 bp, Homo sapiens
tcctcaggcacacag

SEQ ID NO: 1148985 - DNA, 13 bp, Homo sapiens
tcctcaggcccag

SEQ ID NO: 1148986 - DNA, 20 bp, Homo sapiens
tcctcaggcccagctgctcc

SEQ ID NO: 1148987 - DNA, 21 bp, Homo sapiens
tcctcaggcccagctgctccc

SEQ ID NO: 1148988 - DNA, 24 bp, Homo sapiens
tcctcagggacagagacacctgca

SEQ ID NO: 1148989 - DNA, 21 bp, Homo sapiens
tcctcagggagcagggaaggc

SEQ ID NO: 1148990 - DNA, 20 bp, Homo sapiens
tcctcagggggtaggagagc

SEQ ID NO: 1148991 - DNA, 14 bp, Homo sapiens
tcctcaggggtgga

SEQ ID NO: 1148992 - DNA, 17 bp, Homo sapiens
tcctcagggtggggggt

SEQ ID NO: 1148993 - DNA, 17 bp, Homo sapiens
tcctcaggtagtactgg

SEQ ID NO: 1148994 - DNA, 13 bp, Homo sapiens
tcctcaggtcagc

SEQ ID NO: 1148995 - DNA, 15 bp, Homo sapiens
tcctcaggtcagctg

SEQ ID NO: 1148996 - DNA, 16 bp, Homo sapiens
tcctcaggtggccatg

SEQ ID NO: 1148997 - DNA, 16 bp, Homo sapiens
tcctcataaaaagcaa

SEQ ID NO: 1148998 - DNA, 15 bp, Homo sapiens
tcctcatccacccca

SEQ ID NO: 1148999 - DNA, 17 bp, Homo sapiens
tcctcatccatttcttt

SEQ ID NO: 1149000 - DNA, 22 bp, Homo sapiens
tcctcatcccgtgttctccttt

SEQ ID NO: 1149001 - DNA, 14 bp, Homo sapiens
tcctcatcctgctt

SEQ ID NO: 1149002 - DNA, 16 bp, Homo sapiens
tcctcatcctgcttct

SEQ ID NO: 1149003 - DNA, 15 bp, Homo sapiens
tcctcatcctttcct

SEQ ID NO: 1149004 - DNA, 14 bp, Homo sapiens
tcctcatctgggtc

SEQ ID NO: 1149005 - DNA, 20 bp, Homo sapiens
tcctcattataaaatgggaa

SEQ ID NO: 1149006 - DNA, 15 bp, Homo sapiens
tcctcattgcctcct

SEQ ID NO: 1149007 - DNA, 22 bp, Homo sapiens
tcctccaacaccaagcacagca

SEQ ID NO: 1149008 - DNA, 14 bp, Homo sapiens
tcctccaagaattt

SEQ ID NO: 1149009 - DNA, 16 bp, Homo sapiens
tcctccaatgtcctga

SEQ ID NO: 1149010 - DNA, 20 bp, Homo sapiens
tcctccaatgtcctgaaaca

SEQ ID NO: 1149011 - DNA, 18 bp, Homo sapiens
tcctccacaaggtccccc

SEQ ID NO: 1149012 - DNA, 14 bp, Homo sapiens
tcctccacagagag

SEQ ID NO: 1149013 - DNA, 18 bp, Homo sapiens
tcctccacagtgctgctt

SEQ ID NO: 1149014 - DNA, 19 bp, Homo sapiens
tcctccacagtgctgcttc

SEQ ID NO: 1149015 - DNA, 15 bp, Homo sapiens
tcctccacatccttt

SEQ ID NO: 1149016 - DNA, 12 bp, Homo sapiens
tcctccacgcct

SEQ ID NO: 1149017 - DNA, 16 bp, Homo sapiens
tcctccactcactcca

SEQ ID NO: 1149018 - DNA, 20 bp, Homo sapiens
tcctccactcactccagccc

SEQ ID NO: 1149019 - DNA, 16 bp, Homo sapiens
tcctccactccacctc

SEQ ID NO: 1149020 - DNA, 17 bp, Homo sapiens
tcctccactccacctcc

SEQ ID NO: 1149021 - DNA, 13 bp, Homo sapiens
tcctccactctgt

SEQ ID NO: 1149022 - DNA, 16 bp, Homo sapiens
tcctccagaagcctct

SEQ ID NO: 1149023 - DNA, 18 bp, Homo sapiens
tcctccagaagcctctgg

SEQ ID NO: 1149024 - DNA, 12 bp, Homo sapiens
tcctccagccct

SEQ ID NO: 1149025 - DNA, 13 bp, Homo sapiens
tcctccagccctg

SEQ ID NO: 1149026 - DNA, 15 bp, Homo sapiens
tcctccagccctgcc

SEQ ID NO: 1149027 - DNA, 13 bp, Homo sapiens
tcctccagccctt

SEQ ID NO: 1149028 - DNA, 13 bp, Homo sapiens
tcctccagcctcc

SEQ ID NO: 1149029 - DNA, 14 bp, Homo sapiens
tcctccagcctccc

SEQ ID NO: 1149030 - DNA, 19 bp, Homo sapiens
tcctccagcctcccctccc

SEQ ID NO: 1149031 - DNA, 14 bp, Homo sapiens
tcctccagctgcac

SEQ ID NO: 1149032 - DNA, 14 bp, Homo sapiens
tcctccagcttctg

SEQ ID NO: 1149033 - DNA, 19 bp, Homo sapiens
tcctccaggagcttcttgt

SEQ ID NO: 1149034 - DNA, 23 bp, Homo sapiens
tcctccagggaaggtggccacag

SEQ ID NO: 1149035 - DNA, 21 bp, Homo sapiens
tcctccagtacgtcccgctgc

SEQ ID NO: 1149036 - DNA, 16 bp, Homo sapiens
tcctccatactcagga

SEQ ID NO: 1149037 - DNA, 23 bp, Homo sapiens
tcctccatcacctgaaacactgg

SEQ ID NO: 1149038 - DNA, 22 bp, Homo sapiens
tcctccatccacgtggcctctc

SEQ ID NO: 1149039 - DNA, 17 bp, Homo sapiens
tcctccatctttctaca

SEQ ID NO: 1149040 - DNA, 13 bp, Homo sapiens
tcctccatggtgg

SEQ ID NO: 1149041 - DNA, 13 bp, Homo sapiens
tcctccattttct

SEQ ID NO: 1149042 - DNA, 16 bp, Homo sapiens
tcctcccacagacctg

SEQ ID NO: 1149043 - DNA, 17 bp, Homo sapiens
tcctcccacagacctgc

SEQ ID NO: 1149044 - DNA, 20 bp, Homo sapiens
tcctcccacccggctgcaga

SEQ ID NO: 1149045 - DNA, 21 bp, Homo sapiens
tcctcccacccggctgcagag

SEQ ID NO: 1149046 - DNA, 13 bp, Homo sapiens
tcctcccactggg

SEQ ID NO: 1149047 - DNA, 14 bp, Homo sapiens
tcctcccactggga

SEQ ID NO: 1149048 - DNA, 16 bp, Homo sapiens
tcctcccagctgcttt

SEQ ID NO: 1149049 - DNA, 19 bp, Homo sapiens
tcctcccaggcgccccttc

SEQ ID NO: 1149050 - DNA, 20 bp, Homo sapiens
tcctcccaggctcaagctat

SEQ ID NO: 1149051 - DNA, 23 bp, Homo sapiens
tcctcccagtgagactgccccac

SEQ ID NO: 1149052 - DNA, 13 bp, Homo sapiens
tcctcccatcccc

SEQ ID NO: 1149053 - DNA, 20 bp, Homo sapiens
tcctcccatgtcactgcaga

SEQ ID NO: 1149054 - DNA, 16 bp, Homo sapiens
tcctccccaaatcaat

SEQ ID NO: 1149055 - DNA, 21 bp, Homo sapiens
tcctccccacactccactctg

SEQ ID NO: 1149056 - DNA, 14 bp, Homo sapiens
tcctccccacctgt

SEQ ID NO: 1149057 - DNA, 15 bp, Homo sapiens
tcctccccacctgta

SEQ ID NO: 1149058 - DNA, 22 bp, Homo sapiens
tcctccccaccttcaatgactt

SEQ ID NO: 1149059 - DNA, 17 bp, Homo sapiens
tcctccccaccttcccc

SEQ ID NO: 1149060 - DNA, 20 bp, Homo sapiens
tcctccccaccttccccaga

SEQ ID NO: 1149061 - DNA, 19 bp, Homo sapiens
tcctccccatacacacaca

SEQ ID NO: 1149062 - DNA, 19 bp, Homo sapiens
tcctccccctcctaggggg

SEQ ID NO: 1149063 - DNA, 21 bp, Homo sapiens
tcctccccctcctagggggtg

SEQ ID NO: 1149064 - DNA, 15 bp, Homo sapiens
tcctccccctgccag

SEQ ID NO: 1149065 - DNA, 15 bp, Homo sapiens
tcctcccctcttgag

SEQ ID NO: 1149066 - DNA, 14 bp, Homo sapiens
tcctccccttccct

SEQ ID NO: 1149067 - DNA, 21 bp, Homo sapiens
tcctcccgggccctcccttgg

SEQ ID NO: 1149068 - DNA, 15 bp, Homo sapiens
tcctccctcagcctc

SEQ ID NO: 1149069 - DNA, 16 bp, Homo sapiens
tcctccctcagcctcc

SEQ ID NO: 1149070 - DNA, 12 bp, Homo sapiens
tcctccctccaa

SEQ ID NO: 1149071 - DNA, 22 bp, Homo sapiens
tcctccctccaagcctggcacc

SEQ ID NO: 1149072 - DNA, 11 bp, Homo sapiens
tcctccctccc

SEQ ID NO: 1149073 - DNA, 16 bp, Homo sapiens
tcctccctcccagctg

SEQ ID NO: 1149074 - DNA, 17 bp, Homo sapiens
tcctccctgacttttct

SEQ ID NO: 1149075 - DNA, 18 bp, Homo sapiens
tcctccctgacttttctg

SEQ ID NO: 1149076 - DNA, 16 bp, Homo sapiens
tcctccctgcccatcc

SEQ ID NO: 1149077 - DNA, 13 bp, Homo sapiens
tcctccctgcccc

SEQ ID NO: 1149078 - DNA, 15 bp, Homo sapiens
tcctccctgctcctc

SEQ ID NO: 1149079 - DNA, 17 bp, Homo sapiens
tcctccctgctcctcat

SEQ ID NO: 1149080 - DNA, 19 bp, Homo sapiens
tcctccctgctcctcatgg

SEQ ID NO: 1149081 - DNA, 21 bp, Homo sapiens
tcctccctggctgccctggcc

SEQ ID NO: 1149082 - DNA, 20 bp, Homo sapiens
tcctccctgtgcccccagcc

SEQ ID NO: 1149083 - DNA, 24 bp, Homo sapiens
tcctccctgtgcccccagcctcag

SEQ ID NO: 1149084 - DNA, 17 bp, Homo sapiens
tcctcccttccttttcc

SEQ ID NO: 1149085 - DNA, 20 bp, Homo sapiens
tcctcccttgggttctgata

SEQ ID NO: 1149086 - DNA, 18 bp, Homo sapiens
tcctccgccttaccagga

SEQ ID NO: 1149087 - DNA, 15 bp, Homo sapiens
tcctccggagcctca

SEQ ID NO: 1149088 - DNA, 23 bp, Homo sapiens
tcctccggagcctcatgttctct

SEQ ID NO: 1149089 - DNA, 16 bp, Homo sapiens
tcctccgtagggtctt

SEQ ID NO: 1149090 - DNA, 19 bp, Homo sapiens
tcctccgtccacccaggct

SEQ ID NO: 1149091 - DNA, 16 bp, Homo sapiens
tcctccgtccagccgc

SEQ ID NO: 1149092 - DNA, 13 bp, Homo sapiens
tcctccgtctgac

SEQ ID NO: 1149093 - DNA, 16 bp, Homo sapiens
tcctcctacctcagcc

SEQ ID NO: 1149094 - DNA, 19 bp, Homo sapiens
tcctcctacctcagcctcc

SEQ ID NO: 1149095 - DNA, 14 bp, Homo sapiens
tcctcctacctggg

SEQ ID NO: 1149096 - DNA, 22 bp, Homo sapiens
tcctcctacctggggactcctc

SEQ ID NO: 1149097 - DNA, 16 bp, Homo sapiens
tcctcctaccttttgt

SEQ ID NO: 1149098 - DNA, 20 bp, Homo sapiens
tcctcctaccttttgtctct

SEQ ID NO: 1149099 - DNA, 19 bp, Homo sapiens
tcctcctatgtgtgcctcc

SEQ ID NO: 1149100 - DNA, 12 bp, Homo sapiens
tcctcctcacct

SEQ ID NO: 1149101 - DNA, 15 bp, Homo sapiens
tcctcctcagccccc

SEQ ID NO: 1149102 - DNA, 18 bp, Homo sapiens
tcctcctccacagtgctg

SEQ ID NO: 1149103 - DNA, 20 bp, Homo sapiens
tcctcctccacagtgctgct

SEQ ID NO: 1149104 - DNA, 14 bp, Homo sapiens
tcctcctccagggt

SEQ ID NO: 1149105 - DNA, 14 bp, Homo sapiens
tcctcctccatcac

SEQ ID NO: 1149106 - DNA, 20 bp, Homo sapiens
tcctcctccatctttctaca

SEQ ID NO: 1149107 - DNA, 14 bp, Homo sapiens
tcctcctcccaccc

SEQ ID NO: 1149108 - DNA, 15 bp, Homo sapiens
tcctcctcccctcct

SEQ ID NO: 1149109 - DNA, 13 bp, Homo sapiens
tcctcctccctgc

SEQ ID NO: 1149110 - DNA, 14 bp, Homo sapiens
tcctcctccctgca

SEQ ID NO: 1149111 - DNA, 21 bp, Homo sapiens
tcctcctcgctcctccttccc

SEQ ID NO: 1149112 - DNA, 14 bp, Homo sapiens
tcctcctctacctc

SEQ ID NO: 1149113 - DNA, 21 bp, Homo sapiens
tcctcctctgaggaagcagtt

SEQ ID NO: 1149114 - DNA, 14 bp, Homo sapiens
tcctcctctgccta

SEQ ID NO: 1149115 - DNA, 15 bp, Homo sapiens
tcctcctctgcctac

SEQ ID NO: 1149116 - DNA, 13 bp, Homo sapiens
tcctcctctgtga

SEQ ID NO: 1149117 - DNA, 12 bp, Homo sapiens
tcctcctctttc

SEQ ID NO: 1149118 - DNA, 15 bp, Homo sapiens
tcctcctctttctct

SEQ ID NO: 1149119 - DNA, 21 bp, Homo sapiens
tcctcctgaagcctctgccct

SEQ ID NO: 1149120 - DNA, 24 bp, Homo sapiens
tcctcctgaagcctctgccctgcc

SEQ ID NO: 1149121 - DNA, 12 bp, Homo sapiens
tcctcctgcaga

SEQ ID NO: 1149122 - DNA, 13 bp, Homo sapiens
tcctcctgcagac

SEQ ID NO: 1149123 - DNA, 21 bp, Homo sapiens
tcctcctgcccagctcctcac

SEQ ID NO: 1149124 - DNA, 21 bp, Homo sapiens
tcctcctgcctcagccttcca

SEQ ID NO: 1149125 - DNA, 20 bp, Homo sapiens
tcctcctggaaccttgctgt

SEQ ID NO: 1149126 - DNA, 12 bp, Homo sapiens
tcctcctggaag

SEQ ID NO: 1149127 - DNA, 14 bp, Homo sapiens
tcctcctgggccct

SEQ ID NO: 1149128 - DNA, 16 bp, Homo sapiens
tcctcctgggccctct

SEQ ID NO: 1149129 - DNA, 16 bp, Homo sapiens
tcctcctgggggctgg

SEQ ID NO: 1149130 - DNA, 20 bp, Homo sapiens
tcctcctggtgcccacagca

SEQ ID NO: 1149131 - DNA, 12 bp, Homo sapiens
tcctccttccca

SEQ ID NO: 1149132 - DNA, 13 bp, Homo sapiens
tcctccttcccag

SEQ ID NO: 1149133 - DNA, 18 bp, Homo sapiens
tcctccttcccagggacc

SEQ ID NO: 1149134 - DNA, 13 bp, Homo sapiens
tcctccttcctgg

SEQ ID NO: 1149135 - DNA, 22 bp, Homo sapiens
tcctccttttcttcaccctccc

SEQ ID NO: 1149136 - DNA, 12 bp, Homo sapiens
tcctcgagccct

SEQ ID NO: 1149137 - DNA, 16 bp, Homo sapiens
tcctcgagccctcccc

SEQ ID NO: 1149138 - DNA, 15 bp, Homo sapiens
tcctcgcccccacca

SEQ ID NO: 1149139 - DNA, 17 bp, Homo sapiens
ttttgcaaaataagttt

SEQ ID NO: 1149140 - DNA, 19 bp, Homo sapiens
ttttgcaaagatttaatct

SEQ ID NO: 1149141 - DNA, 18 bp, Homo sapiens
ttttgcaaataagtgtat

SEQ ID NO: 1149142 - DNA, 23 bp, Homo sapiens
ttttgcaagtgaaggtttacaat

SEQ ID NO: 1149143 - DNA, 17 bp, Homo sapiens
ttttgcaataacttcta

SEQ ID NO: 1149144 - DNA, 20 bp, Homo sapiens
ttttgcacatgtttcctcta

SEQ ID NO: 1149145 - DNA, 18 bp, Homo sapiens
ttttgcagaaggaaatga

SEQ ID NO: 1149146 - DNA, 20 bp, Homo sapiens
ttttgcagaaggaaatgatg

SEQ ID NO: 1149147 - DNA, 14 bp, Homo sapiens
ttttgcagcagagg

SEQ ID NO: 1149148 - DNA, 21 bp, Homo sapiens
ttttgcagcccagacaaatgt

SEQ ID NO: 1149149 - DNA, 15 bp, Homo sapiens
ttttgcagtaactgt

SEQ ID NO: 1149150 - DNA, 15 bp, Homo sapiens
ttttgcatactgaaa

SEQ ID NO: 1149151 - DNA, 12 bp, Homo sapiens
ttttgcatgaaa

SEQ ID NO: 1149152 - DNA, 13 bp, Homo sapiens
ttttgcatgaaat

SEQ ID NO: 1149153 - DNA, 13 bp, Homo sapiens
ttttgcattcaaa

SEQ ID NO: 1149154 - DNA, 19 bp, Homo sapiens
ttttgcattccagaatctt

SEQ ID NO: 1149155 - DNA, 18 bp, Homo sapiens
ttttgcatttaaaacaga

SEQ ID NO: 1149156 - DNA, 15 bp, Homo sapiens
ttttgcatttagttt

SEQ ID NO: 1149157 - DNA, 22 bp, Homo sapiens
ttttgccactttggcttctcct

SEQ ID NO: 1149158 - DNA, 15 bp, Homo sapiens
ttttgccattaaact

SEQ ID NO: 1149159 - DNA, 21 bp, Homo sapiens
ttttgcccgttgaccagataa

SEQ ID NO: 1149160 - DNA, 11 bp, Homo sapiens
ttttgccctcc

SEQ ID NO: 1149161 - DNA, 13 bp, Homo sapiens
ttttgccctcctg

SEQ ID NO: 1149162 - DNA, 19 bp, Homo sapiens
ttttgccctttagggctgt

SEQ ID NO: 1149163 - DNA, 17 bp, Homo sapiens
ttttgccgctgagatat

SEQ ID NO: 1149164 - DNA, 13 bp, Homo sapiens
ttttgcctatctt

SEQ ID NO: 1149165 - DNA, 15 bp, Homo sapiens
ttttgcctatcttta

SEQ ID NO: 1149166 - DNA, 22 bp, Homo sapiens
ttttgcctttgtggcccatgaa

SEQ ID NO: 1149167 - DNA, 21 bp, Homo sapiens
ttttgcggttcaggaaaattg

SEQ ID NO: 1149168 - DNA, 16 bp, Homo sapiens
ttttgctataatcatt

SEQ ID NO: 1149169 - DNA, 16 bp, Homo sapiens
ttttgctgaattcctt

SEQ ID NO: 1149170 - DNA, 23 bp, Homo sapiens
ttttgctggaattcctaactttt

SEQ ID NO: 1149171 - DNA, 14 bp, Homo sapiens
ttttgctgtagaag

SEQ ID NO: 1149172 - DNA, 13 bp, Homo sapiens
ttttgctgtatat

SEQ ID NO: 1149173 - DNA, 17 bp, Homo sapiens
ttttgctgtctttctct

SEQ ID NO: 1149174 - DNA, 18 bp, Homo sapiens
ttttgcttaacattagat

SEQ ID NO: 1149175 - DNA, 23 bp, Homo sapiens
ttttgcttgttatattaagcaga

SEQ ID NO: 1149176 - DNA, 13 bp, Homo sapiens
ttttgctttggtt

SEQ ID NO: 1149177 - DNA, 21 bp, Homo sapiens
ttttgcttttggcaaaactct

SEQ ID NO: 1149178 - DNA, 13 bp, Homo sapiens
ttttgcttttgtt

SEQ ID NO: 1149179 - DNA, 15 bp, Homo sapiens
ttttggaaagaaatt

SEQ ID NO: 1149180 - DNA, 14 bp, Homo sapiens
ttttggaaagtcag

SEQ ID NO: 1149181 - DNA, 21 bp, Homo sapiens
ttttggaactaaagcaaattt

SEQ ID NO: 1149182 - DNA, 16 bp, Homo sapiens
ttttggaatctaagct

SEQ ID NO: 1149183 - DNA, 20 bp, Homo sapiens
ttttggagaaggttatcaaa

SEQ ID NO: 1149184 - DNA, 13 bp, Homo sapiens
ttttggaggtgct

SEQ ID NO: 1149185 - DNA, 17 bp, Homo sapiens
ttttggatcttgaatgt

SEQ ID NO: 1149186 - DNA, 22 bp, Homo sapiens
ttttggcaatgactcaaagtct

SEQ ID NO: 1149187 - DNA, 22 bp, Homo sapiens
ttttggctgaaattctcctgga

SEQ ID NO: 1149188 - DNA, 22 bp, Homo sapiens
ttttggctgagtactggaataa

SEQ ID NO: 1149189 - DNA, 16 bp, Homo sapiens
ttttggctttctccct

SEQ ID NO: 1149190 - DNA, 17 bp, Homo sapiens
ttttgggccattacccc

SEQ ID NO: 1149191 - DNA, 23 bp, Homo sapiens
ttttggggattttcaaaagataa

SEQ ID NO: 1149192 - DNA, 19 bp, Homo sapiens
ttttgggggtttttaatct

SEQ ID NO: 1149193 - DNA, 23 bp, Homo sapiens
ttttggggttttttttttctgaa

SEQ ID NO: 1149194 - DNA, 17 bp, Homo sapiens
ttttggtaataacaaac

SEQ ID NO: 1149195 - DNA, 19 bp, Homo sapiens
ttttggtacttattactgc

SEQ ID NO: 1149196 - DNA, 14 bp, Homo sapiens
ttttggtataatgt

SEQ ID NO: 1149197 - DNA, 19 bp, Homo sapiens
ttttggtataatgtttaaa

SEQ ID NO: 1149198 - DNA, 17 bp, Homo sapiens
ttttggtattacactgt

SEQ ID NO: 1149199 - DNA, 13 bp, Homo sapiens
ttttggtatttat

SEQ ID NO: 1149200 - DNA, 14 bp, Homo sapiens
ttttggtcccctcc

SEQ ID NO: 1149201 - DNA, 17 bp, Homo sapiens
ttttggtcccctccctc

SEQ ID NO: 1149202 - DNA, 19 bp, Homo sapiens
ttttggttatggagtcttg

SEQ ID NO: 1149203 - DNA, 15 bp, Homo sapiens
ttttggttgaataaa

SEQ ID NO: 1149204 - DNA, 22 bp, Homo sapiens
ttttggttgtcaatattaaata

SEQ ID NO: 1149205 - DNA, 22 bp, Homo sapiens
ttttggtttttcaacactgaaa

SEQ ID NO: 1149206 - DNA, 15 bp, Homo sapiens
ttttgtaaacattta

SEQ ID NO: 1149207 - DNA, 16 bp, Homo sapiens
ttttgtaaacatttat

SEQ ID NO: 1149208 - DNA, 21 bp, Homo sapiens
ttttgtaaagatgccgggttt

SEQ ID NO: 1149209 - DNA, 19 bp, Homo sapiens
ttttgtaaatactgcttga

SEQ ID NO: 1149210 - DNA, 19 bp, Homo sapiens
ttttgtaactacaaagctt

SEQ ID NO: 1149211 - DNA, 11 bp, Homo sapiens
ttttgtaagaa

SEQ ID NO: 1149212 - DNA, 19 bp, Homo sapiens
ttttgtaagttgaagcaaa

SEQ ID NO: 1149213 - DNA, 19 bp, Homo sapiens
ttttgtaatattctgtttt

SEQ ID NO: 1149214 - DNA, 20 bp, Homo sapiens
ttttgtaatattctgttttg

SEQ ID NO: 1149215 - DNA, 17 bp, Homo sapiens
ttttgtaatgcactgtt

SEQ ID NO: 1149216 - DNA, 19 bp, Homo sapiens
ttttgtaatgcactgtttt

SEQ ID NO: 1149217 - DNA, 21 bp, Homo sapiens
ttttgtaatgcactgttttta

SEQ ID NO: 1149218 - DNA, 18 bp, Homo sapiens
ttttgtaattgtgtaaaa

SEQ ID NO: 1149219 - DNA, 14 bp, Homo sapiens
ttttgtaatttaaa

SEQ ID NO: 1149220 - DNA, 14 bp, Homo sapiens
ttttgtacatactg

SEQ ID NO: 1149221 - DNA, 15 bp, Homo sapiens
ttttgtactgaatct

SEQ ID NO: 1149222 - DNA, 20 bp, Homo sapiens
ttttgtagagagagctgtat

SEQ ID NO: 1149223 - DNA, 23 bp, Homo sapiens
ttttgtagagagagctgtattaa

SEQ ID NO: 1149224 - DNA, 18 bp, Homo sapiens
ttttgtagctgctatata

SEQ ID NO: 1149225 - DNA, 23 bp, Homo sapiens
ttttgtaggggtcaaagaaatgc

SEQ ID NO: 1149226 - DNA, 16 bp, Homo sapiens
ttttgtataaaataga

SEQ ID NO: 1149227 - DNA, 16 bp, Homo sapiens
ttttgtatagtaaagt

SEQ ID NO: 1149228 - DNA, 17 bp, Homo sapiens
ttttgtatagtaaagtg

SEQ ID NO: 1149229 - DNA, 18 bp, Homo sapiens
ttttgtatagtaaagtga

SEQ ID NO: 1149230 - DNA, 20 bp, Homo sapiens
ttttgtatagttaacacact

SEQ ID NO: 1149231 - DNA, 14 bp, Homo sapiens
ttttgtatcttcct

SEQ ID NO: 1149232 - DNA, 14 bp, Homo sapiens
ttttgtatcttggg

SEQ ID NO: 1149233 - DNA, 23 bp, Homo sapiens
ttttgtatgaaatatatgtgaaa

SEQ ID NO: 1149234 - DNA, 21 bp, Homo sapiens
ttttgtatgaggtcctcaggt

SEQ ID NO: 1149235 - DNA, 11 bp, Homo sapiens
ttttgtatgta

SEQ ID NO: 1149236 - DNA, 13 bp, Homo sapiens
ttttgtatgtaaa

SEQ ID NO: 1149237 - DNA, 21 bp, Homo sapiens
ttttgtattacatctaatgct

SEQ ID NO: 1149238 - DNA, 17 bp, Homo sapiens
ttttgtattctctgagc

SEQ ID NO: 1149239 - DNA, 18 bp, Homo sapiens
ttttgtatttttaatggg

SEQ ID NO: 1149240 - DNA, 15 bp, Homo sapiens
ttttgtcaacattgt

SEQ ID NO: 1149241 - DNA, 16 bp, Homo sapiens
ttttgtcaacattgtg

SEQ ID NO: 1149242 - DNA, 14 bp, Homo sapiens
ttttgtctaattat

SEQ ID NO: 1149243 - DNA, 13 bp, Homo sapiens
ttttgtcttgaat

SEQ ID NO: 1149244 - DNA, 13 bp, Homo sapiens
ttttgtcttgtgt

SEQ ID NO: 1149245 - DNA, 24 bp, Homo sapiens
ttttgtgaaatgaaaacatgtaat

SEQ ID NO: 1149246 - DNA, 14 bp, Homo sapiens
ttttgtgaactttt

SEQ ID NO: 1149247 - DNA, 21 bp, Homo sapiens
ttttgtgaagtttaattgact

SEQ ID NO: 1149248 - DNA, 19 bp, Homo sapiens
ttttgtgaatttgggtagg

SEQ ID NO: 1149249 - DNA, 23 bp, Homo sapiens
ttttgtgactatatagagatgtt

SEQ ID NO: 1149250 - DNA, 17 bp, Homo sapiens
ttttgtgagcctctttg

SEQ ID NO: 1149251 - DNA, 15 bp, Homo sapiens
ttttgtgatgaacat

SEQ ID NO: 1149252 - DNA, 18 bp, Homo sapiens
ttttgtgatgatgctgtg

SEQ ID NO: 1149253 - DNA, 16 bp, Homo sapiens
ttttgtgatttagaac

SEQ ID NO: 1149254 - DNA, 12 bp, Homo sapiens
ttttgtgcacag

SEQ ID NO: 1149255 - DNA, 12 bp, Homo sapiens
ttttgtgcattc

SEQ ID NO: 1149256 - DNA, 22 bp, Homo sapiens
ttttgtgccattatatttgcat

SEQ ID NO: 1149257 - DNA, 22 bp, Homo sapiens
ttttgtgctcaaaataaaaagc

SEQ ID NO: 1149258 - DNA, 22 bp, Homo sapiens
ttttgtgggtttctctgtgctc

SEQ ID NO: 1149259 - DNA, 22 bp, Homo sapiens
ttttgtggttctattttacttt

SEQ ID NO: 1149260 - DNA, 17 bp, Homo sapiens
ttttgtggtttggaata

SEQ ID NO: 1149261 - DNA, 13 bp, Homo sapiens
ttttgtgtacagt

SEQ ID NO: 1149262 - DNA, 16 bp, Homo sapiens
ttttgtgtaggtgtct

SEQ ID NO: 1149263 - DNA, 18 bp, Homo sapiens
tcaggcccagctgctccc

SEQ ID NO: 1149264 - DNA, 16 bp, Homo sapiens
tcaggcccggcagggc

SEQ ID NO: 1149265 - DNA, 19 bp, Homo sapiens
tcaggcccgtcggagctgc

SEQ ID NO: 1149266 - DNA, 20 bp, Homo sapiens
tcaggcccgtcggagctgcc

SEQ ID NO: 1149267 - DNA, 15 bp, Homo sapiens
tcaggccctctgcct

SEQ ID NO: 1149268 - DNA, 16 bp, Homo sapiens
tcaggccctctgcctg

SEQ ID NO: 1149269 - DNA, 18 bp, Homo sapiens
tcaggccctctgcctgca

SEQ ID NO: 1149270 - DNA, 19 bp, Homo sapiens
tcaggccctctgcctgcac

SEQ ID NO: 1149271 - DNA, 20 bp, Homo sapiens
tcaggccctctgcctgcact

SEQ ID NO: 1149272 - DNA, 17 bp, Homo sapiens
tcaggcctccctctctc

SEQ ID NO: 1149273 - DNA, 14 bp, Homo sapiens
tcaggcctgggcag

SEQ ID NO: 1149274 - DNA, 19 bp, Homo sapiens
tcaggcctgggcaggaccc

SEQ ID NO: 1149275 - DNA, 20 bp, Homo sapiens
tcaggcgatccacctgtctc

SEQ ID NO: 1149276 - DNA, 16 bp, Homo sapiens
tcaggctccattagga

SEQ ID NO: 1149277 - DNA, 20 bp, Homo sapiens
tcaggctccattaggatttg

SEQ ID NO: 1149278 - DNA, 18 bp, Homo sapiens
tcaggctctgttcctcaa

SEQ ID NO: 1149279 - DNA, 23 bp, Homo sapiens
tcaggctctgttcctcaatggcc

SEQ ID NO: 1149280 - DNA, 21 bp, Homo sapiens
tcaggctcttctcctttcaca

SEQ ID NO: 1149281 - DNA, 22 bp, Homo sapiens
tcaggctgcagctggacagagg

SEQ ID NO: 1149282 - DNA, 18 bp, Homo sapiens
tcaggctgggacaggctt

SEQ ID NO: 1149283 - DNA, 14 bp, Homo sapiens
tcaggcttccttgg

SEQ ID NO: 1149284 - DNA, 15 bp, Homo sapiens
tcaggcttccttggc

SEQ ID NO: 1149285 - DNA, 23 bp, Homo sapiens
tcaggcttccttggcatcacagg

SEQ ID NO: 1149286 - DNA, 22 bp, Homo sapiens
tcaggcttgagggagggctggg

SEQ ID NO: 1149287 - DNA, 19 bp, Homo sapiens
tcagggaaaagcagctctc

SEQ ID NO: 1149288 - DNA, 23 bp, Homo sapiens
tcagggaaaagcagctctcccct

SEQ ID NO: 1149289 - DNA, 21 bp, Homo sapiens
tcagggaaactaagattcttt

SEQ ID NO: 1149290 - DNA, 15 bp, Homo sapiens
tcagggaccaaggac

SEQ ID NO: 1149291 - DNA, 16 bp, Homo sapiens
tcagggaccggtgctg

SEQ ID NO: 1149292 - DNA, 20 bp, Homo sapiens
tcagggaccggtgctgcagg

SEQ ID NO: 1149293 - DNA, 17 bp, Homo sapiens
tcagggaccgtccaggg

SEQ ID NO: 1149294 - DNA, 18 bp, Homo sapiens
tcagggaccgtccagggg

SEQ ID NO: 1149295 - DNA, 17 bp, Homo sapiens
tcagggacctcaggggc

SEQ ID NO: 1149296 - DNA, 19 bp, Homo sapiens
tcagggacctcaggggcac

SEQ ID NO: 1149297 - DNA, 18 bp, Homo sapiens
tcagggagcctccccatc

SEQ ID NO: 1149298 - DNA, 16 bp, Homo sapiens
tcagggagggaagggg

SEQ ID NO: 1149299 - DNA, 22 bp, Homo sapiens
tcagggaggggccggctggcct

SEQ ID NO: 1149300 - DNA, 15 bp, Homo sapiens
tcagggaggtcattt

SEQ ID NO: 1149301 - DNA, 22 bp, Homo sapiens
tcagggagtgctggctcacagt

SEQ ID NO: 1149302 - DNA, 17 bp, Homo sapiens
tcagggatgagttgagg

SEQ ID NO: 1149303 - DNA, 18 bp, Homo sapiens
tcagggcacgcaggacca

SEQ ID NO: 1149304 - DNA, 19 bp, Homo sapiens
tcagggcagcgccaggctg

SEQ ID NO: 1149305 - DNA, 12 bp, Homo sapiens
tcagggcagctg

SEQ ID NO: 1149306 - DNA, 18 bp, Homo sapiens
tcagggcagctgcctggc

SEQ ID NO: 1149307 - DNA, 19 bp, Homo sapiens
tcagggccagaaggagggc

SEQ ID NO: 1149308 - DNA, 22 bp, Homo sapiens
tcagggccagtcctcctgggag

SEQ ID NO: 1149309 - DNA, 14 bp, Homo sapiens
tcagggccatgctg

SEQ ID NO: 1149310 - DNA, 21 bp, Homo sapiens
tcagggccatgctgaggcctg

SEQ ID NO: 1149311 - DNA, 14 bp, Homo sapiens
tcagggcccaagtc

SEQ ID NO: 1149312 - DNA, 16 bp, Homo sapiens
tcagggccccagcact

SEQ ID NO: 1149313 - DNA, 12 bp, Homo sapiens
tcagggccctgc

SEQ ID NO: 1149314 - DNA, 14 bp, Homo sapiens
tcagggccctgccc

SEQ ID NO: 1149315 - DNA, 21 bp, Homo sapiens
tcagggcctggggcctgagag

SEQ ID NO: 1149316 - DNA, 23 bp, Homo sapiens
tcagggcctggggcctgagagaa

SEQ ID NO: 1149317 - DNA, 20 bp, Homo sapiens
tcagggctcagtcttttgag

SEQ ID NO: 1149318 - DNA, 16 bp, Homo sapiens
tcagggctcccagggg

SEQ ID NO: 1149319 - DNA, 15 bp, Homo sapiens
tcagggctcctccca

SEQ ID NO: 1149320 - DNA, 17 bp, Homo sapiens
tcagggctggagcctgg

SEQ ID NO: 1149321 - DNA, 18 bp, Homo sapiens
tcagggctggctcctgat

SEQ ID NO: 1149322 - DNA, 16 bp, Homo sapiens
tcagggctgtcccagc

SEQ ID NO: 1149323 - DNA, 20 bp, Homo sapiens
tcagggctgtcccagccccg

SEQ ID NO: 1149324 - DNA, 14 bp, Homo sapiens
tcaggggaagggca

SEQ ID NO: 1149325 - DNA, 15 bp, Homo sapiens
tcaggggaagggcag

SEQ ID NO: 1149326 - DNA, 17 bp, Homo sapiens
tcaggggaagggcaggc

SEQ ID NO: 1149327 - DNA, 15 bp, Homo sapiens
tcaggggacactggc

SEQ ID NO: 1149328 - DNA, 23 bp, Homo sapiens
tcaggggacactggccccacagg

SEQ ID NO: 1149329 - DNA, 12 bp, Homo sapiens
tcaggggacccc

SEQ ID NO: 1149330 - DNA, 18 bp, Homo sapiens
tcaggggactcagccctg

SEQ ID NO: 1149331 - DNA, 15 bp, Homo sapiens
tcaggggagcaagct

SEQ ID NO: 1149332 - DNA, 15 bp, Homo sapiens
tcaggggatgtttac

SEQ ID NO: 1149333 - DNA, 22 bp, Homo sapiens
tcaggggcacctccggctgcct

SEQ ID NO: 1149334 - DNA, 12 bp, Homo sapiens
tcaggggcaggt

SEQ ID NO: 1149335 - DNA, 23 bp, Homo sapiens
tcaggggcaggtggtggaggggc

SEQ ID NO: 1149336 - DNA, 13 bp, Homo sapiens
tcaggggccagag

SEQ ID NO: 1149337 - DNA, 15 bp, Homo sapiens
tcaggggccagagag

SEQ ID NO: 1149338 - DNA, 18 bp, Homo sapiens
tcaggggccagagagcag

SEQ ID NO: 1149339 - DNA, 10 bp, Homo sapiens
tcaggggctc

SEQ ID NO: 1149340 - DNA, 13 bp, Homo sapiens
tcaggggctccct

SEQ ID NO: 1149341 - DNA, 22 bp, Homo sapiens
tcaggggctgggcatcccagct

SEQ ID NO: 1149342 - DNA, 23 bp, Homo sapiens
tcaggggctgggcatcccagctt

SEQ ID NO: 1149343 - DNA, 14 bp, Homo sapiens
tcaggggctgtttg

SEQ ID NO: 1149344 - DNA, 16 bp, Homo sapiens
tcaggggctttgggcc

SEQ ID NO: 1149345 - DNA, 18 bp, Homo sapiens
tcaggggctttgggccca

SEQ ID NO: 1149346 - DNA, 21 bp, Homo sapiens
tcaggggctttgggcccaaga

SEQ ID NO: 1149347 - DNA, 17 bp, Homo sapiens
tcagggggaagaagcag

SEQ ID NO: 1149348 - DNA, 17 bp, Homo sapiens
tcagggggccagctggg

SEQ ID NO: 1149349 - DNA, 22 bp, Homo sapiens
tcagggggccagctggggagat

SEQ ID NO: 1149350 - DNA, 17 bp, Homo sapiens
tcagggggtaggagagc

SEQ ID NO: 1149351 - DNA, 20 bp, Homo sapiens
tcaggggtacattctagctg

SEQ ID NO: 1149352 - DNA, 16 bp, Homo sapiens
tcaggggtcaggtgtc

SEQ ID NO: 1149353 - DNA, 18 bp, Homo sapiens
tcaggggtgcattctggc

SEQ ID NO: 1149354 - DNA, 22 bp, Homo sapiens
tcaggggttcgagaccagtctg

SEQ ID NO: 1149355 - DNA, 21 bp, Homo sapiens
tcagggtccaggagagcctgg

SEQ ID NO: 1149356 - DNA, 22 bp, Homo sapiens
tcagggtccaggagagcctggg

SEQ ID NO: 1149357 - DNA, 23 bp, Homo sapiens
tcagggtccaggagagcctgggg

SEQ ID NO: 1149358 - DNA, 19 bp, Homo sapiens
tcagggtgggaagaaagaa

SEQ ID NO: 1149359 - DNA, 18 bp, Homo sapiens
tcagggtgggccactctc

SEQ ID NO: 1149360 - DNA, 17 bp, Homo sapiens
tcagggtttaatagact

SEQ ID NO: 1149361 - DNA, 17 bp, Homo sapiens
tcaggtaacactacaga

SEQ ID NO: 1149362 - DNA, 16 bp, Homo sapiens
tcaggtaatacaaact

SEQ ID NO: 1149363 - DNA, 20 bp, Homo sapiens
tcaggtacagaaaacatgtt

SEQ ID NO: 1149364 - DNA, 15 bp, Homo sapiens
tcaggtacagcgggc

SEQ ID NO: 1149365 - DNA, 21 bp, Homo sapiens
tcaggtacagcgggctgtgcc

SEQ ID NO: 1149366 - DNA, 16 bp, Homo sapiens
tcaggtacctggagtt

SEQ ID NO: 1149367 - DNA, 23 bp, Homo sapiens
tcaggtaggcccttgtcctgcca

SEQ ID NO: 1149368 - DNA, 15 bp, Homo sapiens
tcaggtatgttgcct

SEQ ID NO: 1149369 - DNA, 16 bp, Homo sapiens
tcaggtatgttgcctt

SEQ ID NO: 1149370 - DNA, 22 bp, Homo sapiens
tcaggtcagctgggagccagtg

SEQ ID NO: 1149371 - DNA, 16 bp, Homo sapiens
tcaggtccccatggct

SEQ ID NO: 1149372 - DNA, 15 bp, Homo sapiens
tcaggtcgtagcatt

SEQ ID NO: 1149373 - DNA, 21 bp, Homo sapiens
tcaggtctcccacgtgggaga

SEQ ID NO: 1149374 - DNA, 15 bp, Homo sapiens
tcaggtctgggcaag

SEQ ID NO: 1149375 - DNA, 16 bp, Homo sapiens
tcaggtctgggcaagt

SEQ ID NO: 1149376 - DNA, 20 bp, Homo sapiens
tcaggtctgtaactgcccag

SEQ ID NO: 1149377 - DNA, 22 bp, Homo sapiens
tcaggtctgtaactgcccagcc

SEQ ID NO: 1149378 - DNA, 21 bp, Homo sapiens
tcaggtgacttctagcagaga

SEQ ID NO: 1149379 - DNA, 18 bp, Homo sapiens
tcaggtgaggcatcttta

SEQ ID NO: 1149380 - DNA, 19 bp, Homo sapiens
tcaggtgatcaaaataaag

SEQ ID NO: 1149381 - DNA, 21 bp, Homo sapiens
tcaggtgatccgcccacctca

SEQ ID NO: 1149382 - DNA, 20 bp, Homo sapiens
tcaggtgatctgcccgcctc

SEQ ID NO: 1149383 - DNA, 22 bp, Homo sapiens
tcaggtgcacacatcaccaggt

SEQ ID NO: 1149384 - DNA, 16 bp, Homo sapiens
tcaggtgccactccct

SEQ ID NO: 1149385 - DNA, 21 bp, Homo sapiens
tcaggtgccactccctgagct

SEQ ID NO: 1149386 - DNA, 23 bp, Homo sapiens
ttttgtgtatattggtgtatatt

SEQ ID NO: 1149387 - DNA, 11 bp, Homo sapiens
ttttgtgtcct

SEQ ID NO: 1149388 - DNA, 13 bp, Homo sapiens
ttttgtgtcctcc

SEQ ID NO: 1149389 - DNA, 20 bp, Homo sapiens
ttttgtgtcctccaggagct

SEQ ID NO: 1149390 - DNA, 20 bp, Homo sapiens
ttttgtgtcttttaaactgg

SEQ ID NO: 1149391 - DNA, 20 bp, Homo sapiens
ttttgtgtgaccaactgtgt

SEQ ID NO: 1149392 - DNA, 18 bp, Homo sapiens
ttttgtgttcctatggaa

SEQ ID NO: 1149393 - DNA, 15 bp, Homo sapiens
ttttgtgtttctaaa

SEQ ID NO: 1149394 - DNA, 16 bp, Homo sapiens
ttttgtgtttgttgta

SEQ ID NO: 1149395 - DNA, 22 bp, Homo sapiens
ttttgttaaagctggaacattt

SEQ ID NO: 1149396 - DNA, 16 bp, Homo sapiens
ttttgttaatattaaa

SEQ ID NO: 1149397 - DNA, 13 bp, Homo sapiens
ttttgttactgtt

SEQ ID NO: 1149398 - DNA, 16 bp, Homo sapiens
ttttgttactgtttta

SEQ ID NO: 1149399 - DNA, 16 bp, Homo sapiens
ttttgttcaatgttcc

SEQ ID NO: 1149400 - DNA, 15 bp, Homo sapiens
ttttgttccacaagt

SEQ ID NO: 1149401 - DNA, 18 bp, Homo sapiens
ttttgttgacattctgaa

SEQ ID NO: 1149402 - DNA, 20 bp, Homo sapiens
ttttgttgacattctgaatg

SEQ ID NO: 1149403 - DNA, 16 bp, Homo sapiens
ttttgttgccccagaa

SEQ ID NO: 1149404 - DNA, 21 bp, Homo sapiens
ttttgttgtttcttaaataag

SEQ ID NO: 1149405 - DNA, 12 bp, Homo sapiens
ttttgtttcaga

SEQ ID NO: 1149406 - DNA, 19 bp, Homo sapiens
ttttgtttcatattgatgt

SEQ ID NO: 1149407 - DNA, 13 bp, Homo sapiens
ttttgtttccttt

SEQ ID NO: 1149408 - DNA, 15 bp, Homo sapiens
ttttgtttcttccaa

SEQ ID NO: 1149409 - DNA, 19 bp, Homo sapiens
ttttgtttgtttgagacag

SEQ ID NO: 1149410 - DNA, 20 bp, Homo sapiens
ttttgtttgtttgagacagg

SEQ ID NO: 1149411 - DNA, 16 bp, Homo sapiens
ttttgttttaaaatta

SEQ ID NO: 1149412 - DNA, 14 bp, Homo sapiens
ttttgttttacttt

SEQ ID NO: 1149413 - DNA, 13 bp, Homo sapiens
ttttgttttgaaa

SEQ ID NO: 1149414 - DNA, 18 bp, Homo sapiens
ttttgttttgaaagttta

SEQ ID NO: 1149415 - DNA, 15 bp, Homo sapiens
ttttgttttggctga

SEQ ID NO: 1149416 - DNA, 23 bp, Homo sapiens
tttttaaaaaagaaaaagacaat

SEQ ID NO: 1149417 - DNA, 19 bp, Homo sapiens
tttttaaaaaatattttct

SEQ ID NO: 1149418 - DNA, 15 bp, Homo sapiens
tttttaaaacaaaag

SEQ ID NO: 1149419 - DNA, 13 bp, Homo sapiens
tttttaaaacact

SEQ ID NO: 1149420 - DNA, 16 bp, Homo sapiens
tttttaaaacactaaa

SEQ ID NO: 1149421 - DNA, 11 bp, Homo sapiens
tttttaaaagt

SEQ ID NO: 1149422 - DNA, 19 bp, Homo sapiens
tttttaaaatatttaactt

SEQ ID NO: 1149423 - DNA, 21 bp, Homo sapiens
tttttaaaatatttaactttt

SEQ ID NO: 1149424 - DNA, 15 bp, Homo sapiens
tttttaaactgtaca

SEQ ID NO: 1149425 - DNA, 17 bp, Homo sapiens
tttttaaactgtacagt

SEQ ID NO: 1149426 - DNA, 21 bp, Homo sapiens
tttttaaactgtacagtgtct

SEQ ID NO: 1149427 - DNA, 11 bp, Homo sapiens
tttttaaagaa

SEQ ID NO: 1149428 - DNA, 18 bp, Homo sapiens
tttttaaagaagagtgac

SEQ ID NO: 1149429 - DNA, 17 bp, Homo sapiens
tttttaaagacagagtc

SEQ ID NO: 1149430 - DNA, 19 bp, Homo sapiens
tttttaaagcctggcttct

SEQ ID NO: 1149431 - DNA, 17 bp, Homo sapiens
tttttaaagtaaattat

SEQ ID NO: 1149432 - DNA, 19 bp, Homo sapiens
tttttaaataaaagcacaa

SEQ ID NO: 1149433 - DNA, 19 bp, Homo sapiens
tttttaaatgattccaaat

SEQ ID NO: 1149434 - DNA, 20 bp, Homo sapiens
tttttaaatgtaaagatatt

SEQ ID NO: 1149435 - DNA, 20 bp, Homo sapiens
tttttaaattttatttcctg

SEQ ID NO: 1149436 - DNA, 19 bp, Homo sapiens
tttttaaattttgtaatga

SEQ ID NO: 1149437 - DNA, 16 bp, Homo sapiens
tttttaacatctttgt

SEQ ID NO: 1149438 - DNA, 23 bp, Homo sapiens
tttttaactgattcttatgatta

SEQ ID NO: 1149439 - DNA, 13 bp, Homo sapiens
tttttaagaaaaa

SEQ ID NO: 1149440 - DNA, 17 bp, Homo sapiens
tttttaagaatatctgt

SEQ ID NO: 1149441 - DNA, 18 bp, Homo sapiens
tttttaagaatatctgta

SEQ ID NO: 1149442 - DNA, 11 bp, Homo sapiens
tttttaagact

SEQ ID NO: 1149443 - DNA, 11 bp, Homo sapiens
tttttaagata

SEQ ID NO: 1149444 - DNA, 16 bp, Homo sapiens
tttttaagatagtgta

SEQ ID NO: 1149445 - DNA, 18 bp, Homo sapiens
tttttaagctatcagcaa

SEQ ID NO: 1149446 - DNA, 15 bp, Homo sapiens
tttttaataaactac

SEQ ID NO: 1149447 - DNA, 17 bp, Homo sapiens
tttttaataaagacagg

SEQ ID NO: 1149448 - DNA, 20 bp, Homo sapiens
tttttaataaagacagggtt

SEQ ID NO: 1149449 - DNA, 21 bp, Homo sapiens
tttttaatagcactaaccaat

SEQ ID NO: 1149450 - DNA, 14 bp, Homo sapiens
tttttaatatgctt

SEQ ID NO: 1149451 - DNA, 17 bp, Homo sapiens
tttttaatcatgaatat

SEQ ID NO: 1149452 - DNA, 16 bp, Homo sapiens
tttttaatctagacaa

SEQ ID NO: 1149453 - DNA, 17 bp, Homo sapiens
tttttaatgtattccct

SEQ ID NO: 1149454 - DNA, 11 bp, Homo sapiens
tttttaattta

SEQ ID NO: 1149455 - DNA, 21 bp, Homo sapiens
tttttaatttattattgaaat

SEQ ID NO: 1149456 - DNA, 22 bp, Homo sapiens
tttttaatttgatgaaagctga

SEQ ID NO: 1149457 - DNA, 19 bp, Homo sapiens
tttttacaaaactgctttg

SEQ ID NO: 1149458 - DNA, 13 bp, Homo sapiens
tttttacagctgt

SEQ ID NO: 1149459 - DNA, 19 bp, Homo sapiens
tttttacagctgtgttatt

SEQ ID NO: 1149460 - DNA, 18 bp, Homo sapiens
tttttacattatgcaaat

SEQ ID NO: 1149461 - DNA, 11 bp, Homo sapiens
tttttacattt

SEQ ID NO: 1149462 - DNA, 13 bp, Homo sapiens
tttttacatttca

SEQ ID NO: 1149463 - DNA, 22 bp, Homo sapiens
tttttacctaccacagtgtctg

SEQ ID NO: 1149464 - DNA, 21 bp, Homo sapiens
tttttactcagtgactgttgt

SEQ ID NO: 1149465 - DNA, 12 bp, Homo sapiens
tttttagaaagc

SEQ ID NO: 1149466 - DNA, 14 bp, Homo sapiens
tttttagatgtatt

SEQ ID NO: 1149467 - DNA, 21 bp, Homo sapiens
tttttagctttgtgtttactt

SEQ ID NO: 1149468 - DNA, 15 bp, Homo sapiens
tttttataatatcca

SEQ ID NO: 1149469 - DNA, 13 bp, Homo sapiens
tttttatacacaa

SEQ ID NO: 1149470 - DNA, 15 bp, Homo sapiens
tttttatactcagaa

SEQ ID NO: 1149471 - DNA, 21 bp, Homo sapiens
tttttatactccatacataac

SEQ ID NO: 1149472 - DNA, 21 bp, Homo sapiens
tttttatatcatgcaaaatat

SEQ ID NO: 1149473 - DNA, 14 bp, Homo sapiens
tttttatattactt

SEQ ID NO: 1149474 - DNA, 22 bp, Homo sapiens
tttttatattacttttgtaaat

SEQ ID NO: 1149475 - DNA, 14 bp, Homo sapiens
tttttatattgcct

SEQ ID NO: 1149476 - DNA, 15 bp, Homo sapiens
tttttatatttagtt

SEQ ID NO: 1149477 - DNA, 22 bp, Homo sapiens
tttttatatttcctttatgtga

SEQ ID NO: 1149478 - DNA, 17 bp, Homo sapiens
tttttatcccatttagt

SEQ ID NO: 1149479 - DNA, 13 bp, Homo sapiens
tttttatgcaaaa

SEQ ID NO: 1149480 - DNA, 20 bp, Homo sapiens
tttttatggcttttgtgcat

SEQ ID NO: 1149481 - DNA, 21 bp, Homo sapiens
tttttatggcttttgtgcatt

SEQ ID NO: 1149482 - DNA, 13 bp, Homo sapiens
tttttattaaatg

SEQ ID NO: 1149483 - DNA, 14 bp, Homo sapiens
tttttattactttt

SEQ ID NO: 1149484 - DNA, 15 bp, Homo sapiens
tttttattatgcatt

SEQ ID NO: 1149485 - DNA, 17 bp, Homo sapiens
tttttattccctgccca

SEQ ID NO: 1149486 - DNA, 21 bp, Homo sapiens
tttttatttaattaaatgtat

SEQ ID NO: 1149487 - DNA, 13 bp, Homo sapiens
tttttatttacat

SEQ ID NO: 1149488 - DNA, 16 bp, Homo sapiens
tttttatttctactgt

SEQ ID NO: 1149489 - DNA, 12 bp, Homo sapiens
tttttatttctg

SEQ ID NO: 1149490 - DNA, 19 bp, Homo sapiens
tttttatttctgatagttt

SEQ ID NO: 1149491 - DNA, 12 bp, Homo sapiens
tttttatttctt

SEQ ID NO: 1149492 - DNA, 20 bp, Homo sapiens
tttttcaaaatagaaaagtt

SEQ ID NO: 1149493 - DNA, 19 bp, Homo sapiens
tttttcaaagatgtgttgc

SEQ ID NO: 1149494 - DNA, 13 bp, Homo sapiens
tttttcaaggaag

SEQ ID NO: 1149495 - DNA, 23 bp, Homo sapiens
tttttcaaggcatttattgccat

SEQ ID NO: 1149496 - DNA, 16 bp, Homo sapiens
tttttcaatatattga

SEQ ID NO: 1149497 - DNA, 20 bp, Homo sapiens
tttttcaatatattgaactt

SEQ ID NO: 1149498 - DNA, 21 bp, Homo sapiens
tttttcaatcaactttactgt

SEQ ID NO: 1149499 - DNA, 11 bp, Homo sapiens
tttttcactgt

SEQ ID NO: 1149500 - DNA, 15 bp, Homo sapiens
tttttcactttgaaa

SEQ ID NO: 1149501 - DNA, 13 bp, Homo sapiens
tttttcactttgg

SEQ ID NO: 1149502 - DNA, 14 bp, Homo sapiens
tttttcagaaaaat

SEQ ID NO: 1149503 - DNA, 11 bp, Homo sapiens
tttttcataga

SEQ ID NO: 1149504 - DNA, 16 bp, Homo sapiens
tttttcatagtgcctt

SEQ ID NO: 1149505 - DNA, 15 bp, Homo sapiens
tttttcatcttcagt

SEQ ID NO: 1149506 - DNA, 16 bp, Homo sapiens
tttttcatgataatga

SEQ ID NO: 1149507 - DNA, 13 bp, Homo sapiens
tttttcatttgtt

SEQ ID NO: 1149508 - DNA, 21 bp, Homo sapiens
tttttccaactactaatagaa

SEQ ID NO: 1149509 - DNA, 23 bp, Homo sapiens
tttttccaactactaatagaata

SEQ ID NO: 1149510 - DNA, 13 bp, Homo sapiens
tttttccaggact

SEQ ID NO: 1149511 - DNA, 13 bp, Homo sapiens
tttttccatctgt

SEQ ID NO: 1149512 - DNA, 22 bp, Homo sapiens
tcaggtgcctccaattggtgct

SEQ ID NO: 1149513 - DNA, 18 bp, Homo sapiens
tcaggtgccttacatctt

SEQ ID NO: 1149514 - DNA, 13 bp, Homo sapiens
tcaggtgctgtcc

SEQ ID NO: 1149515 - DNA, 16 bp, Homo sapiens
tcaggtgctgtccatg

SEQ ID NO: 1149516 - DNA, 19 bp, Homo sapiens
tcaggtgggcggtgtgtct

SEQ ID NO: 1149517 - DNA, 21 bp, Homo sapiens
tcaggtgggcggtgtgtcttt

SEQ ID NO: 1149518 - DNA, 15 bp, Homo sapiens
tcaggtgtcaggccc

SEQ ID NO: 1149519 - DNA, 16 bp, Homo sapiens
tcaggtgtcaggcccg

SEQ ID NO: 1149520 - DNA, 17 bp, Homo sapiens
tcaggttcttgcctttc

SEQ ID NO: 1149521 - DNA, 22 bp, Homo sapiens
tcaggttgtctgaagtcactgc

SEQ ID NO: 1149522 - DNA, 19 bp, Homo sapiens
tcaggtttaacatttgcct

SEQ ID NO: 1149523 - DNA, 16 bp, Homo sapiens
tcaggtttgagaaaaa

SEQ ID NO: 1149524 - DNA, 17 bp, Homo sapiens
tcaggtttgcctgaggg

SEQ ID NO: 1149525 - DNA, 14 bp, Homo sapiens
tcaggttttcaggt

SEQ ID NO: 1149526 - DNA, 21 bp, Homo sapiens
tcagtaaaattatactgtgtg

SEQ ID NO: 1149527 - DNA, 22 bp, Homo sapiens
tcagtaaacgggaacatgcccc

SEQ ID NO: 1149528 - DNA, 17 bp, Homo sapiens
tcagtaaataactggaa

SEQ ID NO: 1149529 - DNA, 14 bp, Homo sapiens
tcagtaaataatga

SEQ ID NO: 1149530 - DNA, 16 bp, Homo sapiens
tcagtaaataatgaaa

SEQ ID NO: 1149531 - DNA, 14 bp, Homo sapiens
tcagtaaatagtgt

SEQ ID NO: 1149532 - DNA, 16 bp, Homo sapiens
tcagtaagctgtgtgg

SEQ ID NO: 1149533 - DNA, 23 bp, Homo sapiens
tcagtaagttatctttgaatatg

SEQ ID NO: 1149534 - DNA, 14 bp, Homo sapiens
tcagtaatatttat

SEQ ID NO: 1149535 - DNA, 18 bp, Homo sapiens
tcagtaatttagaaatca

SEQ ID NO: 1149536 - DNA, 13 bp, Homo sapiens
tcagtaatttata

SEQ ID NO: 1149537 - DNA, 22 bp, Homo sapiens
tcagtacaacccataatcatgt

SEQ ID NO: 1149538 - DNA, 17 bp, Homo sapiens
tcagtaccctctcagct

SEQ ID NO: 1149539 - DNA, 20 bp, Homo sapiens
tcagtacgatcaagttgttg

SEQ ID NO: 1149540 - DNA, 14 bp, Homo sapiens
tcagtactgacttt

SEQ ID NO: 1149541 - DNA, 23 bp, Homo sapiens
tcagtacttttttaaatattttc

SEQ ID NO: 1149542 - DNA, 16 bp, Homo sapiens
tcagtagatttccttt

SEQ ID NO: 1149543 - DNA, 17 bp, Homo sapiens
tcagtaggtccaagggc

SEQ ID NO: 1149544 - DNA, 20 bp, Homo sapiens
tcagtaggtccaagggccat

SEQ ID NO: 1149545 - DNA, 20 bp, Homo sapiens
tcagtaggttgaactatgaa

SEQ ID NO: 1149546 - DNA, 20 bp, Homo sapiens
tcagtagtcacaaactgatc

SEQ ID NO: 1149547 - DNA, 15 bp, Homo sapiens
tcagtagtccctgca

SEQ ID NO: 1149548 - DNA, 14 bp, Homo sapiens
tcagtagtgtacat

SEQ ID NO: 1149549 - DNA, 15 bp, Homo sapiens
tcagtagtttcatgt

SEQ ID NO: 1149550 - DNA, 15 bp, Homo sapiens
tcagtagtttgatca

SEQ ID NO: 1149551 - DNA, 17 bp, Homo sapiens
tcagtataaacaaagtt

SEQ ID NO: 1149552 - DNA, 13 bp, Homo sapiens
tcagtatactgtg

SEQ ID NO: 1149553 - DNA, 14 bp, Homo sapiens
tcagtatactgtgt

SEQ ID NO: 1149554 - DNA, 17 bp, Homo sapiens
tcagtatccaggctttg

SEQ ID NO: 1149555 - DNA, 20 bp, Homo sapiens
tcagtatcttagagtttaca

SEQ ID NO: 1149556 - DNA, 21 bp, Homo sapiens
tcagtatgatttatcctcaca

SEQ ID NO: 1149557 - DNA, 23 bp, Homo sapiens
tcagtatgctgcccctgtcttgc

SEQ ID NO: 1149558 - DNA, 20 bp, Homo sapiens
tcagtattactttctgccgc

SEQ ID NO: 1149559 - DNA, 20 bp, Homo sapiens
tcagtattagatgcacttaa

SEQ ID NO: 1149560 - DNA, 20 bp, Homo sapiens
tcagtattatctaaatgaat

SEQ ID NO: 1149561 - DNA, 12 bp, Homo sapiens
tcagtattctgc

SEQ ID NO: 1149562 - DNA, 17 bp, Homo sapiens
tcagtatttatgtaatt

SEQ ID NO: 1149563 - DNA, 22 bp, Homo sapiens
tcagtatttatgtaatttgtac

SEQ ID NO: 1149564 - DNA, 16 bp, Homo sapiens
tcagtatttccttcca

SEQ ID NO: 1149565 - DNA, 15 bp, Homo sapiens
tcagtattttccagc

SEQ ID NO: 1149566 - DNA, 23 bp, Homo sapiens
tcagtattttccagccttatgtg

SEQ ID NO: 1149567 - DNA, 20 bp, Homo sapiens
tcagtattttggagaaatta

SEQ ID NO: 1149568 - DNA, 13 bp, Homo sapiens
tcagtatttttta

SEQ ID NO: 1149569 - DNA, 19 bp, Homo sapiens
tcagtatttttttttaatt

SEQ ID NO: 1149570 - DNA, 16 bp, Homo sapiens
tcagtcaaaactttaa

SEQ ID NO: 1149571 - DNA, 20 bp, Homo sapiens
tcagtcaatggaagaaatgg

SEQ ID NO: 1149572 - DNA, 13 bp, Homo sapiens
tcagtcacagcca

SEQ ID NO: 1149573 - DNA, 15 bp, Homo sapiens
tcagtcagttcccgg

SEQ ID NO: 1149574 - DNA, 14 bp, Homo sapiens
tcagtcatcaaagc

SEQ ID NO: 1149575 - DNA, 18 bp, Homo sapiens
tcagtcatcactctcaaa

SEQ ID NO: 1149576 - DNA, 14 bp, Homo sapiens
tcagtcatgtgtaa

SEQ ID NO: 1149577 - DNA, 17 bp, Homo sapiens
tcagtcccatcagagag

SEQ ID NO: 1149578 - DNA, 18 bp, Homo sapiens
tcagtcccctcccatctg

SEQ ID NO: 1149579 - DNA, 16 bp, Homo sapiens
tcagtccctatgtatt

SEQ ID NO: 1149580 - DNA, 18 bp, Homo sapiens
tcagtccctatgtatttg

SEQ ID NO: 1149581 - DNA, 14 bp, Homo sapiens
tcagtctaaggtct

SEQ ID NO: 1149582 - DNA, 14 bp, Homo sapiens
tcagtctcaggagc

SEQ ID NO: 1149583 - DNA, 16 bp, Homo sapiens
tcagtctccctccctt

SEQ ID NO: 1149584 - DNA, 17 bp, Homo sapiens
tcagtctccctttccct

SEQ ID NO: 1149585 - DNA, 13 bp, Homo sapiens
tcagtctcttcca

SEQ ID NO: 1149586 - DNA, 16 bp, Homo sapiens
tcagtctgctccacca

SEQ ID NO: 1149587 - DNA, 12 bp, Homo sapiens
tcagtctgttca

SEQ ID NO: 1149588 - DNA, 18 bp, Homo sapiens
tcagtcttaatactttat

SEQ ID NO: 1149589 - DNA, 20 bp, Homo sapiens
tcagtcttccttgtggaatg

SEQ ID NO: 1149590 - DNA, 20 bp, Homo sapiens
tcagtcttctctcactttga

SEQ ID NO: 1149591 - DNA, 12 bp, Homo sapiens
tcagtctttgct

SEQ ID NO: 1149592 - DNA, 17 bp, Homo sapiens
tcagtctttgctcagtg

SEQ ID NO: 1149593 - DNA, 18 bp, Homo sapiens
tcagtctttgctcagtgt

SEQ ID NO: 1149594 - DNA, 20 bp, Homo sapiens
tcagtgaagtctagaatcat

SEQ ID NO: 1149595 - DNA, 17 bp, Homo sapiens
tcagtgaatttgtccat

SEQ ID NO: 1149596 - DNA, 18 bp, Homo sapiens
tcagtgaatttgtccatt

SEQ ID NO: 1149597 - DNA, 21 bp, Homo sapiens
tcagtgacaaaatgggaggag

SEQ ID NO: 1149598 - DNA, 16 bp, Homo sapiens
tcagtgacagactgga

SEQ ID NO: 1149599 - DNA, 17 bp, Homo sapiens
tcagtgactgaaaccat

SEQ ID NO: 1149600 - DNA, 19 bp, Homo sapiens
tcagtgactgaaaccattt

SEQ ID NO: 1149601 - DNA, 20 bp, Homo sapiens
tcagtgactgaattctgcct

SEQ ID NO: 1149602 - DNA, 15 bp, Homo sapiens
tcagtgagcccctcc

SEQ ID NO: 1149603 - DNA, 17 bp, Homo sapiens
tcagtgagcccctcccc

SEQ ID NO: 1149604 - DNA, 18 bp, Homo sapiens
tcagtgagcccctcccca

SEQ ID NO: 1149605 - DNA, 22 bp, Homo sapiens
tcagtgagcccctccccagcca

SEQ ID NO: 1149606 - DNA, 23 bp, Homo sapiens
tcagtgagcccctccccagccag

SEQ ID NO: 1149607 - DNA, 22 bp, Homo sapiens
tcagtgagcctcctgtgcctgg

SEQ ID NO: 1149608 - DNA, 18 bp, Homo sapiens
tcagtgaggcccagggag

SEQ ID NO: 1149609 - DNA, 16 bp, Homo sapiens
tcagtgatctatgttt

SEQ ID NO: 1149610 - DNA, 16 bp, Homo sapiens
tcagtgatttcctaca

SEQ ID NO: 1149611 - DNA, 22 bp, Homo sapiens
tcagtgcaaattgtatcttatt

SEQ ID NO: 1149612 - DNA, 14 bp, Homo sapiens
tcagtgcacctgcc

SEQ ID NO: 1149613 - DNA, 19 bp, Homo sapiens
tcagtgcacctgcctcagc

SEQ ID NO: 1149614 - DNA, 15 bp, Homo sapiens
tcagtgcagcccgtg

SEQ ID NO: 1149615 - DNA, 14 bp, Homo sapiens
tcagtgcatttgtg

SEQ ID NO: 1149616 - DNA, 16 bp, Homo sapiens
tcagtgccacctatgc

SEQ ID NO: 1149617 - DNA, 9 bp, Homo sapiens
tcagtgccc

SEQ ID NO: 1149618 - DNA, 16 bp, Homo sapiens
tcagtgcccaactgtt

SEQ ID NO: 1149619 - DNA, 15 bp, Homo sapiens
tcagtgccctccagc

SEQ ID NO: 1149620 - DNA, 12 bp, Homo sapiens
tcagtgcctcct

SEQ ID NO: 1149621 - DNA, 13 bp, Homo sapiens
tcagtgcctcctg

SEQ ID NO: 1149622 - DNA, 22 bp, Homo sapiens
tcagtgcctggtgttctgaagt

SEQ ID NO: 1149623 - DNA, 23 bp, Homo sapiens
tcagtgccttttggtttcacctt

SEQ ID NO: 1149624 - DNA, 24 bp, Homo sapiens
tcagtgccttttggtttcaccttc

SEQ ID NO: 1149625 - DNA, 12 bp, Homo sapiens
tcagtgctccct

SEQ ID NO: 1149626 - DNA, 13 bp, Homo sapiens
tcagtgctccctc

SEQ ID NO: 1149627 - DNA, 16 bp, Homo sapiens
tcagtgctctcagctg

SEQ ID NO: 1149628 - DNA, 14 bp, Homo sapiens
tcagtgctgcctgt

SEQ ID NO: 1149629 - DNA, 19 bp, Homo sapiens
tcagtgctgcctgtcccca

SEQ ID NO: 1149630 - DNA, 17 bp, Homo sapiens
tcagtgctgtggcctgg

SEQ ID NO: 1149631 - DNA, 22 bp, Homo sapiens
tcagtgctgtggcctgggcaag

SEQ ID NO: 1149632 - DNA, 19 bp, Homo sapiens
tcagtgcttgggctccacg

SEQ ID NO: 1149633 - DNA, 22 bp, Homo sapiens
tcagtggaacacaaatgaaaat

SEQ ID NO: 1149634 - DNA, 19 bp, Homo sapiens
tcagtggaccctgtggcca

SEQ ID NO: 1149635 - DNA, 20 bp, Homo sapiens
tcagtggaccctgtggccag

SEQ ID NO: 1149636 - DNA, 16 bp, Homo sapiens
tcagtggctttgcata

SEQ ID NO: 1149637 - DNA, 18 bp, Homo sapiens
tttttcccataagacaat

SEQ ID NO: 1149638 - DNA, 15 bp, Homo sapiens
tttttccgtaaaaat

SEQ ID NO: 1149639 - DNA, 22 bp, Homo sapiens
tttttcctactccgttcctggc

SEQ ID NO: 1149640 - DNA, 17 bp, Homo sapiens
tttttcctcatgtaaca

SEQ ID NO: 1149641 - DNA, 16 bp, Homo sapiens
tttttcctcttcagaa

SEQ ID NO: 1149642 - DNA, 11 bp, Homo sapiens
tttttcctgca

SEQ ID NO: 1149643 - DNA, 15 bp, Homo sapiens
tttttccttaatcca

SEQ ID NO: 1149644 - DNA, 20 bp, Homo sapiens
tttttccttaatccagctga

SEQ ID NO: 1149645 - DNA, 19 bp, Homo sapiens
tttttccttcaaagtttaa

SEQ ID NO: 1149646 - DNA, 18 bp, Homo sapiens
tttttcctttaactgaca

SEQ ID NO: 1149647 - DNA, 12 bp, Homo sapiens
tttttcctttct

SEQ ID NO: 1149648 - DNA, 11 bp, Homo sapiens
tttttcctttt

SEQ ID NO: 1149649 - DNA, 12 bp, Homo sapiens
tttttccttttt

SEQ ID NO: 1149650 - DNA, 12 bp, Homo sapiens
tttttctaaaac

SEQ ID NO: 1149651 - DNA, 16 bp, Homo sapiens
tttttctataaatcag

SEQ ID NO: 1149652 - DNA, 23 bp, Homo sapiens
tttttctatgcataaaaaaatga

SEQ ID NO: 1149653 - DNA, 18 bp, Homo sapiens
tttttctcaatacgcctt

SEQ ID NO: 1149654 - DNA, 12 bp, Homo sapiens
tttttctctttc

SEQ ID NO: 1149655 - DNA, 10 bp, Homo sapiens
tttttctgaa

SEQ ID NO: 1149656 - DNA, 13 bp, Homo sapiens
tttttctgataaa

SEQ ID NO: 1149657 - DNA, 14 bp, Homo sapiens
tttttctgcttttg

SEQ ID NO: 1149658 - DNA, 17 bp, Homo sapiens
tttttctgcttttgaaa

SEQ ID NO: 1149659 - DNA, 11 bp, Homo sapiens
tttttctggac

SEQ ID NO: 1149660 - DNA, 11 bp, Homo sapiens
tttttcttaaa

SEQ ID NO: 1149661 - DNA, 12 bp, Homo sapiens
tttttcttggga

SEQ ID NO: 1149662 - DNA, 13 bp, Homo sapiens
tttttcttggggt

SEQ ID NO: 1149663 - DNA, 19 bp, Homo sapiens
tttttcttgtattcatgaa

SEQ ID NO: 1149664 - DNA, 12 bp, Homo sapiens
tttttcttgtct

SEQ ID NO: 1149665 - DNA, 22 bp, Homo sapiens
tttttcttgtctataaagcatt

SEQ ID NO: 1149666 - DNA, 23 bp, Homo sapiens
tttttctttttaaccctaatctt

SEQ ID NO: 1149667 - DNA, 17 bp, Homo sapiens
tttttgaaaaagcgaaa

SEQ ID NO: 1149668 - DNA, 21 bp, Homo sapiens
tttttgaaaaatattgctaaa

SEQ ID NO: 1149669 - DNA, 11 bp, Homo sapiens
tttttgaagtg

SEQ ID NO: 1149670 - DNA, 14 bp, Homo sapiens
tttttgaagtgtag

SEQ ID NO: 1149671 - DNA, 15 bp, Homo sapiens
tttttgaatttaaat

SEQ ID NO: 1149672 - DNA, 12 bp, Homo sapiens
tttttgacactg

SEQ ID NO: 1149673 - DNA, 16 bp, Homo sapiens
tttttgactcccagat

SEQ ID NO: 1149674 - DNA, 14 bp, Homo sapiens
tttttgagtactgt

SEQ ID NO: 1149675 - DNA, 16 bp, Homo sapiens
tttttgagtcaaagac

SEQ ID NO: 1149676 - DNA, 17 bp, Homo sapiens
tttttgagtttattctg

SEQ ID NO: 1149677 - DNA, 15 bp, Homo sapiens
tttttgatactaagc

SEQ ID NO: 1149678 - DNA, 9 bp, Homo sapiens
tttttgcag

SEQ ID NO: 1149679 - DNA, 21 bp, Homo sapiens
tttttgccaaaatatcatgtt

SEQ ID NO: 1149680 - DNA, 17 bp, Homo sapiens
tttttgccagactctag

SEQ ID NO: 1149681 - DNA, 23 bp, Homo sapiens
tttttgctgctgcctctttccct

SEQ ID NO: 1149682 - DNA, 12 bp, Homo sapiens
tttttgcttttg

SEQ ID NO: 1149683 - DNA, 24 bp, Homo sapiens
tttttggaccaccgttcagtcatt

SEQ ID NO: 1149684 - DNA, 16 bp, Homo sapiens
tttttggctagagttt

SEQ ID NO: 1149685 - DNA, 18 bp, Homo sapiens
tttttggctgagtactgg

SEQ ID NO: 1149686 - DNA, 21 bp, Homo sapiens
tttttgggcagcaatttaaat

SEQ ID NO: 1149687 - DNA, 15 bp, Homo sapiens
tttttgggggctttc

SEQ ID NO: 1149688 - DNA, 22 bp, Homo sapiens
tttttgggtttggccagggagg

SEQ ID NO: 1149689 - DNA, 14 bp, Homo sapiens
tttttggtaaattt

SEQ ID NO: 1149690 - DNA, 15 bp, Homo sapiens
tttttggtaataaca

SEQ ID NO: 1149691 - DNA, 23 bp, Homo sapiens
tttttggtaataacaaacgtgtt

SEQ ID NO: 1149692 - DNA, 13 bp, Homo sapiens
tttttggtacaaa

SEQ ID NO: 1149693 - DNA, 12 bp, Homo sapiens
tttttggtattt

SEQ ID NO: 1149694 - DNA, 13 bp, Homo sapiens
tttttggtattta

SEQ ID NO: 1149695 - DNA, 16 bp, Homo sapiens
tttttggtatttatgt

SEQ ID NO: 1149696 - DNA, 14 bp, Homo sapiens
tttttgtaaactgt

SEQ ID NO: 1149697 - DNA, 12 bp, Homo sapiens
tttttgtaacta

SEQ ID NO: 1149698 - DNA, 13 bp, Homo sapiens
tttttgtaagata

SEQ ID NO: 1149699 - DNA, 19 bp, Homo sapiens
tttttgtaatgcactgttt

SEQ ID NO: 1149700 - DNA, 11 bp, Homo sapiens
tttttgtagta

SEQ ID NO: 1149701 - DNA, 12 bp, Homo sapiens
tttttgtataaa

SEQ ID NO: 1149702 - DNA, 20 bp, Homo sapiens
tttttgtataaaaaggaaat

SEQ ID NO: 1149703 - DNA, 21 bp, Homo sapiens
tttttgtataaaaaggaaatt

SEQ ID NO: 1149704 - DNA, 14 bp, Homo sapiens
tttttgtataaatg

SEQ ID NO: 1149705 - DNA, 19 bp, Homo sapiens
tttttgtatagacaggggc

SEQ ID NO: 1149706 - DNA, 14 bp, Homo sapiens
tttttgtatgtgtg

SEQ ID NO: 1149707 - DNA, 20 bp, Homo sapiens
tttttgtatgttatgaacat

SEQ ID NO: 1149708 - DNA, 17 bp, Homo sapiens
tttttgtcttattgaaa

SEQ ID NO: 1149709 - DNA, 22 bp, Homo sapiens
tttttgtgccattatatttgca

SEQ ID NO: 1149710 - DNA, 18 bp, Homo sapiens
tttttgtgtgtatttgct

SEQ ID NO: 1149711 - DNA, 15 bp, Homo sapiens
tttttgttactgttt

SEQ ID NO: 1149712 - DNA, 13 bp, Homo sapiens
tttttgttgacat

SEQ ID NO: 1149713 - DNA, 14 bp, Homo sapiens
tttttgtttctaac

SEQ ID NO: 1149714 - DNA, 17 bp, Homo sapiens
tttttgttttacaatgt

SEQ ID NO: 1149715 - DNA, 17 bp, Homo sapiens
tttttgttttgaaagtt

SEQ ID NO: 1149716 - DNA, 16 bp, Homo sapiens
tttttgttttttgtaa

SEQ ID NO: 1149717 - DNA, 9 bp, Homo sapiens
ttttttaaa

SEQ ID NO: 1149718 - DNA, 21 bp, Homo sapiens
ttttttaaaactgaatcttaa

SEQ ID NO: 1149719 - DNA, 18 bp, Homo sapiens
ttttttaaaataagtctg

SEQ ID NO: 1149720 - DNA, 14 bp, Homo sapiens
ttttttaaaataga

SEQ ID NO: 1149721 - DNA, 23 bp, Homo sapiens
ttttttaaacaaaatttcacagt

SEQ ID NO: 1149722 - DNA, 13 bp, Homo sapiens
ttttttaaagaaa

SEQ ID NO: 1149723 - DNA, 12 bp, Homo sapiens
ttttttaaagca

SEQ ID NO: 1149724 - DNA, 19 bp, Homo sapiens
ttttttaaccaaaggtgaa

SEQ ID NO: 1149725 - DNA, 10 bp, Homo sapiens
ttttttaaga

SEQ ID NO: 1149726 - DNA, 17 bp, Homo sapiens
ttttttaagaatatctg

SEQ ID NO: 1149727 - DNA, 12 bp, Homo sapiens
ttttttaatgta

SEQ ID NO: 1149728 - DNA, 23 bp, Homo sapiens
ttttttacaaagtttcaaaaact

SEQ ID NO: 1149729 - DNA, 14 bp, Homo sapiens
ttttttacttttgt

SEQ ID NO: 1149730 - DNA, 17 bp, Homo sapiens
ttttttaggacatctta

SEQ ID NO: 1149731 - DNA, 11 bp, Homo sapiens
ttttttatact

SEQ ID NO: 1149732 - DNA, 11 bp, Homo sapiens
ttttttatgtt

SEQ ID NO: 1149733 - DNA, 15 bp, Homo sapiens
ttttttatgttttgt

SEQ ID NO: 1149734 - DNA, 12 bp, Homo sapiens
ttttttcaatat

SEQ ID NO: 1149735 - DNA, 12 bp, Homo sapiens
ttttttcagttc

SEQ ID NO: 1149736 - DNA, 13 bp, Homo sapiens
ttttttccactta

SEQ ID NO: 1149737 - DNA, 13 bp, Homo sapiens
ttttttccatctt

SEQ ID NO: 1149738 - DNA, 11 bp, Homo sapiens
ttttttcctaa

SEQ ID NO: 1149739 - DNA, 12 bp, Homo sapiens
ttttttcctaag

SEQ ID NO: 1149740 - DNA, 12 bp, Homo sapiens
ttttttcctgtg

SEQ ID NO: 1149741 - DNA, 11 bp, Homo sapiens
ttttttccttt

SEQ ID NO: 1149742 - DNA, 10 bp, Homo sapiens
ttttttctct

SEQ ID NO: 1149743 - DNA, 11 bp, Homo sapiens
ttttttctctt

SEQ ID NO: 1149744 - DNA, 12 bp, Homo sapiens
ttttttctcttc

SEQ ID NO: 1149745 - DNA, 23 bp, Homo sapiens
ttttttctcttttaaaatatcct

SEQ ID NO: 1149746 - DNA, 12 bp, Homo sapiens
ttttttctgaat

SEQ ID NO: 1149747 - DNA, 12 bp, Homo sapiens
ttttttcttcta

SEQ ID NO: 1149748 - DNA, 13 bp, Homo sapiens
ttttttcttttta

SEQ ID NO: 1149749 - DNA, 13 bp, Homo sapiens
ttttttgaaacag

SEQ ID NO: 1149750 - DNA, 18 bp, Homo sapiens
ttttttgagtttattctg

SEQ ID NO: 1149751 - DNA, 20 bp, Homo sapiens
ttttttgcattttcacaaat

SEQ ID NO: 1149752 - DNA, 12 bp, Homo sapiens
ttttttggctgt

SEQ ID NO: 1149753 - DNA, 16 bp, Homo sapiens
ttttttgggccattac

SEQ ID NO: 1149754 - DNA, 21 bp, Homo sapiens
ttttttgggccattaccccat

SEQ ID NO: 1149755 - DNA, 13 bp, Homo sapiens
ttttttggtaaat

SEQ ID NO: 1149756 - DNA, 16 bp, Homo sapiens
ttttttggtacaaaaa

SEQ ID NO: 1149757 - DNA, 13 bp, Homo sapiens
ttttttggtataa

SEQ ID NO: 1149758 - DNA, 13 bp, Homo sapiens
ttttttgtaaact

SEQ ID NO: 1149759 - DNA, 15 bp, Homo sapiens
ttttttgtatagtta

SEQ ID NO: 1149760 - DNA, 14 bp, Homo sapiens
ttttttgtgtatgt

SEQ ID NO: 1149761 - DNA, 14 bp, Homo sapiens
ttttttgttactgt

SEQ ID NO: 1149762 - DNA, 13 bp, Homo sapiens
ttttttgtttcat

SEQ ID NO: 1149763 - DNA, 12 bp, Homo sapiens
tttttttaacat

SEQ ID NO: 1149764 - DNA, 21 bp, Homo sapiens
tttttttaatagtcattccaa

SEQ ID NO: 1149765 - DNA, 12 bp, Homo sapiens
tttttttcagtg

SEQ ID NO: 1149766 - DNA, 15 bp, Homo sapiens
tcagtgggaacgtga

SEQ ID NO: 1149767 - DNA, 22 bp, Homo sapiens
tcagtgggaacgtgactgcccc

SEQ ID NO: 1149768 - DNA, 20 bp, Homo sapiens
tcagtgggacaaaccagagc

SEQ ID NO: 1149769 - DNA, 19 bp, Homo sapiens
tcagtgggactcggtgagc

SEQ ID NO: 1149770 - DNA, 23 bp, Homo sapiens
tcagtggtttctacttcccctgg

SEQ ID NO: 1149771 - DNA, 11 bp, Homo sapiens
tcagtgtacat

SEQ ID NO: 1149772 - DNA, 18 bp, Homo sapiens
tcagtgtaccatttgcct

SEQ ID NO: 1149773 - DNA, 19 bp, Homo sapiens
tcagtgtaccatttgcctc

SEQ ID NO: 1149774 - DNA, 22 bp, Homo sapiens
tcagtgtagacctgagctggga

SEQ ID NO: 1149775 - DNA, 15 bp, Homo sapiens
tcagtgtatttgtat

SEQ ID NO: 1149776 - DNA, 23 bp, Homo sapiens
tcagtgtatttttgtaaaaaata

SEQ ID NO: 1149777 - DNA, 13 bp, Homo sapiens
tcagtgtcagcgg

SEQ ID NO: 1149778 - DNA, 16 bp, Homo sapiens
tcagtgtcagcgggtg

SEQ ID NO: 1149779 - DNA, 17 bp, Homo sapiens
tcagtgtcccgggcccg

SEQ ID NO: 1149780 - DNA, 19 bp, Homo sapiens
tcagtgtcctcttgctcaa

SEQ ID NO: 1149781 - DNA, 12 bp, Homo sapiens
tcagtgtgcata

SEQ ID NO: 1149782 - DNA, 17 bp, Homo sapiens
tcagtgtggagaggggt

SEQ ID NO: 1149783 - DNA, 15 bp, Homo sapiens
tcagtgtgtaaataa

SEQ ID NO: 1149784 - DNA, 13 bp, Homo sapiens
tcagtgttaaaaa

SEQ ID NO: 1149785 - DNA, 16 bp, Homo sapiens
tcagtgttaaaaaatt

SEQ ID NO: 1149786 - DNA, 17 bp, Homo sapiens
tcagtgttacctgtgtg

SEQ ID NO: 1149787 - DNA, 20 bp, Homo sapiens
tcagtgttccctttcctact

SEQ ID NO: 1149788 - DNA, 18 bp, Homo sapiens
tcagtgttgttgctctag

SEQ ID NO: 1149789 - DNA, 18 bp, Homo sapiens
tcagtgtttatgtgctat

SEQ ID NO: 1149790 - DNA, 15 bp, Homo sapiens
tcagtgttttggact

SEQ ID NO: 1149791 - DNA, 16 bp, Homo sapiens
tcagtgttttggactc

SEQ ID NO: 1149792 - DNA, 20 bp, Homo sapiens
tcagtgttttggactccatc

SEQ ID NO: 1149793 - DNA, 20 bp, Homo sapiens
tcagttaaaatcacatttta

SEQ ID NO: 1149794 - DNA, 14 bp, Homo sapiens
tcagttaattctta

SEQ ID NO: 1149795 - DNA, 13 bp, Homo sapiens
tcagttacacagg

SEQ ID NO: 1149796 - DNA, 20 bp, Homo sapiens
tcagttactaagaagaaaat

SEQ ID NO: 1149797 - DNA, 16 bp, Homo sapiens
tcagttataaagtcaa

SEQ ID NO: 1149798 - DNA, 21 bp, Homo sapiens
tcagttatacagttataaaat

SEQ ID NO: 1149799 - DNA, 20 bp, Homo sapiens
tcagttcagtagatttcctt

SEQ ID NO: 1149800 - DNA, 15 bp, Homo sapiens
tcagttcccagctcc

SEQ ID NO: 1149801 - DNA, 20 bp, Homo sapiens
tcagttcccccagtacctcc

SEQ ID NO: 1149802 - DNA, 14 bp, Homo sapiens
tcagttcccggagc

SEQ ID NO: 1149803 - DNA, 15 bp, Homo sapiens
tcagttcccggagca

SEQ ID NO: 1149804 - DNA, 21 bp, Homo sapiens
tcagttcccggagcacagccc

SEQ ID NO: 1149805 - DNA, 17 bp, Homo sapiens
tcagttcccttggcctc

SEQ ID NO: 1149806 - DNA, 20 bp, Homo sapiens
tcagttcccttggcctcaga

SEQ ID NO: 1149807 - DNA, 19 bp, Homo sapiens
tcagttctagtctctctgg

SEQ ID NO: 1149808 - DNA, 23 bp, Homo sapiens
tcagttgagcttcatataccagc

SEQ ID NO: 1149809 - DNA, 16 bp, Homo sapiens
tcagttggagtttgtg

SEQ ID NO: 1149810 - DNA, 13 bp, Homo sapiens
tcagttgtgtttt

SEQ ID NO: 1149811 - DNA, 13 bp, Homo sapiens
tcagtttacatct

SEQ ID NO: 1149812 - DNA, 14 bp, Homo sapiens
tcagtttatcctga

SEQ ID NO: 1149813 - DNA, 19 bp, Homo sapiens
tcagtttcacagaaaataa

SEQ ID NO: 1149814 - DNA, 19 bp, Homo sapiens
tcagtttcataaaaggaga

SEQ ID NO: 1149815 - DNA, 14 bp, Homo sapiens
tcagtttcccctct

SEQ ID NO: 1149816 - DNA, 18 bp, Homo sapiens
tcagtttccgaatctctt

SEQ ID NO: 1149817 - DNA, 14 bp, Homo sapiens
tcagtttcctctcc

SEQ ID NO: 1149818 - DNA, 20 bp, Homo sapiens
tcagtttgaaaatattttgt

SEQ ID NO: 1149819 - DNA, 19 bp, Homo sapiens
tcagtttgctagcagaaat

SEQ ID NO: 1149820 - DNA, 15 bp, Homo sapiens
tcagtttgtatatac

SEQ ID NO: 1149821 - DNA, 16 bp, Homo sapiens
tcagtttgtgtgtctt

SEQ ID NO: 1149822 - DNA, 17 bp, Homo sapiens
tcagtttgtgtgtctta

SEQ ID NO: 1149823 - DNA, 13 bp, Homo sapiens
tcagttttaacta

SEQ ID NO: 1149824 - DNA, 17 bp, Homo sapiens
tcagttttatcattttc

SEQ ID NO: 1149825 - DNA, 13 bp, Homo sapiens
tcagttttcattt

SEQ ID NO: 1149826 - DNA, 13 bp, Homo sapiens
tcagttttccttc

SEQ ID NO: 1149827 - DNA, 14 bp, Homo sapiens
tcagttttccttct

SEQ ID NO: 1149828 - DNA, 23 bp, Homo sapiens
tcagttttggaatctaagctgtt

SEQ ID NO: 1149829 - DNA, 15 bp, Homo sapiens
tcagtttttcatttg

SEQ ID NO: 1149830 - DNA, 17 bp, Homo sapiens
tcagtttttcatttgtt

SEQ ID NO: 1149831 - DNA, 20 bp, Homo sapiens
tcagtttttcatttgttttg

SEQ ID NO: 1149832 - DNA, 12 bp, Homo sapiens
tcagtttttgta

SEQ ID NO: 1149833 - DNA, 17 bp, Homo sapiens
tcagttttttgttttac

SEQ ID NO: 1149834 - DNA, 18 bp, Homo sapiens
tcagttttttgttttaca

SEQ ID NO: 1149835 - DNA, 17 bp, Homo sapiens
tcagtttttttaaatgc

SEQ ID NO: 1149836 - DNA, 12 bp, Homo sapiens
tcataaaataaa

SEQ ID NO: 1149837 - DNA, 14 bp, Homo sapiens
tcataaaatgcata

SEQ ID NO: 1149838 - DNA, 14 bp, Homo sapiens
tcataaagaattgt

SEQ ID NO: 1149839 - DNA, 17 bp, Homo sapiens
tcataaagtaatgatga

SEQ ID NO: 1149840 - DNA, 22 bp, Homo sapiens
tcataaagtaatgatgaaatct

SEQ ID NO: 1149841 - DNA, 19 bp, Homo sapiens
tcataaatcatgttgttgt

SEQ ID NO: 1149842 - DNA, 11 bp, Homo sapiens
tcataaattat

SEQ ID NO: 1149843 - DNA, 13 bp, Homo sapiens
tcataaattattt

SEQ ID NO: 1149844 - DNA, 14 bp, Homo sapiens
tcataacttgctga

SEQ ID NO: 1149845 - DNA, 15 bp, Homo sapiens
tcataacttgctgaa

SEQ ID NO: 1149846 - DNA, 21 bp, Homo sapiens
tcataacttgctgaatttcag

SEQ ID NO: 1149847 - DNA, 19 bp, Homo sapiens
tcataagactttgggatag

SEQ ID NO: 1149848 - DNA, 19 bp, Homo sapiens
tcataaggcctgccctccc

SEQ ID NO: 1149849 - DNA, 20 bp, Homo sapiens
tcataaggttttattcatat

SEQ ID NO: 1149850 - DNA, 20 bp, Homo sapiens
tcataagtattatgtctctt

SEQ ID NO: 1149851 - DNA, 15 bp, Homo sapiens
tcataagtatttcaa

SEQ ID NO: 1149852 - DNA, 18 bp, Homo sapiens
tcataataaaagtgaagt

SEQ ID NO: 1149853 - DNA, 18 bp, Homo sapiens
tcataataaactacacaa

SEQ ID NO: 1149854 - DNA, 16 bp, Homo sapiens
tcataatcagtaaata

SEQ ID NO: 1149855 - DNA, 18 bp, Homo sapiens
tcataatcagtaaatagt

SEQ ID NO: 1149856 - DNA, 18 bp, Homo sapiens
tcataatgaattataaca

SEQ ID NO: 1149857 - DNA, 19 bp, Homo sapiens
tcataatgaattataacag

SEQ ID NO: 1149858 - DNA, 21 bp, Homo sapiens
tcataatgaattataacagtt

SEQ ID NO: 1149859 - DNA, 19 bp, Homo sapiens
tcataatgggggtaaagtt

SEQ ID NO: 1149860 - DNA, 14 bp, Homo sapiens
tcataattacattc

SEQ ID NO: 1149861 - DNA, 16 bp, Homo sapiens
tcataattacattcct

SEQ ID NO: 1149862 - DNA, 15 bp, Homo sapiens
tcataattattttgt

SEQ ID NO: 1149863 - DNA, 22 bp, Homo sapiens
tcataatttaaaaatctccatt

SEQ ID NO: 1149864 - DNA, 22 bp, Homo sapiens
tcataattttagtaatttccta

SEQ ID NO: 1149865 - DNA, 14 bp, Homo sapiens
tcatacaaaataaa

SEQ ID NO: 1149866 - DNA, 15 bp, Homo sapiens
tcatacaaactctca

SEQ ID NO: 1149867 - DNA, 11 bp, Homo sapiens
tcatacagttt

SEQ ID NO: 1149868 - DNA, 13 bp, Homo sapiens
tcatacagttttc

SEQ ID NO: 1149869 - DNA, 21 bp, Homo sapiens
tcatacatatatatatttgta

SEQ ID NO: 1149870 - DNA, 15 bp, Homo sapiens
tcataccaatgaaaa

SEQ ID NO: 1149871 - DNA, 21 bp, Homo sapiens
tcataccattattatgtaaat

SEQ ID NO: 1149872 - DNA, 21 bp, Homo sapiens
tcataccgcctcgtgccagca

SEQ ID NO: 1149873 - DNA, 22 bp, Homo sapiens
tcatacgcatcccatctctccc

SEQ ID NO: 1149874 - DNA, 21 bp, Homo sapiens
tcatactactgaaacagattt

SEQ ID NO: 1149875 - DNA, 22 bp, Homo sapiens
tcatactgcctactgttactct

SEQ ID NO: 1149876 - DNA, 15 bp, Homo sapiens
tcatacttaaaaatt

SEQ ID NO: 1149877 - DNA, 19 bp, Homo sapiens
tcatacttaaaaatttatt

SEQ ID NO: 1149878 - DNA, 22 bp, Homo sapiens
tcatacttaacatttcattgta

SEQ ID NO: 1149879 - DNA, 16 bp, Homo sapiens
tcatacttaagcaaaa

SEQ ID NO: 1149880 - DNA, 19 bp, Homo sapiens
tcatagaaagtgccagaaa

SEQ ID NO: 1149881 - DNA, 17 bp, Homo sapiens
tcatagaaattctttat

SEQ ID NO: 1149882 - DNA, 19 bp, Homo sapiens
tcatagaaggtgtaggctg

SEQ ID NO: 1149883 - DNA, 14 bp, Homo sapiens
tcatagaagtgttg

SEQ ID NO: 1149884 - DNA, 20 bp, Homo sapiens
tcatagactcctttgctaat

SEQ ID NO: 1149885 - DNA, 17 bp, Homo sapiens
tcatagaggtgagaaaa

SEQ ID NO: 1149886 - DNA, 20 bp, Homo sapiens
tcatagaggtgagaaaactc

SEQ ID NO: 1149887 - DNA, 16 bp, Homo sapiens
tcatagattattataa

SEQ ID NO: 1149888 - DNA, 17 bp, Homo sapiens
tcatagattattataaa

SEQ ID NO: 1149889 - DNA, 18 bp, Homo sapiens
tcatagcagattttaatt

SEQ ID NO: 1149890 - DNA, 16 bp, Homo sapiens
tcatagccaaagccag

SEQ ID NO: 1149891 - DNA, 10 bp, Homo sapiens
tttttttcca

SEQ ID NO: 1149892 - DNA, 12 bp, Homo sapiens
tttttttccaaa

SEQ ID NO: 1149893 - DNA, 12 bp, Homo sapiens
tttttttcctgt

SEQ ID NO: 1149894 - DNA, 13 bp, Homo sapiens
tttttttctaaaa

SEQ ID NO: 1149895 - DNA, 14 bp, Homo sapiens
tttttttctaagag

SEQ ID NO: 1149896 - DNA, 13 bp, Homo sapiens
tttttttctgatt

SEQ ID NO: 1149897 - DNA, 12 bp, Homo sapiens
tttttttgtagc

SEQ ID NO: 1149898 - DNA, 13 bp, Homo sapiens
tttttttgtagct

SEQ ID NO: 1149899 - DNA, 11 bp, Homo sapiens
ttttttttgca

SEQ ID NO: 1149900 - DNA, 13 bp, Homo sapiens
ttttttttttcca

SEQ ID NO: 1149901 - DNA, 20 bp, Homo sapiens
ttataatcttccatacttct

SEQ ID NO: 1149902 - DNA, 13 bp, Homo sapiens
ttataatgtattt

SEQ ID NO: 1149903 - DNA, 19 bp, Homo sapiens
ttataatgtatttgaaaat

SEQ ID NO: 1149904 - DNA, 20 bp, Homo sapiens
ttataatgtatttgaaaatt

SEQ ID NO: 1149905 - DNA, 15 bp, Homo sapiens
ttataattaaagatg

SEQ ID NO: 1149906 - DNA, 14 bp, Homo sapiens
ttataattctcatt

SEQ ID NO: 1149907 - DNA, 17 bp, Homo sapiens
ttataattctcattaaa

SEQ ID NO: 1149908 - DNA, 14 bp, Homo sapiens
ttataattgtttat

SEQ ID NO: 1149909 - DNA, 15 bp, Homo sapiens
ttataatttaaatga

SEQ ID NO: 1149910 - DNA, 19 bp, Homo sapiens
ttataatttataaatacag

SEQ ID NO: 1149911 - DNA, 16 bp, Homo sapiens
ttataattttcctaat

SEQ ID NO: 1149912 - DNA, 20 bp, Homo sapiens
ttatacaaacctaccaaaat

SEQ ID NO: 1149913 - DNA, 13 bp, Homo sapiens
ttatacaataacc

SEQ ID NO: 1149914 - DNA, 22 bp, Homo sapiens
ttatacaataacccagttactt

SEQ ID NO: 1149915 - DNA, 15 bp, Homo sapiens
ttatacacaactttg

SEQ ID NO: 1149916 - DNA, 16 bp, Homo sapiens
ttatacagaactcaca

SEQ ID NO: 1149917 - DNA, 22 bp, Homo sapiens
ttatacagaccgaactgttgta

SEQ ID NO: 1149918 - DNA, 20 bp, Homo sapiens
ttatacagatagagttccat

SEQ ID NO: 1149919 - DNA, 15 bp, Homo sapiens
ttatacagctgtatt

SEQ ID NO: 1149920 - DNA, 13 bp, Homo sapiens
ttatacataaaca

SEQ ID NO: 1149921 - DNA, 16 bp, Homo sapiens
ttataccaaagggaaa

SEQ ID NO: 1149922 - DNA, 19 bp, Homo sapiens
ttataccatgtgtgctaat

SEQ ID NO: 1149923 - DNA, 18 bp, Homo sapiens
ttataccccctgcaaagc

SEQ ID NO: 1149924 - DNA, 14 bp, Homo sapiens
ttatacctttgaaa

SEQ ID NO: 1149925 - DNA, 14 bp, Homo sapiens
ttatacgaaataat

SEQ ID NO: 1149926 - DNA, 16 bp, Homo sapiens
ttatacgaaataattg

SEQ ID NO: 1149927 - DNA, 21 bp, Homo sapiens
ttatacgctggcaacacagag

SEQ ID NO: 1149928 - DNA, 22 bp, Homo sapiens
ttatacgctggcaacacagagg

SEQ ID NO: 1149929 - DNA, 20 bp, Homo sapiens
ttatacggaaaaaattgtat

SEQ ID NO: 1149930 - DNA, 14 bp, Homo sapiens
ttatactgagcttt

SEQ ID NO: 1149931 - DNA, 22 bp, Homo sapiens
ttatactgagcttttgagtgtt

SEQ ID NO: 1149932 - DNA, 18 bp, Homo sapiens
ttatactgtacaataaaa

SEQ ID NO: 1149933 - DNA, 13 bp, Homo sapiens
ttatactgtacat

SEQ ID NO: 1149934 - DNA, 13 bp, Homo sapiens
ttatacttcaaaa

SEQ ID NO: 1149935 - DNA, 12 bp, Homo sapiens
ttatagaagaaa

SEQ ID NO: 1149936 - DNA, 13 bp, Homo sapiens
ttatagaagaaat

SEQ ID NO: 1149937 - DNA, 17 bp, Homo sapiens
ttatagaaggaatttgt

SEQ ID NO: 1149938 - DNA, 22 bp, Homo sapiens
ttatagaaggaatttgtacttc

SEQ ID NO: 1149939 - DNA, 18 bp, Homo sapiens
ttatagaataaaagctat

SEQ ID NO: 1149940 - DNA, 14 bp, Homo sapiens
ttatagattgtctt

SEQ ID NO: 1149941 - DNA, 17 bp, Homo sapiens
ttatagcaaacttggaa

SEQ ID NO: 1149942 - DNA, 17 bp, Homo sapiens
ttatagcaactaatgtt

SEQ ID NO: 1149943 - DNA, 22 bp, Homo sapiens
ttatagcaagatattgatcaaa

SEQ ID NO: 1149944 - DNA, 16 bp, Homo sapiens
ttatagctcagtttat

SEQ ID NO: 1149945 - DNA, 21 bp, Homo sapiens
ttatagctctaataagtttgt

SEQ ID NO: 1149946 - DNA, 19 bp, Homo sapiens
ttataggaatagaggaaga

SEQ ID NO: 1149947 - DNA, 14 bp, Homo sapiens
ttataggagagatt

SEQ ID NO: 1149948 - DNA, 18 bp, Homo sapiens
ttataggtcactcctggg

SEQ ID NO: 1149949 - DNA, 13 bp, Homo sapiens
ttatagtacatga

SEQ ID NO: 1149950 - DNA, 18 bp, Homo sapiens
ttatagtagaacaaggca

SEQ ID NO: 1149951 - DNA, 15 bp, Homo sapiens
ttatagtatatctgg

SEQ ID NO: 1149952 - DNA, 21 bp, Homo sapiens
ttatagtgaatactgctacag

SEQ ID NO: 1149953 - DNA, 19 bp, Homo sapiens
ttatagtgtttaactggca

SEQ ID NO: 1149954 - DNA, 19 bp, Homo sapiens
ttatagttactgtgtaatt

SEQ ID NO: 1149955 - DNA, 20 bp, Homo sapiens
ttatagttgtgggtgggaga

SEQ ID NO: 1149956 - DNA, 12 bp, Homo sapiens
ttatagtttgta

SEQ ID NO: 1149957 - DNA, 16 bp, Homo sapiens
ttatataactgtattt

SEQ ID NO: 1149958 - DNA, 19 bp, Homo sapiens
ttatataagtctgttattt

SEQ ID NO: 1149959 - DNA, 21 bp, Homo sapiens
ttatataatatctaaagttat

SEQ ID NO: 1149960 - DNA, 19 bp, Homo sapiens
ttatatacctggcttttac

SEQ ID NO: 1149961 - DNA, 23 bp, Homo sapiens
ttatatacctggcttttacttta

SEQ ID NO: 1149962 - DNA, 19 bp, Homo sapiens
ttatatagtctacagttgt

SEQ ID NO: 1149963 - DNA, 18 bp, Homo sapiens
ttatatagtggatgatat

SEQ ID NO: 1149964 - DNA, 18 bp, Homo sapiens
ttatatatatatgtatat

SEQ ID NO: 1149965 - DNA, 21 bp, Homo sapiens
ttatatatggggatggtagtt

SEQ ID NO: 1149966 - DNA, 23 bp, Homo sapiens
ttatatattgaaagttgctttta

SEQ ID NO: 1149967 - DNA, 13 bp, Homo sapiens
ttatatatttata

SEQ ID NO: 1149968 - DNA, 23 bp, Homo sapiens
ttatatatttataactcatcata

SEQ ID NO: 1149969 - DNA, 12 bp, Homo sapiens
ttatatatttct

SEQ ID NO: 1149970 - DNA, 15 bp, Homo sapiens
ttatatcagcctgag

SEQ ID NO: 1149971 - DNA, 15 bp, Homo sapiens
ttatatcagcttttc

SEQ ID NO: 1149972 - DNA, 23 bp, Homo sapiens
ttatatcatacagttttcattga

SEQ ID NO: 1149973 - DNA, 15 bp, Homo sapiens
ttatatcatatgtat

SEQ ID NO: 1149974 - DNA, 19 bp, Homo sapiens
ttatatctaattatttcca

SEQ ID NO: 1149975 - DNA, 15 bp, Homo sapiens
ttatatcttgtttac

SEQ ID NO: 1149976 - DNA, 20 bp, Homo sapiens
ttatatcttttggttattct

SEQ ID NO: 1149977 - DNA, 12 bp, Homo sapiens
ttatatgaaata

SEQ ID NO: 1149978 - DNA, 15 bp, Homo sapiens
ttatatgaagaaaat

SEQ ID NO: 1149979 - DNA, 17 bp, Homo sapiens
ttatatgccaagctaat

SEQ ID NO: 1149980 - DNA, 18 bp, Homo sapiens
ttatatgccaagctaatt

SEQ ID NO: 1149981 - DNA, 22 bp, Homo sapiens
ttatatgctaattaaataatac

SEQ ID NO: 1149982 - DNA, 13 bp, Homo sapiens
ttatatggaaatt

SEQ ID NO: 1149983 - DNA, 18 bp, Homo sapiens
ttatatggaagaaagtaa

SEQ ID NO: 1149984 - DNA, 17 bp, Homo sapiens
ttatatggcccagcctt

SEQ ID NO: 1149985 - DNA, 19 bp, Homo sapiens
ttatatgggtatatattca

SEQ ID NO: 1149986 - DNA, 16 bp, Homo sapiens
ttatatgtaaatgtgt

SEQ ID NO: 1149987 - DNA, 17 bp, Homo sapiens
ttatatgtacagtttat

SEQ ID NO: 1149988 - DNA, 19 bp, Homo sapiens
ttatatgtacatgagaagg

SEQ ID NO: 1149989 - DNA, 16 bp, Homo sapiens
ttatatgtcaaagcag

SEQ ID NO: 1149990 - DNA, 18 bp, Homo sapiens
ttatatgttgtaatattt

SEQ ID NO: 1149991 - DNA, 15 bp, Homo sapiens
ttatattaaaatatg

SEQ ID NO: 1149992 - DNA, 19 bp, Homo sapiens
ttatattaatgtacttgtt

SEQ ID NO: 1149993 - DNA, 15 bp, Homo sapiens
ttatattacttttgt

SEQ ID NO: 1149994 - DNA, 23 bp, Homo sapiens
ttatattagtgaagatggtttca

SEQ ID NO: 1149995 - DNA, 13 bp, Homo sapiens
ttatattcacaga

SEQ ID NO: 1149996 - DNA, 15 bp, Homo sapiens
taagtcctttatgtg

SEQ ID NO: 1149997 - DNA, 20 bp, Homo sapiens
taagtcctttatgtggaaaa

SEQ ID NO: 1149998 - DNA, 15 bp, Homo sapiens
taagtctacattaaa

SEQ ID NO: 1149999 - DNA, 16 bp, Homo sapiens
taagtctcctgtctta

SEQ ID NO: 1150000 - DNA, 21 bp, Homo sapiens
taagtctcctttactgaatgt

SEQ ID NO: 1150001 - DNA, 16 bp, Homo sapiens
taagtctcgaatgtaa

SEQ ID NO: 1150002 - DNA, 14 bp, Homo sapiens
taagtctgatttaa

SEQ ID NO: 1150003 - DNA, 19 bp, Homo sapiens
taagtctgggatgtagaac

SEQ ID NO: 1150004 - DNA, 20 bp, Homo sapiens
taagtcttacataaaccatt

SEQ ID NO: 1150005 - DNA, 14 bp, Homo sapiens
taagtcttccttaa

SEQ ID NO: 1150006 - DNA, 19 bp, Homo sapiens
taagtcttccttaaatgac

SEQ ID NO: 1150007 - DNA, 22 bp, Homo sapiens
taagtcttttttttttccaaat

SEQ ID NO: 1150008 - DNA, 20 bp, Homo sapiens
taagtgacaaagccagagga

SEQ ID NO: 1150009 - DNA, 20 bp, Homo sapiens
taagtgacaccaataaatgt

SEQ ID NO: 1150010 - DNA, 10 bp, Homo sapiens
taagtgacat

SEQ ID NO: 1150011 - DNA, 17 bp, Homo sapiens
taagtgatgtcatttga

SEQ ID NO: 1150012 - DNA, 22 bp, Homo sapiens
taagtgatgtgctgaattttat

SEQ ID NO: 1150013 - DNA, 17 bp, Homo sapiens
taagtgatttccacagg

SEQ ID NO: 1150014 - DNA, 17 bp, Homo sapiens
taagtgatttgcctgta

SEQ ID NO: 1150015 - DNA, 13 bp, Homo sapiens
taagtgcaacatt

SEQ ID NO: 1150016 - DNA, 12 bp, Homo sapiens
taagtgcacttt

SEQ ID NO: 1150017 - DNA, 14 bp, Homo sapiens
taagtgcacttttt

SEQ ID NO: 1150018 - DNA, 23 bp, Homo sapiens
taagtgcacttttttatgaagaa

SEQ ID NO: 1150019 - DNA, 20 bp, Homo sapiens
taagtgccattactactgta

SEQ ID NO: 1150020 - DNA, 21 bp, Homo sapiens
taagtgccattactactgtac

SEQ ID NO: 1150021 - DNA, 17 bp, Homo sapiens
taagtgcccacatttga

SEQ ID NO: 1150022 - DNA, 18 bp, Homo sapiens
taagtgcccacatttgat

SEQ ID NO: 1150023 - DNA, 18 bp, Homo sapiens
taagtgctgcatttaaaa

SEQ ID NO: 1150024 - DNA, 20 bp, Homo sapiens
taagtggaattagagggcct

SEQ ID NO: 1150025 - DNA, 19 bp, Homo sapiens
taagtggactggtgtcata

SEQ ID NO: 1150026 - DNA, 16 bp, Homo sapiens
taagtggaggcacttt

SEQ ID NO: 1150027 - DNA, 21 bp, Homo sapiens
taagtggggttgcaaccactg

SEQ ID NO: 1150028 - DNA, 15 bp, Homo sapiens
taagtggttactttg

SEQ ID NO: 1150029 - DNA, 13 bp, Homo sapiens
ttatcaatttttc

SEQ ID NO: 1150030 - DNA, 21 bp, Homo sapiens
ttatcaccagctgcctcttct

SEQ ID NO: 1150031 - DNA, 21 bp, Homo sapiens
ttatcacccagaagaaaatag

SEQ ID NO: 1150032 - DNA, 12 bp, Homo sapiens
ttatcacctcat

SEQ ID NO: 1150033 - DNA, 15 bp, Homo sapiens
ttatcagagtcatga

SEQ ID NO: 1150034 - DNA, 20 bp, Homo sapiens
ttatcagatacatcactgct

SEQ ID NO: 1150035 - DNA, 17 bp, Homo sapiens
ttatcagccatgtttgg

SEQ ID NO: 1150036 - DNA, 16 bp, Homo sapiens
ttatcagctgggcagt

SEQ ID NO: 1150037 - DNA, 21 bp, Homo sapiens
ttatcagtcataactaaataa

SEQ ID NO: 1150038 - DNA, 23 bp, Homo sapiens
ttatcagtcataactaaataaag

SEQ ID NO: 1150039 - DNA, 18 bp, Homo sapiens
ttatcatgaattttaaag

SEQ ID NO: 1150040 - DNA, 19 bp, Homo sapiens
ttatcatgaattttaaagt

SEQ ID NO: 1150041 - DNA, 16 bp, Homo sapiens
ttatcatggtatttga

SEQ ID NO: 1150042 - DNA, 18 bp, Homo sapiens
ttatcattaaaaattacc

SEQ ID NO: 1150043 - DNA, 16 bp, Homo sapiens
ttatcattttcaaaat

SEQ ID NO: 1150044 - DNA, 18 bp, Homo sapiens
ttatcatttttgtataaa

SEQ ID NO: 1150045 - DNA, 20 bp, Homo sapiens
ttatcatttttgtataaaaa

SEQ ID NO: 1150046 - DNA, 18 bp, Homo sapiens
ttatccaaaatgtgtatt

SEQ ID NO: 1150047 - DNA, 19 bp, Homo sapiens
ttatccatattgagtcaaa

SEQ ID NO: 1150048 - DNA, 22 bp, Homo sapiens
ttatccattacgtgcatttaaa

SEQ ID NO: 1150049 - DNA, 23 bp, Homo sapiens
ttatcccaagaccctgccccctg

SEQ ID NO: 1150050 - DNA, 19 bp, Homo sapiens
ttatcccccccagcctggc

SEQ ID NO: 1150051 - DNA, 17 bp, Homo sapiens
ttatccctcacctgtag

SEQ ID NO: 1150052 - DNA, 13 bp, Homo sapiens
ttatcctctctct

SEQ ID NO: 1150053 - DNA, 19 bp, Homo sapiens
ttatcctctgatctccatg

SEQ ID NO: 1150054 - DNA, 20 bp, Homo sapiens
ttatcctgagtcccttaatc

SEQ ID NO: 1150055 - DNA, 14 bp, Homo sapiens
ttatcctgtattct

SEQ ID NO: 1150056 - DNA, 13 bp, Homo sapiens
ttatcctgtctga

SEQ ID NO: 1150057 - DNA, 19 bp, Homo sapiens
ttatcctttattttattga

SEQ ID NO: 1150058 - DNA, 14 bp, Homo sapiens
ttatcggaagcagt

SEQ ID NO: 1150059 - DNA, 14 bp, Homo sapiens
ttatcgggaacagt

SEQ ID NO: 1150060 - DNA, 17 bp, Homo sapiens
ttatcgggaacagtgtt

SEQ ID NO: 1150061 - DNA, 23 bp, Homo sapiens
ttatcgggaacagtgtttcccat

SEQ ID NO: 1150062 - DNA, 16 bp, Homo sapiens
ttatcgttttcttaaa

SEQ ID NO: 1150063 - DNA, 21 bp, Homo sapiens
ttatctaaaagaaatgtctat

SEQ ID NO: 1150064 - DNA, 23 bp, Homo sapiens
ttatctaactatatgtacagctc

SEQ ID NO: 1150065 - DNA, 22 bp, Homo sapiens
ttatctaatacaaaattataaa

SEQ ID NO: 1150066 - DNA, 11 bp, Homo sapiens
ttatctaattt

SEQ ID NO: 1150067 - DNA, 17 bp, Homo sapiens
ttatctaatttataaaa

SEQ ID NO: 1150068 - DNA, 18 bp, Homo sapiens
ttatctacctgttctgta

SEQ ID NO: 1150069 - DNA, 19 bp, Homo sapiens
ttatctacttccaaactaa

SEQ ID NO: 1150070 - DNA, 17 bp, Homo sapiens
ttatctataatttacct

SEQ ID NO: 1150071 - DNA, 17 bp, Homo sapiens
ttatctatacatatctt

SEQ ID NO: 1150072 - DNA, 16 bp, Homo sapiens
ttatctatataaaata

SEQ ID NO: 1150073 - DNA, 15 bp, Homo sapiens
ttatctatggaaatg

SEQ ID NO: 1150074 - DNA, 14 bp, Homo sapiens
ttatctcaacggaa

SEQ ID NO: 1150075 - DNA, 17 bp, Homo sapiens
ttatctcatcctttcct

SEQ ID NO: 1150076 - DNA, 19 bp, Homo sapiens
ttatctcttttatatttgt

SEQ ID NO: 1150077 - DNA, 20 bp, Homo sapiens
ttatctgaaggaccccaggt

SEQ ID NO: 1150078 - DNA, 18 bp, Homo sapiens
ttatctgaatttttaaac

SEQ ID NO: 1150079 - DNA, 20 bp, Homo sapiens
ttatctgaatttttaaacaa

SEQ ID NO: 1150080 - DNA, 18 bp, Homo sapiens
ttatctgatctgtgatta

SEQ ID NO: 1150081 - DNA, 19 bp, Homo sapiens
ttatctgcctggcctggct

SEQ ID NO: 1150082 - DNA, 19 bp, Homo sapiens
ttatctggaatattgtgat

SEQ ID NO: 1150083 - DNA, 14 bp, Homo sapiens
ttatctgtaattgt

SEQ ID NO: 1150084 - DNA, 21 bp, Homo sapiens
ttatctgtaattgtaattcca

SEQ ID NO: 1150085 - DNA, 12 bp, Homo sapiens
ttatctgtgaat

SEQ ID NO: 1150086 - DNA, 21 bp, Homo sapiens
ttatctgtggagttcctgctc

SEQ ID NO: 1150087 - DNA, 18 bp, Homo sapiens
ttatctgtgtttttgaaa

SEQ ID NO: 1150088 - DNA, 13 bp, Homo sapiens
ttatcttacgaaa

SEQ ID NO: 1150089 - DNA, 16 bp, Homo sapiens
ttatcttagctggata

SEQ ID NO: 1150090 - DNA, 20 bp, Homo sapiens
ttatcttatactgtacaata

SEQ ID NO: 1150091 - DNA, 19 bp, Homo sapiens
ttatcttcaccctcatcct

SEQ ID NO: 1150092 - DNA, 15 bp, Homo sapiens
ttatcttctttatta

SEQ ID NO: 1150093 - DNA, 20 bp, Homo sapiens
ttatcttgaagtcagccaca

SEQ ID NO: 1150094 - DNA, 18 bp, Homo sapiens
ttatcttgatacattcaa

SEQ ID NO: 1150095 - DNA, 16 bp, Homo sapiens
ttatcttgtctctggg

SEQ ID NO: 1150096 - DNA, 12 bp, Homo sapiens
ttatctttacca

SEQ ID NO: 1150097 - DNA, 14 bp, Homo sapiens
ttatctttgaatat

SEQ ID NO: 1150098 - DNA, 14 bp, Homo sapiens
ttatcttttggctt

SEQ ID NO: 1150099 - DNA, 13 bp, Homo sapiens
ttatgaaaaacat

SEQ ID NO: 1150100 - DNA, 17 bp, Homo sapiens
ttatgaaaaagaagaat

SEQ ID NO: 1150101 - DNA, 19 bp, Homo sapiens
ttatgaaaaagaagaatct

SEQ ID NO: 1150102 - DNA, 17 bp, Homo sapiens
ttatgaaacatatcatg

SEQ ID NO: 1150103 - DNA, 23 bp, Homo sapiens
ttatgaagaaaaagtacaatgaa

SEQ ID NO: 1150104 - DNA, 13 bp, Homo sapiens
ttatgaagagcta

SEQ ID NO: 1150105 - DNA, 12 bp, Homo sapiens
ttatgaaggaat

SEQ ID NO: 1150106 - DNA, 14 bp, Homo sapiens
ttatgaaggaattt

SEQ ID NO: 1150107 - DNA, 19 bp, Homo sapiens
ttatgaatatttataacag

SEQ ID NO: 1150108 - DNA, 21 bp, Homo sapiens
ttatgaatctgtgctggccat

SEQ ID NO: 1150109 - DNA, 14 bp, Homo sapiens
ttatgaatctttcc

SEQ ID NO: 1150110 - DNA, 18 bp, Homo sapiens
ttatgaattataaatgtg

SEQ ID NO: 1150111 - DNA, 18 bp, Homo sapiens
ttatgacatcacttgtac

SEQ ID NO: 1150112 - DNA, 18 bp, Homo sapiens
ttatgacctcttccttta

SEQ ID NO: 1150113 - DNA, 15 bp, Homo sapiens
ttatgactatgtaaa

SEQ ID NO: 1150114 - DNA, 19 bp, Homo sapiens
ttatgactttcctcagaac

SEQ ID NO: 1150115 - DNA, 21 bp, Homo sapiens
ttatgagaaactggcaaagca

SEQ ID NO: 1150116 - DNA, 23 bp, Homo sapiens
ttatgagaaactggcaaagcaga

SEQ ID NO: 1150117 - DNA, 13 bp, Homo sapiens
ttatgagaaactt

SEQ ID NO: 1150118 - DNA, 14 bp, Homo sapiens
taataactttattg

SEQ ID NO: 1150119 - DNA, 19 bp, Homo sapiens
taataactttattgcatat

SEQ ID NO: 1150120 - DNA, 21 bp, Homo sapiens
taataagaaagtataaagtca

SEQ ID NO: 1150121 - DNA, 16 bp, Homo sapiens
taataagaacagatca

SEQ ID NO: 1150122 - DNA, 18 bp, Homo sapiens
taataagaagtgccaagt

SEQ ID NO: 1150123 - DNA, 14 bp, Homo sapiens
taataagcaaaaag

SEQ ID NO: 1150124 - DNA, 17 bp, Homo sapiens
taataagcacttgcctg

SEQ ID NO: 1150125 - DNA, 22 bp, Homo sapiens
taataagcacttgcctggaata

SEQ ID NO: 1150126 - DNA, 23 bp, Homo sapiens
taataagcacttgcctggaataa

SEQ ID NO: 1150127 - DNA, 21 bp, Homo sapiens
taataagttttgatataatct

SEQ ID NO: 1150128 - DNA, 11 bp, Homo sapiens
taataataaat

SEQ ID NO: 1150129 - DNA, 16 bp, Homo sapiens
taataataatgggttt

SEQ ID NO: 1150130 - DNA, 20 bp, Homo sapiens
taataatcttattagggaga

SEQ ID NO: 1150131 - DNA, 14 bp, Homo sapiens
taataatgtattgt

SEQ ID NO: 1150132 - DNA, 20 bp, Homo sapiens
taataatgtattgtaatctt

SEQ ID NO: 1150133 - DNA, 15 bp, Homo sapiens
taataatgtttaata

SEQ ID NO: 1150134 - DNA, 20 bp, Homo sapiens
taataattgctcataagcaa

SEQ ID NO: 1150135 - DNA, 22 bp, Homo sapiens
taataatttacaggttcttagg

SEQ ID NO: 1150136 - DNA, 22 bp, Homo sapiens
taataatttagacttcaagcat

SEQ ID NO: 1150137 - DNA, 19 bp, Homo sapiens
taataatttttgctgaatt

SEQ ID NO: 1150138 - DNA, 16 bp, Homo sapiens
taatacaccactacat

SEQ ID NO: 1150139 - DNA, 22 bp, Homo sapiens
taatacactaattcctttctat

SEQ ID NO: 1150140 - DNA, 19 bp, Homo sapiens
taatacagcagtgtcatca

SEQ ID NO: 1150141 - DNA, 16 bp, Homo sapiens
taatacatctttccct

SEQ ID NO: 1150142 - DNA, 21 bp, Homo sapiens
taatacattctatgacatttt

SEQ ID NO: 1150143 - DNA, 20 bp, Homo sapiens
taataccaaagactatttca

SEQ ID NO: 1150144 - DNA, 18 bp, Homo sapiens
taataccaaatattttag

SEQ ID NO: 1150145 - DNA, 20 bp, Homo sapiens
taatacctcttactttgctt

SEQ ID NO: 1150146 - DNA, 15 bp, Homo sapiens
taatacctgggtgat

SEQ ID NO: 1150147 - DNA, 16 bp, Homo sapiens
taatactaagacccta

SEQ ID NO: 1150148 - DNA, 14 bp, Homo sapiens
taatactaccttga

SEQ ID NO: 1150149 - DNA, 12 bp, Homo sapiens
taatactatatt

SEQ ID NO: 1150150 - DNA, 21 bp, Homo sapiens
taatactcaaatgagtaacat

SEQ ID NO: 1150151 - DNA, 15 bp, Homo sapiens
taatactctgttgta

SEQ ID NO: 1150152 - DNA, 17 bp, Homo sapiens
taatactgacctacctc

SEQ ID NO: 1150153 - DNA, 12 bp, Homo sapiens
taatactggaat

SEQ ID NO: 1150154 - DNA, 12 bp, Homo sapiens
taatactgtatt

SEQ ID NO: 1150155 - DNA, 14 bp, Homo sapiens
taatactgtatttg

SEQ ID NO: 1150156 - DNA, 14 bp, Homo sapiens
taatacttaaataa

SEQ ID NO: 1150157 - DNA, 20 bp, Homo sapiens
ttatggaattgatttgcatt

SEQ ID NO: 1150158 - DNA, 22 bp, Homo sapiens
ttatggacaaaattaatacatt

SEQ ID NO: 1150159 - DNA, 13 bp, Homo sapiens
ttatggacactgc

SEQ ID NO: 1150160 - DNA, 15 bp, Homo sapiens
ttatggacactgcct

SEQ ID NO: 1150161 - DNA, 14 bp, Homo sapiens
ttatggcatttcta

SEQ ID NO: 1150162 - DNA, 23 bp, Homo sapiens
ttatgggaaccccttcatcctct

SEQ ID NO: 1150163 - DNA, 19 bp, Homo sapiens
ttatgggaataattgcttt

SEQ ID NO: 1150164 - DNA, 12 bp, Homo sapiens
ttatgggagaat

SEQ ID NO: 1150165 - DNA, 16 bp, Homo sapiens
ttatgggatgtaaaca

SEQ ID NO: 1150166 - DNA, 17 bp, Homo sapiens
ttatgggatgtaaacaa

SEQ ID NO: 1150167 - DNA, 18 bp, Homo sapiens
ttatgggtggctttcaag

SEQ ID NO: 1150168 - DNA, 23 bp, Homo sapiens
ttatggtaactgctttctgttcc

SEQ ID NO: 1150169 - DNA, 13 bp, Homo sapiens
ttatggtctaatg

SEQ ID NO: 1150170 - DNA, 16 bp, Homo sapiens
ttatggtgatgactta

SEQ ID NO: 1150171 - DNA, 15 bp, Homo sapiens
ttatggttatgtttt

SEQ ID NO: 1150172 - DNA, 22 bp, Homo sapiens
ttatggtttaatgttacaacaa

SEQ ID NO: 1150173 - DNA, 11 bp, Homo sapiens
ttatggttttg

SEQ ID NO: 1150174 - DNA, 17 bp, Homo sapiens
ttatggttttgtgatgt

SEQ ID NO: 1150175 - DNA, 16 bp, Homo sapiens
ttatgtaaagtatgtt

SEQ ID NO: 1150176 - DNA, 18 bp, Homo sapiens
ttatgtaacatccagaag

SEQ ID NO: 1150177 - DNA, 16 bp, Homo sapiens
ttatgtaatatattgt

SEQ ID NO: 1150178 - DNA, 20 bp, Homo sapiens
ttatgtaatatattgtacaa

SEQ ID NO: 1150179 - DNA, 13 bp, Homo sapiens
ttatgtaatttca

SEQ ID NO: 1150180 - DNA, 16 bp, Homo sapiens
ttatgtaatttgtaca

SEQ ID NO: 1150181 - DNA, 14 bp, Homo sapiens
ttatgtacaaccct

SEQ ID NO: 1150182 - DNA, 22 bp, Homo sapiens
ttatgtacaaggatgaaagaaa

SEQ ID NO: 1150183 - DNA, 20 bp, Homo sapiens
ttatgtactagtgttctgtt

SEQ ID NO: 1150184 - DNA, 22 bp, Homo sapiens
ttatgtagcactactacagaaa

SEQ ID NO: 1150185 - DNA, 15 bp, Homo sapiens
ttatgtagtaattga

SEQ ID NO: 1150186 - DNA, 16 bp, Homo sapiens
ttatgtagtaattgac

SEQ ID NO: 1150187 - DNA, 11 bp, Homo sapiens
ttatgtagttt

SEQ ID NO: 1150188 - DNA, 21 bp, Homo sapiens
ttatgtagtttttatatgttg

SEQ ID NO: 1150189 - DNA, 16 bp, Homo sapiens
ttatgtatttataatt

SEQ ID NO: 1150190 - DNA, 18 bp, Homo sapiens
ttatgtatttataattta

SEQ ID NO: 1150191 - DNA, 11 bp, Homo sapiens
ttatgtatttc

SEQ ID NO: 1150192 - DNA, 14 bp, Homo sapiens
ttatgtattttgaa

SEQ ID NO: 1150193 - DNA, 15 bp, Homo sapiens
ttatgtattttgaaa

SEQ ID NO: 1150194 - DNA, 17 bp, Homo sapiens
ttatgtattttgaaaaa

SEQ ID NO: 1150195 - DNA, 21 bp, Homo sapiens
ttatgtcagcacacacttaca

SEQ ID NO: 1150196 - DNA, 15 bp, Homo sapiens
ttatgtccactgtgt

SEQ ID NO: 1150197 - DNA, 17 bp, Homo sapiens
ttatgtctatttaagcc

SEQ ID NO: 1150198 - DNA, 20 bp, Homo sapiens
ttatgtctcatgtaatttgc

SEQ ID NO: 1150199 - DNA, 24 bp, Homo sapiens
ttatgtctcttgagcatcaatctt

SEQ ID NO: 1150200 - DNA, 19 bp, Homo sapiens
ttatgtctgctgaataata

SEQ ID NO: 1150201 - DNA, 15 bp, Homo sapiens
ttatgtcttcttttg

SEQ ID NO: 1150202 - DNA, 16 bp, Homo sapiens
ttatgtcttcttttgt

SEQ ID NO: 1150203 - DNA, 11 bp, Homo sapiens
ttatgtgaatt

SEQ ID NO: 1150204 - DNA, 19 bp, Homo sapiens
ttatgtgaatttttaagct

SEQ ID NO: 1150205 - DNA, 15 bp, Homo sapiens
ttatgtgacattaac

SEQ ID NO: 1150206 - DNA, 14 bp, Homo sapiens
ttatgtgacttgca

SEQ ID NO: 1150207 - DNA, 21 bp, Homo sapiens
ttatgtgatgccaaagatgtt

SEQ ID NO: 1150208 - DNA, 18 bp, Homo sapiens
ttatgtgccgtgttattg

SEQ ID NO: 1150209 - DNA, 15 bp, Homo sapiens
ttatgtgttatgaac

SEQ ID NO: 1150210 - DNA, 16 bp, Homo sapiens
ttatgttaaactctgt

SEQ ID NO: 1150211 - DNA, 22 bp, Homo sapiens
ttatgttaagggaagaattcca

SEQ ID NO: 1150212 - DNA, 20 bp, Homo sapiens
ttatgttcagcttataatga

SEQ ID NO: 1150213 - DNA, 14 bp, Homo sapiens
ttatgttcatgtaa

SEQ ID NO: 1150214 - DNA, 14 bp, Homo sapiens
ttatgtttattaca

SEQ ID NO: 1150215 - DNA, 19 bp, Homo sapiens
ttatgtttattacaatttt

SEQ ID NO: 1150216 - DNA, 20 bp, Homo sapiens
ttattaaaaatgttctcaaa

SEQ ID NO: 1150217 - DNA, 12 bp, Homo sapiens
ttattaaaatct

SEQ ID NO: 1150218 - DNA, 14 bp, Homo sapiens
ttattaaaattctg

SEQ ID NO: 1150219 - DNA, 21 bp, Homo sapiens
ttattaaacagatttttacaa

SEQ ID NO: 1150220 - DNA, 17 bp, Homo sapiens
ttattaaatgcttcatt

SEQ ID NO: 1150221 - DNA, 12 bp, Homo sapiens
ttattaaatgta

SEQ ID NO: 1150222 - DNA, 15 bp, Homo sapiens
ttattaaatgtagct

SEQ ID NO: 1150223 - DNA, 20 bp, Homo sapiens
ttattaacgggcatgtatta

SEQ ID NO: 1150224 - DNA, 23 bp, Homo sapiens
ttattaactactgaataatgcta

SEQ ID NO: 1150225 - DNA, 19 bp, Homo sapiens
ttattaagctttttggaat

SEQ ID NO: 1150226 - DNA, 14 bp, Homo sapiens
ttattaagtaaaat

SEQ ID NO: 1150227 - DNA, 15 bp, Homo sapiens
ttattaataatgaag

SEQ ID NO: 1150228 - DNA, 19 bp, Homo sapiens
ttattaatatgagttactg

SEQ ID NO: 1150229 - DNA, 18 bp, Homo sapiens
ttattaatatttaacatt

SEQ ID NO: 1150230 - DNA, 15 bp, Homo sapiens
ttattaattgctttg

SEQ ID NO: 1150231 - DNA, 13 bp, Homo sapiens
ttattaattgtcc

SEQ ID NO: 1150232 - DNA, 20 bp, Homo sapiens
ttattaattttagtttttca

SEQ ID NO: 1150233 - DNA, 16 bp, Homo sapiens
ttattacaagtggctc

SEQ ID NO: 1150234 - DNA, 17 bp, Homo sapiens
ttattacaatgtatctt

SEQ ID NO: 1150235 - DNA, 17 bp, Homo sapiens
ttattacagaaatgttt

SEQ ID NO: 1150236 - DNA, 15 bp, Homo sapiens
ttattacatgtaatt

SEQ ID NO: 1150237 - DNA, 16 bp, Homo sapiens
ttattacatttataca

SEQ ID NO: 1150238 - DNA, 22 bp, Homo sapiens
ttattaccccctccttcagaca

SEQ ID NO: 1150239 - DNA, 12 bp, Homo sapiens
ttattacctctg

SEQ ID NO: 1150240 - DNA, 15 bp, Homo sapiens
taatattttgtaata

SEQ ID NO: 1150241 - DNA, 21 bp, Homo sapiens
taatattttgtaatattctgt

SEQ ID NO: 1150242 - DNA, 15 bp, Homo sapiens
taatattttgtattt

SEQ ID NO: 1150243 - DNA, 19 bp, Homo sapiens
taatatttttgtatttctc

SEQ ID NO: 1150244 - DNA, 17 bp, Homo sapiens
taatcaaaagctattta

SEQ ID NO: 1150245 - DNA, 15 bp, Homo sapiens
taatcaaaattgtct

SEQ ID NO: 1150246 - DNA, 12 bp, Homo sapiens
taatcaaagcta

SEQ ID NO: 1150247 - DNA, 16 bp, Homo sapiens
taatcaagagaaactt

SEQ ID NO: 1150248 - DNA, 18 bp, Homo sapiens
taatcaagagaaacttca

SEQ ID NO: 1150249 - DNA, 20 bp, Homo sapiens
taatcaagtacctatattga

SEQ ID NO: 1150250 - DNA, 21 bp, Homo sapiens
taatcaagttgtaacttatat

SEQ ID NO: 1150251 - DNA, 14 bp, Homo sapiens
taatcaataaagaa

SEQ ID NO: 1150252 - DNA, 17 bp, Homo sapiens
taatcacatgtgctgca

SEQ ID NO: 1150253 - DNA, 14 bp, Homo sapiens
taatcaccaaagta

SEQ ID NO: 1150254 - DNA, 23 bp, Homo sapiens
taatcaccctaccaactttactg

SEQ ID NO: 1150255 - DNA, 13 bp, Homo sapiens
taatcactactgt

SEQ ID NO: 1150256 - DNA, 20 bp, Homo sapiens
taatcactctaattaattgt

SEQ ID NO: 1150257 - DNA, 16 bp, Homo sapiens
taatcactgctgaaga

SEQ ID NO: 1150258 - DNA, 23 bp, Homo sapiens
taatcagaaaagtaattttgtca

SEQ ID NO: 1150259 - DNA, 22 bp, Homo sapiens
taatcagaatgaaccctcctcc

SEQ ID NO: 1150260 - DNA, 20 bp, Homo sapiens
taatcagagttaccattatt

SEQ ID NO: 1150261 - DNA, 20 bp, Homo sapiens
taatcagccccagagtgctt

SEQ ID NO: 1150262 - DNA, 12 bp, Homo sapiens
taatcagcctct

SEQ ID NO: 1150263 - DNA, 16 bp, Homo sapiens
taatcagctctcctgg

SEQ ID NO: 1150264 - DNA, 12 bp, Homo sapiens
taatcaggcagc

SEQ ID NO: 1150265 - DNA, 15 bp, Homo sapiens
taatcagtgactgaa

SEQ ID NO: 1150266 - DNA, 23 bp, Homo sapiens
taatcagttcattagaaatattt

SEQ ID NO: 1150267 - DNA, 20 bp, Homo sapiens
taatcatataataaatgtac

SEQ ID NO: 1150268 - DNA, 20 bp, Homo sapiens
taatcatccctccttgccta

SEQ ID NO: 1150269 - DNA, 15 bp, Homo sapiens
taatcatgaaccaat

SEQ ID NO: 1150270 - DNA, 16 bp, Homo sapiens
taatcatgagaaaaac

SEQ ID NO: 1150271 - DNA, 17 bp, Homo sapiens
taatcatgctcatgtat

SEQ ID NO: 1150272 - DNA, 13 bp, Homo sapiens
taatcatgtaaat

SEQ ID NO: 1150273 - DNA, 15 bp, Homo sapiens
taatcatgtaaatgc

SEQ ID NO: 1150274 - DNA, 17 bp, Homo sapiens
taatcattagttttaga

SEQ ID NO: 1150275 - DNA, 12 bp, Homo sapiens
taatcatttctt

SEQ ID NO: 1150276 - DNA, 14 bp, Homo sapiens
taatcatttgttta

SEQ ID NO: 1150277 - DNA, 19 bp, Homo sapiens
taatcatttgtttacattt

SEQ ID NO: 1150278 - DNA, 18 bp, Homo sapiens
taatcattttaaattcca

SEQ ID NO: 1150279 - DNA, 19 bp, Homo sapiens
taatcattttaataaagtt

SEQ ID NO: 1150280 - DNA, 20 bp, Homo sapiens
taatccaatattttgccttt

SEQ ID NO: 1150281 - DNA, 22 bp, Homo sapiens
taatccaatccactaacacttt

SEQ ID NO: 1150282 - DNA, 13 bp, Homo sapiens
taatccagctgat

SEQ ID NO: 1150283 - DNA, 19 bp, Homo sapiens
taatccaggcacagctgag

SEQ ID NO: 1150284 - DNA, 18 bp, Homo sapiens
taatccattccaaaatac

SEQ ID NO: 1150285 - DNA, 16 bp, Homo sapiens
taatcccagcactttg

SEQ ID NO: 1150286 - DNA, 17 bp, Homo sapiens
ttattccgagcattcca

SEQ ID NO: 1150287 - DNA, 14 bp, Homo sapiens
ttattcctagtctt

SEQ ID NO: 1150288 - DNA, 20 bp, Homo sapiens
ttattcctatatagtttatt

SEQ ID NO: 1150289 - DNA, 14 bp, Homo sapiens
ttattcctcagatt

SEQ ID NO: 1150290 - DNA, 17 bp, Homo sapiens
ttattcctgtatgttgt

SEQ ID NO: 1150291 - DNA, 22 bp, Homo sapiens
ttattccttccatctagcagct

SEQ ID NO: 1150292 - DNA, 14 bp, Homo sapiens
ttattccttctgta

SEQ ID NO: 1150293 - DNA, 18 bp, Homo sapiens
ttattcgtcctttgacaa

SEQ ID NO: 1150294 - DNA, 19 bp, Homo sapiens
ttattctagttaaggaaat

SEQ ID NO: 1150295 - DNA, 14 bp, Homo sapiens
ttattctcaaagca

SEQ ID NO: 1150296 - DNA, 17 bp, Homo sapiens
ttattctcactccacca

SEQ ID NO: 1150297 - DNA, 18 bp, Homo sapiens
ttattctgacataaaatt

SEQ ID NO: 1150298 - DNA, 19 bp, Homo sapiens
ttattctgtggttctataa

SEQ ID NO: 1150299 - DNA, 20 bp, Homo sapiens
ttattcttattaaggaaata

SEQ ID NO: 1150300 - DNA, 14 bp, Homo sapiens
ttattcttccagaa

SEQ ID NO: 1150301 - DNA, 15 bp, Homo sapiens
ttattcttctcataa

SEQ ID NO: 1150302 - DNA, 14 bp, Homo sapiens
ttattcttgagttt

SEQ ID NO: 1150303 - DNA, 16 bp, Homo sapiens
ttattcttgctgggca

SEQ ID NO: 1150304 - DNA, 21 bp, Homo sapiens
ttattcttgctgggcatactt

SEQ ID NO: 1150305 - DNA, 16 bp, Homo sapiens
ttattctttgaaaaca

SEQ ID NO: 1150306 - DNA, 22 bp, Homo sapiens
ttattgaaaaaaaaaatgttga

SEQ ID NO: 1150307 - DNA, 20 bp, Homo sapiens
ttattgaaatgtataattaa

SEQ ID NO: 1150308 - DNA, 18 bp, Homo sapiens
ttattgaatctatttaag

SEQ ID NO: 1150309 - DNA, 15 bp, Homo sapiens
ttattgaattagaaa

SEQ ID NO: 1150310 - DNA, 20 bp, Homo sapiens
ttattgaattagaaaattag

SEQ ID NO: 1150311 - DNA, 14 bp, Homo sapiens
ttattgaatttgtt

SEQ ID NO: 1150312 - DNA, 23 bp, Homo sapiens
ttattgaatttgttagactagtt

SEQ ID NO: 1150313 - DNA, 18 bp, Homo sapiens
ttattgacaataatttca

SEQ ID NO: 1150314 - DNA, 22 bp, Homo sapiens
ttattgacaataatttcaggtt

SEQ ID NO: 1150315 - DNA, 19 bp, Homo sapiens
ttattgagaattttaaatt

SEQ ID NO: 1150316 - DNA, 22 bp, Homo sapiens
ttattgagggtcattctttatt

SEQ ID NO: 1150317 - DNA, 17 bp, Homo sapiens
ttattgatattctaaga

SEQ ID NO: 1150318 - DNA, 14 bp, Homo sapiens
ttattgatcccaca

SEQ ID NO: 1150319 - DNA, 21 bp, Homo sapiens
ttattgcaaaatagcatttgt

SEQ ID NO: 1150320 - DNA, 15 bp, Homo sapiens
ttattgcacattgtt

SEQ ID NO: 1150321 - DNA, 23 bp, Homo sapiens
ttattgcaccattttcaatttgg

SEQ ID NO: 1150322 - DNA, 14 bp, Homo sapiens
ttattgcagaatgt

SEQ ID NO: 1150323 - DNA, 18 bp, Homo sapiens
ttattgcagtttatcatt

SEQ ID NO: 1150324 - DNA, 21 bp, Homo sapiens
ttattgcagtttatcattcaa

SEQ ID NO: 1150325 - DNA, 14 bp, Homo sapiens
ttattgcatgctga

SEQ ID NO: 1150326 - DNA, 13 bp, Homo sapiens
ttattgcattata

SEQ ID NO: 1150327 - DNA, 19 bp, Homo sapiens
ttattgccaggaaaggaga

SEQ ID NO: 1150328 - DNA, 21 bp, Homo sapiens
ttattgcccatgatataactt

SEQ ID NO: 1150329 - DNA, 21 bp, Homo sapiens
ttattgctcgcccagacacca

SEQ ID NO: 1150330 - DNA, 16 bp, Homo sapiens
ttattgctgccaaaac

SEQ ID NO: 1150331 - DNA, 22 bp, Homo sapiens
ttattggaagtgttcaagaaat

SEQ ID NO: 1150332 - DNA, 13 bp, Homo sapiens
ttattggaattaa

SEQ ID NO: 1150333 - DNA, 22 bp, Homo sapiens
ttattggaattaacctggtgct

SEQ ID NO: 1150334 - DNA, 23 bp, Homo sapiens
ttattggcagccaaggaatgtgt

SEQ ID NO: 1150335 - DNA, 15 bp, Homo sapiens
ttattggctgagata

SEQ ID NO: 1150336 - DNA, 19 bp, Homo sapiens
ttattgggcaagtgattga

SEQ ID NO: 1150337 - DNA, 20 bp, Homo sapiens
ttattgggcaagtgattgaa

SEQ ID NO: 1150338 - DNA, 14 bp, Homo sapiens
ttattgggttttta

SEQ ID NO: 1150339 - DNA, 12 bp, Homo sapiens
ttattgtaaact

SEQ ID NO: 1150340 - DNA, 13 bp, Homo sapiens
ttattgtaaactt

SEQ ID NO: 1150341 - DNA, 12 bp, Homo sapiens
ttattgtacctc

SEQ ID NO: 1150342 - DNA, 12 bp, Homo sapiens
ttattgtacttg

SEQ ID NO: 1150343 - DNA, 16 bp, Homo sapiens
ttattgtataaaaagt

SEQ ID NO: 1150344 - DNA, 23 bp, Homo sapiens
ttattgtgctgggtcccagcctg

SEQ ID NO: 1150345 - DNA, 23 bp, Homo sapiens
ttattgtgggccatgaaccaaat

SEQ ID NO: 1150346 - DNA, 20 bp, Homo sapiens
ttattgtgtttttaatttat

SEQ ID NO: 1150347 - DNA, 16 bp, Homo sapiens
ttattgttaaattaca

SEQ ID NO: 1150348 - DNA, 22 bp, Homo sapiens
ttattgttccaagacattgtca

SEQ ID NO: 1150349 - DNA, 12 bp, Homo sapiens
ttattgttgaac

SEQ ID NO: 1150350 - DNA, 14 bp, Homo sapiens
ttattgttgccttt

SEQ ID NO: 1150351 - DNA, 15 bp, Homo sapiens
ttatttaaaactctg

SEQ ID NO: 1150352 - DNA, 12 bp, Homo sapiens
ttatttaaaaga

SEQ ID NO: 1150353 - DNA, 16 bp, Homo sapiens
ttatttaaaatagcaa

SEQ ID NO: 1150354 - DNA, 21 bp, Homo sapiens
ttatttaaaatagcaaaagaa

SEQ ID NO: 1150355 - DNA, 22 bp, Homo sapiens
ttatttaaaatagcaaaagaag

SEQ ID NO: 1150356 - DNA, 14 bp, Homo sapiens
ttatttaaatctgt

SEQ ID NO: 1150357 - DNA, 21 bp, Homo sapiens
ttatttaaatgcatgtcttaa

SEQ ID NO: 1150358 - DNA, 14 bp, Homo sapiens
ttatttaactggta

SEQ ID NO: 1150359 - DNA, 15 bp, Homo sapiens
ttatttaagactaaa

SEQ ID NO: 1150360 - DNA, 23 bp, Homo sapiens
ttatttaagtatggaatattcat

SEQ ID NO: 1150361 - DNA, 16 bp, Homo sapiens
ttatttaagttgtgat

SEQ ID NO: 1150362 - DNA, 22 bp, Homo sapiens
taatgaattataacagttatat

SEQ ID NO: 1150363 - DNA, 20 bp, Homo sapiens
taatgaatttaaggcaaaaa

SEQ ID NO: 1150364 - DNA, 17 bp, Homo sapiens
taatgacagatggtgaa

SEQ ID NO: 1150365 - DNA, 18 bp, Homo sapiens
taatgaccaattgagtaa

SEQ ID NO: 1150366 - DNA, 17 bp, Homo sapiens
taatgactctttctgaa

SEQ ID NO: 1150367 - DNA, 14 bp, Homo sapiens
taatgacttagaaa

SEQ ID NO: 1150368 - DNA, 16 bp, Homo sapiens
taatgacttagaaact

SEQ ID NO: 1150369 - DNA, 19 bp, Homo sapiens
taatgagactttaaaagca

SEQ ID NO: 1150370 - DNA, 22 bp, Homo sapiens
taatgagatgttattactgttt

SEQ ID NO: 1150371 - DNA, 17 bp, Homo sapiens
taatgataaaataaata

SEQ ID NO: 1150372 - DNA, 21 bp, Homo sapiens
taatgataaactcagatctga

SEQ ID NO: 1150373 - DNA, 13 bp, Homo sapiens
taatgatatactg

SEQ ID NO: 1150374 - DNA, 15 bp, Homo sapiens
taatgatcaaaacat

SEQ ID NO: 1150375 - DNA, 13 bp, Homo sapiens
taatgatctaaga

SEQ ID NO: 1150376 - DNA, 14 bp, Homo sapiens
taatgatgagcatt

SEQ ID NO: 1150377 - DNA, 19 bp, Homo sapiens
taatgatgagcatttagca

SEQ ID NO: 1150378 - DNA, 23 bp, Homo sapiens
taatgatgagcatttagcacaat

SEQ ID NO: 1150379 - DNA, 14 bp, Homo sapiens
taatgatgtaacag

SEQ ID NO: 1150380 - DNA, 20 bp, Homo sapiens
taatgatgttgataatttca

SEQ ID NO: 1150381 - DNA, 16 bp, Homo sapiens
taatgattcaaatgtt

SEQ ID NO: 1150382 - DNA, 23 bp, Homo sapiens
taatgattcaaatgttttaaagt

SEQ ID NO: 1150383 - DNA, 20 bp, Homo sapiens
taatgatttgctctttgaca

SEQ ID NO: 1150384 - DNA, 18 bp, Homo sapiens
taatgcaaattaaaacat

SEQ ID NO: 1150385 - DNA, 13 bp, Homo sapiens
taatgcactttct

SEQ ID NO: 1150386 - DNA, 14 bp, Homo sapiens
taatgcactttcta

SEQ ID NO: 1150387 - DNA, 23 bp, Homo sapiens
taatgcagccacgattggagaat

SEQ ID NO: 1150388 - DNA, 17 bp, Homo sapiens
taatgcagttgcttact

SEQ ID NO: 1150389 - DNA, 22 bp, Homo sapiens
taatgcatctagattatggagc

SEQ ID NO: 1150390 - DNA, 18 bp, Homo sapiens
taatgcattcttctctgt

SEQ ID NO: 1150391 - DNA, 19 bp, Homo sapiens
taatgcattcttctctgtt

SEQ ID NO: 1150392 - DNA, 20 bp, Homo sapiens
taatgccacacattgtgctt

SEQ ID NO: 1150393 - DNA, 14 bp, Homo sapiens
taatgcccagccag

SEQ ID NO: 1150394 - DNA, 18 bp, Homo sapiens
taatgcccagccagccac

SEQ ID NO: 1150395 - DNA, 20 bp, Homo sapiens
taatgcccagccagccaccc

SEQ ID NO: 1150396 - DNA, 20 bp, Homo sapiens
taatgcctgctttttggaaa

SEQ ID NO: 1150397 - DNA, 15 bp, Homo sapiens
taatgccttactctt

SEQ ID NO: 1150398 - DNA, 22 bp, Homo sapiens
taatgcctttaaagtatgaatc

SEQ ID NO: 1150399 - DNA, 19 bp, Homo sapiens
taatgcgtgcataccactt

SEQ ID NO: 1150400 - DNA, 23 bp, Homo sapiens
taatgcgtgcataccacttttgt

SEQ ID NO: 1150401 - DNA, 20 bp, Homo sapiens
taatgctaccaggatgctaa

SEQ ID NO: 1150402 - DNA, 15 bp, Homo sapiens
taatgctactgtctc

SEQ ID NO: 1150403 - DNA, 17 bp, Homo sapiens
taatgctatttgaacaa

SEQ ID NO: 1150404 - DNA, 19 bp, Homo sapiens
taatgctctatgtttgtat

SEQ ID NO: 1150405 - DNA, 22 bp, Homo sapiens
taatgctctatgtttgtatttg

SEQ ID NO: 1150406 - DNA, 15 bp, Homo sapiens
taatgctgtttctaa

SEQ ID NO: 1150407 - DNA, 17 bp, Homo sapiens
taatgctgtttctaaga

SEQ ID NO: 1150408 - DNA, 20 bp, Homo sapiens
taatgctgtttctaagaaaa

SEQ ID NO: 1150409 - DNA, 23 bp, Homo sapiens
taatgcttcaagtgttgctcttg

SEQ ID NO: 1150410 - DNA, 14 bp, Homo sapiens
taatgcttcattca

SEQ ID NO: 1150411 - DNA, 21 bp, Homo sapiens
taatgcttgtaatttaaacat

SEQ ID NO: 1150412 - DNA, 19 bp, Homo sapiens
taatgctttcacaacattt

SEQ ID NO: 1150413 - DNA, 23 bp, Homo sapiens
ttatttgtgcattttattgactg

SEQ ID NO: 1150414 - DNA, 22 bp, Homo sapiens
ttatttgtgttttaatttaaac

SEQ ID NO: 1150415 - DNA, 18 bp, Homo sapiens
ttatttgttattttcagt

SEQ ID NO: 1150416 - DNA, 19 bp, Homo sapiens
ttatttgttgagagtgtga

SEQ ID NO: 1150417 - DNA, 20 bp, Homo sapiens
ttattttacagctcattaaa

SEQ ID NO: 1150418 - DNA, 12 bp, Homo sapiens
ttattttacatt

SEQ ID NO: 1150419 - DNA, 13 bp, Homo sapiens
ttattttacattt

SEQ ID NO: 1150420 - DNA, 12 bp, Homo sapiens
ttattttagcag

SEQ ID NO: 1150421 - DNA, 18 bp, Homo sapiens
ttattttagcttcagttg

SEQ ID NO: 1150422 - DNA, 21 bp, Homo sapiens
ttattttagcttcagttgttc

SEQ ID NO: 1150423 - DNA, 22 bp, Homo sapiens
ttattttatatcatacagtttt

SEQ ID NO: 1150424 - DNA, 18 bp, Homo sapiens
ttattttattatgcatga

SEQ ID NO: 1150425 - DNA, 18 bp, Homo sapiens
ttattttattgaaatgta

SEQ ID NO: 1150426 - DNA, 14 bp, Homo sapiens
ttattttatttgct

SEQ ID NO: 1150427 - DNA, 12 bp, Homo sapiens
ttattttcaaga

SEQ ID NO: 1150428 - DNA, 13 bp, Homo sapiens
ttattttcaagaa

SEQ ID NO: 1150429 - DNA, 18 bp, Homo sapiens
ttattttcaagaaactga

SEQ ID NO: 1150430 - DNA, 19 bp, Homo sapiens
ttattttcagtatactgtg

SEQ ID NO: 1150431 - DNA, 14 bp, Homo sapiens
ttattttcagtatt

SEQ ID NO: 1150432 - DNA, 15 bp, Homo sapiens
ttattttcattgtga

SEQ ID NO: 1150433 - DNA, 13 bp, Homo sapiens
ttattttctgtca

SEQ ID NO: 1150434 - DNA, 16 bp, Homo sapiens
ttattttcttgtttaa

SEQ ID NO: 1150435 - DNA, 17 bp, Homo sapiens
ttattttgacataaagt

SEQ ID NO: 1150436 - DNA, 13 bp, Homo sapiens
ttattttgctccc

SEQ ID NO: 1150437 - DNA, 18 bp, Homo sapiens
ttattttgctccctctgt

SEQ ID NO: 1150438 - DNA, 19 bp, Homo sapiens
ttattttgctccctctgtt

SEQ ID NO: 1150439 - DNA, 15 bp, Homo sapiens
ttattttgctgagtt

SEQ ID NO: 1150440 - DNA, 16 bp, Homo sapiens
ttattttgctgagttg

SEQ ID NO: 1150441 - DNA, 20 bp, Homo sapiens
ttattttgctgagttgttct

SEQ ID NO: 1150442 - DNA, 18 bp, Homo sapiens
ttattttgctttggttaa

SEQ ID NO: 1150443 - DNA, 20 bp, Homo sapiens
ttattttggcttcatttcaa

SEQ ID NO: 1150444 - DNA, 13 bp, Homo sapiens
ttattttggtact

SEQ ID NO: 1150445 - DNA, 22 bp, Homo sapiens
ttattttgtattacatctaatg

SEQ ID NO: 1150446 - DNA, 13 bp, Homo sapiens
ttattttgtctta

SEQ ID NO: 1150447 - DNA, 23 bp, Homo sapiens
ttattttgttgaccattttgtta

SEQ ID NO: 1150448 - DNA, 18 bp, Homo sapiens
ttatttttacgatctgtt

SEQ ID NO: 1150449 - DNA, 17 bp, Homo sapiens
ttatttttattaaatgt

SEQ ID NO: 1150450 - DNA, 18 bp, Homo sapiens
ttatttttattaaatgta

SEQ ID NO: 1150451 - DNA, 22 bp, Homo sapiens
ttatttttctaaggttctcata

SEQ ID NO: 1150452 - DNA, 17 bp, Homo sapiens
ttatttttctaagtgta

SEQ ID NO: 1150453 - DNA, 19 bp, Homo sapiens
ttatttttctcttgtacca

SEQ ID NO: 1150454 - DNA, 16 bp, Homo sapiens
ttatttttctgtgggt

SEQ ID NO: 1150455 - DNA, 15 bp, Homo sapiens
ttatttttctgttac

SEQ ID NO: 1150456 - DNA, 14 bp, Homo sapiens
ttatttttcttgtc

SEQ ID NO: 1150457 - DNA, 17 bp, Homo sapiens
ttatttttgtgtttcta

SEQ ID NO: 1150458 - DNA, 15 bp, Homo sapiens
ttattttttaaaaag

SEQ ID NO: 1150459 - DNA, 18 bp, Homo sapiens
ttattttttaaaaaggta

SEQ ID NO: 1150460 - DNA, 16 bp, Homo sapiens
ttattttttaaatgta

SEQ ID NO: 1150461 - DNA, 16 bp, Homo sapiens
ttattttttaattatt

SEQ ID NO: 1150462 - DNA, 18 bp, Homo sapiens
ttattttttacattatta

SEQ ID NO: 1150463 - DNA, 13 bp, Homo sapiens
ttattttttattg

SEQ ID NO: 1150464 - DNA, 21 bp, Homo sapiens
ttcaaaaaaaaaaaaaaagac

SEQ ID NO: 1150465 - DNA, 22 bp, Homo sapiens
ttcaaaaaaaaaaaaaaagact

SEQ ID NO: 1150466 - DNA, 17 bp, Homo sapiens
ttcaaaaaaacactagt

SEQ ID NO: 1150467 - DNA, 18 bp, Homo sapiens
ttcaaaaaaacactagtt

SEQ ID NO: 1150468 - DNA, 22 bp, Homo sapiens
ttcaaaaaatcatgtttatttt

SEQ ID NO: 1150469 - DNA, 18 bp, Homo sapiens
ttcaaaaaccagccaggc

SEQ ID NO: 1150470 - DNA, 20 bp, Homo sapiens
ttcaaaaaccagccaggcag

SEQ ID NO: 1150471 - DNA, 23 bp, Homo sapiens
ttcaaaaagcagagtggactgca

SEQ ID NO: 1150472 - DNA, 13 bp, Homo sapiens
ttcaaaaagtgtt

SEQ ID NO: 1150473 - DNA, 14 bp, Homo sapiens
ttcaaaaagtgttt

SEQ ID NO: 1150474 - DNA, 19 bp, Homo sapiens
ttcaaaaataaattagaaa

SEQ ID NO: 1150475 - DNA, 16 bp, Homo sapiens
ttcaaaacctgcagtt

SEQ ID NO: 1150476 - DNA, 15 bp, Homo sapiens
ttcaaaactgtttgt

SEQ ID NO: 1150477 - DNA, 23 bp, Homo sapiens
ttcaaaagaaatttaagttctat

SEQ ID NO: 1150478 - DNA, 19 bp, Homo sapiens
ttcaaaagccataacttga

SEQ ID NO: 1150479 - DNA, 13 bp, Homo sapiens
ttcaaaagggaag

SEQ ID NO: 1150480 - DNA, 16 bp, Homo sapiens
ttcaaaataaaaagta

SEQ ID NO: 1150481 - DNA, 16 bp, Homo sapiens
ttcaaaatatgttctt

SEQ ID NO: 1150482 - DNA, 22 bp, Homo sapiens
ttcaaaatatttaaaaatgtct

SEQ ID NO: 1150483 - DNA, 15 bp, Homo sapiens
taatgtgatcatatg

SEQ ID NO: 1150484 - DNA, 23 bp, Homo sapiens
taatgtgatggatggcacaatga

SEQ ID NO: 1150485 - DNA, 17 bp, Homo sapiens
taatgtgcaaattttgc

SEQ ID NO: 1150486 - DNA, 22 bp, Homo sapiens
taatgtgcagggatattgcctt

SEQ ID NO: 1150487 - DNA, 23 bp, Homo sapiens
taatgtgcagggatattgcctta

SEQ ID NO: 1150488 - DNA, 19 bp, Homo sapiens
taatgtgccccatgtccaa

SEQ ID NO: 1150489 - DNA, 22 bp, Homo sapiens
taatgtgggaagaaacaaaccc

SEQ ID NO: 1150490 - DNA, 22 bp, Homo sapiens
taatgtgggttatcctcctctc

SEQ ID NO: 1150491 - DNA, 16 bp, Homo sapiens
taatgtggttatttct

SEQ ID NO: 1150492 - DNA, 14 bp, Homo sapiens
taatgtgtctgtgt

SEQ ID NO: 1150493 - DNA, 13 bp, Homo sapiens
taatgtgtgaaaa

SEQ ID NO: 1150494 - DNA, 19 bp, Homo sapiens
taatgtgtggtggcctcag

SEQ ID NO: 1150495 - DNA, 14 bp, Homo sapiens
taatgttaagcttt

SEQ ID NO: 1150496 - DNA, 11 bp, Homo sapiens
taatgttactg

SEQ ID NO: 1150497 - DNA, 23 bp, Homo sapiens
taatgttactgatcatgcattgt

SEQ ID NO: 1150498 - DNA, 19 bp, Homo sapiens
taatgttattattactcta

SEQ ID NO: 1150499 - DNA, 16 bp, Homo sapiens
taatgttcacattttt

SEQ ID NO: 1150500 - DNA, 19 bp, Homo sapiens
taatgttgaatgtattttg

SEQ ID NO: 1150501 - DNA, 19 bp, Homo sapiens
taatgttgataatatatat

SEQ ID NO: 1150502 - DNA, 13 bp, Homo sapiens
taatgttgatcag

SEQ ID NO: 1150503 - DNA, 17 bp, Homo sapiens
taatgttgatcagcaaa

SEQ ID NO: 1150504 - DNA, 18 bp, Homo sapiens
taatgttgatcagcaaat

SEQ ID NO: 1150505 - DNA, 22 bp, Homo sapiens
taatgttgctggatcaggaagc

SEQ ID NO: 1150506 - DNA, 18 bp, Homo sapiens
taatgtttatgagccaga

SEQ ID NO: 1150507 - DNA, 17 bp, Homo sapiens
taatgtttattaaatgc

SEQ ID NO: 1150508 - DNA, 21 bp, Homo sapiens
taatgtttattatttacatca

SEQ ID NO: 1150509 - DNA, 22 bp, Homo sapiens
taatgtttctggatttcatact

SEQ ID NO: 1150510 - DNA, 14 bp, Homo sapiens
taatgtttgaacaa

SEQ ID NO: 1150511 - DNA, 12 bp, Homo sapiens
taatgtttgcta

SEQ ID NO: 1150512 - DNA, 12 bp, Homo sapiens
taatgttttgta

SEQ ID NO: 1150513 - DNA, 15 bp, Homo sapiens
taatgttttgtacaa

SEQ ID NO: 1150514 - DNA, 16 bp, Homo sapiens
taatgtttttaatatt

SEQ ID NO: 1150515 - DNA, 22 bp, Homo sapiens
taatgttttttgccacagcttt

SEQ ID NO: 1150516 - DNA, 23 bp, Homo sapiens
taatgttttttgccacagctttt

SEQ ID NO: 1150517 - DNA, 22 bp, Homo sapiens
taatgttttttggaaattcaga

SEQ ID NO: 1150518 - DNA, 14 bp, Homo sapiens
taattaaaaacttt

SEQ ID NO: 1150519 - DNA, 14 bp, Homo sapiens
taattaaactgtta

SEQ ID NO: 1150520 - DNA, 17 bp, Homo sapiens
taattaaagatgccata

SEQ ID NO: 1150521 - DNA, 18 bp, Homo sapiens
taattaaagatgccatag

SEQ ID NO: 1150522 - DNA, 21 bp, Homo sapiens
taattaaagatgccatagcat

SEQ ID NO: 1150523 - DNA, 21 bp, Homo sapiens
taattaaagcttaaactgaat

SEQ ID NO: 1150524 - DNA, 15 bp, Homo sapiens
taattaaatttaact

SEQ ID NO: 1150525 - DNA, 16 bp, Homo sapiens
taattaactgaaacat

SEQ ID NO: 1150526 - DNA, 16 bp, Homo sapiens
taattaactgtaaact

SEQ ID NO: 1150527 - DNA, 18 bp, Homo sapiens
taattaagactgaaaata

SEQ ID NO: 1150528 - DNA, 16 bp, Homo sapiens
taattaagcagaaaca

SEQ ID NO: 1150529 - DNA, 19 bp, Homo sapiens
taattaagcagaaacagca

SEQ ID NO: 1150530 - DNA, 13 bp, Homo sapiens
taattaagtatct

SEQ ID NO: 1150531 - DNA, 19 bp, Homo sapiens
taattaataaagaaaaaga

SEQ ID NO: 1150532 - DNA, 17 bp, Homo sapiens
taattaatatattaaaa

SEQ ID NO: 1150533 - DNA, 15 bp, Homo sapiens
taattaattgtcatt

SEQ ID NO: 1150534 - DNA, 21 bp, Homo sapiens
taattacagccttatttttgt

SEQ ID NO: 1150535 - DNA, 15 bp, Homo sapiens
taattacatatttga

SEQ ID NO: 1150536 - DNA, 19 bp, Homo sapiens
taattacatatttgactct

SEQ ID NO: 1150537 - DNA, 22 bp, Homo sapiens
taattacattcctaactagaat

SEQ ID NO: 1150538 - DNA, 16 bp, Homo sapiens
taattaccaacctgtt

SEQ ID NO: 1150539 - DNA, 22 bp, Homo sapiens
ttcaagaaagcttcaaactgca

SEQ ID NO: 1150540 - DNA, 12 bp, Homo sapiens
ttcaagaaataa

SEQ ID NO: 1150541 - DNA, 16 bp, Homo sapiens
ttcaagaacctggaaa

SEQ ID NO: 1150542 - DNA, 18 bp, Homo sapiens
ttcaagaatgaaaaatat

SEQ ID NO: 1150543 - DNA, 21 bp, Homo sapiens
ttcaagaatgaaaaatataat

SEQ ID NO: 1150544 - DNA, 18 bp, Homo sapiens
ttcaagagctagaaaaat

SEQ ID NO: 1150545 - DNA, 22 bp, Homo sapiens
ttcaagaggaaaggcgcccccg

SEQ ID NO: 1150546 - DNA, 17 bp, Homo sapiens
ttcaagaggcgtgtgca

SEQ ID NO: 1150547 - DNA, 13 bp, Homo sapiens
ttcaagattctaa

SEQ ID NO: 1150548 - DNA, 15 bp, Homo sapiens
ttcaagattctaaag

SEQ ID NO: 1150549 - DNA, 17 bp, Homo sapiens
ttcaagattctaaagct

SEQ ID NO: 1150550 - DNA, 16 bp, Homo sapiens
ttcaagattgttgata

SEQ ID NO: 1150551 - DNA, 15 bp, Homo sapiens
ttcaagcaaacatca

SEQ ID NO: 1150552 - DNA, 21 bp, Homo sapiens
ttcaagcaaacatcaaataaa

SEQ ID NO: 1150553 - DNA, 17 bp, Homo sapiens
ttcaagcacactggaat

SEQ ID NO: 1150554 - DNA, 17 bp, Homo sapiens
ttcaagcacttacagct

SEQ ID NO: 1150555 - DNA, 23 bp, Homo sapiens
ttcaagcagtcgtgcctgtgtcc

SEQ ID NO: 1150556 - DNA, 17 bp, Homo sapiens
ttcaagcatcctcagaa

SEQ ID NO: 1150557 - DNA, 15 bp, Homo sapiens
ttcaagcattaagaa

SEQ ID NO: 1150558 - DNA, 17 bp, Homo sapiens
ttcaagcctctaaacag

SEQ ID NO: 1150559 - DNA, 18 bp, Homo sapiens
ttcaagcctctaaacaga

SEQ ID NO: 1150560 - DNA, 15 bp, Homo sapiens
ttcaagctgagaaaa

SEQ ID NO: 1150561 - DNA, 24 bp, Homo sapiens
ttcaagctgagaaaagtattctca

SEQ ID NO: 1150562 - DNA, 11 bp, Homo sapiens
ttcaagctttc

SEQ ID NO: 1150563 - DNA, 16 bp, Homo sapiens
ttcaaggaagaaaacg

SEQ ID NO: 1150564 - DNA, 19 bp, Homo sapiens
ttcaaggaatttcttaact

SEQ ID NO: 1150565 - DNA, 17 bp, Homo sapiens
ttcaaggactgtttcag

SEQ ID NO: 1150566 - DNA, 21 bp, Homo sapiens
ttcaaggatatactgcagctt

SEQ ID NO: 1150567 - DNA, 14 bp, Homo sapiens
ttcaaggcatttat

SEQ ID NO: 1150568 - DNA, 16 bp, Homo sapiens
ttcaaggcatttgtct

SEQ ID NO: 1150569 - DNA, 10 bp, Homo sapiens
ttcaaggcct

SEQ ID NO: 1150570 - DNA, 12 bp, Homo sapiens
ttcaaggcctcc

SEQ ID NO: 1150571 - DNA, 13 bp, Homo sapiens
ttcaaggcctccc

SEQ ID NO: 1150572 - DNA, 12 bp, Homo sapiens
ttcaaggccttc

SEQ ID NO: 1150573 - DNA, 19 bp, Homo sapiens
ttcaagggttgcttctgag

SEQ ID NO: 1150574 - DNA, 22 bp, Homo sapiens
ttcaaggtcactgtttcctggg

SEQ ID NO: 1150575 - DNA, 18 bp, Homo sapiens
ttcaaggtggccaaatta

SEQ ID NO: 1150576 - DNA, 22 bp, Homo sapiens
ttcaaggtggccaaattatttg

SEQ ID NO: 1150577 - DNA, 16 bp, Homo sapiens
ttcaaggttttaaaac

SEQ ID NO: 1150578 - DNA, 17 bp, Homo sapiens
ttcaagtgactctcctg

SEQ ID NO: 1150579 - DNA, 21 bp, Homo sapiens
ttcaagtgactctcctgcctc

SEQ ID NO: 1150580 - DNA, 22 bp, Homo sapiens
ttcaagtgcatgctctctgcag

SEQ ID NO: 1150581 - DNA, 18 bp, Homo sapiens
ttcaagtggggctcgcca

SEQ ID NO: 1150582 - DNA, 17 bp, Homo sapiens
ttcaagttattcaaatt

SEQ ID NO: 1150583 - DNA, 15 bp, Homo sapiens
ttcaagtttacactt

SEQ ID NO: 1150584 - DNA, 14 bp, Homo sapiens
ttcaagttttaaag

SEQ ID NO: 1150585 - DNA, 15 bp, Homo sapiens
ttcaagttttaaagt

SEQ ID NO: 1150586 - DNA, 18 bp, Homo sapiens
ttcaataaagcatttata

SEQ ID NO: 1150587 - DNA, 16 bp, Homo sapiens
ttcaataaagtttgta

SEQ ID NO: 1150588 - DNA, 17 bp, Homo sapiens
ttcaataacaaagcaca

SEQ ID NO: 1150589 - DNA, 21 bp, Homo sapiens
ttcaatacagtgaaggtcttt

SEQ ID NO: 1150590 - DNA, 23 bp, Homo sapiens
ttcaatactcttgaaatgtagaa

SEQ ID NO: 1150591 - DNA, 22 bp, Homo sapiens
ttcaatactgtatgccttctgt

SEQ ID NO: 1150592 - DNA, 14 bp, Homo sapiens
ttcaatagccacta

SEQ ID NO: 1150593 - DNA, 17 bp, Homo sapiens
ttcaatagccactaacc

SEQ ID NO: 1150594 - DNA, 17 bp, Homo sapiens
ttcaatataagaagcaa

SEQ ID NO: 1150595 - DNA, 22 bp, Homo sapiens
ttcaatatgaatctataagtag

SEQ ID NO: 1150596 - DNA, 19 bp, Homo sapiens
ttcaatattatgaattcac

SEQ ID NO: 1150597 - DNA, 15 bp, Homo sapiens
ttcaatattgacatt

SEQ ID NO: 1150598 - DNA, 16 bp, Homo sapiens
ttcaatattgacattt

SEQ ID NO: 1150599 - DNA, 17 bp, Homo sapiens
ttcaatattgacatttg

SEQ ID NO: 1150600 - DNA, 18 bp, Homo sapiens
ttcaatattgacatttgt

SEQ ID NO: 1150601 - DNA, 20 bp, Homo sapiens
ttcaatatttagaaaatttt

SEQ ID NO: 1150602 - DNA, 16 bp, Homo sapiens
ttcaatattttctttt

SEQ ID NO: 1150603 - DNA, 18 bp, Homo sapiens
ttcaatcaactttactgt

SEQ ID NO: 1150604 - DNA, 17 bp, Homo sapiens
ttcaatcattgaagtat

SEQ ID NO: 1150605 - DNA, 15 bp, Homo sapiens
taattgattaaaatc

SEQ ID NO: 1150606 - DNA, 21 bp, Homo sapiens
taattgcaaaaacatagaaat

SEQ ID NO: 1150607 - DNA, 19 bp, Homo sapiens
taattgcacatttttttct

SEQ ID NO: 1150608 - DNA, 20 bp, Homo sapiens
taattgccagcaaataaata

SEQ ID NO: 1150609 - DNA, 14 bp, Homo sapiens
taattgcctttgag

SEQ ID NO: 1150610 - DNA, 21 bp, Homo sapiens
taattgcgtagaggctacagg

SEQ ID NO: 1150611 - DNA, 16 bp, Homo sapiens
taattggaagtgcagt

SEQ ID NO: 1150612 - DNA, 16 bp, Homo sapiens
taattggatttcctaa

SEQ ID NO: 1150613 - DNA, 17 bp, Homo sapiens
taattggatttcctaat

SEQ ID NO: 1150614 - DNA, 23 bp, Homo sapiens
taattggatttcctaatactgtc

SEQ ID NO: 1150615 - DNA, 21 bp, Homo sapiens
taattgggccagcttttcaaa

SEQ ID NO: 1150616 - DNA, 18 bp, Homo sapiens
taattgtaaatattttga

SEQ ID NO: 1150617 - DNA, 19 bp, Homo sapiens
taattgtaaatattttgat

SEQ ID NO: 1150618 - DNA, 18 bp, Homo sapiens
taattgtaagtgaaatta

SEQ ID NO: 1150619 - DNA, 15 bp, Homo sapiens
taattgtactaatct

SEQ ID NO: 1150620 - DNA, 13 bp, Homo sapiens
taattgtagttct

SEQ ID NO: 1150621 - DNA, 23 bp, Homo sapiens
taattgtataagtcaagcacatg

SEQ ID NO: 1150622 - DNA, 23 bp, Homo sapiens
taattgtgaataaaaattgatga

SEQ ID NO: 1150623 - DNA, 21 bp, Homo sapiens
taattgtgtaaaaaatggaaa

SEQ ID NO: 1150624 - DNA, 22 bp, Homo sapiens
taattgtgtaaaaaatggaaaa

SEQ ID NO: 1150625 - DNA, 17 bp, Homo sapiens
taattgtgtattttctt

SEQ ID NO: 1150626 - DNA, 15 bp, Homo sapiens
taattgttgatattt

SEQ ID NO: 1150627 - DNA, 18 bp, Homo sapiens
taattgttgattaatttg

SEQ ID NO: 1150628 - DNA, 16 bp, Homo sapiens
taattgttgttctgtt

SEQ ID NO: 1150629 - DNA, 17 bp, Homo sapiens
taattgttgttctgtta

SEQ ID NO: 1150630 - DNA, 15 bp, Homo sapiens
taattgttgtttgta

SEQ ID NO: 1150631 - DNA, 19 bp, Homo sapiens
taattgttgtttgtatgta

SEQ ID NO: 1150632 - DNA, 12 bp, Homo sapiens
taattgtttaaa

SEQ ID NO: 1150633 - DNA, 13 bp, Homo sapiens
taattgtttataa

SEQ ID NO: 1150634 - DNA, 21 bp, Homo sapiens
taattgtttccaacttgtctg

SEQ ID NO: 1150635 - DNA, 21 bp, Homo sapiens
taatttaaaaaagcaaatgga

SEQ ID NO: 1150636 - DNA, 22 bp, Homo sapiens
taatttaaaaaagcaaatggaa

SEQ ID NO: 1150637 - DNA, 22 bp, Homo sapiens
taatttaaaaagtgctatacta

SEQ ID NO: 1150638 - DNA, 22 bp, Homo sapiens
taatttaaaaatatatttataa

SEQ ID NO: 1150639 - DNA, 20 bp, Homo sapiens
taatttaaaaatctccatta

SEQ ID NO: 1150640 - DNA, 11 bp, Homo sapiens
taatttaaaca

SEQ ID NO: 1150641 - DNA, 17 bp, Homo sapiens
taatttaaacacctcct

SEQ ID NO: 1150642 - DNA, 14 bp, Homo sapiens
taatttaaagagac

SEQ ID NO: 1150643 - DNA, 16 bp, Homo sapiens
taatttaaatgatatt

SEQ ID NO: 1150644 - DNA, 18 bp, Homo sapiens
taatttaaatgatttaaa

SEQ ID NO: 1150645 - DNA, 17 bp, Homo sapiens
taatttaataaaaagga

SEQ ID NO: 1150646 - DNA, 18 bp, Homo sapiens
taatttaataaaaaggaa

SEQ ID NO: 1150647 - DNA, 11 bp, Homo sapiens
taatttaatgg

SEQ ID NO: 1150648 - DNA, 13 bp, Homo sapiens
taatttaatgggg

SEQ ID NO: 1150649 - DNA, 16 bp, Homo sapiens
taatttaattgctttg

SEQ ID NO: 1150650 - DNA, 17 bp, Homo sapiens
taatttaattgctttga

SEQ ID NO: 1150651 - DNA, 18 bp, Homo sapiens
taatttaattgctttgaa

SEQ ID NO: 1150652 - DNA, 21 bp, Homo sapiens
taatttacctaagattacaaa

SEQ ID NO: 1150653 - DNA, 22 bp, Homo sapiens
taatttacctaagattacaaat

SEQ ID NO: 1150654 - DNA, 14 bp, Homo sapiens
taatttactttctg

SEQ ID NO: 1150655 - DNA, 14 bp, Homo sapiens
taatttagaaaact

SEQ ID NO: 1150656 - DNA, 21 bp, Homo sapiens
taatttagaaaactttaaagc

SEQ ID NO: 1150657 - DNA, 19 bp, Homo sapiens
taatttagaaactgatttc

SEQ ID NO: 1150658 - DNA, 14 bp, Homo sapiens
taatttagaaatca

SEQ ID NO: 1150659 - DNA, 15 bp, Homo sapiens
taatttagaagatat

SEQ ID NO: 1150660 - DNA, 21 bp, Homo sapiens
taatttagaagatattatttg

SEQ ID NO: 1150661 - DNA, 15 bp, Homo sapiens
taatttagttattga

SEQ ID NO: 1150662 - DNA, 14 bp, Homo sapiens
taatttataaagaa

SEQ ID NO: 1150663 - DNA, 14 bp, Homo sapiens
taatttataatgta

SEQ ID NO: 1150664 - DNA, 16 bp, Homo sapiens
taatttataatgtatt

SEQ ID NO: 1150665 - DNA, 18 bp, Homo sapiens
taatttataatgtatttg

SEQ ID NO: 1150666 - DNA, 20 bp, Homo sapiens
taatttatactttaaagtat

SEQ ID NO: 1150667 - DNA, 14 bp, Homo sapiens
ttcacatttagaaa

SEQ ID NO: 1150668 - DNA, 18 bp, Homo sapiens
ttcacatttgatgtacat

SEQ ID NO: 1150669 - DNA, 15 bp, Homo sapiens
ttcaccaaaaccaaa

SEQ ID NO: 1150670 - DNA, 19 bp, Homo sapiens
ttcaccactcctctccctt

SEQ ID NO: 1150671 - DNA, 19 bp, Homo sapiens
ttcaccagaatggaaagac

SEQ ID NO: 1150672 - DNA, 16 bp, Homo sapiens
ttcaccagtctgtcta

SEQ ID NO: 1150673 - DNA, 14 bp, Homo sapiens
ttcaccagtgttcc

SEQ ID NO: 1150674 - DNA, 18 bp, Homo sapiens
ttcaccagtgttcctgaa

SEQ ID NO: 1150675 - DNA, 16 bp, Homo sapiens
ttcaccatggccccct

SEQ ID NO: 1150676 - DNA, 24 bp, Homo sapiens
ttcaccatttggcaatgccatcat

SEQ ID NO: 1150677 - DNA, 20 bp, Homo sapiens
ttcaccccatccctccttaa

SEQ ID NO: 1150678 - DNA, 23 bp, Homo sapiens
ttcaccccatccctccttaagag

SEQ ID NO: 1150679 - DNA, 14 bp, Homo sapiens
ttcacccccaactt

SEQ ID NO: 1150680 - DNA, 17 bp, Homo sapiens
ttcaccccccactcacc

SEQ ID NO: 1150681 - DNA, 19 bp, Homo sapiens
ttcaccccctttcctggac

SEQ ID NO: 1150682 - DNA, 13 bp, Homo sapiens
ttcacccctgcac

SEQ ID NO: 1150683 - DNA, 17 bp, Homo sapiens
ttcaccctccacttccc

SEQ ID NO: 1150684 - DNA, 18 bp, Homo sapiens
ttcacccttaacccaagg

SEQ ID NO: 1150685 - DNA, 21 bp, Homo sapiens
ttcacctaagtctctgtgaat

SEQ ID NO: 1150686 - DNA, 19 bp, Homo sapiens
ttcacctcactgaaaacat

SEQ ID NO: 1150687 - DNA, 17 bp, Homo sapiens
ttcacctcagcctggag

SEQ ID NO: 1150688 - DNA, 23 bp, Homo sapiens
ttcacctcggagggatggagaaa

SEQ ID NO: 1150689 - DNA, 13 bp, Homo sapiens
ttcacctcttcca

SEQ ID NO: 1150690 - DNA, 17 bp, Homo sapiens
ttcacctcttcctctgg

SEQ ID NO: 1150691 - DNA, 18 bp, Homo sapiens
ttcacctgtaaacctgag

SEQ ID NO: 1150692 - DNA, 12 bp, Homo sapiens
ttcacctgttat

SEQ ID NO: 1150693 - DNA, 21 bp, Homo sapiens
ttcacctgtttttaagctgtt

SEQ ID NO: 1150694 - DNA, 23 bp, Homo sapiens
ttcacctgtttttaagctgtttc

SEQ ID NO: 1150695 - DNA, 14 bp, Homo sapiens
ttcaccttgaagaa

SEQ ID NO: 1150696 - DNA, 19 bp, Homo sapiens
ttcacctttggtgcagagg

SEQ ID NO: 1150697 - DNA, 22 bp, Homo sapiens
ttcacctttggtgcagaggttt

SEQ ID NO: 1150698 - DNA, 23 bp, Homo sapiens
ttcacctttgtaagacatttgta

SEQ ID NO: 1150699 - DNA, 13 bp, Homo sapiens
ttcacgaactgtt

SEQ ID NO: 1150700 - DNA, 15 bp, Homo sapiens
ttcacgaactgttca

SEQ ID NO: 1150701 - DNA, 17 bp, Homo sapiens
ttcacgaagtgttgcat

SEQ ID NO: 1150702 - DNA, 19 bp, Homo sapiens
ttcacgcctgaggcaatta

SEQ ID NO: 1150703 - DNA, 22 bp, Homo sapiens
ttcacggaagttttcaatgatg

SEQ ID NO: 1150704 - DNA, 20 bp, Homo sapiens
ttcacggtgacacaggtcag

SEQ ID NO: 1150705 - DNA, 22 bp, Homo sapiens
ttcacgtcttggtgccttttgt

SEQ ID NO: 1150706 - DNA, 15 bp, Homo sapiens
ttcactaaatgtaaa

SEQ ID NO: 1150707 - DNA, 23 bp, Homo sapiens
ttcactacccatcggtgtccatt

SEQ ID NO: 1150708 - DNA, 14 bp, Homo sapiens
ttcactagggctga

SEQ ID NO: 1150709 - DNA, 23 bp, Homo sapiens
ttcactagtgaccccttccctgt

SEQ ID NO: 1150710 - DNA, 14 bp, Homo sapiens
ttcactattcctat

SEQ ID NO: 1150711 - DNA, 19 bp, Homo sapiens
ttcactatttcctttataa

SEQ ID NO: 1150712 - DNA, 16 bp, Homo sapiens
ttcactcactctaaag

SEQ ID NO: 1150713 - DNA, 14 bp, Homo sapiens
ttcactcattgaca

SEQ ID NO: 1150714 - DNA, 23 bp, Homo sapiens
ttcactccggtgtgcctgcagcc

SEQ ID NO: 1150715 - DNA, 21 bp, Homo sapiens
ttcactcctgcttctctcagc

SEQ ID NO: 1150716 - DNA, 18 bp, Homo sapiens
ttcactctaagtcatgta

SEQ ID NO: 1150717 - DNA, 13 bp, Homo sapiens
ttcactctctgaa

SEQ ID NO: 1150718 - DNA, 18 bp, Homo sapiens
ttcactgaaatgtttgga

SEQ ID NO: 1150719 - DNA, 12 bp, Homo sapiens
ttcactgagctc

SEQ ID NO: 1150720 - DNA, 21 bp, Homo sapiens
ttcactgagctccccagatct

SEQ ID NO: 1150721 - DNA, 15 bp, Homo sapiens
ttcactgcaattttg

SEQ ID NO: 1150722 - DNA, 20 bp, Homo sapiens
ttcactgccatgatagctgg

SEQ ID NO: 1150723 - DNA, 24 bp, Homo sapiens
ttcactgccatgatagctggggct

SEQ ID NO: 1150724 - DNA, 17 bp, Homo sapiens
ttcactgcctgtagaga

SEQ ID NO: 1150725 - DNA, 13 bp, Homo sapiens
ttcactgccttcc

SEQ ID NO: 1150726 - DNA, 13 bp, Homo sapiens
taattttaaattc

SEQ ID NO: 1150727 - DNA, 23 bp, Homo sapiens
taattttaacaaacgcattaaga

SEQ ID NO: 1150728 - DNA, 22 bp, Homo sapiens
taattttaaccaaaacatgtct

SEQ ID NO: 1150729 - DNA, 15 bp, Homo sapiens
taattttacacatta

SEQ ID NO: 1150730 - DNA, 18 bp, Homo sapiens
taattttacacgcttttg

SEQ ID NO: 1150731 - DNA, 16 bp, Homo sapiens
taattttagtttttca

SEQ ID NO: 1150732 - DNA, 19 bp, Homo sapiens
taattttagtttttcatta

SEQ ID NO: 1150733 - DNA, 23 bp, Homo sapiens
taattttatggtggaaaagaact

SEQ ID NO: 1150734 - DNA, 17 bp, Homo sapiens
taattttattgcaaagt

SEQ ID NO: 1150735 - DNA, 16 bp, Homo sapiens
taattttcaccgagca

SEQ ID NO: 1150736 - DNA, 16 bp, Homo sapiens
taattttcacttctgt

SEQ ID NO: 1150737 - DNA, 10 bp, Homo sapiens
taattttcta

SEQ ID NO: 1150738 - DNA, 13 bp, Homo sapiens
taattttctaaga

SEQ ID NO: 1150739 - DNA, 22 bp, Homo sapiens
taattttctctttgtatgtctg

SEQ ID NO: 1150740 - DNA, 14 bp, Homo sapiens
taattttcttcatg

SEQ ID NO: 1150741 - DNA, 14 bp, Homo sapiens
taattttctttatg

SEQ ID NO: 1150742 - DNA, 18 bp, Homo sapiens
taattttgaagtgctgtt

SEQ ID NO: 1150743 - DNA, 22 bp, Homo sapiens
taattttgaagtgctgtttatt

SEQ ID NO: 1150744 - DNA, 20 bp, Homo sapiens
taattttgacactgaaataa

SEQ ID NO: 1150745 - DNA, 19 bp, Homo sapiens
taattttgatatacattgt

SEQ ID NO: 1150746 - DNA, 21 bp, Homo sapiens
taattttgatatacattgtgt

SEQ ID NO: 1150747 - DNA, 15 bp, Homo sapiens
taattttgcctttaa

SEQ ID NO: 1150748 - DNA, 19 bp, Homo sapiens
taattttggaataatttct

SEQ ID NO: 1150749 - DNA, 12 bp, Homo sapiens
taattttgtaat

SEQ ID NO: 1150750 - DNA, 16 bp, Homo sapiens
taattttgtgcattct

SEQ ID NO: 1150751 - DNA, 18 bp, Homo sapiens
taattttgtgcattcttt

SEQ ID NO: 1150752 - DNA, 22 bp, Homo sapiens
taattttgtgcattctttggta

SEQ ID NO: 1150753 - DNA, 13 bp, Homo sapiens
taatttttaaagt

SEQ ID NO: 1150754 - DNA, 13 bp, Homo sapiens
taatttttaactt

SEQ ID NO: 1150755 - DNA, 16 bp, Homo sapiens
taatttttaagagcat

SEQ ID NO: 1150756 - DNA, 16 bp, Homo sapiens
taatttttcctatatt

SEQ ID NO: 1150757 - DNA, 17 bp, Homo sapiens
taatttttcctgcatgt

SEQ ID NO: 1150758 - DNA, 21 bp, Homo sapiens
taatttttgatactaagcatt

SEQ ID NO: 1150759 - DNA, 14 bp, Homo sapiens
taatttttgtaatt

SEQ ID NO: 1150760 - DNA, 13 bp, Homo sapiens
taatttttgtaca

SEQ ID NO: 1150761 - DNA, 14 bp, Homo sapiens
taatttttgtacat

SEQ ID NO: 1150762 - DNA, 19 bp, Homo sapiens
taattttttagagagctgt

SEQ ID NO: 1150763 - DNA, 13 bp, Homo sapiens
taattttttctta

SEQ ID NO: 1150764 - DNA, 21 bp, Homo sapiens
taatttttttaaccaaaggtg

SEQ ID NO: 1150765 - DNA, 21 bp, Homo sapiens
taatttttttcacctagattt

SEQ ID NO: 1150766 - DNA, 17 bp, Homo sapiens
taattttttttaaaata

SEQ ID NO: 1150767 - DNA, 19 bp, Homo sapiens
taattttttttgttttttg

SEQ ID NO: 1150768 - DNA, 21 bp, Homo sapiens
taattttttttgttttttgta

SEQ ID NO: 1150769 - DNA, 15 bp, Homo sapiens
tacaaaaaaacacgt

SEQ ID NO: 1150770 - DNA, 13 bp, Homo sapiens
tacaaaaacactt

SEQ ID NO: 1150771 - DNA, 23 bp, Homo sapiens
tacaaaaacacttcgttcgcaga

SEQ ID NO: 1150772 - DNA, 18 bp, Homo sapiens
tacaaaaacatacttcaa

SEQ ID NO: 1150773 - DNA, 20 bp, Homo sapiens
tacaaaaacatacttcaaaa

SEQ ID NO: 1150774 - DNA, 13 bp, Homo sapiens
tacaaaaagaaaa

SEQ ID NO: 1150775 - DNA, 19 bp, Homo sapiens
tacaaaaagtaaaaattaa

SEQ ID NO: 1150776 - DNA, 17 bp, Homo sapiens
tacaaaaataaatttat

SEQ ID NO: 1150777 - DNA, 22 bp, Homo sapiens
tacaaaacaaactcattcatta

SEQ ID NO: 1150778 - DNA, 11 bp, Homo sapiens
tacaaaacaat

SEQ ID NO: 1150779 - DNA, 19 bp, Homo sapiens
tacaaaacctcaaaccagt

SEQ ID NO: 1150780 - DNA, 15 bp, Homo sapiens
tacaaaagcatgtga

SEQ ID NO: 1150781 - DNA, 19 bp, Homo sapiens
tacaaaataaacaaataac

SEQ ID NO: 1150782 - DNA, 22 bp, Homo sapiens
tacaaaatacagggattactgg

SEQ ID NO: 1150783 - DNA, 16 bp, Homo sapiens
tacaaaatatttaagt

SEQ ID NO: 1150784 - DNA, 21 bp, Homo sapiens
tacaaaatcctggaagatttt

SEQ ID NO: 1150785 - DNA, 19 bp, Homo sapiens
tacaaaatttgaaatttag

SEQ ID NO: 1150786 - DNA, 15 bp, Homo sapiens
tacaaaccaggtcac

SEQ ID NO: 1150787 - DNA, 23 bp, Homo sapiens
tacaaaccaggtcaccatcctca

SEQ ID NO: 1150788 - DNA, 19 bp, Homo sapiens
tacaaaccattacctgtac

SEQ ID NO: 1150789 - DNA, 13 bp, Homo sapiens
tacaaactctcac

SEQ ID NO: 1150790 - DNA, 11 bp, Homo sapiens
tacaaactgca

SEQ ID NO: 1150791 - DNA, 16 bp, Homo sapiens
tacaaactggtattct

SEQ ID NO: 1150792 - DNA, 15 bp, Homo sapiens
tacaaagctttgcta

SEQ ID NO: 1150793 - DNA, 17 bp, Homo sapiens
ttcagacacaggaaaaa

SEQ ID NO: 1150794 - DNA, 20 bp, Homo sapiens
ttcagacacaggaaaaataa

SEQ ID NO: 1150795 - DNA, 22 bp, Homo sapiens
ttcagacacaggaaaaataaac

SEQ ID NO: 1150796 - DNA, 17 bp, Homo sapiens
ttcagacagggtctgaa

SEQ ID NO: 1150797 - DNA, 12 bp, Homo sapiens
ttcagacatatc

SEQ ID NO: 1150798 - DNA, 14 bp, Homo sapiens
ttcagacccagaga

SEQ ID NO: 1150799 - DNA, 15 bp, Homo sapiens
ttcagacccctgcct

SEQ ID NO: 1150800 - DNA, 23 bp, Homo sapiens
ttcagacctgacaccgtccctca

SEQ ID NO: 1150801 - DNA, 17 bp, Homo sapiens
ttcagagaattactatt

SEQ ID NO: 1150802 - DNA, 21 bp, Homo sapiens
ttcagagactcagggccccag

SEQ ID NO: 1150803 - DNA, 14 bp, Homo sapiens
ttcagagagctggt

SEQ ID NO: 1150804 - DNA, 15 bp, Homo sapiens
ttcagagaggccttt

SEQ ID NO: 1150805 - DNA, 16 bp, Homo sapiens
ttcagagcaagttcct

SEQ ID NO: 1150806 - DNA, 16 bp, Homo sapiens
ttcagagcaggaggcc

SEQ ID NO: 1150807 - DNA, 13 bp, Homo sapiens
ttcagagccagtg

SEQ ID NO: 1150808 - DNA, 22 bp, Homo sapiens
ttcagaggccctcgctgccagc

SEQ ID NO: 1150809 - DNA, 23 bp, Homo sapiens
ttcagaggccctcgctgccagct

SEQ ID NO: 1150810 - DNA, 12 bp, Homo sapiens
ttcagaggctca

SEQ ID NO: 1150811 - DNA, 13 bp, Homo sapiens
ttcagaggctcag

SEQ ID NO: 1150812 - DNA, 16 bp, Homo sapiens
ttcagaggctgaggtg

SEQ ID NO: 1150813 - DNA, 21 bp, Homo sapiens
ttcagagtttgtcatatactg

SEQ ID NO: 1150814 - DNA, 14 bp, Homo sapiens
ttcagagtttgtgt

SEQ ID NO: 1150815 - DNA, 12 bp, Homo sapiens
ttcagatacatg

SEQ ID NO: 1150816 - DNA, 16 bp, Homo sapiens
ttcagatatatttttc

SEQ ID NO: 1150817 - DNA, 16 bp, Homo sapiens
ttcagatatcaaaatt

SEQ ID NO: 1150818 - DNA, 22 bp, Homo sapiens
ttcagatatcttggacaaatca

SEQ ID NO: 1150819 - DNA, 19 bp, Homo sapiens
ttcagatcaaaatgccttt

SEQ ID NO: 1150820 - DNA, 13 bp, Homo sapiens
ttcagatcttaat

SEQ ID NO: 1150821 - DNA, 11 bp, Homo sapiens
ttcagatgagg

SEQ ID NO: 1150822 - DNA, 15 bp, Homo sapiens
ttcagatgtaatgtt

SEQ ID NO: 1150823 - DNA, 16 bp, Homo sapiens
ttcagatgtaatgttt

SEQ ID NO: 1150824 - DNA, 23 bp, Homo sapiens
ttcagatgtcttctgcctgttat

SEQ ID NO: 1150825 - DNA, 16 bp, Homo sapiens
ttcagatgtgcaataa

SEQ ID NO: 1150826 - DNA, 23 bp, Homo sapiens
ttcagatgtgcatttcacctgtg

SEQ ID NO: 1150827 - DNA, 14 bp, Homo sapiens
ttcagattgtcttg

SEQ ID NO: 1150828 - DNA, 20 bp, Homo sapiens
ttcagattgtggaatgttgg

SEQ ID NO: 1150829 - DNA, 13 bp, Homo sapiens
ttcagcaccccca

SEQ ID NO: 1150830 - DNA, 15 bp, Homo sapiens
ttcagcacccccacc

SEQ ID NO: 1150831 - DNA, 21 bp, Homo sapiens
ttcagcacccccacccacctc

SEQ ID NO: 1150832 - DNA, 22 bp, Homo sapiens
ttcagcaccctgggtgccattc

SEQ ID NO: 1150833 - DNA, 23 bp, Homo sapiens
ttcagcaccctgggtgccattcc

SEQ ID NO: 1150834 - DNA, 14 bp, Homo sapiens
ttcagcactgtccc

SEQ ID NO: 1150835 - DNA, 23 bp, Homo sapiens
ttcagcatgggtccttgatgcca

SEQ ID NO: 1150836 - DNA, 14 bp, Homo sapiens
ttcagccaatttgt

SEQ ID NO: 1150837 - DNA, 18 bp, Homo sapiens
ttcagccaatttgtctcc

SEQ ID NO: 1150838 - DNA, 22 bp, Homo sapiens
ttcagccatgataagaacagag

SEQ ID NO: 1150839 - DNA, 20 bp, Homo sapiens
ttcagcccatatttcatcgt

SEQ ID NO: 1150840 - DNA, 13 bp, Homo sapiens
ttcagcccctcct

SEQ ID NO: 1150841 - DNA, 18 bp, Homo sapiens
ttcagcccctcctctgcc

SEQ ID NO: 1150842 - DNA, 19 bp, Homo sapiens
ttcagcccctcctctgcca

SEQ ID NO: 1150843 - DNA, 16 bp, Homo sapiens
ttcagccctggcccct

SEQ ID NO: 1150844 - DNA, 12 bp, Homo sapiens
ttcagccctttg

SEQ ID NO: 1150845 - DNA, 14 bp, Homo sapiens
ttcagcctccctca

SEQ ID NO: 1150846 - DNA, 17 bp, Homo sapiens
ttcagccttcgtgtggc

SEQ ID NO: 1150847 - DNA, 20 bp, Homo sapiens
ttcagccttctttttctgga

SEQ ID NO: 1150848 - DNA, 15 bp, Homo sapiens
tgtgacaaaaaatta

SEQ ID NO: 1150849 - DNA, 21 bp, Homo sapiens
tgtgacaaaaaattaaagcat

SEQ ID NO: 1150850 - DNA, 18 bp, Homo sapiens
tgtgacaaaggatgaaga

SEQ ID NO: 1150851 - DNA, 18 bp, Homo sapiens
tgtgacaaccctggcctc

SEQ ID NO: 1150852 - DNA, 13 bp, Homo sapiens
tgtgacaaggcta

SEQ ID NO: 1150853 - DNA, 19 bp, Homo sapiens
tgtgacaataagtttgaac

SEQ ID NO: 1150854 - DNA, 14 bp, Homo sapiens
tgtgacaataataa

SEQ ID NO: 1150855 - DNA, 22 bp, Homo sapiens
tgtgacaatagggctaaatgtt

SEQ ID NO: 1150856 - DNA, 19 bp, Homo sapiens
tgtgacaattttgtacaaa

SEQ ID NO: 1150857 - DNA, 14 bp, Homo sapiens
tgtgacactgatga

SEQ ID NO: 1150858 - DNA, 19 bp, Homo sapiens
tgtgacaggaaagccctcc

SEQ ID NO: 1150859 - DNA, 12 bp, Homo sapiens
tgtgacagggcc

SEQ ID NO: 1150860 - DNA, 13 bp, Homo sapiens
tgtgacagggcca

SEQ ID NO: 1150861 - DNA, 15 bp, Homo sapiens
tgtgacagggccagt

SEQ ID NO: 1150862 - DNA, 23 bp, Homo sapiens
tgtgacagggccagtggggcctg

SEQ ID NO: 1150863 - DNA, 22 bp, Homo sapiens
tgtgacagtgaaatacatcctt

SEQ ID NO: 1150864 - DNA, 13 bp, Homo sapiens
tgtgacagtgcct

SEQ ID NO: 1150865 - DNA, 17 bp, Homo sapiens
tgtgacagtttccaaat

SEQ ID NO: 1150866 - DNA, 21 bp, Homo sapiens
tgtgacagtttccaaattgcc

SEQ ID NO: 1150867 - DNA, 20 bp, Homo sapiens
tgtgacattccatgacgaca

SEQ ID NO: 1150868 - DNA, 14 bp, Homo sapiens
tgtgacattccttc

SEQ ID NO: 1150869 - DNA, 17 bp, Homo sapiens
tgtgacatttatatatt

SEQ ID NO: 1150870 - DNA, 17 bp, Homo sapiens
tgtgacattttacatta

SEQ ID NO: 1150871 - DNA, 17 bp, Homo sapiens
tgtgaccaaaagttaca

SEQ ID NO: 1150872 - DNA, 18 bp, Homo sapiens
tgtgaccaaaataccttg

SEQ ID NO: 1150873 - DNA, 13 bp, Homo sapiens
tgtgaccaactgt

SEQ ID NO: 1150874 - DNA, 16 bp, Homo sapiens
tgtgaccaactgtgtt

SEQ ID NO: 1150875 - DNA, 21 bp, Homo sapiens
tgtgaccacatacgtgttagg

SEQ ID NO: 1150876 - DNA, 13 bp, Homo sapiens
tgtgaccaccacc

SEQ ID NO: 1150877 - DNA, 17 bp, Homo sapiens
tgtgaccagcactgtct

SEQ ID NO: 1150878 - DNA, 13 bp, Homo sapiens
tgtgaccagcgga

SEQ ID NO: 1150879 - DNA, 15 bp, Homo sapiens
tgtgaccaggggtga

SEQ ID NO: 1150880 - DNA, 16 bp, Homo sapiens
tgtgaccatgttcatt

SEQ ID NO: 1150881 - DNA, 20 bp, Homo sapiens
tgtgacccccagctccggcc

SEQ ID NO: 1150882 - DNA, 18 bp, Homo sapiens
tgtgacctgatttcagaa

SEQ ID NO: 1150883 - DNA, 16 bp, Homo sapiens
tgtgaccttgggacca

SEQ ID NO: 1150884 - DNA, 17 bp, Homo sapiens
tgtgacctttaattcag

SEQ ID NO: 1150885 - DNA, 16 bp, Homo sapiens
tgtgacgcgcaagtct

SEQ ID NO: 1150886 - DNA, 15 bp, Homo sapiens
tgtgacgtgcactgt

SEQ ID NO: 1150887 - DNA, 19 bp, Homo sapiens
tgtgactaactatgcaata

SEQ ID NO: 1150888 - DNA, 17 bp, Homo sapiens
tgtgactaggcatacac

SEQ ID NO: 1150889 - DNA, 22 bp, Homo sapiens
tgtgactatatagagatgtttt

SEQ ID NO: 1150890 - DNA, 16 bp, Homo sapiens
tgtgactcagcagagg

SEQ ID NO: 1150891 - DNA, 16 bp, Homo sapiens
tgtgactcgggagctg

SEQ ID NO: 1150892 - DNA, 17 bp, Homo sapiens
tgtgactcgggagctgc

SEQ ID NO: 1150893 - DNA, 18 bp, Homo sapiens
tgtgactcgggagctgca

SEQ ID NO: 1150894 - DNA, 13 bp, Homo sapiens
tgtgactctgggc

SEQ ID NO: 1150895 - DNA, 15 bp, Homo sapiens
tgtgactctgggcag

SEQ ID NO: 1150896 - DNA, 17 bp, Homo sapiens
tgtgactctgggcaggg

SEQ ID NO: 1150897 - DNA, 22 bp, Homo sapiens
tgtgactctttcctaaagccaa

SEQ ID NO: 1150898 - DNA, 13 bp, Homo sapiens
tgtgactgaaggg

SEQ ID NO: 1150899 - DNA, 20 bp, Homo sapiens
tgtgactgaaggggcacacc

SEQ ID NO: 1150900 - DNA, 19 bp, Homo sapiens
tgtgacttcactgtatata

SEQ ID NO: 1150901 - DNA, 18 bp, Homo sapiens
tgtgacttcagctctgtt

SEQ ID NO: 1150902 - DNA, 20 bp, Homo sapiens
tgtgacttctcccctgccct

SEQ ID NO: 1150903 - DNA, 16 bp, Homo sapiens
tgtgacttttctgatt

SEQ ID NO: 1150904 - DNA, 15 bp, Homo sapiens
tgtgagaaatgtcta

SEQ ID NO: 1150905 - DNA, 16 bp, Homo sapiens
tgtgagaggtttgact

SEQ ID NO: 1150906 - DNA, 14 bp, Homo sapiens
tgtgagagttgtct

SEQ ID NO: 1150907 - DNA, 22 bp, Homo sapiens
tgtgagatccttcacaggcagt

SEQ ID NO: 1150908 - DNA, 14 bp, Homo sapiens
tgtgagatgtaatt

SEQ ID NO: 1150909 - DNA, 13 bp, Homo sapiens
tgtgagatgtgta

SEQ ID NO: 1150910 - DNA, 14 bp, Homo sapiens
tgtgagcacatgcg

SEQ ID NO: 1150911 - DNA, 14 bp, Homo sapiens
tgtgagcagggctg

SEQ ID NO: 1150912 - DNA, 19 bp, Homo sapiens
tgtgagccacagtgcctgg

SEQ ID NO: 1150913 - DNA, 21 bp, Homo sapiens
tgtgagccaccgtgcctggcc

SEQ ID NO: 1150914 - DNA, 22 bp, Homo sapiens
tgtgagcccctggtcctgaggg

SEQ ID NO: 1150915 - DNA, 15 bp, Homo sapiens
tgtgagcctctttgt

SEQ ID NO: 1150916 - DNA, 15 bp, Homo sapiens
tgtgagcgagcaagc

SEQ ID NO: 1150917 - DNA, 20 bp, Homo sapiens
tgtgagctctggttattttt

SEQ ID NO: 1150918 - DNA, 18 bp, Homo sapiens
tgtgagctgtaaaaatgt

SEQ ID NO: 1150919 - DNA, 13 bp, Homo sapiens
tgtgagctttgaa

SEQ ID NO: 1150920 - DNA, 18 bp, Homo sapiens
tgtgaggcaggggcggag

SEQ ID NO: 1150921 - DNA, 13 bp, Homo sapiens
tgtgaggccaggg

SEQ ID NO: 1150922 - DNA, 15 bp, Homo sapiens
tgtgaggccagggca

SEQ ID NO: 1150923 - DNA, 14 bp, Homo sapiens
tgtgaggcccctgg

SEQ ID NO: 1150924 - DNA, 22 bp, Homo sapiens
tgtgaggcccctggacaagcag

SEQ ID NO: 1150925 - DNA, 14 bp, Homo sapiens
tgtgaggctgtcct

SEQ ID NO: 1150926 - DNA, 18 bp, Homo sapiens
tgtgaggctgtgtctctg

SEQ ID NO: 1150927 - DNA, 22 bp, Homo sapiens
tgtgagggacatgctcacctct

SEQ ID NO: 1150928 - DNA, 22 bp, Homo sapiens
tgtgagggaggggaaaagcatt

SEQ ID NO: 1150929 - DNA, 15 bp, Homo sapiens
tgtgagggagtgcag

SEQ ID NO: 1150930 - DNA, 15 bp, Homo sapiens
tgtgagggcagcact

SEQ ID NO: 1150931 - DNA, 19 bp, Homo sapiens
tgtgagggcagcactggga

SEQ ID NO: 1150932 - DNA, 19 bp, Homo sapiens
tgtgagtaagagctggtgt

SEQ ID NO: 1150933 - DNA, 16 bp, Homo sapiens
tgtgagtcaatacata

SEQ ID NO: 1150934 - DNA, 17 bp, Homo sapiens
tgtgagtcagaatgtga

SEQ ID NO: 1150935 - DNA, 21 bp, Homo sapiens
tgtgagtcctgttgaagactt

SEQ ID NO: 1150936 - DNA, 19 bp, Homo sapiens
tgtgagtgccttttgcaga

SEQ ID NO: 1150937 - DNA, 22 bp, Homo sapiens
tgtgagtggagttgaggtgtca

SEQ ID NO: 1150938 - DNA, 16 bp, Homo sapiens
tgtgagtggcagccat

SEQ ID NO: 1150939 - DNA, 17 bp, Homo sapiens
tgtgagtggcagccatg

SEQ ID NO: 1150940 - DNA, 16 bp, Homo sapiens
tgtgagtgtaagtgtg

SEQ ID NO: 1150941 - DNA, 15 bp, Homo sapiens
tgtgagtgtgacagg

SEQ ID NO: 1150942 - DNA, 16 bp, Homo sapiens
tgtgagtgtgacaggg

SEQ ID NO: 1150943 - DNA, 18 bp, Homo sapiens
tgtgagtgtgagagatgg

SEQ ID NO: 1150944 - DNA, 23 bp, Homo sapiens
tgtgagtgtgtccaagtgtgtgt

SEQ ID NO: 1150945 - DNA, 22 bp, Homo sapiens
tgtgagtgtttttatcttttta

SEQ ID NO: 1150946 - DNA, 19 bp, Homo sapiens
tgtgagtttaccttgtata

SEQ ID NO: 1150947 - DNA, 20 bp, Homo sapiens
tgtgagtttggtctggactg

SEQ ID NO: 1150948 - DNA, 21 bp, Homo sapiens
tgtgagtttggtctggactga

SEQ ID NO: 1150949 - DNA, 16 bp, Homo sapiens
tgtgataactctgcaa

SEQ ID NO: 1150950 - DNA, 18 bp, Homo sapiens
tgtgataaggatcagaac

SEQ ID NO: 1150951 - DNA, 22 bp, Homo sapiens
tgtgataaggcctactatacat

SEQ ID NO: 1150952 - DNA, 16 bp, Homo sapiens
tgtgatacatttctga

SEQ ID NO: 1150953 - DNA, 22 bp, Homo sapiens
tgtgatacccatagcttccatg

SEQ ID NO: 1150954 - DNA, 15 bp, Homo sapiens
tgtgatagcactttc

SEQ ID NO: 1150955 - DNA, 13 bp, Homo sapiens
tgtgatatataag

SEQ ID NO: 1150956 - DNA, 13 bp, Homo sapiens
tgtgatattctgt

SEQ ID NO: 1150957 - DNA, 18 bp, Homo sapiens
tgtgatcacgcctggcta

SEQ ID NO: 1150958 - DNA, 17 bp, Homo sapiens
tgtgatcactgagacag

SEQ ID NO: 1150959 - DNA, 15 bp, Homo sapiens
tgtgatcagaccata

SEQ ID NO: 1150960 - DNA, 17 bp, Homo sapiens
tgtgatcagcattgtga

SEQ ID NO: 1150961 - DNA, 19 bp, Homo sapiens
tgtgatcatagctcactgt

SEQ ID NO: 1150962 - DNA, 22 bp, Homo sapiens
tgtgatccagccctggttctgg

SEQ ID NO: 1150963 - DNA, 13 bp, Homo sapiens
tgtgatcgtctga

SEQ ID NO: 1150964 - DNA, 21 bp, Homo sapiens
tgtgatcttaatatatttgaa

SEQ ID NO: 1150965 - DNA, 19 bp, Homo sapiens
tgtgccctagatgcacgtg

SEQ ID NO: 1150966 - DNA, 16 bp, Homo sapiens
tgtgccctcaccacca

SEQ ID NO: 1150967 - DNA, 18 bp, Homo sapiens
tgtgccctcaccaccaca

SEQ ID NO: 1150968 - DNA, 16 bp, Homo sapiens
tgtgccctcaccccaa

SEQ ID NO: 1150969 - DNA, 15 bp, Homo sapiens
tgtgccctccaaaga

SEQ ID NO: 1150970 - DNA, 16 bp, Homo sapiens
tgtgccctccaaagag

SEQ ID NO: 1150971 - DNA, 16 bp, Homo sapiens
tgtgccctgggccagg

SEQ ID NO: 1150972 - DNA, 21 bp, Homo sapiens
tgtgccctgggccaggcaggc

SEQ ID NO: 1150973 - DNA, 13 bp, Homo sapiens
tgtgccctggtgg

SEQ ID NO: 1150974 - DNA, 21 bp, Homo sapiens
tgtgcccttttataaggaaac

SEQ ID NO: 1150975 - DNA, 16 bp, Homo sapiens
tgtgcctaattttcta

SEQ ID NO: 1150976 - DNA, 14 bp, Homo sapiens
tgtgcctcagagac

SEQ ID NO: 1150977 - DNA, 16 bp, Homo sapiens
tgtgcctcagagacca

SEQ ID NO: 1150978 - DNA, 14 bp, Homo sapiens
tgtgcctcaggcca

SEQ ID NO: 1150979 - DNA, 18 bp, Homo sapiens
gttatacaaccttcattt

SEQ ID NO: 1150980 - DNA, 14 bp, Homo sapiens
gttatacaaggcaa

SEQ ID NO: 1150981 - DNA, 18 bp, Homo sapiens
gttatacaataacccagt

SEQ ID NO: 1150982 - DNA, 20 bp, Homo sapiens
gttatacaataacccagtta

SEQ ID NO: 1150983 - DNA, 22 bp, Homo sapiens
gttatacaataacccagttact

SEQ ID NO: 1150984 - DNA, 18 bp, Homo sapiens
gttatacagttataaaat

SEQ ID NO: 1150985 - DNA, 22 bp, Homo sapiens
gttatacagttataaaattaaa

SEQ ID NO: 1150986 - DNA, 13 bp, Homo sapiens
gttatacttcaaa

SEQ ID NO: 1150987 - DNA, 19 bp, Homo sapiens
gttatagaacttcatggat

SEQ ID NO: 1150988 - DNA, 20 bp, Homo sapiens
gttatagaatagcctgaggt

SEQ ID NO: 1150989 - DNA, 17 bp, Homo sapiens
gttataggtcactcctg

SEQ ID NO: 1150990 - DNA, 19 bp, Homo sapiens
gttatagtatatctggaca

SEQ ID NO: 1150991 - DNA, 21 bp, Homo sapiens
gttatagtgaatactgctaca

SEQ ID NO: 1150992 - DNA, 18 bp, Homo sapiens
gttatagtgtttaactgg

SEQ ID NO: 1150993 - DNA, 12 bp, Homo sapiens
gttatataattt

SEQ ID NO: 1150994 - DNA, 14 bp, Homo sapiens
gttatatagtggat

SEQ ID NO: 1150995 - DNA, 16 bp, Homo sapiens
gttatatatctctttt

SEQ ID NO: 1150996 - DNA, 13 bp, Homo sapiens
gttatatgatatt

SEQ ID NO: 1150997 - DNA, 16 bp, Homo sapiens
gttatattccaaggaa

SEQ ID NO: 1150998 - DNA, 17 bp, Homo sapiens
gttatattccaaggaaa

SEQ ID NO: 1150999 - DNA, 21 bp, Homo sapiens
gttatattccaaggaaaattg

SEQ ID NO: 1151000 - DNA, 17 bp, Homo sapiens
gttatattgaatatatc

SEQ ID NO: 1151001 - DNA, 19 bp, Homo sapiens
gttatattgaatatatcag

SEQ ID NO: 1151002 - DNA, 10 bp, Homo sapiens
gttatatttc

SEQ ID NO: 1151003 - DNA, 21 bp, Homo sapiens
gttatatttcagatgtaatgt

SEQ ID NO: 1151004 - DNA, 14 bp, Homo sapiens
gttatcactgtgca

SEQ ID NO: 1151005 - DNA, 13 bp, Homo sapiens
gttatcagctggg

SEQ ID NO: 1151006 - DNA, 17 bp, Homo sapiens
gttatcatgaattttaa

SEQ ID NO: 1151007 - DNA, 18 bp, Homo sapiens
gttatcatgaattttaaa

SEQ ID NO: 1151008 - DNA, 21 bp, Homo sapiens
gttatcccaagaccctgcccc

SEQ ID NO: 1151009 - DNA, 21 bp, Homo sapiens
gttatcccttccttttagcct

SEQ ID NO: 1151010 - DNA, 14 bp, Homo sapiens
gttatcctcctctc

SEQ ID NO: 1151011 - DNA, 14 bp, Homo sapiens
gttatcctttcatt

SEQ ID NO: 1151012 - DNA, 23 bp, Homo sapiens
gttatcctttcattaggcaaagt

SEQ ID NO: 1151013 - DNA, 16 bp, Homo sapiens
gttatctaaaagaaat

SEQ ID NO: 1151014 - DNA, 18 bp, Homo sapiens
gttatctgcctggcctgg

SEQ ID NO: 1151015 - DNA, 20 bp, Homo sapiens
gttatctgcctggcctggct

SEQ ID NO: 1151016 - DNA, 20 bp, Homo sapiens
gttatcttatactgtacaat

SEQ ID NO: 1151017 - DNA, 11 bp, Homo sapiens
gttatgaaaat

SEQ ID NO: 1151018 - DNA, 15 bp, Homo sapiens
gttatgaaataaaga

SEQ ID NO: 1151019 - DNA, 15 bp, Homo sapiens
gttatgaatctgtgc

SEQ ID NO: 1151020 - DNA, 20 bp, Homo sapiens
gttatgaggatataatgtgt

SEQ ID NO: 1151021 - DNA, 20 bp, Homo sapiens
gttatgatttccttcaatgt

SEQ ID NO: 1151022 - DNA, 19 bp, Homo sapiens
gttatgcactgtggtttca

SEQ ID NO: 1151023 - DNA, 11 bp, Homo sapiens
gttatgccatg

SEQ ID NO: 1151024 - DNA, 15 bp, Homo sapiens
gttatggtagaaaaa

SEQ ID NO: 1151025 - DNA, 11 bp, Homo sapiens
gttatgtatga

SEQ ID NO: 1151026 - DNA, 20 bp, Homo sapiens
gttatgttcccagcagtggg

SEQ ID NO: 1151027 - DNA, 17 bp, Homo sapiens
gttatgtttaataagct

SEQ ID NO: 1151028 - DNA, 20 bp, Homo sapiens
gttattaacgggcatgtatt

SEQ ID NO: 1151029 - DNA, 21 bp, Homo sapiens
gttattaacgggcatgtatta

SEQ ID NO: 1151030 - DNA, 23 bp, Homo sapiens
gttattatctatggaaatgtgag

SEQ ID NO: 1151031 - DNA, 19 bp, Homo sapiens
gttattatgaaggaatttg

SEQ ID NO: 1151032 - DNA, 18 bp, Homo sapiens
gttattcaaatttgtaca

SEQ ID NO: 1151033 - DNA, 18 bp, Homo sapiens
gttattcacaacctcacc

SEQ ID NO: 1151034 - DNA, 14 bp, Homo sapiens
gttattcattattc

SEQ ID NO: 1151035 - DNA, 16 bp, Homo sapiens
gttattcattattcct

SEQ ID NO: 1151036 - DNA, 15 bp, Homo sapiens
gttattcgcccaccc

SEQ ID NO: 1151037 - DNA, 18 bp, Homo sapiens
gttattgcaataaagtat

SEQ ID NO: 1151038 - DNA, 21 bp, Homo sapiens
gttattgttgaacatacttca

SEQ ID NO: 1151039 - DNA, 14 bp, Homo sapiens
gttattgttttgtt

SEQ ID NO: 1151040 - DNA, 13 bp, Homo sapiens
gttatttaaagaa

SEQ ID NO: 1151041 - DNA, 15 bp, Homo sapiens
gttatttaaagaaga

SEQ ID NO: 1151042 - DNA, 19 bp, Homo sapiens
gttatttacactggtctaa

SEQ ID NO: 1151043 - DNA, 20 bp, Homo sapiens
gttatttagtaaagtttgtt

SEQ ID NO: 1151044 - DNA, 14 bp, Homo sapiens
gttatttattatta

SEQ ID NO: 1151045 - DNA, 16 bp, Homo sapiens
gttatttctgtttgtt

SEQ ID NO: 1151046 - DNA, 14 bp, Homo sapiens
gttatttcttgttt

SEQ ID NO: 1151047 - DNA, 12 bp, Homo sapiens
gttattttcagt

SEQ ID NO: 1151048 - DNA, 15 bp, Homo sapiens
gttattttgataaca

SEQ ID NO: 1151049 - DNA, 13 bp, Homo sapiens
gttattttgcttt

SEQ ID NO: 1151050 - DNA, 23 bp, Homo sapiens
gttatttttatatcagcctgagt

SEQ ID NO: 1151051 - DNA, 17 bp, Homo sapiens
gttatttttattaaatg

SEQ ID NO: 1151052 - DNA, 20 bp, Homo sapiens
gttatttttattaaatgtat

SEQ ID NO: 1151053 - DNA, 17 bp, Homo sapiens
gttatttttcaaggaag

SEQ ID NO: 1151054 - DNA, 17 bp, Homo sapiens
gttatttttctcttgta

SEQ ID NO: 1151055 - DNA, 14 bp, Homo sapiens
gttcaaaatgtctg

SEQ ID NO: 1151056 - DNA, 17 bp, Homo sapiens
gttcaaactactgtaca

SEQ ID NO: 1151057 - DNA, 13 bp, Homo sapiens
gttcaaagactgt

SEQ ID NO: 1151058 - DNA, 16 bp, Homo sapiens
gttcaaagactgtgaa

SEQ ID NO: 1151059 - DNA, 20 bp, Homo sapiens
gttcaaagatattttgcttt

SEQ ID NO: 1151060 - DNA, 14 bp, Homo sapiens
gttcaaagctgcct

SEQ ID NO: 1151061 - DNA, 15 bp, Homo sapiens
gttcaaagtgtatat

SEQ ID NO: 1151062 - DNA, 23 bp, Homo sapiens
gttcaacaaagaaacaaagatgt

SEQ ID NO: 1151063 - DNA, 16 bp, Homo sapiens
gttcaacccacagcta

SEQ ID NO: 1151064 - DNA, 13 bp, Homo sapiens
gttcaagaaataa

SEQ ID NO: 1151065 - DNA, 16 bp, Homo sapiens
gttcaagaccagcctg

SEQ ID NO: 1151066 - DNA, 14 bp, Homo sapiens
gttcaagcacactg

SEQ ID NO: 1151067 - DNA, 19 bp, Homo sapiens
gttcaagcacactggaata

SEQ ID NO: 1151068 - DNA, 18 bp, Homo sapiens
gttcaaggtcactgtttc

SEQ ID NO: 1151069 - DNA, 12 bp, Homo sapiens
gttcaatatttt

SEQ ID NO: 1151070 - DNA, 18 bp, Homo sapiens
gttcaatctcccgctgct

SEQ ID NO: 1151071 - DNA, 23 bp, Homo sapiens
gttcacaaactacctctggacag

SEQ ID NO: 1151072 - DNA, 13 bp, Homo sapiens
gttcacaaactgt

SEQ ID NO: 1151073 - DNA, 14 bp, Homo sapiens
gttcacaacctagg

SEQ ID NO: 1151074 - DNA, 16 bp, Homo sapiens
gttcacaccagagaac

SEQ ID NO: 1151075 - DNA, 13 bp, Homo sapiens
gttcacagacata

SEQ ID NO: 1151076 - DNA, 20 bp, Homo sapiens
gttcacggtgacacaggtca

SEQ ID NO: 1151077 - DNA, 15 bp, Homo sapiens
gttcactaaagcagt

SEQ ID NO: 1151078 - DNA, 23 bp, Homo sapiens
gttcactccatttggtcctttct

SEQ ID NO: 1151079 - DNA, 20 bp, Homo sapiens
gttcactgaaggtgattcac

SEQ ID NO: 1151080 - DNA, 22 bp, Homo sapiens
gttcactgagctccccagatct

SEQ ID NO: 1151081 - DNA, 13 bp, Homo sapiens
gttcactgcattc

SEQ ID NO: 1151082 - DNA, 17 bp, Homo sapiens
gttcacttcaaagctaa

SEQ ID NO: 1151083 - DNA, 21 bp, Homo sapiens
gttcacttctttgcagagcct

SEQ ID NO: 1151084 - DNA, 18 bp, Homo sapiens
gttcagaattaagcagaa

SEQ ID NO: 1151085 - DNA, 22 bp, Homo sapiens
gttcagagactcagggccccag

SEQ ID NO: 1151086 - DNA, 11 bp, Homo sapiens
gttcagaggca

SEQ ID NO: 1151087 - DNA, 16 bp, Homo sapiens
gttcagagtggctcac

SEQ ID NO: 1151088 - DNA, 21 bp, Homo sapiens
gttccgggaggcagagaggag

SEQ ID NO: 1151089 - DNA, 15 bp, Homo sapiens
gttccggtccccaca

SEQ ID NO: 1151090 - DNA, 16 bp, Homo sapiens
gttccggtccccacag

SEQ ID NO: 1151091 - DNA, 19 bp, Homo sapiens
gttccgtatctccctggag

SEQ ID NO: 1151092 - DNA, 22 bp, Homo sapiens
gttcctaccgtactccctgcac

SEQ ID NO: 1151093 - DNA, 20 bp, Homo sapiens
gttcctaggcattgcaggac

SEQ ID NO: 1151094 - DNA, 23 bp, Homo sapiens
gttcctagtgatggcttatgata

SEQ ID NO: 1151095 - DNA, 14 bp, Homo sapiens
gttcctatggaaac

SEQ ID NO: 1151096 - DNA, 18 bp, Homo sapiens
gttcctattgtcattaaa

SEQ ID NO: 1151097 - DNA, 20 bp, Homo sapiens
gttcctcaaagcttggatta

SEQ ID NO: 1151098 - DNA, 15 bp, Homo sapiens
gttcctcaaattttt

SEQ ID NO: 1151099 - DNA, 20 bp, Homo sapiens
gttcctcatctgagaggctc

SEQ ID NO: 1151100 - DNA, 21 bp, Homo sapiens
gttcctcatctgagaggctct

SEQ ID NO: 1151101 - DNA, 22 bp, Homo sapiens
gttcctcattagcattttgcta

SEQ ID NO: 1151102 - DNA, 13 bp, Homo sapiens
gttcctcgccctg

SEQ ID NO: 1151103 - DNA, 19 bp, Homo sapiens
gttcctcggtgggccagag

SEQ ID NO: 1151104 - DNA, 14 bp, Homo sapiens
gttcctctgcagtt

SEQ ID NO: 1151105 - DNA, 14 bp, Homo sapiens
gttcctctgcctgc

SEQ ID NO: 1151106 - DNA, 16 bp, Homo sapiens
gttcctctgcctgccc

SEQ ID NO: 1151107 - DNA, 22 bp, Homo sapiens
gttcctcttttctttcaagaac

SEQ ID NO: 1151108 - DNA, 15 bp, Homo sapiens
gttcctgaagctgct

SEQ ID NO: 1151109 - DNA, 17 bp, Homo sapiens
gttcctgaagctgctgt

SEQ ID NO: 1151110 - DNA, 22 bp, Homo sapiens
tgtggatatcagttaccaaaca

SEQ ID NO: 1151111 - DNA, 20 bp, Homo sapiens
tgtggatcaaccatcgcttt

SEQ ID NO: 1151112 - DNA, 17 bp, Homo sapiens
tgtggatcagagatgca

SEQ ID NO: 1151113 - DNA, 17 bp, Homo sapiens
tgtggatccctttagaa

SEQ ID NO: 1151114 - DNA, 22 bp, Homo sapiens
tgtggatgctccagggcagcct

SEQ ID NO: 1151115 - DNA, 15 bp, Homo sapiens
tgtggatgctgagct

SEQ ID NO: 1151116 - DNA, 15 bp, Homo sapiens
tgtggatggaaatgt

SEQ ID NO: 1151117 - DNA, 19 bp, Homo sapiens
tgtggattataaaaaatgt

SEQ ID NO: 1151118 - DNA, 22 bp, Homo sapiens
tgtggattctgaggccctgccc

SEQ ID NO: 1151119 - DNA, 15 bp, Homo sapiens
tgtggatttggggac

SEQ ID NO: 1151120 - DNA, 13 bp, Homo sapiens
tgtggattttgta

SEQ ID NO: 1151121 - DNA, 20 bp, Homo sapiens
tgtggcaaagtgctgtaccc

SEQ ID NO: 1151122 - DNA, 15 bp, Homo sapiens
tgtggcacgcacctg

SEQ ID NO: 1151123 - DNA, 21 bp, Homo sapiens
tgtggcagagttacagttctg

SEQ ID NO: 1151124 - DNA, 13 bp, Homo sapiens
tgtggcagggggc

SEQ ID NO: 1151125 - DNA, 19 bp, Homo sapiens
tgtggcagtcccttataat

SEQ ID NO: 1151126 - DNA, 11 bp, Homo sapiens
tgtggcagtgg

SEQ ID NO: 1151127 - DNA, 12 bp, Homo sapiens
tgtggcagtggt

SEQ ID NO: 1151128 - DNA, 15 bp, Homo sapiens
tgtggcagtggtttt

SEQ ID NO: 1151129 - DNA, 17 bp, Homo sapiens
tgtggcatgggtgaaga

SEQ ID NO: 1151130 - DNA, 15 bp, Homo sapiens
tgtggcatttccaaa

SEQ ID NO: 1151131 - DNA, 14 bp, Homo sapiens
tgtggccaaccagg

SEQ ID NO: 1151132 - DNA, 16 bp, Homo sapiens
tgtggccaaccaggac

SEQ ID NO: 1151133 - DNA, 20 bp, Homo sapiens
tgtggccaaccaggacccag

SEQ ID NO: 1151134 - DNA, 21 bp, Homo sapiens
tgtggccaaccaggacccagg

SEQ ID NO: 1151135 - DNA, 23 bp, Homo sapiens
tgtggccaaccaggacccagggt

SEQ ID NO: 1151136 - DNA, 19 bp, Homo sapiens
tgtggccacaactgctgtg

SEQ ID NO: 1151137 - DNA, 16 bp, Homo sapiens
tgtggccacagccccc

SEQ ID NO: 1151138 - DNA, 12 bp, Homo sapiens
tgtggccaggct

SEQ ID NO: 1151139 - DNA, 20 bp, Homo sapiens
tgtggccagggtgagagctg

SEQ ID NO: 1151140 - DNA, 20 bp, Homo sapiens
tgtggccatatatgctgtat

SEQ ID NO: 1151141 - DNA, 20 bp, Homo sapiens
tgtggccatcactcagcccc

SEQ ID NO: 1151142 - DNA, 17 bp, Homo sapiens
tgtggccatggcctctg

SEQ ID NO: 1151143 - DNA, 16 bp, Homo sapiens
tgtggccccaagaggg

SEQ ID NO: 1151144 - DNA, 17 bp, Homo sapiens
tgtggccccaccctggg

SEQ ID NO: 1151145 - DNA, 19 bp, Homo sapiens
tgtggccccaccctgggcc

SEQ ID NO: 1151146 - DNA, 23 bp, Homo sapiens
tgtggccccaccctgggccctgg

SEQ ID NO: 1151147 - DNA, 16 bp, Homo sapiens
tgtggccctggccact

SEQ ID NO: 1151148 - DNA, 15 bp, Homo sapiens
tgtggccgaggactt

SEQ ID NO: 1151149 - DNA, 16 bp, Homo sapiens
tgtggccgccatctgc

SEQ ID NO: 1151150 - DNA, 17 bp, Homo sapiens
tgtggccgtctcctccc

SEQ ID NO: 1151151 - DNA, 22 bp, Homo sapiens
tgtggcctcaagcaatccacct

SEQ ID NO: 1151152 - DNA, 15 bp, Homo sapiens
tgtggcctcagccct

SEQ ID NO: 1151153 - DNA, 16 bp, Homo sapiens
tgtggcctcagccctc

SEQ ID NO: 1151154 - DNA, 21 bp, Homo sapiens
tgtggcctccctggctcctcc

SEQ ID NO: 1151155 - DNA, 12 bp, Homo sapiens
tgtggcctgccc

SEQ ID NO: 1151156 - DNA, 15 bp, Homo sapiens
tgtggcctgcccagc

SEQ ID NO: 1151157 - DNA, 19 bp, Homo sapiens
tgtggcctggtgggtcagg

SEQ ID NO: 1151158 - DNA, 13 bp, Homo sapiens
tgtggcctgtggc

SEQ ID NO: 1151159 - DNA, 22 bp, Homo sapiens
tgtggcctgtgtccagcagctg

SEQ ID NO: 1151160 - DNA, 22 bp, Homo sapiens
tgtggccttggcatttcttctt

SEQ ID NO: 1151161 - DNA, 18 bp, Homo sapiens
tgtggcgccgtctccagg

SEQ ID NO: 1151162 - DNA, 14 bp, Homo sapiens
tgtggctaattata

SEQ ID NO: 1151163 - DNA, 20 bp, Homo sapiens
tgtggctaattataattcag

SEQ ID NO: 1151164 - DNA, 17 bp, Homo sapiens
tgtggctactgacatat

SEQ ID NO: 1151165 - DNA, 21 bp, Homo sapiens
tgtggctcaggggagcaagct

SEQ ID NO: 1151166 - DNA, 17 bp, Homo sapiens
tgtggctcctatctgtg

SEQ ID NO: 1151167 - DNA, 20 bp, Homo sapiens
tgtggctcctcccagcccat

SEQ ID NO: 1151168 - DNA, 21 bp, Homo sapiens
tgtggctcctgggggttcttt

SEQ ID NO: 1151169 - DNA, 22 bp, Homo sapiens
tgtggctggctctaccttcctg

SEQ ID NO: 1151170 - DNA, 21 bp, Homo sapiens
tgtggctgggggcaggagggc

SEQ ID NO: 1151171 - DNA, 13 bp, Homo sapiens
tgtggctggtgtc

SEQ ID NO: 1151172 - DNA, 15 bp, Homo sapiens
tgtggctggtgtccc

SEQ ID NO: 1151173 - DNA, 23 bp, Homo sapiens
tgtggctggtgtccccttcccct

SEQ ID NO: 1151174 - DNA, 23 bp, Homo sapiens
tgtggcttctctgtctctgtgga

SEQ ID NO: 1151175 - DNA, 12 bp, Homo sapiens
tgtggcttggag

SEQ ID NO: 1151176 - DNA, 14 bp, Homo sapiens
tgtggcttggagga

SEQ ID NO: 1151177 - DNA, 21 bp, Homo sapiens
tgtggcttggagtggccaaat

SEQ ID NO: 1151178 - DNA, 17 bp, Homo sapiens
tgtggctttttgttcag

SEQ ID NO: 1151179 - DNA, 18 bp, Homo sapiens
tgtggcttttttaaaaaa

SEQ ID NO: 1151180 - DNA, 17 bp, Homo sapiens
tgtgggacacctgggag

SEQ ID NO: 1151181 - DNA, 16 bp, Homo sapiens
tgtgggaccgcctggc

SEQ ID NO: 1151182 - DNA, 19 bp, Homo sapiens
tgtgggaccgcctggccct

SEQ ID NO: 1151183 - DNA, 20 bp, Homo sapiens
tgtgggaccgcctggccctc

SEQ ID NO: 1151184 - DNA, 13 bp, Homo sapiens
tgtgggagcagcg

SEQ ID NO: 1151185 - DNA, 13 bp, Homo sapiens
tgtgggagggagc

SEQ ID NO: 1151186 - DNA, 18 bp, Homo sapiens
tgtgggagtgcagagaaa

SEQ ID NO: 1151187 - DNA, 15 bp, Homo sapiens
tgtgggatgtcctct

SEQ ID NO: 1151188 - DNA, 22 bp, Homo sapiens
tgtgggatgttcagcactgtcc

SEQ ID NO: 1151189 - DNA, 19 bp, Homo sapiens
tgtgggcaaaggcagggcc

SEQ ID NO: 1151190 - DNA, 14 bp, Homo sapiens
tgtgggcactggcc

SEQ ID NO: 1151191 - DNA, 13 bp, Homo sapiens
tgtgggcagcacc

SEQ ID NO: 1151192 - DNA, 20 bp, Homo sapiens
tgtgggcaggcaagcccttc

SEQ ID NO: 1151193 - DNA, 19 bp, Homo sapiens
tgtgggcatgagctgctgt

SEQ ID NO: 1151194 - DNA, 21 bp, Homo sapiens
tgtgggcatttcttgcgagcc

SEQ ID NO: 1151195 - DNA, 24 bp, Homo sapiens
tgtgggccaagtccactgtcctcc

SEQ ID NO: 1151196 - DNA, 16 bp, Homo sapiens
tgtgggcgctgcttcc

SEQ ID NO: 1151197 - DNA, 16 bp, Homo sapiens
tgtgggctccaggcct

SEQ ID NO: 1151198 - DNA, 13 bp, Homo sapiens
tgtgggctgcccc

SEQ ID NO: 1151199 - DNA, 20 bp, Homo sapiens
tgtgggctggtgccccacag

SEQ ID NO: 1151200 - DNA, 13 bp, Homo sapiens
tgtgggctgtgag

SEQ ID NO: 1151201 - DNA, 14 bp, Homo sapiens
tgtgggctgtgagt

SEQ ID NO: 1151202 - DNA, 22 bp, Homo sapiens
tgtgggcttcctgctgggactg

SEQ ID NO: 1151203 - DNA, 15 bp, Homo sapiens
tgtgggcttggcctt

SEQ ID NO: 1151204 - DNA, 18 bp, Homo sapiens
tgtggggataaagacaga

SEQ ID NO: 1151205 - DNA, 12 bp, Homo sapiens
tgtggggccagg

SEQ ID NO: 1151206 - DNA, 13 bp, Homo sapiens
tgtggggccagga

SEQ ID NO: 1151207 - DNA, 15 bp, Homo sapiens
tgtggggccaggtca

SEQ ID NO: 1151208 - DNA, 23 bp, Homo sapiens
tgtggggccatgcctcctcagga

SEQ ID NO: 1151209 - DNA, 17 bp, Homo sapiens
tgtggggctgagctggg

SEQ ID NO: 1151210 - DNA, 14 bp, Homo sapiens
tgttctcctcccca

SEQ ID NO: 1151211 - DNA, 12 bp, Homo sapiens
tgttctctcccc

SEQ ID NO: 1151212 - DNA, 13 bp, Homo sapiens
tgttctctcccct

SEQ ID NO: 1151213 - DNA, 23 bp, Homo sapiens
tgttctctcccctcacatcctcc

SEQ ID NO: 1151214 - DNA, 19 bp, Homo sapiens
tgttctctgaattttcaga

SEQ ID NO: 1151215 - DNA, 19 bp, Homo sapiens
tgttctctgctgagggcca

SEQ ID NO: 1151216 - DNA, 16 bp, Homo sapiens
tgttctctggaacctg

SEQ ID NO: 1151217 - DNA, 14 bp, Homo sapiens
tgttctctgggaga

SEQ ID NO: 1151218 - DNA, 16 bp, Homo sapiens
tgttctctgggagaaa

SEQ ID NO: 1151219 - DNA, 14 bp, Homo sapiens
tgttctcttcccag

SEQ ID NO: 1151220 - DNA, 16 bp, Homo sapiens
tgttctcttcccaggc

SEQ ID NO: 1151221 - DNA, 18 bp, Homo sapiens
tgttctgaaaggagacat

SEQ ID NO: 1151222 - DNA, 18 bp, Homo sapiens
tgttctgaataatttctt

SEQ ID NO: 1151223 - DNA, 16 bp, Homo sapiens
tgttctgaatgctgct

SEQ ID NO: 1151224 - DNA, 22 bp, Homo sapiens
tgttctgacattaacagttttc

SEQ ID NO: 1151225 - DNA, 16 bp, Homo sapiens
tgttctgagaactgac

SEQ ID NO: 1151226 - DNA, 22 bp, Homo sapiens
tgttctgagaactgactttctc

SEQ ID NO: 1151227 - DNA, 21 bp, Homo sapiens
tgttctgagattcaatattga

SEQ ID NO: 1151228 - DNA, 14 bp, Homo sapiens
tgttctgattagaa

SEQ ID NO: 1151229 - DNA, 16 bp, Homo sapiens
tgttctgattagaaat

SEQ ID NO: 1151230 - DNA, 21 bp, Homo sapiens
tgttctgcaagaattaaaact

SEQ ID NO: 1151231 - DNA, 23 bp, Homo sapiens
tgttctgcaagaattaaaactga

SEQ ID NO: 1151232 - DNA, 23 bp, Homo sapiens
tgttctgcccacgatcccctccc

SEQ ID NO: 1151233 - DNA, 11 bp, Homo sapiens
tgttctgcctc

SEQ ID NO: 1151234 - DNA, 19 bp, Homo sapiens
tgttctgcctctccctggg

SEQ ID NO: 1151235 - DNA, 20 bp, Homo sapiens
tgttctgcctctccctgggt

SEQ ID NO: 1151236 - DNA, 14 bp, Homo sapiens
tgttctgctcctgc

SEQ ID NO: 1151237 - DNA, 13 bp, Homo sapiens
tgttctgctttat

SEQ ID NO: 1151238 - DNA, 12 bp, Homo sapiens
tgttctgggctg

SEQ ID NO: 1151239 - DNA, 20 bp, Homo sapiens
tgttctgggtgttgaccact

SEQ ID NO: 1151240 - DNA, 23 bp, Homo sapiens
tgttctgggtgttgaccactcca

SEQ ID NO: 1151241 - DNA, 23 bp, Homo sapiens
tgttctggtatttcccctgtcag

SEQ ID NO: 1151242 - DNA, 18 bp, Homo sapiens
tgttctgtaatggaactg

SEQ ID NO: 1151243 - DNA, 22 bp, Homo sapiens
tgttctgtaatggaactgaccc

SEQ ID NO: 1151244 - DNA, 14 bp, Homo sapiens
tgttctgtcttccc

SEQ ID NO: 1151245 - DNA, 21 bp, Homo sapiens
tgttctgtgggcttggccttg

SEQ ID NO: 1151246 - DNA, 13 bp, Homo sapiens
tgttctgtgtctt

SEQ ID NO: 1151247 - DNA, 14 bp, Homo sapiens
tgttctgtgtcttt

SEQ ID NO: 1151248 - DNA, 20 bp, Homo sapiens
tgttctgtgttgcaagatat

SEQ ID NO: 1151249 - DNA, 16 bp, Homo sapiens
tgttctgttaactgaa

SEQ ID NO: 1151250 - DNA, 16 bp, Homo sapiens
tgttctgttctggggg

SEQ ID NO: 1151251 - DNA, 15 bp, Homo sapiens
tgttctgtttgttaa

SEQ ID NO: 1151252 - DNA, 21 bp, Homo sapiens
tgttctgtttgttaaaactgg

SEQ ID NO: 1151253 - DNA, 19 bp, Homo sapiens
tgttctgtttgttattgtt

SEQ ID NO: 1151254 - DNA, 14 bp, Homo sapiens
tgttcttaattctt

SEQ ID NO: 1151255 - DNA, 15 bp, Homo sapiens
tgttcttacaaatgt

SEQ ID NO: 1151256 - DNA, 22 bp, Homo sapiens
tgttcttacctgtatgtctcca

SEQ ID NO: 1151257 - DNA, 20 bp, Homo sapiens
tgttcttagagtgtagctgt

SEQ ID NO: 1151258 - DNA, 15 bp, Homo sapiens
tgttcttcacttctg

SEQ ID NO: 1151259 - DNA, 13 bp, Homo sapiens
tgttcttgaattt

SEQ ID NO: 1151260 - DNA, 23 bp, Homo sapiens
tgttcttgaatttaataatctgt

SEQ ID NO: 1151261 - DNA, 21 bp, Homo sapiens
tgttcttgctgagcaccctct

SEQ ID NO: 1151262 - DNA, 23 bp, Homo sapiens
tgttcttggcttggaagattcta

SEQ ID NO: 1151263 - DNA, 15 bp, Homo sapiens
gtttccaatcaacag

SEQ ID NO: 1151264 - DNA, 19 bp, Homo sapiens
gtttccagacttccttgag

SEQ ID NO: 1151265 - DNA, 17 bp, Homo sapiens
gtttccagcagaagaca

SEQ ID NO: 1151266 - DNA, 16 bp, Homo sapiens
gtttccatcatttctg

SEQ ID NO: 1151267 - DNA, 17 bp, Homo sapiens
gtttccatcatttctgt

SEQ ID NO: 1151268 - DNA, 20 bp, Homo sapiens
gtttcccataattttcttca

SEQ ID NO: 1151269 - DNA, 15 bp, Homo sapiens
gtttccccatctctg

SEQ ID NO: 1151270 - DNA, 17 bp, Homo sapiens
gtttccccatctctgtc

SEQ ID NO: 1151271 - DNA, 22 bp, Homo sapiens
gtttcccccacagttttaataa

SEQ ID NO: 1151272 - DNA, 15 bp, Homo sapiens
gtttccctgcccctg

SEQ ID NO: 1151273 - DNA, 13 bp, Homo sapiens
gtttcccttcctc

SEQ ID NO: 1151274 - DNA, 18 bp, Homo sapiens
gtttcccttgctttgttt

SEQ ID NO: 1151275 - DNA, 17 bp, Homo sapiens
gtttccgaatctctttc

SEQ ID NO: 1151276 - DNA, 16 bp, Homo sapiens
gtttccgcccccgccc

SEQ ID NO: 1151277 - DNA, 15 bp, Homo sapiens
gtttcctaactgtga

SEQ ID NO: 1151278 - DNA, 11 bp, Homo sapiens
gtttcctctgg

SEQ ID NO: 1151279 - DNA, 13 bp, Homo sapiens
gtttcctctggat

SEQ ID NO: 1151280 - DNA, 15 bp, Homo sapiens
gtttcctgacattgt

SEQ ID NO: 1151281 - DNA, 21 bp, Homo sapiens
gtttcctgagggttttctcat

SEQ ID NO: 1151282 - DNA, 12 bp, Homo sapiens
gtttcctttctc

SEQ ID NO: 1151283 - DNA, 14 bp, Homo sapiens
gtttccttttggaa

SEQ ID NO: 1151284 - DNA, 21 bp, Homo sapiens
gtttccttttggaacatttct

SEQ ID NO: 1151285 - DNA, 20 bp, Homo sapiens
gtttcgactggtccagctct

SEQ ID NO: 1151286 - DNA, 21 bp, Homo sapiens
gtttcgactggtccagctctg

SEQ ID NO: 1151287 - DNA, 20 bp, Homo sapiens
gtttcgagtaaacttgaaaa

SEQ ID NO: 1151288 - DNA, 20 bp, Homo sapiens
gtttcgctccatcgcccagg

SEQ ID NO: 1151289 - DNA, 22 bp, Homo sapiens
gtttcggaaaaaaaaaaagaaa

SEQ ID NO: 1151290 - DNA, 20 bp, Homo sapiens
gtttcgtgaagtatactgta

SEQ ID NO: 1151291 - DNA, 15 bp, Homo sapiens
gtttcgttatattaa

SEQ ID NO: 1151292 - DNA, 16 bp, Homo sapiens
gtttcgtttctgtata

SEQ ID NO: 1151293 - DNA, 23 bp, Homo sapiens
gtttctaaaggctacctttgtat

SEQ ID NO: 1151294 - DNA, 13 bp, Homo sapiens
gtttctaagcagt

SEQ ID NO: 1151295 - DNA, 18 bp, Homo sapiens
gtttctaataaacttgga

SEQ ID NO: 1151296 - DNA, 14 bp, Homo sapiens
gtttctacttcccc

SEQ ID NO: 1151297 - DNA, 20 bp, Homo sapiens
gtttctacttcccctgggat

SEQ ID NO: 1151298 - DNA, 15 bp, Homo sapiens
gtttctagaggcctc

SEQ ID NO: 1151299 - DNA, 16 bp, Homo sapiens
gtttctagaggcctca

SEQ ID NO: 1151300 - DNA, 17 bp, Homo sapiens
gtttctagaggcctcag

SEQ ID NO: 1151301 - DNA, 18 bp, Homo sapiens
gtttctagggaaatgaaa

SEQ ID NO: 1151302 - DNA, 18 bp, Homo sapiens
gtttctatgcaaagttct

SEQ ID NO: 1151303 - DNA, 14 bp, Homo sapiens
gtttctattctgtc

SEQ ID NO: 1151304 - DNA, 21 bp, Homo sapiens
gtttctcagggtcactgtcct

SEQ ID NO: 1151305 - DNA, 18 bp, Homo sapiens
gtttctccaaactgaagc

SEQ ID NO: 1151306 - DNA, 17 bp, Homo sapiens
gtttctccacaacagcc

SEQ ID NO: 1151307 - DNA, 15 bp, Homo sapiens
gtttctcctgagcta

SEQ ID NO: 1151308 - DNA, 18 bp, Homo sapiens
gtttctcctgagctagga

SEQ ID NO: 1151309 - DNA, 13 bp, Homo sapiens
gtttctctccctc

SEQ ID NO: 1151310 - DNA, 17 bp, Homo sapiens
gtttctctcttgttgtc

SEQ ID NO: 1151311 - DNA, 22 bp, Homo sapiens
gtttctctcttgttgtccaggc

SEQ ID NO: 1151312 - DNA, 13 bp, Homo sapiens
gtttctctgcaga

SEQ ID NO: 1151313 - DNA, 21 bp, Homo sapiens
gtttctctgccttcttccagg

SEQ ID NO: 1151314 - DNA, 17 bp, Homo sapiens
gtttctcttgagctggc

SEQ ID NO: 1151315 - DNA, 18 bp, Homo sapiens
gtttctcttgagctggcc

SEQ ID NO: 1151316 - DNA, 21 bp, Homo sapiens
gtttctctttccttggctccc

SEQ ID NO: 1151317 - DNA, 21 bp, Homo sapiens
gtttctctttgattatttgca

SEQ ID NO: 1151318 - DNA, 22 bp, Homo sapiens
gtttctctttgattatttgcat

SEQ ID NO: 1151319 - DNA, 23 bp, Homo sapiens
gtttctgaatattttaaatctta

SEQ ID NO: 1151320 - DNA, 12 bp, Homo sapiens
gtttctgactct

SEQ ID NO: 1151321 - DNA, 17 bp, Homo sapiens
gtttctgactctgagct

SEQ ID NO: 1151322 - DNA, 21 bp, Homo sapiens
gtttctgatctgtactttgtg

SEQ ID NO: 1151323 - DNA, 23 bp, Homo sapiens
gtttctgatctgtactttgtgtt

SEQ ID NO: 1151324 - DNA, 21 bp, Homo sapiens
gtttctgcccacattggaccc

SEQ ID NO: 1151325 - DNA, 14 bp, Homo sapiens
gtttctggatttca

SEQ ID NO: 1151326 - DNA, 18 bp, Homo sapiens
gtttctgggtccctgctc

SEQ ID NO: 1151327 - DNA, 22 bp, Homo sapiens
gtttctgggtcctgaagaatta

SEQ ID NO: 1151328 - DNA, 23 bp, Homo sapiens
gtttctgggtcctgaagaattaa

SEQ ID NO: 1151329 - DNA, 18 bp, Homo sapiens
gtttctggtggtctgttg

SEQ ID NO: 1151330 - DNA, 14 bp, Homo sapiens
gtttctggtgtctg

SEQ ID NO: 1151331 - DNA, 20 bp, Homo sapiens
gtttgtaaaattgttcctga

SEQ ID NO: 1151332 - DNA, 17 bp, Homo sapiens
gtttgtaaattaacttt

SEQ ID NO: 1151333 - DNA, 14 bp, Homo sapiens
gtttgtaccattta

SEQ ID NO: 1151334 - DNA, 13 bp, Homo sapiens
gtttgtactcaaa

SEQ ID NO: 1151335 - DNA, 14 bp, Homo sapiens
gtttgtagccaggt

SEQ ID NO: 1151336 - DNA, 15 bp, Homo sapiens
gtttgtataacttct

SEQ ID NO: 1151337 - DNA, 20 bp, Homo sapiens
gtttgtatgagatggttaaa

SEQ ID NO: 1151338 - DNA, 16 bp, Homo sapiens
gtttgtatgtataatt

SEQ ID NO: 1151339 - DNA, 14 bp, Homo sapiens
gtttgtatttttta

SEQ ID NO: 1151340 - DNA, 15 bp, Homo sapiens
gtttgtctattttaa

SEQ ID NO: 1151341 - DNA, 16 bp, Homo sapiens
gtttgtctattttaaa

SEQ ID NO: 1151342 - DNA, 15 bp, Homo sapiens
gtttgtctgaacaaa

SEQ ID NO: 1151343 - DNA, 16 bp, Homo sapiens
gtttgtctgtttgttt

SEQ ID NO: 1151344 - DNA, 23 bp, Homo sapiens
gtttgtgacagtaaccatttcag

SEQ ID NO: 1151345 - DNA, 19 bp, Homo sapiens
gtttgtgcatatctgcctc

SEQ ID NO: 1151346 - DNA, 23 bp, Homo sapiens
gtttgtgcatatctgcctcccct

SEQ ID NO: 1151347 - DNA, 22 bp, Homo sapiens
gtttgtgccttaaaaggagaga

SEQ ID NO: 1151348 - DNA, 12 bp, Homo sapiens
gtttgtggcctc

SEQ ID NO: 1151349 - DNA, 15 bp, Homo sapiens
gtttgtggcctcaga

SEQ ID NO: 1151350 - DNA, 17 bp, Homo sapiens
gtttgtggcgtctccct

SEQ ID NO: 1151351 - DNA, 19 bp, Homo sapiens
gtttgtggcgtctccctcg

SEQ ID NO: 1151352 - DNA, 20 bp, Homo sapiens
gtttgtgggggcccttcctt

SEQ ID NO: 1151353 - DNA, 22 bp, Homo sapiens
gtttgtgtatttacgctttgat

SEQ ID NO: 1151354 - DNA, 21 bp, Homo sapiens
gtttgtgtcaaaactggttta

SEQ ID NO: 1151355 - DNA, 13 bp, Homo sapiens
gtttgtgtgattt

SEQ ID NO: 1151356 - DNA, 22 bp, Homo sapiens
gtttgtgtgtatttgtattaat

SEQ ID NO: 1151357 - DNA, 20 bp, Homo sapiens
gtttgtgtgttgtctcttga

SEQ ID NO: 1151358 - DNA, 21 bp, Homo sapiens
gtttgtgtgttgtcttgaaag

SEQ ID NO: 1151359 - DNA, 16 bp, Homo sapiens
gtttgtgttagaaaag

SEQ ID NO: 1151360 - DNA, 17 bp, Homo sapiens
gtttgtgttagaaaagt

SEQ ID NO: 1151361 - DNA, 15 bp, Homo sapiens
gtttgttatttacac

SEQ ID NO: 1151362 - DNA, 17 bp, Homo sapiens
gtttgttatttacactg

SEQ ID NO: 1151363 - DNA, 17 bp, Homo sapiens
gtttgttcataataaaa

SEQ ID NO: 1151364 - DNA, 20 bp, Homo sapiens
gtttgttcataataaaagtg

SEQ ID NO: 1151365 - DNA, 21 bp, Homo sapiens
gtttgttgagctggtaacatc

SEQ ID NO: 1151366 - DNA, 19 bp, Homo sapiens
gtttgttggatcttcaatg

SEQ ID NO: 1151367 - DNA, 20 bp, Homo sapiens
gtttgttggttgattgttta

SEQ ID NO: 1151368 - DNA, 10 bp, Homo sapiens
gtttgtttca

SEQ ID NO: 1151369 - DNA, 23 bp, Homo sapiens
gtttgtttcatatatacaggcat

SEQ ID NO: 1151370 - DNA, 19 bp, Homo sapiens
gtttgtttctccccctggg

SEQ ID NO: 1151371 - DNA, 20 bp, Homo sapiens
gtttgtttctccccctgggc

SEQ ID NO: 1151372 - DNA, 21 bp, Homo sapiens
gtttgtttcttcttttccttt

SEQ ID NO: 1151373 - DNA, 14 bp, Homo sapiens
gtttgtttgtttca

SEQ ID NO: 1151374 - DNA, 17 bp, Homo sapiens
gtttgtttgtttgtctg

SEQ ID NO: 1151375 - DNA, 13 bp, Homo sapiens
gtttgtttttgct

SEQ ID NO: 1151376 - DNA, 19 bp, Homo sapiens
gttttaaaaaaactgaagg

SEQ ID NO: 1151377 - DNA, 16 bp, Homo sapiens
gttttaaaaagccagt

SEQ ID NO: 1151378 - DNA, 21 bp, Homo sapiens
gttttaaaataaaaattctga

SEQ ID NO: 1151379 - DNA, 13 bp, Homo sapiens
gttttaaaataag

SEQ ID NO: 1151380 - DNA, 22 bp, Homo sapiens
gttttaaaataagttaaaggca

SEQ ID NO: 1151381 - DNA, 22 bp, Homo sapiens
gttttaaacacatgccttaaat

SEQ ID NO: 1151382 - DNA, 19 bp, Homo sapiens
gttttaaacctttaatgag

SEQ ID NO: 1151383 - DNA, 22 bp, Homo sapiens
gttttaaagggtgcccatttgt

SEQ ID NO: 1151384 - DNA, 13 bp, Homo sapiens
gttttaaatgtac

SEQ ID NO: 1151385 - DNA, 15 bp, Homo sapiens
gttttaaatgtacag

SEQ ID NO: 1151386 - DNA, 19 bp, Homo sapiens
gttttaaatttatttcaaa

SEQ ID NO: 1151387 - DNA, 22 bp, Homo sapiens
gttttaacaatttcctttatat

SEQ ID NO: 1151388 - DNA, 15 bp, Homo sapiens
gttttaactgtggat

SEQ ID NO: 1151389 - DNA, 22 bp, Homo sapiens
gttttaactgtggatattgtta

SEQ ID NO: 1151390 - DNA, 19 bp, Homo sapiens
gttttaataagaacagatc

SEQ ID NO: 1151391 - DNA, 12 bp, Homo sapiens
gttttaatgtat

SEQ ID NO: 1151392 - DNA, 13 bp, Homo sapiens
tgttgtataaatt

SEQ ID NO: 1151393 - DNA, 15 bp, Homo sapiens
tgttgtatctttgta

SEQ ID NO: 1151394 - DNA, 15 bp, Homo sapiens
tgttgtattaacaaa

SEQ ID NO: 1151395 - DNA, 16 bp, Homo sapiens
tgttgtattaacaaaa

SEQ ID NO: 1151396 - DNA, 22 bp, Homo sapiens
tgttgtatttatggattaaaaa

SEQ ID NO: 1151397 - DNA, 13 bp, Homo sapiens
tgttgtcaaagag

SEQ ID NO: 1151398 - DNA, 16 bp, Homo sapiens
tgttgtcaagaatagc

SEQ ID NO: 1151399 - DNA, 23 bp, Homo sapiens
tgttgtcataacatttaaagaga

SEQ ID NO: 1151400 - DNA, 21 bp, Homo sapiens
tgttgtcattgtaaacaaact

SEQ ID NO: 1151401 - DNA, 13 bp, Homo sapiens
tgttgtcattgtc

SEQ ID NO: 1151402 - DNA, 15 bp, Homo sapiens
tgttgtcattgtcca

SEQ ID NO: 1151403 - DNA, 20 bp, Homo sapiens
tgttgtcattgtccagctgg

SEQ ID NO: 1151404 - DNA, 12 bp, Homo sapiens
tgttgtccaaca

SEQ ID NO: 1151405 - DNA, 22 bp, Homo sapiens
tgttgtccaacaataaacagga

SEQ ID NO: 1151406 - DNA, 18 bp, Homo sapiens
tgttgtccttgccccact

SEQ ID NO: 1151407 - DNA, 16 bp, Homo sapiens
tgttgtccttttcata

SEQ ID NO: 1151408 - DNA, 18 bp, Homo sapiens
tgttgtcgtaaagatttg

SEQ ID NO: 1151409 - DNA, 12 bp, Homo sapiens
tgttgtcttgaa

SEQ ID NO: 1151410 - DNA, 16 bp, Homo sapiens
tgttgtcttgaaagat

SEQ ID NO: 1151411 - DNA, 16 bp, Homo sapiens
tgttgtcttttttatg

SEQ ID NO: 1151412 - DNA, 19 bp, Homo sapiens
tgttgtgcactagtgcaat

SEQ ID NO: 1151413 - DNA, 22 bp, Homo sapiens
tgttgtgtctgtgccctccaaa

SEQ ID NO: 1151414 - DNA, 13 bp, Homo sapiens
tgttgtgtgcatg

SEQ ID NO: 1151415 - DNA, 20 bp, Homo sapiens
tgttgtgtgtatatgtattt

SEQ ID NO: 1151416 - DNA, 12 bp, Homo sapiens
tgttgtgtgtgc

SEQ ID NO: 1151417 - DNA, 15 bp, Homo sapiens
tgttgtgtgtgcagg

SEQ ID NO: 1151418 - DNA, 15 bp, Homo sapiens
tgttgtgttcctggc

SEQ ID NO: 1151419 - DNA, 11 bp, Homo sapiens
tgttgttattt

SEQ ID NO: 1151420 - DNA, 13 bp, Homo sapiens
tgttgttatttaa

SEQ ID NO: 1151421 - DNA, 23 bp, Homo sapiens
tgttgttcaaatgcattttgggg

SEQ ID NO: 1151422 - DNA, 14 bp, Homo sapiens
tgttgttccatttt

SEQ ID NO: 1151423 - DNA, 13 bp, Homo sapiens
tgttgttctgtgg

SEQ ID NO: 1151424 - DNA, 19 bp, Homo sapiens
tgttgttgaaaggtttttt

SEQ ID NO: 1151425 - DNA, 19 bp, Homo sapiens
tgttgttggcaagctgcag

SEQ ID NO: 1151426 - DNA, 18 bp, Homo sapiens
tgttgtttaatctgaact

SEQ ID NO: 1151427 - DNA, 13 bp, Homo sapiens
tgttgtttacctg

SEQ ID NO: 1151428 - DNA, 15 bp, Homo sapiens
tgttgtttataataa

SEQ ID NO: 1151429 - DNA, 20 bp, Homo sapiens
tgttgtttataataaaaata

SEQ ID NO: 1151430 - DNA, 17 bp, Homo sapiens
tgttgtttcttaaataa

SEQ ID NO: 1151431 - DNA, 13 bp, Homo sapiens
tgttgtttgtaaa

SEQ ID NO: 1151432 - DNA, 12 bp, Homo sapiens
tgttgtttgtat

SEQ ID NO: 1151433 - DNA, 19 bp, Homo sapiens
tgttgtttgtttttttgcc

SEQ ID NO: 1151434 - DNA, 11 bp, Homo sapiens
tgttgttttgt

SEQ ID NO: 1151435 - DNA, 18 bp, Homo sapiens
tgttgtttttaagtcctg

SEQ ID NO: 1151436 - DNA, 21 bp, Homo sapiens
tgtttaaaaagtaagttaata

SEQ ID NO: 1151437 - DNA, 21 bp, Homo sapiens
tgtttaaaactcagaatataa

SEQ ID NO: 1151438 - DNA, 12 bp, Homo sapiens
tgtttaaaactt

SEQ ID NO: 1151439 - DNA, 18 bp, Homo sapiens
tgtttaaaataaaatgaa

SEQ ID NO: 1151440 - DNA, 19 bp, Homo sapiens
tgtttaaaataaaatgaaa

SEQ ID NO: 1151441 - DNA, 22 bp, Homo sapiens
tgtttaaaataaaatgaaaatt

SEQ ID NO: 1151442 - DNA, 22 bp, Homo sapiens
tgtttaaacaatctttcatgtc

SEQ ID NO: 1151443 - DNA, 12 bp, Homo sapiens
tgtttaaagaga

SEQ ID NO: 1151444 - DNA, 21 bp, Homo sapiens
tgtttaaagtcacatccctgt

SEQ ID NO: 1151445 - DNA, 22 bp, Homo sapiens
tgtttaaagtgtacttataaac

SEQ ID NO: 1151446 - DNA, 12 bp, Homo sapiens
tgtttaaataaa

SEQ ID NO: 1151447 - DNA, 15 bp, Homo sapiens
tgtttaaataaaatt

SEQ ID NO: 1151448 - DNA, 23 bp, Homo sapiens
tgtttaaataaaatttaatttca

SEQ ID NO: 1151449 - DNA, 23 bp, Homo sapiens
tgtttaaatagcctaaatgatgg

SEQ ID NO: 1151450 - DNA, 13 bp, Homo sapiens
tgtttaaatcatg

SEQ ID NO: 1151451 - DNA, 21 bp, Homo sapiens
tgtttaaattgtaaattttag

SEQ ID NO: 1151452 - DNA, 22 bp, Homo sapiens
tgtttaacaaatctaatctctt

SEQ ID NO: 1151453 - DNA, 15 bp, Homo sapiens
tgtttctgttattaa

SEQ ID NO: 1151454 - DNA, 13 bp, Homo sapiens
tgtttctgttcca

SEQ ID NO: 1151455 - DNA, 15 bp, Homo sapiens
tgtttcttcatttct

SEQ ID NO: 1151456 - DNA, 18 bp, Homo sapiens
tgtttcttccaaagcaca

SEQ ID NO: 1151457 - DNA, 19 bp, Homo sapiens
tgtttcttccaaagcacat

SEQ ID NO: 1151458 - DNA, 12 bp, Homo sapiens
tgtttcttctcc

SEQ ID NO: 1151459 - DNA, 22 bp, Homo sapiens
tgtttcttctccaattctgaaa

SEQ ID NO: 1151460 - DNA, 18 bp, Homo sapiens
tgtttcttctttctttta

SEQ ID NO: 1151461 - DNA, 18 bp, Homo sapiens
tgtttcttgacaagctga

SEQ ID NO: 1151462 - DNA, 19 bp, Homo sapiens
tgtttcttgctctctctcc

SEQ ID NO: 1151463 - DNA, 15 bp, Homo sapiens
tgtttctttcttcct

SEQ ID NO: 1151464 - DNA, 20 bp, Homo sapiens
tgtttctttcttcctcttct

SEQ ID NO: 1151465 - DNA, 14 bp, Homo sapiens
tgtttctttgtgtt

SEQ ID NO: 1151466 - DNA, 17 bp, Homo sapiens
tgtttctttttacagca

SEQ ID NO: 1151467 - DNA, 19 bp, Homo sapiens
tgtttctttttacagcatt

SEQ ID NO: 1151468 - DNA, 16 bp, Homo sapiens
tgtttgaaaacaaaaa

SEQ ID NO: 1151469 - DNA, 17 bp, Homo sapiens
tgtttgaaatatcatgt

SEQ ID NO: 1151470 - DNA, 21 bp, Homo sapiens
tgtttgacactaagaaaatag

SEQ ID NO: 1151471 - DNA, 18 bp, Homo sapiens
tgtttgaccccagtttct

SEQ ID NO: 1151472 - DNA, 17 bp, Homo sapiens
tgtttgagagagaatga

SEQ ID NO: 1151473 - DNA, 18 bp, Homo sapiens
tgtttgagattctcaaag

SEQ ID NO: 1151474 - DNA, 13 bp, Homo sapiens
tgtttgagctcag

SEQ ID NO: 1151475 - DNA, 23 bp, Homo sapiens
tgtttgaggcaaattaactgtat

SEQ ID NO: 1151476 - DNA, 21 bp, Homo sapiens
tgtttgatgcattaaaagaaa

SEQ ID NO: 1151477 - DNA, 19 bp, Homo sapiens
tgtttgatgctatttatgc

SEQ ID NO: 1151478 - DNA, 13 bp, Homo sapiens
tgtttgatgtttt

SEQ ID NO: 1151479 - DNA, 14 bp, Homo sapiens
tgtttgcaagcagg

SEQ ID NO: 1151480 - DNA, 12 bp, Homo sapiens
tgtttgcaatgc

SEQ ID NO: 1151481 - DNA, 23 bp, Homo sapiens
tgtttgcacctttctagttgaaa

SEQ ID NO: 1151482 - DNA, 15 bp, Homo sapiens
tgtttgccaagctga

SEQ ID NO: 1151483 - DNA, 12 bp, Homo sapiens
tgtttgcccaaa

SEQ ID NO: 1151484 - DNA, 10 bp, Homo sapiens
tgtttgcctc

SEQ ID NO: 1151485 - DNA, 20 bp, Homo sapiens
tgtttgccttctacttttaa

SEQ ID NO: 1151486 - DNA, 23 bp, Homo sapiens
tgtttgctctcccggttcttcca

SEQ ID NO: 1151487 - DNA, 19 bp, Homo sapiens
tgtttgctgattatttatg

SEQ ID NO: 1151488 - DNA, 13 bp, Homo sapiens
tgtttgctgctat

SEQ ID NO: 1151489 - DNA, 14 bp, Homo sapiens
tgtttgcttaaaat

SEQ ID NO: 1151490 - DNA, 15 bp, Homo sapiens
tgtttgcttaaaata

SEQ ID NO: 1151491 - DNA, 17 bp, Homo sapiens
tgtttgcttaaacaaag

SEQ ID NO: 1151492 - DNA, 18 bp, Homo sapiens
tgtttgcttattgttcca

SEQ ID NO: 1151493 - DNA, 20 bp, Homo sapiens
tgtttgcttattgttccaag

SEQ ID NO: 1151494 - DNA, 23 bp, Homo sapiens
tgtttgcttattgttccaagaca

SEQ ID NO: 1151495 - DNA, 12 bp, Homo sapiens
tgtttggaaaaa

SEQ ID NO: 1151496 - DNA, 22 bp, Homo sapiens
tgtttggaaaaaactctgaagg

SEQ ID NO: 1151497 - DNA, 14 bp, Homo sapiens
tgtttggaaacatt

SEQ ID NO: 1151498 - DNA, 17 bp, Homo sapiens
tgtttggactgttttca

SEQ ID NO: 1151499 - DNA, 19 bp, Homo sapiens
tgtttggactgttttcaat

SEQ ID NO: 1151500 - DNA, 15 bp, Homo sapiens
tgtttggatacatct

SEQ ID NO: 1151501 - DNA, 19 bp, Homo sapiens
tgtttggatacatctgctg

SEQ ID NO: 1151502 - DNA, 16 bp, Homo sapiens
tgtttggcaaggaaag

SEQ ID NO: 1151503 - DNA, 17 bp, Homo sapiens
tgtttggcacttgtatt

SEQ ID NO: 1151504 - DNA, 20 bp, Homo sapiens
tgtttggcttataaacacat

SEQ ID NO: 1151505 - DNA, 19 bp, Homo sapiens
tgtttgggggacgtttctc

SEQ ID NO: 1151506 - DNA, 21 bp, Homo sapiens
tgtttggtggggtggcacctg

SEQ ID NO: 1151507 - DNA, 20 bp, Homo sapiens
tgtttggttctggggcccct

SEQ ID NO: 1151508 - DNA, 22 bp, Homo sapiens
tgtttggttgtaaatgctcgtg

SEQ ID NO: 1151509 - DNA, 22 bp, Homo sapiens
tgtttgtaaaagcttgatgaaa

SEQ ID NO: 1151510 - DNA, 15 bp, Homo sapiens
tgtttgtaaataaga

SEQ ID NO: 1151511 - DNA, 19 bp, Homo sapiens
tgtttgtaaataagagatt

SEQ ID NO: 1151512 - DNA, 16 bp, Homo sapiens
tgtttgtaaattaata

SEQ ID NO: 1151513 - DNA, 19 bp, Homo sapiens
tgtttgtaaattaatactt

SEQ ID NO: 1151514 - DNA, 17 bp, Homo sapiens
tgtttgtaagtgaagtg

SEQ ID NO: 1151515 - DNA, 11 bp, Homo sapiens
tgtttgtacag

SEQ ID NO: 1151516 - DNA, 14 bp, Homo sapiens
tgtttgtacagtaa

SEQ ID NO: 1151517 - DNA, 16 bp, Homo sapiens
tgtttgtatatttgca

SEQ ID NO: 1151518 - DNA, 17 bp, Homo sapiens
tgtttgtatatttgcaa

SEQ ID NO: 1151519 - DNA, 13 bp, Homo sapiens
tgtttgtatgaaa

SEQ ID NO: 1151520 - DNA, 14 bp, Homo sapiens
tgtttgtatgaaat

SEQ ID NO: 1151521 - DNA, 15 bp, Homo sapiens
tgtttgtatgaaatt

SEQ ID NO: 1151522 - DNA, 23 bp, Homo sapiens
tgtttgtattttttatttacatt

SEQ ID NO: 1151523 - DNA, 14 bp, Homo sapiens
gttttgttaatata

SEQ ID NO: 1151524 - DNA, 15 bp, Homo sapiens
gttttgttaatatac

SEQ ID NO: 1151525 - DNA, 15 bp, Homo sapiens
gttttgttctttaaa

SEQ ID NO: 1151526 - DNA, 17 bp, Homo sapiens
gttttgttgacattctg

SEQ ID NO: 1151527 - DNA, 12 bp, Homo sapiens
gttttgttgagc

SEQ ID NO: 1151528 - DNA, 12 bp, Homo sapiens
gttttgttgcta

SEQ ID NO: 1151529 - DNA, 21 bp, Homo sapiens
gttttgttttctaagatgttc

SEQ ID NO: 1151530 - DNA, 20 bp, Homo sapiens
gttttgttttttgtttctaa

SEQ ID NO: 1151531 - DNA, 15 bp, Homo sapiens
gtttttaaaaagcaa

SEQ ID NO: 1151532 - DNA, 13 bp, Homo sapiens
gtttttaaactgt

SEQ ID NO: 1151533 - DNA, 14 bp, Homo sapiens
gtttttaaactgta

SEQ ID NO: 1151534 - DNA, 16 bp, Homo sapiens
gtttttaaactgtaca

SEQ ID NO: 1151535 - DNA, 18 bp, Homo sapiens
gtttttaatataaagcct

SEQ ID NO: 1151536 - DNA, 20 bp, Homo sapiens
gtttttaatctttgtgacag

SEQ ID NO: 1151537 - DNA, 18 bp, Homo sapiens
gtttttaatgtatagtaa

SEQ ID NO: 1151538 - DNA, 17 bp, Homo sapiens
gtttttacagctgtgtt

SEQ ID NO: 1151539 - DNA, 14 bp, Homo sapiens
gtttttacattcaa

SEQ ID NO: 1151540 - DNA, 21 bp, Homo sapiens
gtttttacctaccacagtgtc

SEQ ID NO: 1151541 - DNA, 22 bp, Homo sapiens
gtttttacctaccacagtgtct

SEQ ID NO: 1151542 - DNA, 17 bp, Homo sapiens
gtttttacctctgtctt

SEQ ID NO: 1151543 - DNA, 13 bp, Homo sapiens
gtttttagagaat

SEQ ID NO: 1151544 - DNA, 15 bp, Homo sapiens
gtttttagctttgtg

SEQ ID NO: 1151545 - DNA, 14 bp, Homo sapiens
gtttttatattact

SEQ ID NO: 1151546 - DNA, 16 bp, Homo sapiens
gtttttatattacttt

SEQ ID NO: 1151547 - DNA, 18 bp, Homo sapiens
gtttttatattacttttg

SEQ ID NO: 1151548 - DNA, 18 bp, Homo sapiens
gtttttatcaaatttgcc

SEQ ID NO: 1151549 - DNA, 23 bp, Homo sapiens
gtttttatggcttttgtgcatta

SEQ ID NO: 1151550 - DNA, 18 bp, Homo sapiens
gtttttatggggctgaac

SEQ ID NO: 1151551 - DNA, 17 bp, Homo sapiens
gtttttattaatttata

SEQ ID NO: 1151552 - DNA, 13 bp, Homo sapiens
gtttttattacaa

SEQ ID NO: 1151553 - DNA, 16 bp, Homo sapiens
gtttttattccttgtg

SEQ ID NO: 1151554 - DNA, 23 bp, Homo sapiens
gtttttattgctcgcccagacac

SEQ ID NO: 1151555 - DNA, 16 bp, Homo sapiens
gtttttcacattttcc

SEQ ID NO: 1151556 - DNA, 12 bp, Homo sapiens
gtttttcattca

SEQ ID NO: 1151557 - DNA, 21 bp, Homo sapiens
gtttttcatttgttttgcttt

SEQ ID NO: 1151558 - DNA, 15 bp, Homo sapiens
gtttttccactactg

SEQ ID NO: 1151559 - DNA, 15 bp, Homo sapiens
gtttttccctcccca

SEQ ID NO: 1151560 - DNA, 16 bp, Homo sapiens
gtttttccctccccag

SEQ ID NO: 1151561 - DNA, 13 bp, Homo sapiens
gtttttcctccca

SEQ ID NO: 1151562 - DNA, 20 bp, Homo sapiens
gtttttctatatagttcctt

SEQ ID NO: 1151563 - DNA, 11 bp, Homo sapiens
gtttttctcac

SEQ ID NO: 1151564 - DNA, 15 bp, Homo sapiens
gtttttctcatgtat

SEQ ID NO: 1151565 - DNA, 21 bp, Homo sapiens
gtttttctcgtccccctccct

SEQ ID NO: 1151566 - DNA, 22 bp, Homo sapiens
gtttttctcgtccccctccctg

SEQ ID NO: 1151567 - DNA, 14 bp, Homo sapiens
gtttttctgccagg

SEQ ID NO: 1151568 - DNA, 12 bp, Homo sapiens
gtttttcttggg

SEQ ID NO: 1151569 - DNA, 21 bp, Homo sapiens
gtttttctttaatatgattct

SEQ ID NO: 1151570 - DNA, 19 bp, Homo sapiens
gtttttgaaggcagaaagc

SEQ ID NO: 1151571 - DNA, 20 bp, Homo sapiens
gtttttgaaggcagaaagca

SEQ ID NO: 1151572 - DNA, 23 bp, Homo sapiens
gtttttgaggctttctgttgcca

SEQ ID NO: 1151573 - DNA, 22 bp, Homo sapiens
gtttttgataaagtaataatgt

SEQ ID NO: 1151574 - DNA, 12 bp, Homo sapiens
gtttttgcaact

SEQ ID NO: 1151575 - DNA, 16 bp, Homo sapiens
gtttttggaaagaaat

SEQ ID NO: 1151576 - DNA, 12 bp, Homo sapiens
taaaaggggccc

SEQ ID NO: 1151577 - DNA, 20 bp, Homo sapiens
taaaaggggcccaagcccca

SEQ ID NO: 1151578 - DNA, 19 bp, Homo sapiens
taaaagggggtccgtggaa

SEQ ID NO: 1151579 - DNA, 21 bp, Homo sapiens
taaaaggtagagtcttacaat

SEQ ID NO: 1151580 - DNA, 22 bp, Homo sapiens
taaaaggtattaaattgatgtt

SEQ ID NO: 1151581 - DNA, 17 bp, Homo sapiens
taaaaggtgcaggtgtg

SEQ ID NO: 1151582 - DNA, 20 bp, Homo sapiens
taaaaggtggagtttctctg

SEQ ID NO: 1151583 - DNA, 21 bp, Homo sapiens
taaaaggtggagtttctctgt

SEQ ID NO: 1151584 - DNA, 14 bp, Homo sapiens
taaaagtaaaatgt

SEQ ID NO: 1151585 - DNA, 13 bp, Homo sapiens
taaaagtaaacat

SEQ ID NO: 1151586 - DNA, 20 bp, Homo sapiens
taaaagtacatgttaaactt

SEQ ID NO: 1151587 - DNA, 21 bp, Homo sapiens
taaaagtaccacacaaactat

SEQ ID NO: 1151588 - DNA, 15 bp, Homo sapiens
taaaagtactttaaa

SEQ ID NO: 1151589 - DNA, 12 bp, Homo sapiens
taaaagtattca

SEQ ID NO: 1151590 - DNA, 14 bp, Homo sapiens
taaaagtattcata

SEQ ID NO: 1151591 - DNA, 14 bp, Homo sapiens
taaaagtgaagtga

SEQ ID NO: 1151592 - DNA, 13 bp, Homo sapiens
taaaagtgatcaa

SEQ ID NO: 1151593 - DNA, 17 bp, Homo sapiens
taaaagtgcacacctta

SEQ ID NO: 1151594 - DNA, 13 bp, Homo sapiens
taaaagtgcattt

SEQ ID NO: 1151595 - DNA, 14 bp, Homo sapiens
taaaagtgcattta

SEQ ID NO: 1151596 - DNA, 16 bp, Homo sapiens
taaaagtgcatttaag

SEQ ID NO: 1151597 - DNA, 17 bp, Homo sapiens
taaaagtggtctctgct

SEQ ID NO: 1151598 - DNA, 15 bp, Homo sapiens
taaaagtgtatttta

SEQ ID NO: 1151599 - DNA, 19 bp, Homo sapiens
taaaagtgttgattacata

SEQ ID NO: 1151600 - DNA, 14 bp, Homo sapiens
taaaagttataata

SEQ ID NO: 1151601 - DNA, 15 bp, Homo sapiens
taaaagttataataa

SEQ ID NO: 1151602 - DNA, 20 bp, Homo sapiens
taaaagttataataactgaa

SEQ ID NO: 1151603 - DNA, 21 bp, Homo sapiens
taaaagttataataactgaac

SEQ ID NO: 1151604 - DNA, 12 bp, Homo sapiens
taaaagttcttt

SEQ ID NO: 1151605 - DNA, 13 bp, Homo sapiens
taaaagttgcgtt

SEQ ID NO: 1151606 - DNA, 23 bp, Homo sapiens
taaaagttgtgcatgtatgtata

SEQ ID NO: 1151607 - DNA, 13 bp, Homo sapiens
taaaagtttcaat

SEQ ID NO: 1151608 - DNA, 21 bp, Homo sapiens
taaaagttttttattatgcat

SEQ ID NO: 1151609 - DNA, 22 bp, Homo sapiens
taaaagttttttattatgcatt

SEQ ID NO: 1151610 - DNA, 18 bp, Homo sapiens
taaaataaaaaagcaaaa

SEQ ID NO: 1151611 - DNA, 14 bp, Homo sapiens
taaaataaaaaagt

SEQ ID NO: 1151612 - DNA, 15 bp, Homo sapiens
taaaataaaacaagc

SEQ ID NO: 1151613 - DNA, 16 bp, Homo sapiens
taaaataaaacaagcc

SEQ ID NO: 1151614 - DNA, 17 bp, Homo sapiens
taaaataaaacaagcct

SEQ ID NO: 1151615 - DNA, 19 bp, Homo sapiens
taaaataaaacaagcctta

SEQ ID NO: 1151616 - DNA, 20 bp, Homo sapiens
taaaataaaacaagccttaa

SEQ ID NO: 1151617 - DNA, 14 bp, Homo sapiens
taaaataaaatgaa

SEQ ID NO: 1151618 - DNA, 17 bp, Homo sapiens
taaaataaaatgaaaat

SEQ ID NO: 1151619 - DNA, 20 bp, Homo sapiens
taaaataaaatgaaaattgt

SEQ ID NO: 1151620 - DNA, 21 bp, Homo sapiens
taaaataaaatgaaaattgta

SEQ ID NO: 1151621 - DNA, 15 bp, Homo sapiens
taaaataaaatgcct

SEQ ID NO: 1151622 - DNA, 12 bp, Homo sapiens
taaaataaactt

SEQ ID NO: 1151623 - DNA, 15 bp, Homo sapiens
taaaataaagcctat

SEQ ID NO: 1151624 - DNA, 22 bp, Homo sapiens
taaaataaagcctatttttcaa

SEQ ID NO: 1151625 - DNA, 13 bp, Homo sapiens
taaaataaagtat

SEQ ID NO: 1151626 - DNA, 13 bp, Homo sapiens
taaaataaataat

SEQ ID NO: 1151627 - DNA, 23 bp, Homo sapiens
taaaataaatatatataaaccta

SEQ ID NO: 1151628 - DNA, 12 bp, Homo sapiens
taaaataaatgg

SEQ ID NO: 1151629 - DNA, 16 bp, Homo sapiens
taaaataagcaggtgg

SEQ ID NO: 1151630 - DNA, 15 bp, Homo sapiens
taaaataagctcagt

SEQ ID NO: 1151631 - DNA, 20 bp, Homo sapiens
taaaataagctttctcagaa

SEQ ID NO: 1151632 - DNA, 19 bp, Homo sapiens
taaaataagtctgatttaa

SEQ ID NO: 1151633 - DNA, 21 bp, Homo sapiens
taaaataattttgtaatgtat

SEQ ID NO: 1151634 - DNA, 21 bp, Homo sapiens
taaaataccagccagtaaatg

SEQ ID NO: 1151635 - DNA, 22 bp, Homo sapiens
taaaataccagccagtaaatgg

SEQ ID NO: 1151636 - DNA, 18 bp, Homo sapiens
taaaatagaataattctt

SEQ ID NO: 1151637 - DNA, 23 bp, Homo sapiens
taaaatagaatgatagaactttg

SEQ ID NO: 1151638 - DNA, 13 bp, Homo sapiens
taaaatagcaaaa

SEQ ID NO: 1151639 - DNA, 21 bp, Homo sapiens
taaaatagcaaaagaagaagt

SEQ ID NO: 1151640 - DNA, 17 bp, Homo sapiens
taaaatagcatactgtg

SEQ ID NO: 1151641 - DNA, 17 bp, Homo sapiens
taaaatagcgttcttgt

SEQ ID NO: 1151642 - DNA, 21 bp, Homo sapiens
taaaatagcgttcttgtaatt

SEQ ID NO: 1151643 - DNA, 16 bp, Homo sapiens
taaaatagtatgaaaa

SEQ ID NO: 1151644 - DNA, 19 bp, Homo sapiens
taaaatatatgtatttaaa

SEQ ID NO: 1151645 - DNA, 20 bp, Homo sapiens
taaaatatatgtatttaaaa

SEQ ID NO: 1151646 - DNA, 13 bp, Homo sapiens
taaaatatatgtt

SEQ ID NO: 1151647 - DNA, 22 bp, Homo sapiens
taaaatatatgttctgcaagaa

SEQ ID NO: 1151648 - DNA, 18 bp, Homo sapiens
taaaatatcataaagcat

SEQ ID NO: 1151649 - DNA, 15 bp, Homo sapiens
taaaatatcctcagg

SEQ ID NO: 1151650 - DNA, 16 bp, Homo sapiens
taaaatatcttccttt

SEQ ID NO: 1151651 - DNA, 19 bp, Homo sapiens
taaaatatgaagacataaa

SEQ ID NO: 1151652 - DNA, 14 bp, Homo sapiens
taaaatatgtaaaa

SEQ ID NO: 1151653 - DNA, 15 bp, Homo sapiens
taaaatatgtgaagt

SEQ ID NO: 1151654 - DNA, 17 bp, Homo sapiens
taaaatattcgaaattc

SEQ ID NO: 1151655 - DNA, 11 bp, Homo sapiens
taaaatattta

SEQ ID NO: 1151656 - DNA, 12 bp, Homo sapiens
taaaatatttaa

SEQ ID NO: 1151657 - DNA, 23 bp, Homo sapiens
taaaatatttaaacctttttctt

SEQ ID NO: 1151658 - DNA, 20 bp, Homo sapiens
ttaaaaaaattggttggaga

SEQ ID NO: 1151659 - DNA, 23 bp, Homo sapiens
ttaaaaaaatttttataaattac

SEQ ID NO: 1151660 - DNA, 23 bp, Homo sapiens
ttaaaaaacaaaaaccagcaggt

SEQ ID NO: 1151661 - DNA, 13 bp, Homo sapiens
ttaaaaaactaaa

SEQ ID NO: 1151662 - DNA, 17 bp, Homo sapiens
ttaaaaaactattttat

SEQ ID NO: 1151663 - DNA, 20 bp, Homo sapiens
ttaaaaaacttcatgtaatt

SEQ ID NO: 1151664 - DNA, 13 bp, Homo sapiens
ttaaaaaacttgt

SEQ ID NO: 1151665 - DNA, 17 bp, Homo sapiens
ttaaaaaagaaatctgt

SEQ ID NO: 1151666 - DNA, 20 bp, Homo sapiens
ttaaaaaagactgaacatgt

SEQ ID NO: 1151667 - DNA, 13 bp, Homo sapiens
ttaaaaaagagac

SEQ ID NO: 1151668 - DNA, 19 bp, Homo sapiens
ttaaaaaagcttaaaactt

SEQ ID NO: 1151669 - DNA, 21 bp, Homo sapiens
ttaaaaaagcttaaaactttg

SEQ ID NO: 1151670 - DNA, 16 bp, Homo sapiens
ttaaaaaagtgatctt

SEQ ID NO: 1151671 - DNA, 19 bp, Homo sapiens
ttaaaaaataccattgaaa

SEQ ID NO: 1151672 - DNA, 23 bp, Homo sapiens
ttaaaaaataggtggtagatatt

SEQ ID NO: 1151673 - DNA, 16 bp, Homo sapiens
ttaaaaaatattttct

SEQ ID NO: 1151674 - DNA, 19 bp, Homo sapiens
ttaaaaaatcaatcaatgg

SEQ ID NO: 1151675 - DNA, 13 bp, Homo sapiens
ttaaaaaatgtcc

SEQ ID NO: 1151676 - DNA, 14 bp, Homo sapiens
ttaaaaaattaaaa

SEQ ID NO: 1151677 - DNA, 15 bp, Homo sapiens
ttaaaaaattaaaaa

SEQ ID NO: 1151678 - DNA, 21 bp, Homo sapiens
ttaaaaaattctcttaaataa

SEQ ID NO: 1151679 - DNA, 13 bp, Homo sapiens
ttaaaaacaaagg

SEQ ID NO: 1151680 - DNA, 16 bp, Homo sapiens
ttaaaaacatagaaaa

SEQ ID NO: 1151681 - DNA, 18 bp, Homo sapiens
ttaaaaaccgaataaatg

SEQ ID NO: 1151682 - DNA, 16 bp, Homo sapiens
ttaaaaactcacttac

SEQ ID NO: 1151683 - DNA, 13 bp, Homo sapiens
ttaaaaactggaa

SEQ ID NO: 1151684 - DNA, 11 bp, Homo sapiens
ttaaaaactgt

SEQ ID NO: 1151685 - DNA, 14 bp, Homo sapiens
ttaaaaactgtgta

SEQ ID NO: 1151686 - DNA, 23 bp, Homo sapiens
ttaaaaactgtgtatcattaaaa

SEQ ID NO: 1151687 - DNA, 20 bp, Homo sapiens
ttaaaaagaaaagtttataa

SEQ ID NO: 1151688 - DNA, 20 bp, Homo sapiens
ttaaaaagctcactgctgat

SEQ ID NO: 1151689 - DNA, 22 bp, Homo sapiens
ttaaaaaggaaatttgtttgta

SEQ ID NO: 1151690 - DNA, 18 bp, Homo sapiens
ttaaaaagggaagaaact

SEQ ID NO: 1151691 - DNA, 20 bp, Homo sapiens
ttaaaaagggagaaagaaaa

SEQ ID NO: 1151692 - DNA, 17 bp, Homo sapiens
ttaaaaaggtaaatggt

SEQ ID NO: 1151693 - DNA, 14 bp, Homo sapiens
ttaaaaagtcttca

SEQ ID NO: 1151694 - DNA, 15 bp, Homo sapiens
ttaaaaataagtcaa

SEQ ID NO: 1151695 - DNA, 20 bp, Homo sapiens
ttaaaaataccaatcacaag

SEQ ID NO: 1151696 - DNA, 18 bp, Homo sapiens
ttaaaaataccttctatg

SEQ ID NO: 1151697 - DNA, 15 bp, Homo sapiens
ttaaaaatataaaac

SEQ ID NO: 1151698 - DNA, 18 bp, Homo sapiens
taaaatgcatactgttga

SEQ ID NO: 1151699 - DNA, 24 bp, Homo sapiens
taaaatgcatactgttgatacaaa

SEQ ID NO: 1151700 - DNA, 19 bp, Homo sapiens
taaaatgcatgattttgta

SEQ ID NO: 1151701 - DNA, 20 bp, Homo sapiens
taaaatgcctcagtgtattt

SEQ ID NO: 1151702 - DNA, 21 bp, Homo sapiens
taaaatgcctcagtgtatttg

SEQ ID NO: 1151703 - DNA, 12 bp, Homo sapiens
taaaatgcgaaa

SEQ ID NO: 1151704 - DNA, 15 bp, Homo sapiens
taaaatgcgaaatta

SEQ ID NO: 1151705 - DNA, 21 bp, Homo sapiens
taaaatgcgaaattattggtt

SEQ ID NO: 1151706 - DNA, 11 bp, Homo sapiens
taaaatgctgc

SEQ ID NO: 1151707 - DNA, 23 bp, Homo sapiens
taaaatggacacaaattttcaag

SEQ ID NO: 1151708 - DNA, 23 bp, Homo sapiens
taaaatggacattttcttttatt

SEQ ID NO: 1151709 - DNA, 13 bp, Homo sapiens
taaaatggcacct

SEQ ID NO: 1151710 - DNA, 20 bp, Homo sapiens
taaaatggcaccttccccct

SEQ ID NO: 1151711 - DNA, 18 bp, Homo sapiens
taaaatggctgtaatcat

SEQ ID NO: 1151712 - DNA, 16 bp, Homo sapiens
taaaatggtacatttc

SEQ ID NO: 1151713 - DNA, 16 bp, Homo sapiens
taaaatggtgttttca

SEQ ID NO: 1151714 - DNA, 15 bp, Homo sapiens
taaaatgtataaatt

SEQ ID NO: 1151715 - DNA, 13 bp, Homo sapiens
taaaatgtatatt

SEQ ID NO: 1151716 - DNA, 12 bp, Homo sapiens
taaaatgtatta

SEQ ID NO: 1151717 - DNA, 21 bp, Homo sapiens
taaaatgtcagtgtttgggaa

SEQ ID NO: 1151718 - DNA, 23 bp, Homo sapiens
taaaatgtcccagtgtcagtatt

SEQ ID NO: 1151719 - DNA, 20 bp, Homo sapiens
taaaatgtctttccaaatta

SEQ ID NO: 1151720 - DNA, 22 bp, Homo sapiens
taaaatgtctttccaaattatt

SEQ ID NO: 1151721 - DNA, 21 bp, Homo sapiens
taaaatgtgatttttcttcag

SEQ ID NO: 1151722 - DNA, 14 bp, Homo sapiens
taaaatgtgtacag

SEQ ID NO: 1151723 - DNA, 17 bp, Homo sapiens
taaaatgtgtacagtga

SEQ ID NO: 1151724 - DNA, 19 bp, Homo sapiens
taaaatgtgtacagtgaat

SEQ ID NO: 1151725 - DNA, 14 bp, Homo sapiens
taaaatgttaaaac

SEQ ID NO: 1151726 - DNA, 17 bp, Homo sapiens
taaaatgttcacttttg

SEQ ID NO: 1151727 - DNA, 13 bp, Homo sapiens
taaaatgttcagt

SEQ ID NO: 1151728 - DNA, 15 bp, Homo sapiens
taaaattaaaagttt

SEQ ID NO: 1151729 - DNA, 19 bp, Homo sapiens
taaaattaaatgccttgta

SEQ ID NO: 1151730 - DNA, 18 bp, Homo sapiens
taaaattaagtagaacaa

SEQ ID NO: 1151731 - DNA, 15 bp, Homo sapiens
taaaattaagttgaa

SEQ ID NO: 1151732 - DNA, 18 bp, Homo sapiens
taaaattaagttgaaaaa

SEQ ID NO: 1151733 - DNA, 14 bp, Homo sapiens
taaaattacaaaag

SEQ ID NO: 1151734 - DNA, 16 bp, Homo sapiens
taaaattacaaaagag

SEQ ID NO: 1151735 - DNA, 12 bp, Homo sapiens
taaaattactat

SEQ ID NO: 1151736 - DNA, 17 bp, Homo sapiens
taaaattaggactgtat

SEQ ID NO: 1151737 - DNA, 13 bp, Homo sapiens
taaaattagtctt

SEQ ID NO: 1151738 - DNA, 14 bp, Homo sapiens
taaaattatactgt

SEQ ID NO: 1151739 - DNA, 20 bp, Homo sapiens
taaaattatactgtgtgtga

SEQ ID NO: 1151740 - DNA, 15 bp, Homo sapiens
taaaattatttcatg

SEQ ID NO: 1151741 - DNA, 19 bp, Homo sapiens
taaaattcaagaaaataaa

SEQ ID NO: 1151742 - DNA, 14 bp, Homo sapiens
taaaattcagtttt

SEQ ID NO: 1151743 - DNA, 19 bp, Homo sapiens
taaaattcagtttttgtat

SEQ ID NO: 1151744 - DNA, 22 bp, Homo sapiens
taaaattcagtttttgtatctt

SEQ ID NO: 1151745 - DNA, 23 bp, Homo sapiens
taaaattcagtttttgtatcttg

SEQ ID NO: 1151746 - DNA, 12 bp, Homo sapiens
taaaattccact

SEQ ID NO: 1151747 - DNA, 17 bp, Homo sapiens
taaaattcgctttctaa

SEQ ID NO: 1151748 - DNA, 20 bp, Homo sapiens
taaaattgcagtttcatgta

SEQ ID NO: 1151749 - DNA, 18 bp, Homo sapiens
taaaattgctatgttact

SEQ ID NO: 1151750 - DNA, 16 bp, Homo sapiens
taaaattgtatgaaaa

SEQ ID NO: 1151751 - DNA, 12 bp, Homo sapiens
taaaattgtgat

SEQ ID NO: 1151752 - DNA, 18 bp, Homo sapiens
taaaattgtgatgttttg

SEQ ID NO: 1151753 - DNA, 19 bp, Homo sapiens
taaaattgtgatgttttgt

SEQ ID NO: 1151754 - DNA, 12 bp, Homo sapiens
taaaattgttat

SEQ ID NO: 1151755 - DNA, 16 bp, Homo sapiens
taaaattgttatcaaa

SEQ ID NO: 1151756 - DNA, 15 bp, Homo sapiens
taaaattgttcctga

SEQ ID NO: 1151757 - DNA, 18 bp, Homo sapiens
taaaatttaacttcttca

SEQ ID NO: 1151758 - DNA, 14 bp, Homo sapiens
taaaatttatattg

SEQ ID NO: 1151759 - DNA, 17 bp, Homo sapiens
taaaatttatattgtaa

SEQ ID NO: 1151760 - DNA, 16 bp, Homo sapiens
taaaatttatttatat

SEQ ID NO: 1151761 - DNA, 20 bp, Homo sapiens
taaaatttcataattctgaa

SEQ ID NO: 1151762 - DNA, 18 bp, Homo sapiens
taaaatttccttcaggtt

SEQ ID NO: 1151763 - DNA, 19 bp, Homo sapiens
taaaatttccttcaggttt

SEQ ID NO: 1151764 - DNA, 20 bp, Homo sapiens
taaaatttccttcaggtttt

SEQ ID NO: 1151765 - DNA, 16 bp, Homo sapiens
taaaatttgtgtaaat

SEQ ID NO: 1151766 - DNA, 15 bp, Homo sapiens
taaaatttgttgcat

SEQ ID NO: 1151767 - DNA, 14 bp, Homo sapiens
taaaatttgttgtt

SEQ ID NO: 1151768 - DNA, 13 bp, Homo sapiens
taaaattttaatt

SEQ ID NO: 1151769 - DNA, 17 bp, Homo sapiens
taaaattttaatttcta

SEQ ID NO: 1151770 - DNA, 22 bp, Homo sapiens
taaaattttgaaccattcccta

SEQ ID NO: 1151771 - DNA, 19 bp, Homo sapiens
taaaattttgcttttaatt

SEQ ID NO: 1151772 - DNA, 18 bp, Homo sapiens
taaacaaaatagaaagtt

SEQ ID NO: 1151773 - DNA, 19 bp, Homo sapiens
taaacaaaatttcacagtt

SEQ ID NO: 1151774 - DNA, 17 bp, Homo sapiens
taaacaaactcttgaag

SEQ ID NO: 1151775 - DNA, 13 bp, Homo sapiens
taaacaaagcagt

SEQ ID NO: 1151776 - DNA, 18 bp, Homo sapiens
taaacaaagtgactgttt

SEQ ID NO: 1151777 - DNA, 18 bp, Homo sapiens
taaacaacgcattgccac

SEQ ID NO: 1151778 - DNA, 22 bp, Homo sapiens
taaacaacgcattgccacggaa

SEQ ID NO: 1151779 - DNA, 18 bp, Homo sapiens
taaacaagaccacgtttc

SEQ ID NO: 1151780 - DNA, 20 bp, Homo sapiens
taaacaagaccacgtttcta

SEQ ID NO: 1151781 - DNA, 15 bp, Homo sapiens
taaacaagattttaa

SEQ ID NO: 1151782 - DNA, 20 bp, Homo sapiens
taaacaagattttaaagaca

SEQ ID NO: 1151783 - DNA, 18 bp, Homo sapiens
taaacaaggtcatacata

SEQ ID NO: 1151784 - DNA, 18 bp, Homo sapiens
taaacaagtaagaaaaat

SEQ ID NO: 1151785 - DNA, 21 bp, Homo sapiens
taaacaatgctgatttggtga

SEQ ID NO: 1151786 - DNA, 19 bp, Homo sapiens
ttaaaatggtttgtcctga

SEQ ID NO: 1151787 - DNA, 11 bp, Homo sapiens
ttaaaatgtga

SEQ ID NO: 1151788 - DNA, 13 bp, Homo sapiens
ttaaaatgttcac

SEQ ID NO: 1151789 - DNA, 17 bp, Homo sapiens
ttaaaatgtttggatgg

SEQ ID NO: 1151790 - DNA, 14 bp, Homo sapiens
ttaaaattagtctt

SEQ ID NO: 1151791 - DNA, 13 bp, Homo sapiens
ttaaaattcatgt

SEQ ID NO: 1151792 - DNA, 18 bp, Homo sapiens
ttaaaattctgaattttg

SEQ ID NO: 1151793 - DNA, 13 bp, Homo sapiens
ttaaaattggcac

SEQ ID NO: 1151794 - DNA, 17 bp, Homo sapiens
ttaaaatttgtcttaaa

SEQ ID NO: 1151795 - DNA, 23 bp, Homo sapiens
ttaaaattttggaatatttgctt

SEQ ID NO: 1151796 - DNA, 18 bp, Homo sapiens
ttaaacaaaatgaaaata

SEQ ID NO: 1151797 - DNA, 19 bp, Homo sapiens
ttaaacaaaatttcacagt

SEQ ID NO: 1151798 - DNA, 21 bp, Homo sapiens
ttaaacaaaatttcacagttc

SEQ ID NO: 1151799 - DNA, 13 bp, Homo sapiens
ttaaacaaagtga

SEQ ID NO: 1151800 - DNA, 18 bp, Homo sapiens
ttaaacaaatatgaaaaa

SEQ ID NO: 1151801 - DNA, 23 bp, Homo sapiens
ttaaacaaatatgaaaaatgtaa

SEQ ID NO: 1151802 - DNA, 17 bp, Homo sapiens
ttaaacaatctttcatg

SEQ ID NO: 1151803 - DNA, 14 bp, Homo sapiens
ttaaacaatgatca

SEQ ID NO: 1151804 - DNA, 18 bp, Homo sapiens
ttaaacaatgtataaaga

SEQ ID NO: 1151805 - DNA, 12 bp, Homo sapiens
ttaaacacacag

SEQ ID NO: 1151806 - DNA, 23 bp, Homo sapiens
ttaaacacacagatacacacaca

SEQ ID NO: 1151807 - DNA, 16 bp, Homo sapiens
ttaaacacctcctcat

SEQ ID NO: 1151808 - DNA, 17 bp, Homo sapiens
ttaaacactgtaatctt

SEQ ID NO: 1151809 - DNA, 21 bp, Homo sapiens
ttaaacagtagttgtattctt

SEQ ID NO: 1151810 - DNA, 16 bp, Homo sapiens
ttaaacagtatttcat

SEQ ID NO: 1151811 - DNA, 16 bp, Homo sapiens
ttaaacataaagaatt

SEQ ID NO: 1151812 - DNA, 19 bp, Homo sapiens
ttaaacattaatagcagcc

SEQ ID NO: 1151813 - DNA, 12 bp, Homo sapiens
ttaaacatttca

SEQ ID NO: 1151814 - DNA, 19 bp, Homo sapiens
ttaaacccacaagctgcct

SEQ ID NO: 1151815 - DNA, 15 bp, Homo sapiens
ttaaacccatacaat

SEQ ID NO: 1151816 - DNA, 18 bp, Homo sapiens
ttaaacccatacaatgta

SEQ ID NO: 1151817 - DNA, 20 bp, Homo sapiens
ttaaacccatacaatgtatg

SEQ ID NO: 1151818 - DNA, 21 bp, Homo sapiens
ttaaacccatacaatgtatgt

SEQ ID NO: 1151819 - DNA, 19 bp, Homo sapiens
ttaaaccctttagtgcttt

SEQ ID NO: 1151820 - DNA, 16 bp, Homo sapiens
taaactttttaaaata

SEQ ID NO: 1151821 - DNA, 17 bp, Homo sapiens
taaactttttaaaatac

SEQ ID NO: 1151822 - DNA, 21 bp, Homo sapiens
taaactttttcaatggttggg

SEQ ID NO: 1151823 - DNA, 17 bp, Homo sapiens
taaacttttttttgaga

SEQ ID NO: 1151824 - DNA, 16 bp, Homo sapiens
taaagaaaaaaattga

SEQ ID NO: 1151825 - DNA, 18 bp, Homo sapiens
taaagaaaaaaattgaaa

SEQ ID NO: 1151826 - DNA, 20 bp, Homo sapiens
taaagaaaaaaattgaaatg

SEQ ID NO: 1151827 - DNA, 14 bp, Homo sapiens
taaagaaaaacaaa

SEQ ID NO: 1151828 - DNA, 15 bp, Homo sapiens
taaagaaaaacaaac

SEQ ID NO: 1151829 - DNA, 13 bp, Homo sapiens
taaagaaaaagaa

SEQ ID NO: 1151830 - DNA, 16 bp, Homo sapiens
taaagaaaaagaagta

SEQ ID NO: 1151831 - DNA, 20 bp, Homo sapiens
taaagaaaaatatcttggcc

SEQ ID NO: 1151832 - DNA, 16 bp, Homo sapiens
taaagaaaaatgcctg

SEQ ID NO: 1151833 - DNA, 13 bp, Homo sapiens
taaagaaaaccat

SEQ ID NO: 1151834 - DNA, 13 bp, Homo sapiens
taaagaaaacttc

SEQ ID NO: 1151835 - DNA, 15 bp, Homo sapiens
taaagaaaagatgaa

SEQ ID NO: 1151836 - DNA, 23 bp, Homo sapiens
taaagaaacagctttcaagtgcc

SEQ ID NO: 1151837 - DNA, 14 bp, Homo sapiens
taaagaaacatttc

SEQ ID NO: 1151838 - DNA, 17 bp, Homo sapiens
taaagaaagtcgaatta

SEQ ID NO: 1151839 - DNA, 11 bp, Homo sapiens
taaagaaagtg

SEQ ID NO: 1151840 - DNA, 15 bp, Homo sapiens
taaagaaagtgtatt

SEQ ID NO: 1151841 - DNA, 13 bp, Homo sapiens
taaagaaatattt

SEQ ID NO: 1151842 - DNA, 16 bp, Homo sapiens
taaagaaattgcaata

SEQ ID NO: 1151843 - DNA, 15 bp, Homo sapiens
taaagaaatttggta

SEQ ID NO: 1151844 - DNA, 16 bp, Homo sapiens
taaagaaatttggtac

SEQ ID NO: 1151845 - DNA, 13 bp, Homo sapiens
taaagaacagtga

SEQ ID NO: 1151846 - DNA, 17 bp, Homo sapiens
taaagaactccttattt

SEQ ID NO: 1151847 - DNA, 21 bp, Homo sapiens
taaagaactccttattttgta

SEQ ID NO: 1151848 - DNA, 23 bp, Homo sapiens
taaagaacttaaattatgtttta

SEQ ID NO: 1151849 - DNA, 20 bp, Homo sapiens
taaagaagagtgacttattt

SEQ ID NO: 1151850 - DNA, 19 bp, Homo sapiens
taaagaagtatttttagaa

SEQ ID NO: 1151851 - DNA, 18 bp, Homo sapiens
taaagaagtttgaacatt

SEQ ID NO: 1151852 - DNA, 20 bp, Homo sapiens
taaagaattggtcttaatgt

SEQ ID NO: 1151853 - DNA, 19 bp, Homo sapiens
taaagaattttcatcccgt

SEQ ID NO: 1151854 - DNA, 20 bp, Homo sapiens
taaagacaaagacaaattct

SEQ ID NO: 1151855 - DNA, 20 bp, Homo sapiens
taaagacacatcttattgaa

SEQ ID NO: 1151856 - DNA, 10 bp, Homo sapiens
taaagacagg

SEQ ID NO: 1151857 - DNA, 15 bp, Homo sapiens
taaagacaggagaca

SEQ ID NO: 1151858 - DNA, 21 bp, Homo sapiens
taaagacagggaagagcagaa

SEQ ID NO: 1151859 - DNA, 19 bp, Homo sapiens
taaagacgtctctttttgg

SEQ ID NO: 1151860 - DNA, 21 bp, Homo sapiens
taaagacgtctctttttggta

SEQ ID NO: 1151861 - DNA, 13 bp, Homo sapiens
taaagactggttt

SEQ ID NO: 1151862 - DNA, 22 bp, Homo sapiens
taaagactggttttctgccaat

SEQ ID NO: 1151863 - DNA, 18 bp, Homo sapiens
taaagactgtgctgagaa

SEQ ID NO: 1151864 - DNA, 19 bp, Homo sapiens
taaagactgtgctgagaag

SEQ ID NO: 1151865 - DNA, 21 bp, Homo sapiens
taaagactgtggaaatgccaa

SEQ ID NO: 1151866 - DNA, 23 bp, Homo sapiens
taaagagaaaagggaaaaaagaa

SEQ ID NO: 1151867 - DNA, 12 bp, Homo sapiens
taaagagaagac

SEQ ID NO: 1151868 - DNA, 13 bp, Homo sapiens
taaagagacgaat

SEQ ID NO: 1151869 - DNA, 16 bp, Homo sapiens
taaagagagtttgcca

SEQ ID NO: 1151870 - DNA, 23 bp, Homo sapiens
taaagagatttcccttcatttaa

SEQ ID NO: 1151871 - DNA, 20 bp, Homo sapiens
taaagagcatctgattcttg

SEQ ID NO: 1151872 - DNA, 23 bp, Homo sapiens
taaagagcatggaaaaatactgc

SEQ ID NO: 1151873 - DNA, 15 bp, Homo sapiens
taaagagcccttgcc

SEQ ID NO: 1151874 - DNA, 17 bp, Homo sapiens
taaagagcccttgcctc

SEQ ID NO: 1151875 - DNA, 17 bp, Homo sapiens
taaagaggagtgttatt

SEQ ID NO: 1151876 - DNA, 21 bp, Homo sapiens
taaagaggagtgttattgcat

SEQ ID NO: 1151877 - DNA, 21 bp, Homo sapiens
taaagaggcatcttttctaga

SEQ ID NO: 1151878 - DNA, 17 bp, Homo sapiens
taaagaggctgaaagag

SEQ ID NO: 1151879 - DNA, 20 bp, Homo sapiens
taaagatatatagagatgca

SEQ ID NO: 1151880 - DNA, 17 bp, Homo sapiens
taaagatatcagagctc

SEQ ID NO: 1151881 - DNA, 18 bp, Homo sapiens
taaagatatttttatctt

SEQ ID NO: 1151882 - DNA, 21 bp, Homo sapiens
taaagatatttttatctttat

SEQ ID NO: 1151883 - DNA, 22 bp, Homo sapiens
taaagatatttttatctttata

SEQ ID NO: 1151884 - DNA, 23 bp, Homo sapiens
taaagatcacacatcaagactat

SEQ ID NO: 1151885 - DNA, 19 bp, Homo sapiens
taaagatgagctttgtcta

SEQ ID NO: 1151886 - DNA, 21 bp, Homo sapiens
taaagatgcaaggaccaggac

SEQ ID NO: 1151887 - DNA, 19 bp, Homo sapiens
taaagatgccatagcataa

SEQ ID NO: 1151888 - DNA, 13 bp, Homo sapiens
taaagatggaaaa

SEQ ID NO: 1151889 - DNA, 17 bp, Homo sapiens
taaagatgggaggagac

SEQ ID NO: 1151890 - DNA, 14 bp, Homo sapiens
taaagatgttaaat

SEQ ID NO: 1151891 - DNA, 15 bp, Homo sapiens
taaagattagggaaa

SEQ ID NO: 1151892 - DNA, 20 bp, Homo sapiens
taaagattagggaaaatgga

SEQ ID NO: 1151893 - DNA, 11 bp, Homo sapiens
taaagattatt

SEQ ID NO: 1151894 - DNA, 17 bp, Homo sapiens
taaagattctctttaaa

SEQ ID NO: 1151895 - DNA, 19 bp, Homo sapiens
taaagattctctttaaaaa

SEQ ID NO: 1151896 - DNA, 15 bp, Homo sapiens
taaagattgtactta

SEQ ID NO: 1151897 - DNA, 18 bp, Homo sapiens
taaagcaaactatgattt

SEQ ID NO: 1151898 - DNA, 20 bp, Homo sapiens
taaagcaaactatgatttat

SEQ ID NO: 1151899 - DNA, 14 bp, Homo sapiens
taaagcaaattact

SEQ ID NO: 1151900 - DNA, 15 bp, Homo sapiens
taaagcaaattgttt

SEQ ID NO: 1151901 - DNA, 20 bp, Homo sapiens
taaagcaactgttatgaaat

SEQ ID NO: 1151902 - DNA, 23 bp, Homo sapiens
taaagcaataatggtcccatcca

SEQ ID NO: 1151903 - DNA, 15 bp, Homo sapiens
taaagcaatatgcat

SEQ ID NO: 1151904 - DNA, 15 bp, Homo sapiens
taaagcagacagtca

SEQ ID NO: 1151905 - DNA, 13 bp, Homo sapiens
taaagcagagcca

SEQ ID NO: 1151906 - DNA, 20 bp, Homo sapiens
taaagcagagccaaggccac

SEQ ID NO: 1151907 - DNA, 12 bp, Homo sapiens
taaagcagatta

SEQ ID NO: 1151908 - DNA, 17 bp, Homo sapiens
taaagcagattacctct

SEQ ID NO: 1151909 - DNA, 14 bp, Homo sapiens
taaagcagtatttt

SEQ ID NO: 1151910 - DNA, 17 bp, Homo sapiens
taaagcagtatttttct

SEQ ID NO: 1151911 - DNA, 13 bp, Homo sapiens
taaagcagttaat

SEQ ID NO: 1151912 - DNA, 21 bp, Homo sapiens
taaagcatcagagatggtaat

SEQ ID NO: 1151913 - DNA, 15 bp, Homo sapiens
taaagcattactctt

SEQ ID NO: 1151914 - DNA, 23 bp, Homo sapiens
taaagcattcaatttattcaaga

SEQ ID NO: 1151915 - DNA, 19 bp, Homo sapiens
taaagcatttagaaaactt

SEQ ID NO: 1151916 - DNA, 13 bp, Homo sapiens
taaagcatttttt

SEQ ID NO: 1151917 - DNA, 15 bp, Homo sapiens
taaagccacttctgg

SEQ ID NO: 1151918 - DNA, 19 bp, Homo sapiens
taaagccatgttaaatgac

SEQ ID NO: 1151919 - DNA, 13 bp, Homo sapiens
ttaacagaaattg

SEQ ID NO: 1151920 - DNA, 19 bp, Homo sapiens
ttaacagaaattgtatatt

SEQ ID NO: 1151921 - DNA, 14 bp, Homo sapiens
ttaacagagacaga

SEQ ID NO: 1151922 - DNA, 22 bp, Homo sapiens
ttaacagggtctctagtgctgt

SEQ ID NO: 1151923 - DNA, 14 bp, Homo sapiens
ttaacagtatttct

SEQ ID NO: 1151924 - DNA, 14 bp, Homo sapiens
ttaacagttttcca

SEQ ID NO: 1151925 - DNA, 12 bp, Homo sapiens
ttaacataccta

SEQ ID NO: 1151926 - DNA, 14 bp, Homo sapiens
ttaacatcatgaat

SEQ ID NO: 1151927 - DNA, 17 bp, Homo sapiens
ttaacatctttgttttt

SEQ ID NO: 1151928 - DNA, 22 bp, Homo sapiens
ttaacatgaacacccttagaaa

SEQ ID NO: 1151929 - DNA, 15 bp, Homo sapiens
ttaacatgtgttaaa

SEQ ID NO: 1151930 - DNA, 16 bp, Homo sapiens
ttaacattcacagccc

SEQ ID NO: 1151931 - DNA, 14 bp, Homo sapiens
ttaacattctgtaa

SEQ ID NO: 1151932 - DNA, 19 bp, Homo sapiens
ttaacattgacttcttggt

SEQ ID NO: 1151933 - DNA, 22 bp, Homo sapiens
ttaacatttgtgtaatatgaaa

SEQ ID NO: 1151934 - DNA, 12 bp, Homo sapiens
ttaaccaaaggt

SEQ ID NO: 1151935 - DNA, 13 bp, Homo sapiens
ttaaccaaaggtg

SEQ ID NO: 1151936 - DNA, 15 bp, Homo sapiens
ttaaccaaggagggg

SEQ ID NO: 1151937 - DNA, 17 bp, Homo sapiens
ttaaccaaggaggggcc

SEQ ID NO: 1151938 - DNA, 15 bp, Homo sapiens
ttaaccacagtgaaa

SEQ ID NO: 1151939 - DNA, 23 bp, Homo sapiens
ttaaccaccgcatatgcatgcca

SEQ ID NO: 1151940 - DNA, 17 bp, Homo sapiens
ttaaccacttgcctctt

SEQ ID NO: 1151941 - DNA, 22 bp, Homo sapiens
ttaaccagtctgaagtttcatt

SEQ ID NO: 1151942 - DNA, 18 bp, Homo sapiens
ttaaggagggagaaagga

SEQ ID NO: 1151943 - DNA, 20 bp, Homo sapiens
ttaaggagggagaaaggaga

SEQ ID NO: 1151944 - DNA, 22 bp, Homo sapiens
ttaaggataaatcataaagtca

SEQ ID NO: 1151945 - DNA, 23 bp, Homo sapiens
ttaaggataaatcataaagtcag

SEQ ID NO: 1151946 - DNA, 17 bp, Homo sapiens
ttaaggatgcttgtaca

SEQ ID NO: 1151947 - DNA, 14 bp, Homo sapiens
ttaaggcaaaaaag

SEQ ID NO: 1151948 - DNA, 21 bp, Homo sapiens
ttaaggcctaaggaagccagt

SEQ ID NO: 1151949 - DNA, 13 bp, Homo sapiens
ttaagggaaaaat

SEQ ID NO: 1151950 - DNA, 16 bp, Homo sapiens
ttaagggaaaaatata

SEQ ID NO: 1151951 - DNA, 19 bp, Homo sapiens
ttaagggggaaaactgttc

SEQ ID NO: 1151952 - DNA, 22 bp, Homo sapiens
ttaaggggggcagggagtgatg

SEQ ID NO: 1151953 - DNA, 19 bp, Homo sapiens
ttaagggtggaaaaatgcc

SEQ ID NO: 1151954 - DNA, 13 bp, Homo sapiens
ttaaggtctaact

SEQ ID NO: 1151955 - DNA, 14 bp, Homo sapiens
ttaaggtctccaaa

SEQ ID NO: 1151956 - DNA, 20 bp, Homo sapiens
ttaaggtgagcataaatcaa

SEQ ID NO: 1151957 - DNA, 15 bp, Homo sapiens
ttaagtaaaagtcta

SEQ ID NO: 1151958 - DNA, 18 bp, Homo sapiens
ttaagtaatgatactgtg

SEQ ID NO: 1151959 - DNA, 20 bp, Homo sapiens
ttaagtagaaaagttgcaga

SEQ ID NO: 1151960 - DNA, 17 bp, Homo sapiens
ttaagtatatagtatat

SEQ ID NO: 1151961 - DNA, 22 bp, Homo sapiens
ttaagtatctgggattattctt

SEQ ID NO: 1151962 - DNA, 23 bp, Homo sapiens
ttaagtatctgggattattcttt

SEQ ID NO: 1151963 - DNA, 13 bp, Homo sapiens
ttaagtatggaat

SEQ ID NO: 1151964 - DNA, 13 bp, Homo sapiens
ttaagtattgcat

SEQ ID NO: 1151965 - DNA, 21 bp, Homo sapiens
ttaagtattgcatctgtataa

SEQ ID NO: 1151966 - DNA, 16 bp, Homo sapiens
ttaagtatttatatat

SEQ ID NO: 1151967 - DNA, 16 bp, Homo sapiens
ttaagtcatcattact

SEQ ID NO: 1151968 - DNA, 15 bp, Homo sapiens
ttaagtctcgaatgt

SEQ ID NO: 1151969 - DNA, 19 bp, Homo sapiens
ttaagtctcgaatgtaatt

SEQ ID NO: 1151970 - DNA, 17 bp, Homo sapiens
ttaagtgaaaatatagc

SEQ ID NO: 1151971 - DNA, 20 bp, Homo sapiens
ttaagtgaaagagattactt

SEQ ID NO: 1151972 - DNA, 19 bp, Homo sapiens
ttaagtgaatacattaacg

SEQ ID NO: 1151973 - DNA, 14 bp, Homo sapiens
ttaagtgagcagaa

SEQ ID NO: 1151974 - DNA, 16 bp, Homo sapiens
ttaagtgcaattaaca

SEQ ID NO: 1151975 - DNA, 20 bp, Homo sapiens
ttaagtgccattactactgt

SEQ ID NO: 1151976 - DNA, 16 bp, Homo sapiens
ttaagtgctgcattta

SEQ ID NO: 1151977 - DNA, 19 bp, Homo sapiens
ttaagtgctgcatttaaaa

SEQ ID NO: 1151978 - DNA, 15 bp, Homo sapiens
ttaagtgcttacatt

SEQ ID NO: 1151979 - DNA, 22 bp, Homo sapiens
ttaagtggggtagactgaggga

SEQ ID NO: 1151980 - DNA, 16 bp, Homo sapiens
ttaagtggttactttg

SEQ ID NO: 1151981 - DNA, 18 bp, Homo sapiens
ttaagtggttactttgtg

SEQ ID NO: 1151982 - DNA, 21 bp, Homo sapiens
ttaagtgttgtaaatatttat

SEQ ID NO: 1151983 - DNA, 22 bp, Homo sapiens
ttaagttatagtgaatactgct

SEQ ID NO: 1151984 - DNA, 14 bp, Homo sapiens
ttaagttgaaaaag

SEQ ID NO: 1151985 - DNA, 17 bp, Homo sapiens
ttaagtttctctgcaga

SEQ ID NO: 1151986 - DNA, 17 bp, Homo sapiens
ttaagtttctcttcacc

SEQ ID NO: 1151987 - DNA, 23 bp, Homo sapiens
ttaagttttgattaatgtttctt

SEQ ID NO: 1151988 - DNA, 17 bp, Homo sapiens
ttaagtttttttcctct

SEQ ID NO: 1151989 - DNA, 13 bp, Homo sapiens
ttaataaaacaac

SEQ ID NO: 1151990 - DNA, 14 bp, Homo sapiens
ttaataaaacctgt

SEQ ID NO: 1151991 - DNA, 21 bp, Homo sapiens
ttaataaaactgcgaggacat

SEQ ID NO: 1151992 - DNA, 23 bp, Homo sapiens
ttaataaaactgcgaggacatca

SEQ ID NO: 1151993 - DNA, 19 bp, Homo sapiens
ttaataaaagatttacatt

SEQ ID NO: 1151994 - DNA, 14 bp, Homo sapiens
ttaataaactactc

SEQ ID NO: 1151995 - DNA, 19 bp, Homo sapiens
ttaataaactactctttga

SEQ ID NO: 1151996 - DNA, 22 bp, Homo sapiens
ttaataaacttttttttgagaa

SEQ ID NO: 1151997 - DNA, 16 bp, Homo sapiens
ttaataaagaaaaaga

SEQ ID NO: 1151998 - DNA, 15 bp, Homo sapiens
ttaataaagaaatat

SEQ ID NO: 1151999 - DNA, 21 bp, Homo sapiens
ttaataaagaaatatttacct

SEQ ID NO: 1152000 - DNA, 14 bp, Homo sapiens
ttaataaagacagg

SEQ ID NO: 1152001 - DNA, 22 bp, Homo sapiens
ttaataaagacgatttgtcagt

SEQ ID NO: 1152002 - DNA, 15 bp, Homo sapiens
ttaataaagatgagt

SEQ ID NO: 1152003 - DNA, 14 bp, Homo sapiens
ttaataaagcattc

SEQ ID NO: 1152004 - DNA, 22 bp, Homo sapiens
ttaataaaggtttaaagctgaa

SEQ ID NO: 1152005 - DNA, 17 bp, Homo sapiens
ttaataaatatgtaata

SEQ ID NO: 1152006 - DNA, 14 bp, Homo sapiens
ttaataaattccat

SEQ ID NO: 1152007 - DNA, 12 bp, Homo sapiens
ttaataacaatt

SEQ ID NO: 1152008 - DNA, 16 bp, Homo sapiens
ttaataacagctcctt

SEQ ID NO: 1152009 - DNA, 21 bp, Homo sapiens
ttaataatgtattgtaatctt

SEQ ID NO: 1152010 - DNA, 19 bp, Homo sapiens
ttaataatttagacttcaa

SEQ ID NO: 1152011 - DNA, 20 bp, Homo sapiens
ttaatacacagtactttatt

SEQ ID NO: 1152012 - DNA, 22 bp, Homo sapiens
ttaatacagtttatttttaaag

SEQ ID NO: 1152013 - DNA, 15 bp, Homo sapiens
ttaatactaccttga

SEQ ID NO: 1152014 - DNA, 14 bp, Homo sapiens
ttaatactctattt

SEQ ID NO: 1152015 - DNA, 20 bp, Homo sapiens
ttaatagaaataaattccta

SEQ ID NO: 1152016 - DNA, 14 bp, Homo sapiens
ttaatagaatgata

SEQ ID NO: 1152017 - DNA, 16 bp, Homo sapiens
ttaatagaatgataaa

SEQ ID NO: 1152018 - DNA, 21 bp, Homo sapiens
ttaatagacagtagccaagtt

SEQ ID NO: 1152019 - DNA, 15 bp, Homo sapiens
ttaatagagatgaat

SEQ ID NO: 1152020 - DNA, 22 bp, Homo sapiens
ttaatagagatgaatcagtttt

SEQ ID NO: 1152021 - DNA, 11 bp, Homo sapiens
ttaatagagtt

SEQ ID NO: 1152022 - DNA, 16 bp, Homo sapiens
ttaatagattatttca

SEQ ID NO: 1152023 - DNA, 22 bp, Homo sapiens
ttaatagattatttcatatact

SEQ ID NO: 1152024 - DNA, 12 bp, Homo sapiens
ttaatagcacta

SEQ ID NO: 1152025 - DNA, 14 bp, Homo sapiens
ttaatagcagcctt

SEQ ID NO: 1152026 - DNA, 15 bp, Homo sapiens
ttaatagcagccttt

SEQ ID NO: 1152027 - DNA, 17 bp, Homo sapiens
ttaatagtaatttgtaa

SEQ ID NO: 1152028 - DNA, 15 bp, Homo sapiens
ttaatagtttgtcta

SEQ ID NO: 1152029 - DNA, 16 bp, Homo sapiens
ttaatagtttgtctat

SEQ ID NO: 1152030 - DNA, 14 bp, Homo sapiens
ttaatataaattca

SEQ ID NO: 1152031 - DNA, 13 bp, Homo sapiens
ttaatatacccca

SEQ ID NO: 1152032 - DNA, 21 bp, Homo sapiens
ttaatatagtgaaatggccac

SEQ ID NO: 1152033 - DNA, 17 bp, Homo sapiens
ttaatatatacattttt

SEQ ID NO: 1152034 - DNA, 19 bp, Homo sapiens
ttaatatatgtattattta

SEQ ID NO: 1152035 - DNA, 13 bp, Homo sapiens
ttaatatattaaa

SEQ ID NO: 1152036 - DNA, 16 bp, Homo sapiens
ttaatatattgaataa

SEQ ID NO: 1152037 - DNA, 18 bp, Homo sapiens
ttaatatcaactctgaag

SEQ ID NO: 1152038 - DNA, 17 bp, Homo sapiens
ttaatatcactcattaa

SEQ ID NO: 1152039 - DNA, 18 bp, Homo sapiens
ttaatatcactcattaat

SEQ ID NO: 1152040 - DNA, 14 bp, Homo sapiens
ttaatatcctaaac

SEQ ID NO: 1152041 - DNA, 19 bp, Homo sapiens
ttaatatcctaaacatcat

SEQ ID NO: 1152042 - DNA, 14 bp, Homo sapiens
ttaatatctggcac

SEQ ID NO: 1152043 - DNA, 16 bp, Homo sapiens
ttaatatctggcactg

SEQ ID NO: 1152044 - DNA, 18 bp, Homo sapiens
ttaatatctggcactgtt

SEQ ID NO: 1152045 - DNA, 14 bp, Homo sapiens
ttaatatgattcta

SEQ ID NO: 1152046 - DNA, 19 bp, Homo sapiens
ttaatatgctgcaacaaaa

SEQ ID NO: 1152047 - DNA, 19 bp, Homo sapiens
ttaatattaacttttaatg

SEQ ID NO: 1152048 - DNA, 23 bp, Homo sapiens
ttaatattactgtctttattctt

SEQ ID NO: 1152049 - DNA, 14 bp, Homo sapiens
taaataaaactgaa

SEQ ID NO: 1152050 - DNA, 19 bp, Homo sapiens
taaataaaagcagcatctg

SEQ ID NO: 1152051 - DNA, 17 bp, Homo sapiens
taaataaaagtgatcaa

SEQ ID NO: 1152052 - DNA, 19 bp, Homo sapiens
taaataaaagtgatcaata

SEQ ID NO: 1152053 - DNA, 14 bp, Homo sapiens
taaataaaataacc

SEQ ID NO: 1152054 - DNA, 18 bp, Homo sapiens
taaataaaatcatgtagt

SEQ ID NO: 1152055 - DNA, 17 bp, Homo sapiens
taaataaaatgtgtaca

SEQ ID NO: 1152056 - DNA, 21 bp, Homo sapiens
taaataaaatgtgtacagtga

SEQ ID NO: 1152057 - DNA, 20 bp, Homo sapiens
taaataaaatttgttgcata

SEQ ID NO: 1152058 - DNA, 20 bp, Homo sapiens
taaataaacagatgtattat

SEQ ID NO: 1152059 - DNA, 23 bp, Homo sapiens
taaataaacagatgtattatgct

SEQ ID NO: 1152060 - DNA, 15 bp, Homo sapiens
taaataaaccactgt

SEQ ID NO: 1152061 - DNA, 20 bp, Homo sapiens
taaataaagtatcatgcatt

SEQ ID NO: 1152062 - DNA, 20 bp, Homo sapiens
taaataaatgggtgtatata

SEQ ID NO: 1152063 - DNA, 20 bp, Homo sapiens
taaataacacagatattgtt

SEQ ID NO: 1152064 - DNA, 15 bp, Homo sapiens
taaatgacacccaga

SEQ ID NO: 1152065 - DNA, 18 bp, Homo sapiens
taaatgacacccagacct

SEQ ID NO: 1152066 - DNA, 15 bp, Homo sapiens
taaatgacttgattg

SEQ ID NO: 1152067 - DNA, 20 bp, Homo sapiens
taaatgacttgattgtactt

SEQ ID NO: 1152068 - DNA, 22 bp, Homo sapiens
taaatgagcaaatatcatactg

SEQ ID NO: 1152069 - DNA, 18 bp, Homo sapiens
taaatgagggtttctgat

SEQ ID NO: 1152070 - DNA, 20 bp, Homo sapiens
taaatgagggtttctgatct

SEQ ID NO: 1152071 - DNA, 23 bp, Homo sapiens
taaatgagggtttctgatctgta

SEQ ID NO: 1152072 - DNA, 15 bp, Homo sapiens
taaatgagttactta

SEQ ID NO: 1152073 - DNA, 14 bp, Homo sapiens
taaatgatgtgttg

SEQ ID NO: 1152074 - DNA, 16 bp, Homo sapiens
taaatgattagaagta

SEQ ID NO: 1152075 - DNA, 13 bp, Homo sapiens
taaatgattccaa

SEQ ID NO: 1152076 - DNA, 18 bp, Homo sapiens
taaatgattccaaataaa

SEQ ID NO: 1152077 - DNA, 17 bp, Homo sapiens
taaatgattcttagtga

SEQ ID NO: 1152078 - DNA, 12 bp, Homo sapiens
taaatgatttta

SEQ ID NO: 1152079 - DNA, 19 bp, Homo sapiens
taaatgcaaccatttgaaa

SEQ ID NO: 1152080 - DNA, 19 bp, Homo sapiens
taaatgcaatattaatgcc

SEQ ID NO: 1152081 - DNA, 16 bp, Homo sapiens
taaatgcaccaagaaa

SEQ ID NO: 1152082 - DNA, 21 bp, Homo sapiens
taaatgcatgtcttaaatgct

SEQ ID NO: 1152083 - DNA, 14 bp, Homo sapiens
taaatgcattatag

SEQ ID NO: 1152084 - DNA, 17 bp, Homo sapiens
taaatgcccagttcact

SEQ ID NO: 1152085 - DNA, 19 bp, Homo sapiens
taaatgccctttgatgttt

SEQ ID NO: 1152086 - DNA, 14 bp, Homo sapiens
taaatgccttgtat

SEQ ID NO: 1152087 - DNA, 13 bp, Homo sapiens
taaatgctatttt

SEQ ID NO: 1152088 - DNA, 15 bp, Homo sapiens
taaatgctatttttt

SEQ ID NO: 1152089 - DNA, 20 bp, Homo sapiens
taaatgctcattttctggtt

SEQ ID NO: 1152090 - DNA, 20 bp, Homo sapiens
taaatgctcattttctttag

SEQ ID NO: 1152091 - DNA, 17 bp, Homo sapiens
taaatgctcgtgtgatt

SEQ ID NO: 1152092 - DNA, 22 bp, Homo sapiens
taaatgctctctcatcttgttc

SEQ ID NO: 1152093 - DNA, 19 bp, Homo sapiens
taaatgctgttcttacaca

SEQ ID NO: 1152094 - DNA, 14 bp, Homo sapiens
taaatggccagtgc

SEQ ID NO: 1152095 - DNA, 16 bp, Homo sapiens
taaatggccagtgctg

SEQ ID NO: 1152096 - DNA, 18 bp, Homo sapiens
taaatggccagtgctgct

SEQ ID NO: 1152097 - DNA, 19 bp, Homo sapiens
taaatggccagtgctgctt

SEQ ID NO: 1152098 - DNA, 20 bp, Homo sapiens
taaatggccagtgctgcttc

SEQ ID NO: 1152099 - DNA, 14 bp, Homo sapiens
taaatgggggtgca

SEQ ID NO: 1152100 - DNA, 17 bp, Homo sapiens
taaatgggggtgcattt

SEQ ID NO: 1152101 - DNA, 19 bp, Homo sapiens
taaatgggtgtatataatt

SEQ ID NO: 1152102 - DNA, 21 bp, Homo sapiens
taaatggtgtacataatgtat

SEQ ID NO: 1152103 - DNA, 18 bp, Homo sapiens
taaatggtgttacattaa

SEQ ID NO: 1152104 - DNA, 18 bp, Homo sapiens
taaatggttaaattttac

SEQ ID NO: 1152105 - DNA, 20 bp, Homo sapiens
taaatggttaaattttacat

SEQ ID NO: 1152106 - DNA, 21 bp, Homo sapiens
taaatggtttctcattaaact

SEQ ID NO: 1152107 - DNA, 20 bp, Homo sapiens
taaatggtttggtgcttttt

SEQ ID NO: 1152108 - DNA, 16 bp, Homo sapiens
taaatgtaaagatatt

SEQ ID NO: 1152109 - DNA, 14 bp, Homo sapiens
taaatgtaacttat

SEQ ID NO: 1152110 - DNA, 21 bp, Homo sapiens
taaatgtaccttcagaataag

SEQ ID NO: 1152111 - DNA, 21 bp, Homo sapiens
taaatgtagcttcagtcatta

SEQ ID NO: 1152112 - DNA, 19 bp, Homo sapiens
taaatgtatcttattcaca

SEQ ID NO: 1152113 - DNA, 17 bp, Homo sapiens
taaatgtatttaattaa

SEQ ID NO: 1152114 - DNA, 20 bp, Homo sapiens
taaatgtattttaaaataaa

SEQ ID NO: 1152115 - DNA, 15 bp, Homo sapiens
taaatgtctgacaca

SEQ ID NO: 1152116 - DNA, 19 bp, Homo sapiens
taaatgtgaatttcaactt

SEQ ID NO: 1152117 - DNA, 21 bp, Homo sapiens
taaatgtgaatttcaactttt

SEQ ID NO: 1152118 - DNA, 23 bp, Homo sapiens
taaatgtgcattcttttaaaaga

SEQ ID NO: 1152119 - DNA, 13 bp, Homo sapiens
taaatgtgtgtat

SEQ ID NO: 1152120 - DNA, 14 bp, Homo sapiens
taaatgtgttagca

SEQ ID NO: 1152121 - DNA, 12 bp, Homo sapiens
taaatgtgttcc

SEQ ID NO: 1152122 - DNA, 19 bp, Homo sapiens
taaatgtgtttcttgctgc

SEQ ID NO: 1152123 - DNA, 19 bp, Homo sapiens
taaatgttatgactatgta

SEQ ID NO: 1152124 - DNA, 20 bp, Homo sapiens
taaatgttatgactatgtaa

SEQ ID NO: 1152125 - DNA, 22 bp, Homo sapiens
taaatgttatgactatgtaaac

SEQ ID NO: 1152126 - DNA, 20 bp, Homo sapiens
taaatgttattattcttgag

SEQ ID NO: 1152127 - DNA, 15 bp, Homo sapiens
taaatgtttaaagaa

SEQ ID NO: 1152128 - DNA, 18 bp, Homo sapiens
taaatgtttaaatataaa

SEQ ID NO: 1152129 - DNA, 15 bp, Homo sapiens
taaatgtttatactg

SEQ ID NO: 1152130 - DNA, 16 bp, Homo sapiens
taaatgtttatactgt

SEQ ID NO: 1152131 - DNA, 17 bp, Homo sapiens
taaatgtttatactgta

SEQ ID NO: 1152132 - DNA, 13 bp, Homo sapiens
taaatgtttctag

SEQ ID NO: 1152133 - DNA, 14 bp, Homo sapiens
taaatgtttggaaa

SEQ ID NO: 1152134 - DNA, 13 bp, Homo sapiens
taaatgtttgtta

SEQ ID NO: 1152135 - DNA, 19 bp, Homo sapiens
taaatgtttgttatttaca

SEQ ID NO: 1152136 - DNA, 14 bp, Homo sapiens
taaattaaacaatt

SEQ ID NO: 1152137 - DNA, 13 bp, Homo sapiens
taaattaaataaa

SEQ ID NO: 1152138 - DNA, 16 bp, Homo sapiens
taaattaaataaactg

SEQ ID NO: 1152139 - DNA, 13 bp, Homo sapiens
taaattaagacat

SEQ ID NO: 1152140 - DNA, 15 bp, Homo sapiens
taaattaagacatgc

SEQ ID NO: 1152141 - DNA, 20 bp, Homo sapiens
taaattaagatcctaaactc

SEQ ID NO: 1152142 - DNA, 15 bp, Homo sapiens
taaattaagttactg

SEQ ID NO: 1152143 - DNA, 12 bp, Homo sapiens
taaattaatatc

SEQ ID NO: 1152144 - DNA, 13 bp, Homo sapiens
taaattacaattt

SEQ ID NO: 1152145 - DNA, 14 bp, Homo sapiens
taaattacaatttt

SEQ ID NO: 1152146 - DNA, 17 bp, Homo sapiens
taaattacagtcatctg

SEQ ID NO: 1152147 - DNA, 21 bp, Homo sapiens
taaattacagtcatctgtctt

SEQ ID NO: 1152148 - DNA, 21 bp, Homo sapiens
taaattactgttttatgttga

SEQ ID NO: 1152149 - DNA, 22 bp, Homo sapiens
taaattactgttttatgttgat

SEQ ID NO: 1152150 - DNA, 20 bp, Homo sapiens
taaattagaaaatattctct

SEQ ID NO: 1152151 - DNA, 18 bp, Homo sapiens
taaattagtatttattta

SEQ ID NO: 1152152 - DNA, 17 bp, Homo sapiens
taaattatatttgtgct

SEQ ID NO: 1152153 - DNA, 21 bp, Homo sapiens
taaattatatttgtgctatag

SEQ ID NO: 1152154 - DNA, 17 bp, Homo sapiens
taaattatcttatgaaa

SEQ ID NO: 1152155 - DNA, 17 bp, Homo sapiens
taaattatgtaatgcaa

SEQ ID NO: 1152156 - DNA, 20 bp, Homo sapiens
taaattattcagaactattt

SEQ ID NO: 1152157 - DNA, 15 bp, Homo sapiens
taaattattgtaaac

SEQ ID NO: 1152158 - DNA, 14 bp, Homo sapiens
taaattatttgcta

SEQ ID NO: 1152159 - DNA, 21 bp, Homo sapiens
taaattatttgctaagcatat

SEQ ID NO: 1152160 - DNA, 11 bp, Homo sapiens
taaattatttt

SEQ ID NO: 1152161 - DNA, 19 bp, Homo sapiens
taaattattttatatcata

SEQ ID NO: 1152162 - DNA, 20 bp, Homo sapiens
taaattcaaccactgtaaaa

SEQ ID NO: 1152163 - DNA, 16 bp, Homo sapiens
taaattcacaaacttt

SEQ ID NO: 1152164 - DNA, 17 bp, Homo sapiens
taaattcacaatagaaa

SEQ ID NO: 1152165 - DNA, 18 bp, Homo sapiens
taaattcactttcatttt

SEQ ID NO: 1152166 - DNA, 18 bp, Homo sapiens
taaattcagatatatttt

SEQ ID NO: 1152167 - DNA, 17 bp, Homo sapiens
taaattcatcagaatcc

SEQ ID NO: 1152168 - DNA, 17 bp, Homo sapiens
taaattcattttattct

SEQ ID NO: 1152169 - DNA, 12 bp, Homo sapiens
taaattccagag

SEQ ID NO: 1152170 - DNA, 19 bp, Homo sapiens
taaattcctcaacagtgtt

SEQ ID NO: 1152171 - DNA, 22 bp, Homo sapiens
taaattctatgttaaatactgt

SEQ ID NO: 1152172 - DNA, 14 bp, Homo sapiens
taaattctctttca

SEQ ID NO: 1152173 - DNA, 15 bp, Homo sapiens
taaattctgggtgaa

SEQ ID NO: 1152174 - DNA, 19 bp, Homo sapiens
taaattctggtatacattg

SEQ ID NO: 1152175 - DNA, 21 bp, Homo sapiens
taaattgaataggtagtatca

SEQ ID NO: 1152176 - DNA, 22 bp, Homo sapiens
taaattgaatcagtataaacaa

SEQ ID NO: 1152177 - DNA, 17 bp, Homo sapiens
taaattgatagcagata

SEQ ID NO: 1152178 - DNA, 14 bp, Homo sapiens
taaattgatccttt

SEQ ID NO: 1152179 - DNA, 18 bp, Homo sapiens
ttaatttcaggaaaatgt

SEQ ID NO: 1152180 - DNA, 18 bp, Homo sapiens
ttaatttccaggaaaaaa

SEQ ID NO: 1152181 - DNA, 22 bp, Homo sapiens
ttaatttccttctgttaagaaa

SEQ ID NO: 1152182 - DNA, 13 bp, Homo sapiens
ttaatttcctttt

SEQ ID NO: 1152183 - DNA, 19 bp, Homo sapiens
ttaatttcctttttgacac

SEQ ID NO: 1152184 - DNA, 20 bp, Homo sapiens
ttaatttctgccatttcatg

SEQ ID NO: 1152185 - DNA, 22 bp, Homo sapiens
ttaatttctgcctttcccccct

SEQ ID NO: 1152186 - DNA, 21 bp, Homo sapiens
taacagttttccatgaaaacg

SEQ ID NO: 1152187 - DNA, 21 bp, Homo sapiens
taacagttttgagtaattcaa

SEQ ID NO: 1152188 - DNA, 20 bp, Homo sapiens
taacataaaatctgtgaatt

SEQ ID NO: 1152189 - DNA, 17 bp, Homo sapiens
taacataacaacaacag

SEQ ID NO: 1152190 - DNA, 13 bp, Homo sapiens
taacataacacta

SEQ ID NO: 1152191 - DNA, 20 bp, Homo sapiens
taacataacactaaatgctg

SEQ ID NO: 1152192 - DNA, 16 bp, Homo sapiens
taacataactgcttct

SEQ ID NO: 1152193 - DNA, 19 bp, Homo sapiens
taacataactgcttcttgg

SEQ ID NO: 1152194 - DNA, 19 bp, Homo sapiens
taacataatggttgtgaaa

SEQ ID NO: 1152195 - DNA, 21 bp, Homo sapiens
taacataatggttgtgaaatg

SEQ ID NO: 1152196 - DNA, 14 bp, Homo sapiens
taacatacaatgac

SEQ ID NO: 1152197 - DNA, 13 bp, Homo sapiens
taacatatctgat

SEQ ID NO: 1152198 - DNA, 22 bp, Homo sapiens
taacatcagtgtctgtttcaga

SEQ ID NO: 1152199 - DNA, 16 bp, Homo sapiens
taacatcataattaca

SEQ ID NO: 1152200 - DNA, 23 bp, Homo sapiens
taacatctttacgtactgtaact

SEQ ID NO: 1152201 - DNA, 18 bp, Homo sapiens
taacatctttgtttttaa

SEQ ID NO: 1152202 - DNA, 22 bp, Homo sapiens
taacatctttgtttttaaaata

SEQ ID NO: 1152203 - DNA, 22 bp, Homo sapiens
taacatgaaaaacacggcagct

SEQ ID NO: 1152204 - DNA, 19 bp, Homo sapiens
taacatgaggggacatttt

SEQ ID NO: 1152205 - DNA, 16 bp, Homo sapiens
taacatgatgttaact

SEQ ID NO: 1152206 - DNA, 14 bp, Homo sapiens
taacatgcatactt

SEQ ID NO: 1152207 - DNA, 23 bp, Homo sapiens
taacatggacatgatcttcttta

SEQ ID NO: 1152208 - DNA, 18 bp, Homo sapiens
taacatggtttaaaagaa

SEQ ID NO: 1152209 - DNA, 16 bp, Homo sapiens
taacatgtgttaaaca

SEQ ID NO: 1152210 - DNA, 18 bp, Homo sapiens
taacattagatgtcatga

SEQ ID NO: 1152211 - DNA, 22 bp, Homo sapiens
taacattaggaccttagaattt

SEQ ID NO: 1152212 - DNA, 15 bp, Homo sapiens
taacattctttttct

SEQ ID NO: 1152213 - DNA, 16 bp, Homo sapiens
taacattgaccaagaa

SEQ ID NO: 1152214 - DNA, 20 bp, Homo sapiens
taacattgaccaagaactgc

SEQ ID NO: 1152215 - DNA, 21 bp, Homo sapiens
taacattgaccaagaactgca

SEQ ID NO: 1152216 - DNA, 22 bp, Homo sapiens
taacattgaccaagaactgcat

SEQ ID NO: 1152217 - DNA, 16 bp, Homo sapiens
taacattgtaaagtat

SEQ ID NO: 1152218 - DNA, 14 bp, Homo sapiens
taacatttaaattc

SEQ ID NO: 1152219 - DNA, 15 bp, Homo sapiens
taacatttaaattcc

SEQ ID NO: 1152220 - DNA, 17 bp, Homo sapiens
taacatttcattgtaca

SEQ ID NO: 1152221 - DNA, 12 bp, Homo sapiens
taacatttctgt

SEQ ID NO: 1152222 - DNA, 13 bp, Homo sapiens
taacatttgcctt

SEQ ID NO: 1152223 - DNA, 23 bp, Homo sapiens
taacatttgccttgcagaactgc

SEQ ID NO: 1152224 - DNA, 14 bp, Homo sapiens
taacatttgctgtt

SEQ ID NO: 1152225 - DNA, 16 bp, Homo sapiens
taacattttatacaat

SEQ ID NO: 1152226 - DNA, 19 bp, Homo sapiens
taacatttttgaggaagtt

SEQ ID NO: 1152227 - DNA, 23 bp, Homo sapiens
taacatttttgaggaagttttgt

SEQ ID NO: 1152228 - DNA, 15 bp, Homo sapiens
taacattttttaccc

SEQ ID NO: 1152229 - DNA, 11 bp, Homo sapiens
taaccaaaggt

SEQ ID NO: 1152230 - DNA, 18 bp, Homo sapiens
taaccaaaggtgaaggaa

SEQ ID NO: 1152231 - DNA, 21 bp, Homo sapiens
taaccaagagataactgtaaa

SEQ ID NO: 1152232 - DNA, 14 bp, Homo sapiens
taaccaagaggctg

SEQ ID NO: 1152233 - DNA, 11 bp, Homo sapiens
taaccaagctg

SEQ ID NO: 1152234 - DNA, 14 bp, Homo sapiens
taaccaaggagggg

SEQ ID NO: 1152235 - DNA, 15 bp, Homo sapiens
taaccaaggaggggc

SEQ ID NO: 1152236 - DNA, 16 bp, Homo sapiens
taaccaaggaggggcc

SEQ ID NO: 1152237 - DNA, 21 bp, Homo sapiens
taaccacaactttcactataa

SEQ ID NO: 1152238 - DNA, 13 bp, Homo sapiens
taaccacaaggtc

SEQ ID NO: 1152239 - DNA, 16 bp, Homo sapiens
taaccacttcagctga

SEQ ID NO: 1152240 - DNA, 22 bp, Homo sapiens
taaccagacacatactcatttt

SEQ ID NO: 1152241 - DNA, 15 bp, Homo sapiens
taaccagcattccct

SEQ ID NO: 1152242 - DNA, 23 bp, Homo sapiens
taaccagtctgaagtttcattta

SEQ ID NO: 1152243 - DNA, 23 bp, Homo sapiens
taaccagtgttgtggatttaaca

SEQ ID NO: 1152244 - DNA, 19 bp, Homo sapiens
taaccatgtgttatgtttt

SEQ ID NO: 1152245 - DNA, 16 bp, Homo sapiens
taaccattacatgttt

SEQ ID NO: 1152246 - DNA, 20 bp, Homo sapiens
taaccattacatgtttaaat

SEQ ID NO: 1152247 - DNA, 13 bp, Homo sapiens
taaccatttaata

SEQ ID NO: 1152248 - DNA, 19 bp, Homo sapiens
taaccatttaataaagaaa

SEQ ID NO: 1152249 - DNA, 23 bp, Homo sapiens
taaccatttcagtgtattgttta

SEQ ID NO: 1152250 - DNA, 16 bp, Homo sapiens
taaccattttaaccta

SEQ ID NO: 1152251 - DNA, 14 bp, Homo sapiens
taaccattttcctt

SEQ ID NO: 1152252 - DNA, 19 bp, Homo sapiens
taacccaggcctgtctgac

SEQ ID NO: 1152253 - DNA, 21 bp, Homo sapiens
taacccattccagtacagtat

SEQ ID NO: 1152254 - DNA, 14 bp, Homo sapiens
taaccccagcctga

SEQ ID NO: 1152255 - DNA, 19 bp, Homo sapiens
taacccctaagactgcctt

SEQ ID NO: 1152256 - DNA, 20 bp, Homo sapiens
taacccctaagactgccttc

SEQ ID NO: 1152257 - DNA, 21 bp, Homo sapiens
taacccctaagactgccttca

SEQ ID NO: 1152258 - DNA, 19 bp, Homo sapiens
taaccctctcttccctatt

SEQ ID NO: 1152259 - DNA, 15 bp, Homo sapiens
taaccctgccagtgc

SEQ ID NO: 1152260 - DNA, 17 bp, Homo sapiens
taaccctgccagtgcca

SEQ ID NO: 1152261 - DNA, 22 bp, Homo sapiens
taaccctgccagtgccagggtg

SEQ ID NO: 1152262 - DNA, 18 bp, Homo sapiens
taaccctgggctgtccag

SEQ ID NO: 1152263 - DNA, 13 bp, Homo sapiens
taaccctgtggaa

SEQ ID NO: 1152264 - DNA, 13 bp, Homo sapiens
taaccctgtggtt

SEQ ID NO: 1152265 - DNA, 21 bp, Homo sapiens
taacctaattaatatattaaa

SEQ ID NO: 1152266 - DNA, 13 bp, Homo sapiens
taacctagttaaa

SEQ ID NO: 1152267 - DNA, 20 bp, Homo sapiens
taacctataagcatgacata

SEQ ID NO: 1152268 - DNA, 23 bp, Homo sapiens
taacctatttttttctctattct

SEQ ID NO: 1152269 - DNA, 17 bp, Homo sapiens
taacctcagctctggga

SEQ ID NO: 1152270 - DNA, 14 bp, Homo sapiens
taacctctaaccct

SEQ ID NO: 1152271 - DNA, 18 bp, Homo sapiens
taacctctctaagccaca

SEQ ID NO: 1152272 - DNA, 10 bp, Homo sapiens
taacctctgg

SEQ ID NO: 1152273 - DNA, 13 bp, Homo sapiens
taacctctggccc

SEQ ID NO: 1152274 - DNA, 16 bp, Homo sapiens
taacctctggcccttg

SEQ ID NO: 1152275 - DNA, 16 bp, Homo sapiens
taacctgcaaaatctg

SEQ ID NO: 1152276 - DNA, 10 bp, Homo sapiens
taacctgctg

SEQ ID NO: 1152277 - DNA, 16 bp, Homo sapiens
taacctggccactgtc

SEQ ID NO: 1152278 - DNA, 18 bp, Homo sapiens
taacctggtgctggatat

SEQ ID NO: 1152279 - DNA, 19 bp, Homo sapiens
taacctgtacttcaagtta

SEQ ID NO: 1152280 - DNA, 18 bp, Homo sapiens
taacctgtctcacctgga

SEQ ID NO: 1152281 - DNA, 18 bp, Homo sapiens
taacctgttgctccagga

SEQ ID NO: 1152282 - DNA, 14 bp, Homo sapiens
taaccttaaataca

SEQ ID NO: 1152283 - DNA, 17 bp, Homo sapiens
taaccttaaatacactg

SEQ ID NO: 1152284 - DNA, 19 bp, Homo sapiens
taaccttactaattatact

SEQ ID NO: 1152285 - DNA, 20 bp, Homo sapiens
taaccttgaatgctgccagt

SEQ ID NO: 1152286 - DNA, 22 bp, Homo sapiens
taaccttgaatgctgccagtgt

SEQ ID NO: 1152287 - DNA, 14 bp, Homo sapiens
taacctttacatga

SEQ ID NO: 1152288 - DNA, 20 bp, Homo sapiens
taacctttttgtaaatactg

SEQ ID NO: 1152289 - DNA, 17 bp, Homo sapiens
taacgccctatttttgc

SEQ ID NO: 1152290 - DNA, 16 bp, Homo sapiens
taacgcgtcttcctga

SEQ ID NO: 1152291 - DNA, 15 bp, Homo sapiens
taacggctccaggat

SEQ ID NO: 1152292 - DNA, 16 bp, Homo sapiens
taacgggcatgtatta

SEQ ID NO: 1152293 - DNA, 20 bp, Homo sapiens
taacgtccactagcttactg

SEQ ID NO: 1152294 - DNA, 19 bp, Homo sapiens
taacgtgattgattcagta

SEQ ID NO: 1152295 - DNA, 17 bp, Homo sapiens
taacgtttaagccaaaa

SEQ ID NO: 1152296 - DNA, 18 bp, Homo sapiens
taacgtttctcattaaaa

SEQ ID NO: 1152297 - DNA, 18 bp, Homo sapiens
taactaaaataattttgt

SEQ ID NO: 1152298 - DNA, 23 bp, Homo sapiens
taactaaaatgtatctaagaata

SEQ ID NO: 1152299 - DNA, 14 bp, Homo sapiens
taactaaactctct

SEQ ID NO: 1152300 - DNA, 15 bp, Homo sapiens
taactaagactcccg

SEQ ID NO: 1152301 - DNA, 23 bp, Homo sapiens
taactaagggggtagaagtagtt

SEQ ID NO: 1152302 - DNA, 23 bp, Homo sapiens
taactaatatgggcattgtagtt

SEQ ID NO: 1152303 - DNA, 16 bp, Homo sapiens
taactaattttgttga

SEQ ID NO: 1152304 - DNA, 23 bp, Homo sapiens
taactactgctaatgttgatcag

SEQ ID NO: 1152305 - DNA, 17 bp, Homo sapiens
taactactttttatact

SEQ ID NO: 1152306 - DNA, 18 bp, Homo sapiens
taactactttttatactc

SEQ ID NO: 1152307 - DNA, 20 bp, Homo sapiens
taacttgctgaatttcaggc

SEQ ID NO: 1152308 - DNA, 21 bp, Homo sapiens
taacttgctgaatttcaggca

SEQ ID NO: 1152309 - DNA, 17 bp, Homo sapiens
taacttgctttcttctt

SEQ ID NO: 1152310 - DNA, 18 bp, Homo sapiens
taacttgctttcttcttt

SEQ ID NO: 1152311 - DNA, 15 bp, Homo sapiens
taacttgtatattcc

SEQ ID NO: 1152312 - DNA, 19 bp, Homo sapiens
taacttgtcctatgtcaat

SEQ ID NO: 1152313 - DNA, 13 bp, Homo sapiens
taactttaaacat

SEQ ID NO: 1152314 - DNA, 14 bp, Homo sapiens
taactttaaacatc

SEQ ID NO: 1152315 - DNA, 18 bp, Homo sapiens
ttacttgcattgctggac

SEQ ID NO: 1152316 - DNA, 23 bp, Homo sapiens
ttacttgccaagcagtgcacatt

SEQ ID NO: 1152317 - DNA, 15 bp, Homo sapiens
ttacttgcttctcta

SEQ ID NO: 1152318 - DNA, 18 bp, Homo sapiens
ttacttgctttacctttt

SEQ ID NO: 1152319 - DNA, 18 bp, Homo sapiens
ttacttgtctgtcaaatg

SEQ ID NO: 1152320 - DNA, 15 bp, Homo sapiens
ttacttgtgcactta

SEQ ID NO: 1152321 - DNA, 19 bp, Homo sapiens
ttacttgtggtgtgaccat

SEQ ID NO: 1152322 - DNA, 20 bp, Homo sapiens
ttacttgtggtgtgaccatg

SEQ ID NO: 1152323 - DNA, 17 bp, Homo sapiens
ttactttcccttgcttt

SEQ ID NO: 1152324 - DNA, 12 bp, Homo sapiens
ttactttcctcc

SEQ ID NO: 1152325 - DNA, 11 bp, Homo sapiens
ttactttctgt

SEQ ID NO: 1152326 - DNA, 19 bp, Homo sapiens
ttactttctttcagatgtt

SEQ ID NO: 1152327 - DNA, 20 bp, Homo sapiens
ttactttgctgccttaatga

SEQ ID NO: 1152328 - DNA, 13 bp, Homo sapiens
ttactttggttta

SEQ ID NO: 1152329 - DNA, 17 bp, Homo sapiens
ttacttttaaacagtga

SEQ ID NO: 1152330 - DNA, 19 bp, Homo sapiens
ttacttttaaactgtgtac

SEQ ID NO: 1152331 - DNA, 23 bp, Homo sapiens
ttacttttaccactatttaagtt

SEQ ID NO: 1152332 - DNA, 14 bp, Homo sapiens
ttacttttattatt

SEQ ID NO: 1152333 - DNA, 12 bp, Homo sapiens
ttacttttccag

SEQ ID NO: 1152334 - DNA, 14 bp, Homo sapiens
ttacttttgtaaat

SEQ ID NO: 1152335 - DNA, 14 bp, Homo sapiens
ttactttttaactg

SEQ ID NO: 1152336 - DNA, 18 bp, Homo sapiens
ttactttttatatagcaa

SEQ ID NO: 1152337 - DNA, 15 bp, Homo sapiens
ttacttttttatagc

SEQ ID NO: 1152338 - DNA, 19 bp, Homo sapiens
ttactttttttctgtgaca

SEQ ID NO: 1152339 - DNA, 20 bp, Homo sapiens
ttactttttttctgtgacat

SEQ ID NO: 1152340 - DNA, 15 bp, Homo sapiens
ttagaaaaacattta

SEQ ID NO: 1152341 - DNA, 15 bp, Homo sapiens
ttagaaaacaaaatt

SEQ ID NO: 1152342 - DNA, 12 bp, Homo sapiens
ttagaaaatgtg

SEQ ID NO: 1152343 - DNA, 13 bp, Homo sapiens
ttagaaaatgtgt

SEQ ID NO: 1152344 - DNA, 14 bp, Homo sapiens
ttagaaaccttaat

SEQ ID NO: 1152345 - DNA, 13 bp, Homo sapiens
ttagaaaggcagc

SEQ ID NO: 1152346 - DNA, 12 bp, Homo sapiens
ttagaaatactt

SEQ ID NO: 1152347 - DNA, 15 bp, Homo sapiens
ttagaaatagacagt

SEQ ID NO: 1152348 - DNA, 15 bp, Homo sapiens
ttagaaatattcaca

SEQ ID NO: 1152349 - DNA, 19 bp, Homo sapiens
ttagaaatattcacatctt

SEQ ID NO: 1152350 - DNA, 13 bp, Homo sapiens
ttagaaatatttt

SEQ ID NO: 1152351 - DNA, 22 bp, Homo sapiens
ttagaaatattttaaaatcagc

SEQ ID NO: 1152352 - DNA, 17 bp, Homo sapiens
ttagaaatcacaacaaa

SEQ ID NO: 1152353 - DNA, 19 bp, Homo sapiens
ttagaaatcattgtagaaa

SEQ ID NO: 1152354 - DNA, 20 bp, Homo sapiens
ttagaaatgtaaactgccat

SEQ ID NO: 1152355 - DNA, 20 bp, Homo sapiens
ttagaacacacacacttact

SEQ ID NO: 1152356 - DNA, 18 bp, Homo sapiens
ttagaacattttaattca

SEQ ID NO: 1152357 - DNA, 22 bp, Homo sapiens
ttagaaccagccgtattttaca

SEQ ID NO: 1152358 - DNA, 21 bp, Homo sapiens
ttagaagaagaggaagaaatt

SEQ ID NO: 1152359 - DNA, 20 bp, Homo sapiens
ttagaagaggtagtgtgaat

SEQ ID NO: 1152360 - DNA, 21 bp, Homo sapiens
ttagaagcaaagatttcagta

SEQ ID NO: 1152361 - DNA, 23 bp, Homo sapiens
ttagaagcactacaccttgcctt

SEQ ID NO: 1152362 - DNA, 17 bp, Homo sapiens
ttagaagcgacttttgt

SEQ ID NO: 1152363 - DNA, 22 bp, Homo sapiens
ttagaagctaatgtaggactgt

SEQ ID NO: 1152364 - DNA, 16 bp, Homo sapiens
ttagaagtgagagaaa

SEQ ID NO: 1152365 - DNA, 16 bp, Homo sapiens
ttagaataagaatttg

SEQ ID NO: 1152366 - DNA, 18 bp, Homo sapiens
ttagaatagtttgaaata

SEQ ID NO: 1152367 - DNA, 23 bp, Homo sapiens
ttagaatcaaacattttgaaagt

SEQ ID NO: 1152368 - DNA, 21 bp, Homo sapiens
ttagaatcagccttgaaacat

SEQ ID NO: 1152369 - DNA, 22 bp, Homo sapiens
ttagaatccaaacttggatttt

SEQ ID NO: 1152370 - DNA, 14 bp, Homo sapiens
ttagaatcttgttt

SEQ ID NO: 1152371 - DNA, 16 bp, Homo sapiens
ttagaatgaatttatc

SEQ ID NO: 1152372 - DNA, 12 bp, Homo sapiens
ttagaattattt

SEQ ID NO: 1152373 - DNA, 23 bp, Homo sapiens
ttagacaaagccttaagcaaatt

SEQ ID NO: 1152374 - DNA, 15 bp, Homo sapiens
ttagacaactagatt

SEQ ID NO: 1152375 - DNA, 13 bp, Homo sapiens
ttagacataacaa

SEQ ID NO: 1152376 - DNA, 15 bp, Homo sapiens
ttagacctatactga

SEQ ID NO: 1152377 - DNA, 17 bp, Homo sapiens
ttagacctatactgaaa

SEQ ID NO: 1152378 - DNA, 20 bp, Homo sapiens
ttagacctatactgaaagat

SEQ ID NO: 1152379 - DNA, 12 bp, Homo sapiens
ttagacctcagc

SEQ ID NO: 1152380 - DNA, 23 bp, Homo sapiens
ttagacctttatttttctatctg

SEQ ID NO: 1152381 - DNA, 17 bp, Homo sapiens
ttagacgaagaagctgg

SEQ ID NO: 1152382 - DNA, 18 bp, Homo sapiens
ttagactaaggccattat

SEQ ID NO: 1152383 - DNA, 17 bp, Homo sapiens
ttagactcttttccttc

SEQ ID NO: 1152384 - DNA, 15 bp, Homo sapiens
ttagactggaacttg

SEQ ID NO: 1152385 - DNA, 16 bp, Homo sapiens
ttagactggaacttga

SEQ ID NO: 1152386 - DNA, 17 bp, Homo sapiens
ttagactggaacttgaa

SEQ ID NO: 1152387 - DNA, 15 bp, Homo sapiens
ttagactgtggccat

SEQ ID NO: 1152388 - DNA, 23 bp, Homo sapiens
ttagacttcccactgttctgaaa

SEQ ID NO: 1152389 - DNA, 17 bp, Homo sapiens
ttagacttgaaatacta

SEQ ID NO: 1152390 - DNA, 18 bp, Homo sapiens
ttagactttagaaataaa

SEQ ID NO: 1152391 - DNA, 16 bp, Homo sapiens
ttagagaaaataaatt

SEQ ID NO: 1152392 - DNA, 13 bp, Homo sapiens
ttagagaactaaa

SEQ ID NO: 1152393 - DNA, 22 bp, Homo sapiens
ttagagaagctacccctcaaac

SEQ ID NO: 1152394 - DNA, 20 bp, Homo sapiens
ttagagaggtagcgagctgc

SEQ ID NO: 1152395 - DNA, 21 bp, Homo sapiens
ttagagaggtagcgagctgct

SEQ ID NO: 1152396 - DNA, 17 bp, Homo sapiens
ttagagatggagtttgc

SEQ ID NO: 1152397 - DNA, 14 bp, Homo sapiens
ttagagcttccaaa

SEQ ID NO: 1152398 - DNA, 19 bp, Homo sapiens
ttagaggaaaaaaatgact

SEQ ID NO: 1152399 - DNA, 20 bp, Homo sapiens
ttagaggaaataagaaaaat

SEQ ID NO: 1152400 - DNA, 19 bp, Homo sapiens
ttagaggagtctgtggctt

SEQ ID NO: 1152401 - DNA, 19 bp, Homo sapiens
ttagaggctttcaaatgta

SEQ ID NO: 1152402 - DNA, 18 bp, Homo sapiens
ttagagggaggagaatga

SEQ ID NO: 1152403 - DNA, 17 bp, Homo sapiens
ttagaggtaaaagtaca

SEQ ID NO: 1152404 - DNA, 13 bp, Homo sapiens
ttagaggttttaa

SEQ ID NO: 1152405 - DNA, 20 bp, Homo sapiens
ttagagtatacctcctatat

SEQ ID NO: 1152406 - DNA, 18 bp, Homo sapiens
ttagagtatttacactat

SEQ ID NO: 1152407 - DNA, 19 bp, Homo sapiens
ttagagtatttcccttcca

SEQ ID NO: 1152408 - DNA, 22 bp, Homo sapiens
ttagagtatttcccttccaaag

SEQ ID NO: 1152409 - DNA, 15 bp, Homo sapiens
ttagagtgcccagca

SEQ ID NO: 1152410 - DNA, 16 bp, Homo sapiens
ttagagtggttattca

SEQ ID NO: 1152411 - DNA, 17 bp, Homo sapiens
ttagagtgtctttccac

SEQ ID NO: 1152412 - DNA, 14 bp, Homo sapiens
ttagagttcttctt

SEQ ID NO: 1152413 - DNA, 17 bp, Homo sapiens
ttagagtttacagtttg

SEQ ID NO: 1152414 - DNA, 18 bp, Homo sapiens
ttagagtttacagtttgt

SEQ ID NO: 1152415 - DNA, 13 bp, Homo sapiens
ttagagtttctgt

SEQ ID NO: 1152416 - DNA, 19 bp, Homo sapiens
ttagataaagatttctagt

SEQ ID NO: 1152417 - DNA, 15 bp, Homo sapiens
ttagataaatattga

SEQ ID NO: 1152418 - DNA, 21 bp, Homo sapiens
ttagataacttcttgaaaaag

SEQ ID NO: 1152419 - DNA, 20 bp, Homo sapiens
ttagatacactaaaaatctg

SEQ ID NO: 1152420 - DNA, 18 bp, Homo sapiens
ttagatcccatgtcacct

SEQ ID NO: 1152421 - DNA, 12 bp, Homo sapiens
ttagatgccaaa

SEQ ID NO: 1152422 - DNA, 13 bp, Homo sapiens
ttagatgtcatga

SEQ ID NO: 1152423 - DNA, 13 bp, Homo sapiens
ttagatgttacta

SEQ ID NO: 1152424 - DNA, 22 bp, Homo sapiens
ttagatgttctaagtctttcca

SEQ ID NO: 1152425 - DNA, 18 bp, Homo sapiens
ttagatgttttgggatca

SEQ ID NO: 1152426 - DNA, 15 bp, Homo sapiens
ttagattaagaaata

SEQ ID NO: 1152427 - DNA, 14 bp, Homo sapiens
ttagattagctctg

SEQ ID NO: 1152428 - DNA, 13 bp, Homo sapiens
ttagattccagga

SEQ ID NO: 1152429 - DNA, 16 bp, Homo sapiens
ttaggtttttccttat

SEQ ID NO: 1152430 - DNA, 13 bp, Homo sapiens
ttaggtttttggc

SEQ ID NO: 1152431 - DNA, 19 bp, Homo sapiens
ttaggtttttttgtatagt

SEQ ID NO: 1152432 - DNA, 22 bp, Homo sapiens
ttagtaaaaaatcaattaacca

SEQ ID NO: 1152433 - DNA, 23 bp, Homo sapiens
ttagtaacatgtgttaagtattt

SEQ ID NO: 1152434 - DNA, 21 bp, Homo sapiens
ttagtaatagtccaatatttg

SEQ ID NO: 1152435 - DNA, 20 bp, Homo sapiens
ttagtagaaacggggtttca

SEQ ID NO: 1152436 - DNA, 23 bp, Homo sapiens
ttagtagaaatgccagaaacagt

SEQ ID NO: 1152437 - DNA, 20 bp, Homo sapiens
ttagtagagacggggtttca

SEQ ID NO: 1152438 - DNA, 23 bp, Homo sapiens
ttagtagtcaaaaacaaagctga

SEQ ID NO: 1152439 - DNA, 15 bp, Homo sapiens
ttagtagttatttgt

SEQ ID NO: 1152440 - DNA, 17 bp, Homo sapiens
ttagtagtttttacaaa

SEQ ID NO: 1152441 - DNA, 14 bp, Homo sapiens
ttagtataatattt

SEQ ID NO: 1152442 - DNA, 19 bp, Homo sapiens
ttagtatagtagaaagaca

SEQ ID NO: 1152443 - DNA, 20 bp, Homo sapiens
ttagtatagtagaaagacat

SEQ ID NO: 1152444 - DNA, 23 bp, Homo sapiens
ttagtatctaacatgtatcccaa

SEQ ID NO: 1152445 - DNA, 16 bp, Homo sapiens
ttagtatgcagttgat

SEQ ID NO: 1152446 - DNA, 18 bp, Homo sapiens
taagatcgttctctgcct

SEQ ID NO: 1152447 - DNA, 14 bp, Homo sapiens
taagatctgactgc

SEQ ID NO: 1152448 - DNA, 16 bp, Homo sapiens
taagatctgactgcca

SEQ ID NO: 1152449 - DNA, 12 bp, Homo sapiens
taagatgaaatt

SEQ ID NO: 1152450 - DNA, 12 bp, Homo sapiens
taagatgctggg

SEQ ID NO: 1152451 - DNA, 15 bp, Homo sapiens
taagatggattctca

SEQ ID NO: 1152452 - DNA, 17 bp, Homo sapiens
taagatggattctcaga

SEQ ID NO: 1152453 - DNA, 18 bp, Homo sapiens
taagatggattctcagat

SEQ ID NO: 1152454 - DNA, 15 bp, Homo sapiens
taagatgtacattta

SEQ ID NO: 1152455 - DNA, 18 bp, Homo sapiens
taagatgtacatttaata

SEQ ID NO: 1152456 - DNA, 20 bp, Homo sapiens
taagatgtgtcttcaatttg

SEQ ID NO: 1152457 - DNA, 15 bp, Homo sapiens
taagattaaaggaag

SEQ ID NO: 1152458 - DNA, 17 bp, Homo sapiens
taagattaaaggaagga

SEQ ID NO: 1152459 - DNA, 21 bp, Homo sapiens
taagattccagagagtggctc

SEQ ID NO: 1152460 - DNA, 18 bp, Homo sapiens
taagattgttattaaatg

SEQ ID NO: 1152461 - DNA, 20 bp, Homo sapiens
taagattgttattaaatgta

SEQ ID NO: 1152462 - DNA, 19 bp, Homo sapiens
taagatttacttaattgct

SEQ ID NO: 1152463 - DNA, 13 bp, Homo sapiens
taagatttctgtc

SEQ ID NO: 1152464 - DNA, 14 bp, Homo sapiens
taagatttctttat

SEQ ID NO: 1152465 - DNA, 17 bp, Homo sapiens
taagatttctttatgtg

SEQ ID NO: 1152466 - DNA, 15 bp, Homo sapiens
taagatttggtttgg

SEQ ID NO: 1152467 - DNA, 20 bp, Homo sapiens
taagatttgtttttaaactg

SEQ ID NO: 1152468 - DNA, 22 bp, Homo sapiens
taagatttgtttttaaactgta

SEQ ID NO: 1152469 - DNA, 17 bp, Homo sapiens
taagatttttatattaa

SEQ ID NO: 1152470 - DNA, 13 bp, Homo sapiens
taagcaaaaagat

SEQ ID NO: 1152471 - DNA, 22 bp, Homo sapiens
taagcaaacgtctattttgtat

SEQ ID NO: 1152472 - DNA, 17 bp, Homo sapiens
taagcaaaggggacagc

SEQ ID NO: 1152473 - DNA, 14 bp, Homo sapiens
taagcaacatcttt

SEQ ID NO: 1152474 - DNA, 17 bp, Homo sapiens
taagcaacttgcttcta

SEQ ID NO: 1152475 - DNA, 13 bp, Homo sapiens
taagcaagagaga

SEQ ID NO: 1152476 - DNA, 15 bp, Homo sapiens
taagcaatcatttta

SEQ ID NO: 1152477 - DNA, 21 bp, Homo sapiens
taagcacacacatctggccct

SEQ ID NO: 1152478 - DNA, 17 bp, Homo sapiens
taagcacactaaaccaa

SEQ ID NO: 1152479 - DNA, 14 bp, Homo sapiens
taagcactgaaaaa

SEQ ID NO: 1152480 - DNA, 22 bp, Homo sapiens
taagcactgtggatcacgacag

SEQ ID NO: 1152481 - DNA, 15 bp, Homo sapiens
taagcactttgaaaa

SEQ ID NO: 1152482 - DNA, 20 bp, Homo sapiens
taagcactttgaaaatattt

SEQ ID NO: 1152483 - DNA, 15 bp, Homo sapiens
taagcagaaatcctg

SEQ ID NO: 1152484 - DNA, 17 bp, Homo sapiens
taagcagaacactgcag

SEQ ID NO: 1152485 - DNA, 20 bp, Homo sapiens
taagcagaccactgataaaa

SEQ ID NO: 1152486 - DNA, 20 bp, Homo sapiens
taagcagactggaaaagtga

SEQ ID NO: 1152487 - DNA, 13 bp, Homo sapiens
taagcagaggagg

SEQ ID NO: 1152488 - DNA, 15 bp, Homo sapiens
taagcagaggagggg

SEQ ID NO: 1152489 - DNA, 21 bp, Homo sapiens
taagcagatttaacaattcca

SEQ ID NO: 1152490 - DNA, 16 bp, Homo sapiens
taagcagcatggaaaa

SEQ ID NO: 1152491 - DNA, 17 bp, Homo sapiens
taagcagcatggaaaaa

SEQ ID NO: 1152492 - DNA, 12 bp, Homo sapiens
taagcagccagg

SEQ ID NO: 1152493 - DNA, 13 bp, Homo sapiens
taagcagccagga

SEQ ID NO: 1152494 - DNA, 20 bp, Homo sapiens
taagcagctggtcttttctc

SEQ ID NO: 1152495 - DNA, 21 bp, Homo sapiens
taagcaggtggatctatttca

SEQ ID NO: 1152496 - DNA, 17 bp, Homo sapiens
taagcaggtttgttttc

SEQ ID NO: 1152497 - DNA, 17 bp, Homo sapiens
taagcagtgttacttgc

SEQ ID NO: 1152498 - DNA, 16 bp, Homo sapiens
taagcataaaagatca

SEQ ID NO: 1152499 - DNA, 18 bp, Homo sapiens
taagcatactttgtaaat

SEQ ID NO: 1152500 - DNA, 13 bp, Homo sapiens
taagcatattttc

SEQ ID NO: 1152501 - DNA, 17 bp, Homo sapiens
taagcatctacttcagg

SEQ ID NO: 1152502 - DNA, 18 bp, Homo sapiens
taagcatctggctctaat

SEQ ID NO: 1152503 - DNA, 15 bp, Homo sapiens
taagcattctgagct

SEQ ID NO: 1152504 - DNA, 12 bp, Homo sapiens
taagcattgttt

SEQ ID NO: 1152505 - DNA, 15 bp, Homo sapiens
taagcattgtttgct

SEQ ID NO: 1152506 - DNA, 19 bp, Homo sapiens
taagcattgtttgcttatt

SEQ ID NO: 1152507 - DNA, 21 bp, Homo sapiens
taagcattgtttgcttattgt

SEQ ID NO: 1152508 - DNA, 23 bp, Homo sapiens
taagcattgtttgcttattgttc

SEQ ID NO: 1152509 - DNA, 10 bp, Homo sapiens
taagcattta

SEQ ID NO: 1152510 - DNA, 20 bp, Homo sapiens
taagcattttgaaacaaagt

SEQ ID NO: 1152511 - DNA, 21 bp, Homo sapiens
taagcattttgaaacaaagta

SEQ ID NO: 1152512 - DNA, 16 bp, Homo sapiens
taagccaaaaggattc

SEQ ID NO: 1152513 - DNA, 22 bp, Homo sapiens
taagccaaagaaacaagctgtg

SEQ ID NO: 1152514 - DNA, 19 bp, Homo sapiens
taagccacttaaaatgttc

SEQ ID NO: 1152515 - DNA, 20 bp, Homo sapiens
taagccacttaaaatgttca

SEQ ID NO: 1152516 - DNA, 14 bp, Homo sapiens
taagccagagcctg

SEQ ID NO: 1152517 - DNA, 20 bp, Homo sapiens
taagccagggcccctggatc

SEQ ID NO: 1152518 - DNA, 21 bp, Homo sapiens
taagccagggcccctggatct

SEQ ID NO: 1152519 - DNA, 16 bp, Homo sapiens
taagccataggcccag

SEQ ID NO: 1152520 - DNA, 20 bp, Homo sapiens
taagccattctgactcatat

SEQ ID NO: 1152521 - DNA, 16 bp, Homo sapiens
taagcccccagggcct

SEQ ID NO: 1152522 - DNA, 20 bp, Homo sapiens
taagcccccagggcctccag

SEQ ID NO: 1152523 - DNA, 23 bp, Homo sapiens
taagcccctgtgaccctctcact

SEQ ID NO: 1152524 - DNA, 18 bp, Homo sapiens
taagccctcgaaccaagg

SEQ ID NO: 1152525 - DNA, 13 bp, Homo sapiens
taagccctcttta

SEQ ID NO: 1152526 - DNA, 16 bp, Homo sapiens
taagccctgccccggg

SEQ ID NO: 1152527 - DNA, 18 bp, Homo sapiens
taagccctgccccgggat

SEQ ID NO: 1152528 - DNA, 18 bp, Homo sapiens
taagcctaccgtatttca

SEQ ID NO: 1152529 - DNA, 23 bp, Homo sapiens
taagcctaggtgttgtcagcagg

SEQ ID NO: 1152530 - DNA, 18 bp, Homo sapiens
taagcctatacgtttctg

SEQ ID NO: 1152531 - DNA, 17 bp, Homo sapiens
taagcctcatatttaaa

SEQ ID NO: 1152532 - DNA, 20 bp, Homo sapiens
taagcctcatatttaaagac

SEQ ID NO: 1152533 - DNA, 21 bp, Homo sapiens
taagcctgcggcgccagcctc

SEQ ID NO: 1152534 - DNA, 14 bp, Homo sapiens
taagcctggaagcc

SEQ ID NO: 1152535 - DNA, 16 bp, Homo sapiens
taagcctggaagccat

SEQ ID NO: 1152536 - DNA, 14 bp, Homo sapiens
taagcctgtcccca

SEQ ID NO: 1152537 - DNA, 16 bp, Homo sapiens
taagcctgtccccaga

SEQ ID NO: 1152538 - DNA, 21 bp, Homo sapiens
taagctaaagaggctgaaaga

SEQ ID NO: 1152539 - DNA, 16 bp, Homo sapiens
taagctaacccccttc

SEQ ID NO: 1152540 - DNA, 15 bp, Homo sapiens
taagctactagcaaa

SEQ ID NO: 1152541 - DNA, 23 bp, Homo sapiens
taagctaggatgttgctcagaag

SEQ ID NO: 1152542 - DNA, 14 bp, Homo sapiens
taagctatcagcaa

SEQ ID NO: 1152543 - DNA, 13 bp, Homo sapiens
taagctccagctt

SEQ ID NO: 1152544 - DNA, 22 bp, Homo sapiens
taagctccatgtgcatataaag

SEQ ID NO: 1152545 - DNA, 13 bp, Homo sapiens
taagctctggctt

SEQ ID NO: 1152546 - DNA, 15 bp, Homo sapiens
taagctctttgagaa

SEQ ID NO: 1152547 - DNA, 16 bp, Homo sapiens
taagctctttgagaac

SEQ ID NO: 1152548 - DNA, 15 bp, Homo sapiens
taagctgaataaagt

SEQ ID NO: 1152549 - DNA, 13 bp, Homo sapiens
taagctgagccac

SEQ ID NO: 1152550 - DNA, 21 bp, Homo sapiens
taagctgatattatttcttct

SEQ ID NO: 1152551 - DNA, 20 bp, Homo sapiens
tgcccagggctcagcctggt

SEQ ID NO: 1152552 - DNA, 21 bp, Homo sapiens
tgcccagggctcagcctggtg

SEQ ID NO: 1152553 - DNA, 23 bp, Homo sapiens
tgcccagggctcagcctggtggg

SEQ ID NO: 1152554 - DNA, 16 bp, Homo sapiens
tgcccaggggtgcccc

SEQ ID NO: 1152555 - DNA, 21 bp, Homo sapiens
tgcccaggggtgccccctcct

SEQ ID NO: 1152556 - DNA, 17 bp, Homo sapiens
tgcccaggtaccaccct

SEQ ID NO: 1152557 - DNA, 22 bp, Homo sapiens
tgcccaggtaccacccttcaga

SEQ ID NO: 1152558 - DNA, 13 bp, Homo sapiens
tgcccaggtcacc

SEQ ID NO: 1152559 - DNA, 15 bp, Homo sapiens
tgcccaggtcaccgg

SEQ ID NO: 1152560 - DNA, 11 bp, Homo sapiens
tgcccagtcct

SEQ ID NO: 1152561 - DNA, 13 bp, Homo sapiens
tgcccagtcctgg

SEQ ID NO: 1152562 - DNA, 16 bp, Homo sapiens
tgcccagtcctgggtt

SEQ ID NO: 1152563 - DNA, 19 bp, Homo sapiens
tgcccagtgttgtttgtaa

SEQ ID NO: 1152564 - DNA, 13 bp, Homo sapiens
tgcccagttcact

SEQ ID NO: 1152565 - DNA, 15 bp, Homo sapiens
tgcccatactgagcc

SEQ ID NO: 1152566 - DNA, 17 bp, Homo sapiens
tgcccatcaagtgcagt

SEQ ID NO: 1152567 - DNA, 18 bp, Homo sapiens
tgcccatccgtctgtctg

SEQ ID NO: 1152568 - DNA, 14 bp, Homo sapiens
tgcccatgaagagg

SEQ ID NO: 1152569 - DNA, 24 bp, Homo sapiens
tgcccatggacaggctggctccag

SEQ ID NO: 1152570 - DNA, 14 bp, Homo sapiens
tgcccatggctggg

SEQ ID NO: 1152571 - DNA, 17 bp, Homo sapiens
tgcccatggctgggaac

SEQ ID NO: 1152572 - DNA, 21 bp, Homo sapiens
tgcccatgtcgcgctcagcat

SEQ ID NO: 1152573 - DNA, 22 bp, Homo sapiens
tgcccatgtgtcccctcactct

SEQ ID NO: 1152574 - DNA, 13 bp, Homo sapiens
tgcccatgtttca

SEQ ID NO: 1152575 - DNA, 15 bp, Homo sapiens
tgcccatgtttcaaa

SEQ ID NO: 1152576 - DNA, 15 bp, Homo sapiens
tgcccattcctaata

SEQ ID NO: 1152577 - DNA, 21 bp, Homo sapiens
tgccccaaataacttcagtcc

SEQ ID NO: 1152578 - DNA, 13 bp, Homo sapiens
tgccccaactcct

SEQ ID NO: 1152579 - DNA, 14 bp, Homo sapiens
tgccccaagcagcc

SEQ ID NO: 1152580 - DNA, 17 bp, Homo sapiens
tgccccaagcagccagc

SEQ ID NO: 1152581 - DNA, 19 bp, Homo sapiens
tgccccaagcagccagcca

SEQ ID NO: 1152582 - DNA, 18 bp, Homo sapiens
tgccccaaggccccaggg

SEQ ID NO: 1152583 - DNA, 21 bp, Homo sapiens
tgccccaaggccccagggaca

SEQ ID NO: 1152584 - DNA, 20 bp, Homo sapiens
tgccccacacctcctctcac

SEQ ID NO: 1152585 - DNA, 12 bp, Homo sapiens
tgccccacagct

SEQ ID NO: 1152586 - DNA, 19 bp, Homo sapiens
tgccccaccacgcatgctc

SEQ ID NO: 1152587 - DNA, 12 bp, Homo sapiens
tgccccacccca

SEQ ID NO: 1152588 - DNA, 13 bp, Homo sapiens
tgccccaccccat

SEQ ID NO: 1152589 - DNA, 17 bp, Homo sapiens
tgccccacccccctcct

SEQ ID NO: 1152590 - DNA, 19 bp, Homo sapiens
tgccccacccccctcctcc

SEQ ID NO: 1152591 - DNA, 22 bp, Homo sapiens
tgccccacccccctcctccccc

SEQ ID NO: 1152592 - DNA, 17 bp, Homo sapiens
tgccccacctccccaca

SEQ ID NO: 1152593 - DNA, 12 bp, Homo sapiens
tgccccaccttg

SEQ ID NO: 1152594 - DNA, 15 bp, Homo sapiens
tgccccactctgcct

SEQ ID NO: 1152595 - DNA, 15 bp, Homo sapiens
tgccccacttctggc

SEQ ID NO: 1152596 - DNA, 17 bp, Homo sapiens
tgccccacttctggcat

SEQ ID NO: 1152597 - DNA, 12 bp, Homo sapiens
tgccccagactg

SEQ ID NO: 1152598 - DNA, 17 bp, Homo sapiens
tgccccagactgagctc

SEQ ID NO: 1152599 - DNA, 19 bp, Homo sapiens
tgccccagactgagctctc

SEQ ID NO: 1152600 - DNA, 23 bp, Homo sapiens
tgccccagagctgtttatggcct

SEQ ID NO: 1152601 - DNA, 12 bp, Homo sapiens
tgccccagccaa

SEQ ID NO: 1152602 - DNA, 13 bp, Homo sapiens
tgccccagcccag

SEQ ID NO: 1152603 - DNA, 13 bp, Homo sapiens
tgccccagctctg

SEQ ID NO: 1152604 - DNA, 14 bp, Homo sapiens
tgccccagctctgg

SEQ ID NO: 1152605 - DNA, 16 bp, Homo sapiens
tgccccagctctggat

SEQ ID NO: 1152606 - DNA, 23 bp, Homo sapiens
tgccccagctctggatgaaggca

SEQ ID NO: 1152607 - DNA, 14 bp, Homo sapiens
tgccccagctgcca

SEQ ID NO: 1152608 - DNA, 17 bp, Homo sapiens
tgccccagctgccaggc

SEQ ID NO: 1152609 - DNA, 19 bp, Homo sapiens
tgccccaggactctggcac

SEQ ID NO: 1152610 - DNA, 20 bp, Homo sapiens
tgccccaggactctggcact

SEQ ID NO: 1152611 - DNA, 14 bp, Homo sapiens
tgccccaggccagg

SEQ ID NO: 1152612 - DNA, 19 bp, Homo sapiens
tgccccaggccaggtagca

SEQ ID NO: 1152613 - DNA, 13 bp, Homo sapiens
tgccccaggccct

SEQ ID NO: 1152614 - DNA, 15 bp, Homo sapiens
tgccccaggcctgga

SEQ ID NO: 1152615 - DNA, 19 bp, Homo sapiens
tgccccagggagtccaggg

SEQ ID NO: 1152616 - DNA, 21 bp, Homo sapiens
tgccccagggagtccagggtt

SEQ ID NO: 1152617 - DNA, 24 bp, Homo sapiens
tgccccagtcggccccatctctca

SEQ ID NO: 1152618 - DNA, 20 bp, Homo sapiens
tgccccagtcgttagaatat

SEQ ID NO: 1152619 - DNA, 16 bp, Homo sapiens
tgccccagtttggggt

SEQ ID NO: 1152620 - DNA, 17 bp, Homo sapiens
tgccccagtttggggtg

SEQ ID NO: 1152621 - DNA, 18 bp, Homo sapiens
tgccccagtttggggtgc

SEQ ID NO: 1152622 - DNA, 17 bp, Homo sapiens
tgccccatcctccagca

SEQ ID NO: 1152623 - DNA, 21 bp, Homo sapiens
tgccccatcctccagcaggga

SEQ ID NO: 1152624 - DNA, 12 bp, Homo sapiens
tgccccatgcct

SEQ ID NO: 1152625 - DNA, 16 bp, Homo sapiens
tgccccattcctaaga

SEQ ID NO: 1152626 - DNA, 20 bp, Homo sapiens
tgccccattccttgcgcctc

SEQ ID NO: 1152627 - DNA, 12 bp, Homo sapiens
tgccccattctt

SEQ ID NO: 1152628 - DNA, 12 bp, Homo sapiens
tgcccccaagtc

SEQ ID NO: 1152629 - DNA, 12 bp, Homo sapiens
tgcccccactgt

SEQ ID NO: 1152630 - DNA, 17 bp, Homo sapiens
tgcccccagcccaaagg

SEQ ID NO: 1152631 - DNA, 17 bp, Homo sapiens
tgcccccagcctcagcc

SEQ ID NO: 1152632 - DNA, 18 bp, Homo sapiens
tgcccccagcctcagccc

SEQ ID NO: 1152633 - DNA, 13 bp, Homo sapiens
tgcccccaggcag

SEQ ID NO: 1152634 - DNA, 16 bp, Homo sapiens
tgcccccaggcagcca

SEQ ID NO: 1152635 - DNA, 16 bp, Homo sapiens
tgccctgcaggcacag

SEQ ID NO: 1152636 - DNA, 11 bp, Homo sapiens
tgccctgccat

SEQ ID NO: 1152637 - DNA, 14 bp, Homo sapiens
tgccctgcccaagt

SEQ ID NO: 1152638 - DNA, 22 bp, Homo sapiens
tgccctgcccatactgagcctg

SEQ ID NO: 1152639 - DNA, 23 bp, Homo sapiens
tgccctgcccatactgagcctgc

SEQ ID NO: 1152640 - DNA, 17 bp, Homo sapiens
tgccctgcctcagccag

SEQ ID NO: 1152641 - DNA, 18 bp, Homo sapiens
tgccctgcctcagccagg

SEQ ID NO: 1152642 - DNA, 12 bp, Homo sapiens
tgccctgcctga

SEQ ID NO: 1152643 - DNA, 15 bp, Homo sapiens
tgccctgcctgccca

SEQ ID NO: 1152644 - DNA, 16 bp, Homo sapiens
tgccctgcctgcccac

SEQ ID NO: 1152645 - DNA, 14 bp, Homo sapiens
tgccctgcctgggc

SEQ ID NO: 1152646 - DNA, 12 bp, Homo sapiens
tgccctgccttg

SEQ ID NO: 1152647 - DNA, 17 bp, Homo sapiens
tgccctgccttgccgct

SEQ ID NO: 1152648 - DNA, 12 bp, Homo sapiens
tgccctgctcct

SEQ ID NO: 1152649 - DNA, 18 bp, Homo sapiens
tgccctgctgagtcccag

SEQ ID NO: 1152650 - DNA, 11 bp, Homo sapiens
tgccctgctgc

SEQ ID NO: 1152651 - DNA, 15 bp, Homo sapiens
tgccctgctgccaca

SEQ ID NO: 1152652 - DNA, 20 bp, Homo sapiens
tgccctggaggctgacacag

SEQ ID NO: 1152653 - DNA, 21 bp, Homo sapiens
tgccctggaggctgacacaga

SEQ ID NO: 1152654 - DNA, 16 bp, Homo sapiens
tgccctggaggtggct

SEQ ID NO: 1152655 - DNA, 18 bp, Homo sapiens
tgccctggatgcccagga

SEQ ID NO: 1152656 - DNA, 12 bp, Homo sapiens
tgccctggccct

SEQ ID NO: 1152657 - DNA, 12 bp, Homo sapiens
tgccctggctcc

SEQ ID NO: 1152658 - DNA, 14 bp, Homo sapiens
tgccctggctccag

SEQ ID NO: 1152659 - DNA, 16 bp, Homo sapiens
tgccctggctccttgc

SEQ ID NO: 1152660 - DNA, 23 bp, Homo sapiens
tgccctggctccttgcagcaggg

SEQ ID NO: 1152661 - DNA, 15 bp, Homo sapiens
tgccctggctgctgc

SEQ ID NO: 1152662 - DNA, 20 bp, Homo sapiens
tgccctggctgctgccccca

SEQ ID NO: 1152663 - DNA, 18 bp, Homo sapiens
tgccctgggatgcctcac

SEQ ID NO: 1152664 - DNA, 20 bp, Homo sapiens
tgccctgggatgcctcacca

SEQ ID NO: 1152665 - DNA, 22 bp, Homo sapiens
tgccctgggccaaaaccaatgc

SEQ ID NO: 1152666 - DNA, 16 bp, Homo sapiens
tgccctgggccaggca

SEQ ID NO: 1152667 - DNA, 13 bp, Homo sapiens
tgccctggggaga

SEQ ID NO: 1152668 - DNA, 23 bp, Homo sapiens
tgccctggtggagaaagcactga

SEQ ID NO: 1152669 - DNA, 12 bp, Homo sapiens
tgccctgtccct

SEQ ID NO: 1152670 - DNA, 17 bp, Homo sapiens
tgcccttcacagtgttt

SEQ ID NO: 1152671 - DNA, 21 bp, Homo sapiens
tgcccttccccctgcaaaaag

SEQ ID NO: 1152672 - DNA, 11 bp, Homo sapiens
tgcccttccct

SEQ ID NO: 1152673 - DNA, 20 bp, Homo sapiens
tgcccttcctcagggcccct

SEQ ID NO: 1152674 - DNA, 13 bp, Homo sapiens
tgcccttgccctg

SEQ ID NO: 1152675 - DNA, 15 bp, Homo sapiens
tgcccttgccctgac

SEQ ID NO: 1152676 - DNA, 19 bp, Homo sapiens
tgcccttgccctgacctcc

SEQ ID NO: 1152677 - DNA, 14 bp, Homo sapiens
tgcccttgctgccc

SEQ ID NO: 1152678 - DNA, 21 bp, Homo sapiens
tgcccttggcaccaccagggt

SEQ ID NO: 1152679 - DNA, 22 bp, Homo sapiens
tgcccttggggtaagccagagc

SEQ ID NO: 1152680 - DNA, 19 bp, Homo sapiens
tgcccttggtagcagcctg

SEQ ID NO: 1152681 - DNA, 19 bp, Homo sapiens
tgccctttagggctgttgc

SEQ ID NO: 1152682 - DNA, 20 bp, Homo sapiens
tgccctttagggctgttgct

SEQ ID NO: 1152683 - DNA, 21 bp, Homo sapiens
tgccctttagggctgttgcta

SEQ ID NO: 1152684 - DNA, 22 bp, Homo sapiens
tgccgaatgtgcaggtttgtta

SEQ ID NO: 1152685 - DNA, 15 bp, Homo sapiens
tgccgaccagagccc

SEQ ID NO: 1152686 - DNA, 22 bp, Homo sapiens
tgccgaccagagccccacacgg

SEQ ID NO: 1152687 - DNA, 14 bp, Homo sapiens
tgccgacctcgtcc

SEQ ID NO: 1152688 - DNA, 21 bp, Homo sapiens
tgccgacctcgtcctccccct

SEQ ID NO: 1152689 - DNA, 22 bp, Homo sapiens
tgccgactcccccaaccaagga

SEQ ID NO: 1152690 - DNA, 19 bp, Homo sapiens
tgccgacttggagactcct

SEQ ID NO: 1152691 - DNA, 16 bp, Homo sapiens
tgccgagagaggcgcg

SEQ ID NO: 1152692 - DNA, 22 bp, Homo sapiens
tgccgagagaggcgcgtctgcc

SEQ ID NO: 1152693 - DNA, 13 bp, Homo sapiens
tgccgatgttgaa

SEQ ID NO: 1152694 - DNA, 20 bp, Homo sapiens
tgccgatttctgtaaactct

SEQ ID NO: 1152695 - DNA, 20 bp, Homo sapiens
tgccgcaagtctgcagcccg

SEQ ID NO: 1152696 - DNA, 18 bp, Homo sapiens
tgccgcagggagggctgt

SEQ ID NO: 1152697 - DNA, 14 bp, Homo sapiens
tgccgcatgctccc

SEQ ID NO: 1152698 - DNA, 18 bp, Homo sapiens
tgccgccccctcctgaac

SEQ ID NO: 1152699 - DNA, 19 bp, Homo sapiens
tgccgccccctcctgaacc

SEQ ID NO: 1152700 - DNA, 14 bp, Homo sapiens
tgccgcctcccagc

SEQ ID NO: 1152701 - DNA, 16 bp, Homo sapiens
tgccgcgtcgccctcc

SEQ ID NO: 1152702 - DNA, 21 bp, Homo sapiens
tgccgcgtcgccctcccaggc

SEQ ID NO: 1152703 - DNA, 12 bp, Homo sapiens
tgcctcctggag

SEQ ID NO: 1152704 - DNA, 15 bp, Homo sapiens
tgcctcctggtttcc

SEQ ID NO: 1152705 - DNA, 17 bp, Homo sapiens
tgcctcctgtgcctccc

SEQ ID NO: 1152706 - DNA, 14 bp, Homo sapiens
tgcctcctgtgggg

SEQ ID NO: 1152707 - DNA, 14 bp, Homo sapiens
tgcctcctgttctg

SEQ ID NO: 1152708 - DNA, 17 bp, Homo sapiens
tgcctcctgttttctcc

SEQ ID NO: 1152709 - DNA, 19 bp, Homo sapiens
tgcctccttccacctccct

SEQ ID NO: 1152710 - DNA, 17 bp, Homo sapiens
tgcctcgaaacacagaa

SEQ ID NO: 1152711 - DNA, 21 bp, Homo sapiens
tgcctcgaaacacagaaacct

SEQ ID NO: 1152712 - DNA, 24 bp, Homo sapiens
tgcctcgacacgtgggctcccctc

SEQ ID NO: 1152713 - DNA, 20 bp, Homo sapiens
tgcctcgagggccgcctgcc

SEQ ID NO: 1152714 - DNA, 14 bp, Homo sapiens
tgcctcggactcca

SEQ ID NO: 1152715 - DNA, 21 bp, Homo sapiens
tgcctctacacaggggccctg

SEQ ID NO: 1152716 - DNA, 22 bp, Homo sapiens
tgcctctacacaggggccctgt

SEQ ID NO: 1152717 - DNA, 15 bp, Homo sapiens
tgcctctacctgaca

SEQ ID NO: 1152718 - DNA, 14 bp, Homo sapiens
tgcctctatgccct

SEQ ID NO: 1152719 - DNA, 17 bp, Homo sapiens
tgcctctatgccctgca

SEQ ID NO: 1152720 - DNA, 20 bp, Homo sapiens
tgcctctatgccctgcagag

SEQ ID NO: 1152721 - DNA, 14 bp, Homo sapiens
tgcctctccaggca

SEQ ID NO: 1152722 - DNA, 16 bp, Homo sapiens
tgcctctcccaggctg

SEQ ID NO: 1152723 - DNA, 12 bp, Homo sapiens
tgcctctccctc

SEQ ID NO: 1152724 - DNA, 14 bp, Homo sapiens
tgcctctccctctg

SEQ ID NO: 1152725 - DNA, 18 bp, Homo sapiens
tgcctctccctgggtctg

SEQ ID NO: 1152726 - DNA, 23 bp, Homo sapiens
tgcctctctggaaagaggctctg

SEQ ID NO: 1152727 - DNA, 14 bp, Homo sapiens
tgcctctcttgccc

SEQ ID NO: 1152728 - DNA, 16 bp, Homo sapiens
tgcctctcttgcccct

SEQ ID NO: 1152729 - DNA, 23 bp, Homo sapiens
tgcctctgacagcagcctgtgag

SEQ ID NO: 1152730 - DNA, 11 bp, Homo sapiens
tgcctctgagt

SEQ ID NO: 1152731 - DNA, 11 bp, Homo sapiens
tgcctctgcct

SEQ ID NO: 1152732 - DNA, 18 bp, Homo sapiens
tgcctctgcctgtctccc

SEQ ID NO: 1152733 - DNA, 11 bp, Homo sapiens
tgcctctgctc

SEQ ID NO: 1152734 - DNA, 15 bp, Homo sapiens
tgcctctgctccctc

SEQ ID NO: 1152735 - DNA, 16 bp, Homo sapiens
tgcctctgctccctct

SEQ ID NO: 1152736 - DNA, 18 bp, Homo sapiens
tgcctctggaggcctctg

SEQ ID NO: 1152737 - DNA, 23 bp, Homo sapiens
tgcctctggaggcctctggccct

SEQ ID NO: 1152738 - DNA, 14 bp, Homo sapiens
tgcctctgggactg

SEQ ID NO: 1152739 - DNA, 12 bp, Homo sapiens
tgcctctgggca

SEQ ID NO: 1152740 - DNA, 15 bp, Homo sapiens
tgcctctgggcagcc

SEQ ID NO: 1152741 - DNA, 18 bp, Homo sapiens
tgcctctgggcagcctgc

SEQ ID NO: 1152742 - DNA, 20 bp, Homo sapiens
tgcctctgggcagcctgctt

SEQ ID NO: 1152743 - DNA, 21 bp, Homo sapiens
tgcctctgggcagcctgcttt

SEQ ID NO: 1152744 - DNA, 13 bp, Homo sapiens
tgcctctgtcctc

SEQ ID NO: 1152745 - DNA, 16 bp, Homo sapiens
tgcctctgtcctccca

SEQ ID NO: 1152746 - DNA, 17 bp, Homo sapiens
tgcctctgtcctcccat

SEQ ID NO: 1152747 - DNA, 19 bp, Homo sapiens
tgcctctgtcctcccatcc

SEQ ID NO: 1152748 - DNA, 12 bp, Homo sapiens
tgcctctgtgga

SEQ ID NO: 1152749 - DNA, 13 bp, Homo sapiens
tgcctctgtggaa

SEQ ID NO: 1152750 - DNA, 14 bp, Homo sapiens
tgcctctgtggaag

SEQ ID NO: 1152751 - DNA, 19 bp, Homo sapiens
tgcctctgtgtagccgccc

SEQ ID NO: 1152752 - DNA, 16 bp, Homo sapiens
tgcctcttccagtgaa

SEQ ID NO: 1152753 - DNA, 18 bp, Homo sapiens
tgcctcttccagtgaaca

SEQ ID NO: 1152754 - DNA, 13 bp, Homo sapiens
tgcctcttctggg

SEQ ID NO: 1152755 - DNA, 16 bp, Homo sapiens
tgcctcttctgggagg

SEQ ID NO: 1152756 - DNA, 13 bp, Homo sapiens
tgcctcttggctt

SEQ ID NO: 1152757 - DNA, 22 bp, Homo sapiens
tgcctcttggcttctcagcccc

SEQ ID NO: 1152758 - DNA, 17 bp, Homo sapiens
tgcctcttgtgtccctg

SEQ ID NO: 1152759 - DNA, 15 bp, Homo sapiens
tgcctcttgtttctg

SEQ ID NO: 1152760 - DNA, 15 bp, Homo sapiens
tgcctctttcatcca

SEQ ID NO: 1152761 - DNA, 14 bp, Homo sapiens
tgcctctttcctgt

SEQ ID NO: 1152762 - DNA, 12 bp, Homo sapiens
tgcctgaaacag

SEQ ID NO: 1152763 - DNA, 19 bp, Homo sapiens
tgcctgaaacagccatgtc

SEQ ID NO: 1152764 - DNA, 13 bp, Homo sapiens
tgcctgaacatcc

SEQ ID NO: 1152765 - DNA, 15 bp, Homo sapiens
tgcctgaatatttgt

SEQ ID NO: 1152766 - DNA, 13 bp, Homo sapiens
tgcctgacacact

SEQ ID NO: 1152767 - DNA, 20 bp, Homo sapiens
tgccagcacaggggccccag

SEQ ID NO: 1152768 - DNA, 22 bp, Homo sapiens
tgccagcacctttgagccttgg

SEQ ID NO: 1152769 - DNA, 16 bp, Homo sapiens
tgccagcagcagcagg

SEQ ID NO: 1152770 - DNA, 17 bp, Homo sapiens
tgccagcagcagcaggt

SEQ ID NO: 1152771 - DNA, 16 bp, Homo sapiens
tgccagcagcctcgca

SEQ ID NO: 1152772 - DNA, 19 bp, Homo sapiens
tgccagcagcctcgcacag

SEQ ID NO: 1152773 - DNA, 19 bp, Homo sapiens
tgccagcatacattttctg

SEQ ID NO: 1152774 - DNA, 21 bp, Homo sapiens
tgccagccaatccctggccat

SEQ ID NO: 1152775 - DNA, 17 bp, Homo sapiens
tgccagccagcagccag

SEQ ID NO: 1152776 - DNA, 13 bp, Homo sapiens
tgccagccgaccc

SEQ ID NO: 1152777 - DNA, 19 bp, Homo sapiens
tgccagccgaccctcctgg

SEQ ID NO: 1152778 - DNA, 14 bp, Homo sapiens
tgccagcctgagcg

SEQ ID NO: 1152779 - DNA, 12 bp, Homo sapiens
tgccagcctggc

SEQ ID NO: 1152780 - DNA, 16 bp, Homo sapiens
tgccagcctggcttct

SEQ ID NO: 1152781 - DNA, 20 bp, Homo sapiens
tgccagcctggcttctggag

SEQ ID NO: 1152782 - DNA, 22 bp, Homo sapiens
tgccagcctggcttctggagcc

SEQ ID NO: 1152783 - DNA, 12 bp, Homo sapiens
tgccagccttcc

SEQ ID NO: 1152784 - DNA, 21 bp, Homo sapiens
tgccagccttcctctgcagct

SEQ ID NO: 1152785 - DNA, 19 bp, Homo sapiens
tgccagccttgagccctgg

SEQ ID NO: 1152786 - DNA, 21 bp, Homo sapiens
tgccagcgccaaaacaagcca

SEQ ID NO: 1152787 - DNA, 19 bp, Homo sapiens
tgccagctactcaggaggc

SEQ ID NO: 1152788 - DNA, 19 bp, Homo sapiens
tgccagctccagtgccgct

SEQ ID NO: 1152789 - DNA, 23 bp, Homo sapiens
tgccagctctgtatcaggaccca

SEQ ID NO: 1152790 - DNA, 13 bp, Homo sapiens
tgccagctgcctt

SEQ ID NO: 1152791 - DNA, 14 bp, Homo sapiens
tgccagctgccttc

SEQ ID NO: 1152792 - DNA, 15 bp, Homo sapiens
tgccagctgccttcc

SEQ ID NO: 1152793 - DNA, 17 bp, Homo sapiens
tgccagctgccttcctc

SEQ ID NO: 1152794 - DNA, 16 bp, Homo sapiens
tgccagctggcctttg

SEQ ID NO: 1152795 - DNA, 14 bp, Homo sapiens
tgccagcttctctc

SEQ ID NO: 1152796 - DNA, 15 bp, Homo sapiens
tgccagcttctctct

SEQ ID NO: 1152797 - DNA, 20 bp, Homo sapiens
tgccagcttctctctccagg

SEQ ID NO: 1152798 - DNA, 21 bp, Homo sapiens
tgccagcttctctctccaggg

SEQ ID NO: 1152799 - DNA, 22 bp, Homo sapiens
tgccagcttctctctccagggt

SEQ ID NO: 1152800 - DNA, 19 bp, Homo sapiens
tgccagcttttcctccctt

SEQ ID NO: 1152801 - DNA, 21 bp, Homo sapiens
tgccaggaacctgtcctaagg

SEQ ID NO: 1152802 - DNA, 22 bp, Homo sapiens
tgccaggaacctgtcctaagga

SEQ ID NO: 1152803 - DNA, 12 bp, Homo sapiens
tgccaggaccag

SEQ ID NO: 1152804 - DNA, 14 bp, Homo sapiens
tgccaggaccagcc

SEQ ID NO: 1152805 - DNA, 16 bp, Homo sapiens
tgccaggaccagcctg

SEQ ID NO: 1152806 - DNA, 20 bp, Homo sapiens
tgccaggaccagtcaacctg

SEQ ID NO: 1152807 - DNA, 17 bp, Homo sapiens
tgccaggaccccaggtc

SEQ ID NO: 1152808 - DNA, 18 bp, Homo sapiens
tgccaggacccgccagcc

SEQ ID NO: 1152809 - DNA, 21 bp, Homo sapiens
tgccaggacccgccagccccg

SEQ ID NO: 1152810 - DNA, 22 bp, Homo sapiens
tgccaggacccgccagccccgc

SEQ ID NO: 1152811 - DNA, 23 bp, Homo sapiens
tgccaggactccccaggccaggc

SEQ ID NO: 1152812 - DNA, 14 bp, Homo sapiens
tgccaggagggcac

SEQ ID NO: 1152813 - DNA, 20 bp, Homo sapiens
tgccaggcacacacagcccc

SEQ ID NO: 1152814 - DNA, 17 bp, Homo sapiens
tgccaggcacctggcct

SEQ ID NO: 1152815 - DNA, 14 bp, Homo sapiens
tgccaggcactctc

SEQ ID NO: 1152816 - DNA, 15 bp, Homo sapiens
tgccaggcaggggtg

SEQ ID NO: 1152817 - DNA, 18 bp, Homo sapiens
tgccaggcaggggtgggg

SEQ ID NO: 1152818 - DNA, 14 bp, Homo sapiens
tgccaggcatggtg

SEQ ID NO: 1152819 - DNA, 14 bp, Homo sapiens
tgccaggcggccct

SEQ ID NO: 1152820 - DNA, 15 bp, Homo sapiens
tgccaggcggccctg

SEQ ID NO: 1152821 - DNA, 17 bp, Homo sapiens
tgccaggcggccctggg

SEQ ID NO: 1152822 - DNA, 22 bp, Homo sapiens
tgccaggcgttggtgccacttc

SEQ ID NO: 1152823 - DNA, 20 bp, Homo sapiens
tgccaggctgcgtccctccg

SEQ ID NO: 1152824 - DNA, 15 bp, Homo sapiens
tgccaggctgggcac

SEQ ID NO: 1152825 - DNA, 16 bp, Homo sapiens
tgccaggctgtaagca

SEQ ID NO: 1152826 - DNA, 12 bp, Homo sapiens
tgccaggctgtt

SEQ ID NO: 1152827 - DNA, 15 bp, Homo sapiens
tgccaggcttgcctg

SEQ ID NO: 1152828 - DNA, 18 bp, Homo sapiens
tgccaggcttgcctgggc

SEQ ID NO: 1152829 - DNA, 12 bp, Homo sapiens
tgccagggagct

SEQ ID NO: 1152830 - DNA, 13 bp, Homo sapiens
tgccagggcaggg

SEQ ID NO: 1152831 - DNA, 15 bp, Homo sapiens
tgccagggcagggcc

SEQ ID NO: 1152832 - DNA, 18 bp, Homo sapiens
tgccagggcagggtctgg

SEQ ID NO: 1152833 - DNA, 14 bp, Homo sapiens
tgccagggcccagg

SEQ ID NO: 1152834 - DNA, 16 bp, Homo sapiens
tgccagggcccaggag

SEQ ID NO: 1152835 - DNA, 17 bp, Homo sapiens
tgccaggggtaacctgg

SEQ ID NO: 1152836 - DNA, 20 bp, Homo sapiens
tgccaggggtaacctggcca

SEQ ID NO: 1152837 - DNA, 15 bp, Homo sapiens
tgccagggtgggctg

SEQ ID NO: 1152838 - DNA, 21 bp, Homo sapiens
tgccagggtgggctggggact

SEQ ID NO: 1152839 - DNA, 22 bp, Homo sapiens
tgccagggtgggctggggactc

SEQ ID NO: 1152840 - DNA, 20 bp, Homo sapiens
tgccaggtggttgggttctg

SEQ ID NO: 1152841 - DNA, 22 bp, Homo sapiens
tgccagtaaaaaaaaaaaatgg

SEQ ID NO: 1152842 - DNA, 18 bp, Homo sapiens
tgccagtaacgcgtcttc

SEQ ID NO: 1152843 - DNA, 21 bp, Homo sapiens
tgccagtattttaaaatagcg

SEQ ID NO: 1152844 - DNA, 17 bp, Homo sapiens
tgccagtcaagaagaaa

SEQ ID NO: 1152845 - DNA, 17 bp, Homo sapiens
tgccagtccccctgccc

SEQ ID NO: 1152846 - DNA, 20 bp, Homo sapiens
tgccagtccccctgccccag

SEQ ID NO: 1152847 - DNA, 23 bp, Homo sapiens
tgccagtctcactgtgggaaggc

SEQ ID NO: 1152848 - DNA, 17 bp, Homo sapiens
tgccagtgaagacttct

SEQ ID NO: 1152849 - DNA, 22 bp, Homo sapiens
tgccagtgaagacttcttgggt

SEQ ID NO: 1152850 - DNA, 21 bp, Homo sapiens
tgccagtgaagggttttgtgt

SEQ ID NO: 1152851 - DNA, 22 bp, Homo sapiens
tgccagtgaagtccttcagtga

SEQ ID NO: 1152852 - DNA, 22 bp, Homo sapiens
tgccagtgacagacaggctctt

SEQ ID NO: 1152853 - DNA, 16 bp, Homo sapiens
tgccagtgcagccact

SEQ ID NO: 1152854 - DNA, 15 bp, Homo sapiens
tgccagtgccagggt

SEQ ID NO: 1152855 - DNA, 15 bp, Homo sapiens
tgccagtgccttacc

SEQ ID NO: 1152856 - DNA, 22 bp, Homo sapiens
tgccagtgccttacctcctgcc

SEQ ID NO: 1152857 - DNA, 18 bp, Homo sapiens
tgccagttacttgcttta

SEQ ID NO: 1152858 - DNA, 22 bp, Homo sapiens
tgccagttgaaaatggattttt

SEQ ID NO: 1152859 - DNA, 12 bp, Homo sapiens
tgccataaaaca

SEQ ID NO: 1152860 - DNA, 14 bp, Homo sapiens
tgccataaaacatt

SEQ ID NO: 1152861 - DNA, 21 bp, Homo sapiens
tgccataaaattgcagtttca

SEQ ID NO: 1152862 - DNA, 13 bp, Homo sapiens
tgccataattcta

SEQ ID NO: 1152863 - DNA, 23 bp, Homo sapiens
tgccataattctaagttatttac

SEQ ID NO: 1152864 - DNA, 13 bp, Homo sapiens
tgccatactaatg

SEQ ID NO: 1152865 - DNA, 17 bp, Homo sapiens
tgccatactttgtctga

SEQ ID NO: 1152866 - DNA, 18 bp, Homo sapiens
tgccatactttgtctgaa

SEQ ID NO: 1152867 - DNA, 23 bp, Homo sapiens
tgccttcgcaccttgctgtgtga

SEQ ID NO: 1152868 - DNA, 17 bp, Homo sapiens
tgccttcgcttcttgcc

SEQ ID NO: 1152869 - DNA, 23 bp, Homo sapiens
tgccttcgcttcttgcctctgtg

SEQ ID NO: 1152870 - DNA, 20 bp, Homo sapiens
tgccttcgtctttcccatgg

SEQ ID NO: 1152871 - DNA, 15 bp, Homo sapiens
tgccttctaaaggtg

SEQ ID NO: 1152872 - DNA, 22 bp, Homo sapiens
tgccttctagattcactgtctt

SEQ ID NO: 1152873 - DNA, 14 bp, Homo sapiens
tgccttctcctctc

SEQ ID NO: 1152874 - DNA, 22 bp, Homo sapiens
tgccttctgccaacgcctcctg

SEQ ID NO: 1152875 - DNA, 17 bp, Homo sapiens
tgccttctgggcttttt

SEQ ID NO: 1152876 - DNA, 16 bp, Homo sapiens
tgccttcttcacccag

SEQ ID NO: 1152877 - DNA, 19 bp, Homo sapiens
tgccttcttccaggatcag

SEQ ID NO: 1152878 - DNA, 23 bp, Homo sapiens
tgccttcttcggggaactcctgg

SEQ ID NO: 1152879 - DNA, 18 bp, Homo sapiens
tgccttgacaacagactg

SEQ ID NO: 1152880 - DNA, 20 bp, Homo sapiens
tgccttgataaatatatatg

SEQ ID NO: 1152881 - DNA, 14 bp, Homo sapiens
tgccttgcagaact

SEQ ID NO: 1152882 - DNA, 19 bp, Homo sapiens
tgccttgcagaactgccat

SEQ ID NO: 1152883 - DNA, 13 bp, Homo sapiens
tgccttgcccaca

SEQ ID NO: 1152884 - DNA, 19 bp, Homo sapiens
tgccttgcccacaggtgcg

SEQ ID NO: 1152885 - DNA, 17 bp, Homo sapiens
tgccttgccgctcccct

SEQ ID NO: 1152886 - DNA, 20 bp, Homo sapiens
tgccttgccgctccccttgg

SEQ ID NO: 1152887 - DNA, 13 bp, Homo sapiens
tgccttgctgttt

SEQ ID NO: 1152888 - DNA, 11 bp, Homo sapiens
tgccttgcttc

SEQ ID NO: 1152889 - DNA, 13 bp, Homo sapiens
tgccttgcttctc

SEQ ID NO: 1152890 - DNA, 16 bp, Homo sapiens
tgccttgcttctccca

SEQ ID NO: 1152891 - DNA, 17 bp, Homo sapiens
tgccttgcttctcccat

SEQ ID NO: 1152892 - DNA, 17 bp, Homo sapiens
tgccttggcctcccaaa

SEQ ID NO: 1152893 - DNA, 18 bp, Homo sapiens
tgccttggcctcccaaag

SEQ ID NO: 1152894 - DNA, 17 bp, Homo sapiens
tgccttggctcagacat

SEQ ID NO: 1152895 - DNA, 19 bp, Homo sapiens
tgccttggctcagacatgt

SEQ ID NO: 1152896 - DNA, 19 bp, Homo sapiens
tgccttggggaatttcctc

SEQ ID NO: 1152897 - DNA, 20 bp, Homo sapiens
tgccttggggaatttcctct

SEQ ID NO: 1152898 - DNA, 15 bp, Homo sapiens
tgccttggttctggc

SEQ ID NO: 1152899 - DNA, 19 bp, Homo sapiens
tgccttggttctggccacc

SEQ ID NO: 1152900 - DNA, 22 bp, Homo sapiens
tgccttggttctggccacccca

SEQ ID NO: 1152901 - DNA, 22 bp, Homo sapiens
tgccttgtccaggaactgcctg

SEQ ID NO: 1152902 - DNA, 17 bp, Homo sapiens
tgccttgtttgagtttt

SEQ ID NO: 1152903 - DNA, 14 bp, Homo sapiens
tgcctttaaatctg

SEQ ID NO: 1152904 - DNA, 12 bp, Homo sapiens
tgcctttaacag

SEQ ID NO: 1152905 - DNA, 22 bp, Homo sapiens
tgcctttaatattttgtaatat

SEQ ID NO: 1152906 - DNA, 15 bp, Homo sapiens
tgcctttagaaaata

SEQ ID NO: 1152907 - DNA, 19 bp, Homo sapiens
tgcctttatctcagccatc

SEQ ID NO: 1152908 - DNA, 22 bp, Homo sapiens
tgcctttatgatgctaagctga

SEQ ID NO: 1152909 - DNA, 17 bp, Homo sapiens
tgcctttcaaatttaga

SEQ ID NO: 1152910 - DNA, 18 bp, Homo sapiens
tgcctttcagaagtgatt

SEQ ID NO: 1152911 - DNA, 13 bp, Homo sapiens
tgcctttccaggg

SEQ ID NO: 1152912 - DNA, 15 bp, Homo sapiens
tgcctttcctatcac

SEQ ID NO: 1152913 - DNA, 23 bp, Homo sapiens
tgcctttcctatcacctcgagaa

SEQ ID NO: 1152914 - DNA, 17 bp, Homo sapiens
tgcctttcgaggcctga

SEQ ID NO: 1152915 - DNA, 13 bp, Homo sapiens
tgcctttctgcct

SEQ ID NO: 1152916 - DNA, 21 bp, Homo sapiens
tgcctttgcagttggactctc

SEQ ID NO: 1152917 - DNA, 15 bp, Homo sapiens
tgcctttgctgttta

SEQ ID NO: 1152918 - DNA, 12 bp, Homo sapiens
tgcctttgtaag

SEQ ID NO: 1152919 - DNA, 17 bp, Homo sapiens
tgcctttgtatgtggaa

SEQ ID NO: 1152920 - DNA, 18 bp, Homo sapiens
tgcctttgtatgtggaag

SEQ ID NO: 1152921 - DNA, 16 bp, Homo sapiens
tgcctttgtccccaca

SEQ ID NO: 1152922 - DNA, 15 bp, Homo sapiens
tgcctttgttttgat

SEQ ID NO: 1152923 - DNA, 17 bp, Homo sapiens
tgccttttaagtttgaa

SEQ ID NO: 1152924 - DNA, 20 bp, Homo sapiens
tgccttttaagtttgaaact

SEQ ID NO: 1152925 - DNA, 13 bp, Homo sapiens
tgccttttatagc

SEQ ID NO: 1152926 - DNA, 17 bp, Homo sapiens
tgccttttatagctatt

SEQ ID NO: 1152927 - DNA, 14 bp, Homo sapiens
tgccttttgcaccc

SEQ ID NO: 1152928 - DNA, 15 bp, Homo sapiens
tgccttttgcacccc

SEQ ID NO: 1152929 - DNA, 20 bp, Homo sapiens
tgccttttgcacccctccca

SEQ ID NO: 1152930 - DNA, 17 bp, Homo sapiens
tgccttttgcagaagag

SEQ ID NO: 1152931 - DNA, 22 bp, Homo sapiens
tgccttttggtttcaccttccc

SEQ ID NO: 1152932 - DNA, 17 bp, Homo sapiens
tgccttttgtgtgatgc

SEQ ID NO: 1152933 - DNA, 21 bp, Homo sapiens
tgcctttttagatgtattttt

SEQ ID NO: 1152934 - DNA, 16 bp, Homo sapiens
tgcctttttccttatt

SEQ ID NO: 1152935 - DNA, 21 bp, Homo sapiens
tgccttttttcacggaagttt

SEQ ID NO: 1152936 - DNA, 21 bp, Homo sapiens
tgccttttttctatatcaaaa

SEQ ID NO: 1152937 - DNA, 18 bp, Homo sapiens
tgcgaaatgttctcatga

SEQ ID NO: 1152938 - DNA, 20 bp, Homo sapiens
tgcgaagaccctcttgccca

SEQ ID NO: 1152939 - DNA, 16 bp, Homo sapiens
tgcgaaggggccctgg

SEQ ID NO: 1152940 - DNA, 15 bp, Homo sapiens
tgcgacggagagaaa

SEQ ID NO: 1152941 - DNA, 13 bp, Homo sapiens
tgcaggcagacac

SEQ ID NO: 1152942 - DNA, 15 bp, Homo sapiens
tgcaggcagagctgg

SEQ ID NO: 1152943 - DNA, 22 bp, Homo sapiens
tgcaggcagagctggagccccc

SEQ ID NO: 1152944 - DNA, 13 bp, Homo sapiens
tgcaggcagcctt

SEQ ID NO: 1152945 - DNA, 14 bp, Homo sapiens
tgcaggcagccttg

SEQ ID NO: 1152946 - DNA, 15 bp, Homo sapiens
tgcaggcagccttga

SEQ ID NO: 1152947 - DNA, 19 bp, Homo sapiens
tgcaggcaggaacaaacag

SEQ ID NO: 1152948 - DNA, 20 bp, Homo sapiens
tgcaggcaggaacaaacagg

SEQ ID NO: 1152949 - DNA, 19 bp, Homo sapiens
tgcaggcaggcggctcctc

SEQ ID NO: 1152950 - DNA, 15 bp, Homo sapiens
tgcaggccaggccag

SEQ ID NO: 1152951 - DNA, 19 bp, Homo sapiens
tgcaggccccgcttgtcca

SEQ ID NO: 1152952 - DNA, 20 bp, Homo sapiens
tgcaggccctggcctcccct

SEQ ID NO: 1152953 - DNA, 17 bp, Homo sapiens
tgcaggcctaggtgcag

SEQ ID NO: 1152954 - DNA, 14 bp, Homo sapiens
tgcaggctctgggc

SEQ ID NO: 1152955 - DNA, 15 bp, Homo sapiens
tgcaggctctgggct

SEQ ID NO: 1152956 - DNA, 18 bp, Homo sapiens
tgcaggctctgggctcag

SEQ ID NO: 1152957 - DNA, 19 bp, Homo sapiens
tgcaggctctgggctcagg

SEQ ID NO: 1152958 - DNA, 23 bp, Homo sapiens
tgcaggctctgggctcagggctg

SEQ ID NO: 1152959 - DNA, 22 bp, Homo sapiens
tgcaggctggcaccgccttctc

SEQ ID NO: 1152960 - DNA, 16 bp, Homo sapiens
tgcaggctggggaggt

SEQ ID NO: 1152961 - DNA, 19 bp, Homo sapiens
tgcaggctggggaggtgct

SEQ ID NO: 1152962 - DNA, 20 bp, Homo sapiens
tgcagggaaaattatttgca

SEQ ID NO: 1152963 - DNA, 16 bp, Homo sapiens
tgcagggaagagggca

SEQ ID NO: 1152964 - DNA, 15 bp, Homo sapiens
tgcagggacaaagag

SEQ ID NO: 1152965 - DNA, 20 bp, Homo sapiens
tgcagggagacatctgcacc

SEQ ID NO: 1152966 - DNA, 14 bp, Homo sapiens
tgcagggagcactg

SEQ ID NO: 1152967 - DNA, 24 bp, Homo sapiens
tgcagggaggaggtggcagccctg

SEQ ID NO: 1152968 - DNA, 15 bp, Homo sapiens
tgcagggaggggagg

SEQ ID NO: 1152969 - DNA, 16 bp, Homo sapiens
tgcagggaggggaggc

SEQ ID NO: 1152970 - DNA, 18 bp, Homo sapiens
tgcagggcacggggacct

SEQ ID NO: 1152971 - DNA, 16 bp, Homo sapiens
tgcagggcgcccctgg

SEQ ID NO: 1152972 - DNA, 15 bp, Homo sapiens
tgcagggcttctcct

SEQ ID NO: 1152973 - DNA, 20 bp, Homo sapiens
tgcaggggattgaagccctc

SEQ ID NO: 1152974 - DNA, 21 bp, Homo sapiens
tgcaggggattgaagccctcc

SEQ ID NO: 1152975 - DNA, 20 bp, Homo sapiens
tgcaggggccaggggtggga

SEQ ID NO: 1152976 - DNA, 13 bp, Homo sapiens
tgcaggggcctgg

SEQ ID NO: 1152977 - DNA, 16 bp, Homo sapiens
tgcaggggcctggagg

SEQ ID NO: 1152978 - DNA, 24 bp, Homo sapiens
tgcaggggctacgttagcagccca

SEQ ID NO: 1152979 - DNA, 19 bp, Homo sapiens
tgcagggggtgtgtctgct

SEQ ID NO: 1152980 - DNA, 17 bp, Homo sapiens
tgcaggggtccctgcta

SEQ ID NO: 1152981 - DNA, 13 bp, Homo sapiens
tgcaggggtgacg

SEQ ID NO: 1152982 - DNA, 14 bp, Homo sapiens
tgcaggggtgacgg

SEQ ID NO: 1152983 - DNA, 15 bp, Homo sapiens
tgcaggtacttcctc

SEQ ID NO: 1152984 - DNA, 20 bp, Homo sapiens
tgcaggtacttcctcctgat

SEQ ID NO: 1152985 - DNA, 23 bp, Homo sapiens
tgcaggtacttcctcctgatggc

SEQ ID NO: 1152986 - DNA, 14 bp, Homo sapiens
tgcaggtcagcctc

SEQ ID NO: 1152987 - DNA, 19 bp, Homo sapiens
tgcaggtcagttgtaataa

SEQ ID NO: 1152988 - DNA, 16 bp, Homo sapiens
tgcaggtgaacttttt

SEQ ID NO: 1152989 - DNA, 11 bp, Homo sapiens
tgcaggtgctg

SEQ ID NO: 1152990 - DNA, 16 bp, Homo sapiens
tgcaggtgggctgggc

SEQ ID NO: 1152991 - DNA, 21 bp, Homo sapiens
tgcaggtggggttcgagggga

SEQ ID NO: 1152992 - DNA, 19 bp, Homo sapiens
tgcaggtggtgtcgggccc

SEQ ID NO: 1152993 - DNA, 15 bp, Homo sapiens
tgcaggttcatggat

SEQ ID NO: 1152994 - DNA, 17 bp, Homo sapiens
tgcaggttgaagccatg

SEQ ID NO: 1152995 - DNA, 22 bp, Homo sapiens
tgcaggtttctccttgaagcaa

SEQ ID NO: 1152996 - DNA, 16 bp, Homo sapiens
tgcaggtttgttacat

SEQ ID NO: 1152997 - DNA, 14 bp, Homo sapiens
tgcaggttttctgt

SEQ ID NO: 1152998 - DNA, 13 bp, Homo sapiens
tgcagtaaatctt

SEQ ID NO: 1152999 - DNA, 18 bp, Homo sapiens
tgcagtaaatcttttaca

SEQ ID NO: 1153000 - DNA, 18 bp, Homo sapiens
tgcagtactttacctcct

SEQ ID NO: 1153001 - DNA, 18 bp, Homo sapiens
tgcagtactttgtgcatt

SEQ ID NO: 1153002 - DNA, 21 bp, Homo sapiens
tgcagtagtctctgtgctttg

SEQ ID NO: 1153003 - DNA, 14 bp, Homo sapiens
tgcagtatatttct

SEQ ID NO: 1153004 - DNA, 16 bp, Homo sapiens
tgcagtatcatgccct

SEQ ID NO: 1153005 - DNA, 18 bp, Homo sapiens
tgcagtatctcttacatc

SEQ ID NO: 1153006 - DNA, 14 bp, Homo sapiens
tgcagtcactggag

SEQ ID NO: 1153007 - DNA, 13 bp, Homo sapiens
tgcagtcactgtg

SEQ ID NO: 1153008 - DNA, 14 bp, Homo sapiens
tgcagtcagcagat

SEQ ID NO: 1153009 - DNA, 20 bp, Homo sapiens
tgcagtccgttgctgaaaat

SEQ ID NO: 1153010 - DNA, 16 bp, Homo sapiens
tgcagtcctgaggaga

SEQ ID NO: 1153011 - DNA, 19 bp, Homo sapiens
tgcagtcctgatcagagcc

SEQ ID NO: 1153012 - DNA, 19 bp, Homo sapiens
tgcagtcggcatgccagga

SEQ ID NO: 1153013 - DNA, 21 bp, Homo sapiens
tgcagtcggcatgccaggacc

SEQ ID NO: 1153014 - DNA, 13 bp, Homo sapiens
tgcagtctgcaga

SEQ ID NO: 1153015 - DNA, 15 bp, Homo sapiens
tgcagtgagcagggt

SEQ ID NO: 1153016 - DNA, 16 bp, Homo sapiens
tgcagtgagcagggtg

SEQ ID NO: 1153017 - DNA, 20 bp, Homo sapiens
tgcagtgagcagggtggggt

SEQ ID NO: 1153018 - DNA, 15 bp, Homo sapiens
tgcagtgaggggccc

SEQ ID NO: 1153019 - DNA, 14 bp, Homo sapiens
tgcagtgatgtgat

SEQ ID NO: 1153020 - DNA, 10 bp, Homo sapiens
tgcagtgcag

SEQ ID NO: 1153021 - DNA, 12 bp, Homo sapiens
tgcagtgccttg

SEQ ID NO: 1153022 - DNA, 23 bp, Homo sapiens
tgcagtgccttggggaatttcct

SEQ ID NO: 1153023 - DNA, 23 bp, Homo sapiens
tgcagtggcacaatcatggctca

SEQ ID NO: 1153024 - DNA, 18 bp, Homo sapiens
tgcagtggcgcattctag

SEQ ID NO: 1153025 - DNA, 17 bp, Homo sapiens
tgcagtggtgtgctctg

SEQ ID NO: 1153026 - DNA, 16 bp, Homo sapiens
tgcagttaccacagca

SEQ ID NO: 1153027 - DNA, 20 bp, Homo sapiens
tgcagttcaaatcctcacca

SEQ ID NO: 1153028 - DNA, 16 bp, Homo sapiens
tgcagttcattatttt

SEQ ID NO: 1153029 - DNA, 21 bp, Homo sapiens
tgcagttcccccaacctcaga

SEQ ID NO: 1153030 - DNA, 12 bp, Homo sapiens
tgcagttcctgg

SEQ ID NO: 1153031 - DNA, 13 bp, Homo sapiens
tgcagttcctggc

SEQ ID NO: 1153032 - DNA, 17 bp, Homo sapiens
tgcagttctactcaggc

SEQ ID NO: 1153033 - DNA, 17 bp, Homo sapiens
tgcagttgacagcaggt

SEQ ID NO: 1153034 - DNA, 14 bp, Homo sapiens
tgcagttgataaga

SEQ ID NO: 1153035 - DNA, 17 bp, Homo sapiens
tgcagttgataagagga

SEQ ID NO: 1153036 - DNA, 12 bp, Homo sapiens
tgcagttgctgt

SEQ ID NO: 1153037 - DNA, 18 bp, Homo sapiens
tgcagttggactctcagg

SEQ ID NO: 1153038 - DNA, 19 bp, Homo sapiens
tgcagttggactctcaggg

SEQ ID NO: 1153039 - DNA, 18 bp, Homo sapiens
tgcagtttaagagcagaa

SEQ ID NO: 1153040 - DNA, 10 bp, Homo sapiens
tgcagtttat

SEQ ID NO: 1153041 - DNA, 18 bp, Homo sapiens
tgcagtttcatgtatgta

SEQ ID NO: 1153042 - DNA, 19 bp, Homo sapiens
tgcagtttcatgtatgtat

SEQ ID NO: 1153043 - DNA, 12 bp, Homo sapiens
tgcagtttcctg

SEQ ID NO: 1153044 - DNA, 21 bp, Homo sapiens
tgcagtttcttgtgtagattt

SEQ ID NO: 1153045 - DNA, 19 bp, Homo sapiens
tgcagtttgagacaggaga

SEQ ID NO: 1153046 - DNA, 20 bp, Homo sapiens
tgcagtttggccctggagcc

SEQ ID NO: 1153047 - DNA, 22 bp, Homo sapiens
tgcagtttggccctggagccag

SEQ ID NO: 1153048 - DNA, 23 bp, Homo sapiens
tgcagtttggccctggagccagg

SEQ ID NO: 1153049 - DNA, 15 bp, Homo sapiens
tgcagcagaggagct

SEQ ID NO: 1153050 - DNA, 13 bp, Homo sapiens
tgcagcagcccag

SEQ ID NO: 1153051 - DNA, 16 bp, Homo sapiens
tgcagcagcccagctt

SEQ ID NO: 1153052 - DNA, 19 bp, Homo sapiens
tgcagcagcccagcttcct

SEQ ID NO: 1153053 - DNA, 20 bp, Homo sapiens
tgcagcagcccagcttcctg

SEQ ID NO: 1153054 - DNA, 14 bp, Homo sapiens
tgcagcagggatgc

SEQ ID NO: 1153055 - DNA, 22 bp, Homo sapiens
tgcagcagggatgccctggagg

SEQ ID NO: 1153056 - DNA, 14 bp, Homo sapiens
tgcagcagggctgg

SEQ ID NO: 1153057 - DNA, 17 bp, Homo sapiens
tgcagcagggctgggcc

SEQ ID NO: 1153058 - DNA, 22 bp, Homo sapiens
tgcagcagggctgggcctgcga

SEQ ID NO: 1153059 - DNA, 17 bp, Homo sapiens
tgcagcaggtgctgggc

SEQ ID NO: 1153060 - DNA, 18 bp, Homo sapiens
tgcagcagtgagtctctt

SEQ ID NO: 1153061 - DNA, 19 bp, Homo sapiens
tgcagcatgacctgtgacc

SEQ ID NO: 1153062 - DNA, 14 bp, Homo sapiens
tgcagcatgagact

SEQ ID NO: 1153063 - DNA, 15 bp, Homo sapiens
tgcagcatgagactt

SEQ ID NO: 1153064 - DNA, 16 bp, Homo sapiens
tgcagcatgagacttt

SEQ ID NO: 1153065 - DNA, 21 bp, Homo sapiens
tgcagcatgagactttctgct

SEQ ID NO: 1153066 - DNA, 19 bp, Homo sapiens
tgcagcatggtccctgcct

SEQ ID NO: 1153067 - DNA, 17 bp, Homo sapiens
tgcagccaaaggggagc

SEQ ID NO: 1153068 - DNA, 14 bp, Homo sapiens
tgcagccagcccag

SEQ ID NO: 1153069 - DNA, 11 bp, Homo sapiens
tgcagccagct

SEQ ID NO: 1153070 - DNA, 14 bp, Homo sapiens
tgcagccaggagaa

SEQ ID NO: 1153071 - DNA, 22 bp, Homo sapiens
tgcagcccaaaacccagggcaa

SEQ ID NO: 1153072 - DNA, 19 bp, Homo sapiens
tgcagcccaccaggagcac

SEQ ID NO: 1153073 - DNA, 12 bp, Homo sapiens
tgcagcccagcc

SEQ ID NO: 1153074 - DNA, 20 bp, Homo sapiens
tgcagcccagcctagtcagg

SEQ ID NO: 1153075 - DNA, 18 bp, Homo sapiens
tgcagcccatgcccacct

SEQ ID NO: 1153076 - DNA, 19 bp, Homo sapiens
tgcagcccatgcccacctg

SEQ ID NO: 1153077 - DNA, 17 bp, Homo sapiens
tgcagccccagaagaaa

SEQ ID NO: 1153078 - DNA, 21 bp, Homo sapiens
tgcagccccgcgcctccttcc

SEQ ID NO: 1153079 - DNA, 22 bp, Homo sapiens
tgcagcccttcctcctgaagcc

SEQ ID NO: 1153080 - DNA, 13 bp, Homo sapiens
tgcagcccttggg

SEQ ID NO: 1153081 - DNA, 16 bp, Homo sapiens
tgcagcccttgggcag

SEQ ID NO: 1153082 - DNA, 19 bp, Homo sapiens
tgcagcccttgggcagttc

SEQ ID NO: 1153083 - DNA, 14 bp, Homo sapiens
tgcagccgctgagc

SEQ ID NO: 1153084 - DNA, 15 bp, Homo sapiens
tgcagccggaggagg

SEQ ID NO: 1153085 - DNA, 18 bp, Homo sapiens
tgcagccggaggaggaga

SEQ ID NO: 1153086 - DNA, 18 bp, Homo sapiens
tgcagcctcaacctcctg

SEQ ID NO: 1153087 - DNA, 20 bp, Homo sapiens
tgcagcctcatactcctggg

SEQ ID NO: 1153088 - DNA, 21 bp, Homo sapiens
tgcagcctcatactcctgggc

SEQ ID NO: 1153089 - DNA, 22 bp, Homo sapiens
tgcagcctcatactcctgggct

SEQ ID NO: 1153090 - DNA, 16 bp, Homo sapiens
tgcagcctcctcctga

SEQ ID NO: 1153091 - DNA, 17 bp, Homo sapiens
tgcagcctcctcctgac

SEQ ID NO: 1153092 - DNA, 19 bp, Homo sapiens
tgcagcctcctcctgacca

SEQ ID NO: 1153093 - DNA, 17 bp, Homo sapiens
tgcagcctctctggctg

SEQ ID NO: 1153094 - DNA, 21 bp, Homo sapiens
tgcagcctctctggctggtct

SEQ ID NO: 1153095 - DNA, 22 bp, Homo sapiens
tgcagcctctctggctggtctt

SEQ ID NO: 1153096 - DNA, 17 bp, Homo sapiens
tgcagcctgcaggacct

SEQ ID NO: 1153097 - DNA, 18 bp, Homo sapiens
tgcagcctgcatcccttc

SEQ ID NO: 1153098 - DNA, 14 bp, Homo sapiens
tgcagcctgcgcca

SEQ ID NO: 1153099 - DNA, 22 bp, Homo sapiens
tgcagcctgctctagtgggaca

SEQ ID NO: 1153100 - DNA, 17 bp, Homo sapiens
tgcagcctgctggggct

SEQ ID NO: 1153101 - DNA, 12 bp, Homo sapiens
tgcagcctgggt

SEQ ID NO: 1153102 - DNA, 13 bp, Homo sapiens
tgcagcctgggtc

SEQ ID NO: 1153103 - DNA, 21 bp, Homo sapiens
tgcagcctgggtctggatggg

SEQ ID NO: 1153104 - DNA, 13 bp, Homo sapiens
tgcagcctgtggc

SEQ ID NO: 1153105 - DNA, 17 bp, Homo sapiens
tgcagccttcccctccc

SEQ ID NO: 1153106 - DNA, 19 bp, Homo sapiens
tgcagccttcccctccctg

SEQ ID NO: 1153107 - DNA, 20 bp, Homo sapiens
tgcagccttcccctccctgt

SEQ ID NO: 1153108 - DNA, 13 bp, Homo sapiens
tgcagccttctcc

SEQ ID NO: 1153109 - DNA, 15 bp, Homo sapiens
tgcagccttctccat

SEQ ID NO: 1153110 - DNA, 14 bp, Homo sapiens
tgcagccttgcgct

SEQ ID NO: 1153111 - DNA, 23 bp, Homo sapiens
tgcagcctttgcctccccggctc

SEQ ID NO: 1153112 - DNA, 19 bp, Homo sapiens
tgcagccttttctggtccc

SEQ ID NO: 1153113 - DNA, 23 bp, Homo sapiens
tgcagccttttctggtccctctt

SEQ ID NO: 1153114 - DNA, 12 bp, Homo sapiens
tgcagcgcagct

SEQ ID NO: 1153115 - DNA, 20 bp, Homo sapiens
tgcagctatgcgcaatgtgg

SEQ ID NO: 1153116 - DNA, 13 bp, Homo sapiens
tgcagctcctcag

SEQ ID NO: 1153117 - DNA, 15 bp, Homo sapiens
tgcagctcctcagcg

SEQ ID NO: 1153118 - DNA, 15 bp, Homo sapiens
tgcagctgacctctg

SEQ ID NO: 1153119 - DNA, 18 bp, Homo sapiens
tgcagctgatccatagga

SEQ ID NO: 1153120 - DNA, 14 bp, Homo sapiens
tgcagctgatttta

SEQ ID NO: 1153121 - DNA, 18 bp, Homo sapiens
tgcagctgattttaacaa

SEQ ID NO: 1153122 - DNA, 19 bp, Homo sapiens
tgcagctgattttaacaat

SEQ ID NO: 1153123 - DNA, 20 bp, Homo sapiens
tgcagctgattttaacaata

SEQ ID NO: 1153124 - DNA, 13 bp, Homo sapiens
tgcagctgcctgg

SEQ ID NO: 1153125 - DNA, 14 bp, Homo sapiens
tgcagctgcctggg

SEQ ID NO: 1153126 - DNA, 17 bp, Homo sapiens
tgcagctgcctggggcc

SEQ ID NO: 1153127 - DNA, 14 bp, Homo sapiens
tgcagctggacaga

SEQ ID NO: 1153128 - DNA, 12 bp, Homo sapiens
tgcagctgggcc

SEQ ID NO: 1153129 - DNA, 22 bp, Homo sapiens
tgcagctgggccccatgctctg

SEQ ID NO: 1153130 - DNA, 23 bp, Homo sapiens
tgcagctgggccccatgctctgc

SEQ ID NO: 1153131 - DNA, 17 bp, Homo sapiens
tgcagctgggcttggcc

SEQ ID NO: 1153132 - DNA, 20 bp, Homo sapiens
tgcagctgggcttggcctgg

SEQ ID NO: 1153133 - DNA, 21 bp, Homo sapiens
tgcagctgggcttggcctgga

SEQ ID NO: 1153134 - DNA, 23 bp, Homo sapiens
tgcagctgggcttggcctggaga

SEQ ID NO: 1153135 - DNA, 13 bp, Homo sapiens
tgcagctgggtgg

SEQ ID NO: 1153136 - DNA, 16 bp, Homo sapiens
tgcagctgttgagaaa

SEQ ID NO: 1153137 - DNA, 18 bp, Homo sapiens
tgcagctgttttcaaagc

SEQ ID NO: 1153138 - DNA, 20 bp, Homo sapiens
tgcagctgttttcaaagccc

SEQ ID NO: 1153139 - DNA, 17 bp, Homo sapiens
tgcagcttcgaggacag

SEQ ID NO: 1153140 - DNA, 19 bp, Homo sapiens
tgcagcttcgaggacagga

SEQ ID NO: 1153141 - DNA, 14 bp, Homo sapiens
tgcagcttgcagtc

SEQ ID NO: 1153142 - DNA, 17 bp, Homo sapiens
tgcaggaacgagcactg

SEQ ID NO: 1153143 - DNA, 20 bp, Homo sapiens
tgcaggaacgagcactggcc

SEQ ID NO: 1153144 - DNA, 15 bp, Homo sapiens
tctgattcctttaaa

SEQ ID NO: 1153145 - DNA, 19 bp, Homo sapiens
tctgattctctttaactgt

SEQ ID NO: 1153146 - DNA, 20 bp, Homo sapiens
tctgattctctttaactgtg

SEQ ID NO: 1153147 - DNA, 21 bp, Homo sapiens
tctgattctctttaactgtgt

SEQ ID NO: 1153148 - DNA, 14 bp, Homo sapiens
tctgattgaggata

SEQ ID NO: 1153149 - DNA, 19 bp, Homo sapiens
tctgattggaatttctggc

SEQ ID NO: 1153150 - DNA, 23 bp, Homo sapiens
tctgattggacattttcttcaga

SEQ ID NO: 1153151 - DNA, 17 bp, Homo sapiens
tctgattgtgttgaaga

SEQ ID NO: 1153152 - DNA, 23 bp, Homo sapiens
tctgattgttcccgatggtctct

SEQ ID NO: 1153153 - DNA, 12 bp, Homo sapiens
tctgatttaatg

SEQ ID NO: 1153154 - DNA, 14 bp, Homo sapiens
tctgatttaatgtt

SEQ ID NO: 1153155 - DNA, 17 bp, Homo sapiens
tctgatttaatgttttc

SEQ ID NO: 1153156 - DNA, 18 bp, Homo sapiens
tctgatttaatgttttct

SEQ ID NO: 1153157 - DNA, 22 bp, Homo sapiens
tctgatttattttgtatgaaat

SEQ ID NO: 1153158 - DNA, 13 bp, Homo sapiens
tctgatttcagga

SEQ ID NO: 1153159 - DNA, 14 bp, Homo sapiens
tctgatttcagttt

SEQ ID NO: 1153160 - DNA, 19 bp, Homo sapiens
tctgatttcataattcaga

SEQ ID NO: 1153161 - DNA, 14 bp, Homo sapiens
tctgattttggcat

SEQ ID NO: 1153162 - DNA, 17 bp, Homo sapiens
tctgattttttccccct

SEQ ID NO: 1153163 - DNA, 20 bp, Homo sapiens
tctgattttttttgtagctg

SEQ ID NO: 1153164 - DNA, 14 bp, Homo sapiens
tctgcaaaggcctg

SEQ ID NO: 1153165 - DNA, 17 bp, Homo sapiens
tctgcaaaggcctgggc

SEQ ID NO: 1153166 - DNA, 15 bp, Homo sapiens
tctgcaactagccaa

SEQ ID NO: 1153167 - DNA, 18 bp, Homo sapiens
tctgcaactagccaaggc

SEQ ID NO: 1153168 - DNA, 15 bp, Homo sapiens
tctgcaagaattaaa

SEQ ID NO: 1153169 - DNA, 17 bp, Homo sapiens
tctgcaagaattaaaac

SEQ ID NO: 1153170 - DNA, 19 bp, Homo sapiens
tctgcaagaattaaaactg

SEQ ID NO: 1153171 - DNA, 20 bp, Homo sapiens
tctgcaagaattaaaactga

SEQ ID NO: 1153172 - DNA, 17 bp, Homo sapiens
tctgcaagggcccagag

SEQ ID NO: 1153173 - DNA, 22 bp, Homo sapiens
tctgcaagtatactagggagcc

SEQ ID NO: 1153174 - DNA, 23 bp, Homo sapiens
tctgcaagtatactagggagcca

SEQ ID NO: 1153175 - DNA, 19 bp, Homo sapiens
tctgcaatttgtttaaaga

SEQ ID NO: 1153176 - DNA, 20 bp, Homo sapiens
tctgcaatttgtttaaagaa

SEQ ID NO: 1153177 - DNA, 14 bp, Homo sapiens
tctgcacacaaata

SEQ ID NO: 1153178 - DNA, 23 bp, Homo sapiens
tctgcacaccttgaatctgcctg

SEQ ID NO: 1153179 - DNA, 22 bp, Homo sapiens
tctgcacagaaacttgaactcc

SEQ ID NO: 1153180 - DNA, 15 bp, Homo sapiens
tctgcacagatggat

SEQ ID NO: 1153181 - DNA, 22 bp, Homo sapiens
tctgcacatgcagctgcaccct

SEQ ID NO: 1153182 - DNA, 23 bp, Homo sapiens
tctgcacatgcagctgcaccctc

SEQ ID NO: 1153183 - DNA, 20 bp, Homo sapiens
tctgcaccaccatgcccagc

SEQ ID NO: 1153184 - DNA, 14 bp, Homo sapiens
tctgcacccagaac

SEQ ID NO: 1153185 - DNA, 13 bp, Homo sapiens
tctgcacccaggg

SEQ ID NO: 1153186 - DNA, 21 bp, Homo sapiens
tctgcaccccttctctcctcc

SEQ ID NO: 1153187 - DNA, 13 bp, Homo sapiens
tctgcaccctcca

SEQ ID NO: 1153188 - DNA, 15 bp, Homo sapiens
tctgcaccctccacc

SEQ ID NO: 1153189 - DNA, 17 bp, Homo sapiens
tctgcaccctccaccct

SEQ ID NO: 1153190 - DNA, 18 bp, Homo sapiens
tctgcaccctccaccctg

SEQ ID NO: 1153191 - DNA, 15 bp, Homo sapiens
tctgcacccttcttt

SEQ ID NO: 1153192 - DNA, 16 bp, Homo sapiens
tctgcacccttctttt

SEQ ID NO: 1153193 - DNA, 15 bp, Homo sapiens
tctgcacgctgccca

SEQ ID NO: 1153194 - DNA, 18 bp, Homo sapiens
tctgcactactcctctgc

SEQ ID NO: 1153195 - DNA, 20 bp, Homo sapiens
tctgcactactgacatgtgg

SEQ ID NO: 1153196 - DNA, 17 bp, Homo sapiens
tctgcactccatggcca

SEQ ID NO: 1153197 - DNA, 21 bp, Homo sapiens
tctgcactcctttatctgtaa

SEQ ID NO: 1153198 - DNA, 15 bp, Homo sapiens
tctgcactctaaact

SEQ ID NO: 1153199 - DNA, 20 bp, Homo sapiens
tctgcactctaaactgcaaa

SEQ ID NO: 1153200 - DNA, 15 bp, Homo sapiens
tctgcagaaacagaa

SEQ ID NO: 1153201 - DNA, 21 bp, Homo sapiens
tctgcagaaatttgcaactca

SEQ ID NO: 1153202 - DNA, 10 bp, Homo sapiens
tctgcagaag

SEQ ID NO: 1153203 - DNA, 21 bp, Homo sapiens
tctgcagaaggaaaaatgtgt

SEQ ID NO: 1153204 - DNA, 15 bp, Homo sapiens
tctgcagacctggtt

SEQ ID NO: 1153205 - DNA, 21 bp, Homo sapiens
tctgcagcactttaaccctct

SEQ ID NO: 1153206 - DNA, 16 bp, Homo sapiens
tctgcagcatgacctg

SEQ ID NO: 1153207 - DNA, 15 bp, Homo sapiens
tctgcagccagccca

SEQ ID NO: 1153208 - DNA, 12 bp, Homo sapiens
tctgcagcccag

SEQ ID NO: 1153209 - DNA, 23 bp, Homo sapiens
tctgcagcccggcgccaccatcc

SEQ ID NO: 1153210 - DNA, 17 bp, Homo sapiens
tctgcagcccttgggca

SEQ ID NO: 1153211 - DNA, 20 bp, Homo sapiens
tctgcagcccttgggcagtt

SEQ ID NO: 1153212 - DNA, 16 bp, Homo sapiens
tctgcagccggaggag

SEQ ID NO: 1153213 - DNA, 22 bp, Homo sapiens
tctgcagctatgcgcaatgtgg

SEQ ID NO: 1153214 - DNA, 13 bp, Homo sapiens
tctgcagctgccg

SEQ ID NO: 1153215 - DNA, 15 bp, Homo sapiens
tctgcaggcaccggg

SEQ ID NO: 1153216 - DNA, 19 bp, Homo sapiens
tctgcaggccactgtgagc

SEQ ID NO: 1153217 - DNA, 16 bp, Homo sapiens
tctgcagggagcaact

SEQ ID NO: 1153218 - DNA, 13 bp, Homo sapiens
tctgcaggggcct

SEQ ID NO: 1153219 - DNA, 17 bp, Homo sapiens
tctgcagtaaaacacat

SEQ ID NO: 1153220 - DNA, 18 bp, Homo sapiens
tctgcagtaaaacacatt

SEQ ID NO: 1153221 - DNA, 18 bp, Homo sapiens
tgcaaacttttttatatc

SEQ ID NO: 1153222 - DNA, 14 bp, Homo sapiens
tgcaaagactctga

SEQ ID NO: 1153223 - DNA, 20 bp, Homo sapiens
tgcaaagactctgagccaag

SEQ ID NO: 1153224 - DNA, 16 bp, Homo sapiens
tgcaaagcgacagatt

SEQ ID NO: 1153225 - DNA, 12 bp, Homo sapiens
tgcaaaggactg

SEQ ID NO: 1153226 - DNA, 20 bp, Homo sapiens
tgcaaaggtagggactggag

SEQ ID NO: 1153227 - DNA, 21 bp, Homo sapiens
tgcaaaggtggcaatgcttaa

SEQ ID NO: 1153228 - DNA, 14 bp, Homo sapiens
tgcaaagtaaaaaa

SEQ ID NO: 1153229 - DNA, 15 bp, Homo sapiens
tgcaaagtcgccagt

SEQ ID NO: 1153230 - DNA, 22 bp, Homo sapiens
tgcaaagtcgccagtcactgct

SEQ ID NO: 1153231 - DNA, 21 bp, Homo sapiens
tgcaaagtgttttctcagaac

SEQ ID NO: 1153232 - DNA, 22 bp, Homo sapiens
tgcaaagtgttttctcagaaca

SEQ ID NO: 1153233 - DNA, 15 bp, Homo sapiens
tgcaaataaagcctt

SEQ ID NO: 1153234 - DNA, 15 bp, Homo sapiens
tgcaaataagtgtat

SEQ ID NO: 1153235 - DNA, 19 bp, Homo sapiens
tgcaaataggcagaatgga

SEQ ID NO: 1153236 - DNA, 20 bp, Homo sapiens
tgcaaatcaggcttttgttt

SEQ ID NO: 1153237 - DNA, 14 bp, Homo sapiens
tgcaaatcttgaaa

SEQ ID NO: 1153238 - DNA, 17 bp, Homo sapiens
tgcaaatgaatcattgt

SEQ ID NO: 1153239 - DNA, 20 bp, Homo sapiens
tgcaaatgagttcaggacta

SEQ ID NO: 1153240 - DNA, 17 bp, Homo sapiens
tgcaaatggagataaaa

SEQ ID NO: 1153241 - DNA, 14 bp, Homo sapiens
tgcaaatgggagct

SEQ ID NO: 1153242 - DNA, 18 bp, Homo sapiens
tgcaaatgtcttccaggt

SEQ ID NO: 1153243 - DNA, 15 bp, Homo sapiens
tgcaaatgttttgaa

SEQ ID NO: 1153244 - DNA, 15 bp, Homo sapiens
tgcaaattcagaact

SEQ ID NO: 1153245 - DNA, 12 bp, Homo sapiens
tgcaaattgtat

SEQ ID NO: 1153246 - DNA, 14 bp, Homo sapiens
tgcaaatttctata

SEQ ID NO: 1153247 - DNA, 20 bp, Homo sapiens
tgcaaattttgcatttagtt

SEQ ID NO: 1153248 - DNA, 14 bp, Homo sapiens
tgcaacaaaatgta

SEQ ID NO: 1153249 - DNA, 16 bp, Homo sapiens
tgcaacaaaatgtaga

SEQ ID NO: 1153250 - DNA, 20 bp, Homo sapiens
tgcaacaaaatgtagaatat

SEQ ID NO: 1153251 - DNA, 13 bp, Homo sapiens
tgcaacacacaga

SEQ ID NO: 1153252 - DNA, 13 bp, Homo sapiens
tgcaacagacaag

SEQ ID NO: 1153253 - DNA, 13 bp, Homo sapiens
tgcaacagcactg

SEQ ID NO: 1153254 - DNA, 14 bp, Homo sapiens
tgcaacagcactgg

SEQ ID NO: 1153255 - DNA, 17 bp, Homo sapiens
tgcaacagcactggctc

SEQ ID NO: 1153256 - DNA, 18 bp, Homo sapiens
tgcaacaggggaggaaaa

SEQ ID NO: 1153257 - DNA, 21 bp, Homo sapiens
tgcaacaggggaggaaaaaag

SEQ ID NO: 1153258 - DNA, 22 bp, Homo sapiens
tgcaacaggggaggaaaaaaga

SEQ ID NO: 1153259 - DNA, 17 bp, Homo sapiens
tgcaacagtaatcagag

SEQ ID NO: 1153260 - DNA, 14 bp, Homo sapiens
tgcaacatttctgt

SEQ ID NO: 1153261 - DNA, 17 bp, Homo sapiens
tgcaaccaactacaacc

SEQ ID NO: 1153262 - DNA, 19 bp, Homo sapiens
tgcaaccaactatccaagt

SEQ ID NO: 1153263 - DNA, 20 bp, Homo sapiens
tgcaaccaactatccaagtg

SEQ ID NO: 1153264 - DNA, 19 bp, Homo sapiens
tgcaatctaatctgaactg

SEQ ID NO: 1153265 - DNA, 23 bp, Homo sapiens
tgcaatcttggctcactgcaacc

SEQ ID NO: 1153266 - DNA, 13 bp, Homo sapiens
tgcaatgaaacag

SEQ ID NO: 1153267 - DNA, 16 bp, Homo sapiens
tgcaatgacatcttca

SEQ ID NO: 1153268 - DNA, 16 bp, Homo sapiens
tgcaatgactcaggac

SEQ ID NO: 1153269 - DNA, 22 bp, Homo sapiens
tgcaatgcttttatatggccca

SEQ ID NO: 1153270 - DNA, 15 bp, Homo sapiens
tgcaatggcagcatt

SEQ ID NO: 1153271 - DNA, 22 bp, Homo sapiens
tgcaatgtctgagtgaacctgt

SEQ ID NO: 1153272 - DNA, 15 bp, Homo sapiens
tgcaatgtgaaaaat

SEQ ID NO: 1153273 - DNA, 15 bp, Homo sapiens
tgcaatgttttcctt

SEQ ID NO: 1153274 - DNA, 19 bp, Homo sapiens
tgcaattaaacttccaaag

SEQ ID NO: 1153275 - DNA, 16 bp, Homo sapiens
tgcaattaaagtgata

SEQ ID NO: 1153276 - DNA, 18 bp, Homo sapiens
tgcaattacagcaaaaag

SEQ ID NO: 1153277 - DNA, 13 bp, Homo sapiens
tgcaattcatgta

SEQ ID NO: 1153278 - DNA, 17 bp, Homo sapiens
tgcaattcatgtaacag

SEQ ID NO: 1153279 - DNA, 18 bp, Homo sapiens
tgcaattccaagaaaata

SEQ ID NO: 1153280 - DNA, 13 bp, Homo sapiens
tgcaattgctctt

SEQ ID NO: 1153281 - DNA, 15 bp, Homo sapiens
tgcaattgctcttct

SEQ ID NO: 1153282 - DNA, 17 bp, Homo sapiens
tgcaattgctcttctcc

SEQ ID NO: 1153283 - DNA, 15 bp, Homo sapiens
tgcaatttaaaatta

SEQ ID NO: 1153284 - DNA, 17 bp, Homo sapiens
tgcaatttgtttaaaga

SEQ ID NO: 1153285 - DNA, 18 bp, Homo sapiens
tgcaatttgtttaaagaa

SEQ ID NO: 1153286 - DNA, 20 bp, Homo sapiens
tgcaatttgtttaaagaata

SEQ ID NO: 1153287 - DNA, 20 bp, Homo sapiens
tgcaattttaattgattatt

SEQ ID NO: 1153288 - DNA, 21 bp, Homo sapiens
tgcacaaatatttattttctt

SEQ ID NO: 1153289 - DNA, 13 bp, Homo sapiens
tgcacaacagccc

SEQ ID NO: 1153290 - DNA, 14 bp, Homo sapiens
tgcacaacagccct

SEQ ID NO: 1153291 - DNA, 15 bp, Homo sapiens
tgcacaacagccctg

SEQ ID NO: 1153292 - DNA, 23 bp, Homo sapiens
tgcacaagaatggatcacaagat

SEQ ID NO: 1153293 - DNA, 18 bp, Homo sapiens
tgcacaagctgcaccctc

SEQ ID NO: 1153294 - DNA, 21 bp, Homo sapiens
tgcacaagctgcaccctcagg

SEQ ID NO: 1153295 - DNA, 16 bp, Homo sapiens
tgcacaatatttcttt

SEQ ID NO: 1153296 - DNA, 15 bp, Homo sapiens
tgcacacaattagat

SEQ ID NO: 1153297 - DNA, 17 bp, Homo sapiens
tgcacacaattagattt

SEQ ID NO: 1153298 - DNA, 14 bp, Homo sapiens
tgcacacacagctc

SEQ ID NO: 1153299 - DNA, 18 bp, Homo sapiens
tgcacacacatatattat

SEQ ID NO: 1153300 - DNA, 15 bp, Homo sapiens
tgcacacagaatgct

SEQ ID NO: 1153301 - DNA, 14 bp, Homo sapiens
tgcacacagtgctt

SEQ ID NO: 1153302 - DNA, 16 bp, Homo sapiens
tgcacacatcaccagg

SEQ ID NO: 1153303 - DNA, 20 bp, Homo sapiens
tgcacacatcaccaggtgca

SEQ ID NO: 1153304 - DNA, 10 bp, Homo sapiens
tgcacacatt

SEQ ID NO: 1153305 - DNA, 11 bp, Homo sapiens
tgcacacattt

SEQ ID NO: 1153306 - DNA, 12 bp, Homo sapiens
tgcacacatttt

SEQ ID NO: 1153307 - DNA, 13 bp, Homo sapiens
tgcacacattttt

SEQ ID NO: 1153308 - DNA, 14 bp, Homo sapiens
tgcacacccactgc

SEQ ID NO: 1153309 - DNA, 18 bp, Homo sapiens
tgcacacccactgccccg

SEQ ID NO: 1153310 - DNA, 20 bp, Homo sapiens
tgcacacccactgccccgtg

SEQ ID NO: 1153311 - DNA, 16 bp, Homo sapiens
tgcacaccccactccc

SEQ ID NO: 1153312 - DNA, 18 bp, Homo sapiens
tgcacaccccactcccac

SEQ ID NO: 1153313 - DNA, 20 bp, Homo sapiens
tgaatagcttgtttctgtca

SEQ ID NO: 1153314 - DNA, 19 bp, Homo sapiens
tgaatagtgctgcaataaa

SEQ ID NO: 1153315 - DNA, 17 bp, Homo sapiens
tgaatataaatgtgtgt

SEQ ID NO: 1153316 - DNA, 22 bp, Homo sapiens
tgaatataaatgtgtgtatgtg

SEQ ID NO: 1153317 - DNA, 21 bp, Homo sapiens
tgaatataatatatttgtgta

SEQ ID NO: 1153318 - DNA, 15 bp, Homo sapiens
tgaatatataaacac

SEQ ID NO: 1153319 - DNA, 21 bp, Homo sapiens
tgaatatctattaatatatgt

SEQ ID NO: 1153320 - DNA, 16 bp, Homo sapiens
tgaatattcctggact

SEQ ID NO: 1153321 - DNA, 15 bp, Homo sapiens
tgaatattgatgtta

SEQ ID NO: 1153322 - DNA, 16 bp, Homo sapiens
tgaatattgccattat

SEQ ID NO: 1153323 - DNA, 19 bp, Homo sapiens
tgaatattggtaattaaaa

SEQ ID NO: 1153324 - DNA, 21 bp, Homo sapiens
tgaatattggtaattaaaaga

SEQ ID NO: 1153325 - DNA, 17 bp, Homo sapiens
tgaatatttataacagc

SEQ ID NO: 1153326 - DNA, 20 bp, Homo sapiens
tgaatattttatctttcctt

SEQ ID NO: 1153327 - DNA, 19 bp, Homo sapiens
tgaatattttcattaaaag

SEQ ID NO: 1153328 - DNA, 20 bp, Homo sapiens
tgaatattttggaaactgct

SEQ ID NO: 1153329 - DNA, 18 bp, Homo sapiens
tgaatcaagcaatatgga

SEQ ID NO: 1153330 - DNA, 13 bp, Homo sapiens
tgaatcaatgaaa

SEQ ID NO: 1153331 - DNA, 21 bp, Homo sapiens
tgaatcaatgaaaaatgtaat

SEQ ID NO: 1153332 - DNA, 14 bp, Homo sapiens
tgaatcacatgaat

SEQ ID NO: 1153333 - DNA, 11 bp, Homo sapiens
tgaatcactgt

SEQ ID NO: 1153334 - DNA, 13 bp, Homo sapiens
tgaatcactgttg

SEQ ID NO: 1153335 - DNA, 22 bp, Homo sapiens
tgaatcagaacagatgctgagc

SEQ ID NO: 1153336 - DNA, 17 bp, Homo sapiens
tgaatcagacagtggat

SEQ ID NO: 1153337 - DNA, 13 bp, Homo sapiens
tgaatcagctgga

SEQ ID NO: 1153338 - DNA, 17 bp, Homo sapiens
tgaatcagctggacata

SEQ ID NO: 1153339 - DNA, 19 bp, Homo sapiens
tgaatcagtataaacaaag

SEQ ID NO: 1153340 - DNA, 20 bp, Homo sapiens
tgaatcagtttccaattatt

SEQ ID NO: 1153341 - DNA, 23 bp, Homo sapiens
tgaatcagtttccaattatttga

SEQ ID NO: 1153342 - DNA, 14 bp, Homo sapiens
tgaatcatgagcct

SEQ ID NO: 1153343 - DNA, 21 bp, Homo sapiens
tgaatcattgtatgtggtcat

SEQ ID NO: 1153344 - DNA, 12 bp, Homo sapiens
tgaatcattgtt

SEQ ID NO: 1153345 - DNA, 13 bp, Homo sapiens
tgaatcatttctt

SEQ ID NO: 1153346 - DNA, 15 bp, Homo sapiens
tgaatccaaactaat

SEQ ID NO: 1153347 - DNA, 16 bp, Homo sapiens
tgaatccaaactaatc

SEQ ID NO: 1153348 - DNA, 20 bp, Homo sapiens
tgaatccaaatctgtcctct

SEQ ID NO: 1153349 - DNA, 22 bp, Homo sapiens
tgaatccaaatctgtcctctgt

SEQ ID NO: 1153350 - DNA, 23 bp, Homo sapiens
tgaatccaaatctgtcctctgta

SEQ ID NO: 1153351 - DNA, 18 bp, Homo sapiens
tgaatccaactgcttaaa

SEQ ID NO: 1153352 - DNA, 14 bp, Homo sapiens
tgaatccatgcttg

SEQ ID NO: 1153353 - DNA, 17 bp, Homo sapiens
tgaatccatgcttgggt

SEQ ID NO: 1153354 - DNA, 22 bp, Homo sapiens
tgaatcccatcaggctgttatt

SEQ ID NO: 1153355 - DNA, 19 bp, Homo sapiens
tgaatccccgaccccccta

SEQ ID NO: 1153356 - DNA, 15 bp, Homo sapiens
tgaatccctgggagc

SEQ ID NO: 1153357 - DNA, 14 bp, Homo sapiens
tgaatcctcagaga

SEQ ID NO: 1153358 - DNA, 23 bp, Homo sapiens
tgaatcgggctaaggtccctggg

SEQ ID NO: 1153359 - DNA, 18 bp, Homo sapiens
tgaatctacaaaagtgaa

SEQ ID NO: 1153360 - DNA, 14 bp, Homo sapiens
tgaatctatttaag

SEQ ID NO: 1153361 - DNA, 21 bp, Homo sapiens
tgaatctctgcctctcccagg

SEQ ID NO: 1153362 - DNA, 20 bp, Homo sapiens
tgaatctgcgagtagatgaa

SEQ ID NO: 1153363 - DNA, 16 bp, Homo sapiens
tgaatctgggagggaa

SEQ ID NO: 1153364 - DNA, 18 bp, Homo sapiens
tgaatctggtgttgggga

SEQ ID NO: 1153365 - DNA, 12 bp, Homo sapiens
tgaatctgtaca

SEQ ID NO: 1153366 - DNA, 18 bp, Homo sapiens
tgaatctgtgctggccat

SEQ ID NO: 1153367 - DNA, 23 bp, Homo sapiens
tgaatctgtgtgcatatttgtta

SEQ ID NO: 1153368 - DNA, 13 bp, Homo sapiens
tgaatcttaattt

SEQ ID NO: 1153369 - DNA, 11 bp, Homo sapiens
tgaatgaaaaa

SEQ ID NO: 1153370 - DNA, 20 bp, Homo sapiens
tgaatgaaaaatttaagcat

SEQ ID NO: 1153371 - DNA, 22 bp, Homo sapiens
tgaatgaaaaatttaagcattg

SEQ ID NO: 1153372 - DNA, 14 bp, Homo sapiens
tgaatgaaaacatt

SEQ ID NO: 1153373 - DNA, 14 bp, Homo sapiens
tgaatgaaaataca

SEQ ID NO: 1153374 - DNA, 15 bp, Homo sapiens
tgaatgaacactctt

SEQ ID NO: 1153375 - DNA, 16 bp, Homo sapiens
tgaatgaaccttctgg

SEQ ID NO: 1153376 - DNA, 17 bp, Homo sapiens
tgaatgacaacagaagc

SEQ ID NO: 1153377 - DNA, 15 bp, Homo sapiens
tgaatgacctctcta

SEQ ID NO: 1153378 - DNA, 18 bp, Homo sapiens
tgaatgagacctggaaca

SEQ ID NO: 1153379 - DNA, 22 bp, Homo sapiens
tgaatgagacctggaacaaatc

SEQ ID NO: 1153380 - DNA, 22 bp, Homo sapiens
tgaatgaggtcagcatgtctat

SEQ ID NO: 1153381 - DNA, 18 bp, Homo sapiens
tgaatgaggtcccaggca

SEQ ID NO: 1153382 - DNA, 22 bp, Homo sapiens
tgaatgaggtcccaggcagaga

SEQ ID NO: 1153383 - DNA, 15 bp, Homo sapiens
tgaatgatctctctg

SEQ ID NO: 1153384 - DNA, 13 bp, Homo sapiens
tgaggggaggggc

SEQ ID NO: 1153385 - DNA, 14 bp, Homo sapiens
tgaggggaggggcc

SEQ ID NO: 1153386 - DNA, 18 bp, Homo sapiens
tgaggggaggggcctccc

SEQ ID NO: 1153387 - DNA, 19 bp, Homo sapiens
tgaggggaggggcctcccc

SEQ ID NO: 1153388 - DNA, 22 bp, Homo sapiens
tgaggggcatctgcccctcccc

SEQ ID NO: 1153389 - DNA, 23 bp, Homo sapiens
tgaggggccaccccgtgcccctg

SEQ ID NO: 1153390 - DNA, 13 bp, Homo sapiens
tgaggggccactg

SEQ ID NO: 1153391 - DNA, 17 bp, Homo sapiens
tgaggggccaggggcag

SEQ ID NO: 1153392 - DNA, 18 bp, Homo sapiens
tgaggggccaggggcagg

SEQ ID NO: 1153393 - DNA, 19 bp, Homo sapiens
tgaggggccaggggcaggc

SEQ ID NO: 1153394 - DNA, 18 bp, Homo sapiens
tgaggggccctccatgcg

SEQ ID NO: 1153395 - DNA, 15 bp, Homo sapiens
tgaggggcctgcgcc

SEQ ID NO: 1153396 - DNA, 22 bp, Homo sapiens
tgaggggcctgcgcccagagct

SEQ ID NO: 1153397 - DNA, 15 bp, Homo sapiens
tgaggggcctggaga

SEQ ID NO: 1153398 - DNA, 14 bp, Homo sapiens
tgaggggctcctgg

SEQ ID NO: 1153399 - DNA, 15 bp, Homo sapiens
tgaggggctcctgga

SEQ ID NO: 1153400 - DNA, 12 bp, Homo sapiens
tgaggggctggg

SEQ ID NO: 1153401 - DNA, 17 bp, Homo sapiens
tgaggggctggggaggg

SEQ ID NO: 1153402 - DNA, 14 bp, Homo sapiens
tgagggtaagtatt

SEQ ID NO: 1153403 - DNA, 18 bp, Homo sapiens
tgagggtatgaagagctg

SEQ ID NO: 1153404 - DNA, 23 bp, Homo sapiens
tgagggtatgaagagctgtcttc

SEQ ID NO: 1153405 - DNA, 15 bp, Homo sapiens
tgagggtccccacct

SEQ ID NO: 1153406 - DNA, 18 bp, Homo sapiens
tgagggtcctgcagcctg

SEQ ID NO: 1153407 - DNA, 19 bp, Homo sapiens
tgagggtcctgcagcctgc

SEQ ID NO: 1153408 - DNA, 22 bp, Homo sapiens
tgagggtgccccgcctgagtca

SEQ ID NO: 1153409 - DNA, 21 bp, Homo sapiens
tgagggtgcttgttccctctc

SEQ ID NO: 1153410 - DNA, 17 bp, Homo sapiens
tgagggtgggccagcat

SEQ ID NO: 1153411 - DNA, 18 bp, Homo sapiens
tgagggtttcagagagcc

SEQ ID NO: 1153412 - DNA, 23 bp, Homo sapiens
tgaggtaagtggaattagagggc

SEQ ID NO: 1153413 - DNA, 18 bp, Homo sapiens
tgaggtactggtcccttc

SEQ ID NO: 1153414 - DNA, 16 bp, Homo sapiens
tgaggtaggagaggcg

SEQ ID NO: 1153415 - DNA, 18 bp, Homo sapiens
tgaggtatggccatgccc

SEQ ID NO: 1153416 - DNA, 23 bp, Homo sapiens
tgaggtatggccatgccctagac

SEQ ID NO: 1153417 - DNA, 16 bp, Homo sapiens
tgaggtcaacacaggt

SEQ ID NO: 1153418 - DNA, 18 bp, Homo sapiens
tgaggtcaataaagcaga

SEQ ID NO: 1153419 - DNA, 19 bp, Homo sapiens
tgaggtcaataaagcagag

SEQ ID NO: 1153420 - DNA, 23 bp, Homo sapiens
tgaggtcaataaagcagagccaa

SEQ ID NO: 1153421 - DNA, 16 bp, Homo sapiens
tgaggtcaggagttcc

SEQ ID NO: 1153422 - DNA, 21 bp, Homo sapiens
tgaggtcctcaggtcagctgg

SEQ ID NO: 1153423 - DNA, 18 bp, Homo sapiens
tgaggtctcttgagggag

SEQ ID NO: 1153424 - DNA, 14 bp, Homo sapiens
tgaggtctgttcct

SEQ ID NO: 1153425 - DNA, 16 bp, Homo sapiens
tgaggtctgttccttt

SEQ ID NO: 1153426 - DNA, 14 bp, Homo sapiens
tgaggtctgttctt

SEQ ID NO: 1153427 - DNA, 15 bp, Homo sapiens
tgaggtctgttcttt

SEQ ID NO: 1153428 - DNA, 17 bp, Homo sapiens
tgaggtctgtttaaagt

SEQ ID NO: 1153429 - DNA, 23 bp, Homo sapiens
tgaggtctttctcctcaggacaa

SEQ ID NO: 1153430 - DNA, 24 bp, Homo sapiens
tgaggtctttctcctcaggacaag

SEQ ID NO: 1153431 - DNA, 17 bp, Homo sapiens
tgaggtgaaagggagct

SEQ ID NO: 1153432 - DNA, 18 bp, Homo sapiens
tgaggtgaaagggagcta

SEQ ID NO: 1153433 - DNA, 17 bp, Homo sapiens
tgaggtgaaatgggaga

SEQ ID NO: 1153434 - DNA, 15 bp, Homo sapiens
tgaggtgaaattcag

SEQ ID NO: 1153435 - DNA, 17 bp, Homo sapiens
tgaggtgaaattcagtt

SEQ ID NO: 1153436 - DNA, 20 bp, Homo sapiens
tgaggtgcctgctcaggtgc

SEQ ID NO: 1153437 - DNA, 15 bp, Homo sapiens
tgaggtgcctgtccc

SEQ ID NO: 1153438 - DNA, 16 bp, Homo sapiens
tgaggtggaagccctc

SEQ ID NO: 1153439 - DNA, 21 bp, Homo sapiens
tgaggtggaagccctccttcc

SEQ ID NO: 1153440 - DNA, 13 bp, Homo sapiens
tgaggtggcccag

SEQ ID NO: 1153441 - DNA, 21 bp, Homo sapiens
tgaggtggcccaggcccccgg

SEQ ID NO: 1153442 - DNA, 13 bp, Homo sapiens
tgaggtgggaggt

SEQ ID NO: 1153443 - DNA, 13 bp, Homo sapiens
tgaggtgggccca

SEQ ID NO: 1153444 - DNA, 14 bp, Homo sapiens
tgaggtgggcccag

SEQ ID NO: 1153445 - DNA, 16 bp, Homo sapiens
tgaggtgggcccagga

SEQ ID NO: 1153446 - DNA, 20 bp, Homo sapiens
tgaggtgggcccaggaccag

SEQ ID NO: 1153447 - DNA, 17 bp, Homo sapiens
tgaggtgggctggggct

SEQ ID NO: 1153448 - DNA, 23 bp, Homo sapiens
tgaggtgggctggggctgctccc

SEQ ID NO: 1153449 - DNA, 18 bp, Homo sapiens
tgaggtggggaaggaggg

SEQ ID NO: 1153450 - DNA, 20 bp, Homo sapiens
tgaggtggggaatcatttta

SEQ ID NO: 1153451 - DNA, 13 bp, Homo sapiens
tgaggtggtctga

SEQ ID NO: 1153452 - DNA, 17 bp, Homo sapiens
tgaggtggtctgaatgt

SEQ ID NO: 1153453 - DNA, 20 bp, Homo sapiens
tgaggtggtctgaatgttct

SEQ ID NO: 1153454 - DNA, 20 bp, Homo sapiens
tgaggtgtcagagaaaatga

SEQ ID NO: 1153455 - DNA, 15 bp, Homo sapiens
tgaggtgtgggggct

SEQ ID NO: 1153456 - DNA, 20 bp, Homo sapiens
tgaggttgggggaaccagca

SEQ ID NO: 1153457 - DNA, 19 bp, Homo sapiens
tgaggttttgaataaaaag

SEQ ID NO: 1153458 - DNA, 21 bp, Homo sapiens
tgagtaaaaactagaaggctt

SEQ ID NO: 1153459 - DNA, 23 bp, Homo sapiens
tgagtaaaaaggtggtatgtaat

SEQ ID NO: 1153460 - DNA, 18 bp, Homo sapiens
tgagtaaaacacatattc

SEQ ID NO: 1153461 - DNA, 21 bp, Homo sapiens
tgagtaaaggagtaagaacct

SEQ ID NO: 1153462 - DNA, 14 bp, Homo sapiens
tgagtaaattggaa

SEQ ID NO: 1153463 - DNA, 10 bp, Homo sapiens
tgagtaacat

SEQ ID NO: 1153464 - DNA, 15 bp, Homo sapiens
tgagtaacatttgct

SEQ ID NO: 1153465 - DNA, 16 bp, Homo sapiens
tgagtaacatttgctg

SEQ ID NO: 1153466 - DNA, 18 bp, Homo sapiens
tgagtaacatttgctgtt

SEQ ID NO: 1153467 - DNA, 18 bp, Homo sapiens
tgagtaagagctggtgtc

SEQ ID NO: 1153468 - DNA, 13 bp, Homo sapiens
tgagtaagtgtgt

SEQ ID NO: 1153469 - DNA, 22 bp, Homo sapiens
tgagtaatcaatacagacaagg

SEQ ID NO: 1153470 - DNA, 19 bp, Homo sapiens
tgagtaatggtgtagaaca

SEQ ID NO: 1153471 - DNA, 18 bp, Homo sapiens
tgagtaattaataaagaa

SEQ ID NO: 1153472 - DNA, 15 bp, Homo sapiens
tgagtacagcagaaa

SEQ ID NO: 1153473 - DNA, 19 bp, Homo sapiens
tgagtactggaataaacag

SEQ ID NO: 1153474 - DNA, 14 bp, Homo sapiens
tgagtagagttgat

SEQ ID NO: 1153475 - DNA, 17 bp, Homo sapiens
tgagtagagttgatcaa

SEQ ID NO: 1153476 - DNA, 20 bp, Homo sapiens
tgagtagcctatgaatgaaa

SEQ ID NO: 1153477 - DNA, 11 bp, Homo sapiens
tgagtagctgg

SEQ ID NO: 1153478 - DNA, 17 bp, Homo sapiens
tgagtagctgggcctgt

SEQ ID NO: 1153479 - DNA, 23 bp, Homo sapiens
tgagtaggcggcgatttttgtat

SEQ ID NO: 1153480 - DNA, 18 bp, Homo sapiens
tgagtagtcttatgtaaa

SEQ ID NO: 1153481 - DNA, 22 bp, Homo sapiens
tgagtagtcttatgtaaagtat

SEQ ID NO: 1153482 - DNA, 18 bp, Homo sapiens
tgagtattccatgagctg

SEQ ID NO: 1153483 - DNA, 22 bp, Homo sapiens
tgagtattctcataggagactg

SEQ ID NO: 1153484 - DNA, 13 bp, Homo sapiens
tgagtattggaag

SEQ ID NO: 1153485 - DNA, 22 bp, Homo sapiens
tgagtatttttaaaaaatatgt

SEQ ID NO: 1153486 - DNA, 15 bp, Homo sapiens
tgagtcaatgtgcag

SEQ ID NO: 1153487 - DNA, 13 bp, Homo sapiens
tgagtcaccagga

SEQ ID NO: 1153488 - DNA, 16 bp, Homo sapiens
tgagtcacccatgaag

SEQ ID NO: 1153489 - DNA, 14 bp, Homo sapiens
tgagtcacctcctc

SEQ ID NO: 1153490 - DNA, 15 bp, Homo sapiens
tgagtcacctcctcc

SEQ ID NO: 1153491 - DNA, 23 bp, Homo sapiens
tgagtcacctcctccactcactc

SEQ ID NO: 1153492 - DNA, 22 bp, Homo sapiens
tgagtcagacacgattgagaac

SEQ ID NO: 1153493 - DNA, 21 bp, Homo sapiens
tgagtcagatgggtctgatat

SEQ ID NO: 1153494 - DNA, 13 bp, Homo sapiens
tgagtcagcacct

SEQ ID NO: 1153495 - DNA, 22 bp, Homo sapiens
tgagtcagcaccttggcccagg

SEQ ID NO: 1153496 - DNA, 14 bp, Homo sapiens
tgagtcagtctctt

SEQ ID NO: 1153497 - DNA, 16 bp, Homo sapiens
tgagtcagtgctctca

SEQ ID NO: 1153498 - DNA, 21 bp, Homo sapiens
tgagtcatgatctccctgccg

SEQ ID NO: 1153499 - DNA, 23 bp, Homo sapiens
tgagtcatttaaatgtgtacaat

SEQ ID NO: 1153500 - DNA, 12 bp, Homo sapiens
tgagtccagagc

SEQ ID NO: 1153501 - DNA, 20 bp, Homo sapiens
tgagtcccaggctgagcctc

SEQ ID NO: 1153502 - DNA, 16 bp, Homo sapiens
tgagtcctgtctctgc

SEQ ID NO: 1153503 - DNA, 15 bp, Homo sapiens
tgataattgtgtatt

SEQ ID NO: 1153504 - DNA, 23 bp, Homo sapiens
tgataattgtgtattttctttgg

SEQ ID NO: 1153505 - DNA, 12 bp, Homo sapiens
tgataatttcag

SEQ ID NO: 1153506 - DNA, 14 bp, Homo sapiens
tgataatttcaggg

SEQ ID NO: 1153507 - DNA, 21 bp, Homo sapiens
tgataatttcagggaaattaa

SEQ ID NO: 1153508 - DNA, 15 bp, Homo sapiens
tgataattttacaat

SEQ ID NO: 1153509 - DNA, 15 bp, Homo sapiens
tgatacaaatgttta

SEQ ID NO: 1153510 - DNA, 14 bp, Homo sapiens
tgatacaatgctgt

SEQ ID NO: 1153511 - DNA, 18 bp, Homo sapiens
tgatacacagtaattgtg

SEQ ID NO: 1153512 - DNA, 13 bp, Homo sapiens
tgatacataataa

SEQ ID NO: 1153513 - DNA, 13 bp, Homo sapiens
tgatacattcaaa

SEQ ID NO: 1153514 - DNA, 18 bp, Homo sapiens
tgataccacctttactgt

SEQ ID NO: 1153515 - DNA, 21 bp, Homo sapiens
tgatcagttttttcacctgga

SEQ ID NO: 1153516 - DNA, 19 bp, Homo sapiens
tgatcataggtatttcaaa

SEQ ID NO: 1153517 - DNA, 20 bp, Homo sapiens
tgatcataggtatttcaaaa

SEQ ID NO: 1153518 - DNA, 15 bp, Homo sapiens
tgatcatcgccagag

SEQ ID NO: 1153519 - DNA, 16 bp, Homo sapiens
tgatcatcgccagagg

SEQ ID NO: 1153520 - DNA, 15 bp, Homo sapiens
tgatcatgcattgtt

SEQ ID NO: 1153521 - DNA, 17 bp, Homo sapiens
tgatcatgcattgttga

SEQ ID NO: 1153522 - DNA, 14 bp, Homo sapiens
tgatcatgtacttt

SEQ ID NO: 1153523 - DNA, 17 bp, Homo sapiens
tgatcatgtacttttta

SEQ ID NO: 1153524 - DNA, 22 bp, Homo sapiens
tgatcatgtgtggaagttatta

SEQ ID NO: 1153525 - DNA, 14 bp, Homo sapiens
tgatcattaattag

SEQ ID NO: 1153526 - DNA, 17 bp, Homo sapiens
tgatcattgaaatactt

SEQ ID NO: 1153527 - DNA, 22 bp, Homo sapiens
tgatcatttaaaaagctcactg

SEQ ID NO: 1153528 - DNA, 12 bp, Homo sapiens
tgatcatttctg

SEQ ID NO: 1153529 - DNA, 16 bp, Homo sapiens
tgatcatttctgccat

SEQ ID NO: 1153530 - DNA, 17 bp, Homo sapiens
tgatcattttcccccca

SEQ ID NO: 1153531 - DNA, 18 bp, Homo sapiens
tgatcattttccccccac

SEQ ID NO: 1153532 - DNA, 20 bp, Homo sapiens
tgatcattttccccccactc

SEQ ID NO: 1153533 - DNA, 18 bp, Homo sapiens
tgatggaaacgcacttac

SEQ ID NO: 1153534 - DNA, 20 bp, Homo sapiens
tgatggaatgtgccacctgt

SEQ ID NO: 1153535 - DNA, 16 bp, Homo sapiens
tgatggaatttttctg

SEQ ID NO: 1153536 - DNA, 22 bp, Homo sapiens
tgatggaccgggtgggcctggc

SEQ ID NO: 1153537 - DNA, 23 bp, Homo sapiens
tgatggaccgggtgggcctggcc

SEQ ID NO: 1153538 - DNA, 21 bp, Homo sapiens
tgatggacctgccccggacct

SEQ ID NO: 1153539 - DNA, 14 bp, Homo sapiens
tgatggactgggga

SEQ ID NO: 1153540 - DNA, 15 bp, Homo sapiens
tgatggactggggag

SEQ ID NO: 1153541 - DNA, 21 bp, Homo sapiens
tgatggagggtggaaataatt

SEQ ID NO: 1153542 - DNA, 20 bp, Homo sapiens
tgatggagtgtgcagacagc

SEQ ID NO: 1153543 - DNA, 23 bp, Homo sapiens
tgatggcaaaaaaaaaaaagcga

SEQ ID NO: 1153544 - DNA, 14 bp, Homo sapiens
tgatggcagagcca

SEQ ID NO: 1153545 - DNA, 13 bp, Homo sapiens
tgatggcagctgg

SEQ ID NO: 1153546 - DNA, 16 bp, Homo sapiens
tgatggccaagagcat

SEQ ID NO: 1153547 - DNA, 14 bp, Homo sapiens
tgatggccaagggg

SEQ ID NO: 1153548 - DNA, 14 bp, Homo sapiens
tgatggccagagga

SEQ ID NO: 1153549 - DNA, 18 bp, Homo sapiens
tgatggccagcccctggg

SEQ ID NO: 1153550 - DNA, 16 bp, Homo sapiens
tgatggccatttctaa

SEQ ID NO: 1153551 - DNA, 20 bp, Homo sapiens
tgatggccttaatttccttt

SEQ ID NO: 1153552 - DNA, 18 bp, Homo sapiens
tgatggccttacactgaa

SEQ ID NO: 1153553 - DNA, 21 bp, Homo sapiens
tgatggctcaagacaaggctg

SEQ ID NO: 1153554 - DNA, 14 bp, Homo sapiens
tgatggctgctaga

SEQ ID NO: 1153555 - DNA, 13 bp, Homo sapiens
tgatgggaaaata

SEQ ID NO: 1153556 - DNA, 16 bp, Homo sapiens
tgatgggaaaatattt

SEQ ID NO: 1153557 - DNA, 17 bp, Homo sapiens
tgatgggaaaatatttc

SEQ ID NO: 1153558 - DNA, 18 bp, Homo sapiens
tgatgggccaccggggca

SEQ ID NO: 1153559 - DNA, 12 bp, Homo sapiens
tgatgggctttt

SEQ ID NO: 1153560 - DNA, 15 bp, Homo sapiens
tgatggggaaggagt

SEQ ID NO: 1153561 - DNA, 24 bp, Homo sapiens
tgatggggcaagggcacaagtcct

SEQ ID NO: 1153562 - DNA, 15 bp, Homo sapiens
tgatgggggagaggg

SEQ ID NO: 1153563 - DNA, 15 bp, Homo sapiens
tgatgggtgctgccc

SEQ ID NO: 1153564 - DNA, 14 bp, Homo sapiens
tgatggtatttctt

SEQ ID NO: 1153565 - DNA, 15 bp, Homo sapiens
tgatggtcagagggc

SEQ ID NO: 1153566 - DNA, 15 bp, Homo sapiens
tgatggtcagctccc

SEQ ID NO: 1153567 - DNA, 20 bp, Homo sapiens
tgatggtggactaagcaatt

SEQ ID NO: 1153568 - DNA, 21 bp, Homo sapiens
tgatggtgtagccctcccact

SEQ ID NO: 1153569 - DNA, 19 bp, Homo sapiens
tgatggtgtcattctgcct

SEQ ID NO: 1153570 - DNA, 16 bp, Homo sapiens
tgatggtgtccttccc

SEQ ID NO: 1153571 - DNA, 22 bp, Homo sapiens
tgatggtgttaaagctgtacac

SEQ ID NO: 1153572 - DNA, 17 bp, Homo sapiens
tgatgtaaggactgtaa

SEQ ID NO: 1153573 - DNA, 14 bp, Homo sapiens
tgatgtacagaaca

SEQ ID NO: 1153574 - DNA, 16 bp, Homo sapiens
tgatgtacagtctgtc

SEQ ID NO: 1153575 - DNA, 11 bp, Homo sapiens
tgatgtacatg

SEQ ID NO: 1153576 - DNA, 13 bp, Homo sapiens
tgatgtacatgtg

SEQ ID NO: 1153577 - DNA, 16 bp, Homo sapiens
tgatgtacatgtgtag

SEQ ID NO: 1153578 - DNA, 13 bp, Homo sapiens
tgatgtatatgtt

SEQ ID NO: 1153579 - DNA, 15 bp, Homo sapiens
tgatgtatgtgtgaa

SEQ ID NO: 1153580 - DNA, 17 bp, Homo sapiens
tgatgtatgtgtgaaac

SEQ ID NO: 1153581 - DNA, 19 bp, Homo sapiens
tgatgtatgtgtgaaacaa

SEQ ID NO: 1153582 - DNA, 20 bp, Homo sapiens
tgatgtattacatgactgtt

SEQ ID NO: 1153583 - DNA, 17 bp, Homo sapiens
tgatgtattttcatagt

SEQ ID NO: 1153584 - DNA, 18 bp, Homo sapiens
tgatgtattttcatagtg

SEQ ID NO: 1153585 - DNA, 20 bp, Homo sapiens
tgatgtcaagcaatggggaa

SEQ ID NO: 1153586 - DNA, 23 bp, Homo sapiens
tgatgtcaatttctgtgttgcca

SEQ ID NO: 1153587 - DNA, 12 bp, Homo sapiens
tgatgtcagcct

SEQ ID NO: 1153588 - DNA, 18 bp, Homo sapiens
tgatgtcagccttgcatc

SEQ ID NO: 1153589 - DNA, 13 bp, Homo sapiens
tgatgtcatttga

SEQ ID NO: 1153590 - DNA, 12 bp, Homo sapiens
tgatgtccagaa

SEQ ID NO: 1153591 - DNA, 15 bp, Homo sapiens
tgatgtccagaagaa

SEQ ID NO: 1153592 - DNA, 23 bp, Homo sapiens
tgatgtccagaagaatattcagg

SEQ ID NO: 1153593 - DNA, 15 bp, Homo sapiens
tgatgtccccaaagt

SEQ ID NO: 1153594 - DNA, 16 bp, Homo sapiens
tgatgtccccaaagta

SEQ ID NO: 1153595 - DNA, 13 bp, Homo sapiens
tgatgtccttgga

SEQ ID NO: 1153596 - DNA, 18 bp, Homo sapiens
tgatgtccttggactcca

SEQ ID NO: 1153597 - DNA, 15 bp, Homo sapiens
tgatgtctacagaaa

SEQ ID NO: 1153598 - DNA, 17 bp, Homo sapiens
tgatgtctacagaaaat

SEQ ID NO: 1153599 - DNA, 16 bp, Homo sapiens
tgatgtctcttgtaga

SEQ ID NO: 1153600 - DNA, 18 bp, Homo sapiens
tgatgtctcttgtagaag

SEQ ID NO: 1153601 - DNA, 17 bp, Homo sapiens
tgatgtctttttattaa

SEQ ID NO: 1153602 - DNA, 23 bp, Homo sapiens
tgatgtgaaaagcacagctgtat

SEQ ID NO: 1153603 - DNA, 21 bp, Homo sapiens
tgatgtgaagagtttcacaaa

SEQ ID NO: 1153604 - DNA, 21 bp, Homo sapiens
tgatgtgaagataatttgcat

SEQ ID NO: 1153605 - DNA, 16 bp, Homo sapiens
tgatgtgacattccat

SEQ ID NO: 1153606 - DNA, 22 bp, Homo sapiens
tgatgtgcaaaaccttttactg

SEQ ID NO: 1153607 - DNA, 21 bp, Homo sapiens
tgatgtgccattttaaaaaaa

SEQ ID NO: 1153608 - DNA, 15 bp, Homo sapiens
tgatgtggacatatg

SEQ ID NO: 1153609 - DNA, 21 bp, Homo sapiens
tgatgtggaggaagagccacc

SEQ ID NO: 1153610 - DNA, 15 bp, Homo sapiens
tgatgtggtgcctga

SEQ ID NO: 1153611 - DNA, 12 bp, Homo sapiens
tgatgttaaaaa

SEQ ID NO: 1153612 - DNA, 13 bp, Homo sapiens
tgatgttaaaaaa

SEQ ID NO: 1153613 - DNA, 14 bp, Homo sapiens
tgatgttaaaaaaa

SEQ ID NO: 1153614 - DNA, 23 bp, Homo sapiens
tgatgttaaaaaaataagaagaa

SEQ ID NO: 1153615 - DNA, 15 bp, Homo sapiens
tgatgttactgagat

SEQ ID NO: 1153616 - DNA, 15 bp, Homo sapiens
tgatgttagaagaag

SEQ ID NO: 1153617 - DNA, 22 bp, Homo sapiens
tgatgttagaagaagaggaaga

SEQ ID NO: 1153618 - DNA, 23 bp, Homo sapiens
tgatgttagaagaagaggaagaa

SEQ ID NO: 1153619 - DNA, 13 bp, Homo sapiens
tgatgttggaaga

SEQ ID NO: 1153620 - DNA, 16 bp, Homo sapiens
tgatgtttgtggcctc

SEQ ID NO: 1153621 - DNA, 17 bp, Homo sapiens
tgatgtttgtggcctca

SEQ ID NO: 1153622 - DNA, 18 bp, Homo sapiens
tgatgtttgtggcctcag

SEQ ID NO: 1153623 - DNA, 20 bp, Homo sapiens
tgatgtttgtggcctcagaa

SEQ ID NO: 1153624 - DNA, 17 bp, Homo sapiens
tgatgttttaaggatgc

SEQ ID NO: 1153625 - DNA, 20 bp, Homo sapiens
tgatgttttacgtgcaaaca

SEQ ID NO: 1153626 - DNA, 23 bp, Homo sapiens
tgatgttttgatatttatttcct

SEQ ID NO: 1153627 - DNA, 16 bp, Homo sapiens
tgattggttaaaatgt

SEQ ID NO: 1153628 - DNA, 17 bp, Homo sapiens
tgattggttcagttttt

SEQ ID NO: 1153629 - DNA, 20 bp, Homo sapiens
tgattgtagtaatctgcatt

SEQ ID NO: 1153630 - DNA, 16 bp, Homo sapiens
tgattgtattgttgaa

SEQ ID NO: 1153631 - DNA, 14 bp, Homo sapiens
tgattgtcagccac

SEQ ID NO: 1153632 - DNA, 22 bp, Homo sapiens
tgattgtcagccacctccctct

SEQ ID NO: 1153633 - DNA, 21 bp, Homo sapiens
tgattgtcctttaaaaaagaa

SEQ ID NO: 1153634 - DNA, 20 bp, Homo sapiens
tgattgtgaggcttctaata

SEQ ID NO: 1153635 - DNA, 14 bp, Homo sapiens
tgattgtggaatgg

SEQ ID NO: 1153636 - DNA, 21 bp, Homo sapiens
tgattgtggaatggagattca

SEQ ID NO: 1153637 - DNA, 19 bp, Homo sapiens
tgattgttcgggtgtgcaa

SEQ ID NO: 1153638 - DNA, 21 bp, Homo sapiens
tgattgtttaagccagagtgt

SEQ ID NO: 1153639 - DNA, 13 bp, Homo sapiens
tgattgtttacag

SEQ ID NO: 1153640 - DNA, 15 bp, Homo sapiens
tgatttaaaagtgta

SEQ ID NO: 1153641 - DNA, 15 bp, Homo sapiens
tgatttaaacacaca

SEQ ID NO: 1153642 - DNA, 12 bp, Homo sapiens
tgatttaatgtt

SEQ ID NO: 1153643 - DNA, 15 bp, Homo sapiens
tgatttaatgttttc

SEQ ID NO: 1153644 - DNA, 20 bp, Homo sapiens
tgatttacagcaagtagata

SEQ ID NO: 1153645 - DNA, 23 bp, Homo sapiens
tgatttataaacagacaatatgt

SEQ ID NO: 1153646 - DNA, 18 bp, Homo sapiens
tgatttataaataacaaa

SEQ ID NO: 1153647 - DNA, 22 bp, Homo sapiens
tgatttatagtttgtacatgca

SEQ ID NO: 1153648 - DNA, 16 bp, Homo sapiens
tgatttatatatggca

SEQ ID NO: 1153649 - DNA, 12 bp, Homo sapiens
tgatttatttct

SEQ ID NO: 1153650 - DNA, 18 bp, Homo sapiens
tgatttatttctactata

SEQ ID NO: 1153651 - DNA, 20 bp, Homo sapiens
tgatttatttctactatata

SEQ ID NO: 1153652 - DNA, 19 bp, Homo sapiens
tgatttcacaacagatcaa

SEQ ID NO: 1153653 - DNA, 18 bp, Homo sapiens
tgatttcagaagagactg

SEQ ID NO: 1153654 - DNA, 11 bp, Homo sapiens
tgatttcagga

SEQ ID NO: 1153655 - DNA, 14 bp, Homo sapiens
tgatttcagttttt

SEQ ID NO: 1153656 - DNA, 19 bp, Homo sapiens
tgatttcagtttttcattt

SEQ ID NO: 1153657 - DNA, 21 bp, Homo sapiens
tgatttcagtttttcatttgt

SEQ ID NO: 1153658 - DNA, 13 bp, Homo sapiens
tgatttcataatt

SEQ ID NO: 1153659 - DNA, 16 bp, Homo sapiens
tgatttcatcttctgg

SEQ ID NO: 1153660 - DNA, 17 bp, Homo sapiens
tgatttcatcttctgga

SEQ ID NO: 1153661 - DNA, 22 bp, Homo sapiens
tgatttcattacatttctgaat

SEQ ID NO: 1153662 - DNA, 16 bp, Homo sapiens
tgatttccatttctga

SEQ ID NO: 1153663 - DNA, 18 bp, Homo sapiens
tgatttccgttaaaatac

SEQ ID NO: 1153664 - DNA, 18 bp, Homo sapiens
tctttaccttctaaaagc

SEQ ID NO: 1153665 - DNA, 18 bp, Homo sapiens
tctttacgtactgtaact

SEQ ID NO: 1153666 - DNA, 20 bp, Homo sapiens
tctttactcccttcctggcc

SEQ ID NO: 1153667 - DNA, 14 bp, Homo sapiens
tctttactctgact

SEQ ID NO: 1153668 - DNA, 17 bp, Homo sapiens
tctttactctgacttcc

SEQ ID NO: 1153669 - DNA, 15 bp, Homo sapiens
tctttacttcatgga

SEQ ID NO: 1153670 - DNA, 18 bp, Homo sapiens
tctttagagattataaca

SEQ ID NO: 1153671 - DNA, 20 bp, Homo sapiens
tctttagatagccctgtcct

SEQ ID NO: 1153672 - DNA, 21 bp, Homo sapiens
tctttagatagccctgtcctg

SEQ ID NO: 1153673 - DNA, 23 bp, Homo sapiens
tctttagatagccctgtcctggt

SEQ ID NO: 1153674 - DNA, 20 bp, Homo sapiens
tctttagcatttttatgcag

SEQ ID NO: 1153675 - DNA, 21 bp, Homo sapiens
tctttagcatttttatgcaga

SEQ ID NO: 1153676 - DNA, 16 bp, Homo sapiens
tctttaggccaggctt

SEQ ID NO: 1153677 - DNA, 15 bp, Homo sapiens
tctttaggctttcaa

SEQ ID NO: 1153678 - DNA, 14 bp, Homo sapiens
tctttataaaatgt

SEQ ID NO: 1153679 - DNA, 15 bp, Homo sapiens
tctttataaaatgta

SEQ ID NO: 1153680 - DNA, 22 bp, Homo sapiens
tctttataaaatgtataaatta

SEQ ID NO: 1153681 - DNA, 20 bp, Homo sapiens
tctttataattctactttga

SEQ ID NO: 1153682 - DNA, 15 bp, Homo sapiens
tctttatagatgtac

SEQ ID NO: 1153683 - DNA, 13 bp, Homo sapiens
tctttatgctgta

SEQ ID NO: 1153684 - DNA, 16 bp, Homo sapiens
tctttatgtagcacta

SEQ ID NO: 1153685 - DNA, 15 bp, Homo sapiens
tctttattgaaattc

SEQ ID NO: 1153686 - DNA, 16 bp, Homo sapiens
tctttattgagaaaga

SEQ ID NO: 1153687 - DNA, 19 bp, Homo sapiens
tctttattgagaaagagca

SEQ ID NO: 1153688 - DNA, 15 bp, Homo sapiens
tctttattgcactag

SEQ ID NO: 1153689 - DNA, 15 bp, Homo sapiens
tctttatttctagca

SEQ ID NO: 1153690 - DNA, 18 bp, Homo sapiens
tctttatttctagcagag

SEQ ID NO: 1153691 - DNA, 11 bp, Homo sapiens
tctttcaaaac

SEQ ID NO: 1153692 - DNA, 23 bp, Homo sapiens
tctttcaaaaccttttgaaatta

SEQ ID NO: 1153693 - DNA, 18 bp, Homo sapiens
tctttcaaattgagagaa

SEQ ID NO: 1153694 - DNA, 20 bp, Homo sapiens
tctttcaagcagtcgtgcct

SEQ ID NO: 1153695 - DNA, 16 bp, Homo sapiens
tctttcaataaatgta

SEQ ID NO: 1153696 - DNA, 14 bp, Homo sapiens
tctttcacagctcc

SEQ ID NO: 1153697 - DNA, 18 bp, Homo sapiens
tctttcacagctcctccc

SEQ ID NO: 1153698 - DNA, 22 bp, Homo sapiens
tctttcacattgtttgctgcta

SEQ ID NO: 1153699 - DNA, 13 bp, Homo sapiens
tctttcacttgaa

SEQ ID NO: 1153700 - DNA, 21 bp, Homo sapiens
tctttcagtacttttttaaat

SEQ ID NO: 1153701 - DNA, 21 bp, Homo sapiens
tctttcatccactagtgcaaa

SEQ ID NO: 1153702 - DNA, 21 bp, Homo sapiens
tctttcatttgctttggaagt

SEQ ID NO: 1153703 - DNA, 14 bp, Homo sapiens
tctttccaaagtac

SEQ ID NO: 1153704 - DNA, 23 bp, Homo sapiens
tctttccaaagtacactgtttca

SEQ ID NO: 1153705 - DNA, 23 bp, Homo sapiens
tctttccactctggattcagcct

SEQ ID NO: 1153706 - DNA, 16 bp, Homo sapiens
tctttccacttctctg

SEQ ID NO: 1153707 - DNA, 19 bp, Homo sapiens
tctttccacttctctgggt

SEQ ID NO: 1153708 - DNA, 17 bp, Homo sapiens
tctttccatttgcattt

SEQ ID NO: 1153709 - DNA, 22 bp, Homo sapiens
tctttccatttgcatttgttta

SEQ ID NO: 1153710 - DNA, 11 bp, Homo sapiens
tctttccccag

SEQ ID NO: 1153711 - DNA, 20 bp, Homo sapiens
tctttccccagaggctccca

SEQ ID NO: 1153712 - DNA, 14 bp, Homo sapiens
tctttccccagcag

SEQ ID NO: 1153713 - DNA, 20 bp, Homo sapiens
tctttcccctcagagctctt

SEQ ID NO: 1153714 - DNA, 23 bp, Homo sapiens
tctttcccctcaggagtttctat

SEQ ID NO: 1153715 - DNA, 12 bp, Homo sapiens
tctttccctgcg

SEQ ID NO: 1153716 - DNA, 14 bp, Homo sapiens
tctttccctgcgag

SEQ ID NO: 1153717 - DNA, 13 bp, Homo sapiens
tctttccctggac

SEQ ID NO: 1153718 - DNA, 17 bp, Homo sapiens
tctttcctaaggctgca

SEQ ID NO: 1153719 - DNA, 16 bp, Homo sapiens
tctttcctatttcagt

SEQ ID NO: 1153720 - DNA, 15 bp, Homo sapiens
tctttcctccccctg

SEQ ID NO: 1153721 - DNA, 15 bp, Homo sapiens
tctttcctctttctg

SEQ ID NO: 1153722 - DNA, 17 bp, Homo sapiens
tctttcctgccctgtcc

SEQ ID NO: 1153723 - DNA, 13 bp, Homo sapiens
tctttccttgctc

SEQ ID NO: 1153724 - DNA, 19 bp, Homo sapiens
tctttctaactgtagctat

SEQ ID NO: 1153725 - DNA, 15 bp, Homo sapiens
tctttctacagagat

SEQ ID NO: 1153726 - DNA, 22 bp, Homo sapiens
tctttctacatgactgggcctc

SEQ ID NO: 1153727 - DNA, 16 bp, Homo sapiens
tctttctactctgaac

SEQ ID NO: 1153728 - DNA, 15 bp, Homo sapiens
tctttctagaggtgc

SEQ ID NO: 1153729 - DNA, 11 bp, Homo sapiens
tctttctagcc

SEQ ID NO: 1153730 - DNA, 22 bp, Homo sapiens
tctttctagttcagctgcccca

SEQ ID NO: 1153731 - DNA, 18 bp, Homo sapiens
tctttctatagaaatatt

SEQ ID NO: 1153732 - DNA, 17 bp, Homo sapiens
tctttctatataaaatg

SEQ ID NO: 1153733 - DNA, 15 bp, Homo sapiens
tctttctcctcagga

SEQ ID NO: 1153734 - DNA, 14 bp, Homo sapiens
tctttctctaaata

SEQ ID NO: 1153735 - DNA, 10 bp, Homo sapiens
tctttctctc

SEQ ID NO: 1153736 - DNA, 16 bp, Homo sapiens
tctttctctcagtgaa

SEQ ID NO: 1153737 - DNA, 13 bp, Homo sapiens
tctttctctctgc

SEQ ID NO: 1153738 - DNA, 18 bp, Homo sapiens
tctttctctcttccctca

SEQ ID NO: 1153739 - DNA, 12 bp, Homo sapiens
tctttctctgcc

SEQ ID NO: 1153740 - DNA, 11 bp, Homo sapiens
tctttctctgg

SEQ ID NO: 1153741 - DNA, 15 bp, Homo sapiens
tctttctcttccctg

SEQ ID NO: 1153742 - DNA, 19 bp, Homo sapiens
tctttctgagcacacttta

SEQ ID NO: 1153743 - DNA, 21 bp, Homo sapiens
tctttctgagcacactttagt

SEQ ID NO: 1153744 - DNA, 16 bp, Homo sapiens
tctttctgatgtcaaa

SEQ ID NO: 1153745 - DNA, 20 bp, Homo sapiens
tctttctgcacacaaatatt

SEQ ID NO: 1153746 - DNA, 22 bp, Homo sapiens
tctttctgcagaaacagaaagg

SEQ ID NO: 1153747 - DNA, 16 bp, Homo sapiens
tctttctgtcccctct

SEQ ID NO: 1153748 - DNA, 17 bp, Homo sapiens
tctttctgttgaaaagc

SEQ ID NO: 1153749 - DNA, 16 bp, Homo sapiens
tctttcttaagccctt

SEQ ID NO: 1153750 - DNA, 19 bp, Homo sapiens
tctttcttcccgtgtgtat

SEQ ID NO: 1153751 - DNA, 16 bp, Homo sapiens
tctttcttcctctgct

SEQ ID NO: 1153752 - DNA, 21 bp, Homo sapiens
tctttctttacctgagaccag

SEQ ID NO: 1153753 - DNA, 12 bp, Homo sapiens
tctttctttcca

SEQ ID NO: 1153754 - DNA, 19 bp, Homo sapiens
tctttctttgcaccaaaga

SEQ ID NO: 1153755 - DNA, 16 bp, Homo sapiens
tctttcttttaagcag

SEQ ID NO: 1153756 - DNA, 13 bp, Homo sapiens
tctttctttttct

SEQ ID NO: 1153757 - DNA, 15 bp, Homo sapiens
tctttctttttctgg

SEQ ID NO: 1153758 - DNA, 23 bp, Homo sapiens
tctttctttttctggaaattttg

SEQ ID NO: 1153759 - DNA, 21 bp, Homo sapiens
tctttgaaaacagatgaccat

SEQ ID NO: 1153760 - DNA, 11 bp, Homo sapiens
tctttgaaata

SEQ ID NO: 1153761 - DNA, 21 bp, Homo sapiens
tctttgaaatagtctgtgtga

SEQ ID NO: 1153762 - DNA, 23 bp, Homo sapiens
tctttgaagaaaagaaaaaacaa

SEQ ID NO: 1153763 - DNA, 16 bp, Homo sapiens
tctttgaattttctgt

SEQ ID NO: 1153764 - DNA, 17 bp, Homo sapiens
tctttgaattttctgtg

SEQ ID NO: 1153765 - DNA, 19 bp, Homo sapiens
tctttgacaattctgggtg

SEQ ID NO: 1153766 - DNA, 21 bp, Homo sapiens
tctttgacaattgggagctgc

SEQ ID NO: 1153767 - DNA, 23 bp, Homo sapiens
tctttgacctcaacctgtgatga

SEQ ID NO: 1153768 - DNA, 14 bp, Homo sapiens
tctttgacctcaat

SEQ ID NO: 1153769 - DNA, 23 bp, Homo sapiens
tctttgagaactgcttctaagat

SEQ ID NO: 1153770 - DNA, 22 bp, Homo sapiens
tctttgagatagaagaactgca

SEQ ID NO: 1153771 - DNA, 20 bp, Homo sapiens
tctttgataaagaaaagaat

SEQ ID NO: 1153772 - DNA, 13 bp, Homo sapiens
tctttgatccttc

SEQ ID NO: 1153773 - DNA, 21 bp, Homo sapiens
tctttgatccttctgagctcc

SEQ ID NO: 1153774 - DNA, 17 bp, Homo sapiens
tctttgattatttgcat

SEQ ID NO: 1153775 - DNA, 19 bp, Homo sapiens
tctttgattatttgcatgt

SEQ ID NO: 1153776 - DNA, 20 bp, Homo sapiens
tctttgattatttgcatgtt

SEQ ID NO: 1153777 - DNA, 14 bp, Homo sapiens
tctttgatttgtac

SEQ ID NO: 1153778 - DNA, 15 bp, Homo sapiens
tctttgcaaagtatt

SEQ ID NO: 1153779 - DNA, 13 bp, Homo sapiens
tctttgcaactgt

SEQ ID NO: 1153780 - DNA, 17 bp, Homo sapiens
tctttgcacatgtgacc

SEQ ID NO: 1153781 - DNA, 15 bp, Homo sapiens
tctttgcaccaaaga

SEQ ID NO: 1153782 - DNA, 22 bp, Homo sapiens
tctttgcattccttacttgcac

SEQ ID NO: 1153783 - DNA, 23 bp, Homo sapiens
tctttgcattccttacttgcact

SEQ ID NO: 1153784 - DNA, 18 bp, Homo sapiens
tctttgccaacatggtga

SEQ ID NO: 1153785 - DNA, 12 bp, Homo sapiens
tctttgcctggt

SEQ ID NO: 1153786 - DNA, 14 bp, Homo sapiens
tctttgccttctct

SEQ ID NO: 1153787 - DNA, 12 bp, Homo sapiens
tctgtatctctc

SEQ ID NO: 1153788 - DNA, 22 bp, Homo sapiens
tctgtatgaatgtgattggtaa

SEQ ID NO: 1153789 - DNA, 14 bp, Homo sapiens
tctgtatggcatga

SEQ ID NO: 1153790 - DNA, 20 bp, Homo sapiens
tctgtatttaatggttttta

SEQ ID NO: 1153791 - DNA, 13 bp, Homo sapiens
tctgtatttcatg

SEQ ID NO: 1153792 - DNA, 14 bp, Homo sapiens
tctgtatttctagg

SEQ ID NO: 1153793 - DNA, 15 bp, Homo sapiens
tctgtcaaaacactg

SEQ ID NO: 1153794 - DNA, 17 bp, Homo sapiens
tctgtcaaaacactgtg

SEQ ID NO: 1153795 - DNA, 24 bp, Homo sapiens
tctgtcaaatgtttccttaaacat

SEQ ID NO: 1153796 - DNA, 20 bp, Homo sapiens
tctgtcaagcatattggaaa

SEQ ID NO: 1153797 - DNA, 16 bp, Homo sapiens
tctgtcaatcacagtc

SEQ ID NO: 1153798 - DNA, 15 bp, Homo sapiens
tctgtcacaggctgg

SEQ ID NO: 1153799 - DNA, 16 bp, Homo sapiens
tctgtcacaggctggg

SEQ ID NO: 1153800 - DNA, 19 bp, Homo sapiens
tctgtcacaggctgggtca

SEQ ID NO: 1153801 - DNA, 20 bp, Homo sapiens
tctgtcacagtaaaaataaa

SEQ ID NO: 1153802 - DNA, 13 bp, Homo sapiens
tctgtcaccaaat

SEQ ID NO: 1153803 - DNA, 19 bp, Homo sapiens
tctgtcaccaattggttaa

SEQ ID NO: 1153804 - DNA, 18 bp, Homo sapiens
tctgtcagatgagaacaa

SEQ ID NO: 1153805 - DNA, 22 bp, Homo sapiens
tctgtcagatgagaacaaagct

SEQ ID NO: 1153806 - DNA, 18 bp, Homo sapiens
tctgtcagatgggaagac

SEQ ID NO: 1153807 - DNA, 15 bp, Homo sapiens
tctgtcagcatctgg

SEQ ID NO: 1153808 - DNA, 17 bp, Homo sapiens
tctgtcagcatctggct

SEQ ID NO: 1153809 - DNA, 19 bp, Homo sapiens
tctgtcagcatctggctgt

SEQ ID NO: 1153810 - DNA, 13 bp, Homo sapiens
tctgtcagccagc

SEQ ID NO: 1153811 - DNA, 21 bp, Homo sapiens
tctgtcagccagccgccctgg

SEQ ID NO: 1153812 - DNA, 22 bp, Homo sapiens
tctgtcagccagccgccctggg

SEQ ID NO: 1153813 - DNA, 21 bp, Homo sapiens
tctgtcagcgcaggtttagtt

SEQ ID NO: 1153814 - DNA, 14 bp, Homo sapiens
tctgtcagctgcaa

SEQ ID NO: 1153815 - DNA, 18 bp, Homo sapiens
tctgtcaggtttggtttt

SEQ ID NO: 1153816 - DNA, 17 bp, Homo sapiens
tctgtcagtcacagcca

SEQ ID NO: 1153817 - DNA, 17 bp, Homo sapiens
tctgtcatcctcaggaa

SEQ ID NO: 1153818 - DNA, 22 bp, Homo sapiens
tctgtcatgaacatgttcctga

SEQ ID NO: 1153819 - DNA, 15 bp, Homo sapiens
tctgtcatttacaca

SEQ ID NO: 1153820 - DNA, 21 bp, Homo sapiens
tctgtccaaacatttcatccg

SEQ ID NO: 1153821 - DNA, 16 bp, Homo sapiens
tctgtccaaaggaggc

SEQ ID NO: 1153822 - DNA, 19 bp, Homo sapiens
tctgtccaaaggaggctgg

SEQ ID NO: 1153823 - DNA, 13 bp, Homo sapiens
tctgtccaaggaa

SEQ ID NO: 1153824 - DNA, 13 bp, Homo sapiens
tctgtccacctcg

SEQ ID NO: 1153825 - DNA, 14 bp, Homo sapiens
tctgtccacctcgg

SEQ ID NO: 1153826 - DNA, 21 bp, Homo sapiens
tctgtccacctcggcctccca

SEQ ID NO: 1153827 - DNA, 23 bp, Homo sapiens
tctgtccacctcggcctcccaga

SEQ ID NO: 1153828 - DNA, 21 bp, Homo sapiens
tctgtccagctggggccagag

SEQ ID NO: 1153829 - DNA, 13 bp, Homo sapiens
tctgtccatctgt

SEQ ID NO: 1153830 - DNA, 20 bp, Homo sapiens
tctgtccatctgtctgtcct

SEQ ID NO: 1153831 - DNA, 16 bp, Homo sapiens
tcttggctttcatgtt

SEQ ID NO: 1153832 - DNA, 11 bp, Homo sapiens
tcttgggaaat

SEQ ID NO: 1153833 - DNA, 12 bp, Homo sapiens
tcttgggaaata

SEQ ID NO: 1153834 - DNA, 20 bp, Homo sapiens
tcttgggaaatatgaatgcc

SEQ ID NO: 1153835 - DNA, 21 bp, Homo sapiens
tcttgggaactccactctcct

SEQ ID NO: 1153836 - DNA, 14 bp, Homo sapiens
tcttgggaactgaa

SEQ ID NO: 1153837 - DNA, 21 bp, Homo sapiens
tcttgggagtatgttgtcata

SEQ ID NO: 1153838 - DNA, 23 bp, Homo sapiens
tcttgggcagagctggctctgag

SEQ ID NO: 1153839 - DNA, 14 bp, Homo sapiens
tcttgggccccaga

SEQ ID NO: 1153840 - DNA, 20 bp, Homo sapiens
tcttgggccccagaccccag

SEQ ID NO: 1153841 - DNA, 13 bp, Homo sapiens
tcttgggccctcc

SEQ ID NO: 1153842 - DNA, 14 bp, Homo sapiens
tcttgggctactgg

SEQ ID NO: 1153843 - DNA, 19 bp, Homo sapiens
tcttgggctactggcagct

SEQ ID NO: 1153844 - DNA, 14 bp, Homo sapiens
tcttgggctctcct

SEQ ID NO: 1153845 - DNA, 14 bp, Homo sapiens
tcttgggctgagtg

SEQ ID NO: 1153846 - DNA, 16 bp, Homo sapiens
tcttgggctgagtgca

SEQ ID NO: 1153847 - DNA, 18 bp, Homo sapiens
tcttggggaccctgccta

SEQ ID NO: 1153848 - DNA, 22 bp, Homo sapiens
tcttggggactaacccaatgcc

SEQ ID NO: 1153849 - DNA, 17 bp, Homo sapiens
tcttggggcaagactgc

SEQ ID NO: 1153850 - DNA, 23 bp, Homo sapiens
tcttggggcaagactgcaaactt

SEQ ID NO: 1153851 - DNA, 19 bp, Homo sapiens
tcttgggggaggccacccc

SEQ ID NO: 1153852 - DNA, 21 bp, Homo sapiens
tcttgggggtcaggggggaga

SEQ ID NO: 1153853 - DNA, 21 bp, Homo sapiens
tcttggggtactcttgatgtg

SEQ ID NO: 1153854 - DNA, 15 bp, Homo sapiens
tcttggggttcatag

SEQ ID NO: 1153855 - DNA, 21 bp, Homo sapiens
tcttggggttcataggggcag

SEQ ID NO: 1153856 - DNA, 16 bp, Homo sapiens
tcttgggtagggcaga

SEQ ID NO: 1153857 - DNA, 21 bp, Homo sapiens
tcttgggtgaaggtgcatctt

SEQ ID NO: 1153858 - DNA, 17 bp, Homo sapiens
tcttgggtggttcctaa

SEQ ID NO: 1153859 - DNA, 15 bp, Homo sapiens
tcttggtaaaacatt

SEQ ID NO: 1153860 - DNA, 22 bp, Homo sapiens
tcttggtaaaacattacttatt

SEQ ID NO: 1153861 - DNA, 19 bp, Homo sapiens
tcttggtactgttgctttg

SEQ ID NO: 1153862 - DNA, 16 bp, Homo sapiens
tcttggtagttctgtg

SEQ ID NO: 1153863 - DNA, 18 bp, Homo sapiens
tcttggtagttctgtgcc

SEQ ID NO: 1153864 - DNA, 17 bp, Homo sapiens
tcttggtcagatttgaa

SEQ ID NO: 1153865 - DNA, 22 bp, Homo sapiens
tcttggtgaaataataaaatgc

SEQ ID NO: 1153866 - DNA, 22 bp, Homo sapiens
tcttggtgccttttgtgtgatg

SEQ ID NO: 1153867 - DNA, 13 bp, Homo sapiens
tcttggtgctctg

SEQ ID NO: 1153868 - DNA, 16 bp, Homo sapiens
tcttggtgctctgtgt

SEQ ID NO: 1153869 - DNA, 18 bp, Homo sapiens
tcttggtgctctgtgttc

SEQ ID NO: 1153870 - DNA, 20 bp, Homo sapiens
tcttggtgtgattgcacaga

SEQ ID NO: 1153871 - DNA, 21 bp, Homo sapiens
tcttggttcataaatgaattt

SEQ ID NO: 1153872 - DNA, 13 bp, Homo sapiens
tcttggttcctgt

SEQ ID NO: 1153873 - DNA, 13 bp, Homo sapiens
tcttggtttctgg

SEQ ID NO: 1153874 - DNA, 18 bp, Homo sapiens
tcttggttttctctctgg

SEQ ID NO: 1153875 - DNA, 22 bp, Homo sapiens
tcttgtaaaaaggggaggagaa

SEQ ID NO: 1153876 - DNA, 15 bp, Homo sapiens
tcttgtaaagactgg

SEQ ID NO: 1153877 - DNA, 23 bp, Homo sapiens
tcttgtaaagactggttttctgc

SEQ ID NO: 1153878 - DNA, 19 bp, Homo sapiens
tcttgtaatccgaatctct

SEQ ID NO: 1153879 - DNA, 15 bp, Homo sapiens
tcttgtaattttaca

SEQ ID NO: 1153880 - DNA, 19 bp, Homo sapiens
tcttgtaattttacacgct

SEQ ID NO: 1153881 - DNA, 21 bp, Homo sapiens
tcttgtaccatagaaaaatgt

SEQ ID NO: 1153882 - DNA, 22 bp, Homo sapiens
tcttgtaccatagaaaaatgta

SEQ ID NO: 1153883 - DNA, 21 bp, Homo sapiens
tcttgtagaagatggactctg

SEQ ID NO: 1153884 - DNA, 20 bp, Homo sapiens
tcttgtatctggattcaaat

SEQ ID NO: 1153885 - DNA, 23 bp, Homo sapiens
tcttgtatttgggccaaggtgtt

SEQ ID NO: 1153886 - DNA, 16 bp, Homo sapiens
tcttgtcacaataaat

SEQ ID NO: 1153887 - DNA, 15 bp, Homo sapiens
tcttgtccacattct

SEQ ID NO: 1153888 - DNA, 19 bp, Homo sapiens
tcttgtccacattctactt

SEQ ID NO: 1153889 - DNA, 18 bp, Homo sapiens
tcttgtcccaattaaaat

SEQ ID NO: 1153890 - DNA, 13 bp, Homo sapiens
tcttgtcctagct

SEQ ID NO: 1153891 - DNA, 15 bp, Homo sapiens
tcttgtcctggccct

SEQ ID NO: 1153892 - DNA, 12 bp, Homo sapiens
tcttgtctataa

SEQ ID NO: 1153893 - DNA, 13 bp, Homo sapiens
tcttgtctctggg

SEQ ID NO: 1153894 - DNA, 12 bp, Homo sapiens
tcttgtctgtta

SEQ ID NO: 1153895 - DNA, 13 bp, Homo sapiens
tcttgtcttacca

SEQ ID NO: 1153896 - DNA, 15 bp, Homo sapiens
tcttgtcttttcaga

SEQ ID NO: 1153897 - DNA, 17 bp, Homo sapiens
tcttgtgacgtgcactg

SEQ ID NO: 1153898 - DNA, 17 bp, Homo sapiens
tcttgtgactcagcaga

SEQ ID NO: 1153899 - DNA, 22 bp, Homo sapiens
tcttgtgagtggataatcagga

SEQ ID NO: 1153900 - DNA, 20 bp, Homo sapiens
tcttgtgcaaggtggccttt

SEQ ID NO: 1153901 - DNA, 23 bp, Homo sapiens
tcttgtgcataattcttccaaag

SEQ ID NO: 1153902 - DNA, 23 bp, Homo sapiens
tcttgtgctagaatactttttaa

SEQ ID NO: 1153903 - DNA, 22 bp, Homo sapiens
tcttgtgctcagcatgattctt

SEQ ID NO: 1153904 - DNA, 21 bp, Homo sapiens
tcttgtgcttttcctatttgt

SEQ ID NO: 1153905 - DNA, 24 bp, Homo sapiens
tcttgtggatggaaatgtagtgct

SEQ ID NO: 1153906 - DNA, 15 bp, Homo sapiens
tcttgtgggataatg

SEQ ID NO: 1153907 - DNA, 17 bp, Homo sapiens
tcttgtgtagatttgaa

SEQ ID NO: 1153908 - DNA, 18 bp, Homo sapiens
tcttgtgtagatttgaaa

SEQ ID NO: 1153909 - DNA, 20 bp, Homo sapiens
tcttgtgtagatttgaaaat

SEQ ID NO: 1153910 - DNA, 20 bp, Homo sapiens
tcttgtgtctttggaggtgc

SEQ ID NO: 1153911 - DNA, 18 bp, Homo sapiens
tcttgtgtgattaactta

SEQ ID NO: 1153912 - DNA, 22 bp, Homo sapiens
tcttgtgtttgacactaagaaa

SEQ ID NO: 1153913 - DNA, 19 bp, Homo sapiens
tcttgttaatgtcattgct

SEQ ID NO: 1153914 - DNA, 22 bp, Homo sapiens
tcttgttaatgtcattgctaaa

SEQ ID NO: 1153915 - DNA, 15 bp, Homo sapiens
tcttgttactgtgat

SEQ ID NO: 1153916 - DNA, 15 bp, Homo sapiens
tcttgttagaaaaca

SEQ ID NO: 1153917 - DNA, 24 bp, Homo sapiens
tcttgttagagagcttttcactgt

SEQ ID NO: 1153918 - DNA, 20 bp, Homo sapiens
tcttgttattaccaaaacag

SEQ ID NO: 1153919 - DNA, 17 bp, Homo sapiens
tcttgttattgaagtgt

SEQ ID NO: 1153920 - DNA, 14 bp, Homo sapiens
tcttgttctgttcc

SEQ ID NO: 1153921 - DNA, 16 bp, Homo sapiens
tcttgttgataaaaat

SEQ ID NO: 1153922 - DNA, 15 bp, Homo sapiens
tcttgttgcatcttt

SEQ ID NO: 1153923 - DNA, 22 bp, Homo sapiens
tcttgttgctcaaaaaatgagc

SEQ ID NO: 1153924 - DNA, 16 bp, Homo sapiens
tcttgttggtgcacag

SEQ ID NO: 1153925 - DNA, 14 bp, Homo sapiens
tcttgtttcaattc

SEQ ID NO: 1153926 - DNA, 11 bp, Homo sapiens
tcttgtttctg

SEQ ID NO: 1153927 - DNA, 23 bp, Homo sapiens
tcttgttttgtttgcttccatta

SEQ ID NO: 1153928 - DNA, 15 bp, Homo sapiens
tcttgtttttattaa

SEQ ID NO: 1153929 - DNA, 21 bp, Homo sapiens
tcttgtttttattaatttata

SEQ ID NO: 1153930 - DNA, 20 bp, Homo sapiens
tcttgtttttccactactgc

SEQ ID NO: 1153931 - DNA, 18 bp, Homo sapiens
tcttgttttttttttcca

SEQ ID NO: 1153932 - DNA, 16 bp, Homo sapiens
tctttaaaagaatgac

SEQ ID NO: 1153933 - DNA, 14 bp, Homo sapiens
tctttaaaagagag

SEQ ID NO: 1153934 - DNA, 15 bp, Homo sapiens
tctttaaaagagaga

SEQ ID NO: 1153935 - DNA, 23 bp, Homo sapiens
tctttaaaagagagagagagaaa

SEQ ID NO: 1153936 - DNA, 18 bp, Homo sapiens
tctttaaaaggaaagaaa

SEQ ID NO: 1153937 - DNA, 22 bp, Homo sapiens
tctttaaacaaatatgaaaaat

SEQ ID NO: 1153938 - DNA, 11 bp, Homo sapiens
tctttaaacag

SEQ ID NO: 1153939 - DNA, 17 bp, Homo sapiens
tctttaaaggcaaatat

SEQ ID NO: 1153940 - DNA, 20 bp, Homo sapiens
tctttaacaattgtcttaaa

SEQ ID NO: 1153941 - DNA, 22 bp, Homo sapiens
tctttaacatacaagaaaatgt

SEQ ID NO: 1153942 - DNA, 23 bp, Homo sapiens
tctttaactcccattaccatgta

SEQ ID NO: 1153943 - DNA, 13 bp, Homo sapiens
tctttaagccata

SEQ ID NO: 1153944 - DNA, 18 bp, Homo sapiens
tctttaaggtattgtgca

SEQ ID NO: 1153945 - DNA, 16 bp, Homo sapiens
tctttaatgctgtctt

SEQ ID NO: 1153946 - DNA, 14 bp, Homo sapiens
tctttttccttctt

SEQ ID NO: 1153947 - DNA, 15 bp, Homo sapiens
tctttttctccaccc

SEQ ID NO: 1153948 - DNA, 15 bp, Homo sapiens
tctttttctcttctg

SEQ ID NO: 1153949 - DNA, 16 bp, Homo sapiens
tctttttctcttctgt

SEQ ID NO: 1153950 - DNA, 12 bp, Homo sapiens
tctttttcttct

SEQ ID NO: 1153951 - DNA, 16 bp, Homo sapiens
tctttttctttctttg

SEQ ID NO: 1153952 - DNA, 15 bp, Homo sapiens
tctttttctttttaa

SEQ ID NO: 1153953 - DNA, 13 bp, Homo sapiens
tctttttgcttct

SEQ ID NO: 1153954 - DNA, 14 bp, Homo sapiens
tgaaaatcttggag

SEQ ID NO: 1153955 - DNA, 13 bp, Homo sapiens
tgaaaatgagccc

SEQ ID NO: 1153956 - DNA, 14 bp, Homo sapiens
tgaaaatgagccct

SEQ ID NO: 1153957 - DNA, 20 bp, Homo sapiens
tgaaaatgctcttaaaatat

SEQ ID NO: 1153958 - DNA, 21 bp, Homo sapiens
tgaaaatgctcttaaaatatc

SEQ ID NO: 1153959 - DNA, 22 bp, Homo sapiens
tgaaaatgctcttaaaatatct

SEQ ID NO: 1153960 - DNA, 13 bp, Homo sapiens
tgaaaatgctggc

SEQ ID NO: 1153961 - DNA, 11 bp, Homo sapiens
tgaaaatggaa

SEQ ID NO: 1153962 - DNA, 18 bp, Homo sapiens
tgaaaatggtttcaagtt

SEQ ID NO: 1153963 - DNA, 20 bp, Homo sapiens
tgaaaatggtttcaagttat

SEQ ID NO: 1153964 - DNA, 16 bp, Homo sapiens
tgaaaatgtatttcct

SEQ ID NO: 1153965 - DNA, 14 bp, Homo sapiens
tgaaaatgtcaaag

SEQ ID NO: 1153966 - DNA, 15 bp, Homo sapiens
tgaaaatgtcagaaa

SEQ ID NO: 1153967 - DNA, 18 bp, Homo sapiens
tgaaaatgtcagaaacca

SEQ ID NO: 1153968 - DNA, 19 bp, Homo sapiens
tgaaatacacaagtaaaca

SEQ ID NO: 1153969 - DNA, 13 bp, Homo sapiens
tgaaatacatcct

SEQ ID NO: 1153970 - DNA, 14 bp, Homo sapiens
tgaaatacatcctt

SEQ ID NO: 1153971 - DNA, 13 bp, Homo sapiens
tgaaatactactt

SEQ ID NO: 1153972 - DNA, 16 bp, Homo sapiens
tgaaatagctttactg

SEQ ID NO: 1153973 - DNA, 22 bp, Homo sapiens
tgaaatagctttactgtttctc

SEQ ID NO: 1153974 - DNA, 21 bp, Homo sapiens
tgaaataggagggaaaccttt

SEQ ID NO: 1153975 - DNA, 13 bp, Homo sapiens
tgaaatagtctgt

SEQ ID NO: 1153976 - DNA, 16 bp, Homo sapiens
tgaaatagtctgtgtg

SEQ ID NO: 1153977 - DNA, 17 bp, Homo sapiens
tgaaatagtctgtgtga

SEQ ID NO: 1153978 - DNA, 18 bp, Homo sapiens
tgaaatagtctgtgtgaa

SEQ ID NO: 1153979 - DNA, 17 bp, Homo sapiens
tgaaatagttctgccac

SEQ ID NO: 1153980 - DNA, 17 bp, Homo sapiens
tgaaatatatattgtaa

SEQ ID NO: 1153981 - DNA, 12 bp, Homo sapiens
tgaaatatgcat

SEQ ID NO: 1153982 - DNA, 18 bp, Homo sapiens
tgaaatattaaaatcact

SEQ ID NO: 1153983 - DNA, 16 bp, Homo sapiens
tgaaatattcagaaat

SEQ ID NO: 1153984 - DNA, 14 bp, Homo sapiens
tgaaatattcttag

SEQ ID NO: 1153985 - DNA, 15 bp, Homo sapiens
tgaaatattcttagg

SEQ ID NO: 1153986 - DNA, 19 bp, Homo sapiens
tgaaatatttaagtatata

SEQ ID NO: 1153987 - DNA, 18 bp, Homo sapiens
tgaaatcagcatgacaaa

SEQ ID NO: 1153988 - DNA, 16 bp, Homo sapiens
tgaaatcagtatcaga

SEQ ID NO: 1153989 - DNA, 23 bp, Homo sapiens
tgaaatccatatatatgaaatgt

SEQ ID NO: 1153990 - DNA, 20 bp, Homo sapiens
tgaaatccttgactggacct

SEQ ID NO: 1153991 - DNA, 19 bp, Homo sapiens
tgaaatctcagaattcctt

SEQ ID NO: 1153992 - DNA, 15 bp, Homo sapiens
tgaaatctgctagaa

SEQ ID NO: 1153993 - DNA, 20 bp, Homo sapiens
tgaaatctgctagaaagtta

SEQ ID NO: 1153994 - DNA, 15 bp, Homo sapiens
tgaaatctgtcaaga

SEQ ID NO: 1153995 - DNA, 21 bp, Homo sapiens
tgaaatctgtcaagagtagtt

SEQ ID NO: 1153996 - DNA, 12 bp, Homo sapiens
tgaaatctttct

SEQ ID NO: 1153997 - DNA, 16 bp, Homo sapiens
tgaaatgaccaagaca

SEQ ID NO: 1153998 - DNA, 17 bp, Homo sapiens
tgaaatgaggtctgttt

SEQ ID NO: 1153999 - DNA, 18 bp, Homo sapiens
tgaaatgaggtctgttta

SEQ ID NO: 1154000 - DNA, 20 bp, Homo sapiens
tgaaatgagtaaaaactaga

SEQ ID NO: 1154001 - DNA, 18 bp, Homo sapiens
tgaaatgataaagacttt

SEQ ID NO: 1154002 - DNA, 22 bp, Homo sapiens
tgaaatgcactgtattgctcct

SEQ ID NO: 1154003 - DNA, 14 bp, Homo sapiens
tgaaatgccaagtg

SEQ ID NO: 1154004 - DNA, 17 bp, Homo sapiens
tgaaatgccaagtgcct

SEQ ID NO: 1154005 - DNA, 17 bp, Homo sapiens
tgaaatgccctcctaaa

SEQ ID NO: 1154006 - DNA, 17 bp, Homo sapiens
tgaaatgggcatttatt

SEQ ID NO: 1154007 - DNA, 15 bp, Homo sapiens
tgaaatgtaacatga

SEQ ID NO: 1154008 - DNA, 14 bp, Homo sapiens
tgaaatgtataatt

SEQ ID NO: 1154009 - DNA, 20 bp, Homo sapiens
tgaaatgtataattaactta

SEQ ID NO: 1154010 - DNA, 21 bp, Homo sapiens
tgaaatgtcaaattgatgtgc

SEQ ID NO: 1154011 - DNA, 13 bp, Homo sapiens
tgaaatgtcagtt

SEQ ID NO: 1154012 - DNA, 18 bp, Homo sapiens
tgaaatgtcagttctgat

SEQ ID NO: 1154013 - DNA, 20 bp, Homo sapiens
tgaaatgtcagttctgatat

SEQ ID NO: 1154014 - DNA, 17 bp, Homo sapiens
tgaaatgtggttttcct

SEQ ID NO: 1154015 - DNA, 19 bp, Homo sapiens
tgaaatgtggttttcctga

SEQ ID NO: 1154016 - DNA, 13 bp, Homo sapiens
tgaaatgtgtttc

SEQ ID NO: 1154017 - DNA, 15 bp, Homo sapiens
tgaaatgttaacaat

SEQ ID NO: 1154018 - DNA, 17 bp, Homo sapiens
tgaaattaaagaaatga

SEQ ID NO: 1154019 - DNA, 19 bp, Homo sapiens
tgaaattaagcattttgaa

SEQ ID NO: 1154020 - DNA, 20 bp, Homo sapiens
tgaaattaatttgtgaattt

SEQ ID NO: 1154021 - DNA, 23 bp, Homo sapiens
tgaaattagggcccaattaataa

SEQ ID NO: 1154022 - DNA, 17 bp, Homo sapiens
tgaaattatgtatgttt

SEQ ID NO: 1154023 - DNA, 20 bp, Homo sapiens
tgaaattatgtgacatttta

SEQ ID NO: 1154024 - DNA, 21 bp, Homo sapiens
tgaaattcagagcaagttcct

SEQ ID NO: 1154025 - DNA, 15 bp, Homo sapiens
tgaaattccagatga

SEQ ID NO: 1154026 - DNA, 15 bp, Homo sapiens
tgaaattccagcaat

SEQ ID NO: 1154027 - DNA, 14 bp, Homo sapiens
tgaaattcctcctt

SEQ ID NO: 1154028 - DNA, 13 bp, Homo sapiens
tgaaattctattt

SEQ ID NO: 1154029 - DNA, 14 bp, Homo sapiens
tgaaattctcctgg

SEQ ID NO: 1154030 - DNA, 15 bp, Homo sapiens
tgaaattctcctgga

SEQ ID NO: 1154031 - DNA, 12 bp, Homo sapiens
tgaaattgtaaa

SEQ ID NO: 1154032 - DNA, 17 bp, Homo sapiens
tgaaattgtacatattt

SEQ ID NO: 1154033 - DNA, 22 bp, Homo sapiens
tgaaattgtctagcagagcagg

SEQ ID NO: 1154034 - DNA, 13 bp, Homo sapiens
tgaaatttaaata

SEQ ID NO: 1154035 - DNA, 16 bp, Homo sapiens
tgaaatttaaataata

SEQ ID NO: 1154036 - DNA, 23 bp, Homo sapiens
tgaaatttagtacactatgttct

SEQ ID NO: 1154037 - DNA, 17 bp, Homo sapiens
tgaaatttattcacata

SEQ ID NO: 1154038 - DNA, 17 bp, Homo sapiens
tgaaatttatttaatgt

SEQ ID NO: 1154039 - DNA, 21 bp, Homo sapiens
tgaaatttcatgattggctta

SEQ ID NO: 1154040 - DNA, 14 bp, Homo sapiens
tgaaatttgcctct

SEQ ID NO: 1154041 - DNA, 15 bp, Homo sapiens
tgaaatttgcctctg

SEQ ID NO: 1154042 - DNA, 20 bp, Homo sapiens
tgaaatttgcctctgtccaa

SEQ ID NO: 1154043 - DNA, 18 bp, Homo sapiens
tgaaattttagaaatatt

SEQ ID NO: 1154044 - DNA, 21 bp, Homo sapiens
tgaaattttctagactttctg

SEQ ID NO: 1154045 - DNA, 20 bp, Homo sapiens
tgaaatttttattaaattat

SEQ ID NO: 1154046 - DNA, 23 bp, Homo sapiens
tgaacaaacactgaatcatgtta

SEQ ID NO: 1154047 - DNA, 14 bp, Homo sapiens
tgaacaaagcagcc

SEQ ID NO: 1154048 - DNA, 18 bp, Homo sapiens
tgaacaaagctcaaagta

SEQ ID NO: 1154049 - DNA, 12 bp, Homo sapiens
tgaacaaagtgc

SEQ ID NO: 1154050 - DNA, 15 bp, Homo sapiens
tgaacaaatatgctt

SEQ ID NO: 1154051 - DNA, 14 bp, Homo sapiens
tgaacaagaattgg

SEQ ID NO: 1154052 - DNA, 19 bp, Homo sapiens
tgaacaagttgtttcattg

SEQ ID NO: 1154053 - DNA, 13 bp, Homo sapiens
tgaacacaattga

SEQ ID NO: 1154054 - DNA, 21 bp, Homo sapiens
tgaacacaattgatacttcag

SEQ ID NO: 1154055 - DNA, 22 bp, Homo sapiens
tgaacacaattgatacttcagg

SEQ ID NO: 1154056 - DNA, 20 bp, Homo sapiens
tgaacacacacgccagctcc

SEQ ID NO: 1154057 - DNA, 18 bp, Homo sapiens
tgaacacactgtgtcctg

SEQ ID NO: 1154058 - DNA, 23 bp, Homo sapiens
tgaacacactgtgtcctggtgct

SEQ ID NO: 1154059 - DNA, 15 bp, Homo sapiens
tgaacacatgtgtat

SEQ ID NO: 1154060 - DNA, 17 bp, Homo sapiens
tgaacaccattgaaggc

SEQ ID NO: 1154061 - DNA, 15 bp, Homo sapiens
tgaacactagtctgt

SEQ ID NO: 1154062 - DNA, 13 bp, Homo sapiens
tgaacacttataa

SEQ ID NO: 1154063 - DNA, 20 bp, Homo sapiens
tgaacagaaaacattctgat

SEQ ID NO: 1154064 - DNA, 22 bp, Homo sapiens
tgaacagactagaagtatttgt

SEQ ID NO: 1154065 - DNA, 13 bp, Homo sapiens
tgaacagcataag

SEQ ID NO: 1154066 - DNA, 17 bp, Homo sapiens
tgaaccacgtgaaactg

SEQ ID NO: 1154067 - DNA, 12 bp, Homo sapiens
tgaaccactgct

SEQ ID NO: 1154068 - DNA, 17 bp, Homo sapiens
tgaaccactgcttctct

SEQ ID NO: 1154069 - DNA, 19 bp, Homo sapiens
tgaaccactgcttctcttt

SEQ ID NO: 1154070 - DNA, 13 bp, Homo sapiens
tgaaccagccacg

SEQ ID NO: 1154071 - DNA, 23 bp, Homo sapiens
tgaaccagccacgaacagcccgc

SEQ ID NO: 1154072 - DNA, 15 bp, Homo sapiens
tgaaccagctcatct

SEQ ID NO: 1154073 - DNA, 20 bp, Homo sapiens
tgaaccagctcatctccaag

SEQ ID NO: 1154074 - DNA, 22 bp, Homo sapiens
tgaaccatggtgaagtgcttgg

SEQ ID NO: 1154075 - DNA, 23 bp, Homo sapiens
tgaaccatggtgaagtgcttgga

SEQ ID NO: 1154076 - DNA, 23 bp, Homo sapiens
tgaaccattccctagtcatttcc

SEQ ID NO: 1154077 - DNA, 21 bp, Homo sapiens
tgaaccatttgggatggagaa

SEQ ID NO: 1154078 - DNA, 14 bp, Homo sapiens
tgaacccaacagtc

SEQ ID NO: 1154079 - DNA, 14 bp, Homo sapiens
tgaacccacacctg

SEQ ID NO: 1154080 - DNA, 17 bp, Homo sapiens
tgaacccacacctgggc

SEQ ID NO: 1154081 - DNA, 13 bp, Homo sapiens
tgaaccccatggg

SEQ ID NO: 1154082 - DNA, 19 bp, Homo sapiens
tgaaccccatgggcttgga

SEQ ID NO: 1154083 - DNA, 14 bp, Homo sapiens
tgaacccccatgat

SEQ ID NO: 1154084 - DNA, 13 bp, Homo sapiens
tgaaccccctccc

SEQ ID NO: 1154085 - DNA, 13 bp, Homo sapiens
tgaacccctggcc

SEQ ID NO: 1154086 - DNA, 15 bp, Homo sapiens
tgaacccctggccag

SEQ ID NO: 1154087 - DNA, 16 bp, Homo sapiens
tgaacccctggccagc

SEQ ID NO: 1154088 - DNA, 23 bp, Homo sapiens
tgaacccctggccagctctgagg

SEQ ID NO: 1154089 - DNA, 13 bp, Homo sapiens
tgaacccctgtgt

SEQ ID NO: 1154090 - DNA, 19 bp, Homo sapiens
tgaacccgtccattcagaa

SEQ ID NO: 1154091 - DNA, 19 bp, Homo sapiens
tgaaccctaaggtgagtgt

SEQ ID NO: 1154092 - DNA, 13 bp, Homo sapiens
tgaaccctccagg

SEQ ID NO: 1154093 - DNA, 13 bp, Homo sapiens
tgaaccctcctcc

SEQ ID NO: 1154094 - DNA, 14 bp, Homo sapiens
tgaaccctcctcct

SEQ ID NO: 1154095 - DNA, 20 bp, Homo sapiens
tgaaccctcctcctttttaa

SEQ ID NO: 1154096 - DNA, 13 bp, Homo sapiens
tgaaccctcttgc

SEQ ID NO: 1154097 - DNA, 19 bp, Homo sapiens
tgaaccctcttgccatcct

SEQ ID NO: 1154098 - DNA, 21 bp, Homo sapiens
tgaaccctcttgccatcctga

SEQ ID NO: 1154099 - DNA, 21 bp, Homo sapiens
tgaaccctggggcctgactgc

SEQ ID NO: 1154100 - DNA, 20 bp, Homo sapiens
tgaaccgaggggctcaggaa

SEQ ID NO: 1154101 - DNA, 15 bp, Homo sapiens
tgaaccgcaccccat

SEQ ID NO: 1154102 - DNA, 16 bp, Homo sapiens
tgaacctattttcatt

SEQ ID NO: 1154103 - DNA, 17 bp, Homo sapiens
tgaacctattttcattt

SEQ ID NO: 1154104 - DNA, 22 bp, Homo sapiens
tgaacctcgaggaactccagga

SEQ ID NO: 1154105 - DNA, 12 bp, Homo sapiens
tgaacctgccct

SEQ ID NO: 1154106 - DNA, 13 bp, Homo sapiens
tgaacctggatcc

SEQ ID NO: 1154107 - DNA, 17 bp, Homo sapiens
tgaacctgggaggcaga

SEQ ID NO: 1154108 - DNA, 19 bp, Homo sapiens
tgaacgactgtatattgct

SEQ ID NO: 1154109 - DNA, 20 bp, Homo sapiens
tgaacgatccttcaaagtct

SEQ ID NO: 1154110 - DNA, 15 bp, Homo sapiens
tgaacgtccttcctt

SEQ ID NO: 1154111 - DNA, 16 bp, Homo sapiens
tgaacgttttaataat

SEQ ID NO: 1154112 - DNA, 18 bp, Homo sapiens
tgaacgttttcttctttc

SEQ ID NO: 1154113 - DNA, 20 bp, Homo sapiens
tgaacgttttcttctttccc

SEQ ID NO: 1154114 - DNA, 22 bp, Homo sapiens
tgaactagcaattggttgttta

SEQ ID NO: 1154115 - DNA, 20 bp, Homo sapiens
tgaactagctaccatataag

SEQ ID NO: 1154116 - DNA, 16 bp, Homo sapiens
tgaactcaagaaggaa

SEQ ID NO: 1154117 - DNA, 18 bp, Homo sapiens
tgaactcaagaaggaatt

SEQ ID NO: 1154118 - DNA, 20 bp, Homo sapiens
tgaactcaatctccagggct

SEQ ID NO: 1154119 - DNA, 15 bp, Homo sapiens
tgaactcaccctggg

SEQ ID NO: 1154120 - DNA, 21 bp, Homo sapiens
tgaactcaccctgggagccag

SEQ ID NO: 1154121 - DNA, 16 bp, Homo sapiens
tgaactcatcattttt

SEQ ID NO: 1154122 - DNA, 18 bp, Homo sapiens
tgaactccatacagcctc

SEQ ID NO: 1154123 - DNA, 17 bp, Homo sapiens
tgaactccatcattcat

SEQ ID NO: 1154124 - DNA, 15 bp, Homo sapiens
tgaactcctgccagg

SEQ ID NO: 1154125 - DNA, 14 bp, Homo sapiens
tgaactcctgccat

SEQ ID NO: 1154126 - DNA, 14 bp, Homo sapiens
tgaactcctggcct

SEQ ID NO: 1154127 - DNA, 22 bp, Homo sapiens
tgaactctcaaaagtctatttt

SEQ ID NO: 1154128 - DNA, 19 bp, Homo sapiens
tgaactctgttcccccacc

SEQ ID NO: 1154129 - DNA, 19 bp, Homo sapiens
tgaactcttagaaatgaag

SEQ ID NO: 1154130 - DNA, 17 bp, Homo sapiens
tgaactcttaggcacat

SEQ ID NO: 1154131 - DNA, 21 bp, Homo sapiens
tgaactcttaggcacatcaat

SEQ ID NO: 1154132 - DNA, 14 bp, Homo sapiens
tgaactcttcagaa

SEQ ID NO: 1154133 - DNA, 14 bp, Homo sapiens
tgaactctttctgg

SEQ ID NO: 1154134 - DNA, 12 bp, Homo sapiens
tgaactgaagtt

SEQ ID NO: 1154135 - DNA, 13 bp, Homo sapiens
tgaactgaagttt

SEQ ID NO: 1154136 - DNA, 14 bp, Homo sapiens
tgaactgacaatga

SEQ ID NO: 1154137 - DNA, 20 bp, Homo sapiens
tgaactgacaatgaagggaa

SEQ ID NO: 1154138 - DNA, 14 bp, Homo sapiens
tgaactgaggccct

SEQ ID NO: 1154139 - DNA, 19 bp, Homo sapiens
tgaactgaggccctgtgat

SEQ ID NO: 1154140 - DNA, 17 bp, Homo sapiens
tgaactgattcacatct

SEQ ID NO: 1154141 - DNA, 21 bp, Homo sapiens
tgaactgattcacatctcatt

SEQ ID NO: 1154142 - DNA, 14 bp, Homo sapiens
tgaactgcaaagct

SEQ ID NO: 1154143 - DNA, 14 bp, Homo sapiens
tgaactgcaacact

SEQ ID NO: 1154144 - DNA, 23 bp, Homo sapiens
tgaactgcctcaggaccccactg

SEQ ID NO: 1154145 - DNA, 14 bp, Homo sapiens
tgaactgggcacag

SEQ ID NO: 1154146 - DNA, 17 bp, Homo sapiens
tgaactgggcatttcac

SEQ ID NO: 1154147 - DNA, 22 bp, Homo sapiens
tgaactgggcgaatgtcttatt

SEQ ID NO: 1154148 - DNA, 10 bp, Homo sapiens
tgaactgtgg

SEQ ID NO: 1154149 - DNA, 16 bp, Homo sapiens
tgaactgttagatgct

SEQ ID NO: 1154150 - DNA, 18 bp, Homo sapiens
tgaactgttagatgctga

SEQ ID NO: 1154151 - DNA, 23 bp, Homo sapiens
tgaactgtttggtcgagtctttg

SEQ ID NO: 1154152 - DNA, 15 bp, Homo sapiens
tgaacttaaaatgaa

SEQ ID NO: 1154153 - DNA, 18 bp, Homo sapiens
tgaacttaaatgcccccc

SEQ ID NO: 1154154 - DNA, 23 bp, Homo sapiens
tgaacttaataactgtgtactgt

SEQ ID NO: 1154155 - DNA, 23 bp, Homo sapiens
tgaacttacacttggagcccgtg

SEQ ID NO: 1154156 - DNA, 21 bp, Homo sapiens
tgaacttagatgttaaatgtt

SEQ ID NO: 1154157 - DNA, 17 bp, Homo sapiens
tgaagcagctttaaaca

SEQ ID NO: 1154158 - DNA, 13 bp, Homo sapiens
tgaagcagtgcct

SEQ ID NO: 1154159 - DNA, 15 bp, Homo sapiens
tgaagcagtgcctcg

SEQ ID NO: 1154160 - DNA, 15 bp, Homo sapiens
tgaagcataaagtta

SEQ ID NO: 1154161 - DNA, 14 bp, Homo sapiens
tgaagcataatttg

SEQ ID NO: 1154162 - DNA, 15 bp, Homo sapiens
tgaagcataatttgt

SEQ ID NO: 1154163 - DNA, 19 bp, Homo sapiens
tgaagcatagctacaattt

SEQ ID NO: 1154164 - DNA, 18 bp, Homo sapiens
tgaagcatgctttgctgc

SEQ ID NO: 1154165 - DNA, 23 bp, Homo sapiens
tgaagcatttcaaagccctgcct

SEQ ID NO: 1154166 - DNA, 12 bp, Homo sapiens
tgaagccaaaga

SEQ ID NO: 1154167 - DNA, 14 bp, Homo sapiens
tgaagccaagtggg

SEQ ID NO: 1154168 - DNA, 16 bp, Homo sapiens
tgaagccactgaagct

SEQ ID NO: 1154169 - DNA, 19 bp, Homo sapiens
tgaagccactgaagctggg

SEQ ID NO: 1154170 - DNA, 20 bp, Homo sapiens
tgaagccactgaagctggga

SEQ ID NO: 1154171 - DNA, 13 bp, Homo sapiens
tgaagccacttgg

SEQ ID NO: 1154172 - DNA, 19 bp, Homo sapiens
tgaagccatgtagccaccc

SEQ ID NO: 1154173 - DNA, 15 bp, Homo sapiens
tgaagcccaataaac

SEQ ID NO: 1154174 - DNA, 12 bp, Homo sapiens
tgaagcccccct

SEQ ID NO: 1154175 - DNA, 15 bp, Homo sapiens
tgaagccgactctgg

SEQ ID NO: 1154176 - DNA, 16 bp, Homo sapiens
tgaagccgactctggc

SEQ ID NO: 1154177 - DNA, 22 bp, Homo sapiens
tgaagcctccgtggaacattct

SEQ ID NO: 1154178 - DNA, 15 bp, Homo sapiens
tgaagcctctctcct

SEQ ID NO: 1154179 - DNA, 22 bp, Homo sapiens
tgaagcctctgccctgcctccc

SEQ ID NO: 1154180 - DNA, 14 bp, Homo sapiens
tgaagccttttgtt

SEQ ID NO: 1154181 - DNA, 15 bp, Homo sapiens
tgaagcgactctcct

SEQ ID NO: 1154182 - DNA, 16 bp, Homo sapiens
tgaagcgactctcctg

SEQ ID NO: 1154183 - DNA, 17 bp, Homo sapiens
tgaagctaaaaggaaaa

SEQ ID NO: 1154184 - DNA, 22 bp, Homo sapiens
tgaagctaatgaactctttcaa

SEQ ID NO: 1154185 - DNA, 20 bp, Homo sapiens
tgaagctacaggttgtgaaa

SEQ ID NO: 1154186 - DNA, 19 bp, Homo sapiens
tgaagctatttatctgtag

SEQ ID NO: 1154187 - DNA, 16 bp, Homo sapiens
tgaagctcacactgat

SEQ ID NO: 1154188 - DNA, 21 bp, Homo sapiens
tgaagctcacactgatgggct

SEQ ID NO: 1154189 - DNA, 22 bp, Homo sapiens
tgaagctcacactgatgggctg

SEQ ID NO: 1154190 - DNA, 16 bp, Homo sapiens
tgaagctcacttctgg

SEQ ID NO: 1154191 - DNA, 20 bp, Homo sapiens
tgaagctcgcatccagacag

SEQ ID NO: 1154192 - DNA, 14 bp, Homo sapiens
tgaagctggcctgg

SEQ ID NO: 1154193 - DNA, 23 bp, Homo sapiens
tgaagctgttgctatttgtattt

SEQ ID NO: 1154194 - DNA, 15 bp, Homo sapiens
tgaagctgttgtgtg

SEQ ID NO: 1154195 - DNA, 19 bp, Homo sapiens
tgaagctgttgtgtgaggt

SEQ ID NO: 1154196 - DNA, 21 bp, Homo sapiens
tgaagcttcggccgcgccacc

SEQ ID NO: 1154197 - DNA, 18 bp, Homo sapiens
tgaagcttgactcccaag

SEQ ID NO: 1154198 - DNA, 13 bp, Homo sapiens
tgaagtggctggt

SEQ ID NO: 1154199 - DNA, 13 bp, Homo sapiens
tgaagtgtcttct

SEQ ID NO: 1154200 - DNA, 14 bp, Homo sapiens
tgaagtgtcttctg

SEQ ID NO: 1154201 - DNA, 18 bp, Homo sapiens
tgaagtgttctgagctgt

SEQ ID NO: 1154202 - DNA, 21 bp, Homo sapiens
tgaagttaaaacacctttcct

SEQ ID NO: 1154203 - DNA, 22 bp, Homo sapiens
tgaagttacacaattaattgtc

SEQ ID NO: 1154204 - DNA, 16 bp, Homo sapiens
tgaagttcatggtgat

SEQ ID NO: 1154205 - DNA, 18 bp, Homo sapiens
tgaagttcatggtgatca

SEQ ID NO: 1154206 - DNA, 15 bp, Homo sapiens
tgaagttgctgttta

SEQ ID NO: 1154207 - DNA, 18 bp, Homo sapiens
tgaagttggacagcaaaa

SEQ ID NO: 1154208 - DNA, 14 bp, Homo sapiens
tgaagttggcacat

SEQ ID NO: 1154209 - DNA, 18 bp, Homo sapiens
tgaagttgttactaacta

SEQ ID NO: 1154210 - DNA, 18 bp, Homo sapiens
tgaagtttaaattctagt

SEQ ID NO: 1154211 - DNA, 23 bp, Homo sapiens
tgaagtttcaagttttaaagttc

SEQ ID NO: 1154212 - DNA, 13 bp, Homo sapiens
tgaagtttcacat

SEQ ID NO: 1154213 - DNA, 21 bp, Homo sapiens
tgaagtttcatttatgataca

SEQ ID NO: 1154214 - DNA, 19 bp, Homo sapiens
tgaagttttccttgctatt

SEQ ID NO: 1154215 - DNA, 23 bp, Homo sapiens
tgaagttttccttgctatttcaa

SEQ ID NO: 1154216 - DNA, 15 bp, Homo sapiens
tgaataaaaaagatt

SEQ ID NO: 1154217 - DNA, 16 bp, Homo sapiens
tgaataaaaaagattc

SEQ ID NO: 1154218 - DNA, 18 bp, Homo sapiens
tgaataaaaaagattcta

SEQ ID NO: 1154219 - DNA, 19 bp, Homo sapiens
tgaataaaaaagattctac

SEQ ID NO: 1154220 - DNA, 17 bp, Homo sapiens
tgaataaaaagtgaact

SEQ ID NO: 1154221 - DNA, 20 bp, Homo sapiens
tgaataaactagattacatt

SEQ ID NO: 1154222 - DNA, 18 bp, Homo sapiens
tgaataaagaatgccatt

SEQ ID NO: 1154223 - DNA, 12 bp, Homo sapiens
tgaataaagtgt

SEQ ID NO: 1154224 - DNA, 14 bp, Homo sapiens
tgaataaatacctc

SEQ ID NO: 1154225 - DNA, 15 bp, Homo sapiens
tgaataaatacctct

SEQ ID NO: 1154226 - DNA, 19 bp, Homo sapiens
tgaataaatacctcttagc

SEQ ID NO: 1154227 - DNA, 15 bp, Homo sapiens
tgaataaatgtcttg

SEQ ID NO: 1154228 - DNA, 20 bp, Homo sapiens
tgaataaattttcaaatcct

SEQ ID NO: 1154229 - DNA, 21 bp, Homo sapiens
tgaataacctgaggattctat

SEQ ID NO: 1154230 - DNA, 16 bp, Homo sapiens
tgaataataagcagga

SEQ ID NO: 1154231 - DNA, 12 bp, Homo sapiens
tgaataatacag

SEQ ID NO: 1154232 - DNA, 13 bp, Homo sapiens
tgaatacaagcct

SEQ ID NO: 1154233 - DNA, 20 bp, Homo sapiens
tgaatacaattaaaggtcct

SEQ ID NO: 1154234 - DNA, 23 bp, Homo sapiens
tgaatacattaacggtgctaaaa

SEQ ID NO: 1154235 - DNA, 18 bp, Homo sapiens
tgaataccactctgtaat

SEQ ID NO: 1154236 - DNA, 22 bp, Homo sapiens
tgaataccattaaaactgcttt

SEQ ID NO: 1154237 - DNA, 14 bp, Homo sapiens
tgaatacctgctca

SEQ ID NO: 1154238 - DNA, 15 bp, Homo sapiens
tgaatactcttccca

SEQ ID NO: 1154239 - DNA, 14 bp, Homo sapiens
tgaatactcttgaa

SEQ ID NO: 1154240 - DNA, 21 bp, Homo sapiens
tgaatagatatgaaagctgat

SEQ ID NO: 1154241 - DNA, 21 bp, Homo sapiens
tgaatagatggaatttggaac

SEQ ID NO: 1154242 - DNA, 16 bp, Homo sapiens
tgaatagatgtgatca

SEQ ID NO: 1154243 - DNA, 15 bp, Homo sapiens
tgaatagcctggcca

SEQ ID NO: 1154244 - DNA, 15 bp, Homo sapiens
tgaatagcttgtttc

SEQ ID NO: 1154245 - DNA, 15 bp, Homo sapiens
tctgctctagccagg

SEQ ID NO: 1154246 - DNA, 16 bp, Homo sapiens
tctgctctagccagga

SEQ ID NO: 1154247 - DNA, 18 bp, Homo sapiens
tctgctctagccaggagt

SEQ ID NO: 1154248 - DNA, 14 bp, Homo sapiens
tctgctctgccatc

SEQ ID NO: 1154249 - DNA, 12 bp, Homo sapiens
tctgctctgccc

SEQ ID NO: 1154250 - DNA, 13 bp, Homo sapiens
tctgctctgccct

SEQ ID NO: 1154251 - DNA, 13 bp, Homo sapiens
tctgctctgcctg

SEQ ID NO: 1154252 - DNA, 14 bp, Homo sapiens
tctgctctgcctgg

SEQ ID NO: 1154253 - DNA, 12 bp, Homo sapiens
tctgctctgctg

SEQ ID NO: 1154254 - DNA, 12 bp, Homo sapiens
tctgctctggaa

SEQ ID NO: 1154255 - DNA, 18 bp, Homo sapiens
tctgctctggttgtttct

SEQ ID NO: 1154256 - DNA, 15 bp, Homo sapiens
tctgctcttgtttca

SEQ ID NO: 1154257 - DNA, 16 bp, Homo sapiens
tctgctcttgtttcac

SEQ ID NO: 1154258 - DNA, 20 bp, Homo sapiens
tctgctctttctctgccagt

SEQ ID NO: 1154259 - DNA, 13 bp, Homo sapiens
tctgctgaaggaa

SEQ ID NO: 1154260 - DNA, 16 bp, Homo sapiens
tctgctgaaggacaga

SEQ ID NO: 1154261 - DNA, 18 bp, Homo sapiens
tctgctgacctgctgacc

SEQ ID NO: 1154262 - DNA, 19 bp, Homo sapiens
tctgctgacctgctgacct

SEQ ID NO: 1154263 - DNA, 19 bp, Homo sapiens
tctgctgactgtttcattc

SEQ ID NO: 1154264 - DNA, 20 bp, Homo sapiens
tctgctgactgtttcattca

SEQ ID NO: 1154265 - DNA, 18 bp, Homo sapiens
tctgctgagctgggccca

SEQ ID NO: 1154266 - DNA, 12 bp, Homo sapiens
tctgctgaggcc

SEQ ID NO: 1154267 - DNA, 14 bp, Homo sapiens
tctgctgagtgctg

SEQ ID NO: 1154268 - DNA, 18 bp, Homo sapiens
tctgctgagtgctgggca

SEQ ID NO: 1154269 - DNA, 12 bp, Homo sapiens
tctgctgcagtt

SEQ ID NO: 1154270 - DNA, 23 bp, Homo sapiens
tctgctgcagttaccacagcaac

SEQ ID NO: 1154271 - DNA, 13 bp, Homo sapiens
tctgctgccccct

SEQ ID NO: 1154272 - DNA, 17 bp, Homo sapiens
tctgctgcccccttccc

SEQ ID NO: 1154273 - DNA, 15 bp, Homo sapiens
tctgctgccctccat

SEQ ID NO: 1154274 - DNA, 18 bp, Homo sapiens
tctgctgccctccatccc

SEQ ID NO: 1154275 - DNA, 13 bp, Homo sapiens
tctgctgccctct

SEQ ID NO: 1154276 - DNA, 21 bp, Homo sapiens
tctgctgccgcaggagcacct

SEQ ID NO: 1154277 - DNA, 13 bp, Homo sapiens
tctgctgcctctg

SEQ ID NO: 1154278 - DNA, 15 bp, Homo sapiens
tctgctgcctctgtg

SEQ ID NO: 1154279 - DNA, 17 bp, Homo sapiens
tctgctgcctctgtgga

SEQ ID NO: 1154280 - DNA, 18 bp, Homo sapiens
tctgctgcctctgtggaa

SEQ ID NO: 1154281 - DNA, 20 bp, Homo sapiens
tctgctggaaggggcagcag

SEQ ID NO: 1154282 - DNA, 12 bp, Homo sapiens
tctgctggagga

SEQ ID NO: 1154283 - DNA, 20 bp, Homo sapiens
tctgctggaggaggggaagc

SEQ ID NO: 1154284 - DNA, 19 bp, Homo sapiens
tctgctggagtttcatgta

SEQ ID NO: 1154285 - DNA, 17 bp, Homo sapiens
tctgctggcctggatct

SEQ ID NO: 1154286 - DNA, 18 bp, Homo sapiens
tctgctggcctggatctc

SEQ ID NO: 1154287 - DNA, 23 bp, Homo sapiens
tctgctgggaacctagcacacct

SEQ ID NO: 1154288 - DNA, 21 bp, Homo sapiens
tctgctgggatgtgtgctttc

SEQ ID NO: 1154289 - DNA, 17 bp, Homo sapiens
tctgctgggctctgcct

SEQ ID NO: 1154290 - DNA, 17 bp, Homo sapiens
tctgctggtatttctaa

SEQ ID NO: 1154291 - DNA, 16 bp, Homo sapiens
tctgctggttttaaca

SEQ ID NO: 1154292 - DNA, 12 bp, Homo sapiens
tctgctgtagaa

SEQ ID NO: 1154293 - DNA, 16 bp, Homo sapiens
tctgctgtccttgcct

SEQ ID NO: 1154294 - DNA, 22 bp, Homo sapiens
tctgctgtctcatcacataaaa

SEQ ID NO: 1154295 - DNA, 15 bp, Homo sapiens
tctgctgtggtctat

SEQ ID NO: 1154296 - DNA, 13 bp, Homo sapiens
tctgctgttaact

SEQ ID NO: 1154297 - DNA, 19 bp, Homo sapiens
tctgctgttgccatagccc

SEQ ID NO: 1154298 - DNA, 22 bp, Homo sapiens
tctgctgtttgttccaggctca

SEQ ID NO: 1154299 - DNA, 17 bp, Homo sapiens
tctgcttaaagcttccc

SEQ ID NO: 1154300 - DNA, 19 bp, Homo sapiens
tctgcttacaattccctgc

SEQ ID NO: 1154301 - DNA, 14 bp, Homo sapiens
tctgcttcagtgga

SEQ ID NO: 1154302 - DNA, 16 bp, Homo sapiens
tctgcttctctgactt

SEQ ID NO: 1154303 - DNA, 19 bp, Homo sapiens
tctgcttctgtccaggaca

SEQ ID NO: 1154304 - DNA, 13 bp, Homo sapiens
tctgcttgacaga

SEQ ID NO: 1154305 - DNA, 22 bp, Homo sapiens
tctgcttgcctagccccaggtc

SEQ ID NO: 1154306 - DNA, 19 bp, Homo sapiens
tctgcttgttattagagat

SEQ ID NO: 1154307 - DNA, 17 bp, Homo sapiens
tctgctttatcttttca

SEQ ID NO: 1154308 - DNA, 18 bp, Homo sapiens
tctgctttatcttttcat

SEQ ID NO: 1154309 - DNA, 15 bp, Homo sapiens
tctgctttccttttc

SEQ ID NO: 1154310 - DNA, 13 bp, Homo sapiens
tctgcttttatta

SEQ ID NO: 1154311 - DNA, 23 bp, Homo sapiens
tctgctttttaaagaatgctctt

SEQ ID NO: 1154312 - DNA, 18 bp, Homo sapiens
tctggaaaaaaaatatat

SEQ ID NO: 1154313 - DNA, 15 bp, Homo sapiens
tctggaaaactattg

SEQ ID NO: 1154314 - DNA, 23 bp, Homo sapiens
tctggaaaactattgagccttgc

SEQ ID NO: 1154315 - DNA, 13 bp, Homo sapiens
tctggaaaagagg

SEQ ID NO: 1154316 - DNA, 18 bp, Homo sapiens
tctggaaaatgtgaccca

SEQ ID NO: 1154317 - DNA, 12 bp, Homo sapiens
tctggaaagaaa

SEQ ID NO: 1154318 - DNA, 15 bp, Homo sapiens
tctggaaagaggctc

SEQ ID NO: 1154319 - DNA, 14 bp, Homo sapiens
tctggaaagcaaag

SEQ ID NO: 1154320 - DNA, 16 bp, Homo sapiens
tctggaaaggaaacat

SEQ ID NO: 1154321 - DNA, 13 bp, Homo sapiens
tctggaaatctgt

SEQ ID NO: 1154322 - DNA, 10 bp, Homo sapiens
tctggaaatt

SEQ ID NO: 1154323 - DNA, 17 bp, Homo sapiens
tctggaaattttgtcca

SEQ ID NO: 1154324 - DNA, 22 bp, Homo sapiens
tctggaacaacttgtagcagct

SEQ ID NO: 1154325 - DNA, 19 bp, Homo sapiens
tctggaaccccccaggccc

SEQ ID NO: 1154326 - DNA, 14 bp, Homo sapiens
tctggaacctgact

SEQ ID NO: 1154327 - DNA, 14 bp, Homo sapiens
tctggaagaaaaaa

SEQ ID NO: 1154328 - DNA, 13 bp, Homo sapiens
tctggaagactgc

SEQ ID NO: 1154329 - DNA, 13 bp, Homo sapiens
tctggaagagagg

SEQ ID NO: 1154330 - DNA, 20 bp, Homo sapiens
tctggaagaggccttcccat

SEQ ID NO: 1154331 - DNA, 20 bp, Homo sapiens
tctggaagctgattaaaaca

SEQ ID NO: 1154332 - DNA, 14 bp, Homo sapiens
tctggaaggggcag

SEQ ID NO: 1154333 - DNA, 16 bp, Homo sapiens
tctggaaggggcagcc

SEQ ID NO: 1154334 - DNA, 20 bp, Homo sapiens
tctggaaggggcagccctga

SEQ ID NO: 1154335 - DNA, 21 bp, Homo sapiens
tctggaaggggcagccctgag

SEQ ID NO: 1154336 - DNA, 23 bp, Homo sapiens
tctggaagtggagttgactctgg

SEQ ID NO: 1154337 - DNA, 18 bp, Homo sapiens
tctggaataaagttgcag

SEQ ID NO: 1154338 - DNA, 14 bp, Homo sapiens
tctggaatacatga

SEQ ID NO: 1154339 - DNA, 20 bp, Homo sapiens
tctggaatatgcaacattgt

SEQ ID NO: 1154340 - DNA, 15 bp, Homo sapiens
tctggaatattgtga

SEQ ID NO: 1154341 - DNA, 19 bp, Homo sapiens
tctggaatattgtgattct

SEQ ID NO: 1154342 - DNA, 18 bp, Homo sapiens
tctggaatgcttgctgta

SEQ ID NO: 1154343 - DNA, 23 bp, Homo sapiens
tctggaatggtacatgtcttcca

SEQ ID NO: 1154344 - DNA, 15 bp, Homo sapiens
tctggaatgtaatca

SEQ ID NO: 1154345 - DNA, 21 bp, Homo sapiens
tctggaatgtttttccctccc

SEQ ID NO: 1154346 - DNA, 15 bp, Homo sapiens
tctggaattgtggct

SEQ ID NO: 1154347 - DNA, 14 bp, Homo sapiens
tctggacacactgt

SEQ ID NO: 1154348 - DNA, 20 bp, Homo sapiens
tctggacagcagaagcctcc

SEQ ID NO: 1154349 - DNA, 15 bp, Homo sapiens
tctggacagtacctg

SEQ ID NO: 1154350 - DNA, 14 bp, Homo sapiens
tctggaccccatct

SEQ ID NO: 1154351 - DNA, 17 bp, Homo sapiens
tctggacctcaggaggg

SEQ ID NO: 1154352 - DNA, 20 bp, Homo sapiens
tctggacctcaggagggcag

SEQ ID NO: 1154353 - DNA, 22 bp, Homo sapiens
tctggacctcaggagggcaggc

SEQ ID NO: 1154354 - DNA, 20 bp, Homo sapiens
tctggacctccatccctgct

SEQ ID NO: 1154355 - DNA, 22 bp, Homo sapiens
tctggacggcaggctcactgcc

SEQ ID NO: 1154356 - DNA, 16 bp, Homo sapiens
tctggactcctctgtc

SEQ ID NO: 1154357 - DNA, 18 bp, Homo sapiens
tctggactcctctgtcca

SEQ ID NO: 1154358 - DNA, 15 bp, Homo sapiens
tctggactctgcccc

SEQ ID NO: 1154359 - DNA, 13 bp, Homo sapiens
tctggactgaagc

SEQ ID NO: 1154360 - DNA, 22 bp, Homo sapiens
tctggactttctctaataataa

SEQ ID NO: 1154361 - DNA, 13 bp, Homo sapiens
tctggagaaaaag

SEQ ID NO: 1154362 - DNA, 11 bp, Homo sapiens
tctggagaagc

SEQ ID NO: 1154363 - DNA, 23 bp, Homo sapiens
tctggagaagctcccaggaacaa

SEQ ID NO: 1154364 - DNA, 20 bp, Homo sapiens
tctggagaggttataggtca

SEQ ID NO: 1154365 - DNA, 22 bp, Homo sapiens
tctggagcaggtggcttgttaa

SEQ ID NO: 1154366 - DNA, 13 bp, Homo sapiens
tctggagcccttg

SEQ ID NO: 1154367 - DNA, 20 bp, Homo sapiens
tctggagctgggagacaaag

SEQ ID NO: 1154368 - DNA, 20 bp, Homo sapiens
tctggaggtactgagacagg

SEQ ID NO: 1154369 - DNA, 17 bp, Homo sapiens
tctggaggtgctgctct

SEQ ID NO: 1154370 - DNA, 15 bp, Homo sapiens
tctggagtcccaccc

SEQ ID NO: 1154371 - DNA, 18 bp, Homo sapiens
tctggagttcccacccaa

SEQ ID NO: 1154372 - DNA, 22 bp, Homo sapiens
tctggataaaccaccctctggg

SEQ ID NO: 1154373 - DNA, 23 bp, Homo sapiens
tctggataaaccaccctctgggg

SEQ ID NO: 1154374 - DNA, 13 bp, Homo sapiens
tctggatctcctg

SEQ ID NO: 1154375 - DNA, 15 bp, Homo sapiens
tctggatctcctgct

SEQ ID NO: 1154376 - DNA, 21 bp, Homo sapiens
tctggatctgaccctcccagt

SEQ ID NO: 1154377 - DNA, 18 bp, Homo sapiens
tctggatggcaccagagg

SEQ ID NO: 1154378 - DNA, 14 bp, Homo sapiens
tctggatgggagga

SEQ ID NO: 1154379 - DNA, 22 bp, Homo sapiens
tctggatgggaggagagccact

SEQ ID NO: 1154380 - DNA, 13 bp, Homo sapiens
tctggattcagcc

SEQ ID NO: 1154381 - DNA, 14 bp, Homo sapiens
tctggattcagcct

SEQ ID NO: 1154382 - DNA, 16 bp, Homo sapiens
tctggattctgaatct

SEQ ID NO: 1154383 - DNA, 19 bp, Homo sapiens
tctggcaaacttttctttc

SEQ ID NO: 1154384 - DNA, 20 bp, Homo sapiens
tctggcaaacttttctttct

SEQ ID NO: 1154385 - DNA, 14 bp, Homo sapiens
tctggcaaatgatg

SEQ ID NO: 1154386 - DNA, 14 bp, Homo sapiens
tctggcaagagcag

SEQ ID NO: 1154387 - DNA, 15 bp, Homo sapiens
tctggcaagagcaga

SEQ ID NO: 1154388 - DNA, 12 bp, Homo sapiens
tctggcaaggac

SEQ ID NO: 1154389 - DNA, 15 bp, Homo sapiens
tctggcaatattctg

SEQ ID NO: 1154390 - DNA, 19 bp, Homo sapiens
tctggcacagtgatgccgg

SEQ ID NO: 1154391 - DNA, 15 bp, Homo sapiens
tctggcagagcctct

SEQ ID NO: 1154392 - DNA, 12 bp, Homo sapiens
tctggcaggacc

SEQ ID NO: 1154393 - DNA, 13 bp, Homo sapiens
tctggcaggacct

SEQ ID NO: 1154394 - DNA, 17 bp, Homo sapiens
tctggcaggacctgcct

SEQ ID NO: 1154395 - DNA, 21 bp, Homo sapiens
tctggcaggacctgcctagca

SEQ ID NO: 1154396 - DNA, 18 bp, Homo sapiens
tctggcagttctggaatg

SEQ ID NO: 1154397 - DNA, 19 bp, Homo sapiens
tctggcattctacacctgg

SEQ ID NO: 1154398 - DNA, 21 bp, Homo sapiens
tctggccaaatatgcactttc

SEQ ID NO: 1154399 - DNA, 10 bp, Homo sapiens
tctggccacc

SEQ ID NO: 1154400 - DNA, 21 bp, Homo sapiens
tctggccaccccagagtggga

SEQ ID NO: 1154401 - DNA, 14 bp, Homo sapiens
tctggccaggcact

SEQ ID NO: 1154402 - DNA, 14 bp, Homo sapiens
tctggcccaccagg

SEQ ID NO: 1154403 - DNA, 13 bp, Homo sapiens
tctggcccagaaa

SEQ ID NO: 1154404 - DNA, 22 bp, Homo sapiens
tctggccctgacttctggagat

SEQ ID NO: 1154405 - DNA, 15 bp, Homo sapiens
tctggccctgccttc

SEQ ID NO: 1154406 - DNA, 12 bp, Homo sapiens
tctggcccttgg

SEQ ID NO: 1154407 - DNA, 17 bp, Homo sapiens
tctggcccttggaataa

SEQ ID NO: 1154408 - DNA, 21 bp, Homo sapiens
tctggccgtccttgtctctgg

SEQ ID NO: 1154409 - DNA, 16 bp, Homo sapiens
tctggcctcacgtgtc

SEQ ID NO: 1154410 - DNA, 11 bp, Homo sapiens
tctggcctcca

SEQ ID NO: 1154411 - DNA, 15 bp, Homo sapiens
tctggcctcccaccc

SEQ ID NO: 1154412 - DNA, 14 bp, Homo sapiens
tctggcctcctaag

SEQ ID NO: 1154413 - DNA, 15 bp, Homo sapiens
tctggcctctgcttt

SEQ ID NO: 1154414 - DNA, 11 bp, Homo sapiens
tctggcctgtt

SEQ ID NO: 1154415 - DNA, 22 bp, Homo sapiens
tctggcgacagttttccttctc

SEQ ID NO: 1154416 - DNA, 19 bp, Homo sapiens
tctggcggcttcctgtcca

SEQ ID NO: 1154417 - DNA, 17 bp, Homo sapiens
tctggctagaggccagc

SEQ ID NO: 1154418 - DNA, 22 bp, Homo sapiens
tctggctatgcatttgaaaatt

SEQ ID NO: 1154419 - DNA, 14 bp, Homo sapiens
tctggctcacagga

SEQ ID NO: 1154420 - DNA, 19 bp, Homo sapiens
tctggctcagcctgtctcg

SEQ ID NO: 1154421 - DNA, 13 bp, Homo sapiens
tctggctccctgc

SEQ ID NO: 1154422 - DNA, 15 bp, Homo sapiens
tctggctccctgccc

SEQ ID NO: 1154423 - DNA, 18 bp, Homo sapiens
tctggctccctgcccctt

SEQ ID NO: 1154424 - DNA, 21 bp, Homo sapiens
tctggctcggacccaccccaa

SEQ ID NO: 1154425 - DNA, 18 bp, Homo sapiens
tctggctgaacactggca

SEQ ID NO: 1154426 - DNA, 14 bp, Homo sapiens
tctggctgaaccct

SEQ ID NO: 1154427 - DNA, 17 bp, Homo sapiens
tctggggcaggctgggc

SEQ ID NO: 1154428 - DNA, 13 bp, Homo sapiens
tctggggccctgg

SEQ ID NO: 1154429 - DNA, 14 bp, Homo sapiens
tctggggccctggg

SEQ ID NO: 1154430 - DNA, 18 bp, Homo sapiens
tctggggccctgggcctc

SEQ ID NO: 1154431 - DNA, 19 bp, Homo sapiens
tctggggccctgggcctca

SEQ ID NO: 1154432 - DNA, 13 bp, Homo sapiens
tctggggctgtgt

SEQ ID NO: 1154433 - DNA, 15 bp, Homo sapiens
tctggggctgtgtta

SEQ ID NO: 1154434 - DNA, 16 bp, Homo sapiens
tctggggcttgtcctg

SEQ ID NO: 1154435 - DNA, 13 bp, Homo sapiens
tctgggggcagct

SEQ ID NO: 1154436 - DNA, 19 bp, Homo sapiens
tctggggggatatttccta

SEQ ID NO: 1154437 - DNA, 22 bp, Homo sapiens
tctggggggtggggaggaggaa

SEQ ID NO: 1154438 - DNA, 20 bp, Homo sapiens
tctgggggtaggatgaagag

SEQ ID NO: 1154439 - DNA, 18 bp, Homo sapiens
tctggggtatgtgtgtgt

SEQ ID NO: 1154440 - DNA, 23 bp, Homo sapiens
tctggggtcaggtgccactgacc

SEQ ID NO: 1154441 - DNA, 18 bp, Homo sapiens
tctggggttcagcccctc

SEQ ID NO: 1154442 - DNA, 23 bp, Homo sapiens
tctggggttcagcccctcctctg

SEQ ID NO: 1154443 - DNA, 17 bp, Homo sapiens
tctgggtccaggcctgg

SEQ ID NO: 1154444 - DNA, 13 bp, Homo sapiens
tctgggtccctgc

SEQ ID NO: 1154445 - DNA, 17 bp, Homo sapiens
tctgggtccctgctccc

SEQ ID NO: 1154446 - DNA, 19 bp, Homo sapiens
tctgggtccctgctcccct

SEQ ID NO: 1154447 - DNA, 20 bp, Homo sapiens
tctgggtccctgctcccctt

SEQ ID NO: 1154448 - DNA, 13 bp, Homo sapiens
tctgggtcttttg

SEQ ID NO: 1154449 - DNA, 13 bp, Homo sapiens
tctgggtggcctc

SEQ ID NO: 1154450 - DNA, 16 bp, Homo sapiens
tctgggttaatttctt

SEQ ID NO: 1154451 - DNA, 17 bp, Homo sapiens
tctgggttccagcagag

SEQ ID NO: 1154452 - DNA, 19 bp, Homo sapiens
tctgggtttggcccaagac

SEQ ID NO: 1154453 - DNA, 18 bp, Homo sapiens
tctggtagatagaaataa

SEQ ID NO: 1154454 - DNA, 20 bp, Homo sapiens
tctggtagatttttaacgaa

SEQ ID NO: 1154455 - DNA, 21 bp, Homo sapiens
tctggtatacattgaattcat

SEQ ID NO: 1154456 - DNA, 15 bp, Homo sapiens
tctggtatatgtcat

SEQ ID NO: 1154457 - DNA, 16 bp, Homo sapiens
tctggtatatgtcatt

SEQ ID NO: 1154458 - DNA, 22 bp, Homo sapiens
tctggtatcttgttagagagct

SEQ ID NO: 1154459 - DNA, 17 bp, Homo sapiens
tctggtcaacctcctgg

SEQ ID NO: 1154460 - DNA, 22 bp, Homo sapiens
tctggtcaagttgagattttta

SEQ ID NO: 1154461 - DNA, 22 bp, Homo sapiens
tctggtcccacaaatgggcgcc

SEQ ID NO: 1154462 - DNA, 15 bp, Homo sapiens
tctggtccctcttct

SEQ ID NO: 1154463 - DNA, 21 bp, Homo sapiens
tctggtccctcttctctcctc

SEQ ID NO: 1154464 - DNA, 22 bp, Homo sapiens
tctggtccctcttctctcctca

SEQ ID NO: 1154465 - DNA, 13 bp, Homo sapiens
tctggtccttttt

SEQ ID NO: 1154466 - DNA, 16 bp, Homo sapiens
tctggtcttccaggca

SEQ ID NO: 1154467 - DNA, 21 bp, Homo sapiens
tctggtcttgtttccaggagc

SEQ ID NO: 1154468 - DNA, 15 bp, Homo sapiens
tctggtgacaaatat

SEQ ID NO: 1154469 - DNA, 17 bp, Homo sapiens
tctggtgaccagacttt

SEQ ID NO: 1154470 - DNA, 20 bp, Homo sapiens
tctggtgcacgcctgagcgt

SEQ ID NO: 1154471 - DNA, 12 bp, Homo sapiens
tctggtgcctcc

SEQ ID NO: 1154472 - DNA, 14 bp, Homo sapiens
tctggtgcctcctc

SEQ ID NO: 1154473 - DNA, 20 bp, Homo sapiens
tctggtggaggagctgaggg

SEQ ID NO: 1154474 - DNA, 12 bp, Homo sapiens
tctggtggcccc

SEQ ID NO: 1154475 - DNA, 14 bp, Homo sapiens
tctggtggccccgt

SEQ ID NO: 1154476 - DNA, 23 bp, Homo sapiens
tctggtggggtgtgttccaactg

SEQ ID NO: 1154477 - DNA, 21 bp, Homo sapiens
aaaattttataaaattaagca

SEQ ID NO: 1154478 - DNA, 13 bp, Homo sapiens
aaaattttattcc

SEQ ID NO: 1154479 - DNA, 20 bp, Homo sapiens
aaaattttgatgttttaagg

SEQ ID NO: 1154480 - DNA, 18 bp, Homo sapiens
aaaattttggaatatttg

SEQ ID NO: 1154481 - DNA, 21 bp, Homo sapiens
aaaattttggaatatttgctt

SEQ ID NO: 1154482 - DNA, 17 bp, Homo sapiens
aaaatttttacattcat

SEQ ID NO: 1154483 - DNA, 23 bp, Homo sapiens
tcccagctaggaagagcaggact

SEQ ID NO: 1154484 - DNA, 18 bp, Homo sapiens
tcccagctccccccgccc

SEQ ID NO: 1154485 - DNA, 11 bp, Homo sapiens
tcccagctgct

SEQ ID NO: 1154486 - DNA, 12 bp, Homo sapiens
tcccagctgctt

SEQ ID NO: 1154487 - DNA, 16 bp, Homo sapiens
tcccagctgtgctgtg

SEQ ID NO: 1154488 - DNA, 13 bp, Homo sapiens
tcccagcttgccc

SEQ ID NO: 1154489 - DNA, 18 bp, Homo sapiens
tcccagcttgctgagggg

SEQ ID NO: 1154490 - DNA, 20 bp, Homo sapiens
tcccaggaaagaagcatttc

SEQ ID NO: 1154491 - DNA, 23 bp, Homo sapiens
tcccaggaacaatcgatggcctt

SEQ ID NO: 1154492 - DNA, 11 bp, Homo sapiens
tcccaggaact

SEQ ID NO: 1154493 - DNA, 16 bp, Homo sapiens
tcccaggaactgggcc

SEQ ID NO: 1154494 - DNA, 17 bp, Homo sapiens
tcccaggaccctccact

SEQ ID NO: 1154495 - DNA, 17 bp, Homo sapiens
tcccaggagctgcccag

SEQ ID NO: 1154496 - DNA, 18 bp, Homo sapiens
tcccaggagctgcccaga

SEQ ID NO: 1154497 - DNA, 23 bp, Homo sapiens
tcccaggcatgcagctgcctggg

SEQ ID NO: 1154498 - DNA, 20 bp, Homo sapiens
tcccaggcccactgtgcctc

SEQ ID NO: 1154499 - DNA, 18 bp, Homo sapiens
tcccaggccccctgcatc

SEQ ID NO: 1154500 - DNA, 20 bp, Homo sapiens
tcccaggccccctgcatcta

SEQ ID NO: 1154501 - DNA, 18 bp, Homo sapiens
tcccaggccggcccagat

SEQ ID NO: 1154502 - DNA, 19 bp, Homo sapiens
tcccaggccggcccagatg

SEQ ID NO: 1154503 - DNA, 17 bp, Homo sapiens
tcccaggcctgcctgca

SEQ ID NO: 1154504 - DNA, 12 bp, Homo sapiens
tcccaggccttt

SEQ ID NO: 1154505 - DNA, 21 bp, Homo sapiens
tcccaggcgccccttccccct

SEQ ID NO: 1154506 - DNA, 16 bp, Homo sapiens
tcccaggctgagcctc

SEQ ID NO: 1154507 - DNA, 19 bp, Homo sapiens
tcccaggctgagcctcagt

SEQ ID NO: 1154508 - DNA, 23 bp, Homo sapiens
tcccaggctgctggagtgcagtg

SEQ ID NO: 1154509 - DNA, 22 bp, Homo sapiens
tctgactccagagtctgagccc

SEQ ID NO: 1154510 - DNA, 20 bp, Homo sapiens
tctgactccctccccaccca

SEQ ID NO: 1154511 - DNA, 16 bp, Homo sapiens
tctgactcggtttctc

SEQ ID NO: 1154512 - DNA, 21 bp, Homo sapiens
tctgactgagagcccactgca

SEQ ID NO: 1154513 - DNA, 12 bp, Homo sapiens
tctgactgccaa

SEQ ID NO: 1154514 - DNA, 20 bp, Homo sapiens
tctgactgccaaataaatca

SEQ ID NO: 1154515 - DNA, 15 bp, Homo sapiens
tctgacttcctctga

SEQ ID NO: 1154516 - DNA, 15 bp, Homo sapiens
tctgactttacttgt

SEQ ID NO: 1154517 - DNA, 21 bp, Homo sapiens
tctgagaaacctgttgaagat

SEQ ID NO: 1154518 - DNA, 20 bp, Homo sapiens
tctgagaaataggtatcaaa

SEQ ID NO: 1154519 - DNA, 15 bp, Homo sapiens
tctgagaactgactt

SEQ ID NO: 1154520 - DNA, 18 bp, Homo sapiens
tctgagaaggtccttaat

SEQ ID NO: 1154521 - DNA, 16 bp, Homo sapiens
tctgagaagtacttta

SEQ ID NO: 1154522 - DNA, 15 bp, Homo sapiens
tctgagaatctttat

SEQ ID NO: 1154523 - DNA, 15 bp, Homo sapiens
tctgagacacacccc

SEQ ID NO: 1154524 - DNA, 18 bp, Homo sapiens
tctgagacccttttctca

SEQ ID NO: 1154525 - DNA, 19 bp, Homo sapiens
tctgagacccttttctcag

SEQ ID NO: 1154526 - DNA, 22 bp, Homo sapiens
tctgagacccttttctcaggac

SEQ ID NO: 1154527 - DNA, 13 bp, Homo sapiens
tctgagactcaca

SEQ ID NO: 1154528 - DNA, 21 bp, Homo sapiens
tctgagagtgaaaccatgact

SEQ ID NO: 1154529 - DNA, 20 bp, Homo sapiens
tctgagagttggctcaggca

SEQ ID NO: 1154530 - DNA, 22 bp, Homo sapiens
tctgagagttggctcaggcaga

SEQ ID NO: 1154531 - DNA, 19 bp, Homo sapiens
tctgagatgctcactttat

SEQ ID NO: 1154532 - DNA, 18 bp, Homo sapiens
tctgagattcaatattga

SEQ ID NO: 1154533 - DNA, 19 bp, Homo sapiens
tctgagatttttttgtgta

SEQ ID NO: 1154534 - DNA, 22 bp, Homo sapiens
tctgagatttttttgtgtatgt

SEQ ID NO: 1154535 - DNA, 15 bp, Homo sapiens
tctgagcacacttta

SEQ ID NO: 1154536 - DNA, 23 bp, Homo sapiens
tctgagcacatagtgtcctgccc

SEQ ID NO: 1154537 - DNA, 14 bp, Homo sapiens
tctgagcaccccct

SEQ ID NO: 1154538 - DNA, 19 bp, Homo sapiens
tctgagcaccccctcattc

SEQ ID NO: 1154539 - DNA, 21 bp, Homo sapiens
tctgagcaccccctcattccc

SEQ ID NO: 1154540 - DNA, 22 bp, Homo sapiens
tctgagcaccccctcattcccc

SEQ ID NO: 1154541 - DNA, 22 bp, Homo sapiens
tctgagcaccgaatattgagca

SEQ ID NO: 1154542 - DNA, 22 bp, Homo sapiens
tctgagcactgtttatacactg

SEQ ID NO: 1154543 - DNA, 14 bp, Homo sapiens
tctgagcaggggca

SEQ ID NO: 1154544 - DNA, 22 bp, Homo sapiens
tctgagcagtcagggtgggaag

SEQ ID NO: 1154545 - DNA, 23 bp, Homo sapiens
tctgagcattcgctgtacccttt

SEQ ID NO: 1154546 - DNA, 23 bp, Homo sapiens
tctgagccaagggagggaagggc

SEQ ID NO: 1154547 - DNA, 17 bp, Homo sapiens
tctgagccacagtggga

SEQ ID NO: 1154548 - DNA, 12 bp, Homo sapiens
tctgagcccagg

SEQ ID NO: 1154549 - DNA, 13 bp, Homo sapiens
tctgagcccaggc

SEQ ID NO: 1154550 - DNA, 18 bp, Homo sapiens
tctgagcccccggctagt

SEQ ID NO: 1154551 - DNA, 16 bp, Homo sapiens
tctgagcccgggctgc

SEQ ID NO: 1154552 - DNA, 15 bp, Homo sapiens
tctgagccctggtgt

SEQ ID NO: 1154553 - DNA, 17 bp, Homo sapiens
tctgagcgggaggcaga

SEQ ID NO: 1154554 - DNA, 22 bp, Homo sapiens
tctgagcgggaggcagagtttg

SEQ ID NO: 1154555 - DNA, 17 bp, Homo sapiens
tctgagctatttcatct

SEQ ID NO: 1154556 - DNA, 15 bp, Homo sapiens
tctgagcttcagtat

SEQ ID NO: 1154557 - DNA, 18 bp, Homo sapiens
tctgagcttttcatggaa

SEQ ID NO: 1154558 - DNA, 17 bp, Homo sapiens
tctgaggaagcagttgg

SEQ ID NO: 1154559 - DNA, 15 bp, Homo sapiens
tctgaggaagtctta

SEQ ID NO: 1154560 - DNA, 14 bp, Homo sapiens
tctgaggacaagag

SEQ ID NO: 1154561 - DNA, 21 bp, Homo sapiens
tctgaggacaggctctagaga

SEQ ID NO: 1154562 - DNA, 20 bp, Homo sapiens
tctgaggactgtcctcccac

SEQ ID NO: 1154563 - DNA, 23 bp, Homo sapiens
tctgaggatagtagttaaataac

SEQ ID NO: 1154564 - DNA, 14 bp, Homo sapiens
tctgaggccctgcc

SEQ ID NO: 1154565 - DNA, 12 bp, Homo sapiens
tctgaggcctca

SEQ ID NO: 1154566 - DNA, 13 bp, Homo sapiens
tctgaggcctgcc

SEQ ID NO: 1154567 - DNA, 19 bp, Homo sapiens
tctgaggctctttctgggc

SEQ ID NO: 1154568 - DNA, 21 bp, Homo sapiens
tctgaggctctttctgggcca

SEQ ID NO: 1154569 - DNA, 22 bp, Homo sapiens
tctgaggctggatcctagcctt

SEQ ID NO: 1154570 - DNA, 14 bp, Homo sapiens
tctgaggcttccag

SEQ ID NO: 1154571 - DNA, 19 bp, Homo sapiens
tctgaggcttccagagagt

SEQ ID NO: 1154572 - DNA, 22 bp, Homo sapiens
tctgagggaggaggccacctct

SEQ ID NO: 1154573 - DNA, 20 bp, Homo sapiens
tctgaggggaggcacctcca

SEQ ID NO: 1154574 - DNA, 19 bp, Homo sapiens
tctgaggggctaccaggaa

SEQ ID NO: 1154575 - DNA, 23 bp, Homo sapiens
tctgaggggtgtccgagaggctg

SEQ ID NO: 1154576 - DNA, 12 bp, Homo sapiens
tctgaggtcaat

SEQ ID NO: 1154577 - DNA, 18 bp, Homo sapiens
tctgaggtcaataaagca

SEQ ID NO: 1154578 - DNA, 20 bp, Homo sapiens
tctgagtaactggttgctgt

SEQ ID NO: 1154579 - DNA, 12 bp, Homo sapiens
tctgagtaatta

SEQ ID NO: 1154580 - DNA, 20 bp, Homo sapiens
tctgagtaggtctgggatgg

SEQ ID NO: 1154581 - DNA, 15 bp, Homo sapiens
tctgagtccagctcc

SEQ ID NO: 1154582 - DNA, 23 bp, Homo sapiens
tctgagtcccaggagctgcccag

SEQ ID NO: 1154583 - DNA, 12 bp, Homo sapiens
tctgagtcctgt

SEQ ID NO: 1154584 - DNA, 14 bp, Homo sapiens
tctgagtcctgtct

SEQ ID NO: 1154585 - DNA, 12 bp, Homo sapiens
tctgagtctatg

SEQ ID NO: 1154586 - DNA, 13 bp, Homo sapiens
tctgagtctgagt

SEQ ID NO: 1154587 - DNA, 13 bp, Homo sapiens
tctgagtgagttt

SEQ ID NO: 1154588 - DNA, 18 bp, Homo sapiens
tctgagtgagttttactc

SEQ ID NO: 1154589 - DNA, 19 bp, Homo sapiens
tctgagttctgtgtatttt

SEQ ID NO: 1154590 - DNA, 19 bp, Homo sapiens
tctgagttgccaagacaaa

SEQ ID NO: 1154591 - DNA, 14 bp, Homo sapiens
tccttaaactgtgt

SEQ ID NO: 1154592 - DNA, 17 bp, Homo sapiens
tccttaaactgtgtgga

SEQ ID NO: 1154593 - DNA, 22 bp, Homo sapiens
tccttaaaggcaccatctaata

SEQ ID NO: 1154594 - DNA, 23 bp, Homo sapiens
tccttaaaggcaccatctaatag

SEQ ID NO: 1154595 - DNA, 20 bp, Homo sapiens
tccttaaatgacttttctta

SEQ ID NO: 1154596 - DNA, 17 bp, Homo sapiens
tccttaatccagctgat

SEQ ID NO: 1154597 - DNA, 19 bp, Homo sapiens
tccttaatgaaaaatacat

SEQ ID NO: 1154598 - DNA, 14 bp, Homo sapiens
tccttaatgatccg

SEQ ID NO: 1154599 - DNA, 17 bp, Homo sapiens
tccttaattcactccca

SEQ ID NO: 1154600 - DNA, 14 bp, Homo sapiens
tccttacaatgtaa

SEQ ID NO: 1154601 - DNA, 15 bp, Homo sapiens
tccttactctgagcc

SEQ ID NO: 1154602 - DNA, 20 bp, Homo sapiens
tccttactctgagcccaggc

SEQ ID NO: 1154603 - DNA, 22 bp, Homo sapiens
tccttactctgagcccaggccg

SEQ ID NO: 1154604 - DNA, 22 bp, Homo sapiens
tccttagacactttggaatcta

SEQ ID NO: 1154605 - DNA, 18 bp, Homo sapiens
tccttagactcttttcct

SEQ ID NO: 1154606 - DNA, 19 bp, Homo sapiens
tccttagagacatcaaaat

SEQ ID NO: 1154607 - DNA, 20 bp, Homo sapiens
tccttagaggtcctctggag

SEQ ID NO: 1154608 - DNA, 22 bp, Homo sapiens
tccttagctatttatccctttc

SEQ ID NO: 1154609 - DNA, 19 bp, Homo sapiens
tccttaggaaaatgcttct

SEQ ID NO: 1154610 - DNA, 22 bp, Homo sapiens
tccttaggaaaatgcttctgtt

SEQ ID NO: 1154611 - DNA, 17 bp, Homo sapiens
tccttaggcctctgaga

SEQ ID NO: 1154612 - DNA, 14 bp, Homo sapiens
tccttaggttttct

SEQ ID NO: 1154613 - DNA, 15 bp, Homo sapiens
tccttagtgccagga

SEQ ID NO: 1154614 - DNA, 22 bp, Homo sapiens
tccttagtgccaggagggcaca

SEQ ID NO: 1154615 - DNA, 18 bp, Homo sapiens
tccttatagacacttgct

SEQ ID NO: 1154616 - DNA, 22 bp, Homo sapiens
tccttatcagagctaagggtgg

SEQ ID NO: 1154617 - DNA, 23 bp, Homo sapiens
tccttatcctacagtacaatcag

SEQ ID NO: 1154618 - DNA, 22 bp, Homo sapiens
tccttatgggatcatttttcca

SEQ ID NO: 1154619 - DNA, 18 bp, Homo sapiens
tccttattatcccagctt

SEQ ID NO: 1154620 - DNA, 13 bp, Homo sapiens
tccttattcttct

SEQ ID NO: 1154621 - DNA, 19 bp, Homo sapiens
tccttattgggacttttct

SEQ ID NO: 1154622 - DNA, 19 bp, Homo sapiens
tccttatttctctctcctg

SEQ ID NO: 1154623 - DNA, 23 bp, Homo sapiens
tccttatttctctctcctggtgt

SEQ ID NO: 1154624 - DNA, 13 bp, Homo sapiens
tccttcaaagtct

SEQ ID NO: 1154625 - DNA, 20 bp, Homo sapiens
tccttcaacaattctaaaat

SEQ ID NO: 1154626 - DNA, 21 bp, Homo sapiens
tccttcaagaactctgggctg

SEQ ID NO: 1154627 - DNA, 18 bp, Homo sapiens
tccttcaagttagctcag

SEQ ID NO: 1154628 - DNA, 20 bp, Homo sapiens
tccttcacatcctgtgtttc

SEQ ID NO: 1154629 - DNA, 19 bp, Homo sapiens
tccttcacctcactgaaaa

SEQ ID NO: 1154630 - DNA, 19 bp, Homo sapiens
tccttcactgaacatgcct

SEQ ID NO: 1154631 - DNA, 19 bp, Homo sapiens
tccttcactgttccctctg

SEQ ID NO: 1154632 - DNA, 21 bp, Homo sapiens
tccttcactgttccctctggc

SEQ ID NO: 1154633 - DNA, 12 bp, Homo sapiens
tccttcagacac

SEQ ID NO: 1154634 - DNA, 23 bp, Homo sapiens
tccttcagacaccctcaacctct

SEQ ID NO: 1154635 - DNA, 14 bp, Homo sapiens
tccttcaggactct

SEQ ID NO: 1154636 - DNA, 15 bp, Homo sapiens
tccttcaggactctg

SEQ ID NO: 1154637 - DNA, 20 bp, Homo sapiens
tccttcaggactctgcggga

SEQ ID NO: 1154638 - DNA, 14 bp, Homo sapiens
tccttcattcatag

SEQ ID NO: 1154639 - DNA, 24 bp, Homo sapiens
tccttcatttccaccaggccgtgc

SEQ ID NO: 1154640 - DNA, 21 bp, Homo sapiens
tccttccaaggtcactcttgg

SEQ ID NO: 1154641 - DNA, 22 bp, Homo sapiens
tccttccaaggtcactcttggt

SEQ ID NO: 1154642 - DNA, 23 bp, Homo sapiens
tccttccacagttatcttagctg

SEQ ID NO: 1154643 - DNA, 15 bp, Homo sapiens
tccttccaccaagtt

SEQ ID NO: 1154644 - DNA, 12 bp, Homo sapiens
tccttccacctc

SEQ ID NO: 1154645 - DNA, 13 bp, Homo sapiens
tccttccactgta

SEQ ID NO: 1154646 - DNA, 17 bp, Homo sapiens
tccttccactgtagcta

SEQ ID NO: 1154647 - DNA, 15 bp, Homo sapiens
tccttccactgtgca

SEQ ID NO: 1154648 - DNA, 17 bp, Homo sapiens
tccttccatatccctgc

SEQ ID NO: 1154649 - DNA, 19 bp, Homo sapiens
tccttcccagcaacactcc

SEQ ID NO: 1154650 - DNA, 16 bp, Homo sapiens
tccttcccagggacca

SEQ ID NO: 1154651 - DNA, 23 bp, Homo sapiens
tccttcccatgcctgtctctgtt

SEQ ID NO: 1154652 - DNA, 15 bp, Homo sapiens
tccttccccaacttc

SEQ ID NO: 1154653 - DNA, 20 bp, Homo sapiens
tccttccccaacttccctag

SEQ ID NO: 1154654 - DNA, 23 bp, Homo sapiens
tccttccccaacttccctagtcc

SEQ ID NO: 1154655 - DNA, 22 bp, Homo sapiens
tccttcccccatcccctttcct

SEQ ID NO: 1154656 - DNA, 23 bp, Homo sapiens
tccttcccccatcccctttcctc

SEQ ID NO: 1154657 - DNA, 17 bp, Homo sapiens
tccttccccccatctct

SEQ ID NO: 1154658 - DNA, 19 bp, Homo sapiens
tcggccctgaaccacgagg

SEQ ID NO: 1154659 - DNA, 22 bp, Homo sapiens
tcggccctgaaccacgaggctg

SEQ ID NO: 1154660 - DNA, 11 bp, Homo sapiens
tcggccctgcg

SEQ ID NO: 1154661 - DNA, 22 bp, Homo sapiens
tcggccctgcgtcggccctggg

SEQ ID NO: 1154662 - DNA, 19 bp, Homo sapiens
tcggccctgtcccctggag

SEQ ID NO: 1154663 - DNA, 13 bp, Homo sapiens
tcggccgaggcct

SEQ ID NO: 1154664 - DNA, 12 bp, Homo sapiens
tcggcctcccaa

SEQ ID NO: 1154665 - DNA, 18 bp, Homo sapiens
tcggcctcccaaagtgct

SEQ ID NO: 1154666 - DNA, 19 bp, Homo sapiens
tcggcctcccaaagtgctg

SEQ ID NO: 1154667 - DNA, 23 bp, Homo sapiens
tcggcctcccaaagtgctgggat

SEQ ID NO: 1154668 - DNA, 14 bp, Homo sapiens
tcggctcagcctcc

SEQ ID NO: 1154669 - DNA, 14 bp, Homo sapiens
tcggctccctggag

SEQ ID NO: 1154670 - DNA, 12 bp, Homo sapiens
tcggctcctgat

SEQ ID NO: 1154671 - DNA, 13 bp, Homo sapiens
tcggctcctgatg

SEQ ID NO: 1154672 - DNA, 15 bp, Homo sapiens
tcggctgaccatgct

SEQ ID NO: 1154673 - DNA, 18 bp, Homo sapiens
tcggctggaagaacatca

SEQ ID NO: 1154674 - DNA, 22 bp, Homo sapiens
tcggcttcctgtggggtgtagg

SEQ ID NO: 1154675 - DNA, 13 bp, Homo sapiens
tcggcttgatcac

SEQ ID NO: 1154676 - DNA, 17 bp, Homo sapiens
tcggcttgtgggctggt

SEQ ID NO: 1154677 - DNA, 21 bp, Homo sapiens
tcgggaaaaggtagaggagtc

SEQ ID NO: 1154678 - DNA, 14 bp, Homo sapiens
tcgggaaagaagaa

SEQ ID NO: 1154679 - DNA, 12 bp, Homo sapiens
tcgggaagcaga

SEQ ID NO: 1154680 - DNA, 14 bp, Homo sapiens
tcgggaagggaggg

SEQ ID NO: 1154681 - DNA, 14 bp, Homo sapiens
tcgggaattttccc

SEQ ID NO: 1154682 - DNA, 20 bp, Homo sapiens
tcgggaccacatctgtcctc

SEQ ID NO: 1154683 - DNA, 21 bp, Homo sapiens
tcgggaccacatctgtcctca

SEQ ID NO: 1154684 - DNA, 18 bp, Homo sapiens
tcgggacctcccaggaca

SEQ ID NO: 1154685 - DNA, 19 bp, Homo sapiens
tcgggacctcccaggacaa

SEQ ID NO: 1154686 - DNA, 10 bp, Homo sapiens
tcgggactag

SEQ ID NO: 1154687 - DNA, 13 bp, Homo sapiens
tcgggagcaccca

SEQ ID NO: 1154688 - DNA, 14 bp, Homo sapiens
tcgggagcacccag

SEQ ID NO: 1154689 - DNA, 20 bp, Homo sapiens
tcgggagcacccagagcacc

SEQ ID NO: 1154690 - DNA, 13 bp, Homo sapiens
tcgggagcagtgt

SEQ ID NO: 1154691 - DNA, 19 bp, Homo sapiens
tcgggagcagtgtcttcca

SEQ ID NO: 1154692 - DNA, 22 bp, Homo sapiens
tcgggagcagtgtcttccataa

SEQ ID NO: 1154693 - DNA, 23 bp, Homo sapiens
tcgggagcagtgtcttccataat

SEQ ID NO: 1154694 - DNA, 16 bp, Homo sapiens
tcgggaggctgagaca

SEQ ID NO: 1154695 - DNA, 19 bp, Homo sapiens
tcgggaggtcgaggcagga

SEQ ID NO: 1154696 - DNA, 12 bp, Homo sapiens
tcgggattcttt

SEQ ID NO: 1154697 - DNA, 13 bp, Homo sapiens
tcgggcagccagc

SEQ ID NO: 1154698 - DNA, 21 bp, Homo sapiens
tcgggcccacctggccacctg

SEQ ID NO: 1154699 - DNA, 23 bp, Homo sapiens
tcgggccccatcctcatccctga

SEQ ID NO: 1154700 - DNA, 13 bp, Homo sapiens
tcgggcccttctt

SEQ ID NO: 1154701 - DNA, 21 bp, Homo sapiens
tcgggcccttcttgctgccct

SEQ ID NO: 1154702 - DNA, 23 bp, Homo sapiens
tcgggcccttcttgctgccctgc

SEQ ID NO: 1154703 - DNA, 21 bp, Homo sapiens
tcgggcgtgggtctctgggga

SEQ ID NO: 1154704 - DNA, 14 bp, Homo sapiens
tcgggctccagcca

SEQ ID NO: 1154705 - DNA, 16 bp, Homo sapiens
tcgggctgagaaggca

SEQ ID NO: 1154706 - DNA, 15 bp, Homo sapiens
tcggggaactcctgg

SEQ ID NO: 1154707 - DNA, 16 bp, Homo sapiens
tcggggcatgctgggg

SEQ ID NO: 1154708 - DNA, 17 bp, Homo sapiens
tcggggcccttggggcc

SEQ ID NO: 1154709 - DNA, 20 bp, Homo sapiens
tcggggcccttggggcctgg

SEQ ID NO: 1154710 - DNA, 12 bp, Homo sapiens
tcggggcctcct

SEQ ID NO: 1154711 - DNA, 15 bp, Homo sapiens
tcggggcctgggaca

SEQ ID NO: 1154712 - DNA, 17 bp, Homo sapiens
tcgggggagcagagaga

SEQ ID NO: 1154713 - DNA, 16 bp, Homo sapiens
tcgggggcctgtggtg

SEQ ID NO: 1154714 - DNA, 18 bp, Homo sapiens
tcgggggctcttccccta

SEQ ID NO: 1154715 - DNA, 15 bp, Homo sapiens
tcgggggctgaccta

SEQ ID NO: 1154716 - DNA, 16 bp, Homo sapiens
tcgggggctggcctag

SEQ ID NO: 1154717 - DNA, 19 bp, Homo sapiens
tcggggttggggtgggagg

SEQ ID NO: 1154718 - DNA, 20 bp, Homo sapiens
tcggggttggggtgggaggg

SEQ ID NO: 1154719 - DNA, 12 bp, Homo sapiens
tcggtgaagaaa

SEQ ID NO: 1154720 - DNA, 14 bp, Homo sapiens
tcggtggctctggg

SEQ ID NO: 1154721 - DNA, 13 bp, Homo sapiens
tcggtggctgcct

SEQ ID NO: 1154722 - DNA, 15 bp, Homo sapiens
tcggtgggccagagc

SEQ ID NO: 1154723 - DNA, 13 bp, Homo sapiens
tcggtttctccaa

SEQ ID NO: 1154724 - DNA, 22 bp, Homo sapiens
tcggtttgccaaaattcatttc

SEQ ID NO: 1154725 - DNA, 13 bp, Homo sapiens
tcgtaccttccca

SEQ ID NO: 1154726 - DNA, 18 bp, Homo sapiens
tcgtagtccatcaccatt

SEQ ID NO: 1154727 - DNA, 20 bp, Homo sapiens
tcgtatcccgagtctgggac

SEQ ID NO: 1154728 - DNA, 19 bp, Homo sapiens
tcgtcacgagcacaatggt

SEQ ID NO: 1154729 - DNA, 20 bp, Homo sapiens
tcgtcagccacctgggaaca

SEQ ID NO: 1154730 - DNA, 21 bp, Homo sapiens
tcgtccacaggggcaggcctg

SEQ ID NO: 1154731 - DNA, 23 bp, Homo sapiens
tcgtccacaggggcaggcctggg

SEQ ID NO: 1154732 - DNA, 18 bp, Homo sapiens
tcgtcccatcttcactct

SEQ ID NO: 1154733 - DNA, 12 bp, Homo sapiens
tcgtccccctcc

SEQ ID NO: 1154734 - DNA, 15 bp, Homo sapiens
tcgtccccctccctg

SEQ ID NO: 1154735 - DNA, 17 bp, Homo sapiens
tcgtccccctccctgcc

SEQ ID NO: 1154736 - DNA, 14 bp, Homo sapiens
tcgtccgtctgtct

SEQ ID NO: 1154737 - DNA, 16 bp, Homo sapiens
tcgtccgtctgtctcg

SEQ ID NO: 1154738 - DNA, 13 bp, Homo sapiens
tcgtcctccccct

SEQ ID NO: 1154739 - DNA, 17 bp, Homo sapiens
tcgtcctccccctgcca

SEQ ID NO: 1154740 - DNA, 18 bp, Homo sapiens
tcgtcctccccctgccag

SEQ ID NO: 1154741 - DNA, 14 bp, Homo sapiens
tcgtcctgatccct

SEQ ID NO: 1154742 - DNA, 21 bp, Homo sapiens
tcgtcctgggactcggagact

SEQ ID NO: 1154743 - DNA, 13 bp, Homo sapiens
tcgtccttttggt

SEQ ID NO: 1154744 - DNA, 16 bp, Homo sapiens
tcgtctcatcctcctt

SEQ ID NO: 1154745 - DNA, 16 bp, Homo sapiens
tcgtctccctggccac

SEQ ID NO: 1154746 - DNA, 14 bp, Homo sapiens
tcgtctgactctgg

SEQ ID NO: 1154747 - DNA, 13 bp, Homo sapiens
tcgtctgtcccag

SEQ ID NO: 1154748 - DNA, 19 bp, Homo sapiens
ttcagtgagcccctcccca

SEQ ID NO: 1154749 - DNA, 23 bp, Homo sapiens
ttcagtgagcccctccccagcca

SEQ ID NO: 1154750 - DNA, 21 bp, Homo sapiens
ttcagtgcaaattgtatctta

SEQ ID NO: 1154751 - DNA, 13 bp, Homo sapiens
ttcagtgcaatca

SEQ ID NO: 1154752 - DNA, 20 bp, Homo sapiens
ttcagtgcacctgcctcagc

SEQ ID NO: 1154753 - DNA, 23 bp, Homo sapiens
ttcagtgcacctgcctcagctac

SEQ ID NO: 1154754 - DNA, 12 bp, Homo sapiens
ttcagtggagaa

SEQ ID NO: 1154755 - DNA, 16 bp, Homo sapiens
ttcagtgtaaagtgtg

SEQ ID NO: 1154756 - DNA, 23 bp, Homo sapiens
ttcagtgtcgggaattttccccg

SEQ ID NO: 1154757 - DNA, 12 bp, Homo sapiens
ttcagtgttaaa

SEQ ID NO: 1154758 - DNA, 18 bp, Homo sapiens
ttcagtgttacctgtgtg

SEQ ID NO: 1154759 - DNA, 11 bp, Homo sapiens
ttcagttattt

SEQ ID NO: 1154760 - DNA, 22 bp, Homo sapiens
ttcagttccctcctgcccagga

SEQ ID NO: 1154761 - DNA, 16 bp, Homo sapiens
ttcagttgctttgccc

SEQ ID NO: 1154762 - DNA, 13 bp, Homo sapiens
ttcagttgttctt

SEQ ID NO: 1154763 - DNA, 14 bp, Homo sapiens
ttcagttgttcttt

SEQ ID NO: 1154764 - DNA, 17 bp, Homo sapiens
ttcagttgttcttttta

SEQ ID NO: 1154765 - DNA, 17 bp, Homo sapiens
ttcagtttcttctgcgc

SEQ ID NO: 1154766 - DNA, 17 bp, Homo sapiens
ttcagttttatctttaa

SEQ ID NO: 1154767 - DNA, 14 bp, Homo sapiens
ttcagtttttcatt

SEQ ID NO: 1154768 - DNA, 18 bp, Homo sapiens
ttcagtttttcatttgtt

SEQ ID NO: 1154769 - DNA, 19 bp, Homo sapiens
ttcataaacaacttaatgt

SEQ ID NO: 1154770 - DNA, 15 bp, Homo sapiens
ttcataaagaattgt

SEQ ID NO: 1154771 - DNA, 12 bp, Homo sapiens
ttcataaatgaa

SEQ ID NO: 1154772 - DNA, 16 bp, Homo sapiens
ttcataaatgaatttt

SEQ ID NO: 1154773 - DNA, 13 bp, Homo sapiens
ttcataacggaaa

SEQ ID NO: 1154774 - DNA, 23 bp, Homo sapiens
ttcataacttgctgaatttcagg

SEQ ID NO: 1154775 - DNA, 18 bp, Homo sapiens
ttcataaggcctgccctc

SEQ ID NO: 1154776 - DNA, 19 bp, Homo sapiens
ttcataaggcctgccctcc

SEQ ID NO: 1154777 - DNA, 21 bp, Homo sapiens
ttcataataggtagtttggat

SEQ ID NO: 1154778 - DNA, 18 bp, Homo sapiens
ttcataatcagtaaatag

SEQ ID NO: 1154779 - DNA, 22 bp, Homo sapiens
ttcataatgaattataacagtt

SEQ ID NO: 1154780 - DNA, 13 bp, Homo sapiens
ttcataattcaga

SEQ ID NO: 1154781 - DNA, 21 bp, Homo sapiens
ttcatacaaagtactgtcctc

SEQ ID NO: 1154782 - DNA, 18 bp, Homo sapiens
ttcataccattattatgt

SEQ ID NO: 1154783 - DNA, 19 bp, Homo sapiens
ttcataccgcctcgtgcca

SEQ ID NO: 1154784 - DNA, 15 bp, Homo sapiens
ttcatacctcagaat

SEQ ID NO: 1154785 - DNA, 18 bp, Homo sapiens
ttcatacgcatcccatct

SEQ ID NO: 1154786 - DNA, 19 bp, Homo sapiens
ttcatactatttagatttt

SEQ ID NO: 1154787 - DNA, 13 bp, Homo sapiens
ttcatacttttct

SEQ ID NO: 1154788 - DNA, 16 bp, Homo sapiens
ttcatagaagtgttga

SEQ ID NO: 1154789 - DNA, 19 bp, Homo sapiens
ttcatagagatttgtctaa

SEQ ID NO: 1154790 - DNA, 21 bp, Homo sapiens
ttcatagatttgaaaaacttt

SEQ ID NO: 1154791 - DNA, 15 bp, Homo sapiens
ttcatagctccttgg

SEQ ID NO: 1154792 - DNA, 18 bp, Homo sapiens
ttcatagctgtacttctt

SEQ ID NO: 1154793 - DNA, 22 bp, Homo sapiens
ttcataggcagcatctcagatc

SEQ ID NO: 1154794 - DNA, 20 bp, Homo sapiens
ttcataggcggtcatgtgtg

SEQ ID NO: 1154795 - DNA, 22 bp, Homo sapiens
ttcataggcggtcatgtgtgca

SEQ ID NO: 1154796 - DNA, 21 bp, Homo sapiens
ttcatagggaaaggttttgta

SEQ ID NO: 1154797 - DNA, 15 bp, Homo sapiens
ttcataggggcaggt

SEQ ID NO: 1154798 - DNA, 15 bp, Homo sapiens
ttcataggtctgaaa

SEQ ID NO: 1154799 - DNA, 17 bp, Homo sapiens
ttcatagtaacttctta

SEQ ID NO: 1154800 - DNA, 19 bp, Homo sapiens
ttcatagtatccatatttt

SEQ ID NO: 1154801 - DNA, 17 bp, Homo sapiens
ttcatagtgcctttttc

SEQ ID NO: 1154802 - DNA, 20 bp, Homo sapiens
ttcatagtggattaatgcat

SEQ ID NO: 1154803 - DNA, 18 bp, Homo sapiens
ttcatagttttatatccc

SEQ ID NO: 1154804 - DNA, 16 bp, Homo sapiens
ttcatataaagtatca

SEQ ID NO: 1154805 - DNA, 22 bp, Homo sapiens
ttcatatactataattgtaaat

SEQ ID NO: 1154806 - DNA, 13 bp, Homo sapiens
ttcatatatacat

SEQ ID NO: 1154807 - DNA, 21 bp, Homo sapiens
ttcatatatgaggacttgtgt

SEQ ID NO: 1154808 - DNA, 20 bp, Homo sapiens
ttcatatctatttattaaat

SEQ ID NO: 1154809 - DNA, 22 bp, Homo sapiens
ttcatatgcagaacgtatttag

SEQ ID NO: 1154810 - DNA, 13 bp, Homo sapiens
ttcatatgctctg

SEQ ID NO: 1154811 - DNA, 13 bp, Homo sapiens
ttcatatgttgct

SEQ ID NO: 1154812 - DNA, 18 bp, Homo sapiens
ttcatatgttgctcagtc

SEQ ID NO: 1154813 - DNA, 14 bp, Homo sapiens
ttcatattaagaca

SEQ ID NO: 1154814 - DNA, 22 bp, Homo sapiens
ttcatattaagacagtgtacaa

SEQ ID NO: 1154815 - DNA, 18 bp, Homo sapiens
ttcatattgctgagagaa

SEQ ID NO: 1154816 - DNA, 16 bp, Homo sapiens
ttcatattgtgccaat

SEQ ID NO: 1154817 - DNA, 19 bp, Homo sapiens
ttcatatttgtctttgaat

SEQ ID NO: 1154818 - DNA, 17 bp, Homo sapiens
ttcatattttaaacaga

SEQ ID NO: 1154819 - DNA, 21 bp, Homo sapiens
ttcatattttaaacagaggat

SEQ ID NO: 1154820 - DNA, 14 bp, Homo sapiens
ttcatattttaaat

SEQ ID NO: 1154821 - DNA, 23 bp, Homo sapiens
ttcatatttttgatcatcccttt

SEQ ID NO: 1154822 - DNA, 21 bp, Homo sapiens
ttcatcaatatccctcttgta

SEQ ID NO: 1154823 - DNA, 22 bp, Homo sapiens
ttcatcaatatccctcttgtaa

SEQ ID NO: 1154824 - DNA, 11 bp, Homo sapiens
ttcatcactgg

SEQ ID NO: 1154825 - DNA, 14 bp, Homo sapiens
ttcatcagaatgtt

SEQ ID NO: 1154826 - DNA, 20 bp, Homo sapiens
ttcatcaggctctgttcctc

SEQ ID NO: 1154827 - DNA, 21 bp, Homo sapiens
ttcatcaggctctgttcctca

SEQ ID NO: 1154828 - DNA, 15 bp, Homo sapiens
ttcatcagtgttaaa

SEQ ID NO: 1154829 - DNA, 16 bp, Homo sapiens
ttcatcagtgttaaaa

SEQ ID NO: 1154830 - DNA, 15 bp, Homo sapiens
ttcatcatccagatg

SEQ ID NO: 1154831 - DNA, 18 bp, Homo sapiens
ttcatcatcctaagctat

SEQ ID NO: 1154832 - DNA, 17 bp, Homo sapiens
ttcatcattccctctca

SEQ ID NO: 1154833 - DNA, 23 bp, Homo sapiens
ttcatcattgtttctgcatgaat

SEQ ID NO: 1154834 - DNA, 23 bp, Homo sapiens
ttcatcatttcagccaaagtcct

SEQ ID NO: 1154835 - DNA, 18 bp, Homo sapiens
ttcatccaacttccaaga

SEQ ID NO: 1154836 - DNA, 18 bp, Homo sapiens
ttcatccaatcctcactg

SEQ ID NO: 1154837 - DNA, 17 bp, Homo sapiens
ttcatccaggactgaga

SEQ ID NO: 1154838 - DNA, 22 bp, Homo sapiens
ttcatccaggcccaactgtgag

SEQ ID NO: 1154839 - DNA, 17 bp, Homo sapiens
ttcatccataactgaac

SEQ ID NO: 1154840 - DNA, 19 bp, Homo sapiens
ttcatcccaactgtctttt

SEQ ID NO: 1154841 - DNA, 21 bp, Homo sapiens
ttcatcccatgatgtagtgcc

SEQ ID NO: 1154842 - DNA, 18 bp, Homo sapiens
ttcatcccgtatcacagt

SEQ ID NO: 1154843 - DNA, 16 bp, Homo sapiens
ttcatccgcctgtggg

SEQ ID NO: 1154844 - DNA, 20 bp, Homo sapiens
ttcatcctaacatgacagta

SEQ ID NO: 1154845 - DNA, 21 bp, Homo sapiens
ttcatcctcattgcctcctgt

SEQ ID NO: 1154846 - DNA, 16 bp, Homo sapiens
ttcatcctgagcccaa

SEQ ID NO: 1154847 - DNA, 20 bp, Homo sapiens
ttcatccttttttctcttct

SEQ ID NO: 1154848 - DNA, 18 bp, Homo sapiens
ttcatcgaatctactaat

SEQ ID NO: 1154849 - DNA, 21 bp, Homo sapiens
ttcatctaatgtattatgagc

SEQ ID NO: 1154850 - DNA, 16 bp, Homo sapiens
ttcatctatttctgag

SEQ ID NO: 1154851 - DNA, 13 bp, Homo sapiens
ttcatctcattta

SEQ ID NO: 1154852 - DNA, 22 bp, Homo sapiens
ttcatctccagggagtcccctc

SEQ ID NO: 1154853 - DNA, 22 bp, Homo sapiens
ttcatctcccacctagcagcac

SEQ ID NO: 1154854 - DNA, 23 bp, Homo sapiens
ttcatctccctgccatccccctc

SEQ ID NO: 1154855 - DNA, 18 bp, Homo sapiens
ttcatctctaacatatga

SEQ ID NO: 1154856 - DNA, 21 bp, Homo sapiens
ttcatctctctacctccaccc

SEQ ID NO: 1154857 - DNA, 19 bp, Homo sapiens
ttcatctggcaacatcttt

SEQ ID NO: 1154858 - DNA, 13 bp, Homo sapiens
ttcatctgggaaa

SEQ ID NO: 1154859 - DNA, 23 bp, Homo sapiens
ttcatctgtaactctaaaagatc

SEQ ID NO: 1154860 - DNA, 17 bp, Homo sapiens
ttcatctgttgttctgt

SEQ ID NO: 1154861 - DNA, 19 bp, Homo sapiens
ttcatcttcagttgtctct

SEQ ID NO: 1154862 - DNA, 14 bp, Homo sapiens
ttcatcttctggaa

SEQ ID NO: 1154863 - DNA, 15 bp, Homo sapiens
ttcatcttctggaat

SEQ ID NO: 1154864 - DNA, 15 bp, Homo sapiens
ttcatgaatgtgctg

SEQ ID NO: 1154865 - DNA, 16 bp, Homo sapiens
ttcatgacattatgtg

SEQ ID NO: 1154866 - DNA, 12 bp, Homo sapiens
ttcatgataatg

SEQ ID NO: 1154867 - DNA, 15 bp, Homo sapiens
ttcatgcacttaaag

SEQ ID NO: 1154868 - DNA, 13 bp, Homo sapiens
ttcatgcagctgt

SEQ ID NO: 1154869 - DNA, 21 bp, Homo sapiens
ttcatgccaattagcaattga

SEQ ID NO: 1154870 - DNA, 22 bp, Homo sapiens
ttcatgccaccatggccagcca

SEQ ID NO: 1154871 - DNA, 22 bp, Homo sapiens
ttcatgccagctacttcctcct

SEQ ID NO: 1154872 - DNA, 20 bp, Homo sapiens
tacaaagtaaaatgaacatt

SEQ ID NO: 1154873 - DNA, 17 bp, Homo sapiens
tacaaagtaatttcttt

SEQ ID NO: 1154874 - DNA, 22 bp, Homo sapiens
tacaaagtacagaaaaatactt

SEQ ID NO: 1154875 - DNA, 14 bp, Homo sapiens
tacaaagtagaagt

SEQ ID NO: 1154876 - DNA, 18 bp, Homo sapiens
tacaaagtgtgtattaaa

SEQ ID NO: 1154877 - DNA, 19 bp, Homo sapiens
tacaaatactcttaggaag

SEQ ID NO: 1154878 - DNA, 23 bp, Homo sapiens
tacaaataggtagagtcattcat

SEQ ID NO: 1154879 - DNA, 15 bp, Homo sapiens
tacaaatcagaactt

SEQ ID NO: 1154880 - DNA, 16 bp, Homo sapiens
tacaaatcagaagtca

SEQ ID NO: 1154881 - DNA, 20 bp, Homo sapiens
tacaaatcagaagtcatctt

SEQ ID NO: 1154882 - DNA, 21 bp, Homo sapiens
tacaaatgaagaaagtcaaaa

SEQ ID NO: 1154883 - DNA, 13 bp, Homo sapiens
tacaaatggattt

SEQ ID NO: 1154884 - DNA, 21 bp, Homo sapiens
tacaaatgtaagcaaaggctc

SEQ ID NO: 1154885 - DNA, 15 bp, Homo sapiens
tacaaattgtcgttt

SEQ ID NO: 1154886 - DNA, 17 bp, Homo sapiens
tacaaatttataaaggt

SEQ ID NO: 1154887 - DNA, 19 bp, Homo sapiens
tacaaatttataaaggtct

SEQ ID NO: 1154888 - DNA, 20 bp, Homo sapiens
tacaaatttataaaggtctg

SEQ ID NO: 1154889 - DNA, 12 bp, Homo sapiens
tacaaatttatg

SEQ ID NO: 1154890 - DNA, 16 bp, Homo sapiens
tacaaatttatgcatt

SEQ ID NO: 1154891 - DNA, 16 bp, Homo sapiens
tacaaatttggcctta

SEQ ID NO: 1154892 - DNA, 18 bp, Homo sapiens
tacaaatttggccttaag

SEQ ID NO: 1154893 - DNA, 15 bp, Homo sapiens
tacaaattttcactg

SEQ ID NO: 1154894 - DNA, 22 bp, Homo sapiens
tacaacaagagtttatttccaa

SEQ ID NO: 1154895 - DNA, 21 bp, Homo sapiens
tacaacagaaaccagaaaagc

SEQ ID NO: 1154896 - DNA, 17 bp, Homo sapiens
tacaacattcaacttta

SEQ ID NO: 1154897 - DNA, 11 bp, Homo sapiens
tacaaccctga

SEQ ID NO: 1154898 - DNA, 13 bp, Homo sapiens
tacaaccctgacc

SEQ ID NO: 1154899 - DNA, 17 bp, Homo sapiens
tacaactaaaaataaat

SEQ ID NO: 1154900 - DNA, 15 bp, Homo sapiens
tacaactaaataaca

SEQ ID NO: 1154901 - DNA, 17 bp, Homo sapiens
tacaacttgattttttc

SEQ ID NO: 1154902 - DNA, 14 bp, Homo sapiens
tacaactttaccat

SEQ ID NO: 1154903 - DNA, 15 bp, Homo sapiens
tacaacttttgtttt

SEQ ID NO: 1154904 - DNA, 14 bp, Homo sapiens
tacaagaaaatgta

SEQ ID NO: 1154905 - DNA, 18 bp, Homo sapiens
tacaagaaaatgtatcca

SEQ ID NO: 1154906 - DNA, 19 bp, Homo sapiens
tacaagaagcattttgtaa

SEQ ID NO: 1154907 - DNA, 19 bp, Homo sapiens
tacaagactgccatattaa

SEQ ID NO: 1154908 - DNA, 20 bp, Homo sapiens
tacaagactgccatattaaa

SEQ ID NO: 1154909 - DNA, 22 bp, Homo sapiens
tacaagactgccatattaaatt

SEQ ID NO: 1154910 - DNA, 23 bp, Homo sapiens
tacaagagaaaaagcagaggcca

SEQ ID NO: 1154911 - DNA, 19 bp, Homo sapiens
tacaagagcagcctgtggc

SEQ ID NO: 1154912 - DNA, 20 bp, Homo sapiens
tacaagagcagcctgtggca

SEQ ID NO: 1154913 - DNA, 17 bp, Homo sapiens
tacaagatattgatgat

SEQ ID NO: 1154914 - DNA, 24 bp, Homo sapiens
tacaagatgaaggagaggcaacat

SEQ ID NO: 1154915 - DNA, 13 bp, Homo sapiens
tacaagattagaa

SEQ ID NO: 1154916 - DNA, 21 bp, Homo sapiens
tacaagattagaagctgaaaa

SEQ ID NO: 1154917 - DNA, 15 bp, Homo sapiens
tacaagattgaaaat

SEQ ID NO: 1154918 - DNA, 14 bp, Homo sapiens
tacaagattgtaag

SEQ ID NO: 1154919 - DNA, 23 bp, Homo sapiens
tacaagccaaaagtccctccctg

SEQ ID NO: 1154920 - DNA, 15 bp, Homo sapiens
tacaagccccccctt

SEQ ID NO: 1154921 - DNA, 16 bp, Homo sapiens
tacaagcctgcacaat

SEQ ID NO: 1154922 - DNA, 23 bp, Homo sapiens
tacaagcttttagtatccacagg

SEQ ID NO: 1154923 - DNA, 18 bp, Homo sapiens
tacaaggcaagcattttt

SEQ ID NO: 1154924 - DNA, 17 bp, Homo sapiens
tacaaggtaattgtttt

SEQ ID NO: 1154925 - DNA, 18 bp, Homo sapiens
tacaaggtaattgttttt

SEQ ID NO: 1154926 - DNA, 22 bp, Homo sapiens
tacaaggtaggctgcaaaatta

SEQ ID NO: 1154927 - DNA, 16 bp, Homo sapiens
tacaagtaatattatt

SEQ ID NO: 1154928 - DNA, 15 bp, Homo sapiens
tacaagtataacagt

SEQ ID NO: 1154929 - DNA, 20 bp, Homo sapiens
tacaagtatataatatgtca

SEQ ID NO: 1154930 - DNA, 17 bp, Homo sapiens
tacaagtatttttaatt

SEQ ID NO: 1154931 - DNA, 18 bp, Homo sapiens
tacaagtatttttaatta

SEQ ID NO: 1154932 - DNA, 12 bp, Homo sapiens
tacaagtggctc

SEQ ID NO: 1154933 - DNA, 18 bp, Homo sapiens
tacaagtggctccccacc

SEQ ID NO: 1154934 - DNA, 21 bp, Homo sapiens
tacaagtggctccccacctgg

SEQ ID NO: 1154935 - DNA, 19 bp, Homo sapiens
tacaagtggtgaccaaaat

SEQ ID NO: 1154936 - DNA, 15 bp, Homo sapiens
tacaagttagaaaac

SEQ ID NO: 1154937 - DNA, 16 bp, Homo sapiens
tacaagttatagtact

SEQ ID NO: 1154938 - DNA, 23 bp, Homo sapiens
tacaagttctggcaagagcagat

SEQ ID NO: 1154939 - DNA, 16 bp, Homo sapiens
tacaagttgttattgt

SEQ ID NO: 1154940 - DNA, 12 bp, Homo sapiens
tacaagtttcag

SEQ ID NO: 1154941 - DNA, 18 bp, Homo sapiens
tacaagtttgctaaaaga

SEQ ID NO: 1154942 - DNA, 21 bp, Homo sapiens
tacaagtttgctaaaagaaga

SEQ ID NO: 1154943 - DNA, 13 bp, Homo sapiens
tacaataaaaaca

SEQ ID NO: 1154944 - DNA, 14 bp, Homo sapiens
tacaataaaaagaa

SEQ ID NO: 1154945 - DNA, 15 bp, Homo sapiens
tacaataaaaagaaa

SEQ ID NO: 1154946 - DNA, 14 bp, Homo sapiens
tacaataaaagagc

SEQ ID NO: 1154947 - DNA, 19 bp, Homo sapiens
tacaataaaagagctttat

SEQ ID NO: 1154948 - DNA, 13 bp, Homo sapiens
tacaataaataat

SEQ ID NO: 1154949 - DNA, 22 bp, Homo sapiens
tacaataaattgctaatgttgc

SEQ ID NO: 1154950 - DNA, 23 bp, Homo sapiens
tacaataaattgctaatgttgct

SEQ ID NO: 1154951 - DNA, 19 bp, Homo sapiens
tacaataacccagttactt

SEQ ID NO: 1154952 - DNA, 16 bp, Homo sapiens
tacaataataaatcct

SEQ ID NO: 1154953 - DNA, 13 bp, Homo sapiens
tacaatacaatgt

SEQ ID NO: 1154954 - DNA, 13 bp, Homo sapiens
tacaatacatata

SEQ ID NO: 1154955 - DNA, 18 bp, Homo sapiens
tacaatcatggtcaagtt

SEQ ID NO: 1154956 - DNA, 15 bp, Homo sapiens
tacaatcctgtttat

SEQ ID NO: 1154957 - DNA, 21 bp, Homo sapiens
tacaatgaacacttataagtg

SEQ ID NO: 1154958 - DNA, 21 bp, Homo sapiens
tacaatgaacccccatgatgt

SEQ ID NO: 1154959 - DNA, 14 bp, Homo sapiens
tacaatgactttat

SEQ ID NO: 1154960 - DNA, 15 bp, Homo sapiens
tacaatgatggtaaa

SEQ ID NO: 1154961 - DNA, 14 bp, Homo sapiens
tacaatgctgtgcc

SEQ ID NO: 1154962 - DNA, 21 bp, Homo sapiens
tacaatgctgtgccctaaagt

SEQ ID NO: 1154963 - DNA, 14 bp, Homo sapiens
tacaatggaataaa

SEQ ID NO: 1154964 - DNA, 16 bp, Homo sapiens
tacaatggaataaatt

SEQ ID NO: 1154965 - DNA, 22 bp, Homo sapiens
tacaatggtttattcccaagta

SEQ ID NO: 1154966 - DNA, 18 bp, Homo sapiens
tacaatgtacaattatgt

SEQ ID NO: 1154967 - DNA, 19 bp, Homo sapiens
tacaatgtacaattatgtc

SEQ ID NO: 1154968 - DNA, 13 bp, Homo sapiens
tacaatgtatctt

SEQ ID NO: 1154969 - DNA, 16 bp, Homo sapiens
tacaatgtatctttat

SEQ ID NO: 1154970 - DNA, 17 bp, Homo sapiens
tacaatgtatctttatt

SEQ ID NO: 1154971 - DNA, 15 bp, Homo sapiens
tacaatgtatgtaca

SEQ ID NO: 1154972 - DNA, 21 bp, Homo sapiens
tacaatgtgaactttattaaa

SEQ ID NO: 1154973 - DNA, 15 bp, Homo sapiens
tacaatgttcatccc

SEQ ID NO: 1154974 - DNA, 21 bp, Homo sapiens
tacaattaatagtttgtctat

SEQ ID NO: 1154975 - DNA, 22 bp, Homo sapiens
tacaattaatagtttgtctatt

SEQ ID NO: 1154976 - DNA, 14 bp, Homo sapiens
tacaattatgtctc

SEQ ID NO: 1154977 - DNA, 18 bp, Homo sapiens
tacaattatttttacagt

SEQ ID NO: 1154978 - DNA, 21 bp, Homo sapiens
tacaattcattgtgttacctg

SEQ ID NO: 1154979 - DNA, 17 bp, Homo sapiens
tacaattccctgctgtc

SEQ ID NO: 1154980 - DNA, 18 bp, Homo sapiens
tacaattctacattgtca

SEQ ID NO: 1154981 - DNA, 15 bp, Homo sapiens
tacaattgatctttt

SEQ ID NO: 1154982 - DNA, 17 bp, Homo sapiens
tacaatttacaaagtgt

SEQ ID NO: 1154983 - DNA, 17 bp, Homo sapiens
tacaatttccatatagt

SEQ ID NO: 1154984 - DNA, 14 bp, Homo sapiens
tacaatttgcacaa

SEQ ID NO: 1154985 - DNA, 18 bp, Homo sapiens
tacaatttgtttttgcat

SEQ ID NO: 1154986 - DNA, 21 bp, Homo sapiens
tacaatttgtttttgcatttt

SEQ ID NO: 1154987 - DNA, 20 bp, Homo sapiens
tacaattttagtcactaaga

SEQ ID NO: 1154988 - DNA, 12 bp, Homo sapiens
tacaattttatc

SEQ ID NO: 1154989 - DNA, 18 bp, Homo sapiens
tacaatttttaataaatt

SEQ ID NO: 1154990 - DNA, 18 bp, Homo sapiens
tacaattttttttattag

SEQ ID NO: 1154991 - DNA, 19 bp, Homo sapiens
tacaattttttttattagt

SEQ ID NO: 1154992 - DNA, 21 bp, Homo sapiens
tacaattttttttattagtat

SEQ ID NO: 1154993 - DNA, 23 bp, Homo sapiens
tacacaaatgatagcataacata

SEQ ID NO: 1154994 - DNA, 15 bp, Homo sapiens
tacacaactcactcc

SEQ ID NO: 1154995 - DNA, 14 bp, Homo sapiens
tacacaactttgca

SEQ ID NO: 1154996 - DNA, 17 bp, Homo sapiens
ttcatgcctttgtaagt

SEQ ID NO: 1154997 - DNA, 13 bp, Homo sapiens
ttcatgcttgaca

SEQ ID NO: 1154998 - DNA, 15 bp, Homo sapiens
ttcatggacactttg

SEQ ID NO: 1154999 - DNA, 17 bp, Homo sapiens
ttcatggcagaaggcaa

SEQ ID NO: 1155000 - DNA, 21 bp, Homo sapiens
ttcatggcatcttcaatatga

SEQ ID NO: 1155001 - DNA, 15 bp, Homo sapiens
ttcatgggctgtgtg

SEQ ID NO: 1155002 - DNA, 19 bp, Homo sapiens
ttcatggtgaaaatgtact

SEQ ID NO: 1155003 - DNA, 18 bp, Homo sapiens
ttcatgtaacagttgtgt

SEQ ID NO: 1155004 - DNA, 19 bp, Homo sapiens
ttcatgtaacagttgtgtc

SEQ ID NO: 1155005 - DNA, 13 bp, Homo sapiens
ttcatgtaatttt

SEQ ID NO: 1155006 - DNA, 21 bp, Homo sapiens
ttcatgtaattttattttaaa

SEQ ID NO: 1155007 - DNA, 12 bp, Homo sapiens
ttcatgtacagc

SEQ ID NO: 1155008 - DNA, 20 bp, Homo sapiens
ttcatgtagagaaaagcaca

SEQ ID NO: 1155009 - DNA, 14 bp, Homo sapiens
ttcatgtgagaaag

SEQ ID NO: 1155010 - DNA, 14 bp, Homo sapiens
ttcatgtggctgta

SEQ ID NO: 1155011 - DNA, 18 bp, Homo sapiens
ttcatgttagttacctta

SEQ ID NO: 1155012 - DNA, 22 bp, Homo sapiens
ttcatgttgatgactcgaaact

SEQ ID NO: 1155013 - DNA, 12 bp, Homo sapiens
ttcatgtttctt

SEQ ID NO: 1155014 - DNA, 15 bp, Homo sapiens
ttcatgtttgtaaat

SEQ ID NO: 1155015 - DNA, 17 bp, Homo sapiens
ttcatgtttgtaaatta

SEQ ID NO: 1155016 - DNA, 16 bp, Homo sapiens
ttcatgttttgtgact

SEQ ID NO: 1155017 - DNA, 18 bp, Homo sapiens
ttcatgttttgtgactat

SEQ ID NO: 1155018 - DNA, 21 bp, Homo sapiens
ttcattacatttctgaattgt

SEQ ID NO: 1155019 - DNA, 20 bp, Homo sapiens
ttcattagaaatattttaaa

SEQ ID NO: 1155020 - DNA, 18 bp, Homo sapiens
ttcattagcagttgctca

SEQ ID NO: 1155021 - DNA, 22 bp, Homo sapiens
ttcattaggcaaagtacaaaat

SEQ ID NO: 1155022 - DNA, 15 bp, Homo sapiens
ttcattagtcatgtt

SEQ ID NO: 1155023 - DNA, 22 bp, Homo sapiens
ttcattatagacaacgatgaat

SEQ ID NO: 1155024 - DNA, 17 bp, Homo sapiens
ttcattatctgagttgc

SEQ ID NO: 1155025 - DNA, 22 bp, Homo sapiens
ttcattatgcacttttagaaat

SEQ ID NO: 1155026 - DNA, 17 bp, Homo sapiens
ttcattatgttcatgta

SEQ ID NO: 1155027 - DNA, 18 bp, Homo sapiens
ttcattatgttcatgtaa

SEQ ID NO: 1155028 - DNA, 22 bp, Homo sapiens
ttcattattagtactgctcttg

SEQ ID NO: 1155029 - DNA, 23 bp, Homo sapiens
ttcattattcaagaatgaaaaat

SEQ ID NO: 1155030 - DNA, 15 bp, Homo sapiens
ttcattattcctcag

SEQ ID NO: 1155031 - DNA, 20 bp, Homo sapiens
ttcattattctccacttttt

SEQ ID NO: 1155032 - DNA, 18 bp, Homo sapiens
ttcattattggaattaac

SEQ ID NO: 1155033 - DNA, 21 bp, Homo sapiens
ttcattatttgtcaaattgtc

SEQ ID NO: 1155034 - DNA, 18 bp, Homo sapiens
ttcattattttaaaaata

SEQ ID NO: 1155035 - DNA, 14 bp, Homo sapiens
ttcattattttgtg

SEQ ID NO: 1155036 - DNA, 14 bp, Homo sapiens
ttcattcaccagat

SEQ ID NO: 1155037 - DNA, 21 bp, Homo sapiens
ttcattcaccagatattttgt

SEQ ID NO: 1155038 - DNA, 14 bp, Homo sapiens
ttcattcactgtgc

SEQ ID NO: 1155039 - DNA, 16 bp, Homo sapiens
ttcattcactgtgcac

SEQ ID NO: 1155040 - DNA, 15 bp, Homo sapiens
ttcattccagcagct

SEQ ID NO: 1155041 - DNA, 21 bp, Homo sapiens
ttcattccattgcctagctct

SEQ ID NO: 1155042 - DNA, 19 bp, Homo sapiens
ttcattcggtgtgaacttt

SEQ ID NO: 1155043 - DNA, 22 bp, Homo sapiens
ttcattcggtgtgaacttttct

SEQ ID NO: 1155044 - DNA, 12 bp, Homo sapiens
ttcattctcata

SEQ ID NO: 1155045 - DNA, 23 bp, Homo sapiens
ttcattctcataattcctacagc

SEQ ID NO: 1155046 - DNA, 19 bp, Homo sapiens
ttcattctgctacttcact

SEQ ID NO: 1155047 - DNA, 14 bp, Homo sapiens
ttcattcttctcac

SEQ ID NO: 1155048 - DNA, 22 bp, Homo sapiens
ttcattgagttggttacttcat

SEQ ID NO: 1155049 - DNA, 16 bp, Homo sapiens
ttcattgcaattaaac

SEQ ID NO: 1155050 - DNA, 19 bp, Homo sapiens
ttcattgcactttgattag

SEQ ID NO: 1155051 - DNA, 18 bp, Homo sapiens
ttcattgcctgtgtatgg

SEQ ID NO: 1155052 - DNA, 22 bp, Homo sapiens
ttcattggcagctcaaagactt

SEQ ID NO: 1155053 - DNA, 20 bp, Homo sapiens
ttcattgggaagattctcta

SEQ ID NO: 1155054 - DNA, 18 bp, Homo sapiens
ttcattgtaatgttactg

SEQ ID NO: 1155055 - DNA, 12 bp, Homo sapiens
ttcattgtacaa

SEQ ID NO: 1155056 - DNA, 14 bp, Homo sapiens
ttcattgtatgatg

SEQ ID NO: 1155057 - DNA, 15 bp, Homo sapiens
ttcattgtccctctt

SEQ ID NO: 1155058 - DNA, 13 bp, Homo sapiens
ttcatttaaaatg

SEQ ID NO: 1155059 - DNA, 15 bp, Homo sapiens
ttcatttaaaatgat

SEQ ID NO: 1155060 - DNA, 16 bp, Homo sapiens
ttcatttaaaatgatt

SEQ ID NO: 1155061 - DNA, 13 bp, Homo sapiens
ttcatttaaacta

SEQ ID NO: 1155062 - DNA, 23 bp, Homo sapiens
ttcatttaaactaaattactgtt

SEQ ID NO: 1155063 - DNA, 19 bp, Homo sapiens
ttcatttagataatttgaa

SEQ ID NO: 1155064 - DNA, 19 bp, Homo sapiens
ttcatttagtcatgtgacc

SEQ ID NO: 1155065 - DNA, 18 bp, Homo sapiens
ttcatttatctataattt

SEQ ID NO: 1155066 - DNA, 15 bp, Homo sapiens
ttcatttcaactgtt

SEQ ID NO: 1155067 - DNA, 14 bp, Homo sapiens
ttcatttcaatcat

SEQ ID NO: 1155068 - DNA, 11 bp, Homo sapiens
ttcatttcatt

SEQ ID NO: 1155069 - DNA, 12 bp, Homo sapiens
ttcatttcattg

SEQ ID NO: 1155070 - DNA, 15 bp, Homo sapiens
ttcatttcatttcag

SEQ ID NO: 1155071 - DNA, 13 bp, Homo sapiens
ttcatttccactc

SEQ ID NO: 1155072 - DNA, 12 bp, Homo sapiens
ttcatttcctgc

SEQ ID NO: 1155073 - DNA, 13 bp, Homo sapiens
ttcatttcttatc

SEQ ID NO: 1155074 - DNA, 21 bp, Homo sapiens
ttcatttgacacaaagcttct

SEQ ID NO: 1155075 - DNA, 18 bp, Homo sapiens
ttcatttgagaagtaaac

SEQ ID NO: 1155076 - DNA, 14 bp, Homo sapiens
ttcatttgcaattc

SEQ ID NO: 1155077 - DNA, 18 bp, Homo sapiens
ttcatttgcaattcatgt

SEQ ID NO: 1155078 - DNA, 22 bp, Homo sapiens
ttcatttggtgttcctggaagc

SEQ ID NO: 1155079 - DNA, 13 bp, Homo sapiens
ttcatttgtacaa

SEQ ID NO: 1155080 - DNA, 12 bp, Homo sapiens
ttcatttgtatt

SEQ ID NO: 1155081 - DNA, 15 bp, Homo sapiens
ttcatttgttttgct

SEQ ID NO: 1155082 - DNA, 19 bp, Homo sapiens
ttcatttgttttgcttttg

SEQ ID NO: 1155083 - DNA, 16 bp, Homo sapiens
ttcattttaaaaagtc

SEQ ID NO: 1155084 - DNA, 17 bp, Homo sapiens
ttcattttcatcactgg

SEQ ID NO: 1155085 - DNA, 18 bp, Homo sapiens
ttcattttcatcactggg

SEQ ID NO: 1155086 - DNA, 20 bp, Homo sapiens
ttcattttcctgttcagtga

SEQ ID NO: 1155087 - DNA, 20 bp, Homo sapiens
ttcattttctagatacaata

SEQ ID NO: 1155088 - DNA, 21 bp, Homo sapiens
ttcattttctagatacaataa

SEQ ID NO: 1155089 - DNA, 22 bp, Homo sapiens
ttcattttctagatacaataaa

SEQ ID NO: 1155090 - DNA, 14 bp, Homo sapiens
ttcattttctcaaa

SEQ ID NO: 1155091 - DNA, 13 bp, Homo sapiens
ttcattttctcta

SEQ ID NO: 1155092 - DNA, 17 bp, Homo sapiens
ttcattttgagctgaaa

SEQ ID NO: 1155093 - DNA, 19 bp, Homo sapiens
ttcattttgagctgaaatg

SEQ ID NO: 1155094 - DNA, 13 bp, Homo sapiens
ttcattttgcaga

SEQ ID NO: 1155095 - DNA, 18 bp, Homo sapiens
ttcatttttaaagcctgg

SEQ ID NO: 1155096 - DNA, 21 bp, Homo sapiens
ttcatttttgttatccttttt

SEQ ID NO: 1155097 - DNA, 23 bp, Homo sapiens
ttcatttttttcactggagttac

SEQ ID NO: 1155098 - DNA, 18 bp, Homo sapiens
ttcatttttttctctctg

SEQ ID NO: 1155099 - DNA, 17 bp, Homo sapiens
ttccaaaacctgcttcc

SEQ ID NO: 1155100 - DNA, 13 bp, Homo sapiens
ttccaaaatacaa

SEQ ID NO: 1155101 - DNA, 16 bp, Homo sapiens
ttccaaacatccaaaa

SEQ ID NO: 1155102 - DNA, 17 bp, Homo sapiens
ttccaaaccagtttatt

SEQ ID NO: 1155103 - DNA, 21 bp, Homo sapiens
ttccaaaccagtttattctgt

SEQ ID NO: 1155104 - DNA, 21 bp, Homo sapiens
ttccaaagaaaagtattgttt

SEQ ID NO: 1155105 - DNA, 14 bp, Homo sapiens
ttccaaagaaagtt

SEQ ID NO: 1155106 - DNA, 16 bp, Homo sapiens
ttccaaagaatatttt

SEQ ID NO: 1155107 - DNA, 22 bp, Homo sapiens
ttccaaagagtagaattgcatt

SEQ ID NO: 1155108 - DNA, 11 bp, Homo sapiens
ttccaaagcaa

SEQ ID NO: 1155109 - DNA, 20 bp, Homo sapiens
ttccaaagcacattgaaaga

SEQ ID NO: 1155110 - DNA, 23 bp, Homo sapiens
ttccaaagcctagacaacctttc

SEQ ID NO: 1155111 - DNA, 13 bp, Homo sapiens
ttccaaataaaac

SEQ ID NO: 1155112 - DNA, 17 bp, Homo sapiens
ttccaaataaaatgttc

SEQ ID NO: 1155113 - DNA, 20 bp, Homo sapiens
ttccaaataaaatgttccct

SEQ ID NO: 1155114 - DNA, 14 bp, Homo sapiens
ttccaaataaataa

SEQ ID NO: 1155115 - DNA, 22 bp, Homo sapiens
ttccaaatcctggaaggacaca

SEQ ID NO: 1155116 - DNA, 17 bp, Homo sapiens
ttccaaatgcaatttga

SEQ ID NO: 1155117 - DNA, 15 bp, Homo sapiens
ttccaaatgtccctc

SEQ ID NO: 1155118 - DNA, 19 bp, Homo sapiens
ttccaaattattaattgtc

SEQ ID NO: 1155119 - DNA, 13 bp, Homo sapiens
ttccaaattattt

SEQ ID NO: 1155120 - DNA, 15 bp, Homo sapiens
ttccaaattcagttt

SEQ ID NO: 1155121 - DNA, 15 bp, Homo sapiens
tacacaactttgcaa

SEQ ID NO: 1155122 - DNA, 21 bp, Homo sapiens
tacacaataaagcagtcctgt

SEQ ID NO: 1155123 - DNA, 15 bp, Homo sapiens
tacacaataagcaaa

SEQ ID NO: 1155124 - DNA, 17 bp, Homo sapiens
tacacaatcactccatt

SEQ ID NO: 1155125 - DNA, 20 bp, Homo sapiens
tacacaatggtttttaaatt

SEQ ID NO: 1155126 - DNA, 15 bp, Homo sapiens
tacacaattgtttta

SEQ ID NO: 1155127 - DNA, 10 bp, Homo sapiens
tacacacaca

SEQ ID NO: 1155128 - DNA, 15 bp, Homo sapiens
tacacacacaaacca

SEQ ID NO: 1155129 - DNA, 23 bp, Homo sapiens
tacacacacgttgacgggccgca

SEQ ID NO: 1155130 - DNA, 14 bp, Homo sapiens
tacacacatataca

SEQ ID NO: 1155131 - DNA, 17 bp, Homo sapiens
tacacacatatacatat

SEQ ID NO: 1155132 - DNA, 20 bp, Homo sapiens
tacacacatatacatatata

SEQ ID NO: 1155133 - DNA, 13 bp, Homo sapiens
tacacacccccag

SEQ ID NO: 1155134 - DNA, 17 bp, Homo sapiens
tacacacccgcctgaca

SEQ ID NO: 1155135 - DNA, 16 bp, Homo sapiens
tacacacgtaccttca

SEQ ID NO: 1155136 - DNA, 15 bp, Homo sapiens
tacacactgcatgtt

SEQ ID NO: 1155137 - DNA, 20 bp, Homo sapiens
tacacactgtcatgcttcat

SEQ ID NO: 1155138 - DNA, 20 bp, Homo sapiens
tacacagaaatgctgctggc

SEQ ID NO: 1155139 - DNA, 19 bp, Homo sapiens
tacacagagaaatacaaaa

SEQ ID NO: 1155140 - DNA, 13 bp, Homo sapiens
tacacagagaagg

SEQ ID NO: 1155141 - DNA, 18 bp, Homo sapiens
tacacagaggagtgcagc

SEQ ID NO: 1155142 - DNA, 17 bp, Homo sapiens
tacacagcacaccagcc

SEQ ID NO: 1155143 - DNA, 16 bp, Homo sapiens
tacacagcccaagagg

SEQ ID NO: 1155144 - DNA, 15 bp, Homo sapiens
tacacagctctagac

SEQ ID NO: 1155145 - DNA, 21 bp, Homo sapiens
tacacaggggccctgtacagt

SEQ ID NO: 1155146 - DNA, 23 bp, Homo sapiens
tacacagtaaaaacttgtactat

SEQ ID NO: 1155147 - DNA, 15 bp, Homo sapiens
tacacagtactttat

SEQ ID NO: 1155148 - DNA, 20 bp, Homo sapiens
tacacatacagaaagaagca

SEQ ID NO: 1155149 - DNA, 14 bp, Homo sapiens
tacacatacataca

SEQ ID NO: 1155150 - DNA, 16 bp, Homo sapiens
tacacatacatacaca

SEQ ID NO: 1155151 - DNA, 22 bp, Homo sapiens
tacacatctattctcaaagcta

SEQ ID NO: 1155152 - DNA, 14 bp, Homo sapiens
tacacatgtaaaat

SEQ ID NO: 1155153 - DNA, 13 bp, Homo sapiens
tacacattagatt

SEQ ID NO: 1155154 - DNA, 14 bp, Homo sapiens
tacacattagattt

SEQ ID NO: 1155155 - DNA, 19 bp, Homo sapiens
tacacattttattttatta

SEQ ID NO: 1155156 - DNA, 21 bp, Homo sapiens
tacacattttattttattatg

SEQ ID NO: 1155157 - DNA, 23 bp, Homo sapiens
tacacattttattttattatgca

SEQ ID NO: 1155158 - DNA, 22 bp, Homo sapiens
tacacattttcaaggactattt

SEQ ID NO: 1155159 - DNA, 19 bp, Homo sapiens
tacacatttttcagatata

SEQ ID NO: 1155160 - DNA, 21 bp, Homo sapiens
tacacatttttcagatataaa

SEQ ID NO: 1155161 - DNA, 19 bp, Homo sapiens
tacaccactacattctgtt

SEQ ID NO: 1155162 - DNA, 18 bp, Homo sapiens
tacaccagcattcctttt

SEQ ID NO: 1155163 - DNA, 12 bp, Homo sapiens
tacacccagcaa

SEQ ID NO: 1155164 - DNA, 18 bp, Homo sapiens
tacacccagttctgaata

SEQ ID NO: 1155165 - DNA, 19 bp, Homo sapiens
tacacccagttctgaataa

SEQ ID NO: 1155166 - DNA, 16 bp, Homo sapiens
tacacccctgtgctcc

SEQ ID NO: 1155167 - DNA, 23 bp, Homo sapiens
tacacccctgtgctcccctgcca

SEQ ID NO: 1155168 - DNA, 16 bp, Homo sapiens
tacaccgactagccag

SEQ ID NO: 1155169 - DNA, 21 bp, Homo sapiens
tacacctggaccatttgattg

SEQ ID NO: 1155170 - DNA, 13 bp, Homo sapiens
tacacctggctga

SEQ ID NO: 1155171 - DNA, 14 bp, Homo sapiens
tacacctggctgag

SEQ ID NO: 1155172 - DNA, 23 bp, Homo sapiens
tacacctggctgaggttcctctg

SEQ ID NO: 1155173 - DNA, 23 bp, Homo sapiens
tacacctttatctttccatggga

SEQ ID NO: 1155174 - DNA, 18 bp, Homo sapiens
tacacgaatagacatcaa

SEQ ID NO: 1155175 - DNA, 21 bp, Homo sapiens
tacacgaatagacatcaaact

SEQ ID NO: 1155176 - DNA, 20 bp, Homo sapiens
tacacggactgaggtgcctg

SEQ ID NO: 1155177 - DNA, 17 bp, Homo sapiens
tacacgtctggaccccg

SEQ ID NO: 1155178 - DNA, 14 bp, Homo sapiens
tacactaatatatg

SEQ ID NO: 1155179 - DNA, 23 bp, Homo sapiens
tacactaccaaacactcagtcca

SEQ ID NO: 1155180 - DNA, 23 bp, Homo sapiens
tacactagcttgaacttagatgt

SEQ ID NO: 1155181 - DNA, 14 bp, Homo sapiens
tacactatgaaatt

SEQ ID NO: 1155182 - DNA, 20 bp, Homo sapiens
tacactatgataaagttgta

SEQ ID NO: 1155183 - DNA, 15 bp, Homo sapiens
tacactccagcctga

SEQ ID NO: 1155184 - DNA, 13 bp, Homo sapiens
tacactctgctgt

SEQ ID NO: 1155185 - DNA, 15 bp, Homo sapiens
tacactctgctgttt

SEQ ID NO: 1155186 - DNA, 23 bp, Homo sapiens
tacactctgctgtttgacacctc

SEQ ID NO: 1155187 - DNA, 23 bp, Homo sapiens
tacactctgtattgaaaatggct

SEQ ID NO: 1155188 - DNA, 15 bp, Homo sapiens
tacactgaggactgt

SEQ ID NO: 1155189 - DNA, 16 bp, Homo sapiens
tacactgcactttgtt

SEQ ID NO: 1155190 - DNA, 17 bp, Homo sapiens
tacactgcactttgttt

SEQ ID NO: 1155191 - DNA, 23 bp, Homo sapiens
tacactgcactttgtttagaaaa

SEQ ID NO: 1155192 - DNA, 21 bp, Homo sapiens
tacactggaggagagaagaat

SEQ ID NO: 1155193 - DNA, 22 bp, Homo sapiens
tacactgggagaggtgccagca

SEQ ID NO: 1155194 - DNA, 16 bp, Homo sapiens
tacactggtatttata

SEQ ID NO: 1155195 - DNA, 11 bp, Homo sapiens
tacactggtct

SEQ ID NO: 1155196 - DNA, 16 bp, Homo sapiens
tacactggtctaatgt

SEQ ID NO: 1155197 - DNA, 13 bp, Homo sapiens
tacactggtgtgt

SEQ ID NO: 1155198 - DNA, 15 bp, Homo sapiens
tacactgtgaactca

SEQ ID NO: 1155199 - DNA, 20 bp, Homo sapiens
tacactgtttcaaactttac

SEQ ID NO: 1155200 - DNA, 22 bp, Homo sapiens
tacactgtttcaaactttacta

SEQ ID NO: 1155201 - DNA, 17 bp, Homo sapiens
tacacttggtgtactgg

SEQ ID NO: 1155202 - DNA, 15 bp, Homo sapiens
tacagaaaaatactt

SEQ ID NO: 1155203 - DNA, 16 bp, Homo sapiens
tacagaaaaatacttt

SEQ ID NO: 1155204 - DNA, 23 bp, Homo sapiens
tacagaaagaagcagttctcaca

SEQ ID NO: 1155205 - DNA, 19 bp, Homo sapiens
tacagaaataacagctggg

SEQ ID NO: 1155206 - DNA, 20 bp, Homo sapiens
tacagaaataacagctgggg

SEQ ID NO: 1155207 - DNA, 18 bp, Homo sapiens
tacagaaattagccgggc

SEQ ID NO: 1155208 - DNA, 13 bp, Homo sapiens
tacagaaattgaa

SEQ ID NO: 1155209 - DNA, 17 bp, Homo sapiens
tacagaacacaaatgtc

SEQ ID NO: 1155210 - DNA, 17 bp, Homo sapiens
tacagaaccaaatcgtg

SEQ ID NO: 1155211 - DNA, 18 bp, Homo sapiens
tacagaagcccatgtctt

SEQ ID NO: 1155212 - DNA, 20 bp, Homo sapiens
tacagaagcccatgtcttct

SEQ ID NO: 1155213 - DNA, 23 bp, Homo sapiens
tacagaataatccagtattgctg

SEQ ID NO: 1155214 - DNA, 17 bp, Homo sapiens
tacagaatagggtggca

SEQ ID NO: 1155215 - DNA, 17 bp, Homo sapiens
tacagaatcattgctta

SEQ ID NO: 1155216 - DNA, 14 bp, Homo sapiens
tacagaatgcatta

SEQ ID NO: 1155217 - DNA, 15 bp, Homo sapiens
tacagaatgcattaa

SEQ ID NO: 1155218 - DNA, 14 bp, Homo sapiens
tacagaattagaaa

SEQ ID NO: 1155219 - DNA, 19 bp, Homo sapiens
tacagaattgactgcagtt

SEQ ID NO: 1155220 - DNA, 14 bp, Homo sapiens
tacagaatttgaat

SEQ ID NO: 1155221 - DNA, 16 bp, Homo sapiens
tacagaatttgaatta

SEQ ID NO: 1155222 - DNA, 17 bp, Homo sapiens
tacagaatttgaattat

SEQ ID NO: 1155223 - DNA, 14 bp, Homo sapiens
tacagacactaagt

SEQ ID NO: 1155224 - DNA, 18 bp, Homo sapiens
tacagacagacatacata

SEQ ID NO: 1155225 - DNA, 18 bp, Homo sapiens
tacagacatatttaactg

SEQ ID NO: 1155226 - DNA, 20 bp, Homo sapiens
tacagacatggagatgtaaa

SEQ ID NO: 1155227 - DNA, 21 bp, Homo sapiens
tacagaccgaactgttgtata

SEQ ID NO: 1155228 - DNA, 19 bp, Homo sapiens
tacagaccgagaggccagt

SEQ ID NO: 1155229 - DNA, 20 bp, Homo sapiens
tacagaccgagaggccagtt

SEQ ID NO: 1155230 - DNA, 17 bp, Homo sapiens
tacagacgctgctgtca

SEQ ID NO: 1155231 - DNA, 14 bp, Homo sapiens
tacagactgtttta

SEQ ID NO: 1155232 - DNA, 14 bp, Homo sapiens
tacagacttctcca

SEQ ID NO: 1155233 - DNA, 15 bp, Homo sapiens
tacagagactctatt

SEQ ID NO: 1155234 - DNA, 22 bp, Homo sapiens
tacagagactctattttaatgt

SEQ ID NO: 1155235 - DNA, 18 bp, Homo sapiens
tacagagaggagaaacac

SEQ ID NO: 1155236 - DNA, 23 bp, Homo sapiens
tacagagaggatacatttaataa

SEQ ID NO: 1155237 - DNA, 11 bp, Homo sapiens
tacagagccac

SEQ ID NO: 1155238 - DNA, 15 bp, Homo sapiens
tacagagcttccctg

SEQ ID NO: 1155239 - DNA, 16 bp, Homo sapiens
tacagagcttccctga

SEQ ID NO: 1155240 - DNA, 11 bp, Homo sapiens
tacagaggaga

SEQ ID NO: 1155241 - DNA, 17 bp, Homo sapiens
tacagaggatgcctttt

SEQ ID NO: 1155242 - DNA, 19 bp, Homo sapiens
tacagaggatgccttttct

SEQ ID NO: 1155243 - DNA, 23 bp, Homo sapiens
tacagaggatgccttttctgtga

SEQ ID NO: 1155244 - DNA, 20 bp, Homo sapiens
tacagaggtctctgccggct

SEQ ID NO: 1155245 - DNA, 20 bp, Homo sapiens
ttccaaatttttttcttagg

SEQ ID NO: 1155246 - DNA, 21 bp, Homo sapiens
ttccaacaatggggtgggccc

SEQ ID NO: 1155247 - DNA, 18 bp, Homo sapiens
ttccaacaccacagacac

SEQ ID NO: 1155248 - DNA, 21 bp, Homo sapiens
ttccaacaccacagacacaca

SEQ ID NO: 1155249 - DNA, 23 bp, Homo sapiens
ttccaacaccacagacacacaca

SEQ ID NO: 1155250 - DNA, 23 bp, Homo sapiens
ttccaacagctcaagtcttccct

SEQ ID NO: 1155251 - DNA, 14 bp, Homo sapiens
ttccaacagtgagt

SEQ ID NO: 1155252 - DNA, 13 bp, Homo sapiens
ttccaaccaggca

SEQ ID NO: 1155253 - DNA, 15 bp, Homo sapiens
ttccaacttgaagga

SEQ ID NO: 1155254 - DNA, 21 bp, Homo sapiens
ttccaacttgaaggattgcat

SEQ ID NO: 1155255 - DNA, 23 bp, Homo sapiens
ttccaacttgaaggattgcatcc

SEQ ID NO: 1155256 - DNA, 13 bp, Homo sapiens
ttccaagaaagat

SEQ ID NO: 1155257 - DNA, 21 bp, Homo sapiens
ttccaagaaagatccaccctc

SEQ ID NO: 1155258 - DNA, 16 bp, Homo sapiens
ttccaagacatgtctg

SEQ ID NO: 1155259 - DNA, 21 bp, Homo sapiens
ttccaagacatgtctgttcta

SEQ ID NO: 1155260 - DNA, 14 bp, Homo sapiens
ttccaagacattgt

SEQ ID NO: 1155261 - DNA, 16 bp, Homo sapiens
ttccaagacattgtca

SEQ ID NO: 1155262 - DNA, 17 bp, Homo sapiens
ttccaagactgaagact

SEQ ID NO: 1155263 - DNA, 20 bp, Homo sapiens
ttccaagactgaagactgca

SEQ ID NO: 1155264 - DNA, 15 bp, Homo sapiens
ttccaagcatgacaa

SEQ ID NO: 1155265 - DNA, 19 bp, Homo sapiens
ttccaagctccaaatccaa

SEQ ID NO: 1155266 - DNA, 20 bp, Homo sapiens
ttccaaggaaaattgaaagt

SEQ ID NO: 1155267 - DNA, 13 bp, Homo sapiens
ttccaaggagacc

SEQ ID NO: 1155268 - DNA, 16 bp, Homo sapiens
ttccaaggagttccat

SEQ ID NO: 1155269 - DNA, 13 bp, Homo sapiens
ttccaaggccctg

SEQ ID NO: 1155270 - DNA, 18 bp, Homo sapiens
ttccaaggccctgctttt

SEQ ID NO: 1155271 - DNA, 21 bp, Homo sapiens
ttccaaggctttaaagctgag

SEQ ID NO: 1155272 - DNA, 15 bp, Homo sapiens
ttccaagggtactaa

SEQ ID NO: 1155273 - DNA, 19 bp, Homo sapiens
ttccaaggtcactcttggt

SEQ ID NO: 1155274 - DNA, 16 bp, Homo sapiens
ttccaagtgcattttt

SEQ ID NO: 1155275 - DNA, 20 bp, Homo sapiens
ttccaagtgcatttttctta

SEQ ID NO: 1155276 - DNA, 13 bp, Homo sapiens
ttccaataaacca

SEQ ID NO: 1155277 - DNA, 21 bp, Homo sapiens
ttccaataaaccaggtttaga

SEQ ID NO: 1155278 - DNA, 17 bp, Homo sapiens
ttccaatagaaagaaac

SEQ ID NO: 1155279 - DNA, 20 bp, Homo sapiens
ttccaatagaaagaaactaa

SEQ ID NO: 1155280 - DNA, 15 bp, Homo sapiens
ttccaatcacagtgt

SEQ ID NO: 1155281 - DNA, 16 bp, Homo sapiens
ttccaatcacagtgtt

SEQ ID NO: 1155282 - DNA, 13 bp, Homo sapiens
ttccaatgtttta

SEQ ID NO: 1155283 - DNA, 13 bp, Homo sapiens
ttccaatttggaa

SEQ ID NO: 1155284 - DNA, 21 bp, Homo sapiens
ttccaattttctggaatacat

SEQ ID NO: 1155285 - DNA, 17 bp, Homo sapiens
ttccacaaaattagaaa

SEQ ID NO: 1155286 - DNA, 22 bp, Homo sapiens
ttccacaaaattagaaaggaca

SEQ ID NO: 1155287 - DNA, 14 bp, Homo sapiens
ttccacaaagaaaa

SEQ ID NO: 1155288 - DNA, 22 bp, Homo sapiens
ttccacaagtgccgcaaattgt

SEQ ID NO: 1155289 - DNA, 15 bp, Homo sapiens
ttccacaattcttct

SEQ ID NO: 1155290 - DNA, 15 bp, Homo sapiens
ttccacaccttttat

SEQ ID NO: 1155291 - DNA, 22 bp, Homo sapiens
ttccacaccttttattgacaca

SEQ ID NO: 1155292 - DNA, 13 bp, Homo sapiens
ttccacagaggac

SEQ ID NO: 1155293 - DNA, 22 bp, Homo sapiens
ttccacagaggacacagagaag

SEQ ID NO: 1155294 - DNA, 15 bp, Homo sapiens
ttccacagcagcaga

SEQ ID NO: 1155295 - DNA, 21 bp, Homo sapiens
ttccacagcctgcaagtcagt

SEQ ID NO: 1155296 - DNA, 21 bp, Homo sapiens
ttccacaggacacgaaggctg

SEQ ID NO: 1155297 - DNA, 20 bp, Homo sapiens
ttccacagttatcttagctg

SEQ ID NO: 1155298 - DNA, 15 bp, Homo sapiens
ttccacatgtacata

SEQ ID NO: 1155299 - DNA, 15 bp, Homo sapiens
ttccaccacagccag

SEQ ID NO: 1155300 - DNA, 14 bp, Homo sapiens
ttccaccaggccgt

SEQ ID NO: 1155301 - DNA, 14 bp, Homo sapiens
ttccacccattccc

SEQ ID NO: 1155302 - DNA, 19 bp, Homo sapiens
ttccaccccaagagaactc

SEQ ID NO: 1155303 - DNA, 18 bp, Homo sapiens
ttccaccccctccctggc

SEQ ID NO: 1155304 - DNA, 20 bp, Homo sapiens
ttccaccccctccctggcct

SEQ ID NO: 1155305 - DNA, 13 bp, Homo sapiens
ttccacccgtctc

SEQ ID NO: 1155306 - DNA, 15 bp, Homo sapiens
ttccacctcacctct

SEQ ID NO: 1155307 - DNA, 14 bp, Homo sapiens
ttccacctccacca

SEQ ID NO: 1155308 - DNA, 14 bp, Homo sapiens
ttccacctccctcc

SEQ ID NO: 1155309 - DNA, 18 bp, Homo sapiens
ttccacctgtgccctcac

SEQ ID NO: 1155310 - DNA, 13 bp, Homo sapiens
ttccaccttaaat

SEQ ID NO: 1155311 - DNA, 14 bp, Homo sapiens
ttccaccttaaatt

SEQ ID NO: 1155312 - DNA, 15 bp, Homo sapiens
ttccacgcagcaccc

SEQ ID NO: 1155313 - DNA, 16 bp, Homo sapiens
ttccacgcagcaccct

SEQ ID NO: 1155314 - DNA, 19 bp, Homo sapiens
ttccacgctgtctccagac

SEQ ID NO: 1155315 - DNA, 18 bp, Homo sapiens
ttccacggaaacagaact

SEQ ID NO: 1155316 - DNA, 15 bp, Homo sapiens
ttccacggagccact

SEQ ID NO: 1155317 - DNA, 21 bp, Homo sapiens
ttccacggagccactcctctg

SEQ ID NO: 1155318 - DNA, 14 bp, Homo sapiens
ttccactaaaaata

SEQ ID NO: 1155319 - DNA, 22 bp, Homo sapiens
ttccactacacctggctgaggt

SEQ ID NO: 1155320 - DNA, 15 bp, Homo sapiens
ttccactactgctac

SEQ ID NO: 1155321 - DNA, 15 bp, Homo sapiens
ttccactattttcaa

SEQ ID NO: 1155322 - DNA, 16 bp, Homo sapiens
ttccactcaaaatatg

SEQ ID NO: 1155323 - DNA, 20 bp, Homo sapiens
ttccactcgatgatgcttct

SEQ ID NO: 1155324 - DNA, 19 bp, Homo sapiens
ttccactcgtgtgtttcta

SEQ ID NO: 1155325 - DNA, 21 bp, Homo sapiens
ttccactctggattcagcctt

SEQ ID NO: 1155326 - DNA, 23 bp, Homo sapiens
ttccactctggattcagccttct

SEQ ID NO: 1155327 - DNA, 21 bp, Homo sapiens
ttccactgaaaatttaacagt

SEQ ID NO: 1155328 - DNA, 13 bp, Homo sapiens
ttccactgagacc

SEQ ID NO: 1155329 - DNA, 13 bp, Homo sapiens
ttccactgagctc

SEQ ID NO: 1155330 - DNA, 14 bp, Homo sapiens
ttccactgagctcc

SEQ ID NO: 1155331 - DNA, 16 bp, Homo sapiens
ttccactgagggcagt

SEQ ID NO: 1155332 - DNA, 12 bp, Homo sapiens
ttccactggact

SEQ ID NO: 1155333 - DNA, 20 bp, Homo sapiens
ttccactgtcaagaaagagc

SEQ ID NO: 1155334 - DNA, 15 bp, Homo sapiens
ttccacttcttcctt

SEQ ID NO: 1155335 - DNA, 21 bp, Homo sapiens
ttccagaaaaccccagcatcc

SEQ ID NO: 1155336 - DNA, 14 bp, Homo sapiens
ttccagaaaggata

SEQ ID NO: 1155337 - DNA, 19 bp, Homo sapiens
ttccagaacagccctcggc

SEQ ID NO: 1155338 - DNA, 18 bp, Homo sapiens
ttccagaagaacaacttt

SEQ ID NO: 1155339 - DNA, 18 bp, Homo sapiens
ttccagaagatgccctcc

SEQ ID NO: 1155340 - DNA, 19 bp, Homo sapiens
ttccagaagatgccctcca

SEQ ID NO: 1155341 - DNA, 16 bp, Homo sapiens
ttccagaatcccaaga

SEQ ID NO: 1155342 - DNA, 14 bp, Homo sapiens
ttccagaatgctgt

SEQ ID NO: 1155343 - DNA, 19 bp, Homo sapiens
ttccagaatgctgtacatc

SEQ ID NO: 1155344 - DNA, 20 bp, Homo sapiens
ttccagacttccttgagaca

SEQ ID NO: 1155345 - DNA, 20 bp, Homo sapiens
ttccagagagtcctctggat

SEQ ID NO: 1155346 - DNA, 17 bp, Homo sapiens
ttccagagagtggctcc

SEQ ID NO: 1155347 - DNA, 18 bp, Homo sapiens
ttccagagagtggctcct

SEQ ID NO: 1155348 - DNA, 21 bp, Homo sapiens
ttccagagagtggctcctccc

SEQ ID NO: 1155349 - DNA, 14 bp, Homo sapiens
ttccagagccagaa

SEQ ID NO: 1155350 - DNA, 18 bp, Homo sapiens
ttccagaggacagctctg

SEQ ID NO: 1155351 - DNA, 22 bp, Homo sapiens
ttccagaggccctaggcgggat

SEQ ID NO: 1155352 - DNA, 16 bp, Homo sapiens
ttccagaggggttgag

SEQ ID NO: 1155353 - DNA, 16 bp, Homo sapiens
ttccagaggtattcct

SEQ ID NO: 1155354 - DNA, 21 bp, Homo sapiens
ttccagagtccggaggcagca

SEQ ID NO: 1155355 - DNA, 20 bp, Homo sapiens
ttccagagttgttgtttgcc

SEQ ID NO: 1155356 - DNA, 23 bp, Homo sapiens
ttccagataaccagctgtaacac

SEQ ID NO: 1155357 - DNA, 21 bp, Homo sapiens
ttccagatatccacataaatg

SEQ ID NO: 1155358 - DNA, 16 bp, Homo sapiens
ttccagattcctatga

SEQ ID NO: 1155359 - DNA, 17 bp, Homo sapiens
ttccagcaaaatggaag

SEQ ID NO: 1155360 - DNA, 15 bp, Homo sapiens
ttccagcaagcaaag

SEQ ID NO: 1155361 - DNA, 15 bp, Homo sapiens
ttccagcaataagaa

SEQ ID NO: 1155362 - DNA, 19 bp, Homo sapiens
ttccagcaataagaaatga

SEQ ID NO: 1155363 - DNA, 22 bp, Homo sapiens
ttccagcaattctcctgcctca

SEQ ID NO: 1155364 - DNA, 16 bp, Homo sapiens
ttccagcagaagacaa

SEQ ID NO: 1155365 - DNA, 22 bp, Homo sapiens
ttccagcagaagacaaaaagac

SEQ ID NO: 1155366 - DNA, 19 bp, Homo sapiens
ttccagcagtgaaacttgt

SEQ ID NO: 1155367 - DNA, 21 bp, Homo sapiens
ttccagcagtgaaacttgtgc

SEQ ID NO: 1155368 - DNA, 22 bp, Homo sapiens
ttccagcagtgaatgctagaca

SEQ ID NO: 1155369 - DNA, 20 bp, Homo sapiens
tacagagtggcccctcacct

SEQ ID NO: 1155370 - DNA, 14 bp, Homo sapiens
tacagataattcat

SEQ ID NO: 1155371 - DNA, 22 bp, Homo sapiens
tacagataattcatttgtattg

SEQ ID NO: 1155372 - DNA, 23 bp, Homo sapiens
tacagatctgcaccaccatgccc

SEQ ID NO: 1155373 - DNA, 23 bp, Homo sapiens
tacagattaacctgaaagaacat

SEQ ID NO: 1155374 - DNA, 13 bp, Homo sapiens
tacagcaaaaagg

SEQ ID NO: 1155375 - DNA, 15 bp, Homo sapiens
tacagcactactctg

SEQ ID NO: 1155376 - DNA, 16 bp, Homo sapiens
tacagcattgtctttg

SEQ ID NO: 1155377 - DNA, 22 bp, Homo sapiens
tacagcctagggcagacaatag

SEQ ID NO: 1155378 - DNA, 19 bp, Homo sapiens
tacagcgagaggcagagaa

SEQ ID NO: 1155379 - DNA, 16 bp, Homo sapiens
tacagctatgaagtgc

SEQ ID NO: 1155380 - DNA, 20 bp, Homo sapiens
tacagctctcccctcccttg

SEQ ID NO: 1155381 - DNA, 20 bp, Homo sapiens
tacagctctggccacaacag

SEQ ID NO: 1155382 - DNA, 14 bp, Homo sapiens
tacagctcttggca

SEQ ID NO: 1155383 - DNA, 17 bp, Homo sapiens
tacagctcttggcattt

SEQ ID NO: 1155384 - DNA, 16 bp, Homo sapiens
tacagctgcctaccta

SEQ ID NO: 1155385 - DNA, 10 bp, Homo sapiens
tacagctggc

SEQ ID NO: 1155386 - DNA, 23 bp, Homo sapiens
tacagctggctatctactaccag

SEQ ID NO: 1155387 - DNA, 14 bp, Homo sapiens
tacagctgtattgt

SEQ ID NO: 1155388 - DNA, 18 bp, Homo sapiens
tacagctgtattgtctga

SEQ ID NO: 1155389 - DNA, 17 bp, Homo sapiens
tacagctgtgttattct

SEQ ID NO: 1155390 - DNA, 16 bp, Homo sapiens
tacagctgtttaagat

SEQ ID NO: 1155391 - DNA, 18 bp, Homo sapiens
tacagcttcattatctga

SEQ ID NO: 1155392 - DNA, 15 bp, Homo sapiens
tacaggaaaaaccga

SEQ ID NO: 1155393 - DNA, 13 bp, Homo sapiens
tacaggaacttca

SEQ ID NO: 1155394 - DNA, 18 bp, Homo sapiens
tacaggaaggtagaaata

SEQ ID NO: 1155395 - DNA, 14 bp, Homo sapiens
tacaggacatatat

SEQ ID NO: 1155396 - DNA, 18 bp, Homo sapiens
tacaggactgtaaagatt

SEQ ID NO: 1155397 - DNA, 18 bp, Homo sapiens
tacaggagaggcagcatg

SEQ ID NO: 1155398 - DNA, 18 bp, Homo sapiens
tacaggatggtgggcagg

SEQ ID NO: 1155399 - DNA, 19 bp, Homo sapiens
tacaggatggtgggcagga

SEQ ID NO: 1155400 - DNA, 19 bp, Homo sapiens
tacaggcaccgagaatgtt

SEQ ID NO: 1155401 - DNA, 15 bp, Homo sapiens
tacaggcatgtgcca

SEQ ID NO: 1155402 - DNA, 22 bp, Homo sapiens
tacaggcatgtgccaccacgcc

SEQ ID NO: 1155403 - DNA, 19 bp, Homo sapiens
tacaggccctgctcctgca

SEQ ID NO: 1155404 - DNA, 18 bp, Homo sapiens
tacaggcctcttcctgtt

SEQ ID NO: 1155405 - DNA, 15 bp, Homo sapiens
tacaggcgtgagcca

SEQ ID NO: 1155406 - DNA, 22 bp, Homo sapiens
tacagggcgagactctgtctca

SEQ ID NO: 1155407 - DNA, 22 bp, Homo sapiens
tacaggggcagtcagtggaggg

SEQ ID NO: 1155408 - DNA, 12 bp, Homo sapiens
tacaggggccat

SEQ ID NO: 1155409 - DNA, 20 bp, Homo sapiens
tacaggggtagtttgtttta

SEQ ID NO: 1155410 - DNA, 17 bp, Homo sapiens
tacaggggttagcctgg

SEQ ID NO: 1155411 - DNA, 22 bp, Homo sapiens
tacagggtagcaggtaccactg

SEQ ID NO: 1155412 - DNA, 13 bp, Homo sapiens
tacagggtgactc

SEQ ID NO: 1155413 - DNA, 14 bp, Homo sapiens
tacagggtgactca

SEQ ID NO: 1155414 - DNA, 15 bp, Homo sapiens
tacaggttgtgaaat

SEQ ID NO: 1155415 - DNA, 18 bp, Homo sapiens
tacaggttgtgaaataat

SEQ ID NO: 1155416 - DNA, 22 bp, Homo sapiens
tacaggttgtgaaataattttt

SEQ ID NO: 1155417 - DNA, 16 bp, Homo sapiens
tacagtaactaatttt

SEQ ID NO: 1155418 - DNA, 14 bp, Homo sapiens
tacagtaagcatag

SEQ ID NO: 1155419 - DNA, 18 bp, Homo sapiens
tacagtaagctgctctat

SEQ ID NO: 1155420 - DNA, 21 bp, Homo sapiens
tacagtaatcccatttcccaa

SEQ ID NO: 1155421 - DNA, 13 bp, Homo sapiens
tacagtaatgaaa

SEQ ID NO: 1155422 - DNA, 17 bp, Homo sapiens
tacagtaatgaaatgtt

SEQ ID NO: 1155423 - DNA, 21 bp, Homo sapiens
tacagtaatgaaatgtttact

SEQ ID NO: 1155424 - DNA, 13 bp, Homo sapiens
tacagtacacatc

SEQ ID NO: 1155425 - DNA, 17 bp, Homo sapiens
tacagtagattttccaa

SEQ ID NO: 1155426 - DNA, 21 bp, Homo sapiens
tacagtagattttccaaatgt

SEQ ID NO: 1155427 - DNA, 17 bp, Homo sapiens
tacagtagctgctacct

SEQ ID NO: 1155428 - DNA, 13 bp, Homo sapiens
tacagtaggagcc

SEQ ID NO: 1155429 - DNA, 14 bp, Homo sapiens
tacagtaggagccc

SEQ ID NO: 1155430 - DNA, 19 bp, Homo sapiens
tacagtatccaatgtcttt

SEQ ID NO: 1155431 - DNA, 15 bp, Homo sapiens
tacagtatctcaggg

SEQ ID NO: 1155432 - DNA, 18 bp, Homo sapiens
tacagtatctcagggcct

SEQ ID NO: 1155433 - DNA, 17 bp, Homo sapiens
tacagtatgatgaaaat

SEQ ID NO: 1155434 - DNA, 20 bp, Homo sapiens
tacagtatgggggttgtaaa

SEQ ID NO: 1155435 - DNA, 22 bp, Homo sapiens
tacagtatgggggttgtaaatt

SEQ ID NO: 1155436 - DNA, 14 bp, Homo sapiens
tacagtcatctgtc

SEQ ID NO: 1155437 - DNA, 22 bp, Homo sapiens
tacagtcattggaataaggcat

SEQ ID NO: 1155438 - DNA, 17 bp, Homo sapiens
tacagtctctttcttcc

SEQ ID NO: 1155439 - DNA, 19 bp, Homo sapiens
tacagtctctttcttcctt

SEQ ID NO: 1155440 - DNA, 22 bp, Homo sapiens
tacagtctctttcttcctttct

SEQ ID NO: 1155441 - DNA, 23 bp, Homo sapiens
tacagtctctttcttcctttcta

SEQ ID NO: 1155442 - DNA, 13 bp, Homo sapiens
tacagtctgtcat

SEQ ID NO: 1155443 - DNA, 16 bp, Homo sapiens
tacagtctgtcatgaa

SEQ ID NO: 1155444 - DNA, 14 bp, Homo sapiens
tacagtcttccaca

SEQ ID NO: 1155445 - DNA, 17 bp, Homo sapiens
tacagtgaattgtcttt

SEQ ID NO: 1155446 - DNA, 18 bp, Homo sapiens
tacagtgaattgtctttt

SEQ ID NO: 1155447 - DNA, 19 bp, Homo sapiens
tacagtgactccctgggag

SEQ ID NO: 1155448 - DNA, 12 bp, Homo sapiens
tacagtgagcca

SEQ ID NO: 1155449 - DNA, 22 bp, Homo sapiens
tacagtgaggactcggccactg

SEQ ID NO: 1155450 - DNA, 22 bp, Homo sapiens
tacagtggttttatactgaagg

SEQ ID NO: 1155451 - DNA, 13 bp, Homo sapiens
tacagtgtacagt

SEQ ID NO: 1155452 - DNA, 13 bp, Homo sapiens
tacagtgtctttt

SEQ ID NO: 1155453 - DNA, 16 bp, Homo sapiens
tacagtgttattttct

SEQ ID NO: 1155454 - DNA, 19 bp, Homo sapiens
tacagtgttattttctttg

SEQ ID NO: 1155455 - DNA, 15 bp, Homo sapiens
tacagtgtttatcct

SEQ ID NO: 1155456 - DNA, 23 bp, Homo sapiens
tacagtgtttatcctttcatata

SEQ ID NO: 1155457 - DNA, 16 bp, Homo sapiens
tacagttaactctccc

SEQ ID NO: 1155458 - DNA, 23 bp, Homo sapiens
tacagttactcagaattctctag

SEQ ID NO: 1155459 - DNA, 22 bp, Homo sapiens
tacagttagggttttgcaataa

SEQ ID NO: 1155460 - DNA, 17 bp, Homo sapiens
tacagttataaaattaa

SEQ ID NO: 1155461 - DNA, 14 bp, Homo sapiens
tacagttctttcct

SEQ ID NO: 1155462 - DNA, 18 bp, Homo sapiens
tacagttctttcctcttt

SEQ ID NO: 1155463 - DNA, 21 bp, Homo sapiens
tacagttctttcctctttctg

SEQ ID NO: 1155464 - DNA, 15 bp, Homo sapiens
tacagttgttggcct

SEQ ID NO: 1155465 - DNA, 18 bp, Homo sapiens
tacagttgttggcctccg

SEQ ID NO: 1155466 - DNA, 15 bp, Homo sapiens
tacagtttaggagta

SEQ ID NO: 1155467 - DNA, 19 bp, Homo sapiens
tacagtttatattgtggaa

SEQ ID NO: 1155468 - DNA, 22 bp, Homo sapiens
tacagtttattgatattcaata

SEQ ID NO: 1155469 - DNA, 22 bp, Homo sapiens
tacagtttgactttttggaatt

SEQ ID NO: 1155470 - DNA, 15 bp, Homo sapiens
tacagtttgtgtttt

SEQ ID NO: 1155471 - DNA, 17 bp, Homo sapiens
tacagtttgtgttttaa

SEQ ID NO: 1155472 - DNA, 18 bp, Homo sapiens
tacagtttgttagtatga

SEQ ID NO: 1155473 - DNA, 15 bp, Homo sapiens
tacagttttaactgt

SEQ ID NO: 1155474 - DNA, 21 bp, Homo sapiens
tacagttttaactgtggatat

SEQ ID NO: 1155475 - DNA, 15 bp, Homo sapiens
tacagttttcagaaa

SEQ ID NO: 1155476 - DNA, 20 bp, Homo sapiens
tacagttttctagcaatttt

SEQ ID NO: 1155477 - DNA, 15 bp, Homo sapiens
tacataaaagaattt

SEQ ID NO: 1155478 - DNA, 13 bp, Homo sapiens
tacataaattcca

SEQ ID NO: 1155479 - DNA, 13 bp, Homo sapiens
tacataacacatt

SEQ ID NO: 1155480 - DNA, 13 bp, Homo sapiens
tacataactgaaa

SEQ ID NO: 1155481 - DNA, 17 bp, Homo sapiens
tacataactgaaaatgt

SEQ ID NO: 1155482 - DNA, 21 bp, Homo sapiens
tacataactgaaaatgtgcta

SEQ ID NO: 1155483 - DNA, 16 bp, Homo sapiens
tacataagataaatgt

SEQ ID NO: 1155484 - DNA, 17 bp, Homo sapiens
tacataagataaatgtg

SEQ ID NO: 1155485 - DNA, 18 bp, Homo sapiens
tacataagataaatgtgc

SEQ ID NO: 1155486 - DNA, 19 bp, Homo sapiens
tacataagataaatgtgct

SEQ ID NO: 1155487 - DNA, 22 bp, Homo sapiens
tacataagcggcgtaagtttaa

SEQ ID NO: 1155488 - DNA, 18 bp, Homo sapiens
tacataaggatgactttt

SEQ ID NO: 1155489 - DNA, 12 bp, Homo sapiens
tacataatctgt

SEQ ID NO: 1155490 - DNA, 21 bp, Homo sapiens
tacataatgcgtgcataccac

SEQ ID NO: 1155491 - DNA, 24 bp, Homo sapiens
tacataatgcgtgcataccacttt

SEQ ID NO: 1155492 - DNA, 14 bp, Homo sapiens
tacataattgatta

SEQ ID NO: 1155493 - DNA, 24 bp, Homo sapiens
ttccagcatgaggtatctaaggat

SEQ ID NO: 1155494 - DNA, 20 bp, Homo sapiens
ttccagccacattgagactt

SEQ ID NO: 1155495 - DNA, 14 bp, Homo sapiens
ttccagcccctctg

SEQ ID NO: 1155496 - DNA, 16 bp, Homo sapiens
ttccagccttatgtgt

SEQ ID NO: 1155497 - DNA, 18 bp, Homo sapiens
ttccagccttatgtgtta

SEQ ID NO: 1155498 - DNA, 16 bp, Homo sapiens
ttccagctctgccccc

SEQ ID NO: 1155499 - DNA, 13 bp, Homo sapiens
ttccagctgctgt

SEQ ID NO: 1155500 - DNA, 20 bp, Homo sapiens
ttccagctgctgtcttctgg

SEQ ID NO: 1155501 - DNA, 22 bp, Homo sapiens
ttccagctgctgtcttctggac

SEQ ID NO: 1155502 - DNA, 13 bp, Homo sapiens
ttccagcttagaa

SEQ ID NO: 1155503 - DNA, 22 bp, Homo sapiens
ttccaggaaactccacatctgc

SEQ ID NO: 1155504 - DNA, 17 bp, Homo sapiens
ttccaggaatgctgggc

SEQ ID NO: 1155505 - DNA, 14 bp, Homo sapiens
ttccaggaattcct

SEQ ID NO: 1155506 - DNA, 23 bp, Homo sapiens
ttccaggagaaagccgggggagg

SEQ ID NO: 1155507 - DNA, 21 bp, Homo sapiens
ttccaggcccctgaggactgg

SEQ ID NO: 1155508 - DNA, 16 bp, Homo sapiens
ttccaggccctccagt

SEQ ID NO: 1155509 - DNA, 17 bp, Homo sapiens
ttccaggccctccagtg

SEQ ID NO: 1155510 - DNA, 20 bp, Homo sapiens
ttccaggcctgatcttgcct

SEQ ID NO: 1155511 - DNA, 20 bp, Homo sapiens
ttccaggctcttcctggacc

SEQ ID NO: 1155512 - DNA, 13 bp, Homo sapiens
ttccagggctggg

SEQ ID NO: 1155513 - DNA, 18 bp, Homo sapiens
ttccaggggaacctgcca

SEQ ID NO: 1155514 - DNA, 21 bp, Homo sapiens
ttccagggtcaaagtacagaa

SEQ ID NO: 1155515 - DNA, 18 bp, Homo sapiens
ttccagggtccctctgtg

SEQ ID NO: 1155516 - DNA, 17 bp, Homo sapiens
ttccaggtccaaaccct

SEQ ID NO: 1155517 - DNA, 17 bp, Homo sapiens
ttccaggtttaagctgt

SEQ ID NO: 1155518 - DNA, 15 bp, Homo sapiens
ttccaggtttaagta

SEQ ID NO: 1155519 - DNA, 16 bp, Homo sapiens
ttccagtaactttttt

SEQ ID NO: 1155520 - DNA, 17 bp, Homo sapiens
ttccagtacctttgtca

SEQ ID NO: 1155521 - DNA, 15 bp, Homo sapiens
ttccagtattgaaaa

SEQ ID NO: 1155522 - DNA, 19 bp, Homo sapiens
ttccagtattgaaaacttc

SEQ ID NO: 1155523 - DNA, 12 bp, Homo sapiens
ttccagtcacat

SEQ ID NO: 1155524 - DNA, 17 bp, Homo sapiens
ttccagtcacattgcca

SEQ ID NO: 1155525 - DNA, 11 bp, Homo sapiens
ttccagtctgg

SEQ ID NO: 1155526 - DNA, 20 bp, Homo sapiens
ttccagtcttcctgacactt

SEQ ID NO: 1155527 - DNA, 17 bp, Homo sapiens
ttccagtgaacattccc

SEQ ID NO: 1155528 - DNA, 23 bp, Homo sapiens
ttccagtgaacattcccagccca

SEQ ID NO: 1155529 - DNA, 14 bp, Homo sapiens
ttccagtgagtgta

SEQ ID NO: 1155530 - DNA, 11 bp, Homo sapiens
ttccagtgcta

SEQ ID NO: 1155531 - DNA, 18 bp, Homo sapiens
ttccagtggaccctggac

SEQ ID NO: 1155532 - DNA, 21 bp, Homo sapiens
ttccagttaacctattttgtg

SEQ ID NO: 1155533 - DNA, 11 bp, Homo sapiens
ttccagttccc

SEQ ID NO: 1155534 - DNA, 14 bp, Homo sapiens
ttccagtttctcct

SEQ ID NO: 1155535 - DNA, 23 bp, Homo sapiens
ttccataatctggactcctctgt

SEQ ID NO: 1155536 - DNA, 12 bp, Homo sapiens
ttccataattat

SEQ ID NO: 1155537 - DNA, 15 bp, Homo sapiens
ttccatacttctctc

SEQ ID NO: 1155538 - DNA, 15 bp, Homo sapiens
ttccatatccctgcc

SEQ ID NO: 1155539 - DNA, 17 bp, Homo sapiens
ttccatatccctgccca

SEQ ID NO: 1155540 - DNA, 20 bp, Homo sapiens
ttccatatggattttctatt

SEQ ID NO: 1155541 - DNA, 19 bp, Homo sapiens
ttccatcaggttccatccc

SEQ ID NO: 1155542 - DNA, 13 bp, Homo sapiens
ttccatcatcact

SEQ ID NO: 1155543 - DNA, 16 bp, Homo sapiens
ttccatcatcactgta

SEQ ID NO: 1155544 - DNA, 17 bp, Homo sapiens
ttccatcatcactgtaa

SEQ ID NO: 1155545 - DNA, 21 bp, Homo sapiens
ttccatcatcactgtaaagac

SEQ ID NO: 1155546 - DNA, 15 bp, Homo sapiens
ttccatcatgtctgt

SEQ ID NO: 1155547 - DNA, 14 bp, Homo sapiens
ttccatcatttctg

SEQ ID NO: 1155548 - DNA, 19 bp, Homo sapiens
ttccatccacctttcccaa

SEQ ID NO: 1155549 - DNA, 21 bp, Homo sapiens
ttccatccctaccccctaaga

SEQ ID NO: 1155550 - DNA, 18 bp, Homo sapiens
ttccatctagcagctggc

SEQ ID NO: 1155551 - DNA, 18 bp, Homo sapiens
ttccatgaagaccacatc

SEQ ID NO: 1155552 - DNA, 16 bp, Homo sapiens
ttccatgaaggcagag

SEQ ID NO: 1155553 - DNA, 20 bp, Homo sapiens
ttccatgaagtttgaacttc

SEQ ID NO: 1155554 - DNA, 12 bp, Homo sapiens
ttccatgaatgt

SEQ ID NO: 1155555 - DNA, 20 bp, Homo sapiens
ttccatgaatgtatcaggaa

SEQ ID NO: 1155556 - DNA, 13 bp, Homo sapiens
ttccatgaatttt

SEQ ID NO: 1155557 - DNA, 16 bp, Homo sapiens
ttccatgacctcccct

SEQ ID NO: 1155558 - DNA, 17 bp, Homo sapiens
ttccatgacctcccctc

SEQ ID NO: 1155559 - DNA, 10 bp, Homo sapiens
ttccatgagc

SEQ ID NO: 1155560 - DNA, 21 bp, Homo sapiens
ttccatgagttatcatgaatt

SEQ ID NO: 1155561 - DNA, 15 bp, Homo sapiens
ttccatgcagccttg

SEQ ID NO: 1155562 - DNA, 13 bp, Homo sapiens
ttccatgcctgag

SEQ ID NO: 1155563 - DNA, 14 bp, Homo sapiens
ttccatgcctgagg

SEQ ID NO: 1155564 - DNA, 22 bp, Homo sapiens
ttccatgcctgagggtggagac

SEQ ID NO: 1155565 - DNA, 23 bp, Homo sapiens
ttccatgcctgagggtggagact

SEQ ID NO: 1155566 - DNA, 18 bp, Homo sapiens
ttccatgcgtgtttctga

SEQ ID NO: 1155567 - DNA, 14 bp, Homo sapiens
ttccatgctgtgcg

SEQ ID NO: 1155568 - DNA, 17 bp, Homo sapiens
ttccatggaaataaaaa

SEQ ID NO: 1155569 - DNA, 11 bp, Homo sapiens
ttccatggcaa

SEQ ID NO: 1155570 - DNA, 17 bp, Homo sapiens
ttccatgggcccgctgc

SEQ ID NO: 1155571 - DNA, 16 bp, Homo sapiens
ttccatggtgtatatg

SEQ ID NO: 1155572 - DNA, 21 bp, Homo sapiens
ttccatggtgtgatcgtctga

SEQ ID NO: 1155573 - DNA, 21 bp, Homo sapiens
ttccatgtcgcctctgcattc

SEQ ID NO: 1155574 - DNA, 14 bp, Homo sapiens
ttccattatgattc

SEQ ID NO: 1155575 - DNA, 16 bp, Homo sapiens
ttccattatgattctt

SEQ ID NO: 1155576 - DNA, 12 bp, Homo sapiens
ttccattgttgt

SEQ ID NO: 1155577 - DNA, 21 bp, Homo sapiens
ttccattgttgtcaaatgccc

SEQ ID NO: 1155578 - DNA, 17 bp, Homo sapiens
ttccatttacagtctct

SEQ ID NO: 1155579 - DNA, 18 bp, Homo sapiens
ttccatttacttaagact

SEQ ID NO: 1155580 - DNA, 19 bp, Homo sapiens
ttccatttatgctggttaa

SEQ ID NO: 1155581 - DNA, 22 bp, Homo sapiens
ttccatttatttatgaaaaaat

SEQ ID NO: 1155582 - DNA, 17 bp, Homo sapiens
ttccatttgcatttgtt

SEQ ID NO: 1155583 - DNA, 12 bp, Homo sapiens
ttccattttatg

SEQ ID NO: 1155584 - DNA, 14 bp, Homo sapiens
ttccattttccccc

SEQ ID NO: 1155585 - DNA, 22 bp, Homo sapiens
ttccatttttcctctgttcaca

SEQ ID NO: 1155586 - DNA, 16 bp, Homo sapiens
ttcccaaacgcctccc

SEQ ID NO: 1155587 - DNA, 18 bp, Homo sapiens
ttcccaaactacagaata

SEQ ID NO: 1155588 - DNA, 20 bp, Homo sapiens
ttcccaaactacagaataat

SEQ ID NO: 1155589 - DNA, 16 bp, Homo sapiens
ttcccaaagcactttt

SEQ ID NO: 1155590 - DNA, 20 bp, Homo sapiens
ttcccaaagtcctctgctcc

SEQ ID NO: 1155591 - DNA, 13 bp, Homo sapiens
ttcccaacacaaa

SEQ ID NO: 1155592 - DNA, 15 bp, Homo sapiens
ttcccaacacaaaga

SEQ ID NO: 1155593 - DNA, 15 bp, Homo sapiens
ttcccaactctagct

SEQ ID NO: 1155594 - DNA, 21 bp, Homo sapiens
ttcccaagaaaggaaaccttt

SEQ ID NO: 1155595 - DNA, 14 bp, Homo sapiens
ttcccaaggaagct

SEQ ID NO: 1155596 - DNA, 17 bp, Homo sapiens
ttcccaagtatgcctta

SEQ ID NO: 1155597 - DNA, 21 bp, Homo sapiens
ttcccaagtatgccttaagca

SEQ ID NO: 1155598 - DNA, 18 bp, Homo sapiens
ttcccaatctgaaattca

SEQ ID NO: 1155599 - DNA, 15 bp, Homo sapiens
ttcccacacggcagc

SEQ ID NO: 1155600 - DNA, 17 bp, Homo sapiens
ttcccacacggcagccc

SEQ ID NO: 1155601 - DNA, 23 bp, Homo sapiens
ttcccacacggcagcccccccct

SEQ ID NO: 1155602 - DNA, 18 bp, Homo sapiens
ttcccacaggacatttct

SEQ ID NO: 1155603 - DNA, 15 bp, Homo sapiens
ttcccaccaaggtct

SEQ ID NO: 1155604 - DNA, 19 bp, Homo sapiens
ttcccaccattcctgcctt

SEQ ID NO: 1155605 - DNA, 22 bp, Homo sapiens
ttcccaccctccacctctcacg

SEQ ID NO: 1155606 - DNA, 18 bp, Homo sapiens
ttcccacgacaaaaacaa

SEQ ID NO: 1155607 - DNA, 21 bp, Homo sapiens
ttcccagaccttaagacactg

SEQ ID NO: 1155608 - DNA, 23 bp, Homo sapiens
ttcccagaccttaagacactgtg

SEQ ID NO: 1155609 - DNA, 12 bp, Homo sapiens
ttcccagactct

SEQ ID NO: 1155610 - DNA, 19 bp, Homo sapiens
ttcccagagacaggaaaat

SEQ ID NO: 1155611 - DNA, 23 bp, Homo sapiens
ttcccagagcaaaataattttaa

SEQ ID NO: 1155612 - DNA, 19 bp, Homo sapiens
ttcccagagtcatctgatt

SEQ ID NO: 1155613 - DNA, 23 bp, Homo sapiens
ttcccagcagggccactcccggc

SEQ ID NO: 1155614 - DNA, 13 bp, Homo sapiens
ttcccagcccagc

SEQ ID NO: 1155615 - DNA, 20 bp, Homo sapiens
ttcccagccctcatcccact

SEQ ID NO: 1155616 - DNA, 18 bp, Homo sapiens
ttcccagcggttcctgtg

SEQ ID NO: 1155617 - DNA, 19 bp, Homo sapiens
ttcccagctctccctctgg

SEQ ID NO: 1155618 - DNA, 15 bp, Homo sapiens
tacataattgattaa

SEQ ID NO: 1155619 - DNA, 19 bp, Homo sapiens
tacataattgattaaaatc

SEQ ID NO: 1155620 - DNA, 23 bp, Homo sapiens
tacataattgattaaaatctctt

SEQ ID NO: 1155621 - DNA, 19 bp, Homo sapiens
tacataattttttattcaa

SEQ ID NO: 1155622 - DNA, 22 bp, Homo sapiens
tacataattttttattcaagtt

SEQ ID NO: 1155623 - DNA, 9 bp, Homo sapiens
tacatacat

SEQ ID NO: 1155624 - DNA, 12 bp, Homo sapiens
tacatacataca

SEQ ID NO: 1155625 - DNA, 16 bp, Homo sapiens
tacatacatacatata

SEQ ID NO: 1155626 - DNA, 18 bp, Homo sapiens
tacatacatacatatata

SEQ ID NO: 1155627 - DNA, 14 bp, Homo sapiens
tacatacatatata

SEQ ID NO: 1155628 - DNA, 22 bp, Homo sapiens
tacatacatatatatctgataa

SEQ ID NO: 1155629 - DNA, 13 bp, Homo sapiens
tacatacattgta

SEQ ID NO: 1155630 - DNA, 15 bp, Homo sapiens
tacatactgcatctt

SEQ ID NO: 1155631 - DNA, 13 bp, Homo sapiens
tacatactgctgt

SEQ ID NO: 1155632 - DNA, 15 bp, Homo sapiens
tacatactttatcaa

SEQ ID NO: 1155633 - DNA, 19 bp, Homo sapiens
tacatactttatcaatgtg

SEQ ID NO: 1155634 - DNA, 22 bp, Homo sapiens
tacatagatcagccattaaaat

SEQ ID NO: 1155635 - DNA, 20 bp, Homo sapiens
tacatagttatttttctctt

SEQ ID NO: 1155636 - DNA, 23 bp, Homo sapiens
tacatatataaaactaaggcttt

SEQ ID NO: 1155637 - DNA, 15 bp, Homo sapiens
tacatatatatctga

SEQ ID NO: 1155638 - DNA, 13 bp, Homo sapiens
tacatatatctac

SEQ ID NO: 1155639 - DNA, 17 bp, Homo sapiens
tacatatcgctgacttc

SEQ ID NO: 1155640 - DNA, 23 bp, Homo sapiens
tacatatcgctgacttcatggaa

SEQ ID NO: 1155641 - DNA, 16 bp, Homo sapiens
tacatatgagtgtgga

SEQ ID NO: 1155642 - DNA, 16 bp, Homo sapiens
tacatatggatgttac

SEQ ID NO: 1155643 - DNA, 17 bp, Homo sapiens
tacatatgtaaaataaa

SEQ ID NO: 1155644 - DNA, 18 bp, Homo sapiens
tacatattactgttgcat

SEQ ID NO: 1155645 - DNA, 23 bp, Homo sapiens
tacatattactgttgcatttact

SEQ ID NO: 1155646 - DNA, 22 bp, Homo sapiens
tacatattgttagggtcagcca

SEQ ID NO: 1155647 - DNA, 17 bp, Homo sapiens
tacatatttgtggaata

SEQ ID NO: 1155648 - DNA, 23 bp, Homo sapiens
tacatcaagtccatctgacaaaa

SEQ ID NO: 1155649 - DNA, 23 bp, Homo sapiens
tacatcacctttttgacttttcc

SEQ ID NO: 1155650 - DNA, 12 bp, Homo sapiens
tacatcactgct

SEQ ID NO: 1155651 - DNA, 13 bp, Homo sapiens
tacatcactgctt

SEQ ID NO: 1155652 - DNA, 19 bp, Homo sapiens
tacatcactgcttgatgaa

SEQ ID NO: 1155653 - DNA, 23 bp, Homo sapiens
tacatcactgcttgatgaagcaa

SEQ ID NO: 1155654 - DNA, 20 bp, Homo sapiens
tacatccaaagcagacagct

SEQ ID NO: 1155655 - DNA, 17 bp, Homo sapiens
tacatcccaaaggatga

SEQ ID NO: 1155656 - DNA, 20 bp, Homo sapiens
tacatcccaaaggatgagaa

SEQ ID NO: 1155657 - DNA, 22 bp, Homo sapiens
tacatctattttggattgtata

SEQ ID NO: 1155658 - DNA, 15 bp, Homo sapiens
tacatctctccccaa

SEQ ID NO: 1155659 - DNA, 12 bp, Homo sapiens
tacatctgctgt

SEQ ID NO: 1155660 - DNA, 14 bp, Homo sapiens
tacatctgctgtgt

SEQ ID NO: 1155661 - DNA, 16 bp, Homo sapiens
tacatctgctgtgtgg

SEQ ID NO: 1155662 - DNA, 17 bp, Homo sapiens
tacatctgctgtgtgga

SEQ ID NO: 1155663 - DNA, 15 bp, Homo sapiens
tacatctggctggaa

SEQ ID NO: 1155664 - DNA, 18 bp, Homo sapiens
tacatctgtaaagaaaac

SEQ ID NO: 1155665 - DNA, 16 bp, Homo sapiens
tacatcttttctaatc

SEQ ID NO: 1155666 - DNA, 17 bp, Homo sapiens
tacatcttttctaatca

SEQ ID NO: 1155667 - DNA, 17 bp, Homo sapiens
tacatgaaaacacattt

SEQ ID NO: 1155668 - DNA, 19 bp, Homo sapiens
tacatgaaaacacattttt

SEQ ID NO: 1155669 - DNA, 13 bp, Homo sapiens
tacatgaaacaga

SEQ ID NO: 1155670 - DNA, 14 bp, Homo sapiens
tacatgaaacagaa

SEQ ID NO: 1155671 - DNA, 18 bp, Homo sapiens
tacatgaagcttcatgca

SEQ ID NO: 1155672 - DNA, 18 bp, Homo sapiens
tacatgaattgcatttta

SEQ ID NO: 1155673 - DNA, 20 bp, Homo sapiens
tacatgacagatattttatc

SEQ ID NO: 1155674 - DNA, 19 bp, Homo sapiens
tacatgacatcaaaatgag

SEQ ID NO: 1155675 - DNA, 16 bp, Homo sapiens
tacatgactgggcctc

SEQ ID NO: 1155676 - DNA, 17 bp, Homo sapiens
tacatgactgggcctcc

SEQ ID NO: 1155677 - DNA, 15 bp, Homo sapiens
tacatgactgtttct

SEQ ID NO: 1155678 - DNA, 17 bp, Homo sapiens
tacatgactgtttcttt

SEQ ID NO: 1155679 - DNA, 16 bp, Homo sapiens
tacatgatacattttt

SEQ ID NO: 1155680 - DNA, 17 bp, Homo sapiens
tacatgcaacagaagtg

SEQ ID NO: 1155681 - DNA, 22 bp, Homo sapiens
tacatgcaatttattaaaatga

SEQ ID NO: 1155682 - DNA, 20 bp, Homo sapiens
tacatgcatataatgaataa

SEQ ID NO: 1155683 - DNA, 20 bp, Homo sapiens
tacatgctatgctgaagaca

SEQ ID NO: 1155684 - DNA, 17 bp, Homo sapiens
tacatgctgaaaaatat

SEQ ID NO: 1155685 - DNA, 14 bp, Homo sapiens
tacatgctggggtc

SEQ ID NO: 1155686 - DNA, 15 bp, Homo sapiens
tacatgctttgtgaa

SEQ ID NO: 1155687 - DNA, 16 bp, Homo sapiens
tacatgctttgtgaac

SEQ ID NO: 1155688 - DNA, 18 bp, Homo sapiens
tacatggaataacatgta

SEQ ID NO: 1155689 - DNA, 19 bp, Homo sapiens
tacatggaataacatgtaa

SEQ ID NO: 1155690 - DNA, 16 bp, Homo sapiens
tacatggccagtgtga

SEQ ID NO: 1155691 - DNA, 20 bp, Homo sapiens
tacatggcgccctgcctcct

SEQ ID NO: 1155692 - DNA, 14 bp, Homo sapiens
tacatgtaatttga

SEQ ID NO: 1155693 - DNA, 18 bp, Homo sapiens
tacatgtacctatagaaa

SEQ ID NO: 1155694 - DNA, 19 bp, Homo sapiens
tacatgtacctatagaaat

SEQ ID NO: 1155695 - DNA, 17 bp, Homo sapiens
tacatgtactccagagg

SEQ ID NO: 1155696 - DNA, 20 bp, Homo sapiens
tacatgtatctggtttgtca

SEQ ID NO: 1155697 - DNA, 15 bp, Homo sapiens
tacatgtatgcctgc

SEQ ID NO: 1155698 - DNA, 19 bp, Homo sapiens
tacatgtattgcacattgt

SEQ ID NO: 1155699 - DNA, 20 bp, Homo sapiens
tacatgtattgcacattgta

SEQ ID NO: 1155700 - DNA, 20 bp, Homo sapiens
tacatgtgccgaatgtgcag

SEQ ID NO: 1155701 - DNA, 16 bp, Homo sapiens
tacatgtgtaaaggtt

SEQ ID NO: 1155702 - DNA, 16 bp, Homo sapiens
tacatgtgtgggtgct

SEQ ID NO: 1155703 - DNA, 16 bp, Homo sapiens
tacatgttcttgtcat

SEQ ID NO: 1155704 - DNA, 22 bp, Homo sapiens
tacatgttcttgtcataaaatg

SEQ ID NO: 1155705 - DNA, 18 bp, Homo sapiens
tacatgttggaaatgtgt

SEQ ID NO: 1155706 - DNA, 20 bp, Homo sapiens
tacatgtttaaattgtaaat

SEQ ID NO: 1155707 - DNA, 13 bp, Homo sapiens
tacatgtttgcac

SEQ ID NO: 1155708 - DNA, 18 bp, Homo sapiens
tacatgtttgttggttga

SEQ ID NO: 1155709 - DNA, 15 bp, Homo sapiens
tacatgttttttcat

SEQ ID NO: 1155710 - DNA, 22 bp, Homo sapiens
tacatgttttttcatttgtaaa

SEQ ID NO: 1155711 - DNA, 15 bp, Homo sapiens
tacattaaacaatga

SEQ ID NO: 1155712 - DNA, 21 bp, Homo sapiens
tacattaaactcaaatgtaat

SEQ ID NO: 1155713 - DNA, 21 bp, Homo sapiens
tacattaaagccctgtgttaa

SEQ ID NO: 1155714 - DNA, 15 bp, Homo sapiens
tacattaaggagcag

SEQ ID NO: 1155715 - DNA, 12 bp, Homo sapiens
tacattaatgtt

SEQ ID NO: 1155716 - DNA, 15 bp, Homo sapiens
tacattaatgttaat

SEQ ID NO: 1155717 - DNA, 22 bp, Homo sapiens
tacattaattattattgctgtt

SEQ ID NO: 1155718 - DNA, 23 bp, Homo sapiens
tacattaattattattgctgttg

SEQ ID NO: 1155719 - DNA, 19 bp, Homo sapiens
tacattagcagtttgcttt

SEQ ID NO: 1155720 - DNA, 19 bp, Homo sapiens
tacattattaaacgatttc

SEQ ID NO: 1155721 - DNA, 13 bp, Homo sapiens
tacattcaaattt

SEQ ID NO: 1155722 - DNA, 14 bp, Homo sapiens
tacattcaaatttg

SEQ ID NO: 1155723 - DNA, 15 bp, Homo sapiens
tacattcaaatttgt

SEQ ID NO: 1155724 - DNA, 13 bp, Homo sapiens
tacattccccaga

SEQ ID NO: 1155725 - DNA, 17 bp, Homo sapiens
tacattccctctcctgc

SEQ ID NO: 1155726 - DNA, 17 bp, Homo sapiens
tacattcctaactagaa

SEQ ID NO: 1155727 - DNA, 21 bp, Homo sapiens
tacattcctaactagaattag

SEQ ID NO: 1155728 - DNA, 13 bp, Homo sapiens
tacattcctcagc

SEQ ID NO: 1155729 - DNA, 17 bp, Homo sapiens
tacattcctcagctgcc

SEQ ID NO: 1155730 - DNA, 23 bp, Homo sapiens
tacattcctcagctgccaagcac

SEQ ID NO: 1155731 - DNA, 19 bp, Homo sapiens
tacattctgcctagagtgt

SEQ ID NO: 1155732 - DNA, 12 bp, Homo sapiens
tacattctgtta

SEQ ID NO: 1155733 - DNA, 13 bp, Homo sapiens
tacattctgttaa

SEQ ID NO: 1155734 - DNA, 15 bp, Homo sapiens
tacattctttattct

SEQ ID NO: 1155735 - DNA, 19 bp, Homo sapiens
tacattgagcatttgaaag

SEQ ID NO: 1155736 - DNA, 18 bp, Homo sapiens
tacattgatacaaagtac

SEQ ID NO: 1155737 - DNA, 11 bp, Homo sapiens
tacattgctta

SEQ ID NO: 1155738 - DNA, 17 bp, Homo sapiens
tacattgcttaaaatat

SEQ ID NO: 1155739 - DNA, 21 bp, Homo sapiens
tacattgtgagctctggttat

SEQ ID NO: 1155740 - DNA, 13 bp, Homo sapiens
tacattgtgtgaa

SEQ ID NO: 1155741 - DNA, 20 bp, Homo sapiens
tacattgtgtgaaaaaagaa

SEQ ID NO: 1155742 - DNA, 17 bp, Homo sapiens
tacattgttacctctat

SEQ ID NO: 1155743 - DNA, 12 bp, Homo sapiens
ttcccaggccca

SEQ ID NO: 1155744 - DNA, 16 bp, Homo sapiens
ttcccaggcctttgga

SEQ ID NO: 1155745 - DNA, 19 bp, Homo sapiens
ttcccaggtaatttaaatt

SEQ ID NO: 1155746 - DNA, 14 bp, Homo sapiens
ttcccagtataaga

SEQ ID NO: 1155747 - DNA, 12 bp, Homo sapiens
ttcccagtattt

SEQ ID NO: 1155748 - DNA, 23 bp, Homo sapiens
ttcccagtgacacttcagagagc

SEQ ID NO: 1155749 - DNA, 15 bp, Homo sapiens
ttcccagtgggctgt

SEQ ID NO: 1155750 - DNA, 15 bp, Homo sapiens
ttcccatcactcttt

SEQ ID NO: 1155751 - DNA, 14 bp, Homo sapiens
ttcccatcgctgtc

SEQ ID NO: 1155752 - DNA, 17 bp, Homo sapiens
ttcccatctccagggaa

SEQ ID NO: 1155753 - DNA, 18 bp, Homo sapiens
ttcccatgactcttggag

SEQ ID NO: 1155754 - DNA, 15 bp, Homo sapiens
ttcccatgactgcac

SEQ ID NO: 1155755 - DNA, 15 bp, Homo sapiens
ttcccatggggaggg

SEQ ID NO: 1155756 - DNA, 23 bp, Homo sapiens
ttcccatggggagggattctggt

SEQ ID NO: 1155757 - DNA, 20 bp, Homo sapiens
ttcccatggtgtatgtggtt

SEQ ID NO: 1155758 - DNA, 15 bp, Homo sapiens
ttcccattgtgacag

SEQ ID NO: 1155759 - DNA, 17 bp, Homo sapiens
ttcccattgtggctcct

SEQ ID NO: 1155760 - DNA, 18 bp, Homo sapiens
ttcccatttctctacact

SEQ ID NO: 1155761 - DNA, 17 bp, Homo sapiens
ttcccatttgtgccaga

SEQ ID NO: 1155762 - DNA, 20 bp, Homo sapiens
ttcccatttgtgccagagga

SEQ ID NO: 1155763 - DNA, 17 bp, Homo sapiens
ttcccattttgcaaaat

SEQ ID NO: 1155764 - DNA, 20 bp, Homo sapiens
ttccccaacggggtggggag

SEQ ID NO: 1155765 - DNA, 22 bp, Homo sapiens
ttccccaacggggtggggaggg

SEQ ID NO: 1155766 - DNA, 15 bp, Homo sapiens
ttccccacacagggc

SEQ ID NO: 1155767 - DNA, 23 bp, Homo sapiens
ttccccactgacagcctcccacc

SEQ ID NO: 1155768 - DNA, 17 bp, Homo sapiens
ttccccactgcacacac

SEQ ID NO: 1155769 - DNA, 18 bp, Homo sapiens
ttccccactgcctgccca

SEQ ID NO: 1155770 - DNA, 20 bp, Homo sapiens
ttccccagaggctcccaatc

SEQ ID NO: 1155771 - DNA, 16 bp, Homo sapiens
ttccccagcaactctg

SEQ ID NO: 1155772 - DNA, 22 bp, Homo sapiens
ttccccagcagggtcttttcat

SEQ ID NO: 1155773 - DNA, 12 bp, Homo sapiens
ttccccagccct

SEQ ID NO: 1155774 - DNA, 16 bp, Homo sapiens
ttccccagctccagca

SEQ ID NO: 1155775 - DNA, 19 bp, Homo sapiens
ttccccagctttgctgcct

SEQ ID NO: 1155776 - DNA, 12 bp, Homo sapiens
ttccccatcccg

SEQ ID NO: 1155777 - DNA, 15 bp, Homo sapiens
ttccccatctgggtc

SEQ ID NO: 1155778 - DNA, 18 bp, Homo sapiens
ttccccatcttctaaacc

SEQ ID NO: 1155779 - DNA, 23 bp, Homo sapiens
ttccccatctttgatccttctga

SEQ ID NO: 1155780 - DNA, 18 bp, Homo sapiens
ttcccccaacctcagact

SEQ ID NO: 1155781 - DNA, 12 bp, Homo sapiens
ttcccccaccac

SEQ ID NO: 1155782 - DNA, 18 bp, Homo sapiens
ttcccccaccagctaagg

SEQ ID NO: 1155783 - DNA, 18 bp, Homo sapiens
ttcccccacccctccacg

SEQ ID NO: 1155784 - DNA, 14 bp, Homo sapiens
ttcccccactaccg

SEQ ID NO: 1155785 - DNA, 17 bp, Homo sapiens
ttcccccactactgcag

SEQ ID NO: 1155786 - DNA, 23 bp, Homo sapiens
ttcccccagcaacgcccctccaa

SEQ ID NO: 1155787 - DNA, 15 bp, Homo sapiens
ttcccccagccctgt

SEQ ID NO: 1155788 - DNA, 21 bp, Homo sapiens
ttcccccagtacctccaagca

SEQ ID NO: 1155789 - DNA, 21 bp, Homo sapiens
ttcccccatcccctttcctcc

SEQ ID NO: 1155790 - DNA, 18 bp, Homo sapiens
ttcccccatccctaccac

SEQ ID NO: 1155791 - DNA, 18 bp, Homo sapiens
ttcccccatgtggctgaa

SEQ ID NO: 1155792 - DNA, 16 bp, Homo sapiens
ttcccccccctttcct

SEQ ID NO: 1155793 - DNA, 20 bp, Homo sapiens
ttcccccctctcctcccagc

SEQ ID NO: 1155794 - DNA, 22 bp, Homo sapiens
ttcccccctctcctcccagctg

SEQ ID NO: 1155795 - DNA, 12 bp, Homo sapiens
ttccccctaaac

SEQ ID NO: 1155796 - DNA, 19 bp, Homo sapiens
ttccccctccaatcccacc

SEQ ID NO: 1155797 - DNA, 13 bp, Homo sapiens
ttccccctcctca

SEQ ID NO: 1155798 - DNA, 22 bp, Homo sapiens
ttccccctgtttcagaggctca

SEQ ID NO: 1155799 - DNA, 23 bp, Homo sapiens
ttcccccttgatcgacttcttgg

SEQ ID NO: 1155800 - DNA, 19 bp, Homo sapiens
ttcccccttttctgcattt

SEQ ID NO: 1155801 - DNA, 20 bp, Homo sapiens
ttccccgaagagtcagcccc

SEQ ID NO: 1155802 - DNA, 18 bp, Homo sapiens
ttccccgtcccctgcagc

SEQ ID NO: 1155803 - DNA, 21 bp, Homo sapiens
ttccccgtcccctgcagcctg

SEQ ID NO: 1155804 - DNA, 15 bp, Homo sapiens
ttcccctaagtggat

SEQ ID NO: 1155805 - DNA, 19 bp, Homo sapiens
ttcccctacacctccctcc

SEQ ID NO: 1155806 - DNA, 13 bp, Homo sapiens
ttcccctacagaa

SEQ ID NO: 1155807 - DNA, 15 bp, Homo sapiens
ttcccctcagagctc

SEQ ID NO: 1155808 - DNA, 21 bp, Homo sapiens
ttcccctcccccactcctcta

SEQ ID NO: 1155809 - DNA, 14 bp, Homo sapiens
ttcccctccctacc

SEQ ID NO: 1155810 - DNA, 16 bp, Homo sapiens
ttcccctccctggctc

SEQ ID NO: 1155811 - DNA, 13 bp, Homo sapiens
ttcccctctccct

SEQ ID NO: 1155812 - DNA, 21 bp, Homo sapiens
ttcccctctcccttccctcct

SEQ ID NO: 1155813 - DNA, 18 bp, Homo sapiens
ttcccctcttgtctcccc

SEQ ID NO: 1155814 - DNA, 21 bp, Homo sapiens
ttcccctgagagtttcctcag

SEQ ID NO: 1155815 - DNA, 11 bp, Homo sapiens
ttcccctggcc

SEQ ID NO: 1155816 - DNA, 13 bp, Homo sapiens
ttcccctggcctt

SEQ ID NO: 1155817 - DNA, 12 bp, Homo sapiens
ttcccctgggca

SEQ ID NO: 1155818 - DNA, 15 bp, Homo sapiens
ttcccctgtggggat

SEQ ID NO: 1155819 - DNA, 14 bp, Homo sapiens
ttcccctgttcact

SEQ ID NO: 1155820 - DNA, 17 bp, Homo sapiens
ttcccctgttcactcta

SEQ ID NO: 1155821 - DNA, 21 bp, Homo sapiens
ttccccttccactgagggcag

SEQ ID NO: 1155822 - DNA, 12 bp, Homo sapiens
ttccccttccta

SEQ ID NO: 1155823 - DNA, 13 bp, Homo sapiens
ttccccttcctaa

SEQ ID NO: 1155824 - DNA, 14 bp, Homo sapiens
ttccccttcctaag

SEQ ID NO: 1155825 - DNA, 22 bp, Homo sapiens
ttccccttgcccagggctcagc

SEQ ID NO: 1155826 - DNA, 19 bp, Homo sapiens
ttccccttgtctccctggt

SEQ ID NO: 1155827 - DNA, 14 bp, Homo sapiens
ttcccctttcccca

SEQ ID NO: 1155828 - DNA, 17 bp, Homo sapiens
ttcccctttccccactc

SEQ ID NO: 1155829 - DNA, 14 bp, Homo sapiens
ttcccctttcctgt

SEQ ID NO: 1155830 - DNA, 19 bp, Homo sapiens
ttcccctttcctgtcccac

SEQ ID NO: 1155831 - DNA, 16 bp, Homo sapiens
ttcccctttgtcctgc

SEQ ID NO: 1155832 - DNA, 18 bp, Homo sapiens
ttccccttttgcctggct

SEQ ID NO: 1155833 - DNA, 20 bp, Homo sapiens
ttccccttttgcctggctgt

SEQ ID NO: 1155834 - DNA, 17 bp, Homo sapiens
ttcccgacccagccagc

SEQ ID NO: 1155835 - DNA, 15 bp, Homo sapiens
ttcccgagggagctg

SEQ ID NO: 1155836 - DNA, 21 bp, Homo sapiens
ttcccgatggtctctctccct

SEQ ID NO: 1155837 - DNA, 23 bp, Homo sapiens
ttcccggagcacagccctgggag

SEQ ID NO: 1155838 - DNA, 17 bp, Homo sapiens
ttcccgggccagggctg

SEQ ID NO: 1155839 - DNA, 14 bp, Homo sapiens
ttcccggtcccgag

SEQ ID NO: 1155840 - DNA, 15 bp, Homo sapiens
ttcccggtcccgagt

SEQ ID NO: 1155841 - DNA, 23 bp, Homo sapiens
ttcccgtggaacgtttttcctgt

SEQ ID NO: 1155842 - DNA, 13 bp, Homo sapiens
ttcccgttcttaa

SEQ ID NO: 1155843 - DNA, 17 bp, Homo sapiens
ttcccgtttctccacct

SEQ ID NO: 1155844 - DNA, 13 bp, Homo sapiens
ttccctaaactgc

SEQ ID NO: 1155845 - DNA, 16 bp, Homo sapiens
ttccctaatctatggt

SEQ ID NO: 1155846 - DNA, 17 bp, Homo sapiens
ttccctacagaaaagaa

SEQ ID NO: 1155847 - DNA, 21 bp, Homo sapiens
ttccctagaaagccatattcc

SEQ ID NO: 1155848 - DNA, 19 bp, Homo sapiens
ttccctaggggacacttcc

SEQ ID NO: 1155849 - DNA, 15 bp, Homo sapiens
ttccctattagagaa

SEQ ID NO: 1155850 - DNA, 19 bp, Homo sapiens
ttccctcaccccctcccac

SEQ ID NO: 1155851 - DNA, 22 bp, Homo sapiens
ttccctcaccccctcccacccc

SEQ ID NO: 1155852 - DNA, 20 bp, Homo sapiens
ttccctcacctttcccatct

SEQ ID NO: 1155853 - DNA, 15 bp, Homo sapiens
ttccctccccctcct

SEQ ID NO: 1155854 - DNA, 19 bp, Homo sapiens
ttccctccgggcaggggag

SEQ ID NO: 1155855 - DNA, 19 bp, Homo sapiens
ttccctcctagctctccca

SEQ ID NO: 1155856 - DNA, 21 bp, Homo sapiens
ttccctcctagctctcccagt

SEQ ID NO: 1155857 - DNA, 22 bp, Homo sapiens
ttccctcctcccatgtcactgc

SEQ ID NO: 1155858 - DNA, 16 bp, Homo sapiens
ttccctcctgcccagg

SEQ ID NO: 1155859 - DNA, 15 bp, Homo sapiens
ttccctcctgctact

SEQ ID NO: 1155860 - DNA, 16 bp, Homo sapiens
ttccctcctggtcctg

SEQ ID NO: 1155861 - DNA, 18 bp, Homo sapiens
ttccctcctggtcctgga

SEQ ID NO: 1155862 - DNA, 11 bp, Homo sapiens
ttccctcctgt

SEQ ID NO: 1155863 - DNA, 15 bp, Homo sapiens
ttccctcgtccgtct

SEQ ID NO: 1155864 - DNA, 11 bp, Homo sapiens
ttccctctcta

SEQ ID NO: 1155865 - DNA, 14 bp, Homo sapiens
ttccctctgcctgt

SEQ ID NO: 1155866 - DNA, 15 bp, Homo sapiens
ttccctctgctcctg

SEQ ID NO: 1155867 - DNA, 24 bp, Homo sapiens
ttccctctgggcacgcctgctggc

SEQ ID NO: 1155868 - DNA, 14 bp, Homo sapiens
tacattgttcaatt

SEQ ID NO: 1155869 - DNA, 19 bp, Homo sapiens
tacattgtttgtctgtctt

SEQ ID NO: 1155870 - DNA, 20 bp, Homo sapiens
tacatttaaaacattaaaat

SEQ ID NO: 1155871 - DNA, 13 bp, Homo sapiens
tacatttaaaatt

SEQ ID NO: 1155872 - DNA, 17 bp, Homo sapiens
tacatttaaaattgcta

SEQ ID NO: 1155873 - DNA, 18 bp, Homo sapiens
tacatttaaaattgctat

SEQ ID NO: 1155874 - DNA, 17 bp, Homo sapiens
tacatttaataatatca

SEQ ID NO: 1155875 - DNA, 16 bp, Homo sapiens
tacatttacaaactga

SEQ ID NO: 1155876 - DNA, 17 bp, Homo sapiens
tacatttacaaactgaa

SEQ ID NO: 1155877 - DNA, 14 bp, Homo sapiens
tacatttatacatc

SEQ ID NO: 1155878 - DNA, 16 bp, Homo sapiens
tacatttatacatcac

SEQ ID NO: 1155879 - DNA, 13 bp, Homo sapiens
tacatttattcat

SEQ ID NO: 1155880 - DNA, 15 bp, Homo sapiens
tacatttatttatta

SEQ ID NO: 1155881 - DNA, 19 bp, Homo sapiens
tacatttatttattactgt

SEQ ID NO: 1155882 - DNA, 21 bp, Homo sapiens
tacatttcacctactttgtaa

SEQ ID NO: 1155883 - DNA, 16 bp, Homo sapiens
tacatttctctgagca

SEQ ID NO: 1155884 - DNA, 19 bp, Homo sapiens
tacatttgatgcatgtctt

SEQ ID NO: 1155885 - DNA, 16 bp, Homo sapiens
tacatttgatttgttc

SEQ ID NO: 1155886 - DNA, 21 bp, Homo sapiens
tacatttgctccatcctcctg

SEQ ID NO: 1155887 - DNA, 16 bp, Homo sapiens
tacatttgttgtacaa

SEQ ID NO: 1155888 - DNA, 11 bp, Homo sapiens
tacattttaaa

SEQ ID NO: 1155889 - DNA, 17 bp, Homo sapiens
tacattttagtttctaa

SEQ ID NO: 1155890 - DNA, 15 bp, Homo sapiens
tacattttataattt

SEQ ID NO: 1155891 - DNA, 16 bp, Homo sapiens
tacattttatatgtga

SEQ ID NO: 1155892 - DNA, 20 bp, Homo sapiens
tacattttatatttttgtac

SEQ ID NO: 1155893 - DNA, 21 bp, Homo sapiens
tacattttatatttttgtaca

SEQ ID NO: 1155894 - DNA, 22 bp, Homo sapiens
tacattttatatttttgtacat

SEQ ID NO: 1155895 - DNA, 11 bp, Homo sapiens
tacattttatt

SEQ ID NO: 1155896 - DNA, 13 bp, Homo sapiens
tacattttattct

SEQ ID NO: 1155897 - DNA, 21 bp, Homo sapiens
tacattttctaaataaaaata

SEQ ID NO: 1155898 - DNA, 15 bp, Homo sapiens
tacattttgtaaaat

SEQ ID NO: 1155899 - DNA, 11 bp, Homo sapiens
tacatttttaa

SEQ ID NO: 1155900 - DNA, 23 bp, Homo sapiens
tacatttttaagctccatgtgca

SEQ ID NO: 1155901 - DNA, 14 bp, Homo sapiens
tacatttttacaat

SEQ ID NO: 1155902 - DNA, 16 bp, Homo sapiens
tacatttttacaataa

SEQ ID NO: 1155903 - DNA, 20 bp, Homo sapiens
tacatttttcacttttgcta

SEQ ID NO: 1155904 - DNA, 21 bp, Homo sapiens
tacattttttaggacatctta

SEQ ID NO: 1155905 - DNA, 15 bp, Homo sapiens
taccaaaaataaata

SEQ ID NO: 1155906 - DNA, 15 bp, Homo sapiens
taccaaaaattgcca

SEQ ID NO: 1155907 - DNA, 23 bp, Homo sapiens
taccaaaaccatccatccctaga

SEQ ID NO: 1155908 - DNA, 11 bp, Homo sapiens
taccaaaataa

SEQ ID NO: 1155909 - DNA, 19 bp, Homo sapiens
taccaaaattcactaatct

SEQ ID NO: 1155910 - DNA, 14 bp, Homo sapiens
taccaaaattttaa

SEQ ID NO: 1155911 - DNA, 15 bp, Homo sapiens
taccaaacaaggaag

SEQ ID NO: 1155912 - DNA, 18 bp, Homo sapiens
taccaaacaaggaagcca

SEQ ID NO: 1155913 - DNA, 15 bp, Homo sapiens
taccaaacactcagt

SEQ ID NO: 1155914 - DNA, 15 bp, Homo sapiens
taccaaagactattt

SEQ ID NO: 1155915 - DNA, 13 bp, Homo sapiens
taccaaaggatag

SEQ ID NO: 1155916 - DNA, 14 bp, Homo sapiens
taccaaatatttta

SEQ ID NO: 1155917 - DNA, 15 bp, Homo sapiens
taccaaatgcctgtt

SEQ ID NO: 1155918 - DNA, 21 bp, Homo sapiens
taccaaatgcctgttgtattt

SEQ ID NO: 1155919 - DNA, 14 bp, Homo sapiens
taccaactttactg

SEQ ID NO: 1155920 - DNA, 14 bp, Homo sapiens
taccaactttctgt

SEQ ID NO: 1155921 - DNA, 15 bp, Homo sapiens
taccaactttctgta

SEQ ID NO: 1155922 - DNA, 18 bp, Homo sapiens
taccaagacccccgtctc

SEQ ID NO: 1155923 - DNA, 18 bp, Homo sapiens
taccaaggtcttcttaat

SEQ ID NO: 1155924 - DNA, 16 bp, Homo sapiens
taccaagtatgaagta

SEQ ID NO: 1155925 - DNA, 14 bp, Homo sapiens
taccaagtcaaact

SEQ ID NO: 1155926 - DNA, 22 bp, Homo sapiens
taccaatcattttaattattat

SEQ ID NO: 1155927 - DNA, 15 bp, Homo sapiens
taccaatgaaaaaat

SEQ ID NO: 1155928 - DNA, 12 bp, Homo sapiens
taccaatgcatg

SEQ ID NO: 1155929 - DNA, 15 bp, Homo sapiens
taccaatgggaagca

SEQ ID NO: 1155930 - DNA, 18 bp, Homo sapiens
taccaatgtgttttctgt

SEQ ID NO: 1155931 - DNA, 23 bp, Homo sapiens
taccacactagaattcatgtgag

SEQ ID NO: 1155932 - DNA, 22 bp, Homo sapiens
taccacactgagttctatcagt

SEQ ID NO: 1155933 - DNA, 13 bp, Homo sapiens
taccacagacata

SEQ ID NO: 1155934 - DNA, 18 bp, Homo sapiens
taccacagctatttagaa

SEQ ID NO: 1155935 - DNA, 14 bp, Homo sapiens
taccacagtgtctg

SEQ ID NO: 1155936 - DNA, 20 bp, Homo sapiens
taccacatctgctctaggga

SEQ ID NO: 1155937 - DNA, 13 bp, Homo sapiens
taccaccagggcc

SEQ ID NO: 1155938 - DNA, 19 bp, Homo sapiens
taccaccccttcctgtccc

SEQ ID NO: 1155939 - DNA, 15 bp, Homo sapiens
taccacccttcagac

SEQ ID NO: 1155940 - DNA, 23 bp, Homo sapiens
taccacccttcagaccccagttc

SEQ ID NO: 1155941 - DNA, 16 bp, Homo sapiens
taccaccgaatcccta

SEQ ID NO: 1155942 - DNA, 20 bp, Homo sapiens
taccaccgtctgtctcagag

SEQ ID NO: 1155943 - DNA, 15 bp, Homo sapiens
taccacctgtacata

SEQ ID NO: 1155944 - DNA, 13 bp, Homo sapiens
taccactctgtaa

SEQ ID NO: 1155945 - DNA, 19 bp, Homo sapiens
taccactctgtaattgcaa

SEQ ID NO: 1155946 - DNA, 22 bp, Homo sapiens
taccactggtacttcctttctc

SEQ ID NO: 1155947 - DNA, 23 bp, Homo sapiens
taccacttatatcaacttatttt

SEQ ID NO: 1155948 - DNA, 16 bp, Homo sapiens
taccacttctgtgggc

SEQ ID NO: 1155949 - DNA, 17 bp, Homo sapiens
taccacttctgtgggca

SEQ ID NO: 1155950 - DNA, 19 bp, Homo sapiens
taccacttgaatttattga

SEQ ID NO: 1155951 - DNA, 20 bp, Homo sapiens
taccacttgaatttattgat

SEQ ID NO: 1155952 - DNA, 12 bp, Homo sapiens
taccactttttt

SEQ ID NO: 1155953 - DNA, 13 bp, Homo sapiens
taccagaagggaa

SEQ ID NO: 1155954 - DNA, 18 bp, Homo sapiens
taccagagttaaagcata

SEQ ID NO: 1155955 - DNA, 18 bp, Homo sapiens
taccagatgaacatttca

SEQ ID NO: 1155956 - DNA, 19 bp, Homo sapiens
taccagatgctactggact

SEQ ID NO: 1155957 - DNA, 22 bp, Homo sapiens
taccagatgtgcttttatttag

SEQ ID NO: 1155958 - DNA, 15 bp, Homo sapiens
taccagcatttgtcc

SEQ ID NO: 1155959 - DNA, 11 bp, Homo sapiens
taccagccagc

SEQ ID NO: 1155960 - DNA, 12 bp, Homo sapiens
taccagccagcc

SEQ ID NO: 1155961 - DNA, 17 bp, Homo sapiens
taccagcgcccgctggg

SEQ ID NO: 1155962 - DNA, 19 bp, Homo sapiens
taccagcgcccgctgggct

SEQ ID NO: 1155963 - DNA, 16 bp, Homo sapiens
taccagctcctccagc

SEQ ID NO: 1155964 - DNA, 19 bp, Homo sapiens
taccagctcctccagccct

SEQ ID NO: 1155965 - DNA, 14 bp, Homo sapiens
taccagctgcgctt

SEQ ID NO: 1155966 - DNA, 21 bp, Homo sapiens
taccagctgcgcttgcttttc

SEQ ID NO: 1155967 - DNA, 22 bp, Homo sapiens
taccagctgcgcttgcttttct

SEQ ID NO: 1155968 - DNA, 16 bp, Homo sapiens
taccaggacagaactt

SEQ ID NO: 1155969 - DNA, 16 bp, Homo sapiens
taccaggatgctaaag

SEQ ID NO: 1155970 - DNA, 18 bp, Homo sapiens
taccaggggaggcagtgt

SEQ ID NO: 1155971 - DNA, 16 bp, Homo sapiens
taccaggttgaaagac

SEQ ID NO: 1155972 - DNA, 15 bp, Homo sapiens
taccagtatttagaa

SEQ ID NO: 1155973 - DNA, 13 bp, Homo sapiens
taccagtctattt

SEQ ID NO: 1155974 - DNA, 15 bp, Homo sapiens
taccagtctatttcc

SEQ ID NO: 1155975 - DNA, 16 bp, Homo sapiens
taccagtctatttcca

SEQ ID NO: 1155976 - DNA, 23 bp, Homo sapiens
taccagtctttaaaggcccagcc

SEQ ID NO: 1155977 - DNA, 19 bp, Homo sapiens
taccagttaatttttccaa

SEQ ID NO: 1155978 - DNA, 15 bp, Homo sapiens
taccagttgccctag

SEQ ID NO: 1155979 - DNA, 14 bp, Homo sapiens
taccagttgccttt

SEQ ID NO: 1155980 - DNA, 18 bp, Homo sapiens
taccataaagcctttaaa

SEQ ID NO: 1155981 - DNA, 16 bp, Homo sapiens
taccatactgtctctg

SEQ ID NO: 1155982 - DNA, 16 bp, Homo sapiens
taccatagagtaatga

SEQ ID NO: 1155983 - DNA, 18 bp, Homo sapiens
taccatagagtaatgatg

SEQ ID NO: 1155984 - DNA, 13 bp, Homo sapiens
taccataggaaga

SEQ ID NO: 1155985 - DNA, 21 bp, Homo sapiens
taccatcatccggtttagtca

SEQ ID NO: 1155986 - DNA, 18 bp, Homo sapiens
taccatctctaccatcat

SEQ ID NO: 1155987 - DNA, 17 bp, Homo sapiens
taccatctgatgtttca

SEQ ID NO: 1155988 - DNA, 15 bp, Homo sapiens
taccatgaaacaaag

SEQ ID NO: 1155989 - DNA, 14 bp, Homo sapiens
taccatgaacagaa

SEQ ID NO: 1155990 - DNA, 14 bp, Homo sapiens
taccatgtcactgt

SEQ ID NO: 1155991 - DNA, 14 bp, Homo sapiens
taccatgtctttct

SEQ ID NO: 1155992 - DNA, 18 bp, Homo sapiens
taccattattatgtaaat

SEQ ID NO: 1155993 - DNA, 15 bp, Homo sapiens
taccattatttaatt

SEQ ID NO: 1155994 - DNA, 22 bp, Homo sapiens
ttccctctttcatctcctgagt

SEQ ID NO: 1155995 - DNA, 13 bp, Homo sapiens
ttccctcttttct

SEQ ID NO: 1155996 - DNA, 14 bp, Homo sapiens
ttccctcttttctt

SEQ ID NO: 1155997 - DNA, 17 bp, Homo sapiens
ttccctcttttcttact

SEQ ID NO: 1155998 - DNA, 19 bp, Homo sapiens
ttccctcttttcttactcc

SEQ ID NO: 1155999 - DNA, 17 bp, Homo sapiens
ttccctgaaaacccaga

SEQ ID NO: 1156000 - DNA, 20 bp, Homo sapiens
ttccctgaaaacccagagag

SEQ ID NO: 1156001 - DNA, 21 bp, Homo sapiens
ttccctgaaacacgaaacttg

SEQ ID NO: 1156002 - DNA, 22 bp, Homo sapiens
ttccctgaaacacgaaacttgt

SEQ ID NO: 1156003 - DNA, 18 bp, Homo sapiens
ttccctgaacgttttctt

SEQ ID NO: 1156004 - DNA, 13 bp, Homo sapiens
ttccctgaatctg

SEQ ID NO: 1156005 - DNA, 21 bp, Homo sapiens
ttccctgaatctgtgcctgca

SEQ ID NO: 1156006 - DNA, 13 bp, Homo sapiens
ttccctgactcat

SEQ ID NO: 1156007 - DNA, 19 bp, Homo sapiens
ttccctgagtcaccaggaa

SEQ ID NO: 1156008 - DNA, 19 bp, Homo sapiens
ttccctgatggcctttgga

SEQ ID NO: 1156009 - DNA, 20 bp, Homo sapiens
ttccctgatggcctttggac

SEQ ID NO: 1156010 - DNA, 12 bp, Homo sapiens
ttccctgcacta

SEQ ID NO: 1156011 - DNA, 18 bp, Homo sapiens
ttccctgccacatccagc

SEQ ID NO: 1156012 - DNA, 20 bp, Homo sapiens
ttccctgccacatccagctt

SEQ ID NO: 1156013 - DNA, 10 bp, Homo sapiens
ttccctgccc

SEQ ID NO: 1156014 - DNA, 14 bp, Homo sapiens
ttccctgcccctgt

SEQ ID NO: 1156015 - DNA, 17 bp, Homo sapiens
ttccctgcgcttcatct

SEQ ID NO: 1156016 - DNA, 16 bp, Homo sapiens
ttccctgcttccagga

SEQ ID NO: 1156017 - DNA, 17 bp, Homo sapiens
ttccctggacaggcagc

SEQ ID NO: 1156018 - DNA, 20 bp, Homo sapiens
ttccctggacaggcagcctc

SEQ ID NO: 1156019 - DNA, 20 bp, Homo sapiens
ttccctgggatctggtggtc

SEQ ID NO: 1156020 - DNA, 17 bp, Homo sapiens
ttccctggggagccctc

SEQ ID NO: 1156021 - DNA, 16 bp, Homo sapiens
ttccctgtattttctt

SEQ ID NO: 1156022 - DNA, 20 bp, Homo sapiens
ttccctgtattttctttctc

SEQ ID NO: 1156023 - DNA, 14 bp, Homo sapiens
ttccctgtcagagg

SEQ ID NO: 1156024 - DNA, 13 bp, Homo sapiens
ttccctgtgtgga

SEQ ID NO: 1156025 - DNA, 18 bp, Homo sapiens
ttccctgttcttcctcca

SEQ ID NO: 1156026 - DNA, 19 bp, Homo sapiens
ttccctgttcttcctccag

SEQ ID NO: 1156027 - DNA, 15 bp, Homo sapiens
ttcccttaaatacag

SEQ ID NO: 1156028 - DNA, 20 bp, Homo sapiens
ttcccttattgcctcccagg

SEQ ID NO: 1156029 - DNA, 21 bp, Homo sapiens
ttcccttattgcctcccaggc

SEQ ID NO: 1156030 - DNA, 19 bp, Homo sapiens
ttcccttcagtaccctctc

SEQ ID NO: 1156031 - DNA, 22 bp, Homo sapiens
ttcccttcagtaccctctcagc

SEQ ID NO: 1156032 - DNA, 22 bp, Homo sapiens
ttcccttcctgttccctcctgg

SEQ ID NO: 1156033 - DNA, 14 bp, Homo sapiens
ttcccttctgggct

SEQ ID NO: 1156034 - DNA, 20 bp, Homo sapiens
ttcccttgaccattggctgc

SEQ ID NO: 1156035 - DNA, 20 bp, Homo sapiens
ttcccttgagatgagtttct

SEQ ID NO: 1156036 - DNA, 23 bp, Homo sapiens
ttcccttgagatgagtttctggg

SEQ ID NO: 1156037 - DNA, 22 bp, Homo sapiens
ttcccttgcaggggtcccccct

SEQ ID NO: 1156038 - DNA, 11 bp, Homo sapiens
ttcccttggcc

SEQ ID NO: 1156039 - DNA, 15 bp, Homo sapiens
ttcccttggcctcag

SEQ ID NO: 1156040 - DNA, 11 bp, Homo sapiens
ttcccttgtat

SEQ ID NO: 1156041 - DNA, 21 bp, Homo sapiens
ttccctttgacttcagctgcc

SEQ ID NO: 1156042 - DNA, 23 bp, Homo sapiens
ttccctttgacttcagctgcctg

SEQ ID NO: 1156043 - DNA, 12 bp, Homo sapiens
ttccctttgcca

SEQ ID NO: 1156044 - DNA, 14 bp, Homo sapiens
ttccctttgcctta

SEQ ID NO: 1156045 - DNA, 19 bp, Homo sapiens
ttcccttttaatcaactgt

SEQ ID NO: 1156046 - DNA, 17 bp, Homo sapiens
ttcccttttacatactg

SEQ ID NO: 1156047 - DNA, 21 bp, Homo sapiens
ttccctttttaaaaaatacca

SEQ ID NO: 1156048 - DNA, 21 bp, Homo sapiens
ttccgaaaaatcctcttcctc

SEQ ID NO: 1156049 - DNA, 20 bp, Homo sapiens
ttccgaaaccaaagaagaaa

SEQ ID NO: 1156050 - DNA, 22 bp, Homo sapiens
ttccgacaaccgatgctccagc

SEQ ID NO: 1156051 - DNA, 16 bp, Homo sapiens
ttccgacatcccagac

SEQ ID NO: 1156052 - DNA, 22 bp, Homo sapiens
ttccgacatcccagaccagcca

SEQ ID NO: 1156053 - DNA, 17 bp, Homo sapiens
ttccgaccctctgggaa

SEQ ID NO: 1156054 - DNA, 20 bp, Homo sapiens
ttccgagatccccagggcag

SEQ ID NO: 1156055 - DNA, 14 bp, Homo sapiens
ttccgatcaacatt

SEQ ID NO: 1156056 - DNA, 17 bp, Homo sapiens
ttccgatcaacatttat

SEQ ID NO: 1156057 - DNA, 21 bp, Homo sapiens
ttccgcacttcagaattccat

SEQ ID NO: 1156058 - DNA, 15 bp, Homo sapiens
ttccgcactttccac

SEQ ID NO: 1156059 - DNA, 21 bp, Homo sapiens
ttccgcagcccctttccccac

SEQ ID NO: 1156060 - DNA, 14 bp, Homo sapiens
ttccgcccctgcct

SEQ ID NO: 1156061 - DNA, 20 bp, Homo sapiens
ttccgcgcccagcgctcgcc

SEQ ID NO: 1156062 - DNA, 21 bp, Homo sapiens
ttccgcgcggagacctcctga

SEQ ID NO: 1156063 - DNA, 13 bp, Homo sapiens
ttccgcttggagc

SEQ ID NO: 1156064 - DNA, 14 bp, Homo sapiens
ttccggcctgggca

SEQ ID NO: 1156065 - DNA, 22 bp, Homo sapiens
ttccgggcagaaacaataaaac

SEQ ID NO: 1156066 - DNA, 23 bp, Homo sapiens
ttccgggtctcgcagcctgaagc

SEQ ID NO: 1156067 - DNA, 16 bp, Homo sapiens
ttccgtagactgttta

SEQ ID NO: 1156068 - DNA, 15 bp, Homo sapiens
ttccgtatctccctg

SEQ ID NO: 1156069 - DNA, 13 bp, Homo sapiens
ttccgtccccccc

SEQ ID NO: 1156070 - DNA, 15 bp, Homo sapiens
ttccgtcccccccca

SEQ ID NO: 1156071 - DNA, 16 bp, Homo sapiens
ttccgtccccccccag

SEQ ID NO: 1156072 - DNA, 12 bp, Homo sapiens
ttccgtgtcctc

SEQ ID NO: 1156073 - DNA, 14 bp, Homo sapiens
ttccgtgtcctctc

SEQ ID NO: 1156074 - DNA, 16 bp, Homo sapiens
ttccgttaaaatacca

SEQ ID NO: 1156075 - DNA, 13 bp, Homo sapiens
ttcctaaaattat

SEQ ID NO: 1156076 - DNA, 18 bp, Homo sapiens
ttcctaaacataattgtg

SEQ ID NO: 1156077 - DNA, 16 bp, Homo sapiens
ttcctaaatgcagtga

SEQ ID NO: 1156078 - DNA, 14 bp, Homo sapiens
ttcctaacacagca

SEQ ID NO: 1156079 - DNA, 15 bp, Homo sapiens
ttcctaactgtgatt

SEQ ID NO: 1156080 - DNA, 22 bp, Homo sapiens
ttcctaacttttcaatgacatt

SEQ ID NO: 1156081 - DNA, 13 bp, Homo sapiens
ttcctaagccact

SEQ ID NO: 1156082 - DNA, 21 bp, Homo sapiens
ttcctaagccacttgaaatgt

SEQ ID NO: 1156083 - DNA, 22 bp, Homo sapiens
ttcctaagccacttgaaatgtt

SEQ ID NO: 1156084 - DNA, 20 bp, Homo sapiens
ttcctaagcctgttgctgaa

SEQ ID NO: 1156085 - DNA, 17 bp, Homo sapiens
ttcctaaggcacccaca

SEQ ID NO: 1156086 - DNA, 21 bp, Homo sapiens
ttcctaagtttttttcatttt

SEQ ID NO: 1156087 - DNA, 19 bp, Homo sapiens
ttcctaataaagttctgta

SEQ ID NO: 1156088 - DNA, 19 bp, Homo sapiens
ttcctaatatcaaatgcag

SEQ ID NO: 1156089 - DNA, 15 bp, Homo sapiens
ttcctacaacgaaat

SEQ ID NO: 1156090 - DNA, 19 bp, Homo sapiens
ttcctacaactaaaaataa

SEQ ID NO: 1156091 - DNA, 23 bp, Homo sapiens
ttcctacaactaaaaataaatta

SEQ ID NO: 1156092 - DNA, 22 bp, Homo sapiens
ttcctacagaaatactgctctg

SEQ ID NO: 1156093 - DNA, 15 bp, Homo sapiens
ttcctacagcactac

SEQ ID NO: 1156094 - DNA, 23 bp, Homo sapiens
ttcctacagcactactgggtgtc

SEQ ID NO: 1156095 - DNA, 12 bp, Homo sapiens
ttcctacagccc

SEQ ID NO: 1156096 - DNA, 14 bp, Homo sapiens
ttcctacagcccct

SEQ ID NO: 1156097 - DNA, 19 bp, Homo sapiens
ttcctaccaagtcaaactt

SEQ ID NO: 1156098 - DNA, 15 bp, Homo sapiens
ttcctacccctcttc

SEQ ID NO: 1156099 - DNA, 23 bp, Homo sapiens
ttcctacccctcttccagcttct

SEQ ID NO: 1156100 - DNA, 16 bp, Homo sapiens
ttcctaccctgcctcc

SEQ ID NO: 1156101 - DNA, 19 bp, Homo sapiens
ttcctactccctcttccaa

SEQ ID NO: 1156102 - DNA, 14 bp, Homo sapiens
ttcctactcctcat

SEQ ID NO: 1156103 - DNA, 14 bp, Homo sapiens
ttcctagtctttcc

SEQ ID NO: 1156104 - DNA, 15 bp, Homo sapiens
ttcctagtgaggaaa

SEQ ID NO: 1156105 - DNA, 20 bp, Homo sapiens
ttcctagtggatgactgttg

SEQ ID NO: 1156106 - DNA, 21 bp, Homo sapiens
ttcctagtggatgactgttga

SEQ ID NO: 1156107 - DNA, 13 bp, Homo sapiens
ttcctatcacctc

SEQ ID NO: 1156108 - DNA, 22 bp, Homo sapiens
ttcctatcacctcgagaagtaa

SEQ ID NO: 1156109 - DNA, 17 bp, Homo sapiens
ttcctatcataaaaata

SEQ ID NO: 1156110 - DNA, 15 bp, Homo sapiens
ttcctatcatgttaa

SEQ ID NO: 1156111 - DNA, 14 bp, Homo sapiens
ttcctatgacacag

SEQ ID NO: 1156112 - DNA, 18 bp, Homo sapiens
ttcctatgatggatggca

SEQ ID NO: 1156113 - DNA, 13 bp, Homo sapiens
ttcctattctcct

SEQ ID NO: 1156114 - DNA, 17 bp, Homo sapiens
ttcctattctcctgcca

SEQ ID NO: 1156115 - DNA, 14 bp, Homo sapiens
ttcctattctgttg

SEQ ID NO: 1156116 - DNA, 13 bp, Homo sapiens
ttcctattgtaat

SEQ ID NO: 1156117 - DNA, 22 bp, Homo sapiens
ttcctatttcagtgttacctgt

SEQ ID NO: 1156118 - DNA, 18 bp, Homo sapiens
taccattccttcaaataa

SEQ ID NO: 1156119 - DNA, 19 bp, Homo sapiens
taccattccttcaaataaa

SEQ ID NO: 1156120 - DNA, 21 bp, Homo sapiens
taccatttatacaaattagaa

SEQ ID NO: 1156121 - DNA, 13 bp, Homo sapiens
taccatttgtaat

SEQ ID NO: 1156122 - DNA, 14 bp, Homo sapiens
taccatttgtaata

SEQ ID NO: 1156123 - DNA, 18 bp, Homo sapiens
taccattttaaagttagt

SEQ ID NO: 1156124 - DNA, 21 bp, Homo sapiens
taccattttttaaggaaacaa

SEQ ID NO: 1156125 - DNA, 23 bp, Homo sapiens
tacccaaagcacatgcttagctt

SEQ ID NO: 1156126 - DNA, 16 bp, Homo sapiens
tacccaaaggaataga

SEQ ID NO: 1156127 - DNA, 17 bp, Homo sapiens
tacccaacagtttattt

SEQ ID NO: 1156128 - DNA, 22 bp, Homo sapiens
tacccaatgggaccgtgcccca

SEQ ID NO: 1156129 - DNA, 17 bp, Homo sapiens
tacccaatgtctcccac

SEQ ID NO: 1156130 - DNA, 21 bp, Homo sapiens
tacccaccccagcacagccac

SEQ ID NO: 1156131 - DNA, 21 bp, Homo sapiens
tacccacgttctcacacccac

SEQ ID NO: 1156132 - DNA, 13 bp, Homo sapiens
tacccagagcatt

SEQ ID NO: 1156133 - DNA, 14 bp, Homo sapiens
tacccagccatctg

SEQ ID NO: 1156134 - DNA, 16 bp, Homo sapiens
tacccagcgtggccca

SEQ ID NO: 1156135 - DNA, 16 bp, Homo sapiens
tacccaggaccaagcc

SEQ ID NO: 1156136 - DNA, 20 bp, Homo sapiens
tacccagtattactgctgct

SEQ ID NO: 1156137 - DNA, 21 bp, Homo sapiens
tacccatctagtacttgaaaa

SEQ ID NO: 1156138 - DNA, 14 bp, Homo sapiens
tacccatgagcctg

SEQ ID NO: 1156139 - DNA, 15 bp, Homo sapiens
tacccattctgtttt

SEQ ID NO: 1156140 - DNA, 19 bp, Homo sapiens
tacccattgccccagacct

SEQ ID NO: 1156141 - DNA, 17 bp, Homo sapiens
tacccattgttcccttc

SEQ ID NO: 1156142 - DNA, 15 bp, Homo sapiens
taccccaaggccagt

SEQ ID NO: 1156143 - DNA, 21 bp, Homo sapiens
taccccagactagatgtagta

SEQ ID NO: 1156144 - DNA, 22 bp, Homo sapiens
taccccagactagatgtagtat

SEQ ID NO: 1156145 - DNA, 21 bp, Homo sapiens
taccccataccccttattgct

SEQ ID NO: 1156146 - DNA, 20 bp, Homo sapiens
taccccatggagctgggcta

SEQ ID NO: 1156147 - DNA, 20 bp, Homo sapiens
tacccccacagacctgctct

SEQ ID NO: 1156148 - DNA, 23 bp, Homo sapiens
taccccccaccttggtccctctc

SEQ ID NO: 1156149 - DNA, 12 bp, Homo sapiens
tacccccccttt

SEQ ID NO: 1156150 - DNA, 23 bp, Homo sapiens
tacccccccttttctccccacga

SEQ ID NO: 1156151 - DNA, 16 bp, Homo sapiens
taccccctccttcaga

SEQ ID NO: 1156152 - DNA, 18 bp, Homo sapiens
taccccctccttcagaca

SEQ ID NO: 1156153 - DNA, 14 bp, Homo sapiens
taccccctcttcaa

SEQ ID NO: 1156154 - DNA, 16 bp, Homo sapiens
taccccctcttcaaag

SEQ ID NO: 1156155 - DNA, 15 bp, Homo sapiens
taccccctgcaaagc

SEQ ID NO: 1156156 - DNA, 23 bp, Homo sapiens
taccccctgcaaagcccagcttg

SEQ ID NO: 1156157 - DNA, 13 bp, Homo sapiens
taccccctttccc

SEQ ID NO: 1156158 - DNA, 17 bp, Homo sapiens
taccccctttcccttct

SEQ ID NO: 1156159 - DNA, 22 bp, Homo sapiens
tacccctaaaaagattgccaat

SEQ ID NO: 1156160 - DNA, 21 bp, Homo sapiens
tacccctcaaactgcacatct

SEQ ID NO: 1156161 - DNA, 18 bp, Homo sapiens
tacccctcgactcagcac

SEQ ID NO: 1156162 - DNA, 19 bp, Homo sapiens
tacccctcgactcagcacc

SEQ ID NO: 1156163 - DNA, 21 bp, Homo sapiens
tacccctcgactcagcaccac

SEQ ID NO: 1156164 - DNA, 14 bp, Homo sapiens
tacccctgctccca

SEQ ID NO: 1156165 - DNA, 20 bp, Homo sapiens
tacccctgctcccattcctc

SEQ ID NO: 1156166 - DNA, 14 bp, Homo sapiens
taccccttattgct

SEQ ID NO: 1156167 - DNA, 17 bp, Homo sapiens
taccccttattgctgcc

SEQ ID NO: 1156168 - DNA, 19 bp, Homo sapiens
taccccttattgctgccaa

SEQ ID NO: 1156169 - DNA, 16 bp, Homo sapiens
taccccttcctgtcct

SEQ ID NO: 1156170 - DNA, 17 bp, Homo sapiens
taccccttcctgtcctg

SEQ ID NO: 1156171 - DNA, 21 bp, Homo sapiens
taccccttcctgtcctgcctc

SEQ ID NO: 1156172 - DNA, 15 bp, Homo sapiens
taccccttggaaatg

SEQ ID NO: 1156173 - DNA, 22 bp, Homo sapiens
taccccttggaaatgtctgctg

SEQ ID NO: 1156174 - DNA, 23 bp, Homo sapiens
taccccttggaaatgtctgctgg

SEQ ID NO: 1156175 - DNA, 14 bp, Homo sapiens
tacccctttcttct

SEQ ID NO: 1156176 - DNA, 22 bp, Homo sapiens
tacccggcccagagaccccttc

SEQ ID NO: 1156177 - DNA, 14 bp, Homo sapiens
tacccgtgcctggg

SEQ ID NO: 1156178 - DNA, 16 bp, Homo sapiens
tacccgtgcctgggcc

SEQ ID NO: 1156179 - DNA, 20 bp, Homo sapiens
tacccgtgcctgggcccctc

SEQ ID NO: 1156180 - DNA, 22 bp, Homo sapiens
tacccgtgcctgggcccctccc

SEQ ID NO: 1156181 - DNA, 15 bp, Homo sapiens
taccctactgtgggg

SEQ ID NO: 1156182 - DNA, 19 bp, Homo sapiens
taccctagaagaaaacccg

SEQ ID NO: 1156183 - DNA, 20 bp, Homo sapiens
taccctatggggaggccctg

SEQ ID NO: 1156184 - DNA, 21 bp, Homo sapiens
taccctatggggaggccctgc

SEQ ID NO: 1156185 - DNA, 22 bp, Homo sapiens
taccctatggggaggccctgcc

SEQ ID NO: 1156186 - DNA, 23 bp, Homo sapiens
taccctcaggcataggcctgggt

SEQ ID NO: 1156187 - DNA, 18 bp, Homo sapiens
taccctcccaccagaacg

SEQ ID NO: 1156188 - DNA, 15 bp, Homo sapiens
taccctcccaccccc

SEQ ID NO: 1156189 - DNA, 12 bp, Homo sapiens
taccctcctcca

SEQ ID NO: 1156190 - DNA, 13 bp, Homo sapiens
taccctcctctgc

SEQ ID NO: 1156191 - DNA, 14 bp, Homo sapiens
taccctcctctgct

SEQ ID NO: 1156192 - DNA, 16 bp, Homo sapiens
taccctcctctgctgg

SEQ ID NO: 1156193 - DNA, 17 bp, Homo sapiens
taccctccttccacatg

SEQ ID NO: 1156194 - DNA, 17 bp, Homo sapiens
taccctctcagctccag

SEQ ID NO: 1156195 - DNA, 12 bp, Homo sapiens
taccctctggag

SEQ ID NO: 1156196 - DNA, 16 bp, Homo sapiens
taccctgagctgaggc

SEQ ID NO: 1156197 - DNA, 18 bp, Homo sapiens
taccctgagctgaggcag

SEQ ID NO: 1156198 - DNA, 20 bp, Homo sapiens
taccctgcgattttgcctgt

SEQ ID NO: 1156199 - DNA, 12 bp, Homo sapiens
taccctgtcctt

SEQ ID NO: 1156200 - DNA, 16 bp, Homo sapiens
taccctgtcctttgca

SEQ ID NO: 1156201 - DNA, 15 bp, Homo sapiens
taccctgtctgtccc

SEQ ID NO: 1156202 - DNA, 12 bp, Homo sapiens
taccctgtgtca

SEQ ID NO: 1156203 - DNA, 13 bp, Homo sapiens
taccctgtgtcag

SEQ ID NO: 1156204 - DNA, 15 bp, Homo sapiens
taccctgtgtcagag

SEQ ID NO: 1156205 - DNA, 18 bp, Homo sapiens
taccctgtgtcagagcct

SEQ ID NO: 1156206 - DNA, 22 bp, Homo sapiens
tacccttcccgcctccctctca

SEQ ID NO: 1156207 - DNA, 15 bp, Homo sapiens
tacccttccctgcac

SEQ ID NO: 1156208 - DNA, 17 bp, Homo sapiens
tacccttccctgcacta

SEQ ID NO: 1156209 - DNA, 21 bp, Homo sapiens
taccgaccatcgtccagccct

SEQ ID NO: 1156210 - DNA, 16 bp, Homo sapiens
taccgagtatctgtaa

SEQ ID NO: 1156211 - DNA, 17 bp, Homo sapiens
taccgagtatctgtaac

SEQ ID NO: 1156212 - DNA, 22 bp, Homo sapiens
taccgagtctcttctccactgg

SEQ ID NO: 1156213 - DNA, 15 bp, Homo sapiens
taccgatggtcccag

SEQ ID NO: 1156214 - DNA, 15 bp, Homo sapiens
taccgcaggcccgga

SEQ ID NO: 1156215 - DNA, 23 bp, Homo sapiens
taccgcaggcccggactcaccaa

SEQ ID NO: 1156216 - DNA, 19 bp, Homo sapiens
taccgcaggcgggcgagcc

SEQ ID NO: 1156217 - DNA, 12 bp, Homo sapiens
taccgccctggg

SEQ ID NO: 1156218 - DNA, 14 bp, Homo sapiens
taccgccctgggct

SEQ ID NO: 1156219 - DNA, 17 bp, Homo sapiens
taccgccctgggctgga

SEQ ID NO: 1156220 - DNA, 14 bp, Homo sapiens
taccgcgttgtaaa

SEQ ID NO: 1156221 - DNA, 15 bp, Homo sapiens
taccgctcagtattt

SEQ ID NO: 1156222 - DNA, 19 bp, Homo sapiens
taccggacacacctctgct

SEQ ID NO: 1156223 - DNA, 17 bp, Homo sapiens
taccggagagagaatgt

SEQ ID NO: 1156224 - DNA, 18 bp, Homo sapiens
taccggagagagaatgta

SEQ ID NO: 1156225 - DNA, 24 bp, Homo sapiens
taccgtgacagcccgcaggatcag

SEQ ID NO: 1156226 - DNA, 20 bp, Homo sapiens
taccgttatgtctttggaaa

SEQ ID NO: 1156227 - DNA, 13 bp, Homo sapiens
tacctaaaaaaag

SEQ ID NO: 1156228 - DNA, 23 bp, Homo sapiens
tacctaaactgagctgaatgttt

SEQ ID NO: 1156229 - DNA, 22 bp, Homo sapiens
tacctaagattacaaatcagaa

SEQ ID NO: 1156230 - DNA, 21 bp, Homo sapiens
tacctaatgtctcactgttct

SEQ ID NO: 1156231 - DNA, 22 bp, Homo sapiens
tacctaatgtctcactgttctg

SEQ ID NO: 1156232 - DNA, 21 bp, Homo sapiens
tacctacatgctgaaaaatat

SEQ ID NO: 1156233 - DNA, 16 bp, Homo sapiens
tacctaccacagtgtc

SEQ ID NO: 1156234 - DNA, 16 bp, Homo sapiens
tacctactttcttcag

SEQ ID NO: 1156235 - DNA, 13 bp, Homo sapiens
tacctagatttac

SEQ ID NO: 1156236 - DNA, 20 bp, Homo sapiens
tacctagcacacaataagca

SEQ ID NO: 1156237 - DNA, 15 bp, Homo sapiens
tacctagctggctct

SEQ ID NO: 1156238 - DNA, 15 bp, Homo sapiens
tacctagtgaaactt

SEQ ID NO: 1156239 - DNA, 19 bp, Homo sapiens
tacctcaaagggcagtttt

SEQ ID NO: 1156240 - DNA, 19 bp, Homo sapiens
tacctcaacaagaagaatt

SEQ ID NO: 1156241 - DNA, 22 bp, Homo sapiens
tacctcaagccccatttcctca

SEQ ID NO: 1156242 - DNA, 20 bp, Homo sapiens
ttcctattttctatccccct

SEQ ID NO: 1156243 - DNA, 17 bp, Homo sapiens
ttcctatttttaaataa

SEQ ID NO: 1156244 - DNA, 14 bp, Homo sapiens
ttcctcaaattttt

SEQ ID NO: 1156245 - DNA, 21 bp, Homo sapiens
ttcctcaacagtgttttcaga

SEQ ID NO: 1156246 - DNA, 22 bp, Homo sapiens
ttcctcaacagtgttttcagaa

SEQ ID NO: 1156247 - DNA, 20 bp, Homo sapiens
ttcctcaagcaataattgtt

SEQ ID NO: 1156248 - DNA, 18 bp, Homo sapiens
ttcctcagattgctgaat

SEQ ID NO: 1156249 - DNA, 14 bp, Homo sapiens
ttcctcagcctcca

SEQ ID NO: 1156250 - DNA, 13 bp, Homo sapiens
ttcctcagctgcc

SEQ ID NO: 1156251 - DNA, 17 bp, Homo sapiens
ttcctcaggaaggacat

SEQ ID NO: 1156252 - DNA, 23 bp, Homo sapiens
ttcctcagtttaatccttctagt

SEQ ID NO: 1156253 - DNA, 18 bp, Homo sapiens
ttcctcatccaccccatc

SEQ ID NO: 1156254 - DNA, 19 bp, Homo sapiens
ttcctcatccaccccatcc

SEQ ID NO: 1156255 - DNA, 17 bp, Homo sapiens
ttcctcatcctgcttct

SEQ ID NO: 1156256 - DNA, 19 bp, Homo sapiens
ttcctcatcctgcttctct

SEQ ID NO: 1156257 - DNA, 20 bp, Homo sapiens
ttcctcatcctttccctctc

SEQ ID NO: 1156258 - DNA, 21 bp, Homo sapiens
ttcctcatgtaacattggtga

SEQ ID NO: 1156259 - DNA, 22 bp, Homo sapiens
ttcctcatgtaacattggtgaa

SEQ ID NO: 1156260 - DNA, 13 bp, Homo sapiens
ttcctcattagca

SEQ ID NO: 1156261 - DNA, 15 bp, Homo sapiens
ttcctccacatcctt

SEQ ID NO: 1156262 - DNA, 14 bp, Homo sapiens
ttcctccagcctcc

SEQ ID NO: 1156263 - DNA, 15 bp, Homo sapiens
ttcctccagcctccc

SEQ ID NO: 1156264 - DNA, 23 bp, Homo sapiens
ttcctccccacactccactctga

SEQ ID NO: 1156265 - DNA, 11 bp, Homo sapiens
ttcctccccag

SEQ ID NO: 1156266 - DNA, 13 bp, Homo sapiens
ttcctccccagca

SEQ ID NO: 1156267 - DNA, 23 bp, Homo sapiens
ttcctccccattagagtcagcct

SEQ ID NO: 1156268 - DNA, 15 bp, Homo sapiens
ttcctccccctgcaa

SEQ ID NO: 1156269 - DNA, 17 bp, Homo sapiens
ttcctccccctgcaact

SEQ ID NO: 1156270 - DNA, 13 bp, Homo sapiens
ttcctcccctctc

SEQ ID NO: 1156271 - DNA, 14 bp, Homo sapiens
ttcctcccctctca

SEQ ID NO: 1156272 - DNA, 16 bp, Homo sapiens
ttcctcccttctgcta

SEQ ID NO: 1156273 - DNA, 12 bp, Homo sapiens
ttcctccggagc

SEQ ID NO: 1156274 - DNA, 21 bp, Homo sapiens
ttcctccgtccacccaggctg

SEQ ID NO: 1156275 - DNA, 22 bp, Homo sapiens
ttcctccgtccacccaggctgc

SEQ ID NO: 1156276 - DNA, 14 bp, Homo sapiens
ttcctcctacctgg

SEQ ID NO: 1156277 - DNA, 12 bp, Homo sapiens
ttcctcctcagg

SEQ ID NO: 1156278 - DNA, 20 bp, Homo sapiens
ttcctcctcaggcacacagc

SEQ ID NO: 1156279 - DNA, 10 bp, Homo sapiens
ttcctcctcc

SEQ ID NO: 1156280 - DNA, 19 bp, Homo sapiens
ttcctcctccacagtgctg

SEQ ID NO: 1156281 - DNA, 20 bp, Homo sapiens
ttcctcctccacagtgctgc

SEQ ID NO: 1156282 - DNA, 11 bp, Homo sapiens
ttcctcctccc

SEQ ID NO: 1156283 - DNA, 16 bp, Homo sapiens
ttcctcctccccgctc

SEQ ID NO: 1156284 - DNA, 16 bp, Homo sapiens
ttcctcctgaagcctc

SEQ ID NO: 1156285 - DNA, 14 bp, Homo sapiens
ttcctcctgatgga

SEQ ID NO: 1156286 - DNA, 14 bp, Homo sapiens
ttcctcctgcagac

SEQ ID NO: 1156287 - DNA, 23 bp, Homo sapiens
ttcctcctgcagacacctggact

SEQ ID NO: 1156288 - DNA, 14 bp, Homo sapiens
ttcctcctgggccc

SEQ ID NO: 1156289 - DNA, 21 bp, Homo sapiens
ttcctccttcactgtttcatc

SEQ ID NO: 1156290 - DNA, 19 bp, Homo sapiens
ttcctcgcctaggcctgtg

SEQ ID NO: 1156291 - DNA, 19 bp, Homo sapiens
ttcctcggtctcccttccg

SEQ ID NO: 1156292 - DNA, 16 bp, Homo sapiens
ttcctcggtggctctg

SEQ ID NO: 1156293 - DNA, 19 bp, Homo sapiens
ttcctcggtgggccagagc

SEQ ID NO: 1156294 - DNA, 19 bp, Homo sapiens
ttcctcgtgcagagctggg

SEQ ID NO: 1156295 - DNA, 21 bp, Homo sapiens
ttcctcgtgcagagctggggc

SEQ ID NO: 1156296 - DNA, 22 bp, Homo sapiens
ttcctctaacatttttgaggaa

SEQ ID NO: 1156297 - DNA, 17 bp, Homo sapiens
ttcctctagaagccaag

SEQ ID NO: 1156298 - DNA, 17 bp, Homo sapiens
ttcctctagttctttgt

SEQ ID NO: 1156299 - DNA, 19 bp, Homo sapiens
ttcctctcactaaacttta

SEQ ID NO: 1156300 - DNA, 14 bp, Homo sapiens
ttcctctccactgc

SEQ ID NO: 1156301 - DNA, 22 bp, Homo sapiens
ttcctctccctcaggggcaggt

SEQ ID NO: 1156302 - DNA, 16 bp, Homo sapiens
ttcctctcccttccct

SEQ ID NO: 1156303 - DNA, 19 bp, Homo sapiens
ttcctctcggctggaagaa

SEQ ID NO: 1156304 - DNA, 13 bp, Homo sapiens
ttcctctctaccc

SEQ ID NO: 1156305 - DNA, 14 bp, Homo sapiens
ttcctctctgtctg

SEQ ID NO: 1156306 - DNA, 19 bp, Homo sapiens
ttcctctctgtctgtctct

SEQ ID NO: 1156307 - DNA, 22 bp, Homo sapiens
ttcctctctgtctgtctctccc

SEQ ID NO: 1156308 - DNA, 14 bp, Homo sapiens
ttcctctgcagttt

SEQ ID NO: 1156309 - DNA, 15 bp, Homo sapiens
ttcctctgcctgccc

SEQ ID NO: 1156310 - DNA, 14 bp, Homo sapiens
ttcctctggccgca

SEQ ID NO: 1156311 - DNA, 15 bp, Homo sapiens
ttcctctggccgcag

SEQ ID NO: 1156312 - DNA, 12 bp, Homo sapiens
ttcctcttccaa

SEQ ID NO: 1156313 - DNA, 13 bp, Homo sapiens
ttcctcttcctgc

SEQ ID NO: 1156314 - DNA, 18 bp, Homo sapiens
ttcctcttgaccctgcac

SEQ ID NO: 1156315 - DNA, 23 bp, Homo sapiens
ttcctcttgaccctgcaccctcc

SEQ ID NO: 1156316 - DNA, 17 bp, Homo sapiens
ttcctcttgatctcaaa

SEQ ID NO: 1156317 - DNA, 22 bp, Homo sapiens
ttcctctttctgctctgccatc

SEQ ID NO: 1156318 - DNA, 13 bp, Homo sapiens
ttcctctttgctt

SEQ ID NO: 1156319 - DNA, 16 bp, Homo sapiens
ttcctctttgctttgc

SEQ ID NO: 1156320 - DNA, 13 bp, Homo sapiens
ttcctcttttgct

SEQ ID NO: 1156321 - DNA, 11 bp, Homo sapiens
ttcctgaaata

SEQ ID NO: 1156322 - DNA, 17 bp, Homo sapiens
ttcctgaaataaatgtt

SEQ ID NO: 1156323 - DNA, 18 bp, Homo sapiens
ttcctgaaataaatgttt

SEQ ID NO: 1156324 - DNA, 14 bp, Homo sapiens
ttcctgaagcattt

SEQ ID NO: 1156325 - DNA, 14 bp, Homo sapiens
ttcctgaagccaga

SEQ ID NO: 1156326 - DNA, 23 bp, Homo sapiens
ttcctgaagccagatccacccta

SEQ ID NO: 1156327 - DNA, 14 bp, Homo sapiens
ttcctgaagctgag

SEQ ID NO: 1156328 - DNA, 14 bp, Homo sapiens
ttcctgaaggggga

SEQ ID NO: 1156329 - DNA, 22 bp, Homo sapiens
ttcctgaattctatttgctggg

SEQ ID NO: 1156330 - DNA, 15 bp, Homo sapiens
ttcctgacattgtct

SEQ ID NO: 1156331 - DNA, 15 bp, Homo sapiens
ttcctgacccaggcc

SEQ ID NO: 1156332 - DNA, 16 bp, Homo sapiens
ttcctgacccaggccg

SEQ ID NO: 1156333 - DNA, 23 bp, Homo sapiens
ttcctgacccaggccgcagctct

SEQ ID NO: 1156334 - DNA, 16 bp, Homo sapiens
ttcctgacttgagtgt

SEQ ID NO: 1156335 - DNA, 18 bp, Homo sapiens
ttcctgagctggcctgtc

SEQ ID NO: 1156336 - DNA, 16 bp, Homo sapiens
ttcctgagcttggcca

SEQ ID NO: 1156337 - DNA, 17 bp, Homo sapiens
ttcctgataataattga

SEQ ID NO: 1156338 - DNA, 19 bp, Homo sapiens
ttcctgcaactcaaggact

SEQ ID NO: 1156339 - DNA, 19 bp, Homo sapiens
ttcctgcagtgaatttgaa

SEQ ID NO: 1156340 - DNA, 18 bp, Homo sapiens
ttcctgcatttctcttct

SEQ ID NO: 1156341 - DNA, 20 bp, Homo sapiens
ttcctgcatttctcttctca

SEQ ID NO: 1156342 - DNA, 18 bp, Homo sapiens
ttcctgcatttgtgaaat

SEQ ID NO: 1156343 - DNA, 18 bp, Homo sapiens
ttcctgccccaggcctga

SEQ ID NO: 1156344 - DNA, 13 bp, Homo sapiens
ttcctgcccctct

SEQ ID NO: 1156345 - DNA, 14 bp, Homo sapiens
ttcctgcccctctt

SEQ ID NO: 1156346 - DNA, 17 bp, Homo sapiens
ttcctgcccctctttct

SEQ ID NO: 1156347 - DNA, 16 bp, Homo sapiens
ttcctgcccttccctc

SEQ ID NO: 1156348 - DNA, 16 bp, Homo sapiens
ttcctgcccttcctca

SEQ ID NO: 1156349 - DNA, 18 bp, Homo sapiens
ttcctgccgcaacagttt

SEQ ID NO: 1156350 - DNA, 11 bp, Homo sapiens
ttcctgccttt

SEQ ID NO: 1156351 - DNA, 19 bp, Homo sapiens
ttcctgcctttaagccaaa

SEQ ID NO: 1156352 - DNA, 17 bp, Homo sapiens
ttcctgcggagtgaaga

SEQ ID NO: 1156353 - DNA, 17 bp, Homo sapiens
ttcctgctacttaaatt

SEQ ID NO: 1156354 - DNA, 22 bp, Homo sapiens
ttcctgctatattaacatcatc

SEQ ID NO: 1156355 - DNA, 11 bp, Homo sapiens
ttcctgctcca

SEQ ID NO: 1156356 - DNA, 21 bp, Homo sapiens
ttcctgctccatgactggctg

SEQ ID NO: 1156357 - DNA, 14 bp, Homo sapiens
ttcctgctctctgc

SEQ ID NO: 1156358 - DNA, 15 bp, Homo sapiens
ttcctgctctctgct

SEQ ID NO: 1156359 - DNA, 21 bp, Homo sapiens
ttcctgctctctgctcatggg

SEQ ID NO: 1156360 - DNA, 18 bp, Homo sapiens
ttcctgctgaacgtttcc

SEQ ID NO: 1156361 - DNA, 14 bp, Homo sapiens
ttcctgctgagcct

SEQ ID NO: 1156362 - DNA, 11 bp, Homo sapiens
ttcctgctgct

SEQ ID NO: 1156363 - DNA, 16 bp, Homo sapiens
ttcctggaaacagcat

SEQ ID NO: 1156364 - DNA, 18 bp, Homo sapiens
ttcctggaaacagcatga

SEQ ID NO: 1156365 - DNA, 19 bp, Homo sapiens
ttcctggaaacagcatgaa

SEQ ID NO: 1156366 - DNA, 11 bp, Homo sapiens
ttcctggacac

SEQ ID NO: 1156367 - DNA, 14 bp, Homo sapiens
ttcctggacacact

SEQ ID NO: 1156368 - DNA, 17 bp, Homo sapiens
tacctcaagttcttgga

SEQ ID NO: 1156369 - DNA, 12 bp, Homo sapiens
tacctcagccta

SEQ ID NO: 1156370 - DNA, 16 bp, Homo sapiens
tacctcagcctagacc

SEQ ID NO: 1156371 - DNA, 18 bp, Homo sapiens
tacctcaggcagctcaag

SEQ ID NO: 1156372 - DNA, 15 bp, Homo sapiens
tacctcaggcaggaa

SEQ ID NO: 1156373 - DNA, 18 bp, Homo sapiens
tacctcatcatccacccg

SEQ ID NO: 1156374 - DNA, 23 bp, Homo sapiens
tacctcatctctgaaaattctgg

SEQ ID NO: 1156375 - DNA, 17 bp, Homo sapiens
tacctccaaccctgccg

SEQ ID NO: 1156376 - DNA, 15 bp, Homo sapiens
tacctccaccctgca

SEQ ID NO: 1156377 - DNA, 17 bp, Homo sapiens
tacctccaccctgcatt

SEQ ID NO: 1156378 - DNA, 22 bp, Homo sapiens
tacctccaccctgcattttcct

SEQ ID NO: 1156379 - DNA, 15 bp, Homo sapiens
tacctcccacactcc

SEQ ID NO: 1156380 - DNA, 13 bp, Homo sapiens
tacctcccctgcc

SEQ ID NO: 1156381 - DNA, 15 bp, Homo sapiens
tacctccccttttct

SEQ ID NO: 1156382 - DNA, 15 bp, Homo sapiens
tacctccctcgcccc

SEQ ID NO: 1156383 - DNA, 14 bp, Homo sapiens
tacctcctctcagt

SEQ ID NO: 1156384 - DNA, 13 bp, Homo sapiens
tacctcctgccca

SEQ ID NO: 1156385 - DNA, 15 bp, Homo sapiens
tacctcctgcccagg

SEQ ID NO: 1156386 - DNA, 13 bp, Homo sapiens
tacctccttgtgt

SEQ ID NO: 1156387 - DNA, 17 bp, Homo sapiens
tacctctagctgttctt

SEQ ID NO: 1156388 - DNA, 21 bp, Homo sapiens
tacctctcaagctagtgtttc

SEQ ID NO: 1156389 - DNA, 11 bp, Homo sapiens
tacctctctcc

SEQ ID NO: 1156390 - DNA, 14 bp, Homo sapiens
tacctctctgtcat

SEQ ID NO: 1156391 - DNA, 21 bp, Homo sapiens
tacctctctgtcccttgctgt

SEQ ID NO: 1156392 - DNA, 21 bp, Homo sapiens
tacctctcttatagaatattt

SEQ ID NO: 1156393 - DNA, 13 bp, Homo sapiens
tacctctctttct

SEQ ID NO: 1156394 - DNA, 14 bp, Homo sapiens
tacctctgatacct

SEQ ID NO: 1156395 - DNA, 17 bp, Homo sapiens
tacctctgatacctcaa

SEQ ID NO: 1156396 - DNA, 13 bp, Homo sapiens
tacctctgctggg

SEQ ID NO: 1156397 - DNA, 12 bp, Homo sapiens
tacctctggaac

SEQ ID NO: 1156398 - DNA, 22 bp, Homo sapiens
tacctctggaaccccccaggcc

SEQ ID NO: 1156399 - DNA, 18 bp, Homo sapiens
tacctctgtatagaaatc

SEQ ID NO: 1156400 - DNA, 19 bp, Homo sapiens
tacctcttcccatgactgc

SEQ ID NO: 1156401 - DNA, 23 bp, Homo sapiens
tacctcttgagccttgaactttg

SEQ ID NO: 1156402 - DNA, 19 bp, Homo sapiens
tacctctttattttttgat

SEQ ID NO: 1156403 - DNA, 17 bp, Homo sapiens
tacctgacactcccttg

SEQ ID NO: 1156404 - DNA, 16 bp, Homo sapiens
tacctgacctcttgct

SEQ ID NO: 1156405 - DNA, 20 bp, Homo sapiens
tacctgacctcttgctgtct

SEQ ID NO: 1156406 - DNA, 13 bp, Homo sapiens
tacctgagaccag

SEQ ID NO: 1156407 - DNA, 17 bp, Homo sapiens
tacctgattgtattttt

SEQ ID NO: 1156408 - DNA, 19 bp, Homo sapiens
tacctgccctaagggactt

SEQ ID NO: 1156409 - DNA, 17 bp, Homo sapiens
tacctgccttttaagtt

SEQ ID NO: 1156410 - DNA, 15 bp, Homo sapiens
tacctggagaagaat

SEQ ID NO: 1156411 - DNA, 15 bp, Homo sapiens
tacctggatgttctt

SEQ ID NO: 1156412 - DNA, 15 bp, Homo sapiens
tacctggcagtggct

SEQ ID NO: 1156413 - DNA, 17 bp, Homo sapiens
tacctggcttttacttt

SEQ ID NO: 1156414 - DNA, 18 bp, Homo sapiens
tacctggctttttaaaat

SEQ ID NO: 1156415 - DNA, 21 bp, Homo sapiens
tacctgggtccttttcagaag

SEQ ID NO: 1156416 - DNA, 16 bp, Homo sapiens
tacctggtccccactg

SEQ ID NO: 1156417 - DNA, 16 bp, Homo sapiens
tacctgtagtgagaaa

SEQ ID NO: 1156418 - DNA, 12 bp, Homo sapiens
tacctgtataca

SEQ ID NO: 1156419 - DNA, 20 bp, Homo sapiens
tacctgtatacagtgcagag

SEQ ID NO: 1156420 - DNA, 14 bp, Homo sapiens
tacctgtgtatata

SEQ ID NO: 1156421 - DNA, 14 bp, Homo sapiens
tacctgttatttat

SEQ ID NO: 1156422 - DNA, 13 bp, Homo sapiens
tacctgttccatt

SEQ ID NO: 1156423 - DNA, 15 bp, Homo sapiens
taccttactatttaa

SEQ ID NO: 1156424 - DNA, 16 bp, Homo sapiens
taccttagattagctc

SEQ ID NO: 1156425 - DNA, 20 bp, Homo sapiens
taccttagattagctctgga

SEQ ID NO: 1156426 - DNA, 16 bp, Homo sapiens
taccttatagttactg

SEQ ID NO: 1156427 - DNA, 15 bp, Homo sapiens
taccttatgctacac

SEQ ID NO: 1156428 - DNA, 16 bp, Homo sapiens
taccttatttattttt

SEQ ID NO: 1156429 - DNA, 14 bp, Homo sapiens
taccttcaaacttt

SEQ ID NO: 1156430 - DNA, 14 bp, Homo sapiens
taccttcagccctg

SEQ ID NO: 1156431 - DNA, 18 bp, Homo sapiens
taccttcagccctggcca

SEQ ID NO: 1156432 - DNA, 14 bp, Homo sapiens
taccttcatgtggt

SEQ ID NO: 1156433 - DNA, 13 bp, Homo sapiens
taccttcatttca

SEQ ID NO: 1156434 - DNA, 14 bp, Homo sapiens
taccttcctgtccc

SEQ ID NO: 1156435 - DNA, 12 bp, Homo sapiens
taccttctaaaa

SEQ ID NO: 1156436 - DNA, 24 bp, Homo sapiens
taccttctaaaagccattattatg

SEQ ID NO: 1156437 - DNA, 15 bp, Homo sapiens
taccttcttcgctgc

SEQ ID NO: 1156438 - DNA, 22 bp, Homo sapiens
taccttgaatagaagttttcct

SEQ ID NO: 1156439 - DNA, 23 bp, Homo sapiens
taccttgctagctagccagccaa

SEQ ID NO: 1156440 - DNA, 16 bp, Homo sapiens
taccttgcttttgctt

SEQ ID NO: 1156441 - DNA, 21 bp, Homo sapiens
taccttgcttttgcttctaga

SEQ ID NO: 1156442 - DNA, 22 bp, Homo sapiens
taccttggttcccccactgatc

SEQ ID NO: 1156443 - DNA, 15 bp, Homo sapiens
taccttgtgcattgt

SEQ ID NO: 1156444 - DNA, 22 bp, Homo sapiens
taccttgtttttaatctcctgt

SEQ ID NO: 1156445 - DNA, 14 bp, Homo sapiens
tacctttatggttt

SEQ ID NO: 1156446 - DNA, 22 bp, Homo sapiens
tacctttctagccttagacaaa

SEQ ID NO: 1156447 - DNA, 12 bp, Homo sapiens
taccttttctat

SEQ ID NO: 1156448 - DNA, 23 bp, Homo sapiens
taccttttctataagttgtacca

SEQ ID NO: 1156449 - DNA, 17 bp, Homo sapiens
taccttttctgttgtac

SEQ ID NO: 1156450 - DNA, 15 bp, Homo sapiens
taccttttgatgttc

SEQ ID NO: 1156451 - DNA, 21 bp, Homo sapiens
taccttttgatgttcagagtg

SEQ ID NO: 1156452 - DNA, 19 bp, Homo sapiens
taccttttttagagttgat

SEQ ID NO: 1156453 - DNA, 13 bp, Homo sapiens
taccttttttata

SEQ ID NO: 1156454 - DNA, 16 bp, Homo sapiens
taccttttttatacat

SEQ ID NO: 1156455 - DNA, 17 bp, Homo sapiens
taccttttttatacata

SEQ ID NO: 1156456 - DNA, 20 bp, Homo sapiens
taccttttttatacataaac

SEQ ID NO: 1156457 - DNA, 16 bp, Homo sapiens
tacgaaataattgttg

SEQ ID NO: 1156458 - DNA, 22 bp, Homo sapiens
tacgaaataattgttgttctgt

SEQ ID NO: 1156459 - DNA, 14 bp, Homo sapiens
tacgaatacttttg

SEQ ID NO: 1156460 - DNA, 23 bp, Homo sapiens
tacgacagtacactgtcagcagg

SEQ ID NO: 1156461 - DNA, 14 bp, Homo sapiens
tacgactaatcacc

SEQ ID NO: 1156462 - DNA, 14 bp, Homo sapiens
tacgactttatttt

SEQ ID NO: 1156463 - DNA, 15 bp, Homo sapiens
tacgactttattttc

SEQ ID NO: 1156464 - DNA, 23 bp, Homo sapiens
tacgatacgctactataaagaga

SEQ ID NO: 1156465 - DNA, 20 bp, Homo sapiens
tacgattatacttgagattt

SEQ ID NO: 1156466 - DNA, 14 bp, Homo sapiens
tacgcagatgctgt

SEQ ID NO: 1156467 - DNA, 15 bp, Homo sapiens
tacgcatcccatctc

SEQ ID NO: 1156468 - DNA, 23 bp, Homo sapiens
tacgccaaagtgcagcccttcct

SEQ ID NO: 1156469 - DNA, 17 bp, Homo sapiens
tacgcccaacccttccc

SEQ ID NO: 1156470 - DNA, 17 bp, Homo sapiens
tacgcccatctcaggac

SEQ ID NO: 1156471 - DNA, 18 bp, Homo sapiens
tacgcctcttctgtccct

SEQ ID NO: 1156472 - DNA, 20 bp, Homo sapiens
tacgctaagcctggaagcca

SEQ ID NO: 1156473 - DNA, 13 bp, Homo sapiens
tacgctgaagatg

SEQ ID NO: 1156474 - DNA, 14 bp, Homo sapiens
tacgctgtccagaa

SEQ ID NO: 1156475 - DNA, 14 bp, Homo sapiens
tacgctttgattca

SEQ ID NO: 1156476 - DNA, 17 bp, Homo sapiens
tacgcttttaatgaaaa

SEQ ID NO: 1156477 - DNA, 22 bp, Homo sapiens
tacggaaaaaattgtattgaaa

SEQ ID NO: 1156478 - DNA, 13 bp, Homo sapiens
tacggacaccccc

SEQ ID NO: 1156479 - DNA, 21 bp, Homo sapiens
tacggcaaccacatgtcccag

SEQ ID NO: 1156480 - DNA, 23 bp, Homo sapiens
tacggcaaccacatgtcccagat

SEQ ID NO: 1156481 - DNA, 14 bp, Homo sapiens
tacgggggctgtga

SEQ ID NO: 1156482 - DNA, 14 bp, Homo sapiens
tacgtaaaacattt

SEQ ID NO: 1156483 - DNA, 15 bp, Homo sapiens
tacgtaaaacatttg

SEQ ID NO: 1156484 - DNA, 13 bp, Homo sapiens
tacgtacacattt

SEQ ID NO: 1156485 - DNA, 15 bp, Homo sapiens
tacgtacacatttta

SEQ ID NO: 1156486 - DNA, 21 bp, Homo sapiens
tacgtagcctaaggctcctgt

SEQ ID NO: 1156487 - DNA, 16 bp, Homo sapiens
tacgtataaatatcag

SEQ ID NO: 1156488 - DNA, 22 bp, Homo sapiens
tacgtatgaatgatatctttga

SEQ ID NO: 1156489 - DNA, 16 bp, Homo sapiens
tacgtatttaatagca

SEQ ID NO: 1156490 - DNA, 23 bp, Homo sapiens
tacgtccgtgtgtcccagatgct

SEQ ID NO: 1156491 - DNA, 14 bp, Homo sapiens
tacgtctgggagaa

SEQ ID NO: 1156492 - DNA, 21 bp, Homo sapiens
tacgtctgggagaaattgaca

SEQ ID NO: 1156493 - DNA, 19 bp, Homo sapiens
tacgtgaagaaataaatga

SEQ ID NO: 1156494 - DNA, 12 bp, Homo sapiens
ttcctggacatc

SEQ ID NO: 1156495 - DNA, 24 bp, Homo sapiens
ttcctggacatcctcttctgctta

SEQ ID NO: 1156496 - DNA, 17 bp, Homo sapiens
ttcctggacctgagtcg

SEQ ID NO: 1156497 - DNA, 17 bp, Homo sapiens
ttcctggacttaaagaa

SEQ ID NO: 1156498 - DNA, 16 bp, Homo sapiens
ttcctggagtgccctg

SEQ ID NO: 1156499 - DNA, 15 bp, Homo sapiens
ttcctggcaatagtg

SEQ ID NO: 1156500 - DNA, 15 bp, Homo sapiens
ttcctggcatttgct

SEQ ID NO: 1156501 - DNA, 21 bp, Homo sapiens
ttcctggcccactctgtaata

SEQ ID NO: 1156502 - DNA, 16 bp, Homo sapiens
ttcctggccccctcat

SEQ ID NO: 1156503 - DNA, 23 bp, Homo sapiens
ttcctggccccgggctctggcca

SEQ ID NO: 1156504 - DNA, 18 bp, Homo sapiens
ttcctggctccttcactg

SEQ ID NO: 1156505 - DNA, 15 bp, Homo sapiens
ttcctggctctgggg

SEQ ID NO: 1156506 - DNA, 11 bp, Homo sapiens
ttcctggctga

SEQ ID NO: 1156507 - DNA, 22 bp, Homo sapiens
ttcctgggaatggaataactat

SEQ ID NO: 1156508 - DNA, 12 bp, Homo sapiens
ttcctgggagga

SEQ ID NO: 1156509 - DNA, 19 bp, Homo sapiens
ttcctgggaggacaggcag

SEQ ID NO: 1156510 - DNA, 20 bp, Homo sapiens
ttcctgggaggacaggcagg

SEQ ID NO: 1156511 - DNA, 17 bp, Homo sapiens
ttcctgggcctttgcaa

SEQ ID NO: 1156512 - DNA, 14 bp, Homo sapiens
ttcctggggatgtc

SEQ ID NO: 1156513 - DNA, 16 bp, Homo sapiens
ttcctggggatgtcat

SEQ ID NO: 1156514 - DNA, 11 bp, Homo sapiens
ttcctggggcc

SEQ ID NO: 1156515 - DNA, 12 bp, Homo sapiens
ttcctggggccg

SEQ ID NO: 1156516 - DNA, 14 bp, Homo sapiens
ttcctggggctgga

SEQ ID NO: 1156517 - DNA, 21 bp, Homo sapiens
ttcctggggtaaagtatcact

SEQ ID NO: 1156518 - DNA, 17 bp, Homo sapiens
ttcctggtacccagcca

SEQ ID NO: 1156519 - DNA, 20 bp, Homo sapiens
ttcctggtgccaatttcaag

SEQ ID NO: 1156520 - DNA, 20 bp, Homo sapiens
ttcctgtaaataagagttgc

SEQ ID NO: 1156521 - DNA, 21 bp, Homo sapiens
ttcctgtaacacaagccacag

SEQ ID NO: 1156522 - DNA, 14 bp, Homo sapiens
ttcctgtaacaggt

SEQ ID NO: 1156523 - DNA, 18 bp, Homo sapiens
ttcctgtagcatcttctg

SEQ ID NO: 1156524 - DNA, 15 bp, Homo sapiens
ttcctgtccagagag

SEQ ID NO: 1156525 - DNA, 12 bp, Homo sapiens
ttcctgtccctt

SEQ ID NO: 1156526 - DNA, 13 bp, Homo sapiens
ttcctgtcctgcc

SEQ ID NO: 1156527 - DNA, 20 bp, Homo sapiens
ttcctgtcctgcctcctcat

SEQ ID NO: 1156528 - DNA, 20 bp, Homo sapiens
ttcctgtccttgttcatgga

SEQ ID NO: 1156529 - DNA, 13 bp, Homo sapiens
ttcctgtctcctt

SEQ ID NO: 1156530 - DNA, 21 bp, Homo sapiens
ttcctgtctggcttctagaga

SEQ ID NO: 1156531 - DNA, 15 bp, Homo sapiens
ttcctgtctgtttat

SEQ ID NO: 1156532 - DNA, 19 bp, Homo sapiens
ttcctgtcttatcctccac

SEQ ID NO: 1156533 - DNA, 20 bp, Homo sapiens
ttcctgtgatacatttctga

SEQ ID NO: 1156534 - DNA, 17 bp, Homo sapiens
ttcctgtgatccaccca

SEQ ID NO: 1156535 - DNA, 23 bp, Homo sapiens
ttcctgtgcagatgctgctgaag

SEQ ID NO: 1156536 - DNA, 16 bp, Homo sapiens
ttcctgtgccctcacc

SEQ ID NO: 1156537 - DNA, 22 bp, Homo sapiens
ttcctgtgctaagtctttccca

SEQ ID NO: 1156538 - DNA, 13 bp, Homo sapiens
ttcctgtggctcc

SEQ ID NO: 1156539 - DNA, 22 bp, Homo sapiens
ttcctgtggttttattacaaat

SEQ ID NO: 1156540 - DNA, 14 bp, Homo sapiens
ttcctgtgtcctga

SEQ ID NO: 1156541 - DNA, 21 bp, Homo sapiens
ttcctgtgtgtactctgtcca

SEQ ID NO: 1156542 - DNA, 17 bp, Homo sapiens
ttcctgtgtttgtcctg

SEQ ID NO: 1156543 - DNA, 14 bp, Homo sapiens
ttcctgttcagtaa

SEQ ID NO: 1156544 - DNA, 14 bp, Homo sapiens
ttcctgttccctcc

SEQ ID NO: 1156545 - DNA, 18 bp, Homo sapiens
ttcctgttccctcctggt

SEQ ID NO: 1156546 - DNA, 21 bp, Homo sapiens
ttcctgttcggttccagacac

SEQ ID NO: 1156547 - DNA, 13 bp, Homo sapiens
ttcctgttcttcc

SEQ ID NO: 1156548 - DNA, 20 bp, Homo sapiens
ttcctgttgatgggaaaagc

SEQ ID NO: 1156549 - DNA, 23 bp, Homo sapiens
ttcctgtttttcacattttcctt

SEQ ID NO: 1156550 - DNA, 20 bp, Homo sapiens
ttccttaaaattaagttgaa

SEQ ID NO: 1156551 - DNA, 13 bp, Homo sapiens
ttccttaaactgt

SEQ ID NO: 1156552 - DNA, 16 bp, Homo sapiens
ttccttaaactgtgtg

SEQ ID NO: 1156553 - DNA, 22 bp, Homo sapiens
ttccttaaatttttagccattt

SEQ ID NO: 1156554 - DNA, 18 bp, Homo sapiens
ttccttacagaactactt

SEQ ID NO: 1156555 - DNA, 20 bp, Homo sapiens
ttccttacctatttcctcag

SEQ ID NO: 1156556 - DNA, 13 bp, Homo sapiens
ttccttacctttt

SEQ ID NO: 1156557 - DNA, 15 bp, Homo sapiens
ttccttacttgcact

SEQ ID NO: 1156558 - DNA, 14 bp, Homo sapiens
ttccttagatacct

SEQ ID NO: 1156559 - DNA, 17 bp, Homo sapiens
ttccttagctatttatc

SEQ ID NO: 1156560 - DNA, 20 bp, Homo sapiens
ttccttagcttagacctcag

SEQ ID NO: 1156561 - DNA, 22 bp, Homo sapiens
ttccttatcacagaaataaaat

SEQ ID NO: 1156562 - DNA, 16 bp, Homo sapiens
ttccttatttctctct

SEQ ID NO: 1156563 - DNA, 20 bp, Homo sapiens
ttccttatttgcttcattgt

SEQ ID NO: 1156564 - DNA, 20 bp, Homo sapiens
ttccttcaaataaagaaatt

SEQ ID NO: 1156565 - DNA, 16 bp, Homo sapiens
ttccttcagggtttaa

SEQ ID NO: 1156566 - DNA, 12 bp, Homo sapiens
ttccttcagttt

SEQ ID NO: 1156567 - DNA, 18 bp, Homo sapiens
ttccttcagtttgtaaag

SEQ ID NO: 1156568 - DNA, 15 bp, Homo sapiens
ttccttcattcatag

SEQ ID NO: 1156569 - DNA, 16 bp, Homo sapiens
ttccttcattcatagg

SEQ ID NO: 1156570 - DNA, 21 bp, Homo sapiens
ttccttcatttccaccaggcc

SEQ ID NO: 1156571 - DNA, 19 bp, Homo sapiens
ttccttccatctagcagct

SEQ ID NO: 1156572 - DNA, 13 bp, Homo sapiens
ttccttccctctc

SEQ ID NO: 1156573 - DNA, 14 bp, Homo sapiens
ttccttccctggct

SEQ ID NO: 1156574 - DNA, 21 bp, Homo sapiens
ttccttccctgggctgtgcta

SEQ ID NO: 1156575 - DNA, 19 bp, Homo sapiens
ttccttcccttttctgttc

SEQ ID NO: 1156576 - DNA, 16 bp, Homo sapiens
ttccttccttccctgg

SEQ ID NO: 1156577 - DNA, 21 bp, Homo sapiens
ttccttcgaaaggccttcaga

SEQ ID NO: 1156578 - DNA, 16 bp, Homo sapiens
ttccttctcatctgtg

SEQ ID NO: 1156579 - DNA, 13 bp, Homo sapiens
ttccttctctggg

SEQ ID NO: 1156580 - DNA, 20 bp, Homo sapiens
ttccttctgctcccacccca

SEQ ID NO: 1156581 - DNA, 13 bp, Homo sapiens
ttccttctggcct

SEQ ID NO: 1156582 - DNA, 21 bp, Homo sapiens
ttccttctggcctctgctgaa

SEQ ID NO: 1156583 - DNA, 13 bp, Homo sapiens
ttccttctgttaa

SEQ ID NO: 1156584 - DNA, 13 bp, Homo sapiens
ttccttgccttaa

SEQ ID NO: 1156585 - DNA, 14 bp, Homo sapiens
ttccttgccttaat

SEQ ID NO: 1156586 - DNA, 16 bp, Homo sapiens
ttccttgctctgcacc

SEQ ID NO: 1156587 - DNA, 18 bp, Homo sapiens
ttccttgctctgcacccc

SEQ ID NO: 1156588 - DNA, 20 bp, Homo sapiens
ttccttgctgtcctaggcca

SEQ ID NO: 1156589 - DNA, 15 bp, Homo sapiens
ttccttggctcccat

SEQ ID NO: 1156590 - DNA, 21 bp, Homo sapiens
ttccttggctcccattcactc

SEQ ID NO: 1156591 - DNA, 13 bp, Homo sapiens
ttccttgggcaga

SEQ ID NO: 1156592 - DNA, 17 bp, Homo sapiens
ttccttgggcgtctccc

SEQ ID NO: 1156593 - DNA, 15 bp, Homo sapiens
ttccttgtcaccagc

SEQ ID NO: 1156594 - DNA, 20 bp, Homo sapiens
ttccttgtgttttgtcctgc

SEQ ID NO: 1156595 - DNA, 22 bp, Homo sapiens
ttccttgtgttttgtcctgcct

SEQ ID NO: 1156596 - DNA, 21 bp, Homo sapiens
ttccttgttagaatgcaagca

SEQ ID NO: 1156597 - DNA, 19 bp, Homo sapiens
ttccttgttggtcagagga

SEQ ID NO: 1156598 - DNA, 21 bp, Homo sapiens
ttccttgtttatcagatacat

SEQ ID NO: 1156599 - DNA, 16 bp, Homo sapiens
ttcctttacaactaaa

SEQ ID NO: 1156600 - DNA, 20 bp, Homo sapiens
ttcctttacaactaaataac

SEQ ID NO: 1156601 - DNA, 16 bp, Homo sapiens
ttcctttaccttttct

SEQ ID NO: 1156602 - DNA, 16 bp, Homo sapiens
ttcctttactcctggc

SEQ ID NO: 1156603 - DNA, 16 bp, Homo sapiens
ttcctttactttccct

SEQ ID NO: 1156604 - DNA, 22 bp, Homo sapiens
ttcctttactttcccttgcttt

SEQ ID NO: 1156605 - DNA, 13 bp, Homo sapiens
ttcctttataatg

SEQ ID NO: 1156606 - DNA, 14 bp, Homo sapiens
ttcctttatattta

SEQ ID NO: 1156607 - DNA, 20 bp, Homo sapiens
ttcctttatatttgctcccc

SEQ ID NO: 1156608 - DNA, 19 bp, Homo sapiens
ttcctttattttgctgctt

SEQ ID NO: 1156609 - DNA, 12 bp, Homo sapiens
ttcctttcctac

SEQ ID NO: 1156610 - DNA, 14 bp, Homo sapiens
ttcctttcctactg

SEQ ID NO: 1156611 - DNA, 19 bp, Homo sapiens
ttcctttcctactgtcctg

SEQ ID NO: 1156612 - DNA, 15 bp, Homo sapiens
ttcctttcctctgca

SEQ ID NO: 1156613 - DNA, 19 bp, Homo sapiens
ttcctttctcatttctttc

SEQ ID NO: 1156614 - DNA, 14 bp, Homo sapiens
ttcctttctccagg

SEQ ID NO: 1156615 - DNA, 19 bp, Homo sapiens
ttcctttctccaggaccaa

SEQ ID NO: 1156616 - DNA, 13 bp, Homo sapiens
ttcctttctctcc

SEQ ID NO: 1156617 - DNA, 15 bp, Homo sapiens
ttcctttctctcctg

SEQ ID NO: 1156618 - DNA, 17 bp, Homo sapiens
ttcctttcttttccccc

SEQ ID NO: 1156619 - DNA, 21 bp, Homo sapiens
tacgtgaagaaataaatgaaa

SEQ ID NO: 1156620 - DNA, 11 bp, Homo sapiens
tacgtgagaaa

SEQ ID NO: 1156621 - DNA, 20 bp, Homo sapiens
tacgtgcaaacaacctgaat

SEQ ID NO: 1156622 - DNA, 12 bp, Homo sapiens
tacgtgcacagg

SEQ ID NO: 1156623 - DNA, 14 bp, Homo sapiens
tacgtgcacagggt

SEQ ID NO: 1156624 - DNA, 20 bp, Homo sapiens
tacgtgcacagggtccccga

SEQ ID NO: 1156625 - DNA, 18 bp, Homo sapiens
tacgtgcatttaaactct

SEQ ID NO: 1156626 - DNA, 19 bp, Homo sapiens
tacgtgcatttaaactctg

SEQ ID NO: 1156627 - DNA, 19 bp, Homo sapiens
tacgtgccagatataactg

SEQ ID NO: 1156628 - DNA, 15 bp, Homo sapiens
tacgtgtatgtttct

SEQ ID NO: 1156629 - DNA, 16 bp, Homo sapiens
tacgtgtatgtttctt

SEQ ID NO: 1156630 - DNA, 14 bp, Homo sapiens
tacgtgtcaatgtg

SEQ ID NO: 1156631 - DNA, 23 bp, Homo sapiens
tacgttaaaagcaaaaagatgta

SEQ ID NO: 1156632 - DNA, 16 bp, Homo sapiens
tacgttgtgcatttgg

SEQ ID NO: 1156633 - DNA, 20 bp, Homo sapiens
tacgtttgtatgtgtgtaga

SEQ ID NO: 1156634 - DNA, 12 bp, Homo sapiens
tacgtttgttat

SEQ ID NO: 1156635 - DNA, 21 bp, Homo sapiens
tacgttttgtgtatatttgct

SEQ ID NO: 1156636 - DNA, 22 bp, Homo sapiens
tacgttttgtgtatatttgctt

SEQ ID NO: 1156637 - DNA, 16 bp, Homo sapiens
tactaaaaaaaagatg

SEQ ID NO: 1156638 - DNA, 23 bp, Homo sapiens
tactaaaaagaaggaaaatgatc

SEQ ID NO: 1156639 - DNA, 18 bp, Homo sapiens
tactaaaaagtataaaat

SEQ ID NO: 1156640 - DNA, 14 bp, Homo sapiens
tactaaagaaagat

SEQ ID NO: 1156641 - DNA, 18 bp, Homo sapiens
tactaaagatatcagagc

SEQ ID NO: 1156642 - DNA, 23 bp, Homo sapiens
tactaaagcaaattgtttcagtt

SEQ ID NO: 1156643 - DNA, 17 bp, Homo sapiens
tactaaatggtgttaca

SEQ ID NO: 1156644 - DNA, 22 bp, Homo sapiens
tactaaatggtgttacattaaa

SEQ ID NO: 1156645 - DNA, 17 bp, Homo sapiens
tactaaccagcagaaat

SEQ ID NO: 1156646 - DNA, 19 bp, Homo sapiens
tactaaccagcagaaatgc

SEQ ID NO: 1156647 - DNA, 14 bp, Homo sapiens
tactaactaaactc

SEQ ID NO: 1156648 - DNA, 15 bp, Homo sapiens
tactaactaaactct

SEQ ID NO: 1156649 - DNA, 19 bp, Homo sapiens
tactaagatgaaattgcca

SEQ ID NO: 1156650 - DNA, 20 bp, Homo sapiens
tactaagcattgaatggcta

SEQ ID NO: 1156651 - DNA, 22 bp, Homo sapiens
tactaagctttgccagctgctg

SEQ ID NO: 1156652 - DNA, 17 bp, Homo sapiens
tactaaggaaaataata

SEQ ID NO: 1156653 - DNA, 18 bp, Homo sapiens
tactaagggaacaatcca

SEQ ID NO: 1156654 - DNA, 22 bp, Homo sapiens
tactaagggaacaatccatgtg

SEQ ID NO: 1156655 - DNA, 22 bp, Homo sapiens
tactaagtggactggtgtcata

SEQ ID NO: 1156656 - DNA, 14 bp, Homo sapiens
tactaataaactaa

SEQ ID NO: 1156657 - DNA, 16 bp, Homo sapiens
tactaataaactaata

SEQ ID NO: 1156658 - DNA, 22 bp, Homo sapiens
tactaataaactaataattgca

SEQ ID NO: 1156659 - DNA, 13 bp, Homo sapiens
tactaataaattg

SEQ ID NO: 1156660 - DNA, 23 bp, Homo sapiens
tactaatctgagattgtgtttgt

SEQ ID NO: 1156661 - DNA, 17 bp, Homo sapiens
tactaatgatgctttta

SEQ ID NO: 1156662 - DNA, 13 bp, Homo sapiens
tactaatgatgtt

SEQ ID NO: 1156663 - DNA, 18 bp, Homo sapiens
tactaattctatttctct

SEQ ID NO: 1156664 - DNA, 18 bp, Homo sapiens
tactaattttacacatta

SEQ ID NO: 1156665 - DNA, 17 bp, Homo sapiens
tactacaacttttgttt

SEQ ID NO: 1156666 - DNA, 20 bp, Homo sapiens
tactacactggtgtgtccct

SEQ ID NO: 1156667 - DNA, 15 bp, Homo sapiens
tactacagaaattct

SEQ ID NO: 1156668 - DNA, 15 bp, Homo sapiens
tactacagtcaagat

SEQ ID NO: 1156669 - DNA, 17 bp, Homo sapiens
tactacagtcaagatag

SEQ ID NO: 1156670 - DNA, 13 bp, Homo sapiens
tactacagtttgt

SEQ ID NO: 1156671 - DNA, 14 bp, Homo sapiens
tactaccacaagga

SEQ ID NO: 1156672 - DNA, 16 bp, Homo sapiens
tactaccacaaggaaa

SEQ ID NO: 1156673 - DNA, 17 bp, Homo sapiens
tactaccagaagggctt

SEQ ID NO: 1156674 - DNA, 18 bp, Homo sapiens
tactacctataggaaagt

SEQ ID NO: 1156675 - DNA, 15 bp, Homo sapiens
tactacggagaaact

SEQ ID NO: 1156676 - DNA, 17 bp, Homo sapiens
tactactcctttggaaa

SEQ ID NO: 1156677 - DNA, 14 bp, Homo sapiens
tactactctgccaa

SEQ ID NO: 1156678 - DNA, 15 bp, Homo sapiens
tactactgaaacaga

SEQ ID NO: 1156679 - DNA, 21 bp, Homo sapiens
tactactgaaacagatttcat

SEQ ID NO: 1156680 - DNA, 23 bp, Homo sapiens
tactactttgttaggattttcac

SEQ ID NO: 1156681 - DNA, 20 bp, Homo sapiens
tactacttttgcatgaaaat

SEQ ID NO: 1156682 - DNA, 17 bp, Homo sapiens
tactagatgcatcactg

SEQ ID NO: 1156683 - DNA, 18 bp, Homo sapiens
tactagatgcatcactgg

SEQ ID NO: 1156684 - DNA, 20 bp, Homo sapiens
tactagatgcatcactgggt

SEQ ID NO: 1156685 - DNA, 21 bp, Homo sapiens
tactagatgcatcactgggtg

SEQ ID NO: 1156686 - DNA, 14 bp, Homo sapiens
tactagcaaaataa

SEQ ID NO: 1156687 - DNA, 14 bp, Homo sapiens
tactagcatactta

SEQ ID NO: 1156688 - DNA, 20 bp, Homo sapiens
tactaggccattagcccttc

SEQ ID NO: 1156689 - DNA, 15 bp, Homo sapiens
tactaggtgacatgt

SEQ ID NO: 1156690 - DNA, 22 bp, Homo sapiens
tactagtcaccagagactttag

SEQ ID NO: 1156691 - DNA, 16 bp, Homo sapiens
tactagtgttctgttt

SEQ ID NO: 1156692 - DNA, 19 bp, Homo sapiens
tactagttacacatcttca

SEQ ID NO: 1156693 - DNA, 22 bp, Homo sapiens
tactataagtagttggtttgta

SEQ ID NO: 1156694 - DNA, 17 bp, Homo sapiens
tactatagcaaagtagt

SEQ ID NO: 1156695 - DNA, 12 bp, Homo sapiens
tactatagtacc

SEQ ID NO: 1156696 - DNA, 15 bp, Homo sapiens
tactatatacatata

SEQ ID NO: 1156697 - DNA, 14 bp, Homo sapiens
tactatatttacaa

SEQ ID NO: 1156698 - DNA, 15 bp, Homo sapiens
tactatatttgctag

SEQ ID NO: 1156699 - DNA, 21 bp, Homo sapiens
tactatcatactactgaaaca

SEQ ID NO: 1156700 - DNA, 14 bp, Homo sapiens
tactatcattctca

SEQ ID NO: 1156701 - DNA, 17 bp, Homo sapiens
tactatccatgtaataa

SEQ ID NO: 1156702 - DNA, 21 bp, Homo sapiens
tactatccccaaactccttta

SEQ ID NO: 1156703 - DNA, 22 bp, Homo sapiens
tactatccccaaactcctttac

SEQ ID NO: 1156704 - DNA, 16 bp, Homo sapiens
tactatcctgtaaata

SEQ ID NO: 1156705 - DNA, 21 bp, Homo sapiens
tactatgatcagaagaacatg

SEQ ID NO: 1156706 - DNA, 15 bp, Homo sapiens
tactatggagtacca

SEQ ID NO: 1156707 - DNA, 14 bp, Homo sapiens
tactatgtatcaat

SEQ ID NO: 1156708 - DNA, 21 bp, Homo sapiens
tactatgtatgtttttttcca

SEQ ID NO: 1156709 - DNA, 15 bp, Homo sapiens
tactatgtgctgggt

SEQ ID NO: 1156710 - DNA, 22 bp, Homo sapiens
tactattaagcagtaaaaactg

SEQ ID NO: 1156711 - DNA, 13 bp, Homo sapiens
tactattattgtt

SEQ ID NO: 1156712 - DNA, 22 bp, Homo sapiens
tactattcagtggcgagaaata

SEQ ID NO: 1156713 - DNA, 22 bp, Homo sapiens
tactattccctttgacttcagc

SEQ ID NO: 1156714 - DNA, 23 bp, Homo sapiens
tactattccctttgacttcagct

SEQ ID NO: 1156715 - DNA, 20 bp, Homo sapiens
tactattcttggttcttatt

SEQ ID NO: 1156716 - DNA, 19 bp, Homo sapiens
tactatttaaagcctcctc

SEQ ID NO: 1156717 - DNA, 13 bp, Homo sapiens
tactatttagatt

SEQ ID NO: 1156718 - DNA, 12 bp, Homo sapiens
tactatttcttg

SEQ ID NO: 1156719 - DNA, 21 bp, Homo sapiens
tactatttcttgtggttataa

SEQ ID NO: 1156720 - DNA, 22 bp, Homo sapiens
tactatttcttgtggttataac

SEQ ID NO: 1156721 - DNA, 19 bp, Homo sapiens
tactattttctacaattaa

SEQ ID NO: 1156722 - DNA, 17 bp, Homo sapiens
tactcaaactccattct

SEQ ID NO: 1156723 - DNA, 15 bp, Homo sapiens
tactcaaagcccaga

SEQ ID NO: 1156724 - DNA, 18 bp, Homo sapiens
tactcaaatgagtaacat

SEQ ID NO: 1156725 - DNA, 22 bp, Homo sapiens
tactcaaatggtgtcatggctg

SEQ ID NO: 1156726 - DNA, 16 bp, Homo sapiens
tactcaagctgtctct

SEQ ID NO: 1156727 - DNA, 16 bp, Homo sapiens
tactcaagtgttaaat

SEQ ID NO: 1156728 - DNA, 16 bp, Homo sapiens
tactcaagtttcaggt

SEQ ID NO: 1156729 - DNA, 15 bp, Homo sapiens
tactcacagtctctt

SEQ ID NO: 1156730 - DNA, 21 bp, Homo sapiens
tactcacattttgttaagaag

SEQ ID NO: 1156731 - DNA, 18 bp, Homo sapiens
tactcacttttcacttgt

SEQ ID NO: 1156732 - DNA, 15 bp, Homo sapiens
tactcagaactgtcc

SEQ ID NO: 1156733 - DNA, 18 bp, Homo sapiens
tactcagaactgtcccat

SEQ ID NO: 1156734 - DNA, 20 bp, Homo sapiens
tactcagaatagctgttttg

SEQ ID NO: 1156735 - DNA, 12 bp, Homo sapiens
tactcagagcag

SEQ ID NO: 1156736 - DNA, 13 bp, Homo sapiens
tactcagagcaga

SEQ ID NO: 1156737 - DNA, 22 bp, Homo sapiens
tactcagcagcagagagccctg

SEQ ID NO: 1156738 - DNA, 14 bp, Homo sapiens
tactcagcagccct

SEQ ID NO: 1156739 - DNA, 23 bp, Homo sapiens
tactcagcagccctcctcacccc

SEQ ID NO: 1156740 - DNA, 14 bp, Homo sapiens
tactcagccctggg

SEQ ID NO: 1156741 - DNA, 23 bp, Homo sapiens
tactcagccctgggccccaccac

SEQ ID NO: 1156742 - DNA, 16 bp, Homo sapiens
tactcagcctgctgcc

SEQ ID NO: 1156743 - DNA, 13 bp, Homo sapiens
ttcctttgaagat

SEQ ID NO: 1156744 - DNA, 16 bp, Homo sapiens
ttcctttgctctgagg

SEQ ID NO: 1156745 - DNA, 22 bp, Homo sapiens
ttcctttggaacaagacagcct

SEQ ID NO: 1156746 - DNA, 16 bp, Homo sapiens
ttcctttggaagaaaa

SEQ ID NO: 1156747 - DNA, 17 bp, Homo sapiens
ttcctttggaagaaaaa

SEQ ID NO: 1156748 - DNA, 15 bp, Homo sapiens
ttcctttggagcttt

SEQ ID NO: 1156749 - DNA, 20 bp, Homo sapiens
ttcctttggggaagtttatt

SEQ ID NO: 1156750 - DNA, 17 bp, Homo sapiens
ttcctttgtcttcaaac

SEQ ID NO: 1156751 - DNA, 18 bp, Homo sapiens
ttcctttgtgtttctatt

SEQ ID NO: 1156752 - DNA, 23 bp, Homo sapiens
ttccttttaaaaggccctgtggt

SEQ ID NO: 1156753 - DNA, 18 bp, Homo sapiens
ttccttttctaactctcc

SEQ ID NO: 1156754 - DNA, 18 bp, Homo sapiens
ttccttttctctcctgtg

SEQ ID NO: 1156755 - DNA, 14 bp, Homo sapiens
ttccttttgaaatt

SEQ ID NO: 1156756 - DNA, 15 bp, Homo sapiens
ttccttttgatgggg

SEQ ID NO: 1156757 - DNA, 18 bp, Homo sapiens
ttccttttgatggggaga

SEQ ID NO: 1156758 - DNA, 15 bp, Homo sapiens
ttccttttggaacat

SEQ ID NO: 1156759 - DNA, 16 bp, Homo sapiens
ttccttttggaacatt

SEQ ID NO: 1156760 - DNA, 17 bp, Homo sapiens
ttccttttggaacattt

SEQ ID NO: 1156761 - DNA, 20 bp, Homo sapiens
ttccttttggaacatttctt

SEQ ID NO: 1156762 - DNA, 16 bp, Homo sapiens
ttcctttttaaatgtg

SEQ ID NO: 1156763 - DNA, 20 bp, Homo sapiens
ttcctttttaatatgcttaa

SEQ ID NO: 1156764 - DNA, 14 bp, Homo sapiens
ttcctttttcagat

SEQ ID NO: 1156765 - DNA, 15 bp, Homo sapiens
ttcctttttctatga

SEQ ID NO: 1156766 - DNA, 16 bp, Homo sapiens
ttcctttttgacactg

SEQ ID NO: 1156767 - DNA, 17 bp, Homo sapiens
ttcctttttgacactga

SEQ ID NO: 1156768 - DNA, 18 bp, Homo sapiens
ttcctttttgacactgaa

SEQ ID NO: 1156769 - DNA, 20 bp, Homo sapiens
ttcgaaaagcactttgaaaa

SEQ ID NO: 1156770 - DNA, 13 bp, Homo sapiens
ttcgaaaatcaaa

SEQ ID NO: 1156771 - DNA, 17 bp, Homo sapiens
ttcgaaactgccaaggg

SEQ ID NO: 1156772 - DNA, 17 bp, Homo sapiens
ttcgaaaggccttcaga

SEQ ID NO: 1156773 - DNA, 23 bp, Homo sapiens
ttcgaagctgttaatttttctta

SEQ ID NO: 1156774 - DNA, 15 bp, Homo sapiens
ttcgacatatttcct

SEQ ID NO: 1156775 - DNA, 17 bp, Homo sapiens
ttcgacatgctgccagg

SEQ ID NO: 1156776 - DNA, 19 bp, Homo sapiens
ttcgactggtccagctctg

SEQ ID NO: 1156777 - DNA, 16 bp, Homo sapiens
ttcgagaccagcctgg

SEQ ID NO: 1156778 - DNA, 17 bp, Homo sapiens
ttcgagaccagcctggc

SEQ ID NO: 1156779 - DNA, 20 bp, Homo sapiens
ttcgagacccaaacccccaa

SEQ ID NO: 1156780 - DNA, 13 bp, Homo sapiens
ttcgagactccat

SEQ ID NO: 1156781 - DNA, 15 bp, Homo sapiens
ttcgaggcctgaagc

SEQ ID NO: 1156782 - DNA, 20 bp, Homo sapiens
ttcgaggcctgaagccagct

SEQ ID NO: 1156783 - DNA, 18 bp, Homo sapiens
ttcgagtagagaggcccg

SEQ ID NO: 1156784 - DNA, 20 bp, Homo sapiens
ttcgataaacaacaaggtgg

SEQ ID NO: 1156785 - DNA, 16 bp, Homo sapiens
ttcgcacactgtgatt

SEQ ID NO: 1156786 - DNA, 18 bp, Homo sapiens
ttcgcaccattctcctgc

SEQ ID NO: 1156787 - DNA, 17 bp, Homo sapiens
ttcgcagctgaagtgga

SEQ ID NO: 1156788 - DNA, 18 bp, Homo sapiens
ttcgcatggtcacacact

SEQ ID NO: 1156789 - DNA, 21 bp, Homo sapiens
ttcgcatggtcacacactgat

SEQ ID NO: 1156790 - DNA, 21 bp, Homo sapiens
ttcgccttaatacttttttat

SEQ ID NO: 1156791 - DNA, 14 bp, Homo sapiens
ttcgcctttgtctt

SEQ ID NO: 1156792 - DNA, 12 bp, Homo sapiens
ttcgctgcaacc

SEQ ID NO: 1156793 - DNA, 21 bp, Homo sapiens
ttcggaaaaaaaaaaagaaaa

SEQ ID NO: 1156794 - DNA, 17 bp, Homo sapiens
ttcggagcgttctctgt

SEQ ID NO: 1156795 - DNA, 18 bp, Homo sapiens
ttcggccccatgtatctc

SEQ ID NO: 1156796 - DNA, 20 bp, Homo sapiens
ttcgggaggtcgaggcagga

SEQ ID NO: 1156797 - DNA, 12 bp, Homo sapiens
ttcgggctgtgc

SEQ ID NO: 1156798 - DNA, 14 bp, Homo sapiens
ttcgggctgtgccc

SEQ ID NO: 1156799 - DNA, 19 bp, Homo sapiens
ttcgggggagcagagagag

SEQ ID NO: 1156800 - DNA, 17 bp, Homo sapiens
ttcgggtgtgcaatgtc

SEQ ID NO: 1156801 - DNA, 21 bp, Homo sapiens
ttcgggtgtgcaatgtctgag

SEQ ID NO: 1156802 - DNA, 22 bp, Homo sapiens
ttcggtggctagtcaagctcct

SEQ ID NO: 1156803 - DNA, 18 bp, Homo sapiens
ttcggttctccagaatgt

SEQ ID NO: 1156804 - DNA, 16 bp, Homo sapiens
ttcgtaccgcttcctt

SEQ ID NO: 1156805 - DNA, 14 bp, Homo sapiens
ttcgtaccttccca

SEQ ID NO: 1156806 - DNA, 18 bp, Homo sapiens
ttcgtcatttgcaagctg

SEQ ID NO: 1156807 - DNA, 12 bp, Homo sapiens
ttcgtctgtccc

SEQ ID NO: 1156808 - DNA, 13 bp, Homo sapiens
ttcgtctgtccca

SEQ ID NO: 1156809 - DNA, 18 bp, Homo sapiens
ttcgtctgtcccagagct

SEQ ID NO: 1156810 - DNA, 13 bp, Homo sapiens
ttcgtcttctaat

SEQ ID NO: 1156811 - DNA, 14 bp, Homo sapiens
ttcgtcttctaatt

SEQ ID NO: 1156812 - DNA, 12 bp, Homo sapiens
ttcgtgaacata

SEQ ID NO: 1156813 - DNA, 13 bp, Homo sapiens
ttcgtgagctggg

SEQ ID NO: 1156814 - DNA, 15 bp, Homo sapiens
ttcgtgcactctgct

SEQ ID NO: 1156815 - DNA, 16 bp, Homo sapiens
ttcgtggcagcacggc

SEQ ID NO: 1156816 - DNA, 13 bp, Homo sapiens
ttcgtggggaggt

SEQ ID NO: 1156817 - DNA, 21 bp, Homo sapiens
ttcgtgtctctcccaccccgg

SEQ ID NO: 1156818 - DNA, 14 bp, Homo sapiens
ttcgtgtgctgctg

SEQ ID NO: 1156819 - DNA, 16 bp, Homo sapiens
ttcgtgtgctgctgct

SEQ ID NO: 1156820 - DNA, 12 bp, Homo sapiens
ttcgtgtggctc

SEQ ID NO: 1156821 - DNA, 18 bp, Homo sapiens
ttcgttaatagattattt

SEQ ID NO: 1156822 - DNA, 20 bp, Homo sapiens
ttcgttagtaatctgtataa

SEQ ID NO: 1156823 - DNA, 15 bp, Homo sapiens
ttcgtttattttcaa

SEQ ID NO: 1156824 - DNA, 17 bp, Homo sapiens
ttcgtttttcttggggt

SEQ ID NO: 1156825 - DNA, 14 bp, Homo sapiens
ttctaaaaaaagaa

SEQ ID NO: 1156826 - DNA, 14 bp, Homo sapiens
ttctaaaaagtcag

SEQ ID NO: 1156827 - DNA, 18 bp, Homo sapiens
ttctaaaaagtcagatgt

SEQ ID NO: 1156828 - DNA, 13 bp, Homo sapiens
ttctaaaagccat

SEQ ID NO: 1156829 - DNA, 16 bp, Homo sapiens
ttctaaacaagatttt

SEQ ID NO: 1156830 - DNA, 23 bp, Homo sapiens
ttctaaacccaatccaaatggcg

SEQ ID NO: 1156831 - DNA, 13 bp, Homo sapiens
ttctaaagacagg

SEQ ID NO: 1156832 - DNA, 22 bp, Homo sapiens
ttctaaagcactggtttcaaga

SEQ ID NO: 1156833 - DNA, 18 bp, Homo sapiens
ttctaaaggctacctttg

SEQ ID NO: 1156834 - DNA, 19 bp, Homo sapiens
ttctaaaggctacctttgt

SEQ ID NO: 1156835 - DNA, 21 bp, Homo sapiens
ttctaaaggctacctttgtat

SEQ ID NO: 1156836 - DNA, 19 bp, Homo sapiens
ttctaaagtaaaattgaag

SEQ ID NO: 1156837 - DNA, 12 bp, Homo sapiens
ttctaaagtgtt

SEQ ID NO: 1156838 - DNA, 20 bp, Homo sapiens
ttctaaataaggaatttcct

SEQ ID NO: 1156839 - DNA, 21 bp, Homo sapiens
ttctaaatgaatgtttacact

SEQ ID NO: 1156840 - DNA, 23 bp, Homo sapiens
ttctaaatgcatatcctgagcca

SEQ ID NO: 1156841 - DNA, 13 bp, Homo sapiens
ttctaacagtcct

SEQ ID NO: 1156842 - DNA, 16 bp, Homo sapiens
ttctaacatatgtatt

SEQ ID NO: 1156843 - DNA, 19 bp, Homo sapiens
ttctaaccaagaggctggt

SEQ ID NO: 1156844 - DNA, 22 bp, Homo sapiens
ttctaaccttgaatgctgccag

SEQ ID NO: 1156845 - DNA, 14 bp, Homo sapiens
ttctaacctttaca

SEQ ID NO: 1156846 - DNA, 16 bp, Homo sapiens
ttctaacctttacatg

SEQ ID NO: 1156847 - DNA, 15 bp, Homo sapiens
ttctaactgtagcta

SEQ ID NO: 1156848 - DNA, 22 bp, Homo sapiens
ttctaagaaaatgtagttagct

SEQ ID NO: 1156849 - DNA, 21 bp, Homo sapiens
ttctaagaaatagagccaact

SEQ ID NO: 1156850 - DNA, 17 bp, Homo sapiens
ttctaagaaccaaaaaa

SEQ ID NO: 1156851 - DNA, 16 bp, Homo sapiens
ttctaagaagttactt

SEQ ID NO: 1156852 - DNA, 18 bp, Homo sapiens
ttctaagaagttgtttga

SEQ ID NO: 1156853 - DNA, 13 bp, Homo sapiens
ttctaagagaagt

SEQ ID NO: 1156854 - DNA, 22 bp, Homo sapiens
ttctaagagcgaacttcacata

SEQ ID NO: 1156855 - DNA, 23 bp, Homo sapiens
ttctaagatgccagcatatactg

SEQ ID NO: 1156856 - DNA, 13 bp, Homo sapiens
ttctaagatgttc

SEQ ID NO: 1156857 - DNA, 13 bp, Homo sapiens
ttctaagcatgta

SEQ ID NO: 1156858 - DNA, 23 bp, Homo sapiens
ttctaaggcaggaatttgagagt

SEQ ID NO: 1156859 - DNA, 12 bp, Homo sapiens
ttctaagtcttt

SEQ ID NO: 1156860 - DNA, 17 bp, Homo sapiens
ttctaagtctttccatt

SEQ ID NO: 1156861 - DNA, 14 bp, Homo sapiens
ttctaagtgggaga

SEQ ID NO: 1156862 - DNA, 14 bp, Homo sapiens
ttctaagttagact

SEQ ID NO: 1156863 - DNA, 19 bp, Homo sapiens
ttctaagttatttactttt

SEQ ID NO: 1156864 - DNA, 21 bp, Homo sapiens
ttctaagttcatgtttgtaaa

SEQ ID NO: 1156865 - DNA, 18 bp, Homo sapiens
ttctaataaatatactat

SEQ ID NO: 1156866 - DNA, 14 bp, Homo sapiens
ttctaataactgct

SEQ ID NO: 1156867 - DNA, 12 bp, Homo sapiens
ttctaatagaac

SEQ ID NO: 1156868 - DNA, 12 bp, Homo sapiens
tactcaggaggc

SEQ ID NO: 1156869 - DNA, 23 bp, Homo sapiens
tactcaggctggtggagaactct

SEQ ID NO: 1156870 - DNA, 16 bp, Homo sapiens
tactcagggctcctcc

SEQ ID NO: 1156871 - DNA, 18 bp, Homo sapiens
tactcagggctcctccca

SEQ ID NO: 1156872 - DNA, 19 bp, Homo sapiens
tactcagggctcctcccag

SEQ ID NO: 1156873 - DNA, 16 bp, Homo sapiens
tactcatgaatgaaaa

SEQ ID NO: 1156874 - DNA, 16 bp, Homo sapiens
tactcatgatcttgtg

SEQ ID NO: 1156875 - DNA, 20 bp, Homo sapiens
tactccaggacttagaatag

SEQ ID NO: 1156876 - DNA, 23 bp, Homo sapiens
tactccaggacttagaatagtgc

SEQ ID NO: 1156877 - DNA, 18 bp, Homo sapiens
tactccatacataacttg

SEQ ID NO: 1156878 - DNA, 13 bp, Homo sapiens
tactcccccacca

SEQ ID NO: 1156879 - DNA, 21 bp, Homo sapiens
tactcccctgggcatcttctg

SEQ ID NO: 1156880 - DNA, 10 bp, Homo sapiens
tactcccctt

SEQ ID NO: 1156881 - DNA, 16 bp, Homo sapiens
tactcccctttcttcc

SEQ ID NO: 1156882 - DNA, 20 bp, Homo sapiens
tactcccctttcttccaaac

SEQ ID NO: 1156883 - DNA, 16 bp, Homo sapiens
tactccctcttcactg

SEQ ID NO: 1156884 - DNA, 13 bp, Homo sapiens
tactccctcttcc

SEQ ID NO: 1156885 - DNA, 13 bp, Homo sapiens
tactccctgcaga

SEQ ID NO: 1156886 - DNA, 16 bp, Homo sapiens
tactccctgcagatgc

SEQ ID NO: 1156887 - DNA, 16 bp, Homo sapiens
tactcccttcctggcc

SEQ ID NO: 1156888 - DNA, 15 bp, Homo sapiens
tactccctttaaaga

SEQ ID NO: 1156889 - DNA, 16 bp, Homo sapiens
tactcctacctcagcc

SEQ ID NO: 1156890 - DNA, 15 bp, Homo sapiens
tactcctcctctttc

SEQ ID NO: 1156891 - DNA, 23 bp, Homo sapiens
tactcctcctctttctctcccca

SEQ ID NO: 1156892 - DNA, 16 bp, Homo sapiens
tactcctctgcagtgc

SEQ ID NO: 1156893 - DNA, 16 bp, Homo sapiens
tactcctgcaaaattt

SEQ ID NO: 1156894 - DNA, 22 bp, Homo sapiens
tactcctgcaaaattttatagc

SEQ ID NO: 1156895 - DNA, 13 bp, Homo sapiens
tactcctgcggct

SEQ ID NO: 1156896 - DNA, 9 bp, Homo sapiens
tactcctgg

SEQ ID NO: 1156897 - DNA, 22 bp, Homo sapiens
tactcctggctcaagccctgaa

SEQ ID NO: 1156898 - DNA, 12 bp, Homo sapiens
tactcctgggtc

SEQ ID NO: 1156899 - DNA, 17 bp, Homo sapiens
tactcctgtaattccta

SEQ ID NO: 1156900 - DNA, 22 bp, Homo sapiens
tactcctgtaattcctacctcc

SEQ ID NO: 1156901 - DNA, 16 bp, Homo sapiens
tactcctgtgctctgg

SEQ ID NO: 1156902 - DNA, 19 bp, Homo sapiens
tactcctgtgctctggagg

SEQ ID NO: 1156903 - DNA, 14 bp, Homo sapiens
tactcctttggaaa

SEQ ID NO: 1156904 - DNA, 18 bp, Homo sapiens
tactccttttggctgggg

SEQ ID NO: 1156905 - DNA, 22 bp, Homo sapiens
tactcgggaggctgaggcagga

SEQ ID NO: 1156906 - DNA, 18 bp, Homo sapiens
tactcgttggatgtctgt

SEQ ID NO: 1156907 - DNA, 20 bp, Homo sapiens
tactctaaagaaaaatgcct

SEQ ID NO: 1156908 - DNA, 23 bp, Homo sapiens
tactctaaagcttctataaaata

SEQ ID NO: 1156909 - DNA, 14 bp, Homo sapiens
tactctaaatagaa

SEQ ID NO: 1156910 - DNA, 19 bp, Homo sapiens
tactctacaattcctctga

SEQ ID NO: 1156911 - DNA, 16 bp, Homo sapiens
tactctacgccaaagt

SEQ ID NO: 1156912 - DNA, 21 bp, Homo sapiens
tactctagaacatgcacattt

SEQ ID NO: 1156913 - DNA, 22 bp, Homo sapiens
tactctagcctgggccagagaa

SEQ ID NO: 1156914 - DNA, 15 bp, Homo sapiens
tactctcacatgtgg

SEQ ID NO: 1156915 - DNA, 14 bp, Homo sapiens
tactctccaacctg

SEQ ID NO: 1156916 - DNA, 15 bp, Homo sapiens
tactctcctgtttgg

SEQ ID NO: 1156917 - DNA, 16 bp, Homo sapiens
tactctctgctctagc

SEQ ID NO: 1156918 - DNA, 16 bp, Homo sapiens
tactctcttgccagca

SEQ ID NO: 1156919 - DNA, 11 bp, Homo sapiens
tactctgagcc

SEQ ID NO: 1156920 - DNA, 16 bp, Homo sapiens
tactctgagcccaggc

SEQ ID NO: 1156921 - DNA, 18 bp, Homo sapiens
tactctgagcccaggccg

SEQ ID NO: 1156922 - DNA, 21 bp, Homo sapiens
tactctggaatgtttttccct

SEQ ID NO: 1156923 - DNA, 17 bp, Homo sapiens
tactctggcaaatgatg

SEQ ID NO: 1156924 - DNA, 20 bp, Homo sapiens
tactctggtggattgttcta

SEQ ID NO: 1156925 - DNA, 16 bp, Homo sapiens
tactctgtagtctcag

SEQ ID NO: 1156926 - DNA, 15 bp, Homo sapiens
tactctgtccaggcc

SEQ ID NO: 1156927 - DNA, 16 bp, Homo sapiens
tactctgtccaggcca

SEQ ID NO: 1156928 - DNA, 17 bp, Homo sapiens
tactctgtccaggccac

SEQ ID NO: 1156929 - DNA, 15 bp, Homo sapiens
tactctgtgtaaata

SEQ ID NO: 1156930 - DNA, 20 bp, Homo sapiens
tactctgtgtttaaaaagta

SEQ ID NO: 1156931 - DNA, 20 bp, Homo sapiens
tactctgttgagtaaaacac

SEQ ID NO: 1156932 - DNA, 15 bp, Homo sapiens
tactcttcagggtct

SEQ ID NO: 1156933 - DNA, 12 bp, Homo sapiens
tactcttccgaa

SEQ ID NO: 1156934 - DNA, 17 bp, Homo sapiens
tactcttcttgaaattt

SEQ ID NO: 1156935 - DNA, 18 bp, Homo sapiens
tactcttcttgaaatttt

SEQ ID NO: 1156936 - DNA, 11 bp, Homo sapiens
tactctttcaa

SEQ ID NO: 1156937 - DNA, 12 bp, Homo sapiens
tactctttcaat

SEQ ID NO: 1156938 - DNA, 17 bp, Homo sapiens
tactctttcaataaatg

SEQ ID NO: 1156939 - DNA, 13 bp, Homo sapiens
tactctttcctat

SEQ ID NO: 1156940 - DNA, 13 bp, Homo sapiens
tactctttctgta

SEQ ID NO: 1156941 - DNA, 19 bp, Homo sapiens
tactctttttcaataaatt

SEQ ID NO: 1156942 - DNA, 14 bp, Homo sapiens
tactctttttgttt

SEQ ID NO: 1156943 - DNA, 13 bp, Homo sapiens
tactgaaagcctt

SEQ ID NO: 1156944 - DNA, 23 bp, Homo sapiens
tactgaaatttgttatacttcaa

SEQ ID NO: 1156945 - DNA, 20 bp, Homo sapiens
tactgaacacatgtgtatga

SEQ ID NO: 1156946 - DNA, 18 bp, Homo sapiens
tactgaacatctgagtcc

SEQ ID NO: 1156947 - DNA, 21 bp, Homo sapiens
tactgaacatctgagtcctgg

SEQ ID NO: 1156948 - DNA, 16 bp, Homo sapiens
tactgaaccagccacg

SEQ ID NO: 1156949 - DNA, 17 bp, Homo sapiens
tactgaaccctgcctct

SEQ ID NO: 1156950 - DNA, 22 bp, Homo sapiens
tactgaactgtgtgtaattgtt

SEQ ID NO: 1156951 - DNA, 12 bp, Homo sapiens
tactgaaggaaa

SEQ ID NO: 1156952 - DNA, 19 bp, Homo sapiens
tactgaaggaaaaacacaa

SEQ ID NO: 1156953 - DNA, 18 bp, Homo sapiens
tactgaaggtgccagacg

SEQ ID NO: 1156954 - DNA, 19 bp, Homo sapiens
tactgaagtcttttctgtc

SEQ ID NO: 1156955 - DNA, 20 bp, Homo sapiens
tactgaagtcttttctgtca

SEQ ID NO: 1156956 - DNA, 18 bp, Homo sapiens
tactgaataatatcaaat

SEQ ID NO: 1156957 - DNA, 18 bp, Homo sapiens
tactgaataatgctacca

SEQ ID NO: 1156958 - DNA, 20 bp, Homo sapiens
tactgaataatgctaccagg

SEQ ID NO: 1156959 - DNA, 13 bp, Homo sapiens
tactgaatctgct

SEQ ID NO: 1156960 - DNA, 19 bp, Homo sapiens
tactgaatgtcattgaaaa

SEQ ID NO: 1156961 - DNA, 16 bp, Homo sapiens
tactgaatttttttgt

SEQ ID NO: 1156962 - DNA, 19 bp, Homo sapiens
tactgaatttttttgtaat

SEQ ID NO: 1156963 - DNA, 21 bp, Homo sapiens
tactgacagggagcagccccc

SEQ ID NO: 1156964 - DNA, 20 bp, Homo sapiens
tactgacatgtggggccagg

SEQ ID NO: 1156965 - DNA, 20 bp, Homo sapiens
tactgactccaaccattcaa

SEQ ID NO: 1156966 - DNA, 17 bp, Homo sapiens
tactgactgagaatata

SEQ ID NO: 1156967 - DNA, 16 bp, Homo sapiens
tactgagacagggtgc

SEQ ID NO: 1156968 - DNA, 14 bp, Homo sapiens
tactgagacttgtt

SEQ ID NO: 1156969 - DNA, 12 bp, Homo sapiens
tactgagatgct

SEQ ID NO: 1156970 - DNA, 17 bp, Homo sapiens
tactgagatgctgggct

SEQ ID NO: 1156971 - DNA, 14 bp, Homo sapiens
tactgagcttctct

SEQ ID NO: 1156972 - DNA, 23 bp, Homo sapiens
tactgagggaccaactgggccca

SEQ ID NO: 1156973 - DNA, 16 bp, Homo sapiens
tactgaggggattctc

SEQ ID NO: 1156974 - DNA, 14 bp, Homo sapiens
tactgagtgagtta

SEQ ID NO: 1156975 - DNA, 16 bp, Homo sapiens
tactgatatattttac

SEQ ID NO: 1156976 - DNA, 16 bp, Homo sapiens
tactgatcatgcattg

SEQ ID NO: 1156977 - DNA, 17 bp, Homo sapiens
tactgatcatgcattgt

SEQ ID NO: 1156978 - DNA, 13 bp, Homo sapiens
tactgatgatgtg

SEQ ID NO: 1156979 - DNA, 16 bp, Homo sapiens
tactgattgggaggtg

SEQ ID NO: 1156980 - DNA, 15 bp, Homo sapiens
tactgattgtttcat

SEQ ID NO: 1156981 - DNA, 22 bp, Homo sapiens
tactgatttagaagcaaagatt

SEQ ID NO: 1156982 - DNA, 22 bp, Homo sapiens
tactgatttgggctgaatgtat

SEQ ID NO: 1156983 - DNA, 23 bp, Homo sapiens
tactgatttgggctgaatgtatg

SEQ ID NO: 1156984 - DNA, 20 bp, Homo sapiens
tactgattttaaaatgaata

SEQ ID NO: 1156985 - DNA, 17 bp, Homo sapiens
tactgatttttgtgatt

SEQ ID NO: 1156986 - DNA, 20 bp, Homo sapiens
tactgcaaagtcgccagtca

SEQ ID NO: 1156987 - DNA, 22 bp, Homo sapiens
tactgcaaatcaggcttttgtt

SEQ ID NO: 1156988 - DNA, 14 bp, Homo sapiens
tactgcaagaaaat

SEQ ID NO: 1156989 - DNA, 15 bp, Homo sapiens
tactgcaagaaaatg

SEQ ID NO: 1156990 - DNA, 18 bp, Homo sapiens
tactgcactccagcctgg

SEQ ID NO: 1156991 - DNA, 13 bp, Homo sapiens
tactgcactttcc

SEQ ID NO: 1156992 - DNA, 17 bp, Homo sapiens
tactgcactttccccct

SEQ ID NO: 1156993 - DNA, 16 bp, Homo sapiens
ttctaatagagagatt

SEQ ID NO: 1156994 - DNA, 15 bp, Homo sapiens
ttctaatcacagtgt

SEQ ID NO: 1156995 - DNA, 21 bp, Homo sapiens
ttctaatcccagcactttggt

SEQ ID NO: 1156996 - DNA, 21 bp, Homo sapiens
ttctaatgaggagagaaaata

SEQ ID NO: 1156997 - DNA, 23 bp, Homo sapiens
ttctaatgaggagagaaaatata

SEQ ID NO: 1156998 - DNA, 13 bp, Homo sapiens
ttctaatgtcttc

SEQ ID NO: 1156999 - DNA, 17 bp, Homo sapiens
ttctaatgtcttcattt

SEQ ID NO: 1157000 - DNA, 14 bp, Homo sapiens
ttctaattgtaagt

SEQ ID NO: 1157001 - DNA, 21 bp, Homo sapiens
ttctaatttgcactaatgtgt

SEQ ID NO: 1157002 - DNA, 15 bp, Homo sapiens
ttctaatttttaaga

SEQ ID NO: 1157003 - DNA, 22 bp, Homo sapiens
ttctacaaaataacattctgaa

SEQ ID NO: 1157004 - DNA, 19 bp, Homo sapiens
ttctacaagcatatttgag

SEQ ID NO: 1157005 - DNA, 21 bp, Homo sapiens
ttctacaagcatatttgagaa

SEQ ID NO: 1157006 - DNA, 13 bp, Homo sapiens
ttctacaaggact

SEQ ID NO: 1157007 - DNA, 17 bp, Homo sapiens
ttctacaattaatagtt

SEQ ID NO: 1157008 - DNA, 12 bp, Homo sapiens
ttctacacctgg

SEQ ID NO: 1157009 - DNA, 15 bp, Homo sapiens
ttctacagaacctga

SEQ ID NO: 1157010 - DNA, 17 bp, Homo sapiens
ttctacagaacctgagg

SEQ ID NO: 1157011 - DNA, 19 bp, Homo sapiens
ttctacagaacctgagggc

SEQ ID NO: 1157012 - DNA, 13 bp, Homo sapiens
ttctacagaataa

SEQ ID NO: 1157013 - DNA, 17 bp, Homo sapiens
ttctacagagaaaatga

SEQ ID NO: 1157014 - DNA, 19 bp, Homo sapiens
ttctacagagaaaatgaat

SEQ ID NO: 1157015 - DNA, 21 bp, Homo sapiens
ttctacagagaaaatgaattt

SEQ ID NO: 1157016 - DNA, 22 bp, Homo sapiens
ttctacatgactgggcctccct

SEQ ID NO: 1157017 - DNA, 17 bp, Homo sapiens
ttctaccaggcaaattc

SEQ ID NO: 1157018 - DNA, 15 bp, Homo sapiens
ttctaccatttcaga

SEQ ID NO: 1157019 - DNA, 18 bp, Homo sapiens
ttctaccatttcagagag

SEQ ID NO: 1157020 - DNA, 18 bp, Homo sapiens
ttctacccaacggccctg

SEQ ID NO: 1157021 - DNA, 17 bp, Homo sapiens
ttctaccccaaggccag

SEQ ID NO: 1157022 - DNA, 19 bp, Homo sapiens
ttctaccccaaggccagta

SEQ ID NO: 1157023 - DNA, 20 bp, Homo sapiens
ttctaccctagccattcctg

SEQ ID NO: 1157024 - DNA, 23 bp, Homo sapiens
ttctaccggagagagaatgtatt

SEQ ID NO: 1157025 - DNA, 13 bp, Homo sapiens
ttctacctgccct

SEQ ID NO: 1157026 - DNA, 20 bp, Homo sapiens
ttctactaaaaatacaaaaa

SEQ ID NO: 1157027 - DNA, 20 bp, Homo sapiens
ttctactatatacatatata

SEQ ID NO: 1157028 - DNA, 12 bp, Homo sapiens
ttctactggaaa

SEQ ID NO: 1157029 - DNA, 18 bp, Homo sapiens
ttctactgtactttttta

SEQ ID NO: 1157030 - DNA, 13 bp, Homo sapiens
ttctactgtgact

SEQ ID NO: 1157031 - DNA, 19 bp, Homo sapiens
ttctacttcccctgggatg

SEQ ID NO: 1157032 - DNA, 18 bp, Homo sapiens
ttctactttaagcactac

SEQ ID NO: 1157033 - DNA, 17 bp, Homo sapiens
ttctagaaactctggct

SEQ ID NO: 1157034 - DNA, 18 bp, Homo sapiens
ttctagaagcacatgtgt

SEQ ID NO: 1157035 - DNA, 21 bp, Homo sapiens
ttctagaatttatcacacttc

SEQ ID NO: 1157036 - DNA, 12 bp, Homo sapiens
ttctagaccaat

SEQ ID NO: 1157037 - DNA, 15 bp, Homo sapiens
ttctagacgcccctc

SEQ ID NO: 1157038 - DNA, 18 bp, Homo sapiens
ttctagacgcccctccca

SEQ ID NO: 1157039 - DNA, 21 bp, Homo sapiens
ttctagacgcccctcccaagc

SEQ ID NO: 1157040 - DNA, 14 bp, Homo sapiens
ttctagagaagagg

SEQ ID NO: 1157041 - DNA, 22 bp, Homo sapiens
ttctagagaagaggctggtgct

SEQ ID NO: 1157042 - DNA, 15 bp, Homo sapiens
ttctagagttatctt

SEQ ID NO: 1157043 - DNA, 19 bp, Homo sapiens
ttctagatacaataaattg

SEQ ID NO: 1157044 - DNA, 19 bp, Homo sapiens
ttctagatgcaagtctctt

SEQ ID NO: 1157045 - DNA, 17 bp, Homo sapiens
ttctagattcactgtct

SEQ ID NO: 1157046 - DNA, 15 bp, Homo sapiens
ttctagcaggcagga

SEQ ID NO: 1157047 - DNA, 18 bp, Homo sapiens
ttctagcccatggacttc

SEQ ID NO: 1157048 - DNA, 21 bp, Homo sapiens
ttctagccttagacaaatgat

SEQ ID NO: 1157049 - DNA, 21 bp, Homo sapiens
ttctagcgaacgtatttctcc

SEQ ID NO: 1157050 - DNA, 23 bp, Homo sapiens
ttctagcgaacgtatttctccag

SEQ ID NO: 1157051 - DNA, 17 bp, Homo sapiens
ttctagcgcaaggcact

SEQ ID NO: 1157052 - DNA, 18 bp, Homo sapiens
ttctagctagaaatatga

SEQ ID NO: 1157053 - DNA, 19 bp, Homo sapiens
ttctagctagaaatatgat

SEQ ID NO: 1157054 - DNA, 21 bp, Homo sapiens
ttctagctgagctttaaatca

SEQ ID NO: 1157055 - DNA, 14 bp, Homo sapiens
ttctagctgtatga

SEQ ID NO: 1157056 - DNA, 13 bp, Homo sapiens
ttctagctgtctg

SEQ ID NO: 1157057 - DNA, 14 bp, Homo sapiens
ttctagctgtctgt

SEQ ID NO: 1157058 - DNA, 12 bp, Homo sapiens
ttctagctgttg

SEQ ID NO: 1157059 - DNA, 20 bp, Homo sapiens
ttctagctgttgagctgttt

SEQ ID NO: 1157060 - DNA, 21 bp, Homo sapiens
ttctagctgttgagctgtttt

SEQ ID NO: 1157061 - DNA, 15 bp, Homo sapiens
ttctagcttttctct

SEQ ID NO: 1157062 - DNA, 19 bp, Homo sapiens
ttctaggaaattcttgaaa

SEQ ID NO: 1157063 - DNA, 16 bp, Homo sapiens
ttctaggcatctctgt

SEQ ID NO: 1157064 - DNA, 22 bp, Homo sapiens
ttctaggcccattgtcctcctt

SEQ ID NO: 1157065 - DNA, 23 bp, Homo sapiens
ttctaggctacaattttctccca

SEQ ID NO: 1157066 - DNA, 18 bp, Homo sapiens
ttctaggggtagctggtg

SEQ ID NO: 1157067 - DNA, 17 bp, Homo sapiens
ttctaggtaggaagagc

SEQ ID NO: 1157068 - DNA, 16 bp, Homo sapiens
ttctagtacataattg

SEQ ID NO: 1157069 - DNA, 12 bp, Homo sapiens
ttctagtactgt

SEQ ID NO: 1157070 - DNA, 16 bp, Homo sapiens
ttctagtactgtattg

SEQ ID NO: 1157071 - DNA, 19 bp, Homo sapiens
ttctagtatttttttctta

SEQ ID NO: 1157072 - DNA, 21 bp, Homo sapiens
ttctagtctcctttgcactga

SEQ ID NO: 1157073 - DNA, 22 bp, Homo sapiens
ttctagtctcctttgcactgag

SEQ ID NO: 1157074 - DNA, 13 bp, Homo sapiens
ttctagtgctgct

SEQ ID NO: 1157075 - DNA, 18 bp, Homo sapiens
ttctagtgctgctgaaga

SEQ ID NO: 1157076 - DNA, 11 bp, Homo sapiens
ttctagtgtcc

SEQ ID NO: 1157077 - DNA, 13 bp, Homo sapiens
ttctagttttatg

SEQ ID NO: 1157078 - DNA, 12 bp, Homo sapiens
ttctataaatca

SEQ ID NO: 1157079 - DNA, 15 bp, Homo sapiens
ttctataaatcagta

SEQ ID NO: 1157080 - DNA, 14 bp, Homo sapiens
ttctataaggccat

SEQ ID NO: 1157081 - DNA, 21 bp, Homo sapiens
ttctataaggccataaaacag

SEQ ID NO: 1157082 - DNA, 21 bp, Homo sapiens
ttctataagttgtaccaaaac

SEQ ID NO: 1157083 - DNA, 22 bp, Homo sapiens
ttctataagttgtaccaaaaca

SEQ ID NO: 1157084 - DNA, 16 bp, Homo sapiens
ttctataataagtttt

SEQ ID NO: 1157085 - DNA, 21 bp, Homo sapiens
ttctataatttccatttactt

SEQ ID NO: 1157086 - DNA, 20 bp, Homo sapiens
ttctatagccataaacctga

SEQ ID NO: 1157087 - DNA, 22 bp, Homo sapiens
ttctatatagttccttgcctta

SEQ ID NO: 1157088 - DNA, 15 bp, Homo sapiens
ttctatatttatttt

SEQ ID NO: 1157089 - DNA, 16 bp, Homo sapiens
ttctatattttaatag

SEQ ID NO: 1157090 - DNA, 23 bp, Homo sapiens
ttctatcagacgtgctccctccc

SEQ ID NO: 1157091 - DNA, 17 bp, Homo sapiens
ttctatcaggaaaacaa

SEQ ID NO: 1157092 - DNA, 23 bp, Homo sapiens
ttctatcaggaaaacaaatcact

SEQ ID NO: 1157093 - DNA, 22 bp, Homo sapiens
ttctatcagttatcctttgtga

SEQ ID NO: 1157094 - DNA, 20 bp, Homo sapiens
ttctatcattccaattctaa

SEQ ID NO: 1157095 - DNA, 16 bp, Homo sapiens
ttctatccatctcctg

SEQ ID NO: 1157096 - DNA, 16 bp, Homo sapiens
ttctatccccaagctg

SEQ ID NO: 1157097 - DNA, 23 bp, Homo sapiens
ttctatcctacaacaagagttta

SEQ ID NO: 1157098 - DNA, 15 bp, Homo sapiens
ttctatcctcatctt

SEQ ID NO: 1157099 - DNA, 13 bp, Homo sapiens
ttctatcttttgt

SEQ ID NO: 1157100 - DNA, 20 bp, Homo sapiens
ttctatcttttgtttccttt

SEQ ID NO: 1157101 - DNA, 22 bp, Homo sapiens
ttctatgaactagtctacttct

SEQ ID NO: 1157102 - DNA, 17 bp, Homo sapiens
ttctatgacaaattcaa

SEQ ID NO: 1157103 - DNA, 13 bp, Homo sapiens
ttctatgagaaaa

SEQ ID NO: 1157104 - DNA, 16 bp, Homo sapiens
ttctatgatccttttt

SEQ ID NO: 1157105 - DNA, 22 bp, Homo sapiens
ttctatgatccttttttgtcat

SEQ ID NO: 1157106 - DNA, 21 bp, Homo sapiens
ttctatggagactttgctgtt

SEQ ID NO: 1157107 - DNA, 24 bp, Homo sapiens
ttctatgtaaattattgtaaactt

SEQ ID NO: 1157108 - DNA, 16 bp, Homo sapiens
ttctatgtcattttta

SEQ ID NO: 1157109 - DNA, 21 bp, Homo sapiens
ttctatgtcatttttaatgta

SEQ ID NO: 1157110 - DNA, 22 bp, Homo sapiens
ttctatgtcatttttaatgtat

SEQ ID NO: 1157111 - DNA, 22 bp, Homo sapiens
ttctatgtgacaattttgtaca

SEQ ID NO: 1157112 - DNA, 15 bp, Homo sapiens
ttctatgttaaatac

SEQ ID NO: 1157113 - DNA, 20 bp, Homo sapiens
ttctatgttaaatactgtgc

SEQ ID NO: 1157114 - DNA, 22 bp, Homo sapiens
ttctattaatcaagagaaactt

SEQ ID NO: 1157115 - DNA, 21 bp, Homo sapiens
ttctattacctattaggtgga

SEQ ID NO: 1157116 - DNA, 21 bp, Homo sapiens
tactgcactttcccccttccc

SEQ ID NO: 1157117 - DNA, 17 bp, Homo sapiens
tactgcagaatacagta

SEQ ID NO: 1157118 - DNA, 12 bp, Homo sapiens
tactgcagcctg

SEQ ID NO: 1157119 - DNA, 23 bp, Homo sapiens
tactgcagctttacatgcaattt

SEQ ID NO: 1157120 - DNA, 17 bp, Homo sapiens
tactgcatactttttaa

SEQ ID NO: 1157121 - DNA, 22 bp, Homo sapiens
tactgcatactttttaaatgta

SEQ ID NO: 1157122 - DNA, 22 bp, Homo sapiens
tactgcattctctcccatcctg

SEQ ID NO: 1157123 - DNA, 15 bp, Homo sapiens
tactgccactgtgtg

SEQ ID NO: 1157124 - DNA, 16 bp, Homo sapiens
tactgccactgtgtgc

SEQ ID NO: 1157125 - DNA, 12 bp, Homo sapiens
tactgcccaagg

SEQ ID NO: 1157126 - DNA, 19 bp, Homo sapiens
tactgcccaggcctgcctg

SEQ ID NO: 1157127 - DNA, 21 bp, Homo sapiens
tactgcccaggcctgcctgtt

SEQ ID NO: 1157128 - DNA, 22 bp, Homo sapiens
tactgcccaggcctgcctgttc

SEQ ID NO: 1157129 - DNA, 16 bp, Homo sapiens
tactgcccctctccga

SEQ ID NO: 1157130 - DNA, 19 bp, Homo sapiens
tactgccggtcacccaggc

SEQ ID NO: 1157131 - DNA, 20 bp, Homo sapiens
tactgccggtcacccaggct

SEQ ID NO: 1157132 - DNA, 21 bp, Homo sapiens
tactgccggtcacccaggctc

SEQ ID NO: 1157133 - DNA, 17 bp, Homo sapiens
tactgcctactgttact

SEQ ID NO: 1157134 - DNA, 22 bp, Homo sapiens
tactgcctactgttactctaaa

SEQ ID NO: 1157135 - DNA, 21 bp, Homo sapiens
tactgcctataatcttataca

SEQ ID NO: 1157136 - DNA, 19 bp, Homo sapiens
tactgccttcctccttatc

SEQ ID NO: 1157137 - DNA, 18 bp, Homo sapiens
tactgcctttagaaaata

SEQ ID NO: 1157138 - DNA, 18 bp, Homo sapiens
tactgcgactttctgcct

SEQ ID NO: 1157139 - DNA, 20 bp, Homo sapiens
tactgctactgtaattttat

SEQ ID NO: 1157140 - DNA, 15 bp, Homo sapiens
tactgctcaggctgc

SEQ ID NO: 1157141 - DNA, 22 bp, Homo sapiens
tactgctcaggctgcagctgga

SEQ ID NO: 1157142 - DNA, 14 bp, Homo sapiens
tactgctcctgtgg

SEQ ID NO: 1157143 - DNA, 11 bp, Homo sapiens
tactgctctga

SEQ ID NO: 1157144 - DNA, 13 bp, Homo sapiens
tactgctctgaga

SEQ ID NO: 1157145 - DNA, 19 bp, Homo sapiens
tactgctctttattgcaga

SEQ ID NO: 1157146 - DNA, 16 bp, Homo sapiens
tactgctgctgtgctt

SEQ ID NO: 1157147 - DNA, 21 bp, Homo sapiens
tactgcttctctttgtgcagt

SEQ ID NO: 1157148 - DNA, 14 bp, Homo sapiens
tactgcttgatttt

SEQ ID NO: 1157149 - DNA, 17 bp, Homo sapiens
tactgctttaatcagaa

SEQ ID NO: 1157150 - DNA, 21 bp, Homo sapiens
tactggaaatgtagcacttac

SEQ ID NO: 1157151 - DNA, 14 bp, Homo sapiens
tactggaataaaca

SEQ ID NO: 1157152 - DNA, 14 bp, Homo sapiens
tactggaataattt

SEQ ID NO: 1157153 - DNA, 17 bp, Homo sapiens
tactggaataatttgta

SEQ ID NO: 1157154 - DNA, 22 bp, Homo sapiens
tactggaataatttgtaaatga

SEQ ID NO: 1157155 - DNA, 23 bp, Homo sapiens
tactggaataatttgtaaatgat

SEQ ID NO: 1157156 - DNA, 22 bp, Homo sapiens
tactggacacactaaactctgg

SEQ ID NO: 1157157 - DNA, 23 bp, Homo sapiens
tactggacacactaaactctggg

SEQ ID NO: 1157158 - DNA, 22 bp, Homo sapiens
tactggacttgaatggttaata

SEQ ID NO: 1157159 - DNA, 16 bp, Homo sapiens
tactggataaattgtt

SEQ ID NO: 1157160 - DNA, 13 bp, Homo sapiens
tactggattctta

SEQ ID NO: 1157161 - DNA, 18 bp, Homo sapiens
tactggcaaaaggatctt

SEQ ID NO: 1157162 - DNA, 11 bp, Homo sapiens
tactggcagct

SEQ ID NO: 1157163 - DNA, 19 bp, Homo sapiens
tactggcagctcctctcct

SEQ ID NO: 1157164 - DNA, 14 bp, Homo sapiens
tactggcaggaggg

SEQ ID NO: 1157165 - DNA, 22 bp, Homo sapiens
tactggcattggcccttggtgg

SEQ ID NO: 1157166 - DNA, 15 bp, Homo sapiens
tactggccaattttt

SEQ ID NO: 1157167 - DNA, 15 bp, Homo sapiens
tactggccagtgtca

SEQ ID NO: 1157168 - DNA, 22 bp, Homo sapiens
tactgggccttagtgggccagg

SEQ ID NO: 1157169 - DNA, 20 bp, Homo sapiens
tactgggtgtcatttcattc

SEQ ID NO: 1157170 - DNA, 22 bp, Homo sapiens
tactggtgtcaccctttgccta

SEQ ID NO: 1157171 - DNA, 14 bp, Homo sapiens
tactggttgcatgg

SEQ ID NO: 1157172 - DNA, 13 bp, Homo sapiens
tactgtaaaagtt

SEQ ID NO: 1157173 - DNA, 20 bp, Homo sapiens
tactgtaaaagttataataa

SEQ ID NO: 1157174 - DNA, 23 bp, Homo sapiens
tactgtaaaagttataataactg

SEQ ID NO: 1157175 - DNA, 11 bp, Homo sapiens
tactgtaacac

SEQ ID NO: 1157176 - DNA, 16 bp, Homo sapiens
tactgtaattcctcaa

SEQ ID NO: 1157177 - DNA, 15 bp, Homo sapiens
tactgtaatttgtga

SEQ ID NO: 1157178 - DNA, 18 bp, Homo sapiens
tactgtaatttgtgatac

SEQ ID NO: 1157179 - DNA, 19 bp, Homo sapiens
tactgtaatttgtgataca

SEQ ID NO: 1157180 - DNA, 20 bp, Homo sapiens
tactgtaattttatatgaag

SEQ ID NO: 1157181 - DNA, 18 bp, Homo sapiens
tactgtacaataaaaaca

SEQ ID NO: 1157182 - DNA, 18 bp, Homo sapiens
tactgtacagattgctgc

SEQ ID NO: 1157183 - DNA, 16 bp, Homo sapiens
tactgtacataaattc

SEQ ID NO: 1157184 - DNA, 19 bp, Homo sapiens
tactgtacataaattccag

SEQ ID NO: 1157185 - DNA, 18 bp, Homo sapiens
tactgtacatgaaaacac

SEQ ID NO: 1157186 - DNA, 22 bp, Homo sapiens
tactgtacatgaaaacacattt

SEQ ID NO: 1157187 - DNA, 14 bp, Homo sapiens
tactgtacatgcta

SEQ ID NO: 1157188 - DNA, 13 bp, Homo sapiens
tactgtactatcc

SEQ ID NO: 1157189 - DNA, 14 bp, Homo sapiens
tactgtacttaata

SEQ ID NO: 1157190 - DNA, 15 bp, Homo sapiens
tactgtactttttta

SEQ ID NO: 1157191 - DNA, 21 bp, Homo sapiens
tactgtagaaagatcgtttaa

SEQ ID NO: 1157192 - DNA, 17 bp, Homo sapiens
tactgtagctgatgaaa

SEQ ID NO: 1157193 - DNA, 21 bp, Homo sapiens
tactgtatcatgacaaagact

SEQ ID NO: 1157194 - DNA, 16 bp, Homo sapiens
tactgtatgccttctg

SEQ ID NO: 1157195 - DNA, 18 bp, Homo sapiens
tactgtatgccttctgta

SEQ ID NO: 1157196 - DNA, 15 bp, Homo sapiens
tactgtatttctaag

SEQ ID NO: 1157197 - DNA, 16 bp, Homo sapiens
tactgtatttctaaga

SEQ ID NO: 1157198 - DNA, 16 bp, Homo sapiens
tactgtatttttacta

SEQ ID NO: 1157199 - DNA, 16 bp, Homo sapiens
tactgtcaaatgatgt

SEQ ID NO: 1157200 - DNA, 21 bp, Homo sapiens
tactgtcaaatgatgtgcaaa

SEQ ID NO: 1157201 - DNA, 11 bp, Homo sapiens
tactgtcaata

SEQ ID NO: 1157202 - DNA, 15 bp, Homo sapiens
tactgtcaataaaca

SEQ ID NO: 1157203 - DNA, 16 bp, Homo sapiens
tactgtcaataaacag

SEQ ID NO: 1157204 - DNA, 11 bp, Homo sapiens
tactgtcctgg

SEQ ID NO: 1157205 - DNA, 22 bp, Homo sapiens
tactgtctcactgaaacattta

SEQ ID NO: 1157206 - DNA, 14 bp, Homo sapiens
tactgtctcctccc

SEQ ID NO: 1157207 - DNA, 13 bp, Homo sapiens
tactgtctgggat

SEQ ID NO: 1157208 - DNA, 16 bp, Homo sapiens
tactgtctggttttaa

SEQ ID NO: 1157209 - DNA, 19 bp, Homo sapiens
tactgtctggttttaacaa

SEQ ID NO: 1157210 - DNA, 21 bp, Homo sapiens
tactgtcttcagtaagccgtg

SEQ ID NO: 1157211 - DNA, 15 bp, Homo sapiens
tactgtgaaactggc

SEQ ID NO: 1157212 - DNA, 13 bp, Homo sapiens
tactgtgaaatac

SEQ ID NO: 1157213 - DNA, 22 bp, Homo sapiens
tactgtgaaatgagttggccag

SEQ ID NO: 1157214 - DNA, 16 bp, Homo sapiens
tactgtgcagaataat

SEQ ID NO: 1157215 - DNA, 17 bp, Homo sapiens
tactgtgcagaataatg

SEQ ID NO: 1157216 - DNA, 17 bp, Homo sapiens
tactgtgcctggtttga

SEQ ID NO: 1157217 - DNA, 20 bp, Homo sapiens
tactgtggggagagatggca

SEQ ID NO: 1157218 - DNA, 23 bp, Homo sapiens
tactgtgtaaatatatgtctgat

SEQ ID NO: 1157219 - DNA, 13 bp, Homo sapiens
tactgtgtaatta

SEQ ID NO: 1157220 - DNA, 14 bp, Homo sapiens
tactgtgtaattag

SEQ ID NO: 1157221 - DNA, 22 bp, Homo sapiens
tactgtgtacagaattctgcta

SEQ ID NO: 1157222 - DNA, 13 bp, Homo sapiens
tactgtgtatgtt

SEQ ID NO: 1157223 - DNA, 17 bp, Homo sapiens
tactgtgtatgttttat

SEQ ID NO: 1157224 - DNA, 17 bp, Homo sapiens
tactgtgtgtgagtgtg

SEQ ID NO: 1157225 - DNA, 14 bp, Homo sapiens
tactgtgtgtgtga

SEQ ID NO: 1157226 - DNA, 23 bp, Homo sapiens
tactgtgtgtgtgaatgaacact

SEQ ID NO: 1157227 - DNA, 16 bp, Homo sapiens
tactgttactctaaat

SEQ ID NO: 1157228 - DNA, 17 bp, Homo sapiens
tactgttactctaaata

SEQ ID NO: 1157229 - DNA, 14 bp, Homo sapiens
tactgttcctttca

SEQ ID NO: 1157230 - DNA, 14 bp, Homo sapiens
tactgttctgtgtc

SEQ ID NO: 1157231 - DNA, 16 bp, Homo sapiens
tactgttctgtgtctt

SEQ ID NO: 1157232 - DNA, 15 bp, Homo sapiens
tactgttgatacaaa

SEQ ID NO: 1157233 - DNA, 17 bp, Homo sapiens
tactgttgatacaaacc

SEQ ID NO: 1157234 - DNA, 21 bp, Homo sapiens
tactgttgcatttacttttaa

SEQ ID NO: 1157235 - DNA, 18 bp, Homo sapiens
tactgttgctttaatatg

SEQ ID NO: 1157236 - DNA, 14 bp, Homo sapiens
tactgtttacagtt

SEQ ID NO: 1157237 - DNA, 13 bp, Homo sapiens
tactgtttctcaa

SEQ ID NO: 1157238 - DNA, 14 bp, Homo sapiens
tactgtttcttgca

SEQ ID NO: 1157239 - DNA, 16 bp, Homo sapiens
tactgtttcttgcact

SEQ ID NO: 1157240 - DNA, 21 bp, Homo sapiens
tactgtttcttgcactgaata

SEQ ID NO: 1157241 - DNA, 18 bp, Homo sapiens
ttctattatggaaaactg

SEQ ID NO: 1157242 - DNA, 19 bp, Homo sapiens
ttctattatggaaaactgt

SEQ ID NO: 1157243 - DNA, 23 bp, Homo sapiens
ttctattgacttcaatgatagta

SEQ ID NO: 1157244 - DNA, 20 bp, Homo sapiens
ttctattgactttcttaaaa

SEQ ID NO: 1157245 - DNA, 18 bp, Homo sapiens
ttctattgtattatttgg

SEQ ID NO: 1157246 - DNA, 22 bp, Homo sapiens
ttctattgttactctggttctt

SEQ ID NO: 1157247 - DNA, 17 bp, Homo sapiens
ttctatttaacaactgg

SEQ ID NO: 1157248 - DNA, 13 bp, Homo sapiens
ttctatttaatgg

SEQ ID NO: 1157249 - DNA, 18 bp, Homo sapiens
ttctatttaattgaaact

SEQ ID NO: 1157250 - DNA, 13 bp, Homo sapiens
ttctatttataat

SEQ ID NO: 1157251 - DNA, 17 bp, Homo sapiens
ttctatttattcctgtt

SEQ ID NO: 1157252 - DNA, 18 bp, Homo sapiens
ttctatttattcctgtta

SEQ ID NO: 1157253 - DNA, 15 bp, Homo sapiens
ttctatttatttact

SEQ ID NO: 1157254 - DNA, 14 bp, Homo sapiens
ttctatttcataat

SEQ ID NO: 1157255 - DNA, 19 bp, Homo sapiens
ttctatttctcctccatgg

SEQ ID NO: 1157256 - DNA, 13 bp, Homo sapiens
ttctatttctcta

SEQ ID NO: 1157257 - DNA, 14 bp, Homo sapiens
ttctatttctctat

SEQ ID NO: 1157258 - DNA, 16 bp, Homo sapiens
ttctatttcttgaaga

SEQ ID NO: 1157259 - DNA, 16 bp, Homo sapiens
ttctatttgctgggct

SEQ ID NO: 1157260 - DNA, 17 bp, Homo sapiens
ttctattttcatgcaaa

SEQ ID NO: 1157261 - DNA, 13 bp, Homo sapiens
ttctattttgtaa

SEQ ID NO: 1157262 - DNA, 16 bp, Homo sapiens
ttctatttttatctga

SEQ ID NO: 1157263 - DNA, 18 bp, Homo sapiens
ttctatttttcaatcatc

SEQ ID NO: 1157264 - DNA, 22 bp, Homo sapiens
ttctattttttataaatatcat

SEQ ID NO: 1157265 - DNA, 23 bp, Homo sapiens
ttctattttttgttttgtttcct

SEQ ID NO: 1157266 - DNA, 13 bp, Homo sapiens
ttctcaaacacag

SEQ ID NO: 1157267 - DNA, 23 bp, Homo sapiens
ttctcaaagcctcttatttttct

SEQ ID NO: 1157268 - DNA, 14 bp, Homo sapiens
ttctcaacctacca

SEQ ID NO: 1157269 - DNA, 13 bp, Homo sapiens
ttctcaagaatct

SEQ ID NO: 1157270 - DNA, 16 bp, Homo sapiens
ttctcaagaatctaga

SEQ ID NO: 1157271 - DNA, 21 bp, Homo sapiens
ttctcaagtgttttggagaaa

SEQ ID NO: 1157272 - DNA, 19 bp, Homo sapiens
ttctcaatcactgctcccc

SEQ ID NO: 1157273 - DNA, 15 bp, Homo sapiens
ttctcaatcagtgca

SEQ ID NO: 1157274 - DNA, 23 bp, Homo sapiens
ttctcaattattggcctgctaat

SEQ ID NO: 1157275 - DNA, 15 bp, Homo sapiens
ttctcacacccaccg

SEQ ID NO: 1157276 - DNA, 20 bp, Homo sapiens
ttctcacactctaactgtat

SEQ ID NO: 1157277 - DNA, 12 bp, Homo sapiens
ttctcaccagga

SEQ ID NO: 1157278 - DNA, 20 bp, Homo sapiens
ttctcaccctactctggatg

SEQ ID NO: 1157279 - DNA, 18 bp, Homo sapiens
ttctcacctgctccagga

SEQ ID NO: 1157280 - DNA, 14 bp, Homo sapiens
ttctcactcaccac

SEQ ID NO: 1157281 - DNA, 14 bp, Homo sapiens
ttctcactgaactc

SEQ ID NO: 1157282 - DNA, 12 bp, Homo sapiens
ttctcactgcca

SEQ ID NO: 1157283 - DNA, 18 bp, Homo sapiens
ttctcactgttccctctg

SEQ ID NO: 1157284 - DNA, 15 bp, Homo sapiens
ttctcagaatctacc

SEQ ID NO: 1157285 - DNA, 15 bp, Homo sapiens
ttctcagaattcggt

SEQ ID NO: 1157286 - DNA, 21 bp, Homo sapiens
ttctcagaattcggtgtgctg

SEQ ID NO: 1157287 - DNA, 19 bp, Homo sapiens
ttctcagacgacacctgga

SEQ ID NO: 1157288 - DNA, 15 bp, Homo sapiens
ttctcagagccaagt

SEQ ID NO: 1157289 - DNA, 14 bp, Homo sapiens
ttctcagatattta

SEQ ID NO: 1157290 - DNA, 18 bp, Homo sapiens
ttctcagccaggcgtggt

SEQ ID NO: 1157291 - DNA, 18 bp, Homo sapiens
ttctcaggaagagctatg

SEQ ID NO: 1157292 - DNA, 18 bp, Homo sapiens
ttctcagggtcactgtcc

SEQ ID NO: 1157293 - DNA, 16 bp, Homo sapiens
ttctcagtgatttcct

SEQ ID NO: 1157294 - DNA, 17 bp, Homo sapiens
ttctcagtgatttccta

SEQ ID NO: 1157295 - DNA, 12 bp, Homo sapiens
ttctcagtgccg

SEQ ID NO: 1157296 - DNA, 17 bp, Homo sapiens
ttctcataaaactgtga

SEQ ID NO: 1157297 - DNA, 13 bp, Homo sapiens
ttctcatagcatt

SEQ ID NO: 1157298 - DNA, 20 bp, Homo sapiens
ttctcataggaaaagtacat

SEQ ID NO: 1157299 - DNA, 12 bp, Homo sapiens
ttctcatcagta

SEQ ID NO: 1157300 - DNA, 13 bp, Homo sapiens
ttctcatcagtag

SEQ ID NO: 1157301 - DNA, 16 bp, Homo sapiens
ttctcatcatattgta

SEQ ID NO: 1157302 - DNA, 23 bp, Homo sapiens
ttctcatcatattgtatgtaagt

SEQ ID NO: 1157303 - DNA, 17 bp, Homo sapiens
ttctcatcccacgcact

SEQ ID NO: 1157304 - DNA, 17 bp, Homo sapiens
ttctcatcttttatcta

SEQ ID NO: 1157305 - DNA, 13 bp, Homo sapiens
ttctcatgcttct

SEQ ID NO: 1157306 - DNA, 15 bp, Homo sapiens
ttctcatggggtggg

SEQ ID NO: 1157307 - DNA, 15 bp, Homo sapiens
ttctcattaaaagaa

SEQ ID NO: 1157308 - DNA, 18 bp, Homo sapiens
ttctcattaaaatccagt

SEQ ID NO: 1157309 - DNA, 20 bp, Homo sapiens
ttctccaaactgaagcagcc

SEQ ID NO: 1157310 - DNA, 17 bp, Homo sapiens
ttctccaaaggctctgt

SEQ ID NO: 1157311 - DNA, 14 bp, Homo sapiens
ttctccaaatgaga

SEQ ID NO: 1157312 - DNA, 14 bp, Homo sapiens
ttctccaaccccgg

SEQ ID NO: 1157313 - DNA, 15 bp, Homo sapiens
ttctccaaggaaacc

SEQ ID NO: 1157314 - DNA, 21 bp, Homo sapiens
ttctccacctagactgtaaac

SEQ ID NO: 1157315 - DNA, 12 bp, Homo sapiens
ttctccactgga

SEQ ID NO: 1157316 - DNA, 13 bp, Homo sapiens
ttctccagaatgt

SEQ ID NO: 1157317 - DNA, 14 bp, Homo sapiens
ttctccagctcaga

SEQ ID NO: 1157318 - DNA, 15 bp, Homo sapiens
ttctccagctgggct

SEQ ID NO: 1157319 - DNA, 17 bp, Homo sapiens
ttctccagcttcagctc

SEQ ID NO: 1157320 - DNA, 18 bp, Homo sapiens
ttctccaggctctttggg

SEQ ID NO: 1157321 - DNA, 15 bp, Homo sapiens
ttctccagttagaat

SEQ ID NO: 1157322 - DNA, 14 bp, Homo sapiens
ttctccatgctgca

SEQ ID NO: 1157323 - DNA, 22 bp, Homo sapiens
ttctccatgctgcaaaggagaa

SEQ ID NO: 1157324 - DNA, 14 bp, Homo sapiens
ttctccatgggcca

SEQ ID NO: 1157325 - DNA, 15 bp, Homo sapiens
ttctccatgttggtc

SEQ ID NO: 1157326 - DNA, 13 bp, Homo sapiens
ttctcccaaagat

SEQ ID NO: 1157327 - DNA, 21 bp, Homo sapiens
ttctcccagcactgcctcctg

SEQ ID NO: 1157328 - DNA, 22 bp, Homo sapiens
ttctcccagcactgcctcctgt

SEQ ID NO: 1157329 - DNA, 13 bp, Homo sapiens
ttctcccagggag

SEQ ID NO: 1157330 - DNA, 19 bp, Homo sapiens
ttctcccaggtaccagctg

SEQ ID NO: 1157331 - DNA, 16 bp, Homo sapiens
ttctcccccgccctgc

SEQ ID NO: 1157332 - DNA, 14 bp, Homo sapiens
ttctccccctgggc

SEQ ID NO: 1157333 - DNA, 19 bp, Homo sapiens
ttctcccccttgtcttccc

SEQ ID NO: 1157334 - DNA, 13 bp, Homo sapiens
ttctccccttcct

SEQ ID NO: 1157335 - DNA, 23 bp, Homo sapiens
ttctccccttcctggacacactc

SEQ ID NO: 1157336 - DNA, 13 bp, Homo sapiens
ttctccctcaccc

SEQ ID NO: 1157337 - DNA, 12 bp, Homo sapiens
ttctccctgacc

SEQ ID NO: 1157338 - DNA, 13 bp, Homo sapiens
ttctccctgcagc

SEQ ID NO: 1157339 - DNA, 11 bp, Homo sapiens
ttctccctgga

SEQ ID NO: 1157340 - DNA, 23 bp, Homo sapiens
ttctcccttcttgggtctgccct

SEQ ID NO: 1157341 - DNA, 22 bp, Homo sapiens
ttctcccttttttttttaaatt

SEQ ID NO: 1157342 - DNA, 23 bp, Homo sapiens
ttctccgactgctagggagtggt

SEQ ID NO: 1157343 - DNA, 22 bp, Homo sapiens
ttctccgcattggaagagcccg

SEQ ID NO: 1157344 - DNA, 15 bp, Homo sapiens
ttctccgccagcctc

SEQ ID NO: 1157345 - DNA, 16 bp, Homo sapiens
ttctccgccagcctcc

SEQ ID NO: 1157346 - DNA, 19 bp, Homo sapiens
ttctccggggtctgtgctg

SEQ ID NO: 1157347 - DNA, 20 bp, Homo sapiens
ttctccggggtctgtgctgt

SEQ ID NO: 1157348 - DNA, 21 bp, Homo sapiens
ttctccgggtgtggcctcagc

SEQ ID NO: 1157349 - DNA, 16 bp, Homo sapiens
ttctccgttagctcct

SEQ ID NO: 1157350 - DNA, 20 bp, Homo sapiens
ttctccgttagctcctgtgg

SEQ ID NO: 1157351 - DNA, 19 bp, Homo sapiens
ttctcctcatccatttctt

SEQ ID NO: 1157352 - DNA, 20 bp, Homo sapiens
ttctcctcatccatttcttt

SEQ ID NO: 1157353 - DNA, 13 bp, Homo sapiens
ttctcctcccagg

SEQ ID NO: 1157354 - DNA, 11 bp, Homo sapiens
ttctcctcccc

SEQ ID NO: 1157355 - DNA, 20 bp, Homo sapiens
ttctcctcccttccttttcc

SEQ ID NO: 1157356 - DNA, 17 bp, Homo sapiens
ttctcctctctgggcct

SEQ ID NO: 1157357 - DNA, 13 bp, Homo sapiens
ttctcctcttgta

SEQ ID NO: 1157358 - DNA, 19 bp, Homo sapiens
ttctcctgccctttcccag

SEQ ID NO: 1157359 - DNA, 17 bp, Homo sapiens
ttctcctgctgctcctg

SEQ ID NO: 1157360 - DNA, 18 bp, Homo sapiens
ttctcctgctgctcctgt

SEQ ID NO: 1157361 - DNA, 13 bp, Homo sapiens
ttctcctgcttgt

SEQ ID NO: 1157362 - DNA, 20 bp, Homo sapiens
ttctcctggagatagctggg

SEQ ID NO: 1157363 - DNA, 14 bp, Homo sapiens
ttctcctggaggca

SEQ ID NO: 1157364 - DNA, 20 bp, Homo sapiens
ttctcctgggaaacctgcct

SEQ ID NO: 1157365 - DNA, 20 bp, Homo sapiens
ttctccttagtcttctcata

SEQ ID NO: 1157366 - DNA, 21 bp, Homo sapiens
ttctccttgaagcaaatgtgt

SEQ ID NO: 1157367 - DNA, 19 bp, Homo sapiens
tactgttttaattgtagtt

SEQ ID NO: 1157368 - DNA, 22 bp, Homo sapiens
tacttaaaatgacaaagccatt

SEQ ID NO: 1157369 - DNA, 19 bp, Homo sapiens
tacttaaaatgattctcta

SEQ ID NO: 1157370 - DNA, 21 bp, Homo sapiens
tacttaaagttgattttgaac

SEQ ID NO: 1157371 - DNA, 18 bp, Homo sapiens
tacttaaatgaaagcatg

SEQ ID NO: 1157372 - DNA, 23 bp, Homo sapiens
tacttaaatttgaatctgagtga

SEQ ID NO: 1157373 - DNA, 15 bp, Homo sapiens
tacttaacatttcat

SEQ ID NO: 1157374 - DNA, 22 bp, Homo sapiens
tacttaacatttcattgtacaa

SEQ ID NO: 1157375 - DNA, 17 bp, Homo sapiens
tacttaagaatacacag

SEQ ID NO: 1157376 - DNA, 18 bp, Homo sapiens
tacttaattgccagcaaa

SEQ ID NO: 1157377 - DNA, 14 bp, Homo sapiens
tacttacatttcca

SEQ ID NO: 1157378 - DNA, 17 bp, Homo sapiens
tacttacatttccattt

SEQ ID NO: 1157379 - DNA, 17 bp, Homo sapiens
tacttaccatatgtgct

SEQ ID NO: 1157380 - DNA, 19 bp, Homo sapiens
tacttacctagtgaaactt

SEQ ID NO: 1157381 - DNA, 15 bp, Homo sapiens
tacttactataattt

SEQ ID NO: 1157382 - DNA, 16 bp, Homo sapiens
tacttactataatttg

SEQ ID NO: 1157383 - DNA, 16 bp, Homo sapiens
tacttagaatgccata

SEQ ID NO: 1157384 - DNA, 20 bp, Homo sapiens
tacttagagtttctgtttga

SEQ ID NO: 1157385 - DNA, 20 bp, Homo sapiens
tacttagcaagacctgaaaa

SEQ ID NO: 1157386 - DNA, 20 bp, Homo sapiens
tacttagggaagaaaaagca

SEQ ID NO: 1157387 - DNA, 17 bp, Homo sapiens
tacttagtagattaaaa

SEQ ID NO: 1157388 - DNA, 19 bp, Homo sapiens
tacttagtggtatgtctct

SEQ ID NO: 1157389 - DNA, 13 bp, Homo sapiens
tacttatccctgc

SEQ ID NO: 1157390 - DNA, 18 bp, Homo sapiens
tacttattaaaaaatttg

SEQ ID NO: 1157391 - DNA, 15 bp, Homo sapiens
tacttattactgcta

SEQ ID NO: 1157392 - DNA, 13 bp, Homo sapiens
tacttcaaaaata

SEQ ID NO: 1157393 - DNA, 17 bp, Homo sapiens
tacttcaaaaataatgt

SEQ ID NO: 1157394 - DNA, 21 bp, Homo sapiens
tacttcaagttaaagtgaata

SEQ ID NO: 1157395 - DNA, 19 bp, Homo sapiens
tacttcactgtcatcttca

SEQ ID NO: 1157396 - DNA, 20 bp, Homo sapiens
tacttcactgtcatcttcaa

SEQ ID NO: 1157397 - DNA, 22 bp, Homo sapiens
tacttcaggggaagagaagaca

SEQ ID NO: 1157398 - DNA, 19 bp, Homo sapiens
tacttcaggtgcttttgat

SEQ ID NO: 1157399 - DNA, 22 bp, Homo sapiens
tacttccacctcgggcacattt

SEQ ID NO: 1157400 - DNA, 15 bp, Homo sapiens
tacttccccacccct

SEQ ID NO: 1157401 - DNA, 15 bp, Homo sapiens
tacttcccctgggat

SEQ ID NO: 1157402 - DNA, 15 bp, Homo sapiens
tacttccccttccta

SEQ ID NO: 1157403 - DNA, 18 bp, Homo sapiens
tacttccccttcctaatt

SEQ ID NO: 1157404 - DNA, 19 bp, Homo sapiens
tacttcctatcaagccagt

SEQ ID NO: 1157405 - DNA, 14 bp, Homo sapiens
tacttcctcctccc

SEQ ID NO: 1157406 - DNA, 18 bp, Homo sapiens
tacttcctcctgatggcc

SEQ ID NO: 1157407 - DNA, 23 bp, Homo sapiens
tacttcctgtgacttcagctctg

SEQ ID NO: 1157408 - DNA, 20 bp, Homo sapiens
tacttctaaaagctaaagcc

SEQ ID NO: 1157409 - DNA, 18 bp, Homo sapiens
tacttctctataaaaaat

SEQ ID NO: 1157410 - DNA, 13 bp, Homo sapiens
tacttctctcaga

SEQ ID NO: 1157411 - DNA, 17 bp, Homo sapiens
tacttctgactttactt

SEQ ID NO: 1157412 - DNA, 20 bp, Homo sapiens
tacttctgactttacttgtg

SEQ ID NO: 1157413 - DNA, 17 bp, Homo sapiens
tacttctgtaattgtgt

SEQ ID NO: 1157414 - DNA, 22 bp, Homo sapiens
tacttctgtaattgtgtggatt

SEQ ID NO: 1157415 - DNA, 14 bp, Homo sapiens
tacttctgtgttca

SEQ ID NO: 1157416 - DNA, 12 bp, Homo sapiens
tacttctgtttg

SEQ ID NO: 1157417 - DNA, 18 bp, Homo sapiens
tacttcttaaaattcaaa

SEQ ID NO: 1157418 - DNA, 15 bp, Homo sapiens
tacttcttattgcaa

SEQ ID NO: 1157419 - DNA, 18 bp, Homo sapiens
tacttcttcattcaatac

SEQ ID NO: 1157420 - DNA, 17 bp, Homo sapiens
tacttcttctgtaatat

SEQ ID NO: 1157421 - DNA, 20 bp, Homo sapiens
tacttcttttttcaaaagaa

SEQ ID NO: 1157422 - DNA, 24 bp, Homo sapiens
tacttgaagaaacagagtggcctc

SEQ ID NO: 1157423 - DNA, 14 bp, Homo sapiens
tacttgaatagtat

SEQ ID NO: 1157424 - DNA, 15 bp, Homo sapiens
tacttgaatagtatt

SEQ ID NO: 1157425 - DNA, 15 bp, Homo sapiens
tacttgaattttttg

SEQ ID NO: 1157426 - DNA, 16 bp, Homo sapiens
tacttgaattttttga

SEQ ID NO: 1157427 - DNA, 23 bp, Homo sapiens
tacttgaccgtttttatattact

SEQ ID NO: 1157428 - DNA, 12 bp, Homo sapiens
tacttgcactgt

SEQ ID NO: 1157429 - DNA, 15 bp, Homo sapiens
tacttgccaagcagt

SEQ ID NO: 1157430 - DNA, 22 bp, Homo sapiens
tacttgccctgaccatgcattt

SEQ ID NO: 1157431 - DNA, 19 bp, Homo sapiens
tacttgctttaccttttca

SEQ ID NO: 1157432 - DNA, 15 bp, Homo sapiens
tacttgctttcaatt

SEQ ID NO: 1157433 - DNA, 16 bp, Homo sapiens
tacttggaactaggct

SEQ ID NO: 1157434 - DNA, 20 bp, Homo sapiens
tacttggctgcttcctgtga

SEQ ID NO: 1157435 - DNA, 17 bp, Homo sapiens
tacttgggaagctgagg

SEQ ID NO: 1157436 - DNA, 21 bp, Homo sapiens
tacttgggagacctgtaatca

SEQ ID NO: 1157437 - DNA, 14 bp, Homo sapiens
tacttgggagcctg

SEQ ID NO: 1157438 - DNA, 18 bp, Homo sapiens
tacttgggaggctgaggc

SEQ ID NO: 1157439 - DNA, 14 bp, Homo sapiens
tacttggtttgtgt

SEQ ID NO: 1157440 - DNA, 21 bp, Homo sapiens
tacttgtaaaatgcttttcac

SEQ ID NO: 1157441 - DNA, 23 bp, Homo sapiens
tacttgtaaaatgcttttcactt

SEQ ID NO: 1157442 - DNA, 14 bp, Homo sapiens
tacttgtcaaagaa

SEQ ID NO: 1157443 - DNA, 20 bp, Homo sapiens
tacttgtcaatatttaaaca

SEQ ID NO: 1157444 - DNA, 17 bp, Homo sapiens
tacttgtcctcagcttg

SEQ ID NO: 1157445 - DNA, 16 bp, Homo sapiens
tacttgtctgtcaaat

SEQ ID NO: 1157446 - DNA, 13 bp, Homo sapiens
tacttgtgcactt

SEQ ID NO: 1157447 - DNA, 18 bp, Homo sapiens
tacttgtggtgtgaccat

SEQ ID NO: 1157448 - DNA, 13 bp, Homo sapiens
tacttgttcaaaa

SEQ ID NO: 1157449 - DNA, 15 bp, Homo sapiens
tacttgttcatttgg

SEQ ID NO: 1157450 - DNA, 15 bp, Homo sapiens
tactttaaaaaggaa

SEQ ID NO: 1157451 - DNA, 22 bp, Homo sapiens
tactttaaaaaggaaatttgtt

SEQ ID NO: 1157452 - DNA, 23 bp, Homo sapiens
tactttaaaaaggaaatttgttt

SEQ ID NO: 1157453 - DNA, 15 bp, Homo sapiens
tactttaatataaac

SEQ ID NO: 1157454 - DNA, 22 bp, Homo sapiens
tactttacaaaccattacctgt

SEQ ID NO: 1157455 - DNA, 23 bp, Homo sapiens
tactttacaaaccattacctgta

SEQ ID NO: 1157456 - DNA, 23 bp, Homo sapiens
tactttacatatgctttaagaat

SEQ ID NO: 1157457 - DNA, 22 bp, Homo sapiens
tactttacctctctgtcatgtg

SEQ ID NO: 1157458 - DNA, 17 bp, Homo sapiens
tactttacttttgctgt

SEQ ID NO: 1157459 - DNA, 21 bp, Homo sapiens
tactttagatggcaagcatgt

SEQ ID NO: 1157460 - DNA, 18 bp, Homo sapiens
tactttatatcttgttta

SEQ ID NO: 1157461 - DNA, 20 bp, Homo sapiens
tactttatatcttgtttaca

SEQ ID NO: 1157462 - DNA, 18 bp, Homo sapiens
tactttattaatatgagt

SEQ ID NO: 1157463 - DNA, 11 bp, Homo sapiens
tactttattct

SEQ ID NO: 1157464 - DNA, 14 bp, Homo sapiens
tactttattgtaca

SEQ ID NO: 1157465 - DNA, 22 bp, Homo sapiens
tactttattgtacagactgttt

SEQ ID NO: 1157466 - DNA, 13 bp, Homo sapiens
tactttatttctg

SEQ ID NO: 1157467 - DNA, 15 bp, Homo sapiens
tactttattttgctt

SEQ ID NO: 1157468 - DNA, 16 bp, Homo sapiens
tactttcatcttaaac

SEQ ID NO: 1157469 - DNA, 12 bp, Homo sapiens
tactttcccttg

SEQ ID NO: 1157470 - DNA, 15 bp, Homo sapiens
tactttcctcctccc

SEQ ID NO: 1157471 - DNA, 19 bp, Homo sapiens
tactttctttcagatgttt

SEQ ID NO: 1157472 - DNA, 19 bp, Homo sapiens
tactttgaaaccagaaaat

SEQ ID NO: 1157473 - DNA, 17 bp, Homo sapiens
tactttgacaaggaaaa

SEQ ID NO: 1157474 - DNA, 14 bp, Homo sapiens
tactttgacttttt

SEQ ID NO: 1157475 - DNA, 18 bp, Homo sapiens
tactttgagaagatgacc

SEQ ID NO: 1157476 - DNA, 23 bp, Homo sapiens
tactttgatattttcaacgcagc

SEQ ID NO: 1157477 - DNA, 23 bp, Homo sapiens
tactttgatttttatccatttct

SEQ ID NO: 1157478 - DNA, 16 bp, Homo sapiens
tactttgcataaatta

SEQ ID NO: 1157479 - DNA, 19 bp, Homo sapiens
tactttgctctcttcttct

SEQ ID NO: 1157480 - DNA, 13 bp, Homo sapiens
tactttgcttccg

SEQ ID NO: 1157481 - DNA, 20 bp, Homo sapiens
tactttgcttgagaatcctc

SEQ ID NO: 1157482 - DNA, 21 bp, Homo sapiens
tactttggatgcaattaaaac

SEQ ID NO: 1157483 - DNA, 15 bp, Homo sapiens
tactttggcatcttt

SEQ ID NO: 1157484 - DNA, 17 bp, Homo sapiens
tactttggctacaaata

SEQ ID NO: 1157485 - DNA, 20 bp, Homo sapiens
tactttggtagctgggaaag

SEQ ID NO: 1157486 - DNA, 22 bp, Homo sapiens
tactttggtggccacataagcc

SEQ ID NO: 1157487 - DNA, 19 bp, Homo sapiens
tactttggttaatgttgat

SEQ ID NO: 1157488 - DNA, 23 bp, Homo sapiens
tactttgtaaataggatttttag

SEQ ID NO: 1157489 - DNA, 21 bp, Homo sapiens
tactttgtagactgtttcaca

SEQ ID NO: 1157490 - DNA, 15 bp, Homo sapiens
tactttgtgcattct

SEQ ID NO: 1157491 - DNA, 21 bp, Homo sapiens
ttctccttgtgttactaagtt

SEQ ID NO: 1157492 - DNA, 13 bp, Homo sapiens
ttctccttttcct

SEQ ID NO: 1157493 - DNA, 18 bp, Homo sapiens
ttctccttttcctctctc

SEQ ID NO: 1157494 - DNA, 18 bp, Homo sapiens
ttctcgcgccctccccca

SEQ ID NO: 1157495 - DNA, 12 bp, Homo sapiens
ttctcggagacc

SEQ ID NO: 1157496 - DNA, 13 bp, Homo sapiens
ttctcggccagcc

SEQ ID NO: 1157497 - DNA, 13 bp, Homo sapiens
ttctcgtccccct

SEQ ID NO: 1157498 - DNA, 13 bp, Homo sapiens
ttctcgtgtttgc

SEQ ID NO: 1157499 - DNA, 14 bp, Homo sapiens
ttctcgtgtttgct

SEQ ID NO: 1157500 - DNA, 23 bp, Homo sapiens
ttctctaaatgaggggcctcagg

SEQ ID NO: 1157501 - DNA, 24 bp, Homo sapiens
ttctctaagagaacaatgtgctat

SEQ ID NO: 1157502 - DNA, 15 bp, Homo sapiens
ttctctaagcctata

SEQ ID NO: 1157503 - DNA, 20 bp, Homo sapiens
ttctctacagacttctccag

SEQ ID NO: 1157504 - DNA, 23 bp, Homo sapiens
ttctctacaggcctcttcctgtt

SEQ ID NO: 1157505 - DNA, 17 bp, Homo sapiens
ttctctactctagggaa

SEQ ID NO: 1157506 - DNA, 14 bp, Homo sapiens
ttctctactgtctg

SEQ ID NO: 1157507 - DNA, 19 bp, Homo sapiens
ttctctactttgaggaaac

SEQ ID NO: 1157508 - DNA, 18 bp, Homo sapiens
ttctctagctctctaggc

SEQ ID NO: 1157509 - DNA, 22 bp, Homo sapiens
ttctctagctctctaggcctct

SEQ ID NO: 1157510 - DNA, 21 bp, Homo sapiens
ttctctagtttgattaaattc

SEQ ID NO: 1157511 - DNA, 18 bp, Homo sapiens
ttctctataaaaaatatg

SEQ ID NO: 1157512 - DNA, 15 bp, Homo sapiens
ttctctatcctctct

SEQ ID NO: 1157513 - DNA, 17 bp, Homo sapiens
ttctctatcctctctct

SEQ ID NO: 1157514 - DNA, 12 bp, Homo sapiens
ttctctcatcta

SEQ ID NO: 1157515 - DNA, 22 bp, Homo sapiens
ttctctcatctaactgatgagt

SEQ ID NO: 1157516 - DNA, 24 bp, Homo sapiens
ttctctcatctgatcacttcatgt

SEQ ID NO: 1157517 - DNA, 16 bp, Homo sapiens
ttctctcccctcacat

SEQ ID NO: 1157518 - DNA, 17 bp, Homo sapiens
ttctctcctcagtttct

SEQ ID NO: 1157519 - DNA, 14 bp, Homo sapiens
ttctctcctcccca

SEQ ID NO: 1157520 - DNA, 20 bp, Homo sapiens
ttctctcctgattatttatc

SEQ ID NO: 1157521 - DNA, 17 bp, Homo sapiens
ttctctctacagtgcca

SEQ ID NO: 1157522 - DNA, 19 bp, Homo sapiens
ttctctctccagggtgctt

SEQ ID NO: 1157523 - DNA, 14 bp, Homo sapiens
ttctctctcctctc

SEQ ID NO: 1157524 - DNA, 18 bp, Homo sapiens
ttctctctcctctctgct

SEQ ID NO: 1157525 - DNA, 19 bp, Homo sapiens
ttctctctcctggtgtggg

SEQ ID NO: 1157526 - DNA, 20 bp, Homo sapiens
ttctctctcctggtgtgggt

SEQ ID NO: 1157527 - DNA, 20 bp, Homo sapiens
ttctctctttatacagctgt

SEQ ID NO: 1157528 - DNA, 13 bp, Homo sapiens
ttctctcttttaa

SEQ ID NO: 1157529 - DNA, 23 bp, Homo sapiens
ttctctgaagagtgggtttcaca

SEQ ID NO: 1157530 - DNA, 15 bp, Homo sapiens
ttctctgaatcagaa

SEQ ID NO: 1157531 - DNA, 21 bp, Homo sapiens
ttctctgaatcagaaaagcta

SEQ ID NO: 1157532 - DNA, 18 bp, Homo sapiens
ttctctgagctgtgcagg

SEQ ID NO: 1157533 - DNA, 20 bp, Homo sapiens
ttctctgaggacaagagaaa

SEQ ID NO: 1157534 - DNA, 17 bp, Homo sapiens
ttctctgatgcagaaat

SEQ ID NO: 1157535 - DNA, 10 bp, Homo sapiens
ttctctgcag

SEQ ID NO: 1157536 - DNA, 10 bp, Homo sapiens
ttctctgcca

SEQ ID NO: 1157537 - DNA, 12 bp, Homo sapiens
ttctctgccagt

SEQ ID NO: 1157538 - DNA, 15 bp, Homo sapiens
ttctctgcccacagt

SEQ ID NO: 1157539 - DNA, 23 bp, Homo sapiens
ttctctgcccgggccccttgctg

SEQ ID NO: 1157540 - DNA, 21 bp, Homo sapiens
ttctctgccgctacctccctc

SEQ ID NO: 1157541 - DNA, 12 bp, Homo sapiens
ttctctgcctcc

SEQ ID NO: 1157542 - DNA, 17 bp, Homo sapiens
ttctctgcctctgggca

SEQ ID NO: 1157543 - DNA, 23 bp, Homo sapiens
ttctctgcctctgggcagcctgc

SEQ ID NO: 1157544 - DNA, 12 bp, Homo sapiens
ttctctgccttc

SEQ ID NO: 1157545 - DNA, 21 bp, Homo sapiens
ttctctgctatatataaaacg

SEQ ID NO: 1157546 - DNA, 14 bp, Homo sapiens
ttctctgctccacc

SEQ ID NO: 1157547 - DNA, 19 bp, Homo sapiens
ttctctgctcttgtttcac

SEQ ID NO: 1157548 - DNA, 23 bp, Homo sapiens
ttctctgctgcatcttacagaag

SEQ ID NO: 1157549 - DNA, 14 bp, Homo sapiens
ttctctgctgcctc

SEQ ID NO: 1157550 - DNA, 15 bp, Homo sapiens
ttctctggagccaag

SEQ ID NO: 1157551 - DNA, 17 bp, Homo sapiens
ttctctggcaaactttt

SEQ ID NO: 1157552 - DNA, 20 bp, Homo sapiens
ttctctgggagaaaatcatc

SEQ ID NO: 1157553 - DNA, 23 bp, Homo sapiens
ttctctgggagaaaatcatcaag

SEQ ID NO: 1157554 - DNA, 19 bp, Homo sapiens
ttctctggtggtcttcctt

SEQ ID NO: 1157555 - DNA, 13 bp, Homo sapiens
ttctctgtacttt

SEQ ID NO: 1157556 - DNA, 14 bp, Homo sapiens
ttctctgtactttt

SEQ ID NO: 1157557 - DNA, 19 bp, Homo sapiens
ttctctgtatgaatgtgat

SEQ ID NO: 1157558 - DNA, 21 bp, Homo sapiens
ttctctgtcctacttctgact

SEQ ID NO: 1157559 - DNA, 17 bp, Homo sapiens
ttctctgtgctctgaat

SEQ ID NO: 1157560 - DNA, 21 bp, Homo sapiens
ttctctgtgctctgaatggga

SEQ ID NO: 1157561 - DNA, 20 bp, Homo sapiens
ttctctgtgtgcacacccat

SEQ ID NO: 1157562 - DNA, 18 bp, Homo sapiens
ttctctgtgtttgttcct

SEQ ID NO: 1157563 - DNA, 19 bp, Homo sapiens
ttctctgtgtttgttccta

SEQ ID NO: 1157564 - DNA, 15 bp, Homo sapiens
ttctctgttcccttg

SEQ ID NO: 1157565 - DNA, 16 bp, Homo sapiens
ttctctgttgtcaaac

SEQ ID NO: 1157566 - DNA, 15 bp, Homo sapiens
ttctcttaagtggtc

SEQ ID NO: 1157567 - DNA, 18 bp, Homo sapiens
ttctcttaatcactactg

SEQ ID NO: 1157568 - DNA, 18 bp, Homo sapiens
ttctcttagctactgtat

SEQ ID NO: 1157569 - DNA, 22 bp, Homo sapiens
ttctcttaggtggctctgggaa

SEQ ID NO: 1157570 - DNA, 18 bp, Homo sapiens
ttctcttcactcccaata

SEQ ID NO: 1157571 - DNA, 14 bp, Homo sapiens
ttctcttccctgaa

SEQ ID NO: 1157572 - DNA, 10 bp, Homo sapiens
ttctcttccg

SEQ ID NO: 1157573 - DNA, 12 bp, Homo sapiens
ttctcttctagg

SEQ ID NO: 1157574 - DNA, 15 bp, Homo sapiens
ttctcttctgtccat

SEQ ID NO: 1157575 - DNA, 19 bp, Homo sapiens
ttctcttctttattgcact

SEQ ID NO: 1157576 - DNA, 21 bp, Homo sapiens
ttctcttgaaaagttcaggga

SEQ ID NO: 1157577 - DNA, 18 bp, Homo sapiens
ttctcttgagtcacactg

SEQ ID NO: 1157578 - DNA, 18 bp, Homo sapiens
ttctcttggtgaaataat

SEQ ID NO: 1157579 - DNA, 13 bp, Homo sapiens
ttctcttgtacca

SEQ ID NO: 1157580 - DNA, 15 bp, Homo sapiens
ttctcttgtaccata

SEQ ID NO: 1157581 - DNA, 14 bp, Homo sapiens
ttctctttaaaata

SEQ ID NO: 1157582 - DNA, 19 bp, Homo sapiens
ttctctttaccttctaaaa

SEQ ID NO: 1157583 - DNA, 13 bp, Homo sapiens
ttctctttctctc

SEQ ID NO: 1157584 - DNA, 14 bp, Homo sapiens
ttctctttctctcc

SEQ ID NO: 1157585 - DNA, 14 bp, Homo sapiens
ttctctttctctct

SEQ ID NO: 1157586 - DNA, 17 bp, Homo sapiens
ttctctttctctcttcc

SEQ ID NO: 1157587 - DNA, 14 bp, Homo sapiens
ttctctttcttcct

SEQ ID NO: 1157588 - DNA, 21 bp, Homo sapiens
ttctctttgtctgccttccca

SEQ ID NO: 1157589 - DNA, 12 bp, Homo sapiens
ttctctttgtgc

SEQ ID NO: 1157590 - DNA, 15 bp, Homo sapiens
ttctctttgtgcagt

SEQ ID NO: 1157591 - DNA, 14 bp, Homo sapiens
ttctctttgtttct

SEQ ID NO: 1157592 - DNA, 22 bp, Homo sapiens
ttctcttttcccctttcctgtc

SEQ ID NO: 1157593 - DNA, 17 bp, Homo sapiens
ttctcttttcctcgcag

SEQ ID NO: 1157594 - DNA, 18 bp, Homo sapiens
ttctcttttgctttctgt

SEQ ID NO: 1157595 - DNA, 13 bp, Homo sapiens
ttctgaaaacact

SEQ ID NO: 1157596 - DNA, 15 bp, Homo sapiens
ttctgaaacacacga

SEQ ID NO: 1157597 - DNA, 18 bp, Homo sapiens
ttctgaaacacacgagca

SEQ ID NO: 1157598 - DNA, 23 bp, Homo sapiens
ttctgaaaggaaatacacttctt

SEQ ID NO: 1157599 - DNA, 14 bp, Homo sapiens
ttctgaaatacttt

SEQ ID NO: 1157600 - DNA, 16 bp, Homo sapiens
ttctgaaatacttttg

SEQ ID NO: 1157601 - DNA, 16 bp, Homo sapiens
ttctgaaatgttctta

SEQ ID NO: 1157602 - DNA, 20 bp, Homo sapiens
ttctgaaatttttttcctaa

SEQ ID NO: 1157603 - DNA, 21 bp, Homo sapiens
ttctgaaatttttttcctaag

SEQ ID NO: 1157604 - DNA, 17 bp, Homo sapiens
ttctgaacactttaggt

SEQ ID NO: 1157605 - DNA, 18 bp, Homo sapiens
ttctgaactcaaactgag

SEQ ID NO: 1157606 - DNA, 22 bp, Homo sapiens
ttctgaactccatacagcctct

SEQ ID NO: 1157607 - DNA, 23 bp, Homo sapiens
ttctgaacttttgtggagtttga

SEQ ID NO: 1157608 - DNA, 16 bp, Homo sapiens
ttctgaagactgagaa

SEQ ID NO: 1157609 - DNA, 19 bp, Homo sapiens
ttctgaagccatgtagcca

SEQ ID NO: 1157610 - DNA, 13 bp, Homo sapiens
ttctgaagtactt

SEQ ID NO: 1157611 - DNA, 20 bp, Homo sapiens
ttctgaagtgtgtccatcct

SEQ ID NO: 1157612 - DNA, 21 bp, Homo sapiens
ttctgaagtgtgtccatcctg

SEQ ID NO: 1157613 - DNA, 10 bp, Homo sapiens
ttctgaataa

SEQ ID NO: 1157614 - DNA, 12 bp, Homo sapiens
ttctgaataaaa

SEQ ID NO: 1157615 - DNA, 19 bp, Homo sapiens
ttctgaataaaaaagattc

SEQ ID NO: 1157616 - DNA, 19 bp, Homo sapiens
tactttgttaggattttca

SEQ ID NO: 1157617 - DNA, 17 bp, Homo sapiens
tacttttaccactattt

SEQ ID NO: 1157618 - DNA, 17 bp, Homo sapiens
tacttttcacactgtct

SEQ ID NO: 1157619 - DNA, 20 bp, Homo sapiens
tacttttcacactgtcttcc

SEQ ID NO: 1157620 - DNA, 16 bp, Homo sapiens
tacttttcattctctt

SEQ ID NO: 1157621 - DNA, 16 bp, Homo sapiens
tacttttcccctgtta

SEQ ID NO: 1157622 - DNA, 18 bp, Homo sapiens
tacttttcccctgttaaa

SEQ ID NO: 1157623 - DNA, 13 bp, Homo sapiens
tacttttctaaaa

SEQ ID NO: 1157624 - DNA, 14 bp, Homo sapiens
tacttttctaaaat

SEQ ID NO: 1157625 - DNA, 18 bp, Homo sapiens
tacttttctggttccaaa

SEQ ID NO: 1157626 - DNA, 21 bp, Homo sapiens
tacttttctggttccaaacca

SEQ ID NO: 1157627 - DNA, 22 bp, Homo sapiens
tacttttctgtttagttttaca

SEQ ID NO: 1157628 - DNA, 22 bp, Homo sapiens
tacttttgagtatggctatcta

SEQ ID NO: 1157629 - DNA, 17 bp, Homo sapiens
tacttttgagtgtgtgt

SEQ ID NO: 1157630 - DNA, 19 bp, Homo sapiens
tacttttgcaaactgtcct

SEQ ID NO: 1157631 - DNA, 17 bp, Homo sapiens
tacttttgcatgaaaat

SEQ ID NO: 1157632 - DNA, 15 bp, Homo sapiens
tacttttgccctttg

SEQ ID NO: 1157633 - DNA, 13 bp, Homo sapiens
tacttttgtaaat

SEQ ID NO: 1157634 - DNA, 20 bp, Homo sapiens
tactttttaaaaggtatttt

SEQ ID NO: 1157635 - DNA, 19 bp, Homo sapiens
tactttttagtaatttctt

SEQ ID NO: 1157636 - DNA, 16 bp, Homo sapiens
tactttttatactcca

SEQ ID NO: 1157637 - DNA, 13 bp, Homo sapiens
tactttttctaat

SEQ ID NO: 1157638 - DNA, 17 bp, Homo sapiens
tactttttcttgtattc

SEQ ID NO: 1157639 - DNA, 19 bp, Homo sapiens
tactttttgaggggttctt

SEQ ID NO: 1157640 - DNA, 21 bp, Homo sapiens
tactttttgtagagagagctg

SEQ ID NO: 1157641 - DNA, 13 bp, Homo sapiens
tacttttttaaat

SEQ ID NO: 1157642 - DNA, 20 bp, Homo sapiens
tacttttttaaatattttct

SEQ ID NO: 1157643 - DNA, 18 bp, Homo sapiens
tacttttttaacatgtgt

SEQ ID NO: 1157644 - DNA, 20 bp, Homo sapiens
tacttttttaacatgtgtta

SEQ ID NO: 1157645 - DNA, 19 bp, Homo sapiens
tacttttttacactgataa

SEQ ID NO: 1157646 - DNA, 19 bp, Homo sapiens
tacttttttatccacctcc

SEQ ID NO: 1157647 - DNA, 19 bp, Homo sapiens
tacttttttctagtttcag

SEQ ID NO: 1157648 - DNA, 14 bp, Homo sapiens
tactttttttcaca

SEQ ID NO: 1157649 - DNA, 22 bp, Homo sapiens
tactttttttctgtgacattta

SEQ ID NO: 1157650 - DNA, 18 bp, Homo sapiens
tactttttttgtagatga

SEQ ID NO: 1157651 - DNA, 15 bp, Homo sapiens
tactttttttgttat

SEQ ID NO: 1157652 - DNA, 15 bp, Homo sapiens
tagaaaaaaagaaaa

SEQ ID NO: 1157653 - DNA, 23 bp, Homo sapiens
tagaaaaaaagaaaaaaaaaaga

SEQ ID NO: 1157654 - DNA, 15 bp, Homo sapiens
tagaaaaaaattact

SEQ ID NO: 1157655 - DNA, 12 bp, Homo sapiens
tagaaaaataaa

SEQ ID NO: 1157656 - DNA, 17 bp, Homo sapiens
tagaaaaatctcattcc

SEQ ID NO: 1157657 - DNA, 18 bp, Homo sapiens
tagaaaaatgtataaaaa

SEQ ID NO: 1157658 - DNA, 20 bp, Homo sapiens
tagaaaaattcagcaaacca

SEQ ID NO: 1157659 - DNA, 15 bp, Homo sapiens
tagaaaacaggaaaa

SEQ ID NO: 1157660 - DNA, 22 bp, Homo sapiens
tagaaaacaggaaaaaaacttt

SEQ ID NO: 1157661 - DNA, 14 bp, Homo sapiens
tagaaaactccagg

SEQ ID NO: 1157662 - DNA, 15 bp, Homo sapiens
tagaaaactgaaaat

SEQ ID NO: 1157663 - DNA, 22 bp, Homo sapiens
tagaaaactgaaaatctaatat

SEQ ID NO: 1157664 - DNA, 15 bp, Homo sapiens
tagaaaactttaaag

SEQ ID NO: 1157665 - DNA, 18 bp, Homo sapiens
tagaaaagaaaacattta

SEQ ID NO: 1157666 - DNA, 21 bp, Homo sapiens
tagaaaagaaaacatttaaca

SEQ ID NO: 1157667 - DNA, 23 bp, Homo sapiens
tagaaaagaaaacatttaacata

SEQ ID NO: 1157668 - DNA, 22 bp, Homo sapiens
tagaaaagagacttctctgtaa

SEQ ID NO: 1157669 - DNA, 23 bp, Homo sapiens
tagaaaagcagtcccattcatat

SEQ ID NO: 1157670 - DNA, 17 bp, Homo sapiens
tagaaaaggcgtgcagt

SEQ ID NO: 1157671 - DNA, 16 bp, Homo sapiens
tagaaaagtatgttct

SEQ ID NO: 1157672 - DNA, 23 bp, Homo sapiens
tagaaaagttgcagatgtattga

SEQ ID NO: 1157673 - DNA, 19 bp, Homo sapiens
tagaaaagttgctcttaaa

SEQ ID NO: 1157674 - DNA, 22 bp, Homo sapiens
tagaaaatataagtaaagtgat

SEQ ID NO: 1157675 - DNA, 16 bp, Homo sapiens
tagaaaatattctcta

SEQ ID NO: 1157676 - DNA, 18 bp, Homo sapiens
tagaaaatattctctatt

SEQ ID NO: 1157677 - DNA, 12 bp, Homo sapiens
tagaaaattaaa

SEQ ID NO: 1157678 - DNA, 18 bp, Homo sapiens
tagaaaattagtgaccat

SEQ ID NO: 1157679 - DNA, 21 bp, Homo sapiens
tagaaaatttagccctttaaa

SEQ ID NO: 1157680 - DNA, 15 bp, Homo sapiens
tagaaacccaagctc

SEQ ID NO: 1157681 - DNA, 20 bp, Homo sapiens
tagaaacccaagctcctcct

SEQ ID NO: 1157682 - DNA, 15 bp, Homo sapiens
tagaaaccttaatat

SEQ ID NO: 1157683 - DNA, 17 bp, Homo sapiens
tagaaacttcatggttt

SEQ ID NO: 1157684 - DNA, 13 bp, Homo sapiens
tagaaagaaacta

SEQ ID NO: 1157685 - DNA, 15 bp, Homo sapiens
tagaaagaagccata

SEQ ID NO: 1157686 - DNA, 17 bp, Homo sapiens
tagaaagatcgtttaaa

SEQ ID NO: 1157687 - DNA, 23 bp, Homo sapiens
tagaaagctgtttatttattcac

SEQ ID NO: 1157688 - DNA, 21 bp, Homo sapiens
tagaaaggaagccttgctcat

SEQ ID NO: 1157689 - DNA, 19 bp, Homo sapiens
tagaaaggacaacagttct

SEQ ID NO: 1157690 - DNA, 21 bp, Homo sapiens
tagaaaggacaacagttctga

SEQ ID NO: 1157691 - DNA, 13 bp, Homo sapiens
tagaaaggcagcc

SEQ ID NO: 1157692 - DNA, 22 bp, Homo sapiens
tagaaaggggcagtttaaagca

SEQ ID NO: 1157693 - DNA, 23 bp, Homo sapiens
tagaaaggtcatccaaagaacat

SEQ ID NO: 1157694 - DNA, 11 bp, Homo sapiens
tagaaataagt

SEQ ID NO: 1157695 - DNA, 15 bp, Homo sapiens
tagaaataatatgca

SEQ ID NO: 1157696 - DNA, 16 bp, Homo sapiens
tagaaatagatttaaa

SEQ ID NO: 1157697 - DNA, 15 bp, Homo sapiens
tagaaatatctttct

SEQ ID NO: 1157698 - DNA, 14 bp, Homo sapiens
tagaaatattttaa

SEQ ID NO: 1157699 - DNA, 15 bp, Homo sapiens
tagaaatattttaaa

SEQ ID NO: 1157700 - DNA, 16 bp, Homo sapiens
tagaaatattttaaaa

SEQ ID NO: 1157701 - DNA, 19 bp, Homo sapiens
tagaaatattttaaaatca

SEQ ID NO: 1157702 - DNA, 14 bp, Homo sapiens
tagaaatgcatatt

SEQ ID NO: 1157703 - DNA, 21 bp, Homo sapiens
tagaaatggaaattttgctat

SEQ ID NO: 1157704 - DNA, 21 bp, Homo sapiens
tagaaatggtttcctctggat

SEQ ID NO: 1157705 - DNA, 18 bp, Homo sapiens
tagaaatgtaaactgcca

SEQ ID NO: 1157706 - DNA, 19 bp, Homo sapiens
tagaaatgtaaactgccat

SEQ ID NO: 1157707 - DNA, 14 bp, Homo sapiens
tagaaatgtatcct

SEQ ID NO: 1157708 - DNA, 21 bp, Homo sapiens
tagaaatgttagtgccccgca

SEQ ID NO: 1157709 - DNA, 12 bp, Homo sapiens
tagaaatgttta

SEQ ID NO: 1157710 - DNA, 14 bp, Homo sapiens
tagaaattttacaa

SEQ ID NO: 1157711 - DNA, 13 bp, Homo sapiens
tagaaattttgta

SEQ ID NO: 1157712 - DNA, 15 bp, Homo sapiens
tagaaattttgtaag

SEQ ID NO: 1157713 - DNA, 13 bp, Homo sapiens
tagaacaaggctg

SEQ ID NO: 1157714 - DNA, 16 bp, Homo sapiens
tagaacactaattcat

SEQ ID NO: 1157715 - DNA, 14 bp, Homo sapiens
tagaacaggagact

SEQ ID NO: 1157716 - DNA, 18 bp, Homo sapiens
tagaacagtggaaactat

SEQ ID NO: 1157717 - DNA, 17 bp, Homo sapiens
tagaacataaagcaaat

SEQ ID NO: 1157718 - DNA, 22 bp, Homo sapiens
tagaacataaagcaaatagaca

SEQ ID NO: 1157719 - DNA, 19 bp, Homo sapiens
tagaacatgcacatttata

SEQ ID NO: 1157720 - DNA, 14 bp, Homo sapiens
tagaacattcactt

SEQ ID NO: 1157721 - DNA, 17 bp, Homo sapiens
tagaacattcacttttg

SEQ ID NO: 1157722 - DNA, 21 bp, Homo sapiens
tagaaccagccgtattttaca

SEQ ID NO: 1157723 - DNA, 15 bp, Homo sapiens
tagaacctaacaccc

SEQ ID NO: 1157724 - DNA, 14 bp, Homo sapiens
tagaacctatcttt

SEQ ID NO: 1157725 - DNA, 16 bp, Homo sapiens
tagaacgtgcatcctt

SEQ ID NO: 1157726 - DNA, 18 bp, Homo sapiens
tagaacgttaaactatta

SEQ ID NO: 1157727 - DNA, 19 bp, Homo sapiens
tagaactatcatttttaca

SEQ ID NO: 1157728 - DNA, 21 bp, Homo sapiens
tagaactatctgcattatcta

SEQ ID NO: 1157729 - DNA, 18 bp, Homo sapiens
tagaactcactctgggct

SEQ ID NO: 1157730 - DNA, 20 bp, Homo sapiens
tagaactcactctgggctgt

SEQ ID NO: 1157731 - DNA, 19 bp, Homo sapiens
tagaactcagttttaacta

SEQ ID NO: 1157732 - DNA, 22 bp, Homo sapiens
tagaactcagttttaactagaa

SEQ ID NO: 1157733 - DNA, 23 bp, Homo sapiens
tagaactctccatcttattttca

SEQ ID NO: 1157734 - DNA, 16 bp, Homo sapiens
tagaacttgaccccct

SEQ ID NO: 1157735 - DNA, 13 bp, Homo sapiens
tagaacttgcctt

SEQ ID NO: 1157736 - DNA, 20 bp, Homo sapiens
tagaactttgccagtcttta

SEQ ID NO: 1157737 - DNA, 14 bp, Homo sapiens
tagaagaaaacccg

SEQ ID NO: 1157738 - DNA, 19 bp, Homo sapiens
tagaagaaccaaatacctc

SEQ ID NO: 1157739 - DNA, 17 bp, Homo sapiens
tagaagaagaggaagaa

SEQ ID NO: 1157740 - DNA, 17 bp, Homo sapiens
ttctgaataacatttgt

SEQ ID NO: 1157741 - DNA, 16 bp, Homo sapiens
ttctgaataatttctt

SEQ ID NO: 1157742 - DNA, 11 bp, Homo sapiens
ttctgaatgta

SEQ ID NO: 1157743 - DNA, 22 bp, Homo sapiens
ttctgacaaaaagtttccatat

SEQ ID NO: 1157744 - DNA, 14 bp, Homo sapiens
ttctgacagcccaa

SEQ ID NO: 1157745 - DNA, 12 bp, Homo sapiens
ttctgacatgta

SEQ ID NO: 1157746 - DNA, 20 bp, Homo sapiens
ttctgacattaacagttttc

SEQ ID NO: 1157747 - DNA, 22 bp, Homo sapiens
ttctgaccacacttcctgtcca

SEQ ID NO: 1157748 - DNA, 14 bp, Homo sapiens
ttctgaccatttca

SEQ ID NO: 1157749 - DNA, 16 bp, Homo sapiens
ttctgacccaaagcaa

SEQ ID NO: 1157750 - DNA, 16 bp, Homo sapiens
ttctgacccagggcct

SEQ ID NO: 1157751 - DNA, 23 bp, Homo sapiens
ttctgaccccacttatgctgctg

SEQ ID NO: 1157752 - DNA, 21 bp, Homo sapiens
ttctgaccctgcttcaaatat

SEQ ID NO: 1157753 - DNA, 18 bp, Homo sapiens
ttctgactcggtttctcc

SEQ ID NO: 1157754 - DNA, 13 bp, Homo sapiens
ttctgactgctga

SEQ ID NO: 1157755 - DNA, 15 bp, Homo sapiens
ttctgactgtccctg

SEQ ID NO: 1157756 - DNA, 16 bp, Homo sapiens
ttctgactgtccctgc

SEQ ID NO: 1157757 - DNA, 15 bp, Homo sapiens
ttctgacttatgaat

SEQ ID NO: 1157758 - DNA, 20 bp, Homo sapiens
ttctgacttctagctgtctg

SEQ ID NO: 1157759 - DNA, 13 bp, Homo sapiens
ttctgacttttac

SEQ ID NO: 1157760 - DNA, 19 bp, Homo sapiens
ttctgagaactgactttct

SEQ ID NO: 1157761 - DNA, 22 bp, Homo sapiens
ttctgagagttggctcaggcag

SEQ ID NO: 1157762 - DNA, 20 bp, Homo sapiens
ttctgagcaccgaatattga

SEQ ID NO: 1157763 - DNA, 19 bp, Homo sapiens
ttctgagcccggtaagagc

SEQ ID NO: 1157764 - DNA, 15 bp, Homo sapiens
ttctgagctccacct

SEQ ID NO: 1157765 - DNA, 19 bp, Homo sapiens
ttctgagcttttcatggaa

SEQ ID NO: 1157766 - DNA, 13 bp, Homo sapiens
ttctgagtattct

SEQ ID NO: 1157767 - DNA, 14 bp, Homo sapiens
ttctgagtattctc

SEQ ID NO: 1157768 - DNA, 14 bp, Homo sapiens
ttctgagttcttga

SEQ ID NO: 1157769 - DNA, 23 bp, Homo sapiens
ttctgagtttcattctcctgcct

SEQ ID NO: 1157770 - DNA, 15 bp, Homo sapiens
ttctgataggagggg

SEQ ID NO: 1157771 - DNA, 21 bp, Homo sapiens
ttctgataggagggggcggca

SEQ ID NO: 1157772 - DNA, 23 bp, Homo sapiens
ttctgatgacgcctgtctgtgtg

SEQ ID NO: 1157773 - DNA, 22 bp, Homo sapiens
ttctgatgatgtcggtcttgca

SEQ ID NO: 1157774 - DNA, 13 bp, Homo sapiens
ttctgatgtatta

SEQ ID NO: 1157775 - DNA, 13 bp, Homo sapiens
ttctgatgtttat

SEQ ID NO: 1157776 - DNA, 20 bp, Homo sapiens
ttctgattaatatatttaat

SEQ ID NO: 1157777 - DNA, 15 bp, Homo sapiens
ttctgattagaaatg

SEQ ID NO: 1157778 - DNA, 21 bp, Homo sapiens
ttctgattcgaatgacactgt

SEQ ID NO: 1157779 - DNA, 17 bp, Homo sapiens
ttctgattggtgattca

SEQ ID NO: 1157780 - DNA, 17 bp, Homo sapiens
ttctgatttcagttttt

SEQ ID NO: 1157781 - DNA, 20 bp, Homo sapiens
ttctgatttcagtttttcat

SEQ ID NO: 1157782 - DNA, 19 bp, Homo sapiens
ttctgcaaaaatatttata

SEQ ID NO: 1157783 - DNA, 22 bp, Homo sapiens
ttctgcaaaggtggcaatgctt

SEQ ID NO: 1157784 - DNA, 15 bp, Homo sapiens
ttctgcaaatagaaa

SEQ ID NO: 1157785 - DNA, 15 bp, Homo sapiens
ttctgcaactagcca

SEQ ID NO: 1157786 - DNA, 12 bp, Homo sapiens
ttctgcaagaat

SEQ ID NO: 1157787 - DNA, 16 bp, Homo sapiens
ttctgcaagaattaaa

SEQ ID NO: 1157788 - DNA, 20 bp, Homo sapiens
ttctgcaagaattaaaactg

SEQ ID NO: 1157789 - DNA, 23 bp, Homo sapiens
ttctgcaagaattaaaactgagt

SEQ ID NO: 1157790 - DNA, 22 bp, Homo sapiens
ttctgcaagcacatctgcattt

SEQ ID NO: 1157791 - DNA, 16 bp, Homo sapiens
ttctgcaagtttctgt

SEQ ID NO: 1157792 - DNA, 18 bp, Homo sapiens
ttctgcaccacacctggc

SEQ ID NO: 1157793 - DNA, 21 bp, Homo sapiens
ttctgcaccccaattgggaat

SEQ ID NO: 1157794 - DNA, 19 bp, Homo sapiens
ttctgcaccctccaccctg

SEQ ID NO: 1157795 - DNA, 22 bp, Homo sapiens
ttctgcaccctccaccctgtcc

SEQ ID NO: 1157796 - DNA, 20 bp, Homo sapiens
ttctgcagaactcctccaaa

SEQ ID NO: 1157797 - DNA, 23 bp, Homo sapiens
ttctgcagcatgacctgtgacca

SEQ ID NO: 1157798 - DNA, 22 bp, Homo sapiens
ttctgcagtaaatcttttacaa

SEQ ID NO: 1157799 - DNA, 20 bp, Homo sapiens
ttctgcagtagtctctgtgc

SEQ ID NO: 1157800 - DNA, 17 bp, Homo sapiens
ttctgcatatgttgaat

SEQ ID NO: 1157801 - DNA, 23 bp, Homo sapiens
ttctgcatatgttgaatactttt

SEQ ID NO: 1157802 - DNA, 20 bp, Homo sapiens
ttctgcattgctagataaaa

SEQ ID NO: 1157803 - DNA, 23 bp, Homo sapiens
ttctgccatcatttttgatgact

SEQ ID NO: 1157804 - DNA, 19 bp, Homo sapiens
ttctgcccaaaaatatggt

SEQ ID NO: 1157805 - DNA, 17 bp, Homo sapiens
ttctgccccccagggct

SEQ ID NO: 1157806 - DNA, 23 bp, Homo sapiens
ttctgcccctctactgttgcaca

SEQ ID NO: 1157807 - DNA, 17 bp, Homo sapiens
ttctgccctgcctgagg

SEQ ID NO: 1157808 - DNA, 16 bp, Homo sapiens
ttctgccctggctgct

SEQ ID NO: 1157809 - DNA, 19 bp, Homo sapiens
ttctgccctggctgctgcc

SEQ ID NO: 1157810 - DNA, 21 bp, Homo sapiens
ttctgccgccccctcctgaac

SEQ ID NO: 1157811 - DNA, 21 bp, Homo sapiens
ttctgcctacgttctctttaa

SEQ ID NO: 1157812 - DNA, 20 bp, Homo sapiens
ttctgcctagagtgtagcct

SEQ ID NO: 1157813 - DNA, 22 bp, Homo sapiens
ttctgcctagagtgtagcctaa

SEQ ID NO: 1157814 - DNA, 21 bp, Homo sapiens
ttctgcctgcctcctccctcc

SEQ ID NO: 1157815 - DNA, 14 bp, Homo sapiens
ttctgcctggagac

SEQ ID NO: 1157816 - DNA, 14 bp, Homo sapiens
ttctgcctgttata

SEQ ID NO: 1157817 - DNA, 16 bp, Homo sapiens
ttctgccttctcatga

SEQ ID NO: 1157818 - DNA, 15 bp, Homo sapiens
ttctgcctttccccc

SEQ ID NO: 1157819 - DNA, 14 bp, Homo sapiens
ttctgcgcctcagg

SEQ ID NO: 1157820 - DNA, 17 bp, Homo sapiens
ttctgcgggctccctcc

SEQ ID NO: 1157821 - DNA, 18 bp, Homo sapiens
ttctgcgggctccctcct

SEQ ID NO: 1157822 - DNA, 19 bp, Homo sapiens
ttctgcgtccaccaggcct

SEQ ID NO: 1157823 - DNA, 15 bp, Homo sapiens
ttctgctaaatatca

SEQ ID NO: 1157824 - DNA, 22 bp, Homo sapiens
ttctgctacttcactgtcatct

SEQ ID NO: 1157825 - DNA, 19 bp, Homo sapiens
ttctgctagagcagacagg

SEQ ID NO: 1157826 - DNA, 23 bp, Homo sapiens
ttctgctagagcagacaggcctg

SEQ ID NO: 1157827 - DNA, 19 bp, Homo sapiens
ttctgctcatcattctctg

SEQ ID NO: 1157828 - DNA, 20 bp, Homo sapiens
ttctgctccacccttggcct

SEQ ID NO: 1157829 - DNA, 13 bp, Homo sapiens
ttctgctccagcc

SEQ ID NO: 1157830 - DNA, 14 bp, Homo sapiens
ttctgctccagccc

SEQ ID NO: 1157831 - DNA, 15 bp, Homo sapiens
ttctgctcccacccc

SEQ ID NO: 1157832 - DNA, 15 bp, Homo sapiens
ttctgctcctctcca

SEQ ID NO: 1157833 - DNA, 12 bp, Homo sapiens
ttctgctcctgc

SEQ ID NO: 1157834 - DNA, 17 bp, Homo sapiens
ttctgctctggttgttt

SEQ ID NO: 1157835 - DNA, 13 bp, Homo sapiens
ttctgctgccctc

SEQ ID NO: 1157836 - DNA, 17 bp, Homo sapiens
ttctgctgcctctacac

SEQ ID NO: 1157837 - DNA, 15 bp, Homo sapiens
ttctgctggaggagg

SEQ ID NO: 1157838 - DNA, 13 bp, Homo sapiens
ttctgctggataa

SEQ ID NO: 1157839 - DNA, 14 bp, Homo sapiens
ttctgctgttcttc

SEQ ID NO: 1157840 - DNA, 16 bp, Homo sapiens
ttctgcttaggagaga

SEQ ID NO: 1157841 - DNA, 19 bp, Homo sapiens
ttctgcttcaataaatctt

SEQ ID NO: 1157842 - DNA, 17 bp, Homo sapiens
ttctgctttatcttttc

SEQ ID NO: 1157843 - DNA, 19 bp, Homo sapiens
ttctgctttatcttttcat

SEQ ID NO: 1157844 - DNA, 10 bp, Homo sapiens
ttctggaaat

SEQ ID NO: 1157845 - DNA, 19 bp, Homo sapiens
ttctggaaattttgtccat

SEQ ID NO: 1157846 - DNA, 21 bp, Homo sapiens
ttctggaaattttgtccattt

SEQ ID NO: 1157847 - DNA, 20 bp, Homo sapiens
ttctggaatttacctcccct

SEQ ID NO: 1157848 - DNA, 20 bp, Homo sapiens
ttctggaatttgttcaagtt

SEQ ID NO: 1157849 - DNA, 22 bp, Homo sapiens
ttctggaatttgttcaagtttt

SEQ ID NO: 1157850 - DNA, 20 bp, Homo sapiens
ttctggactacacccaagcc

SEQ ID NO: 1157851 - DNA, 17 bp, Homo sapiens
ttctggactatagctgt

SEQ ID NO: 1157852 - DNA, 15 bp, Homo sapiens
ttctggactctgccc

SEQ ID NO: 1157853 - DNA, 18 bp, Homo sapiens
ttctggactctgccccaa

SEQ ID NO: 1157854 - DNA, 17 bp, Homo sapiens
ttctggagatggatcct

SEQ ID NO: 1157855 - DNA, 21 bp, Homo sapiens
ttctggagcaatctgaccctt

SEQ ID NO: 1157856 - DNA, 14 bp, Homo sapiens
ttctggagctggga

SEQ ID NO: 1157857 - DNA, 14 bp, Homo sapiens
ttctggagtttctc

SEQ ID NO: 1157858 - DNA, 16 bp, Homo sapiens
ttctggatctcctgct

SEQ ID NO: 1157859 - DNA, 18 bp, Homo sapiens
ttctggatctcctgctgc

SEQ ID NO: 1157860 - DNA, 15 bp, Homo sapiens
ttctggcaagagcag

SEQ ID NO: 1157861 - DNA, 21 bp, Homo sapiens
ttctggccaaggggtgggcct

SEQ ID NO: 1157862 - DNA, 17 bp, Homo sapiens
ttctggccacatcagcc

SEQ ID NO: 1157863 - DNA, 16 bp, Homo sapiens
ttctggccaccccaga

SEQ ID NO: 1157864 - DNA, 19 bp, Homo sapiens
tagaagaagaggaagaaat

SEQ ID NO: 1157865 - DNA, 16 bp, Homo sapiens
tagaagaatattgtat

SEQ ID NO: 1157866 - DNA, 18 bp, Homo sapiens
tagaagagcacagagccc

SEQ ID NO: 1157867 - DNA, 19 bp, Homo sapiens
tagaagagcacagagccct

SEQ ID NO: 1157868 - DNA, 15 bp, Homo sapiens
tagaagatgtgtaaa

SEQ ID NO: 1157869 - DNA, 19 bp, Homo sapiens
tagaagattgttggtgaat

SEQ ID NO: 1157870 - DNA, 19 bp, Homo sapiens
tagaagcaaagatttcagt

SEQ ID NO: 1157871 - DNA, 22 bp, Homo sapiens
tagaagcactacaccttgcctt

SEQ ID NO: 1157872 - DNA, 12 bp, Homo sapiens
tagaagccaagg

SEQ ID NO: 1157873 - DNA, 16 bp, Homo sapiens
tagaagccaagggaaa

SEQ ID NO: 1157874 - DNA, 12 bp, Homo sapiens
tagaagcctgca

SEQ ID NO: 1157875 - DNA, 16 bp, Homo sapiens
tagaagctgcagtggt

SEQ ID NO: 1157876 - DNA, 23 bp, Homo sapiens
tagaagctggtaaaaatgacaat

SEQ ID NO: 1157877 - DNA, 19 bp, Homo sapiens
tagaaggaagtgtgtttgc

SEQ ID NO: 1157878 - DNA, 19 bp, Homo sapiens
tagaaggaatttgtacttc

SEQ ID NO: 1157879 - DNA, 21 bp, Homo sapiens
tagaaggcgtccatgtttatt

SEQ ID NO: 1157880 - DNA, 18 bp, Homo sapiens
tagaaggcttctctccac

SEQ ID NO: 1157881 - DNA, 22 bp, Homo sapiens
tagaagggccagtcctgcctgg

SEQ ID NO: 1157882 - DNA, 17 bp, Homo sapiens
tagaagtagaattgaca

SEQ ID NO: 1157883 - DNA, 15 bp, Homo sapiens
tagaagtaggaggaa

SEQ ID NO: 1157884 - DNA, 14 bp, Homo sapiens
tagaagtatttgtg

SEQ ID NO: 1157885 - DNA, 19 bp, Homo sapiens
tagaagtcttagatgtata

SEQ ID NO: 1157886 - DNA, 18 bp, Homo sapiens
tagaagtgagtttgtaaa

SEQ ID NO: 1157887 - DNA, 21 bp, Homo sapiens
tagaagtgagtttgtaaatat

SEQ ID NO: 1157888 - DNA, 19 bp, Homo sapiens
tagaagtggaccaggacag

SEQ ID NO: 1157889 - DNA, 20 bp, Homo sapiens
tagaagttctagtgttttca

SEQ ID NO: 1157890 - DNA, 22 bp, Homo sapiens
tagaagttctagtgttttcaat

SEQ ID NO: 1157891 - DNA, 12 bp, Homo sapiens
tagaataaacct

SEQ ID NO: 1157892 - DNA, 21 bp, Homo sapiens
tagaataaaggcagttttcta

SEQ ID NO: 1157893 - DNA, 22 bp, Homo sapiens
tagaataaaggcagttttctaa

SEQ ID NO: 1157894 - DNA, 18 bp, Homo sapiens
tagaataacctttcagaa

SEQ ID NO: 1157895 - DNA, 19 bp, Homo sapiens
tagaataagaatttgcata

SEQ ID NO: 1157896 - DNA, 21 bp, Homo sapiens
tagaataatgtgggaagaaac

SEQ ID NO: 1157897 - DNA, 22 bp, Homo sapiens
tagaataatgtgggaagaaaca

SEQ ID NO: 1157898 - DNA, 11 bp, Homo sapiens
tagaataattc

SEQ ID NO: 1157899 - DNA, 13 bp, Homo sapiens
tagaataattctt

SEQ ID NO: 1157900 - DNA, 20 bp, Homo sapiens
tagaataattcttttctgag

SEQ ID NO: 1157901 - DNA, 23 bp, Homo sapiens
tagaatacagttttgagtagagt

SEQ ID NO: 1157902 - DNA, 17 bp, Homo sapiens
tagaatacattgataca

SEQ ID NO: 1157903 - DNA, 12 bp, Homo sapiens
tagaatactttt

SEQ ID NO: 1157904 - DNA, 22 bp, Homo sapiens
tagaataggcagggggccctgc

SEQ ID NO: 1157905 - DNA, 15 bp, Homo sapiens
tagaatatttattac

SEQ ID NO: 1157906 - DNA, 21 bp, Homo sapiens
tagaatcaaacattttgaaag

SEQ ID NO: 1157907 - DNA, 14 bp, Homo sapiens
tagaatccaaactt

SEQ ID NO: 1157908 - DNA, 18 bp, Homo sapiens
tagaatctgatgccttta

SEQ ID NO: 1157909 - DNA, 13 bp, Homo sapiens
tagaatcttgttt

SEQ ID NO: 1157910 - DNA, 14 bp, Homo sapiens
tagaatcttttaaa

SEQ ID NO: 1157911 - DNA, 19 bp, Homo sapiens
tagaatgaatttatcttta

SEQ ID NO: 1157912 - DNA, 12 bp, Homo sapiens
tagaatgacagt

SEQ ID NO: 1157913 - DNA, 16 bp, Homo sapiens
tagaatgataaatgta

SEQ ID NO: 1157914 - DNA, 17 bp, Homo sapiens
tagaatgatgttttaaa

SEQ ID NO: 1157915 - DNA, 18 bp, Homo sapiens
tagaatgatgttttaaaa

SEQ ID NO: 1157916 - DNA, 11 bp, Homo sapiens
tagaatgtgat

SEQ ID NO: 1157917 - DNA, 20 bp, Homo sapiens
tagaatgtgttttctgaata

SEQ ID NO: 1157918 - DNA, 21 bp, Homo sapiens
tagaattaaaaaagcatactt

SEQ ID NO: 1157919 - DNA, 21 bp, Homo sapiens
tagaattaccattaattacat

SEQ ID NO: 1157920 - DNA, 15 bp, Homo sapiens
tagaattaccatttg

SEQ ID NO: 1157921 - DNA, 15 bp, Homo sapiens
tagaattatctaatt

SEQ ID NO: 1157922 - DNA, 16 bp, Homo sapiens
tagaattatctaattt

SEQ ID NO: 1157923 - DNA, 21 bp, Homo sapiens
tagaattatctaatttataaa

SEQ ID NO: 1157924 - DNA, 15 bp, Homo sapiens
tagaattatttaaac

SEQ ID NO: 1157925 - DNA, 19 bp, Homo sapiens
tagaattatttttcactct

SEQ ID NO: 1157926 - DNA, 17 bp, Homo sapiens
tagaattccttcgaaag

SEQ ID NO: 1157927 - DNA, 18 bp, Homo sapiens
tagaattctagtgctgct

SEQ ID NO: 1157928 - DNA, 19 bp, Homo sapiens
tagaattgagtgtttaaag

SEQ ID NO: 1157929 - DNA, 15 bp, Homo sapiens
tagaattgtatatag

SEQ ID NO: 1157930 - DNA, 20 bp, Homo sapiens
tagaatttattcaattcctc

SEQ ID NO: 1157931 - DNA, 22 bp, Homo sapiens
tagacaaacaagggagaagagt

SEQ ID NO: 1157932 - DNA, 12 bp, Homo sapiens
tagacaaagtac

SEQ ID NO: 1157933 - DNA, 14 bp, Homo sapiens
tagacaaagtacat

SEQ ID NO: 1157934 - DNA, 20 bp, Homo sapiens
tagacaacctgaaatttatt

SEQ ID NO: 1157935 - DNA, 14 bp, Homo sapiens
tagacaacctttct

SEQ ID NO: 1157936 - DNA, 16 bp, Homo sapiens
tagacaacctttctgt

SEQ ID NO: 1157937 - DNA, 20 bp, Homo sapiens
tagacaacgatgaatttctt

SEQ ID NO: 1157938 - DNA, 13 bp, Homo sapiens
tagacaactagat

SEQ ID NO: 1157939 - DNA, 14 bp, Homo sapiens
tagacaactagatt

SEQ ID NO: 1157940 - DNA, 17 bp, Homo sapiens
tagacaactagatttgt

SEQ ID NO: 1157941 - DNA, 18 bp, Homo sapiens
tagacaactagatttgtc

SEQ ID NO: 1157942 - DNA, 18 bp, Homo sapiens
tagacaattgaggtaagt

SEQ ID NO: 1157943 - DNA, 18 bp, Homo sapiens
tagacaatttattatggc

SEQ ID NO: 1157944 - DNA, 13 bp, Homo sapiens
tagacacatgaag

SEQ ID NO: 1157945 - DNA, 20 bp, Homo sapiens
tagacacatgaaggtaaata

SEQ ID NO: 1157946 - DNA, 21 bp, Homo sapiens
tagacacatgaaggtaaataa

SEQ ID NO: 1157947 - DNA, 22 bp, Homo sapiens
tagacacatgaaggtaaataaa

SEQ ID NO: 1157948 - DNA, 17 bp, Homo sapiens
tagacacccattttcac

SEQ ID NO: 1157949 - DNA, 20 bp, Homo sapiens
tagacacgagcttaatcaac

SEQ ID NO: 1157950 - DNA, 17 bp, Homo sapiens
tagacactccccacggg

SEQ ID NO: 1157951 - DNA, 11 bp, Homo sapiens
tagacactgga

SEQ ID NO: 1157952 - DNA, 12 bp, Homo sapiens
tagacactggac

SEQ ID NO: 1157953 - DNA, 18 bp, Homo sapiens
tagacagaaaccaagcca

SEQ ID NO: 1157954 - DNA, 19 bp, Homo sapiens
tagacagaaaccaagccat

SEQ ID NO: 1157955 - DNA, 15 bp, Homo sapiens
tagacagaacaccta

SEQ ID NO: 1157956 - DNA, 15 bp, Homo sapiens
tagacagaagaaaca

SEQ ID NO: 1157957 - DNA, 14 bp, Homo sapiens
tagacagcatgaga

SEQ ID NO: 1157958 - DNA, 18 bp, Homo sapiens
tagacagtattgccacct

SEQ ID NO: 1157959 - DNA, 20 bp, Homo sapiens
tagacagtattgccacctct

SEQ ID NO: 1157960 - DNA, 14 bp, Homo sapiens
tagacagtgctgcc

SEQ ID NO: 1157961 - DNA, 16 bp, Homo sapiens
tagacagtgctgccct

SEQ ID NO: 1157962 - DNA, 17 bp, Homo sapiens
tagacagtgctgccctg

SEQ ID NO: 1157963 - DNA, 20 bp, Homo sapiens
tagacagtgctgccctgcga

SEQ ID NO: 1157964 - DNA, 13 bp, Homo sapiens
tagacatcaaact

SEQ ID NO: 1157965 - DNA, 22 bp, Homo sapiens
tagacatcaaactcaatgcttt

SEQ ID NO: 1157966 - DNA, 19 bp, Homo sapiens
tagacatctacctatactt

SEQ ID NO: 1157967 - DNA, 22 bp, Homo sapiens
tagacatctacctatacttaat

SEQ ID NO: 1157968 - DNA, 20 bp, Homo sapiens
tagacatgcccaaaacttat

SEQ ID NO: 1157969 - DNA, 11 bp, Homo sapiens
tagacatgtag

SEQ ID NO: 1157970 - DNA, 13 bp, Homo sapiens
tagacatttcaaa

SEQ ID NO: 1157971 - DNA, 19 bp, Homo sapiens
tagacatttcaaaattaat

SEQ ID NO: 1157972 - DNA, 20 bp, Homo sapiens
tagacattttggggttttat

SEQ ID NO: 1157973 - DNA, 16 bp, Homo sapiens
tagacatttttgtgcc

SEQ ID NO: 1157974 - DNA, 12 bp, Homo sapiens
tagaccaaagca

SEQ ID NO: 1157975 - DNA, 16 bp, Homo sapiens
tagaccagtttgcatg

SEQ ID NO: 1157976 - DNA, 20 bp, Homo sapiens
tagaccctgggtgggctctg

SEQ ID NO: 1157977 - DNA, 22 bp, Homo sapiens
tagacctagggaggaccttatc

SEQ ID NO: 1157978 - DNA, 21 bp, Homo sapiens
tagacctataatccttgataa

SEQ ID NO: 1157979 - DNA, 21 bp, Homo sapiens
tagacctcagcctgtgctgcc

SEQ ID NO: 1157980 - DNA, 21 bp, Homo sapiens
tagacctctggttaatttata

SEQ ID NO: 1157981 - DNA, 15 bp, Homo sapiens
tagacctgagctggg

SEQ ID NO: 1157982 - DNA, 20 bp, Homo sapiens
tagaccttgagggtgggcca

SEQ ID NO: 1157983 - DNA, 17 bp, Homo sapiens
tagaccttgttacttct

SEQ ID NO: 1157984 - DNA, 14 bp, Homo sapiens
tagacggtgctcac

SEQ ID NO: 1157985 - DNA, 23 bp, Homo sapiens
tagactaaggccattattgtact

SEQ ID NO: 1157986 - DNA, 18 bp, Homo sapiens
tagactaattaaaatctg

SEQ ID NO: 1157987 - DNA, 19 bp, Homo sapiens
tagactaattaaaatctgg

SEQ ID NO: 1157988 - DNA, 17 bp, Homo sapiens
ttctggccagtgtttaa

SEQ ID NO: 1157989 - DNA, 18 bp, Homo sapiens
ttctggccagtgtttaaa

SEQ ID NO: 1157990 - DNA, 22 bp, Homo sapiens
ttctggccagtgtttaaaactt

SEQ ID NO: 1157991 - DNA, 15 bp, Homo sapiens
ttctggcctccagcc

SEQ ID NO: 1157992 - DNA, 14 bp, Homo sapiens
ttctggcctcccac

SEQ ID NO: 1157993 - DNA, 14 bp, Homo sapiens
ttctggcctctgct

SEQ ID NO: 1157994 - DNA, 17 bp, Homo sapiens
ttctggcgcccctgcct

SEQ ID NO: 1157995 - DNA, 18 bp, Homo sapiens
ttctggcgcccctgcctg

SEQ ID NO: 1157996 - DNA, 19 bp, Homo sapiens
ttctggcgcccctgcctgt

SEQ ID NO: 1157997 - DNA, 18 bp, Homo sapiens
ttctggctatgcatttga

SEQ ID NO: 1157998 - DNA, 16 bp, Homo sapiens
ttctggctcacaggaa

SEQ ID NO: 1157999 - DNA, 23 bp, Homo sapiens
ttctgggaaatggcttgaagcca

SEQ ID NO: 1158000 - DNA, 21 bp, Homo sapiens
ttctgggaagggagagttctt

SEQ ID NO: 1158001 - DNA, 22 bp, Homo sapiens
ttctgggagacacccaaagggt

SEQ ID NO: 1158002 - DNA, 16 bp, Homo sapiens
ttctgggaggaagcag

SEQ ID NO: 1158003 - DNA, 23 bp, Homo sapiens
ttctgggatatatggaggattct

SEQ ID NO: 1158004 - DNA, 17 bp, Homo sapiens
ttctgggcagagcctgt

SEQ ID NO: 1158005 - DNA, 22 bp, Homo sapiens
ttctgggctactgccactgtgt

SEQ ID NO: 1158006 - DNA, 14 bp, Homo sapiens
ttctgggctggggc

SEQ ID NO: 1158007 - DNA, 15 bp, Homo sapiens
ttctggggaaaaaaa

SEQ ID NO: 1158008 - DNA, 20 bp, Homo sapiens
ttctggggaaaaaaaagaga

SEQ ID NO: 1158009 - DNA, 22 bp, Homo sapiens
ttctggggaaaaaaaagagact

SEQ ID NO: 1158010 - DNA, 21 bp, Homo sapiens
ttctggggtcaggtgccactg

SEQ ID NO: 1158011 - DNA, 18 bp, Homo sapiens
ttctgggtagtcccctgt

SEQ ID NO: 1158012 - DNA, 17 bp, Homo sapiens
ttctgggtccctgctcc

SEQ ID NO: 1158013 - DNA, 10 bp, Homo sapiens
ttctgggtga

SEQ ID NO: 1158014 - DNA, 18 bp, Homo sapiens
ttctgggtggcctcggga

SEQ ID NO: 1158015 - DNA, 22 bp, Homo sapiens
ttctgggtgttgaccactccag

SEQ ID NO: 1158016 - DNA, 16 bp, Homo sapiens
ttctgggttttctgaa

SEQ ID NO: 1158017 - DNA, 15 bp, Homo sapiens
ttctggtactctcct

SEQ ID NO: 1158018 - DNA, 17 bp, Homo sapiens
ttctggtagatagaaat

SEQ ID NO: 1158019 - DNA, 18 bp, Homo sapiens
ttctggtagatagaaata

SEQ ID NO: 1158020 - DNA, 17 bp, Homo sapiens
ttctggtattcacagaa

SEQ ID NO: 1158021 - DNA, 19 bp, Homo sapiens
ttctggtatttcccctgtc

SEQ ID NO: 1158022 - DNA, 18 bp, Homo sapiens
ttctggtccctcttctct

SEQ ID NO: 1158023 - DNA, 21 bp, Homo sapiens
ttctggtccctcttctctcct

SEQ ID NO: 1158024 - DNA, 16 bp, Homo sapiens
ttctggtcctttttgg

SEQ ID NO: 1158025 - DNA, 13 bp, Homo sapiens
ttctggtctcgtc

SEQ ID NO: 1158026 - DNA, 22 bp, Homo sapiens
ttctggtctcgtcttccgtctc

SEQ ID NO: 1158027 - DNA, 15 bp, Homo sapiens
ttctggtgaccagac

SEQ ID NO: 1158028 - DNA, 17 bp, Homo sapiens
ttctggtgaccagactt

SEQ ID NO: 1158029 - DNA, 14 bp, Homo sapiens
ttctggtgtctgct

SEQ ID NO: 1158030 - DNA, 13 bp, Homo sapiens
ttctggtgttcct

SEQ ID NO: 1158031 - DNA, 13 bp, Homo sapiens
ttctggttccaaa

SEQ ID NO: 1158032 - DNA, 13 bp, Homo sapiens
ttctggttccatt

SEQ ID NO: 1158033 - DNA, 13 bp, Homo sapiens
ttctgtaaacaga

SEQ ID NO: 1158034 - DNA, 22 bp, Homo sapiens
ttctgtaaactctgcatccaga

SEQ ID NO: 1158035 - DNA, 11 bp, Homo sapiens
ttctgtaattc

SEQ ID NO: 1158036 - DNA, 22 bp, Homo sapiens
ttctgtaattcaggtttttcct

SEQ ID NO: 1158037 - DNA, 12 bp, Homo sapiens
ttctgtaccagt

SEQ ID NO: 1158038 - DNA, 14 bp, Homo sapiens
ttctgtaccagtta

SEQ ID NO: 1158039 - DNA, 21 bp, Homo sapiens
ttctgtaccagttaatttttc

SEQ ID NO: 1158040 - DNA, 14 bp, Homo sapiens
ttctgtagctttct

SEQ ID NO: 1158041 - DNA, 20 bp, Homo sapiens
ttctgtagtttttaattaaa

SEQ ID NO: 1158042 - DNA, 24 bp, Homo sapiens
ttctgtatacaaccctggcattat

SEQ ID NO: 1158043 - DNA, 16 bp, Homo sapiens
ttctgtatatactttt

SEQ ID NO: 1158044 - DNA, 22 bp, Homo sapiens
ttctgtatatttgtcatgacag

SEQ ID NO: 1158045 - DNA, 18 bp, Homo sapiens
ttctgtatttcactcttt

SEQ ID NO: 1158046 - DNA, 18 bp, Homo sapiens
ttctgtattttgtttttg

SEQ ID NO: 1158047 - DNA, 22 bp, Homo sapiens
ttctgtatttttttttctaaga

SEQ ID NO: 1158048 - DNA, 18 bp, Homo sapiens
ttctgtcaccaaatttgt

SEQ ID NO: 1158049 - DNA, 16 bp, Homo sapiens
ttctgtcatttacaca

SEQ ID NO: 1158050 - DNA, 17 bp, Homo sapiens
ttctgtcatttacacac

SEQ ID NO: 1158051 - DNA, 17 bp, Homo sapiens
ttctgtccatcagtgca

SEQ ID NO: 1158052 - DNA, 19 bp, Homo sapiens
ttctgtccatcagtgcatg

SEQ ID NO: 1158053 - DNA, 14 bp, Homo sapiens
ttctgtccccagcc

SEQ ID NO: 1158054 - DNA, 14 bp, Homo sapiens
ttctgtccctgtcc

SEQ ID NO: 1158055 - DNA, 21 bp, Homo sapiens
ttctgtccgagctttgaaaat

SEQ ID NO: 1158056 - DNA, 22 bp, Homo sapiens
ttctgtccttttggcactgaga

SEQ ID NO: 1158057 - DNA, 22 bp, Homo sapiens
ttctgtctaggttaaagctaaa

SEQ ID NO: 1158058 - DNA, 22 bp, Homo sapiens
ttctgtctctaaccattcaaat

SEQ ID NO: 1158059 - DNA, 19 bp, Homo sapiens
ttctgtctctgcctccctc

SEQ ID NO: 1158060 - DNA, 18 bp, Homo sapiens
ttctgtctcttttctctt

SEQ ID NO: 1158061 - DNA, 15 bp, Homo sapiens
ttctgtgaaatataa

SEQ ID NO: 1158062 - DNA, 13 bp, Homo sapiens
ttctgtgaagagg

SEQ ID NO: 1158063 - DNA, 15 bp, Homo sapiens
ttctgtgaagctaat

SEQ ID NO: 1158064 - DNA, 18 bp, Homo sapiens
ttctgtgaagctaataca

SEQ ID NO: 1158065 - DNA, 14 bp, Homo sapiens
ttctgtgacattta

SEQ ID NO: 1158066 - DNA, 17 bp, Homo sapiens
ttctgtgacatttatgt

SEQ ID NO: 1158067 - DNA, 23 bp, Homo sapiens
ttctgtgactgaagaagatgagc

SEQ ID NO: 1158068 - DNA, 19 bp, Homo sapiens
ttctgtgagacccccacac

SEQ ID NO: 1158069 - DNA, 16 bp, Homo sapiens
ttctgtgagataaatg

SEQ ID NO: 1158070 - DNA, 17 bp, Homo sapiens
ttctgtgatgagctgat

SEQ ID NO: 1158071 - DNA, 18 bp, Homo sapiens
ttctgtgatgagctgatc

SEQ ID NO: 1158072 - DNA, 13 bp, Homo sapiens
ttctgtgcccagg

SEQ ID NO: 1158073 - DNA, 16 bp, Homo sapiens
ttctgtgccctactca

SEQ ID NO: 1158074 - DNA, 12 bp, Homo sapiens
ttctgtgcctcc

SEQ ID NO: 1158075 - DNA, 15 bp, Homo sapiens
ttctgtgcctccagg

SEQ ID NO: 1158076 - DNA, 15 bp, Homo sapiens
ttctgtgcctccccc

SEQ ID NO: 1158077 - DNA, 16 bp, Homo sapiens
ttctgtgcctgaatat

SEQ ID NO: 1158078 - DNA, 20 bp, Homo sapiens
ttctgtggatacagtgccca

SEQ ID NO: 1158079 - DNA, 22 bp, Homo sapiens
ttctgtggatgccgatttctgt

SEQ ID NO: 1158080 - DNA, 19 bp, Homo sapiens
ttctgtggccgccatctgc

SEQ ID NO: 1158081 - DNA, 12 bp, Homo sapiens
ttctgtggctca

SEQ ID NO: 1158082 - DNA, 22 bp, Homo sapiens
ttctgtgggagaattcttacat

SEQ ID NO: 1158083 - DNA, 19 bp, Homo sapiens
ttctgtgggcatggccgct

SEQ ID NO: 1158084 - DNA, 17 bp, Homo sapiens
ttctgtggtcacagtga

SEQ ID NO: 1158085 - DNA, 17 bp, Homo sapiens
ttctgtggttcctctgc

SEQ ID NO: 1158086 - DNA, 18 bp, Homo sapiens
ttctgtggtttcatgtta

SEQ ID NO: 1158087 - DNA, 20 bp, Homo sapiens
ttctgtggttttcccctccc

SEQ ID NO: 1158088 - DNA, 22 bp, Homo sapiens
ttctgtggttttcccctccctg

SEQ ID NO: 1158089 - DNA, 21 bp, Homo sapiens
ttctgtgtatctctttcacat

SEQ ID NO: 1158090 - DNA, 23 bp, Homo sapiens
ttctgtgtgcaccttaccaactt

SEQ ID NO: 1158091 - DNA, 18 bp, Homo sapiens
ttctgtgtgtcagttttc

SEQ ID NO: 1158092 - DNA, 15 bp, Homo sapiens
ttctgtgttcatttt

SEQ ID NO: 1158093 - DNA, 18 bp, Homo sapiens
ttctgttaaaaaaataaa

SEQ ID NO: 1158094 - DNA, 13 bp, Homo sapiens
ttctgttaactga

SEQ ID NO: 1158095 - DNA, 14 bp, Homo sapiens
ttctgttaactgaa

SEQ ID NO: 1158096 - DNA, 13 bp, Homo sapiens
ttctgttccaaat

SEQ ID NO: 1158097 - DNA, 19 bp, Homo sapiens
ttctgttccaaattcagtt

SEQ ID NO: 1158098 - DNA, 17 bp, Homo sapiens
ttctgttccagtcacat

SEQ ID NO: 1158099 - DNA, 18 bp, Homo sapiens
ttctgttcccaaggaagc

SEQ ID NO: 1158100 - DNA, 13 bp, Homo sapiens
ttctgttccccag

SEQ ID NO: 1158101 - DNA, 15 bp, Homo sapiens
ttctgttcttacaaa

SEQ ID NO: 1158102 - DNA, 18 bp, Homo sapiens
ttctgttctttctggcta

SEQ ID NO: 1158103 - DNA, 17 bp, Homo sapiens
ttctgttgatcccactt

SEQ ID NO: 1158104 - DNA, 11 bp, Homo sapiens
ttctgttgctg

SEQ ID NO: 1158105 - DNA, 20 bp, Homo sapiens
ttctgttgtcattgctgttg

SEQ ID NO: 1158106 - DNA, 20 bp, Homo sapiens
ttctgttgttccattttatg

SEQ ID NO: 1158107 - DNA, 19 bp, Homo sapiens
ttctgtttagttttacact

SEQ ID NO: 1158108 - DNA, 18 bp, Homo sapiens
ttctgtttatggccacat

SEQ ID NO: 1158109 - DNA, 20 bp, Homo sapiens
ttctgtttattcttccagaa

SEQ ID NO: 1158110 - DNA, 11 bp, Homo sapiens
ttctgtttctt

SEQ ID NO: 1158111 - DNA, 14 bp, Homo sapiens
ttctgtttggcact

SEQ ID NO: 1158112 - DNA, 18 bp, Homo sapiens
ttctgtttggcacttgta

SEQ ID NO: 1158113 - DNA, 23 bp, Homo sapiens
tagactaattaaaatctggaaat

SEQ ID NO: 1158114 - DNA, 17 bp, Homo sapiens
tagactagtcctatgga

SEQ ID NO: 1158115 - DNA, 15 bp, Homo sapiens
tagactataaatgtt

SEQ ID NO: 1158116 - DNA, 16 bp, Homo sapiens
tagactctagtattta

SEQ ID NO: 1158117 - DNA, 17 bp, Homo sapiens
tagactctgtctacctg

SEQ ID NO: 1158118 - DNA, 21 bp, Homo sapiens
tagactcttttccttcccttt

SEQ ID NO: 1158119 - DNA, 18 bp, Homo sapiens
tagactggacagcttgtg

SEQ ID NO: 1158120 - DNA, 23 bp, Homo sapiens
tagactggagtgaggcttccagg

SEQ ID NO: 1158121 - DNA, 17 bp, Homo sapiens
tagactgtgattcagaa

SEQ ID NO: 1158122 - DNA, 16 bp, Homo sapiens
tagacttaataaaggt

SEQ ID NO: 1158123 - DNA, 17 bp, Homo sapiens
tagacttactttcctat

SEQ ID NO: 1158124 - DNA, 22 bp, Homo sapiens
tagacttcaagcatggctattt

SEQ ID NO: 1158125 - DNA, 13 bp, Homo sapiens
tagacttctctta

SEQ ID NO: 1158126 - DNA, 16 bp, Homo sapiens
tagacttctgagtaat

SEQ ID NO: 1158127 - DNA, 14 bp, Homo sapiens
tagacttctggttg

SEQ ID NO: 1158128 - DNA, 20 bp, Homo sapiens
tagacttgaaagttttccag

SEQ ID NO: 1158129 - DNA, 15 bp, Homo sapiens
tagacttggacccaa

SEQ ID NO: 1158130 - DNA, 19 bp, Homo sapiens
tagactttagaaataaatg

SEQ ID NO: 1158131 - DNA, 12 bp, Homo sapiens
tagactttctgt

SEQ ID NO: 1158132 - DNA, 13 bp, Homo sapiens
tagagaaaaggct

SEQ ID NO: 1158133 - DNA, 20 bp, Homo sapiens
tagagaaaataaatttaact

SEQ ID NO: 1158134 - DNA, 20 bp, Homo sapiens
tagagaacacgcgtatttac

SEQ ID NO: 1158135 - DNA, 21 bp, Homo sapiens
tagagaactggaggaaccaca

SEQ ID NO: 1158136 - DNA, 16 bp, Homo sapiens
tagagaactgtggccg

SEQ ID NO: 1158137 - DNA, 14 bp, Homo sapiens
tagagacagaagca

SEQ ID NO: 1158138 - DNA, 18 bp, Homo sapiens
tagagacagaagcaggct

SEQ ID NO: 1158139 - DNA, 21 bp, Homo sapiens
tagagacagaagcaggctgga

SEQ ID NO: 1158140 - DNA, 15 bp, Homo sapiens
tagagacccccaggc

SEQ ID NO: 1158141 - DNA, 14 bp, Homo sapiens
tagagagaacaggt

SEQ ID NO: 1158142 - DNA, 14 bp, Homo sapiens
tagagagagaggta

SEQ ID NO: 1158143 - DNA, 19 bp, Homo sapiens
tagagagatgagaagccag

SEQ ID NO: 1158144 - DNA, 12 bp, Homo sapiens
tagagaggcctg

SEQ ID NO: 1158145 - DNA, 19 bp, Homo sapiens
tagagagggagaagaagtc

SEQ ID NO: 1158146 - DNA, 18 bp, Homo sapiens
tagagaggtttttcttgg

SEQ ID NO: 1158147 - DNA, 20 bp, Homo sapiens
tagagatattcttatttcac

SEQ ID NO: 1158148 - DNA, 23 bp, Homo sapiens
tagagatgctgtaacttaaaata

SEQ ID NO: 1158149 - DNA, 22 bp, Homo sapiens
tagagatgtgcctgtgggaggg

SEQ ID NO: 1158150 - DNA, 23 bp, Homo sapiens
tagagatgtgcctgtgggagggg

SEQ ID NO: 1158151 - DNA, 19 bp, Homo sapiens
tagagatgtttttaaaagt

SEQ ID NO: 1158152 - DNA, 17 bp, Homo sapiens
tagagattacctcctga

SEQ ID NO: 1158153 - DNA, 20 bp, Homo sapiens
tagagatttgtctaattgca

SEQ ID NO: 1158154 - DNA, 18 bp, Homo sapiens
tagagatttttatgtgtt

SEQ ID NO: 1158155 - DNA, 21 bp, Homo sapiens
tagagcaaaatcaacatgact

SEQ ID NO: 1158156 - DNA, 20 bp, Homo sapiens
tagagcacagcttcttctgc

SEQ ID NO: 1158157 - DNA, 19 bp, Homo sapiens
tagagcagcctcgtggagc

SEQ ID NO: 1158158 - DNA, 19 bp, Homo sapiens
tagagcattgaattggaga

SEQ ID NO: 1158159 - DNA, 20 bp, Homo sapiens
tagagccaactgattttgta

SEQ ID NO: 1158160 - DNA, 23 bp, Homo sapiens
tagagccaactgattttgtatgt

SEQ ID NO: 1158161 - DNA, 15 bp, Homo sapiens
tagagccaagctgca

SEQ ID NO: 1158162 - DNA, 20 bp, Homo sapiens
tagagccaagtgtcttttaa

SEQ ID NO: 1158163 - DNA, 14 bp, Homo sapiens
tagagctagctgcc

SEQ ID NO: 1158164 - DNA, 15 bp, Homo sapiens
tagagctccagttct

SEQ ID NO: 1158165 - DNA, 18 bp, Homo sapiens
tagagctgatccagagca

SEQ ID NO: 1158166 - DNA, 20 bp, Homo sapiens
tagagctttttaatagcact

SEQ ID NO: 1158167 - DNA, 12 bp, Homo sapiens
tagaggaaaagg

SEQ ID NO: 1158168 - DNA, 20 bp, Homo sapiens
tagaggaaataagaaaaatc

SEQ ID NO: 1158169 - DNA, 23 bp, Homo sapiens
tagaggcattacttgctttcaat

SEQ ID NO: 1158170 - DNA, 13 bp, Homo sapiens
tagaggccaggga

SEQ ID NO: 1158171 - DNA, 16 bp, Homo sapiens
tagaggccagggcagc

SEQ ID NO: 1158172 - DNA, 12 bp, Homo sapiens
tagaggcctgag

SEQ ID NO: 1158173 - DNA, 15 bp, Homo sapiens
tagaggcctgaggat

SEQ ID NO: 1158174 - DNA, 17 bp, Homo sapiens
tagaggctttcaaatgt

SEQ ID NO: 1158175 - DNA, 18 bp, Homo sapiens
tagaggctttcaaatgta

SEQ ID NO: 1158176 - DNA, 17 bp, Homo sapiens
tagagggaacagggcgg

SEQ ID NO: 1158177 - DNA, 23 bp, Homo sapiens
tagagggaggagaatgagcctcg

SEQ ID NO: 1158178 - DNA, 19 bp, Homo sapiens
tagagggccttgcttctct

SEQ ID NO: 1158179 - DNA, 20 bp, Homo sapiens
tagagggccttgcttctctt

SEQ ID NO: 1158180 - DNA, 22 bp, Homo sapiens
tagaggggaaggaaatctcctc

SEQ ID NO: 1158181 - DNA, 18 bp, Homo sapiens
tagagggttgctgccttt

SEQ ID NO: 1158182 - DNA, 17 bp, Homo sapiens
tagaggtcctctggagc

SEQ ID NO: 1158183 - DNA, 16 bp, Homo sapiens
tagaggtgagaaattt

SEQ ID NO: 1158184 - DNA, 14 bp, Homo sapiens
tagaggtgggcagc

SEQ ID NO: 1158185 - DNA, 14 bp, Homo sapiens
tagaggttcaaaga

SEQ ID NO: 1158186 - DNA, 19 bp, Homo sapiens
tagaggttcaaagatattt

SEQ ID NO: 1158187 - DNA, 21 bp, Homo sapiens
tagaggttcaaagatattttg

SEQ ID NO: 1158188 - DNA, 23 bp, Homo sapiens
tagaggttctgggttttctgaaa

SEQ ID NO: 1158189 - DNA, 21 bp, Homo sapiens
tagaggttgcagcatgagact

SEQ ID NO: 1158190 - DNA, 15 bp, Homo sapiens
tagaggttttaaagt

SEQ ID NO: 1158191 - DNA, 19 bp, Homo sapiens
tagaggttttaaagtgatt

SEQ ID NO: 1158192 - DNA, 15 bp, Homo sapiens
tagaggttttgtatt

SEQ ID NO: 1158193 - DNA, 16 bp, Homo sapiens
tagaggttttgtattg

SEQ ID NO: 1158194 - DNA, 16 bp, Homo sapiens
tagaggttttgttgtt

SEQ ID NO: 1158195 - DNA, 15 bp, Homo sapiens
tagagtaatgaaatg

SEQ ID NO: 1158196 - DNA, 16 bp, Homo sapiens
tagagtaatgatgtaa

SEQ ID NO: 1158197 - DNA, 15 bp, Homo sapiens
tagagtatttccctt

SEQ ID NO: 1158198 - DNA, 17 bp, Homo sapiens
tagagtatttcccttcc

SEQ ID NO: 1158199 - DNA, 21 bp, Homo sapiens
tagagtcaatttgctgaaaac

SEQ ID NO: 1158200 - DNA, 14 bp, Homo sapiens
tagagtcagccttc

SEQ ID NO: 1158201 - DNA, 21 bp, Homo sapiens
tagagtcatctccatcagctg

SEQ ID NO: 1158202 - DNA, 13 bp, Homo sapiens
tagagtcatgtga

SEQ ID NO: 1158203 - DNA, 12 bp, Homo sapiens
tagagtcattca

SEQ ID NO: 1158204 - DNA, 16 bp, Homo sapiens
tagagtcattcatatt

SEQ ID NO: 1158205 - DNA, 20 bp, Homo sapiens
tagagtcttaaagcatttca

SEQ ID NO: 1158206 - DNA, 13 bp, Homo sapiens
tagagtgcccagc

SEQ ID NO: 1158207 - DNA, 15 bp, Homo sapiens
tagagtgcccagcag

SEQ ID NO: 1158208 - DNA, 18 bp, Homo sapiens
tagagtggttattcatta

SEQ ID NO: 1158209 - DNA, 23 bp, Homo sapiens
tagagtggttattcattattcct

SEQ ID NO: 1158210 - DNA, 21 bp, Homo sapiens
tagagtgtagcctaaagggca

SEQ ID NO: 1158211 - DNA, 22 bp, Homo sapiens
tagagtgtagcctaaagggcag

SEQ ID NO: 1158212 - DNA, 20 bp, Homo sapiens
tagagtgtagctgtaagggc

SEQ ID NO: 1158213 - DNA, 15 bp, Homo sapiens
tagagtgtctttcca

SEQ ID NO: 1158214 - DNA, 23 bp, Homo sapiens
tagagttcggtctgacagtcctt

SEQ ID NO: 1158215 - DNA, 13 bp, Homo sapiens
tagagttgctgag

SEQ ID NO: 1158216 - DNA, 13 bp, Homo sapiens
tagagtttacagt

SEQ ID NO: 1158217 - DNA, 19 bp, Homo sapiens
tagataaatatttgacttg

SEQ ID NO: 1158218 - DNA, 13 bp, Homo sapiens
tagatacaataaa

SEQ ID NO: 1158219 - DNA, 14 bp, Homo sapiens
tagatacaataaat

SEQ ID NO: 1158220 - DNA, 16 bp, Homo sapiens
tagatacaataaattg

SEQ ID NO: 1158221 - DNA, 22 bp, Homo sapiens
tagataccctacgctgtccaga

SEQ ID NO: 1158222 - DNA, 20 bp, Homo sapiens
tagatactttgctagccggc

SEQ ID NO: 1158223 - DNA, 11 bp, Homo sapiens
tagatagaaat

SEQ ID NO: 1158224 - DNA, 16 bp, Homo sapiens
tagatagaagaatttt

SEQ ID NO: 1158225 - DNA, 17 bp, Homo sapiens
tagatagccctgtcctg

SEQ ID NO: 1158226 - DNA, 19 bp, Homo sapiens
tagatagccctgtcctggt

SEQ ID NO: 1158227 - DNA, 20 bp, Homo sapiens
tagataggaagaaagaagac

SEQ ID NO: 1158228 - DNA, 16 bp, Homo sapiens
tagataggtaaatacc

SEQ ID NO: 1158229 - DNA, 23 bp, Homo sapiens
tagatataatgaacaaaattatt

SEQ ID NO: 1158230 - DNA, 19 bp, Homo sapiens
tagatatatgctctgcatg

SEQ ID NO: 1158231 - DNA, 16 bp, Homo sapiens
tagatatcctctcccc

SEQ ID NO: 1158232 - DNA, 23 bp, Homo sapiens
tagatatcgacttgtttttgcac

SEQ ID NO: 1158233 - DNA, 14 bp, Homo sapiens
tagatattaaaatt

SEQ ID NO: 1158234 - DNA, 22 bp, Homo sapiens
tagatattattttagcttcagt

SEQ ID NO: 1158235 - DNA, 13 bp, Homo sapiens
tagatattgtttt

SEQ ID NO: 1158236 - DNA, 18 bp, Homo sapiens
tagatattgttttctgta

SEQ ID NO: 1158237 - DNA, 16 bp, Homo sapiens
ttctgtttgtaaatta

SEQ ID NO: 1158238 - DNA, 22 bp, Homo sapiens
ttctgttttcgtaccttcccac

SEQ ID NO: 1158239 - DNA, 23 bp, Homo sapiens
ttctgttttcgtaccttcccact

SEQ ID NO: 1158240 - DNA, 14 bp, Homo sapiens
ttctgttttctgtt

SEQ ID NO: 1158241 - DNA, 14 bp, Homo sapiens
ttcttaaaaactgt

SEQ ID NO: 1158242 - DNA, 15 bp, Homo sapiens
ttcttaaaaactgtg

SEQ ID NO: 1158243 - DNA, 11 bp, Homo sapiens
ttcttaaaagt

SEQ ID NO: 1158244 - DNA, 14 bp, Homo sapiens
ttcttaaaagtact

SEQ ID NO: 1158245 - DNA, 15 bp, Homo sapiens
ttcttaaaagtactt

SEQ ID NO: 1158246 - DNA, 18 bp, Homo sapiens
ttcttaaaagtactttaa

SEQ ID NO: 1158247 - DNA, 21 bp, Homo sapiens
ttcttaaaatatatttcagat

SEQ ID NO: 1158248 - DNA, 13 bp, Homo sapiens
ttcttaaagagtt

SEQ ID NO: 1158249 - DNA, 19 bp, Homo sapiens
ttcttaaaggcctggaacc

SEQ ID NO: 1158250 - DNA, 18 bp, Homo sapiens
ttcttaaataagaaactt

SEQ ID NO: 1158251 - DNA, 16 bp, Homo sapiens
ttcttaaataatgctt

SEQ ID NO: 1158252 - DNA, 11 bp, Homo sapiens
ttcttaaatat

SEQ ID NO: 1158253 - DNA, 13 bp, Homo sapiens
ttcttaaatggaa

SEQ ID NO: 1158254 - DNA, 21 bp, Homo sapiens
ttcttaaatgggctactttgt

SEQ ID NO: 1158255 - DNA, 12 bp, Homo sapiens
ttcttaaattat

SEQ ID NO: 1158256 - DNA, 13 bp, Homo sapiens
ttcttaacaaccg

SEQ ID NO: 1158257 - DNA, 19 bp, Homo sapiens
ttcttaacacagccttcct

SEQ ID NO: 1158258 - DNA, 13 bp, Homo sapiens
ttcttaacctttg

SEQ ID NO: 1158259 - DNA, 17 bp, Homo sapiens
ttcttaacttcttgctt

SEQ ID NO: 1158260 - DNA, 18 bp, Homo sapiens
ttcttaattattataaaa

SEQ ID NO: 1158261 - DNA, 22 bp, Homo sapiens
ttcttaattattataaaaatat

SEQ ID NO: 1158262 - DNA, 20 bp, Homo sapiens
ttcttaattttagggacagc

SEQ ID NO: 1158263 - DNA, 11 bp, Homo sapiens
ttcttacaaaa

SEQ ID NO: 1158264 - DNA, 20 bp, Homo sapiens
ttcttacaagcttaaagctt

SEQ ID NO: 1158265 - DNA, 13 bp, Homo sapiens
ttcttacataatt

SEQ ID NO: 1158266 - DNA, 14 bp, Homo sapiens
ttcttacatgcatt

SEQ ID NO: 1158267 - DNA, 16 bp, Homo sapiens
ttcttacatgcatttg

SEQ ID NO: 1158268 - DNA, 14 bp, Homo sapiens
ttcttacatgtttt

SEQ ID NO: 1158269 - DNA, 16 bp, Homo sapiens
ttcttacccaaagcac

SEQ ID NO: 1158270 - DNA, 17 bp, Homo sapiens
ttcttacccaaagcaca

SEQ ID NO: 1158271 - DNA, 18 bp, Homo sapiens
ttcttactaaaaagtata

SEQ ID NO: 1158272 - DNA, 12 bp, Homo sapiens
ttcttactcctc

SEQ ID NO: 1158273 - DNA, 15 bp, Homo sapiens
ttcttactcctcctc

SEQ ID NO: 1158274 - DNA, 19 bp, Homo sapiens
ttcttactcctcctctttc

SEQ ID NO: 1158275 - DNA, 16 bp, Homo sapiens
ttcttagaaaattaaa

SEQ ID NO: 1158276 - DNA, 24 bp, Homo sapiens
ttcttagaaaattaaaataggcat

SEQ ID NO: 1158277 - DNA, 20 bp, Homo sapiens
ttcttagaacagtggaaact

SEQ ID NO: 1158278 - DNA, 22 bp, Homo sapiens
ttcttagagtgtagctgtaagg

SEQ ID NO: 1158279 - DNA, 23 bp, Homo sapiens
ttcttagctcttaattgttcatt

SEQ ID NO: 1158280 - DNA, 17 bp, Homo sapiens
ttcttagctttgaaact

SEQ ID NO: 1158281 - DNA, 20 bp, Homo sapiens
ttcttaggagcaagaagaaa

SEQ ID NO: 1158282 - DNA, 22 bp, Homo sapiens
ttcttaggagcaagaagaaaat

SEQ ID NO: 1158283 - DNA, 23 bp, Homo sapiens
ttcttaggagcaagaagaaaatg

SEQ ID NO: 1158284 - DNA, 13 bp, Homo sapiens
ttcttagtgactt

SEQ ID NO: 1158285 - DNA, 22 bp, Homo sapiens
ttcttagttcatatatcaagaa

SEQ ID NO: 1158286 - DNA, 14 bp, Homo sapiens
ttcttagttgctgt

SEQ ID NO: 1158287 - DNA, 15 bp, Homo sapiens
ttcttagttgctgta

SEQ ID NO: 1158288 - DNA, 23 bp, Homo sapiens
ttcttagttgctgtatgtctcgt

SEQ ID NO: 1158289 - DNA, 19 bp, Homo sapiens
ttcttataccttctgacag

SEQ ID NO: 1158290 - DNA, 16 bp, Homo sapiens
ttcttatacgcttttc

SEQ ID NO: 1158291 - DNA, 23 bp, Homo sapiens
ttcttatcacataagagagatga

SEQ ID NO: 1158292 - DNA, 21 bp, Homo sapiens
ttcttattaattcttcacctg

SEQ ID NO: 1158293 - DNA, 22 bp, Homo sapiens
ttcttattaattcttcacctgt

SEQ ID NO: 1158294 - DNA, 17 bp, Homo sapiens
ttcttattactattatt

SEQ ID NO: 1158295 - DNA, 19 bp, Homo sapiens
ttcttattctcactccacc

SEQ ID NO: 1158296 - DNA, 18 bp, Homo sapiens
ttcttatttaatcttttc

SEQ ID NO: 1158297 - DNA, 12 bp, Homo sapiens
ttcttattttag

SEQ ID NO: 1158298 - DNA, 19 bp, Homo sapiens
ttcttattttagattgcta

SEQ ID NO: 1158299 - DNA, 13 bp, Homo sapiens
ttcttcaaatctc

SEQ ID NO: 1158300 - DNA, 22 bp, Homo sapiens
ttcttcaacatcaatgttcatt

SEQ ID NO: 1158301 - DNA, 21 bp, Homo sapiens
ttcttcaacatgctccaaata

SEQ ID NO: 1158302 - DNA, 14 bp, Homo sapiens
ttcttcaactccct

SEQ ID NO: 1158303 - DNA, 12 bp, Homo sapiens
ttcttcaagagg

SEQ ID NO: 1158304 - DNA, 18 bp, Homo sapiens
ttcttcacacagacacta

SEQ ID NO: 1158305 - DNA, 18 bp, Homo sapiens
ttcttcactcaaattttg

SEQ ID NO: 1158306 - DNA, 16 bp, Homo sapiens
ttcttcagagatcaag

SEQ ID NO: 1158307 - DNA, 18 bp, Homo sapiens
ttcttcagagtttgtcat

SEQ ID NO: 1158308 - DNA, 17 bp, Homo sapiens
ttcttcagatcagtgct

SEQ ID NO: 1158309 - DNA, 18 bp, Homo sapiens
ttcttcagggccagtcct

SEQ ID NO: 1158310 - DNA, 19 bp, Homo sapiens
ttcttcaggtaacactaca

SEQ ID NO: 1158311 - DNA, 20 bp, Homo sapiens
ttcttcaggtcgtagcattt

SEQ ID NO: 1158312 - DNA, 18 bp, Homo sapiens
ttcttcagtgtctctgtt

SEQ ID NO: 1158313 - DNA, 20 bp, Homo sapiens
ttcttcatattctaaaacca

SEQ ID NO: 1158314 - DNA, 21 bp, Homo sapiens
ttcttcatccaacttccaaga

SEQ ID NO: 1158315 - DNA, 20 bp, Homo sapiens
ttcttcatctttgccatatg

SEQ ID NO: 1158316 - DNA, 17 bp, Homo sapiens
ttcttcatgcaatgaca

SEQ ID NO: 1158317 - DNA, 18 bp, Homo sapiens
ttcttcatgcaatgacat

SEQ ID NO: 1158318 - DNA, 20 bp, Homo sapiens
ttcttcattcaatacaagtg

SEQ ID NO: 1158319 - DNA, 21 bp, Homo sapiens
ttcttcattcaatacaagtgt

SEQ ID NO: 1158320 - DNA, 23 bp, Homo sapiens
ttcttccaaatgcagttcattgc

SEQ ID NO: 1158321 - DNA, 22 bp, Homo sapiens
ttcttccacctcagcctcccag

SEQ ID NO: 1158322 - DNA, 14 bp, Homo sapiens
ttcttccactgtgt

SEQ ID NO: 1158323 - DNA, 15 bp, Homo sapiens
ttcttccagaatgct

SEQ ID NO: 1158324 - DNA, 21 bp, Homo sapiens
ttcttccatcatcactgtaaa

SEQ ID NO: 1158325 - DNA, 20 bp, Homo sapiens
ttcttccccaggtccttcct

SEQ ID NO: 1158326 - DNA, 17 bp, Homo sapiens
ttcttcccgccccacct

SEQ ID NO: 1158327 - DNA, 18 bp, Homo sapiens
ttcttcccgccccacctc

SEQ ID NO: 1158328 - DNA, 13 bp, Homo sapiens
ttcttcccttttc

SEQ ID NO: 1158329 - DNA, 14 bp, Homo sapiens
ttcttcccttttcc

SEQ ID NO: 1158330 - DNA, 18 bp, Homo sapiens
ttcttcctaccaagtcaa

SEQ ID NO: 1158331 - DNA, 13 bp, Homo sapiens
ttcttcctcccct

SEQ ID NO: 1158332 - DNA, 15 bp, Homo sapiens
ttcttcctcccctca

SEQ ID NO: 1158333 - DNA, 14 bp, Homo sapiens
ttcttcctcctctg

SEQ ID NO: 1158334 - DNA, 19 bp, Homo sapiens
ttcttcctctccttcccac

SEQ ID NO: 1158335 - DNA, 20 bp, Homo sapiens
ttcttcctctcggctggaag

SEQ ID NO: 1158336 - DNA, 14 bp, Homo sapiens
ttcttcctctgcat

SEQ ID NO: 1158337 - DNA, 13 bp, Homo sapiens
ttcttcctctgct

SEQ ID NO: 1158338 - DNA, 9 bp, Homo sapiens
ttcttcctt

SEQ ID NO: 1158339 - DNA, 11 bp, Homo sapiens
ttcttccttcc

SEQ ID NO: 1158340 - DNA, 12 bp, Homo sapiens
ttcttccttcca

SEQ ID NO: 1158341 - DNA, 13 bp, Homo sapiens
ttcttccttccta

SEQ ID NO: 1158342 - DNA, 13 bp, Homo sapiens
ttcttcctttccc

SEQ ID NO: 1158343 - DNA, 19 bp, Homo sapiens
ttcttcctttccctggagc

SEQ ID NO: 1158344 - DNA, 13 bp, Homo sapiens
ttcttcctttctc

SEQ ID NO: 1158345 - DNA, 18 bp, Homo sapiens
ttcttcgctgctagagaa

SEQ ID NO: 1158346 - DNA, 23 bp, Homo sapiens
ttcttctaaagcactggtttcaa

SEQ ID NO: 1158347 - DNA, 16 bp, Homo sapiens
ttcttctaagaagaca

SEQ ID NO: 1158348 - DNA, 19 bp, Homo sapiens
ttcttctagctgagcttta

SEQ ID NO: 1158349 - DNA, 20 bp, Homo sapiens
ttcttctaggggtagctggt

SEQ ID NO: 1158350 - DNA, 20 bp, Homo sapiens
ttcttctattaatcaagaga

SEQ ID NO: 1158351 - DNA, 14 bp, Homo sapiens
ttcttctctctgtt

SEQ ID NO: 1158352 - DNA, 20 bp, Homo sapiens
ttcttctgaactcaaactga

SEQ ID NO: 1158353 - DNA, 23 bp, Homo sapiens
ttcttctgaactcaaactgagga

SEQ ID NO: 1158354 - DNA, 16 bp, Homo sapiens
ttcttctgccacttct

SEQ ID NO: 1158355 - DNA, 19 bp, Homo sapiens
ttcttctgcccctctactg

SEQ ID NO: 1158356 - DNA, 12 bp, Homo sapiens
ttcttctggctt

SEQ ID NO: 1158357 - DNA, 13 bp, Homo sapiens
ttcttctgtaata

SEQ ID NO: 1158358 - DNA, 23 bp, Homo sapiens
ttcttctgtaatatttacaatgt

SEQ ID NO: 1158359 - DNA, 15 bp, Homo sapiens
ttcttcttacacttc

SEQ ID NO: 1158360 - DNA, 15 bp, Homo sapiens
ttcttcttcagaaga

SEQ ID NO: 1158361 - DNA, 13 bp, Homo sapiens
ttcttcttccctc

SEQ ID NO: 1158362 - DNA, 16 bp, Homo sapiens
tagatcacatcttaaa

SEQ ID NO: 1158363 - DNA, 16 bp, Homo sapiens
tagatcacgagatcaa

SEQ ID NO: 1158364 - DNA, 17 bp, Homo sapiens
tagatcacgagatcaag

SEQ ID NO: 1158365 - DNA, 12 bp, Homo sapiens
tagatcaggttt

SEQ ID NO: 1158366 - DNA, 13 bp, Homo sapiens
tagatcaggtttg

SEQ ID NO: 1158367 - DNA, 17 bp, Homo sapiens
tagatcatatttaaaga

SEQ ID NO: 1158368 - DNA, 16 bp, Homo sapiens
tagatccacacacaga

SEQ ID NO: 1158369 - DNA, 21 bp, Homo sapiens
tagatcccatgtcacctcagc

SEQ ID NO: 1158370 - DNA, 17 bp, Homo sapiens
tagatcctaagatgtgt

SEQ ID NO: 1158371 - DNA, 21 bp, Homo sapiens
tagatcctaagatgtgttctt

SEQ ID NO: 1158372 - DNA, 15 bp, Homo sapiens
tagatcctgagatga

SEQ ID NO: 1158373 - DNA, 22 bp, Homo sapiens
tagatcctgcaccccagcattc

SEQ ID NO: 1158374 - DNA, 13 bp, Homo sapiens
tagatcctttaaa

SEQ ID NO: 1158375 - DNA, 14 bp, Homo sapiens
tagatcctttaaaa

SEQ ID NO: 1158376 - DNA, 22 bp, Homo sapiens
tagatcttcaatttggatattt

SEQ ID NO: 1158377 - DNA, 16 bp, Homo sapiens
tagatcttctgaaatg

SEQ ID NO: 1158378 - DNA, 20 bp, Homo sapiens
tagatgaacttgagctctgt

SEQ ID NO: 1158379 - DNA, 13 bp, Homo sapiens
tagatgaccaaaa

SEQ ID NO: 1158380 - DNA, 17 bp, Homo sapiens
tagatgagggtgactgt

SEQ ID NO: 1158381 - DNA, 14 bp, Homo sapiens
tagatgattatata

SEQ ID NO: 1158382 - DNA, 18 bp, Homo sapiens
tagatgattttttgaaag

SEQ ID NO: 1158383 - DNA, 20 bp, Homo sapiens
tagatgcacgtggggcccac

SEQ ID NO: 1158384 - DNA, 18 bp, Homo sapiens
tagatgctgaatatctgt

SEQ ID NO: 1158385 - DNA, 14 bp, Homo sapiens
tagatgctgactgt

SEQ ID NO: 1158386 - DNA, 17 bp, Homo sapiens
tagatggaaaaacttgt

SEQ ID NO: 1158387 - DNA, 16 bp, Homo sapiens
tagatggaatttggaa

SEQ ID NO: 1158388 - DNA, 14 bp, Homo sapiens
tagatggctcctct

SEQ ID NO: 1158389 - DNA, 21 bp, Homo sapiens
tagatgggagggaggctcagg

SEQ ID NO: 1158390 - DNA, 18 bp, Homo sapiens
tagatgggggaactgtga

SEQ ID NO: 1158391 - DNA, 16 bp, Homo sapiens
tagatgggtctggctg

SEQ ID NO: 1158392 - DNA, 14 bp, Homo sapiens
tagatggtgaaatt

SEQ ID NO: 1158393 - DNA, 16 bp, Homo sapiens
tagatgtaattttgtg

SEQ ID NO: 1158394 - DNA, 20 bp, Homo sapiens
tagatgtagataaactcaga

SEQ ID NO: 1158395 - DNA, 15 bp, Homo sapiens
tagatgtagcattgt

SEQ ID NO: 1158396 - DNA, 22 bp, Homo sapiens
tagatgtagcattgttccacac

SEQ ID NO: 1158397 - DNA, 12 bp, Homo sapiens
tagatgtatata

SEQ ID NO: 1158398 - DNA, 15 bp, Homo sapiens
tagatgtatttttga

SEQ ID NO: 1158399 - DNA, 21 bp, Homo sapiens
tagatgtccctttcttggcca

SEQ ID NO: 1158400 - DNA, 12 bp, Homo sapiens
tagatgtgatta

SEQ ID NO: 1158401 - DNA, 16 bp, Homo sapiens
tagatgtgattaacat

SEQ ID NO: 1158402 - DNA, 16 bp, Homo sapiens
tagatgttgtcttggc

SEQ ID NO: 1158403 - DNA, 13 bp, Homo sapiens
tagatgtttcaca

SEQ ID NO: 1158404 - DNA, 20 bp, Homo sapiens
tagattaagattttacttta

SEQ ID NO: 1158405 - DNA, 21 bp, Homo sapiens
tagattaccccctcattgttt

SEQ ID NO: 1158406 - DNA, 16 bp, Homo sapiens
tagattactgatgtga

SEQ ID NO: 1158407 - DNA, 14 bp, Homo sapiens
tagattagctctgg

SEQ ID NO: 1158408 - DNA, 16 bp, Homo sapiens
tagattagctctggac

SEQ ID NO: 1158409 - DNA, 17 bp, Homo sapiens
tagattaggtagacttt

SEQ ID NO: 1158410 - DNA, 18 bp, Homo sapiens
tagattaggtagactttg

SEQ ID NO: 1158411 - DNA, 14 bp, Homo sapiens
tagattattataaa

SEQ ID NO: 1158412 - DNA, 13 bp, Homo sapiens
tagattatttcat

SEQ ID NO: 1158413 - DNA, 14 bp, Homo sapiens
tagattatttcata

SEQ ID NO: 1158414 - DNA, 16 bp, Homo sapiens
tagattatttcatata

SEQ ID NO: 1158415 - DNA, 13 bp, Homo sapiens
tagattatttctg

SEQ ID NO: 1158416 - DNA, 20 bp, Homo sapiens
tagattcacctgtaaaactt

SEQ ID NO: 1158417 - DNA, 21 bp, Homo sapiens
tagattcacctgtaaaacttt

SEQ ID NO: 1158418 - DNA, 19 bp, Homo sapiens
tagattcaggggaagggca

SEQ ID NO: 1158419 - DNA, 13 bp, Homo sapiens
tagattgcaaagc

SEQ ID NO: 1158420 - DNA, 16 bp, Homo sapiens
tagattggttctgttt

SEQ ID NO: 1158421 - DNA, 15 bp, Homo sapiens
tagattgtcttaatg

SEQ ID NO: 1158422 - DNA, 15 bp, Homo sapiens
tagatttatttcatc

SEQ ID NO: 1158423 - DNA, 16 bp, Homo sapiens
tagatttattttacat

SEQ ID NO: 1158424 - DNA, 19 bp, Homo sapiens
tagatttcatagttcagaa

SEQ ID NO: 1158425 - DNA, 12 bp, Homo sapiens
tagatttctctt

SEQ ID NO: 1158426 - DNA, 13 bp, Homo sapiens
tagatttctcttg

SEQ ID NO: 1158427 - DNA, 17 bp, Homo sapiens
tagatttctcttgggca

SEQ ID NO: 1158428 - DNA, 13 bp, Homo sapiens
tagatttggaata

SEQ ID NO: 1158429 - DNA, 13 bp, Homo sapiens
tagatttgtcctt

SEQ ID NO: 1158430 - DNA, 15 bp, Homo sapiens
tagattttatagtgt

SEQ ID NO: 1158431 - DNA, 19 bp, Homo sapiens
tagattttatagtgtgttg

SEQ ID NO: 1158432 - DNA, 12 bp, Homo sapiens
tagattttccaa

SEQ ID NO: 1158433 - DNA, 16 bp, Homo sapiens
tagattttctctggaa

SEQ ID NO: 1158434 - DNA, 16 bp, Homo sapiens
tagatttttgattcag

SEQ ID NO: 1158435 - DNA, 18 bp, Homo sapiens
tagcaaaacaaattcaaa

SEQ ID NO: 1158436 - DNA, 17 bp, Homo sapiens
tagcaaaataaaacata

SEQ ID NO: 1158437 - DNA, 19 bp, Homo sapiens
tagcaaaataaaacatagc

SEQ ID NO: 1158438 - DNA, 16 bp, Homo sapiens
tagcaaaattcctgtg

SEQ ID NO: 1158439 - DNA, 12 bp, Homo sapiens
tagcaaaggaaa

SEQ ID NO: 1158440 - DNA, 16 bp, Homo sapiens
tagcaacaacaattgg

SEQ ID NO: 1158441 - DNA, 18 bp, Homo sapiens
tagcaacatatctctgcc

SEQ ID NO: 1158442 - DNA, 15 bp, Homo sapiens
tagcaactaatgttt

SEQ ID NO: 1158443 - DNA, 21 bp, Homo sapiens
tagcaactacagtctaaagct

SEQ ID NO: 1158444 - DNA, 12 bp, Homo sapiens
tagcaagacaca

SEQ ID NO: 1158445 - DNA, 23 bp, Homo sapiens
tagcaagacctgaaaatatgtct

SEQ ID NO: 1158446 - DNA, 21 bp, Homo sapiens
tagcaagagagcagcgcccag

SEQ ID NO: 1158447 - DNA, 22 bp, Homo sapiens
tagcaagtgaatttttctctaa

SEQ ID NO: 1158448 - DNA, 17 bp, Homo sapiens
tagcaatcacaacactg

SEQ ID NO: 1158449 - DNA, 21 bp, Homo sapiens
tagcaatccatgttagttttt

SEQ ID NO: 1158450 - DNA, 17 bp, Homo sapiens
tagcaatgtgccttgat

SEQ ID NO: 1158451 - DNA, 14 bp, Homo sapiens
tagcaattagtgat

SEQ ID NO: 1158452 - DNA, 14 bp, Homo sapiens
tagcacaatcctat

SEQ ID NO: 1158453 - DNA, 14 bp, Homo sapiens
tagcacaatttgag

SEQ ID NO: 1158454 - DNA, 23 bp, Homo sapiens
tagcacacctgaatcagctggac

SEQ ID NO: 1158455 - DNA, 16 bp, Homo sapiens
tagcacagattttgaa

SEQ ID NO: 1158456 - DNA, 22 bp, Homo sapiens
tagcacagattttgaatctgtg

SEQ ID NO: 1158457 - DNA, 22 bp, Homo sapiens
tagcacaggttagggtgtgtgc

SEQ ID NO: 1158458 - DNA, 18 bp, Homo sapiens
tagcacataaactttggg

SEQ ID NO: 1158459 - DNA, 20 bp, Homo sapiens
tagcacatgtctgtcctcag

SEQ ID NO: 1158460 - DNA, 23 bp, Homo sapiens
tagcacatgtctgtcctcagagc

SEQ ID NO: 1158461 - DNA, 13 bp, Homo sapiens
tagcacctccccc

SEQ ID NO: 1158462 - DNA, 17 bp, Homo sapiens
tagcaccttcagggctg

SEQ ID NO: 1158463 - DNA, 19 bp, Homo sapiens
tagcactcctcaagacttt

SEQ ID NO: 1158464 - DNA, 19 bp, Homo sapiens
tagcactgatagtcctttt

SEQ ID NO: 1158465 - DNA, 20 bp, Homo sapiens
tagcactgttgatgtatctg

SEQ ID NO: 1158466 - DNA, 19 bp, Homo sapiens
tagcactttgggaggctga

SEQ ID NO: 1158467 - DNA, 19 bp, Homo sapiens
tagcagaatggagaaagta

SEQ ID NO: 1158468 - DNA, 11 bp, Homo sapiens
tagcagacagg

SEQ ID NO: 1158469 - DNA, 19 bp, Homo sapiens
tagcagacaggccccgtga

SEQ ID NO: 1158470 - DNA, 15 bp, Homo sapiens
tagcagacagtgttt

SEQ ID NO: 1158471 - DNA, 21 bp, Homo sapiens
tagcagacccagcttagagtt

SEQ ID NO: 1158472 - DNA, 11 bp, Homo sapiens
tagcagagcct

SEQ ID NO: 1158473 - DNA, 12 bp, Homo sapiens
tagcagagccta

SEQ ID NO: 1158474 - DNA, 13 bp, Homo sapiens
tagcagagcctat

SEQ ID NO: 1158475 - DNA, 22 bp, Homo sapiens
tagcagaggggtaagagaggat

SEQ ID NO: 1158476 - DNA, 21 bp, Homo sapiens
tagcagatggtttccacattt

SEQ ID NO: 1158477 - DNA, 19 bp, Homo sapiens
tagcagcaccgttctgtgc

SEQ ID NO: 1158478 - DNA, 14 bp, Homo sapiens
tagcagcacctcct

SEQ ID NO: 1158479 - DNA, 20 bp, Homo sapiens
tagcagcagcctttaatgca

SEQ ID NO: 1158480 - DNA, 12 bp, Homo sapiens
tagcagcctttc

SEQ ID NO: 1158481 - DNA, 13 bp, Homo sapiens
tagcagcctttct

SEQ ID NO: 1158482 - DNA, 11 bp, Homo sapiens
tagcagctggc

SEQ ID NO: 1158483 - DNA, 15 bp, Homo sapiens
tagcaggctgttcca

SEQ ID NO: 1158484 - DNA, 17 bp, Homo sapiens
tagcaggctgttccatg

SEQ ID NO: 1158485 - DNA, 16 bp, Homo sapiens
tagcagggatgttcct

SEQ ID NO: 1158486 - DNA, 16 bp, Homo sapiens
tagcagggattctctc

SEQ ID NO: 1158487 - DNA, 18 bp, Homo sapiens
tagcaggggcaccttccg

SEQ ID NO: 1158488 - DNA, 13 bp, Homo sapiens
ttcttcttcctga

SEQ ID NO: 1158489 - DNA, 14 bp, Homo sapiens
ttcttcttcctgaa

SEQ ID NO: 1158490 - DNA, 14 bp, Homo sapiens
ttcttcttctaaga

SEQ ID NO: 1158491 - DNA, 16 bp, Homo sapiens
ttcttcttgaggggaa

SEQ ID NO: 1158492 - DNA, 12 bp, Homo sapiens
ttcttctttccc

SEQ ID NO: 1158493 - DNA, 12 bp, Homo sapiens
ttcttcttttcc

SEQ ID NO: 1158494 - DNA, 21 bp, Homo sapiens
ttcttctttttgcttcaaaaa

SEQ ID NO: 1158495 - DNA, 13 bp, Homo sapiens
ttcttgaaaaaga

SEQ ID NO: 1158496 - DNA, 23 bp, Homo sapiens
ttcttgaagctgggctgtctctc

SEQ ID NO: 1158497 - DNA, 17 bp, Homo sapiens
ttcttgaagttcatggt

SEQ ID NO: 1158498 - DNA, 17 bp, Homo sapiens
ttcttgaatataaaaaa

SEQ ID NO: 1158499 - DNA, 15 bp, Homo sapiens
ttcttgaattgttat

SEQ ID NO: 1158500 - DNA, 16 bp, Homo sapiens
ttcttgaattgttatg

SEQ ID NO: 1158501 - DNA, 20 bp, Homo sapiens
ttcttgaattgttatgaaaa

SEQ ID NO: 1158502 - DNA, 23 bp, Homo sapiens
ttcttgaggggaagctagtcttt

SEQ ID NO: 1158503 - DNA, 13 bp, Homo sapiens
ttcttgatcttaa

SEQ ID NO: 1158504 - DNA, 18 bp, Homo sapiens
ttcttgatcttaaagatc

SEQ ID NO: 1158505 - DNA, 15 bp, Homo sapiens
ttcttgatgtcatgt

SEQ ID NO: 1158506 - DNA, 16 bp, Homo sapiens
ttcttgatgttgctta

SEQ ID NO: 1158507 - DNA, 23 bp, Homo sapiens
ttcttgcataggctcttaagcag

SEQ ID NO: 1158508 - DNA, 16 bp, Homo sapiens
ttcttgcatctaatga

SEQ ID NO: 1158509 - DNA, 15 bp, Homo sapiens
ttcttgcctctgtgc

SEQ ID NO: 1158510 - DNA, 15 bp, Homo sapiens
ttcttgctgccctgc

SEQ ID NO: 1158511 - DNA, 20 bp, Homo sapiens
ttcttgctggctctgagaat

SEQ ID NO: 1158512 - DNA, 20 bp, Homo sapiens
ttcttgctgttcagtgcttt

SEQ ID NO: 1158513 - DNA, 19 bp, Homo sapiens
ttcttgcttctttctagaa

SEQ ID NO: 1158514 - DNA, 22 bp, Homo sapiens
ttcttggaccagtttgcagagt

SEQ ID NO: 1158515 - DNA, 20 bp, Homo sapiens
ttcttggagctttggaatat

SEQ ID NO: 1158516 - DNA, 14 bp, Homo sapiens
ttcttggcaaattt

SEQ ID NO: 1158517 - DNA, 19 bp, Homo sapiens
ttcttgggatagtgttctg

SEQ ID NO: 1158518 - DNA, 14 bp, Homo sapiens
ttcttgggccctcc

SEQ ID NO: 1158519 - DNA, 12 bp, Homo sapiens
ttcttggggaga

SEQ ID NO: 1158520 - DNA, 22 bp, Homo sapiens
ttcttgggggaggccaccccaa

SEQ ID NO: 1158521 - DNA, 23 bp, Homo sapiens
ttcttggggtactcttgatgtga

SEQ ID NO: 1158522 - DNA, 19 bp, Homo sapiens
ttcttggggtcccagggaa

SEQ ID NO: 1158523 - DNA, 15 bp, Homo sapiens
ttcttggtagagatt

SEQ ID NO: 1158524 - DNA, 18 bp, Homo sapiens
ttcttggtgactgtccca

SEQ ID NO: 1158525 - DNA, 14 bp, Homo sapiens
ttcttggtgctctg

SEQ ID NO: 1158526 - DNA, 17 bp, Homo sapiens
ttcttggtgctctgtgt

SEQ ID NO: 1158527 - DNA, 14 bp, Homo sapiens
ttcttggttcctgg

SEQ ID NO: 1158528 - DNA, 22 bp, Homo sapiens
ttcttggttgaggaaacaaaca

SEQ ID NO: 1158529 - DNA, 16 bp, Homo sapiens
ttcttggtttcagcca

SEQ ID NO: 1158530 - DNA, 14 bp, Homo sapiens
ttcttggtttctgg

SEQ ID NO: 1158531 - DNA, 13 bp, Homo sapiens
ttcttggtttgta

SEQ ID NO: 1158532 - DNA, 23 bp, Homo sapiens
ttcttggtttgtaaattaacttt

SEQ ID NO: 1158533 - DNA, 19 bp, Homo sapiens
ttcttggttttctctctgg

SEQ ID NO: 1158534 - DNA, 20 bp, Homo sapiens
ttcttgtaaatctttttgct

SEQ ID NO: 1158535 - DNA, 13 bp, Homo sapiens
ttcttgtaaatgt

SEQ ID NO: 1158536 - DNA, 14 bp, Homo sapiens
ttcttgtaaatgtt

SEQ ID NO: 1158537 - DNA, 16 bp, Homo sapiens
ttcttgtaaatgtttc

SEQ ID NO: 1158538 - DNA, 13 bp, Homo sapiens
ttcttgtaatttt

SEQ ID NO: 1158539 - DNA, 23 bp, Homo sapiens
ttcttgtagccatggctgggcgt

SEQ ID NO: 1158540 - DNA, 13 bp, Homo sapiens
ttcttgtagtagt

SEQ ID NO: 1158541 - DNA, 12 bp, Homo sapiens
ttcttgtatctg

SEQ ID NO: 1158542 - DNA, 22 bp, Homo sapiens
ttcttgtatctggattcaaatt

SEQ ID NO: 1158543 - DNA, 12 bp, Homo sapiens
ttcttgtattta

SEQ ID NO: 1158544 - DNA, 14 bp, Homo sapiens
ttcttgtcacaaat

SEQ ID NO: 1158545 - DNA, 18 bp, Homo sapiens
ttcttgtcgtttgtgaac

SEQ ID NO: 1158546 - DNA, 17 bp, Homo sapiens
ttcttgtctataaagca

SEQ ID NO: 1158547 - DNA, 18 bp, Homo sapiens
ttcttgtctataaagcat

SEQ ID NO: 1158548 - DNA, 21 bp, Homo sapiens
ttcttgtctataaagcattta

SEQ ID NO: 1158549 - DNA, 19 bp, Homo sapiens
ttcttgtctgattggctca

SEQ ID NO: 1158550 - DNA, 15 bp, Homo sapiens
ttcttgtctttcctc

SEQ ID NO: 1158551 - DNA, 18 bp, Homo sapiens
ttcttgtgggagacagca

SEQ ID NO: 1158552 - DNA, 20 bp, Homo sapiens
ttcttgtgtagatttgaaaa

SEQ ID NO: 1158553 - DNA, 17 bp, Homo sapiens
ttcttgtgtcctgatga

SEQ ID NO: 1158554 - DNA, 14 bp, Homo sapiens
ttcttgttggtgca

SEQ ID NO: 1158555 - DNA, 12 bp, Homo sapiens
ttcttgtttaac

SEQ ID NO: 1158556 - DNA, 14 bp, Homo sapiens
ttcttgtttccttg

SEQ ID NO: 1158557 - DNA, 13 bp, Homo sapiens
ttcttgtttctcc

SEQ ID NO: 1158558 - DNA, 17 bp, Homo sapiens
ttctttaaaagaatgac

SEQ ID NO: 1158559 - DNA, 14 bp, Homo sapiens
ttctttaaagaagt

SEQ ID NO: 1158560 - DNA, 14 bp, Homo sapiens
ttctttaatatgat

SEQ ID NO: 1158561 - DNA, 16 bp, Homo sapiens
ttctttaatatgattc

SEQ ID NO: 1158562 - DNA, 12 bp, Homo sapiens
ttctttaatgct

SEQ ID NO: 1158563 - DNA, 20 bp, Homo sapiens
ttctttacctgagaccagtt

SEQ ID NO: 1158564 - DNA, 16 bp, Homo sapiens
ttctttactaaagata

SEQ ID NO: 1158565 - DNA, 17 bp, Homo sapiens
ttctttactcgtcccct

SEQ ID NO: 1158566 - DNA, 19 bp, Homo sapiens
ttctttacttctcacttca

SEQ ID NO: 1158567 - DNA, 23 bp, Homo sapiens
ttctttagaggctttcaaatgta

SEQ ID NO: 1158568 - DNA, 20 bp, Homo sapiens
ttctttagcatttttatgca

SEQ ID NO: 1158569 - DNA, 14 bp, Homo sapiens
ttctttaggagatt

SEQ ID NO: 1158570 - DNA, 15 bp, Homo sapiens
ttctttaggagattt

SEQ ID NO: 1158571 - DNA, 22 bp, Homo sapiens
ttctttaggagattttaggtgt

SEQ ID NO: 1158572 - DNA, 20 bp, Homo sapiens
ttctttagtagcaactaaaa

SEQ ID NO: 1158573 - DNA, 15 bp, Homo sapiens
ttctttataaaatgt

SEQ ID NO: 1158574 - DNA, 14 bp, Homo sapiens
ttctttataaactt

SEQ ID NO: 1158575 - DNA, 18 bp, Homo sapiens
ttctttataattctactt

SEQ ID NO: 1158576 - DNA, 19 bp, Homo sapiens
ttctttatatctgaaccaa

SEQ ID NO: 1158577 - DNA, 17 bp, Homo sapiens
ttctttattagctttct

SEQ ID NO: 1158578 - DNA, 13 bp, Homo sapiens
ttctttattgcac

SEQ ID NO: 1158579 - DNA, 16 bp, Homo sapiens
ttctttattgcactag

SEQ ID NO: 1158580 - DNA, 19 bp, Homo sapiens
ttctttccaaaacatttct

SEQ ID NO: 1158581 - DNA, 17 bp, Homo sapiens
ttctttccattatgatt

SEQ ID NO: 1158582 - DNA, 13 bp, Homo sapiens
ttctttccccaga

SEQ ID NO: 1158583 - DNA, 21 bp, Homo sapiens
ttctttccctggacaggcagc

SEQ ID NO: 1158584 - DNA, 11 bp, Homo sapiens
ttctttcctcc

SEQ ID NO: 1158585 - DNA, 19 bp, Homo sapiens
ttctttcctccccctgcaa

SEQ ID NO: 1158586 - DNA, 13 bp, Homo sapiens
ttctttcctgccc

SEQ ID NO: 1158587 - DNA, 15 bp, Homo sapiens
ttctttcctgccctg

SEQ ID NO: 1158588 - DNA, 13 bp, Homo sapiens
ttctttctagaaa

SEQ ID NO: 1158589 - DNA, 19 bp, Homo sapiens
ttctttctagttcagctgc

SEQ ID NO: 1158590 - DNA, 12 bp, Homo sapiens
ttctttctgaga

SEQ ID NO: 1158591 - DNA, 20 bp, Homo sapiens
ttctttgaaaaaaaataaat

SEQ ID NO: 1158592 - DNA, 16 bp, Homo sapiens
ttctttgatttgtacc

SEQ ID NO: 1158593 - DNA, 16 bp, Homo sapiens
ttctttgcaaagtatt

SEQ ID NO: 1158594 - DNA, 16 bp, Homo sapiens
ttctttgcaccaaaga

SEQ ID NO: 1158595 - DNA, 14 bp, Homo sapiens
ttctttgctgcccc

SEQ ID NO: 1158596 - DNA, 20 bp, Homo sapiens
ttctttggaaagtacactct

SEQ ID NO: 1158597 - DNA, 20 bp, Homo sapiens
ttctttggagttaaaatgca

SEQ ID NO: 1158598 - DNA, 17 bp, Homo sapiens
ttctttggcctacattc

SEQ ID NO: 1158599 - DNA, 20 bp, Homo sapiens
ttctttgggggtggaaaagg

SEQ ID NO: 1158600 - DNA, 22 bp, Homo sapiens
ttctttggtggagataaagatt

SEQ ID NO: 1158601 - DNA, 22 bp, Homo sapiens
ttctttggtttcccaagagcta

SEQ ID NO: 1158602 - DNA, 16 bp, Homo sapiens
ttctttgtactaatac

SEQ ID NO: 1158603 - DNA, 21 bp, Homo sapiens
ttctttgtagaataaatggtt

SEQ ID NO: 1158604 - DNA, 15 bp, Homo sapiens
ttctttgtttcctgg

SEQ ID NO: 1158605 - DNA, 13 bp, Homo sapiens
ttctttgtttctt

SEQ ID NO: 1158606 - DNA, 21 bp, Homo sapiens
ttcttttaaaggggcagaaaa

SEQ ID NO: 1158607 - DNA, 18 bp, Homo sapiens
ttcttttaaattagaaaa

SEQ ID NO: 1158608 - DNA, 14 bp, Homo sapiens
ttcttttaagaatc

SEQ ID NO: 1158609 - DNA, 19 bp, Homo sapiens
ttcttttactcatgatctt

SEQ ID NO: 1158610 - DNA, 15 bp, Homo sapiens
ttcttttattatcag

SEQ ID NO: 1158611 - DNA, 13 bp, Homo sapiens
ttcttttccccct

SEQ ID NO: 1158612 - DNA, 15 bp, Homo sapiens
ttcttttctattttt

SEQ ID NO: 1158613 - DNA, 12 bp, Homo sapiens
ttcttttctcat

SEQ ID NO: 1158614 - DNA, 23 bp, Homo sapiens
tagcaggtggtcctgagacctga

SEQ ID NO: 1158615 - DNA, 20 bp, Homo sapiens
tagcagtaaaagataaattt

SEQ ID NO: 1158616 - DNA, 16 bp, Homo sapiens
tagcagtaaaagatga

SEQ ID NO: 1158617 - DNA, 21 bp, Homo sapiens
tagcagtaaatacttgcagtt

SEQ ID NO: 1158618 - DNA, 22 bp, Homo sapiens
tagcagtaaatacttgcagttg

SEQ ID NO: 1158619 - DNA, 23 bp, Homo sapiens
tagcagtaaatacttgcagttgt

SEQ ID NO: 1158620 - DNA, 13 bp, Homo sapiens
tagcagtggctgg

SEQ ID NO: 1158621 - DNA, 17 bp, Homo sapiens
tagcagtggctggtgcc

SEQ ID NO: 1158622 - DNA, 23 bp, Homo sapiens
tagcagtggctggtgcccatgaa

SEQ ID NO: 1158623 - DNA, 17 bp, Homo sapiens
tagcataaataaaactg

SEQ ID NO: 1158624 - DNA, 20 bp, Homo sapiens
tagcataaataaaactgaat

SEQ ID NO: 1158625 - DNA, 21 bp, Homo sapiens
tagcatacatttataatgttt

SEQ ID NO: 1158626 - DNA, 12 bp, Homo sapiens
tagcatactgtg

SEQ ID NO: 1158627 - DNA, 21 bp, Homo sapiens
tagcatactgtgtatgtttta

SEQ ID NO: 1158628 - DNA, 23 bp, Homo sapiens
tagcatactgtgtatgttttata

SEQ ID NO: 1158629 - DNA, 21 bp, Homo sapiens
tagcatcagaaggttcaccca

SEQ ID NO: 1158630 - DNA, 16 bp, Homo sapiens
tagcatcttctggagt

SEQ ID NO: 1158631 - DNA, 15 bp, Homo sapiens
tagcatgaaataaaa

SEQ ID NO: 1158632 - DNA, 18 bp, Homo sapiens
tagcatgacaagccccag

SEQ ID NO: 1158633 - DNA, 18 bp, Homo sapiens
tagcatgcttcctttctc

SEQ ID NO: 1158634 - DNA, 19 bp, Homo sapiens
tagcatgcttcctttctct

SEQ ID NO: 1158635 - DNA, 23 bp, Homo sapiens
tagcatgcttcctttctctcctg

SEQ ID NO: 1158636 - DNA, 16 bp, Homo sapiens
tagcatggggcccctg

SEQ ID NO: 1158637 - DNA, 21 bp, Homo sapiens
tagcatggggcccctggccca

SEQ ID NO: 1158638 - DNA, 22 bp, Homo sapiens
tagcatggggcccctggcccag

SEQ ID NO: 1158639 - DNA, 12 bp, Homo sapiens
tagcatgtaatg

SEQ ID NO: 1158640 - DNA, 14 bp, Homo sapiens
tagcatgtcaactt

SEQ ID NO: 1158641 - DNA, 19 bp, Homo sapiens
tagcatgtcaacttttgac

SEQ ID NO: 1158642 - DNA, 13 bp, Homo sapiens
tagcatgtgactc

SEQ ID NO: 1158643 - DNA, 20 bp, Homo sapiens
tagcatgttgagccaggcct

SEQ ID NO: 1158644 - DNA, 16 bp, Homo sapiens
tagcattaactaatct

SEQ ID NO: 1158645 - DNA, 15 bp, Homo sapiens
tagcattatgcaatt

SEQ ID NO: 1158646 - DNA, 15 bp, Homo sapiens
tagcattcctcagga

SEQ ID NO: 1158647 - DNA, 17 bp, Homo sapiens
tagcattctttggagtt

SEQ ID NO: 1158648 - DNA, 13 bp, Homo sapiens
tagcattgaacat

SEQ ID NO: 1158649 - DNA, 14 bp, Homo sapiens
tagcattgaacatt

SEQ ID NO: 1158650 - DNA, 20 bp, Homo sapiens
tagcattgtgaactgacagg

SEQ ID NO: 1158651 - DNA, 23 bp, Homo sapiens
tagcattgttccacacatttaaa

SEQ ID NO: 1158652 - DNA, 18 bp, Homo sapiens
tagcatttatttctctgg

SEQ ID NO: 1158653 - DNA, 16 bp, Homo sapiens
tagcatttgccactta

SEQ ID NO: 1158654 - DNA, 21 bp, Homo sapiens
tagcattttcctgtttactga

SEQ ID NO: 1158655 - DNA, 22 bp, Homo sapiens
tagcattttgctaaatgtgaat

SEQ ID NO: 1158656 - DNA, 19 bp, Homo sapiens
tagcatttttatgcagaca

SEQ ID NO: 1158657 - DNA, 14 bp, Homo sapiens
tagcatttttgatt

SEQ ID NO: 1158658 - DNA, 20 bp, Homo sapiens
tagccaaaaatgtctaaaag

SEQ ID NO: 1158659 - DNA, 14 bp, Homo sapiens
tagccaaagccagg

SEQ ID NO: 1158660 - DNA, 20 bp, Homo sapiens
tagccaaggtgggctgagcc

SEQ ID NO: 1158661 - DNA, 22 bp, Homo sapiens
tagccaagttatattgaatata

SEQ ID NO: 1158662 - DNA, 21 bp, Homo sapiens
tagccaatgtctcctcccctt

SEQ ID NO: 1158663 - DNA, 16 bp, Homo sapiens
tagccacatttggaat

SEQ ID NO: 1158664 - DNA, 17 bp, Homo sapiens
tagccactccctcccag

SEQ ID NO: 1158665 - DNA, 16 bp, Homo sapiens
tagccactcctgccag

SEQ ID NO: 1158666 - DNA, 24 bp, Homo sapiens
tagccagagcccttcactgccatg

SEQ ID NO: 1158667 - DNA, 17 bp, Homo sapiens
tagccagaggctctaat

SEQ ID NO: 1158668 - DNA, 19 bp, Homo sapiens
tagccagcacttgtatata

SEQ ID NO: 1158669 - DNA, 19 bp, Homo sapiens
tagccagcattcagcacac

SEQ ID NO: 1158670 - DNA, 17 bp, Homo sapiens
tagccagccaggtgcat

SEQ ID NO: 1158671 - DNA, 12 bp, Homo sapiens
tagccagtgact

SEQ ID NO: 1158672 - DNA, 19 bp, Homo sapiens
tagccagttaaggaaagaa

SEQ ID NO: 1158673 - DNA, 15 bp, Homo sapiens
tagccagttcaaagt

SEQ ID NO: 1158674 - DNA, 16 bp, Homo sapiens
tagccagttcaaagtg

SEQ ID NO: 1158675 - DNA, 19 bp, Homo sapiens
tagccagttcaaagtgtat

SEQ ID NO: 1158676 - DNA, 15 bp, Homo sapiens
tagccataaacctga

SEQ ID NO: 1158677 - DNA, 18 bp, Homo sapiens
tagccatcccttggggaa

SEQ ID NO: 1158678 - DNA, 22 bp, Homo sapiens
tagccatgatttgtcccagcct

SEQ ID NO: 1158679 - DNA, 18 bp, Homo sapiens
tagccatggctcaggcaa

SEQ ID NO: 1158680 - DNA, 19 bp, Homo sapiens
tagccatttttcaaagcaa

SEQ ID NO: 1158681 - DNA, 18 bp, Homo sapiens
tagcccaatgaaatgaat

SEQ ID NO: 1158682 - DNA, 23 bp, Homo sapiens
tagcccacacttgagaggatgaa

SEQ ID NO: 1158683 - DNA, 16 bp, Homo sapiens
tagcccactccctgcc

SEQ ID NO: 1158684 - DNA, 17 bp, Homo sapiens
tagcccagactctgagc

SEQ ID NO: 1158685 - DNA, 14 bp, Homo sapiens
tagcccaggagcaa

SEQ ID NO: 1158686 - DNA, 20 bp, Homo sapiens
tagcccataaagtctgagaa

SEQ ID NO: 1158687 - DNA, 13 bp, Homo sapiens
tagccccagactg

SEQ ID NO: 1158688 - DNA, 18 bp, Homo sapiens
tagccccagactgggccc

SEQ ID NO: 1158689 - DNA, 23 bp, Homo sapiens
tagccccagactgggcccaggca

SEQ ID NO: 1158690 - DNA, 17 bp, Homo sapiens
tagccccagtgacagct

SEQ ID NO: 1158691 - DNA, 13 bp, Homo sapiens
tagccccataatt

SEQ ID NO: 1158692 - DNA, 15 bp, Homo sapiens
tagccccctggcctc

SEQ ID NO: 1158693 - DNA, 18 bp, Homo sapiens
tagccccgctgagcttgg

SEQ ID NO: 1158694 - DNA, 23 bp, Homo sapiens
tagcccgacagttctgaactgga

SEQ ID NO: 1158695 - DNA, 20 bp, Homo sapiens
tagccctcagacatttatat

SEQ ID NO: 1158696 - DNA, 16 bp, Homo sapiens
tagccctcccactttg

SEQ ID NO: 1158697 - DNA, 17 bp, Homo sapiens
tagccctcccactttgc

SEQ ID NO: 1158698 - DNA, 19 bp, Homo sapiens
tagccctccccccagctcc

SEQ ID NO: 1158699 - DNA, 13 bp, Homo sapiens
tagccctccccct

SEQ ID NO: 1158700 - DNA, 16 bp, Homo sapiens
tagccctccccctcaa

SEQ ID NO: 1158701 - DNA, 23 bp, Homo sapiens
tagccctccccctcaacctcacc

SEQ ID NO: 1158702 - DNA, 18 bp, Homo sapiens
tagccctcctttttccaa

SEQ ID NO: 1158703 - DNA, 16 bp, Homo sapiens
tagccctgagcccggc

SEQ ID NO: 1158704 - DNA, 13 bp, Homo sapiens
tagccctgtcctg

SEQ ID NO: 1158705 - DNA, 14 bp, Homo sapiens
tagccctgtcctgg

SEQ ID NO: 1158706 - DNA, 15 bp, Homo sapiens
tagccctgtcctggt

SEQ ID NO: 1158707 - DNA, 11 bp, Homo sapiens
tagcccttcca

SEQ ID NO: 1158708 - DNA, 14 bp, Homo sapiens
tagcccttccagcc

SEQ ID NO: 1158709 - DNA, 16 bp, Homo sapiens
tagcccttccagcctg

SEQ ID NO: 1158710 - DNA, 20 bp, Homo sapiens
tagcccttccagcctgggac

SEQ ID NO: 1158711 - DNA, 21 bp, Homo sapiens
tagcccttccagcctgggaca

SEQ ID NO: 1158712 - DNA, 12 bp, Homo sapiens
tagcccttccct

SEQ ID NO: 1158713 - DNA, 15 bp, Homo sapiens
tagccctttctgtgt

SEQ ID NO: 1158714 - DNA, 16 bp, Homo sapiens
tagccgacctcagcct

SEQ ID NO: 1158715 - DNA, 15 bp, Homo sapiens
tagccgagagcctgc

SEQ ID NO: 1158716 - DNA, 17 bp, Homo sapiens
tagccgattctctgccc

SEQ ID NO: 1158717 - DNA, 21 bp, Homo sapiens
tagccgcaccctgcacctgct

SEQ ID NO: 1158718 - DNA, 15 bp, Homo sapiens
tagccgccctgagag

SEQ ID NO: 1158719 - DNA, 16 bp, Homo sapiens
tagccgtccatggcac

SEQ ID NO: 1158720 - DNA, 17 bp, Homo sapiens
tagccgtccatggcacc

SEQ ID NO: 1158721 - DNA, 20 bp, Homo sapiens
tagccgtccatggcaccagc

SEQ ID NO: 1158722 - DNA, 21 bp, Homo sapiens
tagcctaaaacgaatggtctt

SEQ ID NO: 1158723 - DNA, 15 bp, Homo sapiens
tagcctaaagggcag

SEQ ID NO: 1158724 - DNA, 20 bp, Homo sapiens
tagcctaaggctcctgtttt

SEQ ID NO: 1158725 - DNA, 11 bp, Homo sapiens
tagcctaccat

SEQ ID NO: 1158726 - DNA, 19 bp, Homo sapiens
tagcctcaatttctgaaca

SEQ ID NO: 1158727 - DNA, 14 bp, Homo sapiens
tagcctccagcttt

SEQ ID NO: 1158728 - DNA, 13 bp, Homo sapiens
tagcctccctgaa

SEQ ID NO: 1158729 - DNA, 22 bp, Homo sapiens
tagcctccgtttatgggccttg

SEQ ID NO: 1158730 - DNA, 12 bp, Homo sapiens
tagcctctccca

SEQ ID NO: 1158731 - DNA, 14 bp, Homo sapiens
tagcctctcccacc

SEQ ID NO: 1158732 - DNA, 17 bp, Homo sapiens
tagcctcttccctctga

SEQ ID NO: 1158733 - DNA, 12 bp, Homo sapiens
tagcctgcctca

SEQ ID NO: 1158734 - DNA, 15 bp, Homo sapiens
tagcctgctgtgggg

SEQ ID NO: 1158735 - DNA, 14 bp, Homo sapiens
tagcctggatggcc

SEQ ID NO: 1158736 - DNA, 17 bp, Homo sapiens
tagcctggatggcccct

SEQ ID NO: 1158737 - DNA, 11 bp, Homo sapiens
tagcctggcta

SEQ ID NO: 1158738 - DNA, 14 bp, Homo sapiens
tagcctgggccaga

SEQ ID NO: 1158739 - DNA, 14 bp, Homo sapiens
ttcttttctggaaa

SEQ ID NO: 1158740 - DNA, 20 bp, Homo sapiens
ttcttttcttcactcaaatt

SEQ ID NO: 1158741 - DNA, 15 bp, Homo sapiens
ttcttttgattttgt

SEQ ID NO: 1158742 - DNA, 14 bp, Homo sapiens
ttcttttgtatgta

SEQ ID NO: 1158743 - DNA, 20 bp, Homo sapiens
ttcttttgtatgtaaatgtg

SEQ ID NO: 1158744 - DNA, 17 bp, Homo sapiens
ttcttttgtggtgtctt

SEQ ID NO: 1158745 - DNA, 21 bp, Homo sapiens
ttctttttaaagtttgttcac

SEQ ID NO: 1158746 - DNA, 16 bp, Homo sapiens
ttctttttaagagata

SEQ ID NO: 1158747 - DNA, 20 bp, Homo sapiens
ttctttttaattattttaaa

SEQ ID NO: 1158748 - DNA, 22 bp, Homo sapiens
ttctttttacagcattgtcttt

SEQ ID NO: 1158749 - DNA, 15 bp, Homo sapiens
ttctttttattgaat

SEQ ID NO: 1158750 - DNA, 15 bp, Homo sapiens
ttctttttattttct

SEQ ID NO: 1158751 - DNA, 16 bp, Homo sapiens
ttctttttctggactc

SEQ ID NO: 1158752 - DNA, 17 bp, Homo sapiens
ttcttttttaaaatcaa

SEQ ID NO: 1158753 - DNA, 14 bp, Homo sapiens
ttcttttttaaagt

SEQ ID NO: 1158754 - DNA, 14 bp, Homo sapiens
ttcttttttaagtt

SEQ ID NO: 1158755 - DNA, 14 bp, Homo sapiens
ttctttttttgtga

SEQ ID NO: 1158756 - DNA, 18 bp, Homo sapiens
ttcttttttttcattata

SEQ ID NO: 1158757 - DNA, 17 bp, Homo sapiens
ttctttttttttaagtt

SEQ ID NO: 1158758 - DNA, 20 bp, Homo sapiens
ttctttttttttaagttctt

SEQ ID NO: 1158759 - DNA, 23 bp, Homo sapiens
ttgaaaaaaaaaatgttgagaag

SEQ ID NO: 1158760 - DNA, 13 bp, Homo sapiens
ttgaaaaaaaata

SEQ ID NO: 1158761 - DNA, 21 bp, Homo sapiens
ttgaaaaaatttaaaagtaaa

SEQ ID NO: 1158762 - DNA, 20 bp, Homo sapiens
ttgaaaaagttccatagaaa

SEQ ID NO: 1158763 - DNA, 15 bp, Homo sapiens
ttgaaaaagtttgtt

SEQ ID NO: 1158764 - DNA, 22 bp, Homo sapiens
ttgaaaaatacgttttgtgtat

SEQ ID NO: 1158765 - DNA, 14 bp, Homo sapiens
ttgaaaaatattgc

SEQ ID NO: 1158766 - DNA, 13 bp, Homo sapiens
ttgaaaacaaaaa

SEQ ID NO: 1158767 - DNA, 16 bp, Homo sapiens
ttgaaaacctgacaaa

SEQ ID NO: 1158768 - DNA, 18 bp, Homo sapiens
ttgaaaacttcagaagca

SEQ ID NO: 1158769 - DNA, 15 bp, Homo sapiens
ttgaaaagcagacat

SEQ ID NO: 1158770 - DNA, 15 bp, Homo sapiens
ttgaaaagtcaaact

SEQ ID NO: 1158771 - DNA, 14 bp, Homo sapiens
ttgaaaatatttct

SEQ ID NO: 1158772 - DNA, 17 bp, Homo sapiens
ttgaaaatatttctatg

SEQ ID NO: 1158773 - DNA, 21 bp, Homo sapiens
ttgaaaatatttctatgtaaa

SEQ ID NO: 1158774 - DNA, 17 bp, Homo sapiens
ttgaaaatgtgtttgct

SEQ ID NO: 1158775 - DNA, 23 bp, Homo sapiens
ttgaaaattatgcaaaagcagct

SEQ ID NO: 1158776 - DNA, 20 bp, Homo sapiens
ttgaaaattcaaaaagtgtt

SEQ ID NO: 1158777 - DNA, 21 bp, Homo sapiens
ttgaaaattcaaaaagtgttt

SEQ ID NO: 1158778 - DNA, 16 bp, Homo sapiens
ttgaaaattgaaaagt

SEQ ID NO: 1158779 - DNA, 23 bp, Homo sapiens
ttgaaaattgtataccaatgtgt

SEQ ID NO: 1158780 - DNA, 18 bp, Homo sapiens
ttgaaaattttacttcca

SEQ ID NO: 1158781 - DNA, 14 bp, Homo sapiens
ttgaaacagttcca

SEQ ID NO: 1158782 - DNA, 14 bp, Homo sapiens
ttgaaacctgttaa

SEQ ID NO: 1158783 - DNA, 18 bp, Homo sapiens
ttgaaacgttatgatgac

SEQ ID NO: 1158784 - DNA, 16 bp, Homo sapiens
ttgaaactaaaataaa

SEQ ID NO: 1158785 - DNA, 20 bp, Homo sapiens
ttgaaactaaaataaattaa

SEQ ID NO: 1158786 - DNA, 19 bp, Homo sapiens
ttgaaactctctgttcaga

SEQ ID NO: 1158787 - DNA, 16 bp, Homo sapiens
ttgaaactgcatttgt

SEQ ID NO: 1158788 - DNA, 20 bp, Homo sapiens
ttgaaactgtaaatatgttt

SEQ ID NO: 1158789 - DNA, 13 bp, Homo sapiens
ttgaaagaagttt

SEQ ID NO: 1158790 - DNA, 14 bp, Homo sapiens
ttgaaagaatagaa

SEQ ID NO: 1158791 - DNA, 20 bp, Homo sapiens
ttgaaagattttattgtata

SEQ ID NO: 1158792 - DNA, 22 bp, Homo sapiens
ttgaaagattttattgtataaa

SEQ ID NO: 1158793 - DNA, 16 bp, Homo sapiens
ttgaaagcatccatgt

SEQ ID NO: 1158794 - DNA, 18 bp, Homo sapiens
ttgaaagctgaaaagcat

SEQ ID NO: 1158795 - DNA, 22 bp, Homo sapiens
ttgaaaggcaggaagggaagcg

SEQ ID NO: 1158796 - DNA, 21 bp, Homo sapiens
ttgaaaggggacacctgtaca

SEQ ID NO: 1158797 - DNA, 21 bp, Homo sapiens
ttgaaaggttttttttcagtt

SEQ ID NO: 1158798 - DNA, 22 bp, Homo sapiens
ttgaaagtaaaaacctgcttgg

SEQ ID NO: 1158799 - DNA, 16 bp, Homo sapiens
ttgaaagtagagctag

SEQ ID NO: 1158800 - DNA, 20 bp, Homo sapiens
ttgaaagtattcagaaatta

SEQ ID NO: 1158801 - DNA, 19 bp, Homo sapiens
ttgaaagtttaacaaatga

SEQ ID NO: 1158802 - DNA, 21 bp, Homo sapiens
ttgaaagttttccagtattga

SEQ ID NO: 1158803 - DNA, 14 bp, Homo sapiens
ttgaaataaagcta

SEQ ID NO: 1158804 - DNA, 21 bp, Homo sapiens
ttgaaataactggaacaaatt

SEQ ID NO: 1158805 - DNA, 16 bp, Homo sapiens
ttgaaataagaattca

SEQ ID NO: 1158806 - DNA, 14 bp, Homo sapiens
ttgaaatatataat

SEQ ID NO: 1158807 - DNA, 14 bp, Homo sapiens
ttgaaatatcatgt

SEQ ID NO: 1158808 - DNA, 15 bp, Homo sapiens
ttgaaatattaaaat

SEQ ID NO: 1158809 - DNA, 19 bp, Homo sapiens
ttgaaatcagcatgacaaa

SEQ ID NO: 1158810 - DNA, 13 bp, Homo sapiens
ttgaaatctttta

SEQ ID NO: 1158811 - DNA, 21 bp, Homo sapiens
ttgaaatgaaagtataactga

SEQ ID NO: 1158812 - DNA, 18 bp, Homo sapiens
ttgaaatgaggtctgttt

SEQ ID NO: 1158813 - DNA, 20 bp, Homo sapiens
ttgaaatgaggtctgtttaa

SEQ ID NO: 1158814 - DNA, 13 bp, Homo sapiens
ttgaaatgagtaa

SEQ ID NO: 1158815 - DNA, 18 bp, Homo sapiens
ttgaaatgtggttttcct

SEQ ID NO: 1158816 - DNA, 19 bp, Homo sapiens
ttgaaatgtggttttcctg

SEQ ID NO: 1158817 - DNA, 16 bp, Homo sapiens
ttgaaattactgtgta

SEQ ID NO: 1158818 - DNA, 21 bp, Homo sapiens
ttgaaattatgtatgtttaca

SEQ ID NO: 1158819 - DNA, 23 bp, Homo sapiens
ttgaaattatgtatgtttacata

SEQ ID NO: 1158820 - DNA, 17 bp, Homo sapiens
ttgaaattatgtgacat

SEQ ID NO: 1158821 - DNA, 20 bp, Homo sapiens
ttgaaattatgtgacatttt

SEQ ID NO: 1158822 - DNA, 21 bp, Homo sapiens
ttgaaattctatttataatac

SEQ ID NO: 1158823 - DNA, 19 bp, Homo sapiens
ttgaaattgtttaagtgtt

SEQ ID NO: 1158824 - DNA, 20 bp, Homo sapiens
ttgaacaagttgtttcattg

SEQ ID NO: 1158825 - DNA, 18 bp, Homo sapiens
ttgaacacaaactgtaaa

SEQ ID NO: 1158826 - DNA, 16 bp, Homo sapiens
ttgaacagctatcacg

SEQ ID NO: 1158827 - DNA, 21 bp, Homo sapiens
ttgaacatgtgccttttctga

SEQ ID NO: 1158828 - DNA, 14 bp, Homo sapiens
ttgaaccccctccc

SEQ ID NO: 1158829 - DNA, 20 bp, Homo sapiens
ttgaacctggatccagcact

SEQ ID NO: 1158830 - DNA, 12 bp, Homo sapiens
ttgaacctggga

SEQ ID NO: 1158831 - DNA, 20 bp, Homo sapiens
ttgaacctttttttttgaaa

SEQ ID NO: 1158832 - DNA, 21 bp, Homo sapiens
ttgaacgactgtatattgcta

SEQ ID NO: 1158833 - DNA, 19 bp, Homo sapiens
ttgaactatgactggagta

SEQ ID NO: 1158834 - DNA, 21 bp, Homo sapiens
ttgaactgaaacttttctaaa

SEQ ID NO: 1158835 - DNA, 23 bp, Homo sapiens
ttgaactgtattctagtggctgt

SEQ ID NO: 1158836 - DNA, 18 bp, Homo sapiens
ttgaactgttagatgctg

SEQ ID NO: 1158837 - DNA, 14 bp, Homo sapiens
ttgaacttagatgt

SEQ ID NO: 1158838 - DNA, 16 bp, Homo sapiens
ttgaacttgctctttt

SEQ ID NO: 1158839 - DNA, 17 bp, Homo sapiens
ttgaactttgacctctg

SEQ ID NO: 1158840 - DNA, 18 bp, Homo sapiens
ttgaactttgacctctgc

SEQ ID NO: 1158841 - DNA, 20 bp, Homo sapiens
ttgaacttttcattccctgt

SEQ ID NO: 1158842 - DNA, 22 bp, Homo sapiens
ttgaacttttcattccctgtag

SEQ ID NO: 1158843 - DNA, 15 bp, Homo sapiens
ttgaactttttttaa

SEQ ID NO: 1158844 - DNA, 16 bp, Homo sapiens
ttgaagaaaatgactt

SEQ ID NO: 1158845 - DNA, 18 bp, Homo sapiens
ttgaagaactgcactttt

SEQ ID NO: 1158846 - DNA, 20 bp, Homo sapiens
ttgaagaactgcaggccctg

SEQ ID NO: 1158847 - DNA, 20 bp, Homo sapiens
ttgaagaagaaccagcccag

SEQ ID NO: 1158848 - DNA, 23 bp, Homo sapiens
ttgaagaagaaccagcccagcct

SEQ ID NO: 1158849 - DNA, 17 bp, Homo sapiens
ttgaagaatctgcccct

SEQ ID NO: 1158850 - DNA, 18 bp, Homo sapiens
ttgaagaatctgcccctg

SEQ ID NO: 1158851 - DNA, 23 bp, Homo sapiens
ttgaagaatgttaagacttgaca

SEQ ID NO: 1158852 - DNA, 16 bp, Homo sapiens
ttgaagacacagcctc

SEQ ID NO: 1158853 - DNA, 22 bp, Homo sapiens
ttgaagacagagcaaagcgccc

SEQ ID NO: 1158854 - DNA, 15 bp, Homo sapiens
ttgaagacttcctct

SEQ ID NO: 1158855 - DNA, 22 bp, Homo sapiens
ttgaagcaataactccaagcag

SEQ ID NO: 1158856 - DNA, 11 bp, Homo sapiens
ttgaagcactt

SEQ ID NO: 1158857 - DNA, 23 bp, Homo sapiens
ttgaagcacttaagtcttcctta

SEQ ID NO: 1158858 - DNA, 14 bp, Homo sapiens
ttgaagccaaagaa

SEQ ID NO: 1158859 - DNA, 14 bp, Homo sapiens
ttgaagccatgtct

SEQ ID NO: 1158860 - DNA, 19 bp, Homo sapiens
ttgaagccgactctggccc

SEQ ID NO: 1158861 - DNA, 18 bp, Homo sapiens
ttgaagctgggctgtctc

SEQ ID NO: 1158862 - DNA, 14 bp, Homo sapiens
tagcctggggtggg

SEQ ID NO: 1158863 - DNA, 20 bp, Homo sapiens
tagccttaaatttttgtcat

SEQ ID NO: 1158864 - DNA, 17 bp, Homo sapiens
tagccttatcctctgat

SEQ ID NO: 1158865 - DNA, 18 bp, Homo sapiens
tagccttatcctctgatc

SEQ ID NO: 1158866 - DNA, 13 bp, Homo sapiens
tagccttcctcca

SEQ ID NO: 1158867 - DNA, 18 bp, Homo sapiens
tagccttcctccacatcc

SEQ ID NO: 1158868 - DNA, 15 bp, Homo sapiens
tagccttgtgccctg

SEQ ID NO: 1158869 - DNA, 17 bp, Homo sapiens
tagccttgtgccctgcc

SEQ ID NO: 1158870 - DNA, 18 bp, Homo sapiens
tagcctttacctgtgaag

SEQ ID NO: 1158871 - DNA, 22 bp, Homo sapiens
tagcctttacctgtgaagtgtt

SEQ ID NO: 1158872 - DNA, 13 bp, Homo sapiens
tagcctttcttgt

SEQ ID NO: 1158873 - DNA, 23 bp, Homo sapiens
tagcgaacgtatttctccagacc

SEQ ID NO: 1158874 - DNA, 17 bp, Homo sapiens
tagcgatctctcctggc

SEQ ID NO: 1158875 - DNA, 20 bp, Homo sapiens
tagcgatctctcctggccta

SEQ ID NO: 1158876 - DNA, 15 bp, Homo sapiens
tagcgctctcttcca

SEQ ID NO: 1158877 - DNA, 12 bp, Homo sapiens
tagcggctcctc

SEQ ID NO: 1158878 - DNA, 17 bp, Homo sapiens
tagcgtcaagacatttg

SEQ ID NO: 1158879 - DNA, 20 bp, Homo sapiens
tagcgtcaagacatttgctg

SEQ ID NO: 1158880 - DNA, 14 bp, Homo sapiens
tagcgtcctgagga

SEQ ID NO: 1158881 - DNA, 14 bp, Homo sapiens
tagcgtgtgtagat

SEQ ID NO: 1158882 - DNA, 22 bp, Homo sapiens
tagcgttctggactctgcccca

SEQ ID NO: 1158883 - DNA, 15 bp, Homo sapiens
tagcgttcttgtaat

SEQ ID NO: 1158884 - DNA, 17 bp, Homo sapiens
tagcgttcttgtaattt

SEQ ID NO: 1158885 - DNA, 18 bp, Homo sapiens
tagcgttttttaaatgta

SEQ ID NO: 1158886 - DNA, 19 bp, Homo sapiens
tagctaaacggattccaaa

SEQ ID NO: 1158887 - DNA, 22 bp, Homo sapiens
tagctaagtacacaataagcaa

SEQ ID NO: 1158888 - DNA, 20 bp, Homo sapiens
tagctaataaaaagcttttg

SEQ ID NO: 1158889 - DNA, 22 bp, Homo sapiens
tagctacaatttgtttttgcat

SEQ ID NO: 1158890 - DNA, 13 bp, Homo sapiens
tagctacactgag

SEQ ID NO: 1158891 - DNA, 15 bp, Homo sapiens
tagctacaggaagca

SEQ ID NO: 1158892 - DNA, 14 bp, Homo sapiens
tagctacatagcag

SEQ ID NO: 1158893 - DNA, 23 bp, Homo sapiens
tagctacctacatgctgaaaaat

SEQ ID NO: 1158894 - DNA, 19 bp, Homo sapiens
tagctacctttttatattt

SEQ ID NO: 1158895 - DNA, 19 bp, Homo sapiens
tagctagaagtgggccagg

SEQ ID NO: 1158896 - DNA, 15 bp, Homo sapiens
tagctaggtgacata

SEQ ID NO: 1158897 - DNA, 17 bp, Homo sapiens
tagctagtttgcttttt

SEQ ID NO: 1158898 - DNA, 17 bp, Homo sapiens
tagctatatccatgtac

SEQ ID NO: 1158899 - DNA, 18 bp, Homo sapiens
tagctatatccatgtact

SEQ ID NO: 1158900 - DNA, 19 bp, Homo sapiens
tagctatatccatgtactg

SEQ ID NO: 1158901 - DNA, 22 bp, Homo sapiens
tagctatatccatgtactgtag

SEQ ID NO: 1158902 - DNA, 21 bp, Homo sapiens
tagctatgctgtatctgtgct

SEQ ID NO: 1158903 - DNA, 21 bp, Homo sapiens
tagctattagcggctcctcgc

SEQ ID NO: 1158904 - DNA, 21 bp, Homo sapiens
tagctatttgtttacatgcag

SEQ ID NO: 1158905 - DNA, 15 bp, Homo sapiens
tagctattttccttg

SEQ ID NO: 1158906 - DNA, 20 bp, Homo sapiens
tagctcaagtttaaaagcca

SEQ ID NO: 1158907 - DNA, 21 bp, Homo sapiens
tagctcaagtttaaaagccat

SEQ ID NO: 1158908 - DNA, 21 bp, Homo sapiens
tagctcactgaatcttcacga

SEQ ID NO: 1158909 - DNA, 22 bp, Homo sapiens
tagctcaggacctgggacctcc

SEQ ID NO: 1158910 - DNA, 15 bp, Homo sapiens
tagctcaggtgcctt

SEQ ID NO: 1158911 - DNA, 11 bp, Homo sapiens
tagctcagttt

SEQ ID NO: 1158912 - DNA, 21 bp, Homo sapiens
tagctccctgtggggcaggag

SEQ ID NO: 1158913 - DNA, 21 bp, Homo sapiens
tagctcctgccacatggagcc

SEQ ID NO: 1158914 - DNA, 16 bp, Homo sapiens
tagctcctgtggcccc

SEQ ID NO: 1158915 - DNA, 14 bp, Homo sapiens
tagctccttggagc

SEQ ID NO: 1158916 - DNA, 19 bp, Homo sapiens
tagctccttggagcaggca

SEQ ID NO: 1158917 - DNA, 17 bp, Homo sapiens
tagctctattttaaagt

SEQ ID NO: 1158918 - DNA, 14 bp, Homo sapiens
tagctctcccagtg

SEQ ID NO: 1158919 - DNA, 14 bp, Homo sapiens
tagctctccttccc

SEQ ID NO: 1158920 - DNA, 13 bp, Homo sapiens
tagctctctaggc

SEQ ID NO: 1158921 - DNA, 21 bp, Homo sapiens
tagctctggaggtgctgctct

SEQ ID NO: 1158922 - DNA, 13 bp, Homo sapiens
tagctctttcctt

SEQ ID NO: 1158923 - DNA, 12 bp, Homo sapiens
tagctctttctc

SEQ ID NO: 1158924 - DNA, 23 bp, Homo sapiens
tagctcttttttgtttgtttctt

SEQ ID NO: 1158925 - DNA, 14 bp, Homo sapiens
tagctgaaaactaa

SEQ ID NO: 1158926 - DNA, 22 bp, Homo sapiens
tagctgaaaactaatgtactgt

SEQ ID NO: 1158927 - DNA, 17 bp, Homo sapiens
tagctgaaaagggcact

SEQ ID NO: 1158928 - DNA, 23 bp, Homo sapiens
tagctgaaaagggcactcccaac

SEQ ID NO: 1158929 - DNA, 21 bp, Homo sapiens
tagctgacccagccccttgag

SEQ ID NO: 1158930 - DNA, 11 bp, Homo sapiens
tagctgaggga

SEQ ID NO: 1158931 - DNA, 13 bp, Homo sapiens
tagctgaggggac

SEQ ID NO: 1158932 - DNA, 11 bp, Homo sapiens
tagctgcagaa

SEQ ID NO: 1158933 - DNA, 12 bp, Homo sapiens
tagctgccactt

SEQ ID NO: 1158934 - DNA, 16 bp, Homo sapiens
tagctgccagtgctgg

SEQ ID NO: 1158935 - DNA, 22 bp, Homo sapiens
tagctgctctgagcatcaagaa

SEQ ID NO: 1158936 - DNA, 23 bp, Homo sapiens
tagctggagatctgaacccagct

SEQ ID NO: 1158937 - DNA, 11 bp, Homo sapiens
tagctggcagg

SEQ ID NO: 1158938 - DNA, 16 bp, Homo sapiens
tagctgggaaagcata

SEQ ID NO: 1158939 - DNA, 15 bp, Homo sapiens
tagctgggattacag

SEQ ID NO: 1158940 - DNA, 15 bp, Homo sapiens
tagctgggcctgtgc

SEQ ID NO: 1158941 - DNA, 17 bp, Homo sapiens
tagctgggcctgtgcac

SEQ ID NO: 1158942 - DNA, 21 bp, Homo sapiens
tagctgggcctgtgcactggg

SEQ ID NO: 1158943 - DNA, 12 bp, Homo sapiens
tagctggggctt

SEQ ID NO: 1158944 - DNA, 20 bp, Homo sapiens
tagctgggggtgggccaggc

SEQ ID NO: 1158945 - DNA, 21 bp, Homo sapiens
tagctggtgtcagcccctctt

SEQ ID NO: 1158946 - DNA, 23 bp, Homo sapiens
tagctgtaagggcagtgcccatg

SEQ ID NO: 1158947 - DNA, 12 bp, Homo sapiens
tagctgtacaaa

SEQ ID NO: 1158948 - DNA, 21 bp, Homo sapiens
tagctgtagttttccctgcac

SEQ ID NO: 1158949 - DNA, 17 bp, Homo sapiens
tagctgtctagagtagc

SEQ ID NO: 1158950 - DNA, 14 bp, Homo sapiens
tagctgtctgtgaa

SEQ ID NO: 1158951 - DNA, 10 bp, Homo sapiens
tagctgtggg

SEQ ID NO: 1158952 - DNA, 14 bp, Homo sapiens
tagctgtgggggtg

SEQ ID NO: 1158953 - DNA, 14 bp, Homo sapiens
tagctgtggtgagg

SEQ ID NO: 1158954 - DNA, 14 bp, Homo sapiens
tagctgtgtgaaat

SEQ ID NO: 1158955 - DNA, 13 bp, Homo sapiens
tagctgttgagct

SEQ ID NO: 1158956 - DNA, 17 bp, Homo sapiens
tagctgttgagctgttt

SEQ ID NO: 1158957 - DNA, 18 bp, Homo sapiens
tagctgtttcaaatgtgc

SEQ ID NO: 1158958 - DNA, 14 bp, Homo sapiens
tagcttacactgag

SEQ ID NO: 1158959 - DNA, 15 bp, Homo sapiens
tagcttacactgagg

SEQ ID NO: 1158960 - DNA, 16 bp, Homo sapiens
tagcttaccagaagct

SEQ ID NO: 1158961 - DNA, 14 bp, Homo sapiens
tagcttactgatga

SEQ ID NO: 1158962 - DNA, 15 bp, Homo sapiens
tagcttagacctcag

SEQ ID NO: 1158963 - DNA, 19 bp, Homo sapiens
tagcttagacctcagcctg

SEQ ID NO: 1158964 - DNA, 23 bp, Homo sapiens
tagcttagacctcagcctgtgct

SEQ ID NO: 1158965 - DNA, 19 bp, Homo sapiens
tagcttatctacttccaaa

SEQ ID NO: 1158966 - DNA, 22 bp, Homo sapiens
tagcttatctacttccaaacta

SEQ ID NO: 1158967 - DNA, 17 bp, Homo sapiens
tagcttatctttctttc

SEQ ID NO: 1158968 - DNA, 18 bp, Homo sapiens
tagcttatctttctttcc

SEQ ID NO: 1158969 - DNA, 16 bp, Homo sapiens
tagcttcagttgttct

SEQ ID NO: 1158970 - DNA, 16 bp, Homo sapiens
tagcttccaataaagc

SEQ ID NO: 1158971 - DNA, 13 bp, Homo sapiens
tagcttcctccag

SEQ ID NO: 1158972 - DNA, 16 bp, Homo sapiens
tagcttcctccagagg

SEQ ID NO: 1158973 - DNA, 20 bp, Homo sapiens
tagcttctcttctttctgaa

SEQ ID NO: 1158974 - DNA, 13 bp, Homo sapiens
tagcttctgcttt

SEQ ID NO: 1158975 - DNA, 16 bp, Homo sapiens
tagcttgcaccttgtc

SEQ ID NO: 1158976 - DNA, 17 bp, Homo sapiens
tagcttgtttctgtcaa

SEQ ID NO: 1158977 - DNA, 19 bp, Homo sapiens
tagctttaaaaccacagct

SEQ ID NO: 1158978 - DNA, 15 bp, Homo sapiens
tagctttaccctcag

SEQ ID NO: 1158979 - DNA, 16 bp, Homo sapiens
tagctttactgtttct

SEQ ID NO: 1158980 - DNA, 17 bp, Homo sapiens
tagctttagaccctggg

SEQ ID NO: 1158981 - DNA, 18 bp, Homo sapiens
tagctttatatatggaca

SEQ ID NO: 1158982 - DNA, 19 bp, Homo sapiens
tagctttatatatggacat

SEQ ID NO: 1158983 - DNA, 15 bp, Homo sapiens
tagctttattcttca

SEQ ID NO: 1158984 - DNA, 18 bp, Homo sapiens
tagctttattttttaagt

SEQ ID NO: 1158985 - DNA, 19 bp, Homo sapiens
tagctttcccaaataaact

SEQ ID NO: 1158986 - DNA, 18 bp, Homo sapiens
tagctttgtgtttacttt

SEQ ID NO: 1158987 - DNA, 19 bp, Homo sapiens
ttgaagctgggctgtctct

SEQ ID NO: 1158988 - DNA, 13 bp, Homo sapiens
ttgaaggaaacag

SEQ ID NO: 1158989 - DNA, 22 bp, Homo sapiens
ttgaaggaaatgagtggccagc

SEQ ID NO: 1158990 - DNA, 19 bp, Homo sapiens
ttgaaggacctaaattcgt

SEQ ID NO: 1158991 - DNA, 21 bp, Homo sapiens
ttgaaggactaatagaaaagt

SEQ ID NO: 1158992 - DNA, 12 bp, Homo sapiens
ttgaaggattgc

SEQ ID NO: 1158993 - DNA, 12 bp, Homo sapiens
ttgaaggcaaaa

SEQ ID NO: 1158994 - DNA, 15 bp, Homo sapiens
ttgaaggcaaaattg

SEQ ID NO: 1158995 - DNA, 16 bp, Homo sapiens
ttgaaggcagtctgaa

SEQ ID NO: 1158996 - DNA, 11 bp, Homo sapiens
ttgaaggctta

SEQ ID NO: 1158997 - DNA, 20 bp, Homo sapiens
ttgaagggaggggctgtgtt

SEQ ID NO: 1158998 - DNA, 16 bp, Homo sapiens
ttgaagggcaagaaat

SEQ ID NO: 1158999 - DNA, 19 bp, Homo sapiens
ttgaagggtaaagaagttt

SEQ ID NO: 1159000 - DNA, 22 bp, Homo sapiens
ttgaaggtgataagggaaaaga

SEQ ID NO: 1159001 - DNA, 18 bp, Homo sapiens
ttgaaggtttcagatgag

SEQ ID NO: 1159002 - DNA, 15 bp, Homo sapiens
ttgaagtaaactttt

SEQ ID NO: 1159003 - DNA, 16 bp, Homo sapiens
ttgaagtaaacttttt

SEQ ID NO: 1159004 - DNA, 18 bp, Homo sapiens
ttgaagtaatcccgccac

SEQ ID NO: 1159005 - DNA, 23 bp, Homo sapiens
ttgaagtaggtggcttgagctag

SEQ ID NO: 1159006 - DNA, 17 bp, Homo sapiens
ttgaagtatattcttat

SEQ ID NO: 1159007 - DNA, 12 bp, Homo sapiens
ttgaagtcagcc

SEQ ID NO: 1159008 - DNA, 19 bp, Homo sapiens
ttgaagtctataaaaaata

SEQ ID NO: 1159009 - DNA, 19 bp, Homo sapiens
ttgaagtgtaggcagacac

SEQ ID NO: 1159010 - DNA, 13 bp, Homo sapiens
ttgaagtgtcttc

SEQ ID NO: 1159011 - DNA, 19 bp, Homo sapiens
ttgaagttagctttaactt

SEQ ID NO: 1159012 - DNA, 22 bp, Homo sapiens
ttgaagttagtggaaatctgaa

SEQ ID NO: 1159013 - DNA, 19 bp, Homo sapiens
ttgaagttgggtgtttcca

SEQ ID NO: 1159014 - DNA, 19 bp, Homo sapiens
ttgaagttgttactaacta

SEQ ID NO: 1159015 - DNA, 13 bp, Homo sapiens
ttgaataaaaagt

SEQ ID NO: 1159016 - DNA, 16 bp, Homo sapiens
ttgaataaaaatgcac

SEQ ID NO: 1159017 - DNA, 14 bp, Homo sapiens
ttgaataaaagtgc

SEQ ID NO: 1159018 - DNA, 12 bp, Homo sapiens
ttgaataaacta

SEQ ID NO: 1159019 - DNA, 16 bp, Homo sapiens
ttgaataaatgagaaa

SEQ ID NO: 1159020 - DNA, 22 bp, Homo sapiens
ttgaataaattttcaaatcctt

SEQ ID NO: 1159021 - DNA, 15 bp, Homo sapiens
ttgaataatgacaga

SEQ ID NO: 1159022 - DNA, 18 bp, Homo sapiens
ttgaatactctgccctct

SEQ ID NO: 1159023 - DNA, 13 bp, Homo sapiens
ttgaatataaaaa

SEQ ID NO: 1159024 - DNA, 18 bp, Homo sapiens
ttgaatattttttgaagg

SEQ ID NO: 1159025 - DNA, 15 bp, Homo sapiens
ttgaatcacatgaat

SEQ ID NO: 1159026 - DNA, 18 bp, Homo sapiens
ttgaatcagtttccaatt

SEQ ID NO: 1159027 - DNA, 21 bp, Homo sapiens
ttgaatcagtttccaattatt

SEQ ID NO: 1159028 - DNA, 19 bp, Homo sapiens
ttgaatccatgcttgggtg

SEQ ID NO: 1159029 - DNA, 22 bp, Homo sapiens
ttgaatgaaaaatttaagcatt

SEQ ID NO: 1159030 - DNA, 21 bp, Homo sapiens
ttgaatgatttttctttacaa

SEQ ID NO: 1159031 - DNA, 15 bp, Homo sapiens
ttgaatgcaaaccat

SEQ ID NO: 1159032 - DNA, 23 bp, Homo sapiens
ttgaatgctgccagtgtggagtg

SEQ ID NO: 1159033 - DNA, 16 bp, Homo sapiens
ttgaatgcttcctgac

SEQ ID NO: 1159034 - DNA, 16 bp, Homo sapiens
ttgaatggctatgttt

SEQ ID NO: 1159035 - DNA, 20 bp, Homo sapiens
ttgaatggctatgtttttaa

SEQ ID NO: 1159036 - DNA, 16 bp, Homo sapiens
ttgaatggtgttgtat

SEQ ID NO: 1159037 - DNA, 16 bp, Homo sapiens
ttgaatgtaaaacagg

SEQ ID NO: 1159038 - DNA, 12 bp, Homo sapiens
ttgaatgtcaca

SEQ ID NO: 1159039 - DNA, 19 bp, Homo sapiens
ttgaatgtcacaaattgat

SEQ ID NO: 1159040 - DNA, 23 bp, Homo sapiens
ttgaatgtcacaaattgatcaag

SEQ ID NO: 1159041 - DNA, 19 bp, Homo sapiens
ttgaatgtgagtgtgtatg

SEQ ID NO: 1159042 - DNA, 21 bp, Homo sapiens
ttgaatgtggcttgagaaata

SEQ ID NO: 1159043 - DNA, 13 bp, Homo sapiens
ttgaatgtgtcag

SEQ ID NO: 1159044 - DNA, 16 bp, Homo sapiens
ttgaatgttaagaatt

SEQ ID NO: 1159045 - DNA, 22 bp, Homo sapiens
ttgaattaaattaggaataaat

SEQ ID NO: 1159046 - DNA, 23 bp, Homo sapiens
ttgaattaatatccctacatgta

SEQ ID NO: 1159047 - DNA, 20 bp, Homo sapiens
ttgaattatcagcaaagaaa

SEQ ID NO: 1159048 - DNA, 18 bp, Homo sapiens
ttgaattatcttggttga

SEQ ID NO: 1159049 - DNA, 15 bp, Homo sapiens
ttgaattctggaaac

SEQ ID NO: 1159050 - DNA, 20 bp, Homo sapiens
ttgaattgaggggattaata

SEQ ID NO: 1159051 - DNA, 18 bp, Homo sapiens
ttgaattgtaactgttct

SEQ ID NO: 1159052 - DNA, 15 bp, Homo sapiens
ttgaatttaaataaa

SEQ ID NO: 1159053 - DNA, 17 bp, Homo sapiens
ttgaatttaaataaagt

SEQ ID NO: 1159054 - DNA, 23 bp, Homo sapiens
ttgaatttgcacggtttgtgaga

SEQ ID NO: 1159055 - DNA, 19 bp, Homo sapiens
ttgaatttgtattaaaaag

SEQ ID NO: 1159056 - DNA, 16 bp, Homo sapiens
ttgaattttaaatcta

SEQ ID NO: 1159057 - DNA, 22 bp, Homo sapiens
ttgaattttgttctctgggaga

SEQ ID NO: 1159058 - DNA, 16 bp, Homo sapiens
ttgaatttttcctatg

SEQ ID NO: 1159059 - DNA, 17 bp, Homo sapiens
ttgaattttttgaaatg

SEQ ID NO: 1159060 - DNA, 20 bp, Homo sapiens
ttgaattttttgaaatgggc

SEQ ID NO: 1159061 - DNA, 15 bp, Homo sapiens
ttgacaaaagtaaat

SEQ ID NO: 1159062 - DNA, 12 bp, Homo sapiens
ttgacaaaattt

SEQ ID NO: 1159063 - DNA, 17 bp, Homo sapiens
ttgacaaaattttctca

SEQ ID NO: 1159064 - DNA, 15 bp, Homo sapiens
ttgacaacagactga

SEQ ID NO: 1159065 - DNA, 14 bp, Homo sapiens
ttgacaacctagaa

SEQ ID NO: 1159066 - DNA, 14 bp, Homo sapiens
ttgacaagctgact

SEQ ID NO: 1159067 - DNA, 14 bp, Homo sapiens
ttgacaaggaaaat

SEQ ID NO: 1159068 - DNA, 13 bp, Homo sapiens
ttgacaataaaat

SEQ ID NO: 1159069 - DNA, 19 bp, Homo sapiens
ttgacaataaaatattatt

SEQ ID NO: 1159070 - DNA, 16 bp, Homo sapiens
ttgacaatcaaagaaa

SEQ ID NO: 1159071 - DNA, 15 bp, Homo sapiens
ttgacaattcctaga

SEQ ID NO: 1159072 - DNA, 14 bp, Homo sapiens
ttgacacaagtgga

SEQ ID NO: 1159073 - DNA, 19 bp, Homo sapiens
ttgacacaggtctttccta

SEQ ID NO: 1159074 - DNA, 11 bp, Homo sapiens
ttgacacatag

SEQ ID NO: 1159075 - DNA, 19 bp, Homo sapiens
ttgacacatatgaacacag

SEQ ID NO: 1159076 - DNA, 12 bp, Homo sapiens
ttgacacctgct

SEQ ID NO: 1159077 - DNA, 14 bp, Homo sapiens
ttgacaccttagag

SEQ ID NO: 1159078 - DNA, 17 bp, Homo sapiens
ttgacactaagaaaata

SEQ ID NO: 1159079 - DNA, 11 bp, Homo sapiens
ttgacactgaa

SEQ ID NO: 1159080 - DNA, 21 bp, Homo sapiens
ttgacactgaaagttttgtaa

SEQ ID NO: 1159081 - DNA, 15 bp, Homo sapiens
ttgacactgaaataa

SEQ ID NO: 1159082 - DNA, 16 bp, Homo sapiens
ttgacactgctctaac

SEQ ID NO: 1159083 - DNA, 16 bp, Homo sapiens
ttgacactgttttcct

SEQ ID NO: 1159084 - DNA, 16 bp, Homo sapiens
ttgacagcaaaatgtt

SEQ ID NO: 1159085 - DNA, 18 bp, Homo sapiens
ttgacaggtacttggagg

SEQ ID NO: 1159086 - DNA, 14 bp, Homo sapiens
ttgacagtatattt

SEQ ID NO: 1159087 - DNA, 15 bp, Homo sapiens
ttgacagtatatttg

SEQ ID NO: 1159088 - DNA, 14 bp, Homo sapiens
ttgacagtgttttt

SEQ ID NO: 1159089 - DNA, 17 bp, Homo sapiens
ttgacagttctgaagaa

SEQ ID NO: 1159090 - DNA, 15 bp, Homo sapiens
ttgacataaagttga

SEQ ID NO: 1159091 - DNA, 20 bp, Homo sapiens
ttgacatacctaccagtatt

SEQ ID NO: 1159092 - DNA, 16 bp, Homo sapiens
ttgacatatttaatgt

SEQ ID NO: 1159093 - DNA, 20 bp, Homo sapiens
ttgacatgaccctctgtccc

SEQ ID NO: 1159094 - DNA, 15 bp, Homo sapiens
ttgacatgggtgggg

SEQ ID NO: 1159095 - DNA, 16 bp, Homo sapiens
ttgacattctgaatgc

SEQ ID NO: 1159096 - DNA, 23 bp, Homo sapiens
ttgacattgaaatctaggaaaat

SEQ ID NO: 1159097 - DNA, 17 bp, Homo sapiens
ttgacatttacaggagg

SEQ ID NO: 1159098 - DNA, 15 bp, Homo sapiens
ttgacatttgtagtt

SEQ ID NO: 1159099 - DNA, 23 bp, Homo sapiens
ttgacattttctttttaaatttt

SEQ ID NO: 1159100 - DNA, 17 bp, Homo sapiens
ttgaccaagaactgcat

SEQ ID NO: 1159101 - DNA, 18 bp, Homo sapiens
ttgaccactccagagaag

SEQ ID NO: 1159102 - DNA, 18 bp, Homo sapiens
ttgaccagataaatagaa

SEQ ID NO: 1159103 - DNA, 15 bp, Homo sapiens
ttgaccagatctttc

SEQ ID NO: 1159104 - DNA, 19 bp, Homo sapiens
ttgaccccagtttcttctt

SEQ ID NO: 1159105 - DNA, 16 bp, Homo sapiens
ttgacccttgctgtga

SEQ ID NO: 1159106 - DNA, 18 bp, Homo sapiens
ttgacccttttttgaacc

SEQ ID NO: 1159107 - DNA, 20 bp, Homo sapiens
ttgaccgcgactaatttcaa

SEQ ID NO: 1159108 - DNA, 22 bp, Homo sapiens
ttgaccgtactctcacatgtgg

SEQ ID NO: 1159109 - DNA, 21 bp, Homo sapiens
ttgaccgttttcatcctggcc

SEQ ID NO: 1159110 - DNA, 22 bp, Homo sapiens
ttgaccgtttttatattacttt

SEQ ID NO: 1159111 - DNA, 14 bp, Homo sapiens
ttgacctctgcagc

SEQ ID NO: 1159112 - DNA, 18 bp, Homo sapiens
tagcttttaaaaaatatt

SEQ ID NO: 1159113 - DNA, 19 bp, Homo sapiens
tagcttttaaaaaatattt

SEQ ID NO: 1159114 - DNA, 14 bp, Homo sapiens
tagcttttccttcc

SEQ ID NO: 1159115 - DNA, 11 bp, Homo sapiens
tagcttttcta

SEQ ID NO: 1159116 - DNA, 22 bp, Homo sapiens
taggaaaaaattgaaagaactt

SEQ ID NO: 1159117 - DNA, 21 bp, Homo sapiens
taggaaaatcactttgtctaa

SEQ ID NO: 1159118 - DNA, 12 bp, Homo sapiens
taggaaaatgag

SEQ ID NO: 1159119 - DNA, 22 bp, Homo sapiens
taggaaaccccccaatgtctgt

SEQ ID NO: 1159120 - DNA, 16 bp, Homo sapiens
taggaaataaaacctt

SEQ ID NO: 1159121 - DNA, 20 bp, Homo sapiens
taggaaataaaacctttcaa

SEQ ID NO: 1159122 - DNA, 16 bp, Homo sapiens
taggaacatatgaaaa

SEQ ID NO: 1159123 - DNA, 14 bp, Homo sapiens
taggaacttcagag

SEQ ID NO: 1159124 - DNA, 12 bp, Homo sapiens
taggaagaaaga

SEQ ID NO: 1159125 - DNA, 16 bp, Homo sapiens
taggaagaaagatttg

SEQ ID NO: 1159126 - DNA, 14 bp, Homo sapiens
taggaagacataaa

SEQ ID NO: 1159127 - DNA, 17 bp, Homo sapiens
taggaagacataaaact

SEQ ID NO: 1159128 - DNA, 22 bp, Homo sapiens
taggaagacataaaactttaaa

SEQ ID NO: 1159129 - DNA, 21 bp, Homo sapiens
taggaagagcccgcagggcca

SEQ ID NO: 1159130 - DNA, 12 bp, Homo sapiens
taggaaggaaac

SEQ ID NO: 1159131 - DNA, 18 bp, Homo sapiens
taggaagggaccaaggca

SEQ ID NO: 1159132 - DNA, 17 bp, Homo sapiens
taggaagggatctgaga

SEQ ID NO: 1159133 - DNA, 18 bp, Homo sapiens
taggaagtggcagttctt

SEQ ID NO: 1159134 - DNA, 14 bp, Homo sapiens
taggaagtggctgg

SEQ ID NO: 1159135 - DNA, 17 bp, Homo sapiens
taggaagtgtaacagct

SEQ ID NO: 1159136 - DNA, 21 bp, Homo sapiens
taggaagtgtaacagctgagg

SEQ ID NO: 1159137 - DNA, 16 bp, Homo sapiens
taggaatagaggaaga

SEQ ID NO: 1159138 - DNA, 18 bp, Homo sapiens
taggaatagaggaagaaa

SEQ ID NO: 1159139 - DNA, 20 bp, Homo sapiens
taggaatcccagaggtggga

SEQ ID NO: 1159140 - DNA, 21 bp, Homo sapiens
taggaatcccagaggtgggat

SEQ ID NO: 1159141 - DNA, 22 bp, Homo sapiens
taggaatcctttgagaatgtga

SEQ ID NO: 1159142 - DNA, 16 bp, Homo sapiens
taggaatctcttcact

SEQ ID NO: 1159143 - DNA, 17 bp, Homo sapiens
taggaatctgccttcca

SEQ ID NO: 1159144 - DNA, 14 bp, Homo sapiens
taggaattcaattt

SEQ ID NO: 1159145 - DNA, 20 bp, Homo sapiens
taggaattcaatttggcaaa

SEQ ID NO: 1159146 - DNA, 17 bp, Homo sapiens
taggaattctttgcatt

SEQ ID NO: 1159147 - DNA, 19 bp, Homo sapiens
taggaattctttgcattcc

SEQ ID NO: 1159148 - DNA, 19 bp, Homo sapiens
taggaattcttttggggaa

SEQ ID NO: 1159149 - DNA, 19 bp, Homo sapiens
taggacacagttcctggga

SEQ ID NO: 1159150 - DNA, 20 bp, Homo sapiens
taggacataaattagaggtc

SEQ ID NO: 1159151 - DNA, 14 bp, Homo sapiens
taggacatcttaaa

SEQ ID NO: 1159152 - DNA, 14 bp, Homo sapiens
taggaccaagaaag

SEQ ID NO: 1159153 - DNA, 22 bp, Homo sapiens
taggaccaagcatcttgggggg

SEQ ID NO: 1159154 - DNA, 18 bp, Homo sapiens
taggacgccaacttctcc

SEQ ID NO: 1159155 - DNA, 14 bp, Homo sapiens
taggactaccgcag

SEQ ID NO: 1159156 - DNA, 20 bp, Homo sapiens
taggactccatttctttctt

SEQ ID NO: 1159157 - DNA, 13 bp, Homo sapiens
taggactgaggag

SEQ ID NO: 1159158 - DNA, 22 bp, Homo sapiens
taggagacagatcactcctgga

SEQ ID NO: 1159159 - DNA, 23 bp, Homo sapiens
taggagacagatcactcctggag

SEQ ID NO: 1159160 - DNA, 14 bp, Homo sapiens
taggagaccaaggc

SEQ ID NO: 1159161 - DNA, 21 bp, Homo sapiens
taggagaccaaggcgggagca

SEQ ID NO: 1159162 - DNA, 12 bp, Homo sapiens
taggagactgcg

SEQ ID NO: 1159163 - DNA, 14 bp, Homo sapiens
taggagagaccgag

SEQ ID NO: 1159164 - DNA, 14 bp, Homo sapiens
taggagagcactgc

SEQ ID NO: 1159165 - DNA, 16 bp, Homo sapiens
taggagagccaacctc

SEQ ID NO: 1159166 - DNA, 13 bp, Homo sapiens
taggagaggagaa

SEQ ID NO: 1159167 - DNA, 17 bp, Homo sapiens
taggagaggagaaccag

SEQ ID NO: 1159168 - DNA, 15 bp, Homo sapiens
taggagcccttctct

SEQ ID NO: 1159169 - DNA, 23 bp, Homo sapiens
taggagctcccctgtttgcatga

SEQ ID NO: 1159170 - DNA, 22 bp, Homo sapiens
taggaggaaaacacagcctccc

SEQ ID NO: 1159171 - DNA, 22 bp, Homo sapiens
taggaggaaacagttctcactg

SEQ ID NO: 1159172 - DNA, 20 bp, Homo sapiens
taggaggaccagagctactg

SEQ ID NO: 1159173 - DNA, 20 bp, Homo sapiens
taggaggctgcatgctctgg

SEQ ID NO: 1159174 - DNA, 16 bp, Homo sapiens
taggagggaaaccttt

SEQ ID NO: 1159175 - DNA, 14 bp, Homo sapiens
taggagggagactg

SEQ ID NO: 1159176 - DNA, 19 bp, Homo sapiens
taggagggagactgtggta

SEQ ID NO: 1159177 - DNA, 16 bp, Homo sapiens
taggagggagttatct

SEQ ID NO: 1159178 - DNA, 21 bp, Homo sapiens
taggagggagttatctaaaag

SEQ ID NO: 1159179 - DNA, 23 bp, Homo sapiens
taggagggggcggcagggctggg

SEQ ID NO: 1159180 - DNA, 17 bp, Homo sapiens
taggagtgagtgtatgt

SEQ ID NO: 1159181 - DNA, 18 bp, Homo sapiens
taggagtgtgtgacattc

SEQ ID NO: 1159182 - DNA, 20 bp, Homo sapiens
taggagtgtgtgacattcca

SEQ ID NO: 1159183 - DNA, 17 bp, Homo sapiens
taggagtgtgtgatttt

SEQ ID NO: 1159184 - DNA, 17 bp, Homo sapiens
taggagttcgagaccag

SEQ ID NO: 1159185 - DNA, 21 bp, Homo sapiens
taggagttcgagaccagcctg

SEQ ID NO: 1159186 - DNA, 13 bp, Homo sapiens
taggagttctctg

SEQ ID NO: 1159187 - DNA, 20 bp, Homo sapiens
taggagttctctgatgcaga

SEQ ID NO: 1159188 - DNA, 21 bp, Homo sapiens
taggagttctctgatgcagaa

SEQ ID NO: 1159189 - DNA, 21 bp, Homo sapiens
taggagttttgttccagagga

SEQ ID NO: 1159190 - DNA, 20 bp, Homo sapiens
taggataaaaagccagggct

SEQ ID NO: 1159191 - DNA, 22 bp, Homo sapiens
taggataaaaagccagggctgg

SEQ ID NO: 1159192 - DNA, 15 bp, Homo sapiens
taggatacaatgtat

SEQ ID NO: 1159193 - DNA, 18 bp, Homo sapiens
taggatagacactggaca

SEQ ID NO: 1159194 - DNA, 13 bp, Homo sapiens
taggatagcattt

SEQ ID NO: 1159195 - DNA, 19 bp, Homo sapiens
taggatagctaactgtaaa

SEQ ID NO: 1159196 - DNA, 19 bp, Homo sapiens
taggatatgtatattttaa

SEQ ID NO: 1159197 - DNA, 20 bp, Homo sapiens
taggatattgatttaaaatt

SEQ ID NO: 1159198 - DNA, 19 bp, Homo sapiens
taggatcagccctcatttt

SEQ ID NO: 1159199 - DNA, 20 bp, Homo sapiens
taggatcatttgttggaatg

SEQ ID NO: 1159200 - DNA, 13 bp, Homo sapiens
taggatcctggag

SEQ ID NO: 1159201 - DNA, 17 bp, Homo sapiens
taggatcctggaggctg

SEQ ID NO: 1159202 - DNA, 18 bp, Homo sapiens
taggatctgcaaacaatg

SEQ ID NO: 1159203 - DNA, 16 bp, Homo sapiens
taggatgactgctgtg

SEQ ID NO: 1159204 - DNA, 20 bp, Homo sapiens
taggatgcggctttctctgc

SEQ ID NO: 1159205 - DNA, 17 bp, Homo sapiens
taggatggggctcccag

SEQ ID NO: 1159206 - DNA, 18 bp, Homo sapiens
taggatggggctcccagc

SEQ ID NO: 1159207 - DNA, 21 bp, Homo sapiens
taggatgttgcttctgaatca

SEQ ID NO: 1159208 - DNA, 13 bp, Homo sapiens
taggattaaacac

SEQ ID NO: 1159209 - DNA, 18 bp, Homo sapiens
taggattccccctgccct

SEQ ID NO: 1159210 - DNA, 21 bp, Homo sapiens
taggattcccctcaatgcagt

SEQ ID NO: 1159211 - DNA, 14 bp, Homo sapiens
taggattgctgggg

SEQ ID NO: 1159212 - DNA, 12 bp, Homo sapiens
taggattgctgt

SEQ ID NO: 1159213 - DNA, 19 bp, Homo sapiens
taggattgcttcaattaaa

SEQ ID NO: 1159214 - DNA, 22 bp, Homo sapiens
taggatttaacagtcatttaaa

SEQ ID NO: 1159215 - DNA, 17 bp, Homo sapiens
taggatttatttaaaat

SEQ ID NO: 1159216 - DNA, 21 bp, Homo sapiens
taggatttatttaaaatagca

SEQ ID NO: 1159217 - DNA, 23 bp, Homo sapiens
taggattttaacttaactgaaat

SEQ ID NO: 1159218 - DNA, 13 bp, Homo sapiens
taggcaaagcaat

SEQ ID NO: 1159219 - DNA, 18 bp, Homo sapiens
taggcaaagtacaaaatt

SEQ ID NO: 1159220 - DNA, 20 bp, Homo sapiens
taggcaaagtacaaaattgc

SEQ ID NO: 1159221 - DNA, 19 bp, Homo sapiens
taggcaaggctatgtgatt

SEQ ID NO: 1159222 - DNA, 16 bp, Homo sapiens
taggcacgaagcaatt

SEQ ID NO: 1159223 - DNA, 14 bp, Homo sapiens
taggcactgaggga

SEQ ID NO: 1159224 - DNA, 16 bp, Homo sapiens
taggcactttaaaaca

SEQ ID NO: 1159225 - DNA, 21 bp, Homo sapiens
taggcacttttattttcattg

SEQ ID NO: 1159226 - DNA, 13 bp, Homo sapiens
taggcagaatgga

SEQ ID NO: 1159227 - DNA, 22 bp, Homo sapiens
taggcagacacagggacttgaa

SEQ ID NO: 1159228 - DNA, 12 bp, Homo sapiens
taggcagagcct

SEQ ID NO: 1159229 - DNA, 20 bp, Homo sapiens
taggcagattgaaaaggaca

SEQ ID NO: 1159230 - DNA, 19 bp, Homo sapiens
taggcagcctctctgctat

SEQ ID NO: 1159231 - DNA, 12 bp, Homo sapiens
taggcagcttct

SEQ ID NO: 1159232 - DNA, 22 bp, Homo sapiens
taggcaggaagcccaattgctg

SEQ ID NO: 1159233 - DNA, 14 bp, Homo sapiens
taggcagggggccc

SEQ ID NO: 1159234 - DNA, 16 bp, Homo sapiens
taggcagggggccctg

SEQ ID NO: 1159235 - DNA, 21 bp, Homo sapiens
taggcagggggccctgcccca

SEQ ID NO: 1159236 - DNA, 17 bp, Homo sapiens
taggcataaattaaaat

SEQ ID NO: 1159237 - DNA, 18 bp, Homo sapiens
taggcatacactgtagtt

SEQ ID NO: 1159238 - DNA, 16 bp, Homo sapiens
taggcatgtcccaccc

SEQ ID NO: 1159239 - DNA, 17 bp, Homo sapiens
taggcattatttaatgt

SEQ ID NO: 1159240 - DNA, 17 bp, Homo sapiens
taggcattgcaggacct

SEQ ID NO: 1159241 - DNA, 17 bp, Homo sapiens
taggcatttcctgctga

SEQ ID NO: 1159242 - DNA, 16 bp, Homo sapiens
taggcatttgctgaat

SEQ ID NO: 1159243 - DNA, 18 bp, Homo sapiens
taggcattttaagtaaaa

SEQ ID NO: 1159244 - DNA, 19 bp, Homo sapiens
taggccaccccctatcctc

SEQ ID NO: 1159245 - DNA, 15 bp, Homo sapiens
taggccactcctcca

SEQ ID NO: 1159246 - DNA, 23 bp, Homo sapiens
taggccagagccatgccaggctg

SEQ ID NO: 1159247 - DNA, 14 bp, Homo sapiens
taggccatctgtaa

SEQ ID NO: 1159248 - DNA, 14 bp, Homo sapiens
taggccatgaaaaa

SEQ ID NO: 1159249 - DNA, 23 bp, Homo sapiens
taggcccaaggtcccctccacat

SEQ ID NO: 1159250 - DNA, 12 bp, Homo sapiens
taggcccaggat

SEQ ID NO: 1159251 - DNA, 20 bp, Homo sapiens
taggcccattgtcctccttt

SEQ ID NO: 1159252 - DNA, 14 bp, Homo sapiens
taggcccccacttg

SEQ ID NO: 1159253 - DNA, 19 bp, Homo sapiens
taggcccccacttgcctct

SEQ ID NO: 1159254 - DNA, 22 bp, Homo sapiens
taggcctataaaattaaatgcc

SEQ ID NO: 1159255 - DNA, 23 bp, Homo sapiens
taggcctataaaattaaatgcct

SEQ ID NO: 1159256 - DNA, 18 bp, Homo sapiens
taggcctcagccagagaa

SEQ ID NO: 1159257 - DNA, 19 bp, Homo sapiens
taggcctcatttctttgtc

SEQ ID NO: 1159258 - DNA, 14 bp, Homo sapiens
taggcctctctgcc

SEQ ID NO: 1159259 - DNA, 16 bp, Homo sapiens
taggcctctctgcctg

SEQ ID NO: 1159260 - DNA, 19 bp, Homo sapiens
taggcctgggtgctggctg

SEQ ID NO: 1159261 - DNA, 20 bp, Homo sapiens
taggcctgggtgctggctgc

SEQ ID NO: 1159262 - DNA, 21 bp, Homo sapiens
taggccttcctctctccagat

SEQ ID NO: 1159263 - DNA, 15 bp, Homo sapiens
taggcgaccaccgcc

SEQ ID NO: 1159264 - DNA, 18 bp, Homo sapiens
taggcgagtgccaggact

SEQ ID NO: 1159265 - DNA, 17 bp, Homo sapiens
taggcggcgatttttgt

SEQ ID NO: 1159266 - DNA, 14 bp, Homo sapiens
taggcgggatgggc

SEQ ID NO: 1159267 - DNA, 13 bp, Homo sapiens
taggctaaatgtt

SEQ ID NO: 1159268 - DNA, 15 bp, Homo sapiens
taggctacaattttc

SEQ ID NO: 1159269 - DNA, 16 bp, Homo sapiens
taggctattaaaaaag

SEQ ID NO: 1159270 - DNA, 20 bp, Homo sapiens
taggctcttaagcagcatgg

SEQ ID NO: 1159271 - DNA, 15 bp, Homo sapiens
taggctgcaaaatta

SEQ ID NO: 1159272 - DNA, 21 bp, Homo sapiens
taggctggcaagataaacact

SEQ ID NO: 1159273 - DNA, 19 bp, Homo sapiens
taggctggtggcccaggac

SEQ ID NO: 1159274 - DNA, 16 bp, Homo sapiens
taggctggtggccttg

SEQ ID NO: 1159275 - DNA, 21 bp, Homo sapiens
taggctgtaactactttataa

SEQ ID NO: 1159276 - DNA, 17 bp, Homo sapiens
taggctgtctgtgccat

SEQ ID NO: 1159277 - DNA, 18 bp, Homo sapiens
taggctgtctgtgccatg

SEQ ID NO: 1159278 - DNA, 19 bp, Homo sapiens
taggctgtggggtctggct

SEQ ID NO: 1159279 - DNA, 20 bp, Homo sapiens
taggctgtggggtctggctg

SEQ ID NO: 1159280 - DNA, 17 bp, Homo sapiens
taggctgtggggtgggc

SEQ ID NO: 1159281 - DNA, 14 bp, Homo sapiens
taggctgttccctt

SEQ ID NO: 1159282 - DNA, 21 bp, Homo sapiens
taggctgttccctttgcctta

SEQ ID NO: 1159283 - DNA, 19 bp, Homo sapiens
tagggaaaaaccagcgtgt

SEQ ID NO: 1159284 - DNA, 21 bp, Homo sapiens
tagggaaaaaccagcgtgtga

SEQ ID NO: 1159285 - DNA, 18 bp, Homo sapiens
tagggaaaggttttgtat

SEQ ID NO: 1159286 - DNA, 16 bp, Homo sapiens
tagggaaataataggg

SEQ ID NO: 1159287 - DNA, 13 bp, Homo sapiens
tagggaaatgaaa

SEQ ID NO: 1159288 - DNA, 13 bp, Homo sapiens
tagggaacaattt

SEQ ID NO: 1159289 - DNA, 20 bp, Homo sapiens
tagggaagttgtctccttcc

SEQ ID NO: 1159290 - DNA, 16 bp, Homo sapiens
tagggaatctggatta

SEQ ID NO: 1159291 - DNA, 19 bp, Homo sapiens
tagggacaggaccccagct

SEQ ID NO: 1159292 - DNA, 18 bp, Homo sapiens
tagggacctcagaggttt

SEQ ID NO: 1159293 - DNA, 14 bp, Homo sapiens
tagggactatcagg

SEQ ID NO: 1159294 - DNA, 16 bp, Homo sapiens
tagggagaaatgttgt

SEQ ID NO: 1159295 - DNA, 13 bp, Homo sapiens
tagggagagggaa

SEQ ID NO: 1159296 - DNA, 20 bp, Homo sapiens
tagggagatgagttgcagtt

SEQ ID NO: 1159297 - DNA, 16 bp, Homo sapiens
tagggagcagatgact

SEQ ID NO: 1159298 - DNA, 17 bp, Homo sapiens
tagggagccatttgaga

SEQ ID NO: 1159299 - DNA, 22 bp, Homo sapiens
tagggaggaccttatctgtgcg

SEQ ID NO: 1159300 - DNA, 18 bp, Homo sapiens
tagggagtggttcctgtg

SEQ ID NO: 1159301 - DNA, 16 bp, Homo sapiens
tagggattcaggctgc

SEQ ID NO: 1159302 - DNA, 16 bp, Homo sapiens
tagggcactgggctgt

SEQ ID NO: 1159303 - DNA, 13 bp, Homo sapiens
tagggcagcttgc

SEQ ID NO: 1159304 - DNA, 14 bp, Homo sapiens
tagggccctggagg

SEQ ID NO: 1159305 - DNA, 16 bp, Homo sapiens
tagggccttttctgtg

SEQ ID NO: 1159306 - DNA, 17 bp, Homo sapiens
tagggctaaatgtttaa

SEQ ID NO: 1159307 - DNA, 20 bp, Homo sapiens
tagggctaaatgtttaaaga

SEQ ID NO: 1159308 - DNA, 21 bp, Homo sapiens
tagggctgctgcttctgctcc

SEQ ID NO: 1159309 - DNA, 23 bp, Homo sapiens
tagggctgctgcttctgctccag

SEQ ID NO: 1159310 - DNA, 12 bp, Homo sapiens
tagggctgggga

SEQ ID NO: 1159311 - DNA, 14 bp, Homo sapiens
tagggctgtaaaat

SEQ ID NO: 1159312 - DNA, 19 bp, Homo sapiens
tagggctgttgctagggag

SEQ ID NO: 1159313 - DNA, 12 bp, Homo sapiens
taggggaagggg

SEQ ID NO: 1159314 - DNA, 21 bp, Homo sapiens
taggggaggggggagggggaa

SEQ ID NO: 1159315 - DNA, 18 bp, Homo sapiens
taggggatggtccaggat

SEQ ID NO: 1159316 - DNA, 14 bp, Homo sapiens
taggggccacctcc

SEQ ID NO: 1159317 - DNA, 17 bp, Homo sapiens
taggggccacctcctcc

SEQ ID NO: 1159318 - DNA, 19 bp, Homo sapiens
taggggccacctcctcccc

SEQ ID NO: 1159319 - DNA, 20 bp, Homo sapiens
taggggccacctcctccccc

SEQ ID NO: 1159320 - DNA, 22 bp, Homo sapiens
taggggcttataataaaggact

SEQ ID NO: 1159321 - DNA, 22 bp, Homo sapiens
tagggggaaatgacctttttac

SEQ ID NO: 1159322 - DNA, 18 bp, Homo sapiens
tagggggacggggctgac

SEQ ID NO: 1159323 - DNA, 19 bp, Homo sapiens
tagggggccttgcggaagc

SEQ ID NO: 1159324 - DNA, 23 bp, Homo sapiens
tagggggccttgcggaagccata

SEQ ID NO: 1159325 - DNA, 15 bp, Homo sapiens
tagggggctttctgg

SEQ ID NO: 1159326 - DNA, 15 bp, Homo sapiens
tagggggtgtcagaa

SEQ ID NO: 1159327 - DNA, 22 bp, Homo sapiens
tagggtaaatcagtaagaggtg

SEQ ID NO: 1159328 - DNA, 17 bp, Homo sapiens
tagggtaagaagtttgt

SEQ ID NO: 1159329 - DNA, 23 bp, Homo sapiens
tagggtaagaagtttgtgtcttt

SEQ ID NO: 1159330 - DNA, 15 bp, Homo sapiens
tagggtaaggtgcct

SEQ ID NO: 1159331 - DNA, 18 bp, Homo sapiens
tagggtaaggtgccttct

SEQ ID NO: 1159332 - DNA, 13 bp, Homo sapiens
tagggtagaatga

SEQ ID NO: 1159333 - DNA, 18 bp, Homo sapiens
tagggtcagccattttta

SEQ ID NO: 1159334 - DNA, 15 bp, Homo sapiens
tagggtctcttcagg

SEQ ID NO: 1159335 - DNA, 22 bp, Homo sapiens
tagggtctgcagcctgctgggg

SEQ ID NO: 1159336 - DNA, 24 bp, Homo sapiens
tagggtctgcagcctgctggggct

SEQ ID NO: 1159337 - DNA, 23 bp, Homo sapiens
tagggtgctctgaggtcaataaa

SEQ ID NO: 1159338 - DNA, 12 bp, Homo sapiens
tagggtggccct

SEQ ID NO: 1159339 - DNA, 19 bp, Homo sapiens
tagggtgggtaagaaagcc

SEQ ID NO: 1159340 - DNA, 14 bp, Homo sapiens
tagggttaaatggt

SEQ ID NO: 1159341 - DNA, 15 bp, Homo sapiens
tagggttataataat

SEQ ID NO: 1159342 - DNA, 13 bp, Homo sapiens
tagggttatattt

SEQ ID NO: 1159343 - DNA, 17 bp, Homo sapiens
tagggttatatttggga

SEQ ID NO: 1159344 - DNA, 15 bp, Homo sapiens
tagggttctgcctct

SEQ ID NO: 1159345 - DNA, 21 bp, Homo sapiens
tagggttttttttaatgtgaa

SEQ ID NO: 1159346 - DNA, 19 bp, Homo sapiens
taggtaaatgtatttaatt

SEQ ID NO: 1159347 - DNA, 13 bp, Homo sapiens
taggtaacacatt

SEQ ID NO: 1159348 - DNA, 14 bp, Homo sapiens
taggtagaaactat

SEQ ID NO: 1159349 - DNA, 16 bp, Homo sapiens
taggtagactttgctt

SEQ ID NO: 1159350 - DNA, 16 bp, Homo sapiens
taggtagtttggatat

SEQ ID NO: 1159351 - DNA, 18 bp, Homo sapiens
taggtattgtctactctg

SEQ ID NO: 1159352 - DNA, 19 bp, Homo sapiens
taggtattgtctactctga

SEQ ID NO: 1159353 - DNA, 21 bp, Homo sapiens
taggtatttaagactgataat

SEQ ID NO: 1159354 - DNA, 11 bp, Homo sapiens
taggtattttg

SEQ ID NO: 1159355 - DNA, 19 bp, Homo sapiens
taggtcaagtaataaaaag

SEQ ID NO: 1159356 - DNA, 15 bp, Homo sapiens
taggtcactcctggg

SEQ ID NO: 1159357 - DNA, 14 bp, Homo sapiens
taggtcagtgaggc

SEQ ID NO: 1159358 - DNA, 15 bp, Homo sapiens
taggtcatgtctgta

SEQ ID NO: 1159359 - DNA, 15 bp, Homo sapiens
taggtcattgcacct

SEQ ID NO: 1159360 - DNA, 20 bp, Homo sapiens
taggtcattgcacctatctc

SEQ ID NO: 1159361 - DNA, 16 bp, Homo sapiens
ttgacctctgtgacca

SEQ ID NO: 1159362 - DNA, 19 bp, Homo sapiens
ttgacctgcattgtaaata

SEQ ID NO: 1159363 - DNA, 18 bp, Homo sapiens
ttgacctgtcctctttgt

SEQ ID NO: 1159364 - DNA, 20 bp, Homo sapiens
ttgaccttcatttcatgtat

SEQ ID NO: 1159365 - DNA, 15 bp, Homo sapiens
ttgacggatgattgg

SEQ ID NO: 1159366 - DNA, 23 bp, Homo sapiens
ttgacgtcactttttggccatgt

SEQ ID NO: 1159367 - DNA, 17 bp, Homo sapiens
ttgacgttgttgtcatt

SEQ ID NO: 1159368 - DNA, 23 bp, Homo sapiens
ttgacgttgttgtcattgtccag

SEQ ID NO: 1159369 - DNA, 14 bp, Homo sapiens
ttgactaattttac

SEQ ID NO: 1159370 - DNA, 23 bp, Homo sapiens
ttgactcaggatttaaaaactgg

SEQ ID NO: 1159371 - DNA, 16 bp, Homo sapiens
ttgactcatggcagct

SEQ ID NO: 1159372 - DNA, 16 bp, Homo sapiens
ttgactcccaagtttc

SEQ ID NO: 1159373 - DNA, 17 bp, Homo sapiens
ttgactcctttccaata

SEQ ID NO: 1159374 - DNA, 17 bp, Homo sapiens
ttgactctcacactgaa

SEQ ID NO: 1159375 - DNA, 19 bp, Homo sapiens
ttgactctggcaaagcttt

SEQ ID NO: 1159376 - DNA, 21 bp, Homo sapiens
ttgactctttcaaagaaatcc

SEQ ID NO: 1159377 - DNA, 18 bp, Homo sapiens
ttgactgcagttgaacag

SEQ ID NO: 1159378 - DNA, 23 bp, Homo sapiens
ttgactgggtttctctgtatagt

SEQ ID NO: 1159379 - DNA, 15 bp, Homo sapiens
ttgactgtacagaga

SEQ ID NO: 1159380 - DNA, 14 bp, Homo sapiens
ttgactgtcagcaa

SEQ ID NO: 1159381 - DNA, 19 bp, Homo sapiens
ttgactgtctagccactcc

SEQ ID NO: 1159382 - DNA, 17 bp, Homo sapiens
ttgacttagatattaaa

SEQ ID NO: 1159383 - DNA, 18 bp, Homo sapiens
ttgacttattaggacttt

SEQ ID NO: 1159384 - DNA, 15 bp, Homo sapiens
ttgacttattttctc

SEQ ID NO: 1159385 - DNA, 14 bp, Homo sapiens
ttgacttcttggtt

SEQ ID NO: 1159386 - DNA, 17 bp, Homo sapiens
ttgactttatctcctgc

SEQ ID NO: 1159387 - DNA, 15 bp, Homo sapiens
ttgactttcaggtac

SEQ ID NO: 1159388 - DNA, 15 bp, Homo sapiens
ttgactttctgattg

SEQ ID NO: 1159389 - DNA, 22 bp, Homo sapiens
ttgagaaaaatagagcaaaatc

SEQ ID NO: 1159390 - DNA, 16 bp, Homo sapiens
ttgagaaaatataata

SEQ ID NO: 1159391 - DNA, 19 bp, Homo sapiens
ttgagaaagagcacttaag

SEQ ID NO: 1159392 - DNA, 15 bp, Homo sapiens
ttgagaaatgaataa

SEQ ID NO: 1159393 - DNA, 17 bp, Homo sapiens
ttgagaaccagtctcct

SEQ ID NO: 1159394 - DNA, 13 bp, Homo sapiens
ttgagaactgaca

SEQ ID NO: 1159395 - DNA, 20 bp, Homo sapiens
ttgagaactgcttctaagat

SEQ ID NO: 1159396 - DNA, 18 bp, Homo sapiens
ttgagaagcacaactgaa

SEQ ID NO: 1159397 - DNA, 23 bp, Homo sapiens
ttgagaagccttcagctccaggg

SEQ ID NO: 1159398 - DNA, 19 bp, Homo sapiens
ttgagaaggaaaattttag

SEQ ID NO: 1159399 - DNA, 19 bp, Homo sapiens
ttgagaataagaatttgag

SEQ ID NO: 1159400 - DNA, 17 bp, Homo sapiens
ttgagaatcaggttgca

SEQ ID NO: 1159401 - DNA, 23 bp, Homo sapiens
ttgagaatcccaaatttgattga

SEQ ID NO: 1159402 - DNA, 14 bp, Homo sapiens
ttgagacaatgttt

SEQ ID NO: 1159403 - DNA, 13 bp, Homo sapiens
ttgagaccagcct

SEQ ID NO: 1159404 - DNA, 15 bp, Homo sapiens
ttgagaccagcctgg

SEQ ID NO: 1159405 - DNA, 18 bp, Homo sapiens
ttgagacctacaggctga

SEQ ID NO: 1159406 - DNA, 17 bp, Homo sapiens
ttgagactcaaaaaaac

SEQ ID NO: 1159407 - DNA, 15 bp, Homo sapiens
ttgagactgaaattt

SEQ ID NO: 1159408 - DNA, 13 bp, Homo sapiens
ttgagacttaaaa

SEQ ID NO: 1159409 - DNA, 23 bp, Homo sapiens
ttgagagaaatatgaagaactga

SEQ ID NO: 1159410 - DNA, 13 bp, Homo sapiens
ttgagagaagcca

SEQ ID NO: 1159411 - DNA, 12 bp, Homo sapiens
ttgagagccagt

SEQ ID NO: 1159412 - DNA, 16 bp, Homo sapiens
ttgagagcttggcctt

SEQ ID NO: 1159413 - DNA, 14 bp, Homo sapiens
ttgagagctttctg

SEQ ID NO: 1159414 - DNA, 16 bp, Homo sapiens
ttgagagttcacagaa

SEQ ID NO: 1159415 - DNA, 15 bp, Homo sapiens
ttgagatactatttt

SEQ ID NO: 1159416 - DNA, 19 bp, Homo sapiens
ttgagatactattttcatt

SEQ ID NO: 1159417 - DNA, 15 bp, Homo sapiens
ttgagatcagcctgg

SEQ ID NO: 1159418 - DNA, 16 bp, Homo sapiens
ttgagatcagcctggg

SEQ ID NO: 1159419 - DNA, 15 bp, Homo sapiens
ttgagatctgtataa

SEQ ID NO: 1159420 - DNA, 12 bp, Homo sapiens
ttgagatgagtt

SEQ ID NO: 1159421 - DNA, 17 bp, Homo sapiens
ttgagatggtgaggctg

SEQ ID NO: 1159422 - DNA, 13 bp, Homo sapiens
ttgagatgtatga

SEQ ID NO: 1159423 - DNA, 17 bp, Homo sapiens
ttgagatttttaagaac

SEQ ID NO: 1159424 - DNA, 18 bp, Homo sapiens
ttgagatttttaagaact

SEQ ID NO: 1159425 - DNA, 19 bp, Homo sapiens
ttgagatttttttttctct

SEQ ID NO: 1159426 - DNA, 18 bp, Homo sapiens
ttgagcagggatcctggt

SEQ ID NO: 1159427 - DNA, 21 bp, Homo sapiens
ttgagcagtggcctacaaatc

SEQ ID NO: 1159428 - DNA, 13 bp, Homo sapiens
ttgagcatatttt

SEQ ID NO: 1159429 - DNA, 19 bp, Homo sapiens
ttgagcatattttcttact

SEQ ID NO: 1159430 - DNA, 16 bp, Homo sapiens
ttgagcatcaatcttg

SEQ ID NO: 1159431 - DNA, 17 bp, Homo sapiens
ttgagcatcaatcttgt

SEQ ID NO: 1159432 - DNA, 21 bp, Homo sapiens
ttgagcatgacagcctgcagc

SEQ ID NO: 1159433 - DNA, 12 bp, Homo sapiens
ttgagccacagt

SEQ ID NO: 1159434 - DNA, 20 bp, Homo sapiens
ttgagccactccttccttca

SEQ ID NO: 1159435 - DNA, 15 bp, Homo sapiens
ttgagccaggtggat

SEQ ID NO: 1159436 - DNA, 14 bp, Homo sapiens
ttgagccccaagtc

SEQ ID NO: 1159437 - DNA, 18 bp, Homo sapiens
ttgagccccaagtcctga

SEQ ID NO: 1159438 - DNA, 23 bp, Homo sapiens
ttgagccccaagtcctgaagagg

SEQ ID NO: 1159439 - DNA, 13 bp, Homo sapiens
ttgagccctggct

SEQ ID NO: 1159440 - DNA, 18 bp, Homo sapiens
ttgagcctggctgtccaa

SEQ ID NO: 1159441 - DNA, 16 bp, Homo sapiens
ttgagccttgaacttt

SEQ ID NO: 1159442 - DNA, 22 bp, Homo sapiens
ttgagcctttattggtaaattc

SEQ ID NO: 1159443 - DNA, 19 bp, Homo sapiens
ttgagctactggattctta

SEQ ID NO: 1159444 - DNA, 22 bp, Homo sapiens
ttgagctgaaatgctgcatttt

SEQ ID NO: 1159445 - DNA, 14 bp, Homo sapiens
ttgagctgagatgg

SEQ ID NO: 1159446 - DNA, 11 bp, Homo sapiens
ttgagctgcct

SEQ ID NO: 1159447 - DNA, 13 bp, Homo sapiens
ttgagctgccttc

SEQ ID NO: 1159448 - DNA, 14 bp, Homo sapiens
ttgagctgccttcc

SEQ ID NO: 1159449 - DNA, 19 bp, Homo sapiens
ttgagctgccttccctagc

SEQ ID NO: 1159450 - DNA, 21 bp, Homo sapiens
ttgagctgttgcctcagtccc

SEQ ID NO: 1159451 - DNA, 18 bp, Homo sapiens
ttgagctgttttccctga

SEQ ID NO: 1159452 - DNA, 18 bp, Homo sapiens
ttgaggaagcccaggctc

SEQ ID NO: 1159453 - DNA, 17 bp, Homo sapiens
ttgaggaagctctccct

SEQ ID NO: 1159454 - DNA, 17 bp, Homo sapiens
ttgaggaagttttgtct

SEQ ID NO: 1159455 - DNA, 19 bp, Homo sapiens
ttgaggaagttttgtctaa

SEQ ID NO: 1159456 - DNA, 13 bp, Homo sapiens
ttgaggacttctt

SEQ ID NO: 1159457 - DNA, 15 bp, Homo sapiens
ttgaggacttcttgc

SEQ ID NO: 1159458 - DNA, 12 bp, Homo sapiens
ttgaggagcccc

SEQ ID NO: 1159459 - DNA, 21 bp, Homo sapiens
ttgaggatatattttcacttt

SEQ ID NO: 1159460 - DNA, 15 bp, Homo sapiens
ttgaggattgtggaa

SEQ ID NO: 1159461 - DNA, 17 bp, Homo sapiens
ttgaggattgtggaaaa

SEQ ID NO: 1159462 - DNA, 18 bp, Homo sapiens
ttgaggcaaattaactgt

SEQ ID NO: 1159463 - DNA, 19 bp, Homo sapiens
ttgaggcaaattaactgta

SEQ ID NO: 1159464 - DNA, 13 bp, Homo sapiens
ttgaggcaagtgt

SEQ ID NO: 1159465 - DNA, 19 bp, Homo sapiens
ttgagggaaggttcttcat

SEQ ID NO: 1159466 - DNA, 11 bp, Homo sapiens
ttgagggaggg

SEQ ID NO: 1159467 - DNA, 13 bp, Homo sapiens
ttgagggatgctg

SEQ ID NO: 1159468 - DNA, 16 bp, Homo sapiens
ttgagggcaagccacc

SEQ ID NO: 1159469 - DNA, 21 bp, Homo sapiens
ttgagggccagtgatgatgtt

SEQ ID NO: 1159470 - DNA, 14 bp, Homo sapiens
ttgagggctgcagt

SEQ ID NO: 1159471 - DNA, 22 bp, Homo sapiens
ttgaggggattaatatgaaaac

SEQ ID NO: 1159472 - DNA, 13 bp, Homo sapiens
ttgaggggccagg

SEQ ID NO: 1159473 - DNA, 15 bp, Homo sapiens
ttgaggggctcctgg

SEQ ID NO: 1159474 - DNA, 16 bp, Homo sapiens
ttgaggggctcctgga

SEQ ID NO: 1159475 - DNA, 13 bp, Homo sapiens
ttgagggtaggag

SEQ ID NO: 1159476 - DNA, 21 bp, Homo sapiens
ttgaggtaccagttgtattta

SEQ ID NO: 1159477 - DNA, 17 bp, Homo sapiens
ttgaggtctgctcggcc

SEQ ID NO: 1159478 - DNA, 16 bp, Homo sapiens
ttgaggtctgttcttt

SEQ ID NO: 1159479 - DNA, 23 bp, Homo sapiens
ttgaggtcttttgacatgtggaa

SEQ ID NO: 1159480 - DNA, 19 bp, Homo sapiens
ttgaggtgggtgggcctga

SEQ ID NO: 1159481 - DNA, 21 bp, Homo sapiens
ttgaggtgggtgggcctgact

SEQ ID NO: 1159482 - DNA, 19 bp, Homo sapiens
ttgaggtttgaaaagctga

SEQ ID NO: 1159483 - DNA, 22 bp, Homo sapiens
ttgaggtttttaaatatatatt

SEQ ID NO: 1159484 - DNA, 13 bp, Homo sapiens
ttgagtaaaaagg

SEQ ID NO: 1159485 - DNA, 16 bp, Homo sapiens
ttgagtaatggtgtag

SEQ ID NO: 1159486 - DNA, 15 bp, Homo sapiens
taggtccaagggcca

SEQ ID NO: 1159487 - DNA, 21 bp, Homo sapiens
taggtccagatccgctccagc

SEQ ID NO: 1159488 - DNA, 16 bp, Homo sapiens
taggtctcatctcttc

SEQ ID NO: 1159489 - DNA, 12 bp, Homo sapiens
taggtctccagt

SEQ ID NO: 1159490 - DNA, 20 bp, Homo sapiens
taggtctcctcagggtgggg

SEQ ID NO: 1159491 - DNA, 19 bp, Homo sapiens
taggtctcttctcccagaa

SEQ ID NO: 1159492 - DNA, 18 bp, Homo sapiens
taggtctgaaatttttct

SEQ ID NO: 1159493 - DNA, 12 bp, Homo sapiens
taggtctggttg

SEQ ID NO: 1159494 - DNA, 21 bp, Homo sapiens
taggtgaagggatgggggaag

SEQ ID NO: 1159495 - DNA, 22 bp, Homo sapiens
taggtgaagggatgggggaaga

SEQ ID NO: 1159496 - DNA, 18 bp, Homo sapiens
taggtggccgctcctccc

SEQ ID NO: 1159497 - DNA, 19 bp, Homo sapiens
taggtgggccagcccctcc

SEQ ID NO: 1159498 - DNA, 20 bp, Homo sapiens
taggtgggccagcccctccc

SEQ ID NO: 1159499 - DNA, 17 bp, Homo sapiens
taggtgggtaggagccc

SEQ ID NO: 1159500 - DNA, 22 bp, Homo sapiens
taggtgggtaggagcccttctc

SEQ ID NO: 1159501 - DNA, 23 bp, Homo sapiens
taggtgggtaggagcccttctct

SEQ ID NO: 1159502 - DNA, 19 bp, Homo sapiens
taggtgtaaatgagaagac

SEQ ID NO: 1159503 - DNA, 18 bp, Homo sapiens
taggtgtctctgggcctg

SEQ ID NO: 1159504 - DNA, 21 bp, Homo sapiens
taggtgtctgccttcacaaat

SEQ ID NO: 1159505 - DNA, 22 bp, Homo sapiens
taggtgtctgccttcacaaatg

SEQ ID NO: 1159506 - DNA, 23 bp, Homo sapiens
taggtgtgactgaatttcttttg

SEQ ID NO: 1159507 - DNA, 22 bp, Homo sapiens
taggtgtgatttcctaatatga

SEQ ID NO: 1159508 - DNA, 22 bp, Homo sapiens
taggtgttaggcatgtcccacc

SEQ ID NO: 1159509 - DNA, 17 bp, Homo sapiens
taggtgttcaggccagt

SEQ ID NO: 1159510 - DNA, 22 bp, Homo sapiens
taggtgttgattttctgttgta

SEQ ID NO: 1159511 - DNA, 13 bp, Homo sapiens
taggttaaagcta

SEQ ID NO: 1159512 - DNA, 15 bp, Homo sapiens
taggttaaaggccag

SEQ ID NO: 1159513 - DNA, 12 bp, Homo sapiens
taggttatacaa

SEQ ID NO: 1159514 - DNA, 15 bp, Homo sapiens
taggttatacaataa

SEQ ID NO: 1159515 - DNA, 21 bp, Homo sapiens
taggttatacaataacccagt

SEQ ID NO: 1159516 - DNA, 18 bp, Homo sapiens
taggttatctttttaaaa

SEQ ID NO: 1159517 - DNA, 15 bp, Homo sapiens
taggttatttaaaat

SEQ ID NO: 1159518 - DNA, 15 bp, Homo sapiens
taggttcagccaagg

SEQ ID NO: 1159519 - DNA, 15 bp, Homo sapiens
taggttccccagaga

SEQ ID NO: 1159520 - DNA, 23 bp, Homo sapiens
taggttccccagagagcaggcag

SEQ ID NO: 1159521 - DNA, 17 bp, Homo sapiens
taggttccctgttcttc

SEQ ID NO: 1159522 - DNA, 12 bp, Homo sapiens
taggttctaaaa

SEQ ID NO: 1159523 - DNA, 12 bp, Homo sapiens
taggttcttctt

SEQ ID NO: 1159524 - DNA, 20 bp, Homo sapiens
taggttgccaataatacact

SEQ ID NO: 1159525 - DNA, 12 bp, Homo sapiens
taggtttctctc

SEQ ID NO: 1159526 - DNA, 21 bp, Homo sapiens
taggtttgtcccagtcagaaa

SEQ ID NO: 1159527 - DNA, 21 bp, Homo sapiens
taggtttttccttatttgctt

SEQ ID NO: 1159528 - DNA, 15 bp, Homo sapiens
taggtttttgtttgt

SEQ ID NO: 1159529 - DNA, 15 bp, Homo sapiens
taggtttttttgtat

SEQ ID NO: 1159530 - DNA, 18 bp, Homo sapiens
tagtaaaaccttgttcta

SEQ ID NO: 1159531 - DNA, 23 bp, Homo sapiens
tagtaaaagtggtctctgctggg

SEQ ID NO: 1159532 - DNA, 13 bp, Homo sapiens
tagtaaatatgtg

SEQ ID NO: 1159533 - DNA, 18 bp, Homo sapiens
tagtaaatatgtgaagaa

SEQ ID NO: 1159534 - DNA, 22 bp, Homo sapiens
tagtaaatcacgctttttgaaa

SEQ ID NO: 1159535 - DNA, 16 bp, Homo sapiens
tagtaaatcagaaagt

SEQ ID NO: 1159536 - DNA, 20 bp, Homo sapiens
tagtaagaattctggtgttt

SEQ ID NO: 1159537 - DNA, 23 bp, Homo sapiens
tagtaagaattctggtgtttaca

SEQ ID NO: 1159538 - DNA, 20 bp, Homo sapiens
tagtaagtttttcttcatga

SEQ ID NO: 1159539 - DNA, 17 bp, Homo sapiens
tagtaatagtccaatat

SEQ ID NO: 1159540 - DNA, 20 bp, Homo sapiens
tagtaatagtccaatatttg

SEQ ID NO: 1159541 - DNA, 14 bp, Homo sapiens
tagtaattgacatg

SEQ ID NO: 1159542 - DNA, 13 bp, Homo sapiens
tagtaatttccta

SEQ ID NO: 1159543 - DNA, 16 bp, Homo sapiens
tagtaccatttataca

SEQ ID NO: 1159544 - DNA, 22 bp, Homo sapiens
tagtactagagatattttgtaa

SEQ ID NO: 1159545 - DNA, 17 bp, Homo sapiens
tagtactcctgcaaaat

SEQ ID NO: 1159546 - DNA, 20 bp, Homo sapiens
tagtactcctgcaaaatttt

SEQ ID NO: 1159547 - DNA, 17 bp, Homo sapiens
tagtactctctgctcta

SEQ ID NO: 1159548 - DNA, 16 bp, Homo sapiens
tagtactgtattggct

SEQ ID NO: 1159549 - DNA, 22 bp, Homo sapiens
tagtacttgaaatctaggatta

SEQ ID NO: 1159550 - DNA, 22 bp, Homo sapiens
tagtagaaagacatctgcctgt

SEQ ID NO: 1159551 - DNA, 19 bp, Homo sapiens
tagtagaaattttacaata

SEQ ID NO: 1159552 - DNA, 16 bp, Homo sapiens
tagtagaactggatcc

SEQ ID NO: 1159553 - DNA, 14 bp, Homo sapiens
tagtagattaaaaa

SEQ ID NO: 1159554 - DNA, 19 bp, Homo sapiens
tagtagcaatgtgccttga

SEQ ID NO: 1159555 - DNA, 20 bp, Homo sapiens
tagtagcagtgattgtctta

SEQ ID NO: 1159556 - DNA, 11 bp, Homo sapiens
tagtagcattt

SEQ ID NO: 1159557 - DNA, 19 bp, Homo sapiens
tagtagcgttttttaaatg

SEQ ID NO: 1159558 - DNA, 17 bp, Homo sapiens
tagtaggggttgaagaa

SEQ ID NO: 1159559 - DNA, 21 bp, Homo sapiens
tagtaggggttgaagaaaaca

SEQ ID NO: 1159560 - DNA, 19 bp, Homo sapiens
tagtagttcctgctacaac

SEQ ID NO: 1159561 - DNA, 14 bp, Homo sapiens
tagtagtttttaca

SEQ ID NO: 1159562 - DNA, 16 bp, Homo sapiens
tagtagtttttacaaa

SEQ ID NO: 1159563 - DNA, 19 bp, Homo sapiens
tagtatagaagtctggaaa

SEQ ID NO: 1159564 - DNA, 21 bp, Homo sapiens
tagtatagaagtctggaaaaa

SEQ ID NO: 1159565 - DNA, 14 bp, Homo sapiens
tagtatctaacatg

SEQ ID NO: 1159566 - DNA, 19 bp, Homo sapiens
tagtatctagcaatcacaa

SEQ ID NO: 1159567 - DNA, 17 bp, Homo sapiens
tagtatgaggcatttgt

SEQ ID NO: 1159568 - DNA, 19 bp, Homo sapiens
tagtatgttcaactctcat

SEQ ID NO: 1159569 - DNA, 16 bp, Homo sapiens
tagtattaaaagttgc

SEQ ID NO: 1159570 - DNA, 19 bp, Homo sapiens
tagtattgctgaactctta

SEQ ID NO: 1159571 - DNA, 21 bp, Homo sapiens
tagtattgttgtccttttcat

SEQ ID NO: 1159572 - DNA, 20 bp, Homo sapiens
tagtatttaactacatctgc

SEQ ID NO: 1159573 - DNA, 14 bp, Homo sapiens
tagtatttctcagg

SEQ ID NO: 1159574 - DNA, 9 bp, Homo sapiens
tagtatttt

SEQ ID NO: 1159575 - DNA, 19 bp, Homo sapiens
tagtcaaaaacaaagctga

SEQ ID NO: 1159576 - DNA, 15 bp, Homo sapiens
tagtcaagattgtgt

SEQ ID NO: 1159577 - DNA, 15 bp, Homo sapiens
tagtcaagctcctcc

SEQ ID NO: 1159578 - DNA, 15 bp, Homo sapiens
tagtcaataaaatga

SEQ ID NO: 1159579 - DNA, 18 bp, Homo sapiens
tagtcaccgacagcggcc

SEQ ID NO: 1159580 - DNA, 23 bp, Homo sapiens
tagtcactgcctgcagaggtctg

SEQ ID NO: 1159581 - DNA, 15 bp, Homo sapiens
tagtcactgctgcta

SEQ ID NO: 1159582 - DNA, 22 bp, Homo sapiens
tagtcagaagcaggttcttgat

SEQ ID NO: 1159583 - DNA, 19 bp, Homo sapiens
tagtcagactgacactact

SEQ ID NO: 1159584 - DNA, 13 bp, Homo sapiens
tagtcagctgcct

SEQ ID NO: 1159585 - DNA, 23 bp, Homo sapiens
tagtcagggcacagctgccctgc

SEQ ID NO: 1159586 - DNA, 15 bp, Homo sapiens
tagtcatgtttatct

SEQ ID NO: 1159587 - DNA, 18 bp, Homo sapiens
tagtcattccaaatatga

SEQ ID NO: 1159588 - DNA, 16 bp, Homo sapiens
tagtccaatatttggc

SEQ ID NO: 1159589 - DNA, 18 bp, Homo sapiens
tagtccaatttttactca

SEQ ID NO: 1159590 - DNA, 21 bp, Homo sapiens
tagtcccagctactcagaagc

SEQ ID NO: 1159591 - DNA, 22 bp, Homo sapiens
tagtccccccagctctaagcag

SEQ ID NO: 1159592 - DNA, 14 bp, Homo sapiens
tagtcccttcccct

SEQ ID NO: 1159593 - DNA, 22 bp, Homo sapiens
tagtcccttcccctccctggct

SEQ ID NO: 1159594 - DNA, 23 bp, Homo sapiens
tagtccgtgctgacagctgctcc

SEQ ID NO: 1159595 - DNA, 16 bp, Homo sapiens
tagtcctatggaaaaa

SEQ ID NO: 1159596 - DNA, 14 bp, Homo sapiens
tagtcctattctat

SEQ ID NO: 1159597 - DNA, 16 bp, Homo sapiens
tagtcctggcagctgg

SEQ ID NO: 1159598 - DNA, 14 bp, Homo sapiens
tagtctattagcca

SEQ ID NO: 1159599 - DNA, 19 bp, Homo sapiens
tagtctcactgcttgaact

SEQ ID NO: 1159600 - DNA, 15 bp, Homo sapiens
tagtctcagtgaaga

SEQ ID NO: 1159601 - DNA, 18 bp, Homo sapiens
tagtctcagtgaagacta

SEQ ID NO: 1159602 - DNA, 18 bp, Homo sapiens
tagtctcctttgcactga

SEQ ID NO: 1159603 - DNA, 18 bp, Homo sapiens
tagtctctttaaaaggaa

SEQ ID NO: 1159604 - DNA, 19 bp, Homo sapiens
tagtctgagcttctttagc

SEQ ID NO: 1159605 - DNA, 18 bp, Homo sapiens
tagtctgtcagggccttg

SEQ ID NO: 1159606 - DNA, 13 bp, Homo sapiens
tagtctgtgtaac

SEQ ID NO: 1159607 - DNA, 13 bp, Homo sapiens
tagtcttacctaa

SEQ ID NO: 1159608 - DNA, 16 bp, Homo sapiens
tagtcttatgtaaagt

SEQ ID NO: 1159609 - DNA, 22 bp, Homo sapiens
tagtcttccacaaaaaatactt

SEQ ID NO: 1159610 - DNA, 21 bp, Homo sapiens
ttgagtaatggtgtagaacac

SEQ ID NO: 1159611 - DNA, 18 bp, Homo sapiens
ttgagtaggtaccttgta

SEQ ID NO: 1159612 - DNA, 14 bp, Homo sapiens
ttgagtatcacttt

SEQ ID NO: 1159613 - DNA, 13 bp, Homo sapiens
ttgagtctcaagg

SEQ ID NO: 1159614 - DNA, 11 bp, Homo sapiens
ttgagtctctt

SEQ ID NO: 1159615 - DNA, 17 bp, Homo sapiens
ttgagtctcttttttat

SEQ ID NO: 1159616 - DNA, 14 bp, Homo sapiens
ttgagtctgtgcca

SEQ ID NO: 1159617 - DNA, 16 bp, Homo sapiens
ttgagtgcactaaaca

SEQ ID NO: 1159618 - DNA, 15 bp, Homo sapiens
ttgagtgcactgact

SEQ ID NO: 1159619 - DNA, 19 bp, Homo sapiens
ttgagtggatgatgtttcg

SEQ ID NO: 1159620 - DNA, 15 bp, Homo sapiens
ttgagtgggccctgc

SEQ ID NO: 1159621 - DNA, 20 bp, Homo sapiens
ttgagtgtatacatgtgtgg

SEQ ID NO: 1159622 - DNA, 13 bp, Homo sapiens
ttgagtgtatata

SEQ ID NO: 1159623 - DNA, 16 bp, Homo sapiens
ttgagtgtatatatat

SEQ ID NO: 1159624 - DNA, 13 bp, Homo sapiens
ttgagttcctcct

SEQ ID NO: 1159625 - DNA, 23 bp, Homo sapiens
ttgagttcttcctgtaatcttgt

SEQ ID NO: 1159626 - DNA, 17 bp, Homo sapiens
ttgagttggctgtgttc

SEQ ID NO: 1159627 - DNA, 18 bp, Homo sapiens
ttgagtttataattcagg

SEQ ID NO: 1159628 - DNA, 17 bp, Homo sapiens
ttgagtttattctgatt

SEQ ID NO: 1159629 - DNA, 23 bp, Homo sapiens
ttgagtttgtcgctcatgtgtgc

SEQ ID NO: 1159630 - DNA, 17 bp, Homo sapiens
ttgagtttttcctccca

SEQ ID NO: 1159631 - DNA, 14 bp, Homo sapiens
ttgataaaatgtaa

SEQ ID NO: 1159632 - DNA, 14 bp, Homo sapiens
ttgataaagatttt

SEQ ID NO: 1159633 - DNA, 17 bp, Homo sapiens
ttgataaagatttttta

SEQ ID NO: 1159634 - DNA, 20 bp, Homo sapiens
ttgataaagattttttaata

SEQ ID NO: 1159635 - DNA, 22 bp, Homo sapiens
ttgataaagattttttaataat

SEQ ID NO: 1159636 - DNA, 20 bp, Homo sapiens
ttgataaatatatatgatca

SEQ ID NO: 1159637 - DNA, 21 bp, Homo sapiens
ttgataaattccactggactt

SEQ ID NO: 1159638 - DNA, 18 bp, Homo sapiens
ttgataaccttgaaaaaa

SEQ ID NO: 1159639 - DNA, 18 bp, Homo sapiens
ttgataatattagtgatt

SEQ ID NO: 1159640 - DNA, 13 bp, Homo sapiens
ttgataatcttca

SEQ ID NO: 1159641 - DNA, 14 bp, Homo sapiens
ttgataatcttcag

SEQ ID NO: 1159642 - DNA, 22 bp, Homo sapiens
ttgataatcttcaggtgaacac

SEQ ID NO: 1159643 - DNA, 23 bp, Homo sapiens
ttgataatttcagggaaattaat

SEQ ID NO: 1159644 - DNA, 13 bp, Homo sapiens
ttgatacccccct

SEQ ID NO: 1159645 - DNA, 17 bp, Homo sapiens
ttgatactacagtttgt

SEQ ID NO: 1159646 - DNA, 17 bp, Homo sapiens
ttgatagttctataaga

SEQ ID NO: 1159647 - DNA, 20 bp, Homo sapiens
ttgatatctcaatctgcagc

SEQ ID NO: 1159648 - DNA, 22 bp, Homo sapiens
ttgatatctcaatctgcagcca

SEQ ID NO: 1159649 - DNA, 15 bp, Homo sapiens
ttgatatgactgttt

SEQ ID NO: 1159650 - DNA, 15 bp, Homo sapiens
ttgatattgtttgct

SEQ ID NO: 1159651 - DNA, 18 bp, Homo sapiens
ttgatattgtttgctgtt

SEQ ID NO: 1159652 - DNA, 22 bp, Homo sapiens
ttgatattttcaacgcagccct

SEQ ID NO: 1159653 - DNA, 17 bp, Homo sapiens
ttgatcaaattcatttt

SEQ ID NO: 1159654 - DNA, 12 bp, Homo sapiens
ttgatcagaatc

SEQ ID NO: 1159655 - DNA, 17 bp, Homo sapiens
ttgatcagatgctgaat

SEQ ID NO: 1159656 - DNA, 20 bp, Homo sapiens
ttgatcagccccaccctggc

SEQ ID NO: 1159657 - DNA, 20 bp, Homo sapiens
ttgatcatccctttctccca

SEQ ID NO: 1159658 - DNA, 20 bp, Homo sapiens
ttgatccagaagagcccata

SEQ ID NO: 1159659 - DNA, 20 bp, Homo sapiens
ttgatcccacttcactgtga

SEQ ID NO: 1159660 - DNA, 21 bp, Homo sapiens
ttgatccctgttacccagaga

SEQ ID NO: 1159661 - DNA, 12 bp, Homo sapiens
ttgatccttgga

SEQ ID NO: 1159662 - DNA, 20 bp, Homo sapiens
ttgatcctttgatcccagaa

SEQ ID NO: 1159663 - DNA, 19 bp, Homo sapiens
ttgatcgcctttcccaggt

SEQ ID NO: 1159664 - DNA, 14 bp, Homo sapiens
ttgatctctaatga

SEQ ID NO: 1159665 - DNA, 17 bp, Homo sapiens
ttgatctcttagaagcc

SEQ ID NO: 1159666 - DNA, 13 bp, Homo sapiens
ttgatctgctctg

SEQ ID NO: 1159667 - DNA, 14 bp, Homo sapiens
ttgatctgctctgt

SEQ ID NO: 1159668 - DNA, 14 bp, Homo sapiens
ttgatctggacaga

SEQ ID NO: 1159669 - DNA, 21 bp, Homo sapiens
ttgatctgtgatttcttctcc

SEQ ID NO: 1159670 - DNA, 22 bp, Homo sapiens
ttgatctgttgcaagcccctct

SEQ ID NO: 1159671 - DNA, 19 bp, Homo sapiens
ttgatctttgtttaaatgc

SEQ ID NO: 1159672 - DNA, 20 bp, Homo sapiens
ttgatctttgtttaaatgcc

SEQ ID NO: 1159673 - DNA, 19 bp, Homo sapiens
ttgatctttttatattctt

SEQ ID NO: 1159674 - DNA, 20 bp, Homo sapiens
ttgatgaaacgtcatgtgtt

SEQ ID NO: 1159675 - DNA, 18 bp, Homo sapiens
ttgatgaaattcttgaag

SEQ ID NO: 1159676 - DNA, 18 bp, Homo sapiens
ttgatgaagcaaggaaga

SEQ ID NO: 1159677 - DNA, 19 bp, Homo sapiens
ttgatgaattcttcctctc

SEQ ID NO: 1159678 - DNA, 19 bp, Homo sapiens
ttgatgactcgaaactgac

SEQ ID NO: 1159679 - DNA, 18 bp, Homo sapiens
ttgatgataacacttaaa

SEQ ID NO: 1159680 - DNA, 21 bp, Homo sapiens
ttgatgatgtctacagaaaat

SEQ ID NO: 1159681 - DNA, 18 bp, Homo sapiens
ttgatgcagataaaatat

SEQ ID NO: 1159682 - DNA, 21 bp, Homo sapiens
ttgatgcagataaaatatttt

SEQ ID NO: 1159683 - DNA, 18 bp, Homo sapiens
ttgatgccagagggccag

SEQ ID NO: 1159684 - DNA, 20 bp, Homo sapiens
ttgatgccagagggccagca

SEQ ID NO: 1159685 - DNA, 16 bp, Homo sapiens
ttgatgctatttatgc

SEQ ID NO: 1159686 - DNA, 14 bp, Homo sapiens
ttgatggaaaataa

SEQ ID NO: 1159687 - DNA, 15 bp, Homo sapiens
ttgatggaaaataaa

SEQ ID NO: 1159688 - DNA, 19 bp, Homo sapiens
ttgatggagggtggaaata

SEQ ID NO: 1159689 - DNA, 15 bp, Homo sapiens
ttgatggtatttctt

SEQ ID NO: 1159690 - DNA, 19 bp, Homo sapiens
ttgatggtatttctttctc

SEQ ID NO: 1159691 - DNA, 17 bp, Homo sapiens
ttgatggtggactaagc

SEQ ID NO: 1159692 - DNA, 17 bp, Homo sapiens
ttgatgtacatgtgtag

SEQ ID NO: 1159693 - DNA, 13 bp, Homo sapiens
ttgatgtatctga

SEQ ID NO: 1159694 - DNA, 12 bp, Homo sapiens
ttgatgtatgtg

SEQ ID NO: 1159695 - DNA, 15 bp, Homo sapiens
ttgatgtatgtgtga

SEQ ID NO: 1159696 - DNA, 20 bp, Homo sapiens
ttgatgtatgtgtgaaacaa

SEQ ID NO: 1159697 - DNA, 21 bp, Homo sapiens
ttgatgtcatgtacttcctgt

SEQ ID NO: 1159698 - DNA, 22 bp, Homo sapiens
ttgatgtgaagataatttgcat

SEQ ID NO: 1159699 - DNA, 21 bp, Homo sapiens
ttgatgtgactttttttggta

SEQ ID NO: 1159700 - DNA, 13 bp, Homo sapiens
ttgatgttaacaa

SEQ ID NO: 1159701 - DNA, 23 bp, Homo sapiens
ttgatgttaacaagaggggaaaa

SEQ ID NO: 1159702 - DNA, 13 bp, Homo sapiens
ttgatgtttagaa

SEQ ID NO: 1159703 - DNA, 15 bp, Homo sapiens
ttgatgtttagaaaa

SEQ ID NO: 1159704 - DNA, 15 bp, Homo sapiens
ttgatgtttgtggcc

SEQ ID NO: 1159705 - DNA, 18 bp, Homo sapiens
ttgatgtttgtggcctca

SEQ ID NO: 1159706 - DNA, 19 bp, Homo sapiens
ttgatgtttgtggcctcag

SEQ ID NO: 1159707 - DNA, 20 bp, Homo sapiens
ttgatgtttgtggcctcaga

SEQ ID NO: 1159708 - DNA, 21 bp, Homo sapiens
ttgatgttttacgtgcaaaca

SEQ ID NO: 1159709 - DNA, 16 bp, Homo sapiens
ttgatgtttttaaagg

SEQ ID NO: 1159710 - DNA, 16 bp, Homo sapiens
ttgattaaaatctctt

SEQ ID NO: 1159711 - DNA, 17 bp, Homo sapiens
ttgattaaaatctcttg

SEQ ID NO: 1159712 - DNA, 21 bp, Homo sapiens
ttgattaaaatctcttgatta

SEQ ID NO: 1159713 - DNA, 16 bp, Homo sapiens
ttgattaatgtttctt

SEQ ID NO: 1159714 - DNA, 11 bp, Homo sapiens
ttgattacata

SEQ ID NO: 1159715 - DNA, 20 bp, Homo sapiens
ttgattacataatcaaagct

SEQ ID NO: 1159716 - DNA, 21 bp, Homo sapiens
ttgattagaaaataaactcat

SEQ ID NO: 1159717 - DNA, 17 bp, Homo sapiens
ttgattagtataatatt

SEQ ID NO: 1159718 - DNA, 21 bp, Homo sapiens
ttgattagtataatatttctt

SEQ ID NO: 1159719 - DNA, 14 bp, Homo sapiens
ttgattatcttcag

SEQ ID NO: 1159720 - DNA, 19 bp, Homo sapiens
ttgattatcttcagcccag

SEQ ID NO: 1159721 - DNA, 16 bp, Homo sapiens
ttgattattagccagg

SEQ ID NO: 1159722 - DNA, 20 bp, Homo sapiens
ttgattattctgattccact

SEQ ID NO: 1159723 - DNA, 16 bp, Homo sapiens
ttgattatttgcatgt

SEQ ID NO: 1159724 - DNA, 20 bp, Homo sapiens
ttgattcacctcctaaaaca

SEQ ID NO: 1159725 - DNA, 14 bp, Homo sapiens
ttgattcagcaaaa

SEQ ID NO: 1159726 - DNA, 22 bp, Homo sapiens
ttgattcagctcattatgaaaa

SEQ ID NO: 1159727 - DNA, 16 bp, Homo sapiens
ttgattcagctctgca

SEQ ID NO: 1159728 - DNA, 15 bp, Homo sapiens
ttgattcattttcct

SEQ ID NO: 1159729 - DNA, 18 bp, Homo sapiens
ttgattcctcgcgacatc

SEQ ID NO: 1159730 - DNA, 13 bp, Homo sapiens
ttgattcctggtt

SEQ ID NO: 1159731 - DNA, 12 bp, Homo sapiens
ttgattcttcct

SEQ ID NO: 1159732 - DNA, 15 bp, Homo sapiens
ttgattgagaaagat

SEQ ID NO: 1159733 - DNA, 13 bp, Homo sapiens
ttgattgaggagc

SEQ ID NO: 1159734 - DNA, 19 bp, Homo sapiens
ttgattgaggagctgcact

SEQ ID NO: 1159735 - DNA, 12 bp, Homo sapiens
tagtcttctcat

SEQ ID NO: 1159736 - DNA, 19 bp, Homo sapiens
tagtcttctcatagcatta

SEQ ID NO: 1159737 - DNA, 11 bp, Homo sapiens
tagtcttggaa

SEQ ID NO: 1159738 - DNA, 22 bp, Homo sapiens
tagtcttgtcccaattaaaata

SEQ ID NO: 1159739 - DNA, 15 bp, Homo sapiens
tagtctttggagaaa

SEQ ID NO: 1159740 - DNA, 15 bp, Homo sapiens
tagtcttttgcatgt

SEQ ID NO: 1159741 - DNA, 21 bp, Homo sapiens
tagtcttttgcttttggcaaa

SEQ ID NO: 1159742 - DNA, 19 bp, Homo sapiens
tagtcttttgtaatatcaa

SEQ ID NO: 1159743 - DNA, 17 bp, Homo sapiens
tagtgaaacataataat

SEQ ID NO: 1159744 - DNA, 17 bp, Homo sapiens
tagtgacacacactgtc

SEQ ID NO: 1159745 - DNA, 16 bp, Homo sapiens
tagtgaccattattca

SEQ ID NO: 1159746 - DNA, 14 bp, Homo sapiens
tagtgacttcctgg

SEQ ID NO: 1159747 - DNA, 16 bp, Homo sapiens
tagtgacttgtgtccc

SEQ ID NO: 1159748 - DNA, 15 bp, Homo sapiens
tagtgagacccctgt

SEQ ID NO: 1159749 - DNA, 23 bp, Homo sapiens
tagtgagccactcagtctcttcc

SEQ ID NO: 1159750 - DNA, 15 bp, Homo sapiens
tagtgagcctgggcc

SEQ ID NO: 1159751 - DNA, 13 bp, Homo sapiens
tagtgatgcagtt

SEQ ID NO: 1159752 - DNA, 15 bp, Homo sapiens
tagtgattaaatata

SEQ ID NO: 1159753 - DNA, 18 bp, Homo sapiens
tagtgcaaaactgtgtca

SEQ ID NO: 1159754 - DNA, 15 bp, Homo sapiens
tagtgcaagctgaag

SEQ ID NO: 1159755 - DNA, 17 bp, Homo sapiens
tagtgcagctgatttta

SEQ ID NO: 1159756 - DNA, 18 bp, Homo sapiens
tagtgcatttcaaggaat

SEQ ID NO: 1159757 - DNA, 19 bp, Homo sapiens
tagtgcatttttaaacttg

SEQ ID NO: 1159758 - DNA, 15 bp, Homo sapiens
tagtgccccacctcc

SEQ ID NO: 1159759 - DNA, 17 bp, Homo sapiens
tagtgccccagactgag

SEQ ID NO: 1159760 - DNA, 21 bp, Homo sapiens
tagtgccccagactgagctct

SEQ ID NO: 1159761 - DNA, 14 bp, Homo sapiens
tagtgcccgcctag

SEQ ID NO: 1159762 - DNA, 23 bp, Homo sapiens
tagtgccctccacagccgcagcc

SEQ ID NO: 1159763 - DNA, 14 bp, Homo sapiens
tagtgcctaaaatt

SEQ ID NO: 1159764 - DNA, 23 bp, Homo sapiens
tagtgcctaaaattgtatgaaaa

SEQ ID NO: 1159765 - DNA, 20 bp, Homo sapiens
tagtgcctaaagtgctgcag

SEQ ID NO: 1159766 - DNA, 18 bp, Homo sapiens
tagtgccttgcccacagg

SEQ ID NO: 1159767 - DNA, 19 bp, Homo sapiens
tagtgcggacaagttttaa

SEQ ID NO: 1159768 - DNA, 21 bp, Homo sapiens
tagtgctggtcagagagacct

SEQ ID NO: 1159769 - DNA, 16 bp, Homo sapiens
tagtgctgtaatattg

SEQ ID NO: 1159770 - DNA, 23 bp, Homo sapiens
tagtgctgtagagttcactgttg

SEQ ID NO: 1159771 - DNA, 13 bp, Homo sapiens
tagtgctgtgaaa

SEQ ID NO: 1159772 - DNA, 21 bp, Homo sapiens
tagtgcttaaaaatcattgat

SEQ ID NO: 1159773 - DNA, 15 bp, Homo sapiens
tagtgcttcagagtt

SEQ ID NO: 1159774 - DNA, 17 bp, Homo sapiens
tagtggaagagcagcct

SEQ ID NO: 1159775 - DNA, 23 bp, Homo sapiens
tagtggaagagcagcctgatggc

SEQ ID NO: 1159776 - DNA, 15 bp, Homo sapiens
tagtggacatggtca

SEQ ID NO: 1159777 - DNA, 23 bp, Homo sapiens
tagtggattactgccattcactt

SEQ ID NO: 1159778 - DNA, 14 bp, Homo sapiens
tagtgggccagggc

SEQ ID NO: 1159779 - DNA, 14 bp, Homo sapiens
tagtggggcctggg

SEQ ID NO: 1159780 - DNA, 16 bp, Homo sapiens
tagtggggcctgggag

SEQ ID NO: 1159781 - DNA, 21 bp, Homo sapiens
tagtggggtctccctctcctg

SEQ ID NO: 1159782 - DNA, 23 bp, Homo sapiens
tagtggggtctccctctcctgcc

SEQ ID NO: 1159783 - DNA, 13 bp, Homo sapiens
tagtgtaaaataa

SEQ ID NO: 1159784 - DNA, 23 bp, Homo sapiens
tagtgtaacttgcttaaatttct

SEQ ID NO: 1159785 - DNA, 17 bp, Homo sapiens
tagtgtataccacctgt

SEQ ID NO: 1159786 - DNA, 18 bp, Homo sapiens
tagtgtataccacctgta

SEQ ID NO: 1159787 - DNA, 22 bp, Homo sapiens
tagtgtataccacctgtacata

SEQ ID NO: 1159788 - DNA, 18 bp, Homo sapiens
tagtgtattaatcataga

SEQ ID NO: 1159789 - DNA, 16 bp, Homo sapiens
tagtgtccataaataa

SEQ ID NO: 1159790 - DNA, 20 bp, Homo sapiens
tagtgtccccatgggctccc

SEQ ID NO: 1159791 - DNA, 22 bp, Homo sapiens
tagtgtccccatgggctcccac

SEQ ID NO: 1159792 - DNA, 20 bp, Homo sapiens
tagtgtccccccttgaagca

SEQ ID NO: 1159793 - DNA, 18 bp, Homo sapiens
tagtgtctggatcagtaa

SEQ ID NO: 1159794 - DNA, 19 bp, Homo sapiens
tagtgtctggatcagtaaa

SEQ ID NO: 1159795 - DNA, 17 bp, Homo sapiens
tagtgtgaaatatatta

SEQ ID NO: 1159796 - DNA, 20 bp, Homo sapiens
tagtgtgacagtttccaaat

SEQ ID NO: 1159797 - DNA, 17 bp, Homo sapiens
tagtgtgagtggcagcc

SEQ ID NO: 1159798 - DNA, 21 bp, Homo sapiens
tagtgtgagtggcagccatgc

SEQ ID NO: 1159799 - DNA, 18 bp, Homo sapiens
tagtgtgtgcttacagta

SEQ ID NO: 1159800 - DNA, 23 bp, Homo sapiens
tagtgtgtgtgcagagtccattt

SEQ ID NO: 1159801 - DNA, 14 bp, Homo sapiens
tagtgtgtgtgcat

SEQ ID NO: 1159802 - DNA, 17 bp, Homo sapiens
tagtgtgtgtgcatgtg

SEQ ID NO: 1159803 - DNA, 19 bp, Homo sapiens
tagtgttcaaaacaaaatg

SEQ ID NO: 1159804 - DNA, 14 bp, Homo sapiens
tagtgttcacaaac

SEQ ID NO: 1159805 - DNA, 15 bp, Homo sapiens
tagtgttctgtttgt

SEQ ID NO: 1159806 - DNA, 22 bp, Homo sapiens
tagtgtttctagctaaataaat

SEQ ID NO: 1159807 - DNA, 23 bp, Homo sapiens
tagtgttttcaattttaaacata

SEQ ID NO: 1159808 - DNA, 14 bp, Homo sapiens
tagttaaaacacat

SEQ ID NO: 1159809 - DNA, 13 bp, Homo sapiens
tagttaaagaaag

SEQ ID NO: 1159810 - DNA, 18 bp, Homo sapiens
tagttaaagaaaggaaaa

SEQ ID NO: 1159811 - DNA, 20 bp, Homo sapiens
tagttaacacactaccgaat

SEQ ID NO: 1159812 - DNA, 14 bp, Homo sapiens
tagttaagacatga

SEQ ID NO: 1159813 - DNA, 21 bp, Homo sapiens
tagttaagacatgatttcctt

SEQ ID NO: 1159814 - DNA, 13 bp, Homo sapiens
tagttaagggctt

SEQ ID NO: 1159815 - DNA, 18 bp, Homo sapiens
tagttaccgagacatgaa

SEQ ID NO: 1159816 - DNA, 16 bp, Homo sapiens
tagttaggaaataaaa

SEQ ID NO: 1159817 - DNA, 19 bp, Homo sapiens
tagttaggatattgattta

SEQ ID NO: 1159818 - DNA, 15 bp, Homo sapiens
tagttagtagcatgt

SEQ ID NO: 1159819 - DNA, 14 bp, Homo sapiens
tagttagtttggaa

SEQ ID NO: 1159820 - DNA, 23 bp, Homo sapiens
tagttagtttggaaatggtactt

SEQ ID NO: 1159821 - DNA, 22 bp, Homo sapiens
tagttatagtgtttaactggca

SEQ ID NO: 1159822 - DNA, 21 bp, Homo sapiens
tagttcaatacagtgaaggtc

SEQ ID NO: 1159823 - DNA, 15 bp, Homo sapiens
tagttcacagacata

SEQ ID NO: 1159824 - DNA, 22 bp, Homo sapiens
tagttcactccatttggtcctt

SEQ ID NO: 1159825 - DNA, 14 bp, Homo sapiens
tagttcatatatac

SEQ ID NO: 1159826 - DNA, 18 bp, Homo sapiens
tagttcatccaatcctca

SEQ ID NO: 1159827 - DNA, 20 bp, Homo sapiens
tagttcatccaatcctcact

SEQ ID NO: 1159828 - DNA, 16 bp, Homo sapiens
tagttccagtttctcc

SEQ ID NO: 1159829 - DNA, 18 bp, Homo sapiens
tagttccagtttctcctt

SEQ ID NO: 1159830 - DNA, 16 bp, Homo sapiens
tagttcctattttcta

SEQ ID NO: 1159831 - DNA, 15 bp, Homo sapiens
tagttccttgcctta

SEQ ID NO: 1159832 - DNA, 20 bp, Homo sapiens
tagttctatccttttgcctg

SEQ ID NO: 1159833 - DNA, 22 bp, Homo sapiens
tagttctatccttttgcctgca

SEQ ID NO: 1159834 - DNA, 17 bp, Homo sapiens
tagttctctagggtctg

SEQ ID NO: 1159835 - DNA, 14 bp, Homo sapiens
tagttctgccaggc

SEQ ID NO: 1159836 - DNA, 16 bp, Homo sapiens
tagttctgctgccctc

SEQ ID NO: 1159837 - DNA, 16 bp, Homo sapiens
tagttctgtgtacttt

SEQ ID NO: 1159838 - DNA, 14 bp, Homo sapiens
tagttcttgaattg

SEQ ID NO: 1159839 - DNA, 16 bp, Homo sapiens
tagttctttcctcccc

SEQ ID NO: 1159840 - DNA, 22 bp, Homo sapiens
tagttctttcctccccctgcaa

SEQ ID NO: 1159841 - DNA, 12 bp, Homo sapiens
tagttgaaatga

SEQ ID NO: 1159842 - DNA, 18 bp, Homo sapiens
tagttgacaacctagaat

SEQ ID NO: 1159843 - DNA, 20 bp, Homo sapiens
tagttgacaacctagaatgt

SEQ ID NO: 1159844 - DNA, 17 bp, Homo sapiens
tagttgacaattctgca

SEQ ID NO: 1159845 - DNA, 17 bp, Homo sapiens
tagttgagccccaagtc

SEQ ID NO: 1159846 - DNA, 23 bp, Homo sapiens
tagttgcagactcagtttgtcag

SEQ ID NO: 1159847 - DNA, 19 bp, Homo sapiens
tagttgcatagcagtatat

SEQ ID NO: 1159848 - DNA, 20 bp, Homo sapiens
tagttgcatagcagtatatg

SEQ ID NO: 1159849 - DNA, 19 bp, Homo sapiens
tagttgccaacagttgtat

SEQ ID NO: 1159850 - DNA, 17 bp, Homo sapiens
tagttgccttaaaataa

SEQ ID NO: 1159851 - DNA, 11 bp, Homo sapiens
tagttggaatg

SEQ ID NO: 1159852 - DNA, 18 bp, Homo sapiens
tagttggcagaaatacag

SEQ ID NO: 1159853 - DNA, 19 bp, Homo sapiens
tagttggctagtactttga

SEQ ID NO: 1159854 - DNA, 20 bp, Homo sapiens
tagttggctagtactttgat

SEQ ID NO: 1159855 - DNA, 22 bp, Homo sapiens
tagttggctttcataaatcatg

SEQ ID NO: 1159856 - DNA, 20 bp, Homo sapiens
tagttgggtagaaaaattat

SEQ ID NO: 1159857 - DNA, 14 bp, Homo sapiens
tagttgtattcttc

SEQ ID NO: 1159858 - DNA, 13 bp, Homo sapiens
tagttgtgctttt

SEQ ID NO: 1159859 - DNA, 13 bp, Homo sapiens
ttgattgctttgc

SEQ ID NO: 1159860 - DNA, 19 bp, Homo sapiens
ttgattgctttgctgcaca

SEQ ID NO: 1159861 - DNA, 15 bp, Homo sapiens
ttgattgtcagctac

SEQ ID NO: 1159862 - DNA, 13 bp, Homo sapiens
ttgattgtttaag

SEQ ID NO: 1159863 - DNA, 12 bp, Homo sapiens
ttgatttatgca

SEQ ID NO: 1159864 - DNA, 14 bp, Homo sapiens
ttgatttgaagaac

SEQ ID NO: 1159865 - DNA, 11 bp, Homo sapiens
ttgatttgcat

SEQ ID NO: 1159866 - DNA, 16 bp, Homo sapiens
ttgatttgcatggatt

SEQ ID NO: 1159867 - DNA, 13 bp, Homo sapiens
ttgatttgcattg

SEQ ID NO: 1159868 - DNA, 19 bp, Homo sapiens
ttgatttgcattgaacaca

SEQ ID NO: 1159869 - DNA, 18 bp, Homo sapiens
ttgatttgtaccattcct

SEQ ID NO: 1159870 - DNA, 16 bp, Homo sapiens
ttgatttgttcttaca

SEQ ID NO: 1159871 - DNA, 14 bp, Homo sapiens
ttgattttaataca

SEQ ID NO: 1159872 - DNA, 15 bp, Homo sapiens
ttgattttaatacat

SEQ ID NO: 1159873 - DNA, 13 bp, Homo sapiens
ttgattttacaat

SEQ ID NO: 1159874 - DNA, 15 bp, Homo sapiens
ttgattttgaacttt

SEQ ID NO: 1159875 - DNA, 16 bp, Homo sapiens
ttgattttggaaagat

SEQ ID NO: 1159876 - DNA, 18 bp, Homo sapiens
ttgatttttaccgtttct

SEQ ID NO: 1159877 - DNA, 22 bp, Homo sapiens
ttgcaaaacggatgagttatta

SEQ ID NO: 1159878 - DNA, 16 bp, Homo sapiens
ttgcaaaataagtttt

SEQ ID NO: 1159879 - DNA, 14 bp, Homo sapiens
ttgcaaaatacatg

SEQ ID NO: 1159880 - DNA, 19 bp, Homo sapiens
ttgcaaaatagcatttgtt

SEQ ID NO: 1159881 - DNA, 16 bp, Homo sapiens
ttgcaaaatttccagt

SEQ ID NO: 1159882 - DNA, 22 bp, Homo sapiens
ttgcaaaatttccagtaccttt

SEQ ID NO: 1159883 - DNA, 20 bp, Homo sapiens
ttgcaaactatgcatctgag

SEQ ID NO: 1159884 - DNA, 19 bp, Homo sapiens
ttgcaaagaaagaaaaaaa

SEQ ID NO: 1159885 - DNA, 15 bp, Homo sapiens
ttgcaaagaccacct

SEQ ID NO: 1159886 - DNA, 17 bp, Homo sapiens
ttgcaaagaccacctcc

SEQ ID NO: 1159887 - DNA, 17 bp, Homo sapiens
ttgcaaagcgacagatt

SEQ ID NO: 1159888 - DNA, 20 bp, Homo sapiens
ttgcaaagtattgtaaatta

SEQ ID NO: 1159889 - DNA, 13 bp, Homo sapiens
ttgcaaagtgtat

SEQ ID NO: 1159890 - DNA, 12 bp, Homo sapiens
ttgcaaatcttg

SEQ ID NO: 1159891 - DNA, 17 bp, Homo sapiens
ttgcaaatcttgaaatt

SEQ ID NO: 1159892 - DNA, 18 bp, Homo sapiens
ttgcaaattatttattac

SEQ ID NO: 1159893 - DNA, 15 bp, Homo sapiens
ttgcaacacacagac

SEQ ID NO: 1159894 - DNA, 23 bp, Homo sapiens
ttgcaacaggggaggaaaaaaga

SEQ ID NO: 1159895 - DNA, 15 bp, Homo sapiens
ttgcaacagtgccat

SEQ ID NO: 1159896 - DNA, 13 bp, Homo sapiens
ttgcaaccaggaa

SEQ ID NO: 1159897 - DNA, 15 bp, Homo sapiens
ttgcaaccaggcagc

SEQ ID NO: 1159898 - DNA, 18 bp, Homo sapiens
ttgcaacctcaccttcct

SEQ ID NO: 1159899 - DNA, 18 bp, Homo sapiens
ttgcaactaaggacaaat

SEQ ID NO: 1159900 - DNA, 22 bp, Homo sapiens
ttgcaacttcatgtcaacttct

SEQ ID NO: 1159901 - DNA, 12 bp, Homo sapiens
ttgcaagccata

SEQ ID NO: 1159902 - DNA, 22 bp, Homo sapiens
ttgcaaggatttttccatgtgt

SEQ ID NO: 1159903 - DNA, 16 bp, Homo sapiens
ttgcaaggcagtctct

SEQ ID NO: 1159904 - DNA, 13 bp, Homo sapiens
ttgcaagggaaaa

SEQ ID NO: 1159905 - DNA, 22 bp, Homo sapiens
ttgcaagggaaaagtctcttgt

SEQ ID NO: 1159906 - DNA, 17 bp, Homo sapiens
ttgcaataacagctgca

SEQ ID NO: 1159907 - DNA, 20 bp, Homo sapiens
ttgcaataacagctgcaatt

SEQ ID NO: 1159908 - DNA, 13 bp, Homo sapiens
ttgcaataacttc

SEQ ID NO: 1159909 - DNA, 18 bp, Homo sapiens
ttgcaataacttctatat

SEQ ID NO: 1159910 - DNA, 19 bp, Homo sapiens
ttgcaatctaatctgaact

SEQ ID NO: 1159911 - DNA, 23 bp, Homo sapiens
ttgcaatgcttttatatggccca

SEQ ID NO: 1159912 - DNA, 16 bp, Homo sapiens
ttgcacacagatgtga

SEQ ID NO: 1159913 - DNA, 22 bp, Homo sapiens
ttgcacacagatgtgaaatgaa

SEQ ID NO: 1159914 - DNA, 21 bp, Homo sapiens
ttgcacagagcacacttattt

SEQ ID NO: 1159915 - DNA, 22 bp, Homo sapiens
ttgcacagccaacgagacacat

SEQ ID NO: 1159916 - DNA, 12 bp, Homo sapiens
ttgcacatgtga

SEQ ID NO: 1159917 - DNA, 13 bp, Homo sapiens
ttgcacattgttc

SEQ ID NO: 1159918 - DNA, 16 bp, Homo sapiens
ttgcacatttttttct

SEQ ID NO: 1159919 - DNA, 20 bp, Homo sapiens
ttgcaccaaattatcttgat

SEQ ID NO: 1159920 - DNA, 14 bp, Homo sapiens
ttgcaccactgcac

SEQ ID NO: 1159921 - DNA, 16 bp, Homo sapiens
ttgcaccactgcactc

SEQ ID NO: 1159922 - DNA, 18 bp, Homo sapiens
ttgcaccactgcactcca

SEQ ID NO: 1159923 - DNA, 23 bp, Homo sapiens
ttgcaccactgcactccagcttg

SEQ ID NO: 1159924 - DNA, 16 bp, Homo sapiens
ttgcaccatctgcttg

SEQ ID NO: 1159925 - DNA, 14 bp, Homo sapiens
ttgcaccattttca

SEQ ID NO: 1159926 - DNA, 13 bp, Homo sapiens
ttgcacccctcac

SEQ ID NO: 1159927 - DNA, 24 bp, Homo sapiens
ttgcacccctcactctggcctcag

SEQ ID NO: 1159928 - DNA, 12 bp, Homo sapiens
ttgcacccctcc

SEQ ID NO: 1159929 - DNA, 16 bp, Homo sapiens
ttgcacccgcctctcc

SEQ ID NO: 1159930 - DNA, 16 bp, Homo sapiens
ttgcaccgcctgccct

SEQ ID NO: 1159931 - DNA, 19 bp, Homo sapiens
ttgcaccgcctgccctccc

SEQ ID NO: 1159932 - DNA, 16 bp, Homo sapiens
ttgcacctatctcagc

SEQ ID NO: 1159933 - DNA, 20 bp, Homo sapiens
ttgcacctatctcagccata

SEQ ID NO: 1159934 - DNA, 21 bp, Homo sapiens
ttgcacctatctcagccatag

SEQ ID NO: 1159935 - DNA, 21 bp, Homo sapiens
ttgcacctcagcctcccaagt

SEQ ID NO: 1159936 - DNA, 14 bp, Homo sapiens
ttgcacctgagacc

SEQ ID NO: 1159937 - DNA, 13 bp, Homo sapiens
ttgcacctgtccc

SEQ ID NO: 1159938 - DNA, 16 bp, Homo sapiens
ttgcacctgtccccac

SEQ ID NO: 1159939 - DNA, 21 bp, Homo sapiens
ttgcaccttttcatgtacagc

SEQ ID NO: 1159940 - DNA, 21 bp, Homo sapiens
ttgcacgacgccctctcccca

SEQ ID NO: 1159941 - DNA, 17 bp, Homo sapiens
ttgcacgcccatgtgtg

SEQ ID NO: 1159942 - DNA, 14 bp, Homo sapiens
ttgcacgcctcccc

SEQ ID NO: 1159943 - DNA, 12 bp, Homo sapiens
ttgcacggctgc

SEQ ID NO: 1159944 - DNA, 22 bp, Homo sapiens
ttgcactaggaattctttgcat

SEQ ID NO: 1159945 - DNA, 14 bp, Homo sapiens
ttgcactgaacagg

SEQ ID NO: 1159946 - DNA, 23 bp, Homo sapiens
ttgcactgaatatataaacactc

SEQ ID NO: 1159947 - DNA, 13 bp, Homo sapiens
ttgcactttagac

SEQ ID NO: 1159948 - DNA, 19 bp, Homo sapiens
ttgcactttataaacactg

SEQ ID NO: 1159949 - DNA, 17 bp, Homo sapiens
ttgcagaaaattctgtg

SEQ ID NO: 1159950 - DNA, 22 bp, Homo sapiens
ttgcagaaacattttgtggtca

SEQ ID NO: 1159951 - DNA, 11 bp, Homo sapiens
ttgcagaactg

SEQ ID NO: 1159952 - DNA, 20 bp, Homo sapiens
ttgcagaagagggtgtgttt

SEQ ID NO: 1159953 - DNA, 19 bp, Homo sapiens
ttgcagaaggaaatgatgg

SEQ ID NO: 1159954 - DNA, 20 bp, Homo sapiens
ttgcagactagaattctagt

SEQ ID NO: 1159955 - DNA, 20 bp, Homo sapiens
ttgcagagatttcctccatg

SEQ ID NO: 1159956 - DNA, 16 bp, Homo sapiens
ttgcagaggagcccag

SEQ ID NO: 1159957 - DNA, 18 bp, Homo sapiens
ttgcagatatctgcatgt

SEQ ID NO: 1159958 - DNA, 12 bp, Homo sapiens
ttgcagattcta

SEQ ID NO: 1159959 - DNA, 16 bp, Homo sapiens
ttgcagattttcttaa

SEQ ID NO: 1159960 - DNA, 13 bp, Homo sapiens
ttgcagcagagga

SEQ ID NO: 1159961 - DNA, 17 bp, Homo sapiens
ttgcagcagaggagctg

SEQ ID NO: 1159962 - DNA, 11 bp, Homo sapiens
ttgcagcaggg

SEQ ID NO: 1159963 - DNA, 17 bp, Homo sapiens
ttgcagcagggctgggc

SEQ ID NO: 1159964 - DNA, 12 bp, Homo sapiens
ttgcagcagtga

SEQ ID NO: 1159965 - DNA, 23 bp, Homo sapiens
ttgcagcagtgagtctcttcaga

SEQ ID NO: 1159966 - DNA, 16 bp, Homo sapiens
ttgcagcatgagactt

SEQ ID NO: 1159967 - DNA, 15 bp, Homo sapiens
ttgcagcccttgtga

SEQ ID NO: 1159968 - DNA, 18 bp, Homo sapiens
ttgcagccggcacagggt

SEQ ID NO: 1159969 - DNA, 20 bp, Homo sapiens
ttgcagccggcacagggtct

SEQ ID NO: 1159970 - DNA, 15 bp, Homo sapiens
ttgcagcctgctcta

SEQ ID NO: 1159971 - DNA, 14 bp, Homo sapiens
ttgcagcttcaact

SEQ ID NO: 1159972 - DNA, 14 bp, Homo sapiens
ttgcagctttatgt

SEQ ID NO: 1159973 - DNA, 15 bp, Homo sapiens
ttgcaggattccctt

SEQ ID NO: 1159974 - DNA, 22 bp, Homo sapiens
ttgcaggattcccttctgggct

SEQ ID NO: 1159975 - DNA, 12 bp, Homo sapiens
ttgcagggtact

SEQ ID NO: 1159976 - DNA, 17 bp, Homo sapiens
ttgcagggtcctcttct

SEQ ID NO: 1159977 - DNA, 23 bp, Homo sapiens
ttgcagggtcctcttctgggcct

SEQ ID NO: 1159978 - DNA, 20 bp, Homo sapiens
ttgcagtagagtcatctcca

SEQ ID NO: 1159979 - DNA, 23 bp, Homo sapiens
ttgcagtgagcagggtggggtct

SEQ ID NO: 1159980 - DNA, 20 bp, Homo sapiens
ttgcagtgtggtgagatcat

SEQ ID NO: 1159981 - DNA, 13 bp, Homo sapiens
ttgcagttcacct

SEQ ID NO: 1159982 - DNA, 16 bp, Homo sapiens
ttgcagttcagcacca

SEQ ID NO: 1159983 - DNA, 13 bp, Homo sapiens
ttgcagtttatca

SEQ ID NO: 1159984 - DNA, 13 bp, Homo sapiens
ttgcagttttgta

SEQ ID NO: 1159985 - DNA, 12 bp, Homo sapiens
tagttgtgtctg

SEQ ID NO: 1159986 - DNA, 15 bp, Homo sapiens
tagttgtgtttcaac

SEQ ID NO: 1159987 - DNA, 23 bp, Homo sapiens
tagtttaccacttgcctttttct

SEQ ID NO: 1159988 - DNA, 22 bp, Homo sapiens
tagtttacctgaataaatggta

SEQ ID NO: 1159989 - DNA, 16 bp, Homo sapiens
tagtttaggaaaatga

SEQ ID NO: 1159990 - DNA, 12 bp, Homo sapiens
tagtttatctta

SEQ ID NO: 1159991 - DNA, 18 bp, Homo sapiens
tagtttattggaagtgtt

SEQ ID NO: 1159992 - DNA, 17 bp, Homo sapiens
tagtttcaaatctgtaa

SEQ ID NO: 1159993 - DNA, 16 bp, Homo sapiens
tagtttcaccactcct

SEQ ID NO: 1159994 - DNA, 18 bp, Homo sapiens
tagtttcaccactcctct

SEQ ID NO: 1159995 - DNA, 19 bp, Homo sapiens
tagtttcaccactcctctc

SEQ ID NO: 1159996 - DNA, 18 bp, Homo sapiens
tagtttcagatatatatc

SEQ ID NO: 1159997 - DNA, 20 bp, Homo sapiens
tagtttcatataaagtatca

SEQ ID NO: 1159998 - DNA, 16 bp, Homo sapiens
tagtttctagaggcct

SEQ ID NO: 1159999 - DNA, 16 bp, Homo sapiens
tagtttctttctgtct

SEQ ID NO: 1160000 - DNA, 22 bp, Homo sapiens
tagtttgaacagatatgttttt

SEQ ID NO: 1160001 - DNA, 17 bp, Homo sapiens
tagtttgatcagacagc

SEQ ID NO: 1160002 - DNA, 23 bp, Homo sapiens
tagtttgattaaattcttgcaaa

SEQ ID NO: 1160003 - DNA, 21 bp, Homo sapiens
tagtttgattattcagtgtca

SEQ ID NO: 1160004 - DNA, 19 bp, Homo sapiens
tagtttgcctgcagtttct

SEQ ID NO: 1160005 - DNA, 11 bp, Homo sapiens
tagtttggata

SEQ ID NO: 1160006 - DNA, 15 bp, Homo sapiens
tagtttggatatttt

SEQ ID NO: 1160007 - DNA, 21 bp, Homo sapiens
tagtttggatatttttgtact

SEQ ID NO: 1160008 - DNA, 22 bp, Homo sapiens
tagtttggatatttttgtactt

SEQ ID NO: 1160009 - DNA, 17 bp, Homo sapiens
tagtttgtacatgcatt

SEQ ID NO: 1160010 - DNA, 23 bp, Homo sapiens
tagtttgtgggttaaacaaaatg

SEQ ID NO: 1160011 - DNA, 14 bp, Homo sapiens
tagttttactttta

SEQ ID NO: 1160012 - DNA, 22 bp, Homo sapiens
tagttttagtgatttttttcat

SEQ ID NO: 1160013 - DNA, 17 bp, Homo sapiens
tagttttagttgcagaa

SEQ ID NO: 1160014 - DNA, 22 bp, Homo sapiens
tagttttcatccataactgaac

SEQ ID NO: 1160015 - DNA, 19 bp, Homo sapiens
tagttttgtaaaaactgaa

SEQ ID NO: 1160016 - DNA, 15 bp, Homo sapiens
tagttttgtaactta

SEQ ID NO: 1160017 - DNA, 14 bp, Homo sapiens
tagttttgtttaat

SEQ ID NO: 1160018 - DNA, 16 bp, Homo sapiens
tagtttttaattaaaa

SEQ ID NO: 1160019 - DNA, 20 bp, Homo sapiens
tagtttttgcagggttttat

SEQ ID NO: 1160020 - DNA, 17 bp, Homo sapiens
tagtttttgtaatttat

SEQ ID NO: 1160021 - DNA, 18 bp, Homo sapiens
tagttttttttgtaaact

SEQ ID NO: 1160022 - DNA, 21 bp, Homo sapiens
tagttttttttgtaaactgta

SEQ ID NO: 1160023 - DNA, 17 bp, Homo sapiens
tataaaaaatggttcag

SEQ ID NO: 1160024 - DNA, 13 bp, Homo sapiens
tataaaaaatgta

SEQ ID NO: 1160025 - DNA, 14 bp, Homo sapiens
tataaaaaatgtaa

SEQ ID NO: 1160026 - DNA, 11 bp, Homo sapiens
tataaaaacaa

SEQ ID NO: 1160027 - DNA, 12 bp, Homo sapiens
tataaaaacaga

SEQ ID NO: 1160028 - DNA, 20 bp, Homo sapiens
tataaaaaccccaaactgtt

SEQ ID NO: 1160029 - DNA, 19 bp, Homo sapiens
tataaaaagaaaagataaa

SEQ ID NO: 1160030 - DNA, 14 bp, Homo sapiens
tataaaaagataat

SEQ ID NO: 1160031 - DNA, 21 bp, Homo sapiens
tataaaaaggaaattagtctt

SEQ ID NO: 1160032 - DNA, 14 bp, Homo sapiens
tataaaaatggctt

SEQ ID NO: 1160033 - DNA, 22 bp, Homo sapiens
tataaaactgcgttaaaggctc

SEQ ID NO: 1160034 - DNA, 14 bp, Homo sapiens
tataaaagaaacac

SEQ ID NO: 1160035 - DNA, 18 bp, Homo sapiens
tataaaagctatggtgag

SEQ ID NO: 1160036 - DNA, 19 bp, Homo sapiens
tataaaaggatgttacaag

SEQ ID NO: 1160037 - DNA, 20 bp, Homo sapiens
tataaaaggcaaatgtgtac

SEQ ID NO: 1160038 - DNA, 17 bp, Homo sapiens
tataaaataaacttctt

SEQ ID NO: 1160039 - DNA, 14 bp, Homo sapiens
tataaaataaatat

SEQ ID NO: 1160040 - DNA, 17 bp, Homo sapiens
tataaaataaatatata

SEQ ID NO: 1160041 - DNA, 21 bp, Homo sapiens
tataaaataaatatatataaa

SEQ ID NO: 1160042 - DNA, 19 bp, Homo sapiens
tataaaatagacaaataga

SEQ ID NO: 1160043 - DNA, 21 bp, Homo sapiens
tataaaatatgaagacataaa

SEQ ID NO: 1160044 - DNA, 18 bp, Homo sapiens
tataaaattaaatgcctt

SEQ ID NO: 1160045 - DNA, 19 bp, Homo sapiens
tataaacactccacagtgt

SEQ ID NO: 1160046 - DNA, 20 bp, Homo sapiens
tataaacagacaatatgtga

SEQ ID NO: 1160047 - DNA, 15 bp, Homo sapiens
tataaacatattttt

SEQ ID NO: 1160048 - DNA, 18 bp, Homo sapiens
tataaacatatttttata

SEQ ID NO: 1160049 - DNA, 20 bp, Homo sapiens
tataaacatatttttatact

SEQ ID NO: 1160050 - DNA, 17 bp, Homo sapiens
tataaacatcacacaca

SEQ ID NO: 1160051 - DNA, 18 bp, Homo sapiens
tataaacatcacacacac

SEQ ID NO: 1160052 - DNA, 21 bp, Homo sapiens
tataaactaattttgtacgta

SEQ ID NO: 1160053 - DNA, 17 bp, Homo sapiens
tataaactaggtaaaat

SEQ ID NO: 1160054 - DNA, 16 bp, Homo sapiens
tataaactataaactt

SEQ ID NO: 1160055 - DNA, 11 bp, Homo sapiens
tataaactgag

SEQ ID NO: 1160056 - DNA, 17 bp, Homo sapiens
tataaactgctgtcaat

SEQ ID NO: 1160057 - DNA, 23 bp, Homo sapiens
tataaacttagtgcggacaagtt

SEQ ID NO: 1160058 - DNA, 13 bp, Homo sapiens
tataaacttcaga

SEQ ID NO: 1160059 - DNA, 16 bp, Homo sapiens
tataaactttaccttt

SEQ ID NO: 1160060 - DNA, 22 bp, Homo sapiens
tataaagaacaaggtagttttt

SEQ ID NO: 1160061 - DNA, 23 bp, Homo sapiens
tataaagaaggttggtgaatttc

SEQ ID NO: 1160062 - DNA, 22 bp, Homo sapiens
tataaagacaagtatgaatatt

SEQ ID NO: 1160063 - DNA, 17 bp, Homo sapiens
tataaagattgtactta

SEQ ID NO: 1160064 - DNA, 24 bp, Homo sapiens
tataaagattgtacttagccagtt

SEQ ID NO: 1160065 - DNA, 17 bp, Homo sapiens
tataaagcaaattactc

SEQ ID NO: 1160066 - DNA, 19 bp, Homo sapiens
tataaagcattactctttt

SEQ ID NO: 1160067 - DNA, 21 bp, Homo sapiens
tataaagcctgtattctcaaa

SEQ ID NO: 1160068 - DNA, 20 bp, Homo sapiens
tataaagtatatattaggat

SEQ ID NO: 1160069 - DNA, 21 bp, Homo sapiens
tataaataaaatcatgtagtt

SEQ ID NO: 1160070 - DNA, 13 bp, Homo sapiens
tataaataataaa

SEQ ID NO: 1160071 - DNA, 19 bp, Homo sapiens
tataaataataaagaactc

SEQ ID NO: 1160072 - DNA, 23 bp, Homo sapiens
tataaatacgtattacaaacaag

SEQ ID NO: 1160073 - DNA, 16 bp, Homo sapiens
tataaatagctgaaaa

SEQ ID NO: 1160074 - DNA, 18 bp, Homo sapiens
tataaatagctgaaaact

SEQ ID NO: 1160075 - DNA, 15 bp, Homo sapiens
tataaatatcattgt

SEQ ID NO: 1160076 - DNA, 23 bp, Homo sapiens
tataaatcaacaccttaatatgc

SEQ ID NO: 1160077 - DNA, 17 bp, Homo sapiens
tataaatgacaaagtgt

SEQ ID NO: 1160078 - DNA, 14 bp, Homo sapiens
tataaatgctattt

SEQ ID NO: 1160079 - DNA, 16 bp, Homo sapiens
tataaatggtgttttt

SEQ ID NO: 1160080 - DNA, 18 bp, Homo sapiens
tataaatgtaaaaatgaa

SEQ ID NO: 1160081 - DNA, 20 bp, Homo sapiens
tataaatgtacatttccaaa

SEQ ID NO: 1160082 - DNA, 23 bp, Homo sapiens
tataaatgtacatttccaaatga

SEQ ID NO: 1160083 - DNA, 13 bp, Homo sapiens
tataaatgtgtgt

SEQ ID NO: 1160084 - DNA, 16 bp, Homo sapiens
tataaatgtgtgtatg

SEQ ID NO: 1160085 - DNA, 15 bp, Homo sapiens
tataaatgtgtttat

SEQ ID NO: 1160086 - DNA, 13 bp, Homo sapiens
tataaattaaata

SEQ ID NO: 1160087 - DNA, 19 bp, Homo sapiens
tataaattaaatatatgta

SEQ ID NO: 1160088 - DNA, 23 bp, Homo sapiens
tataaattaaatatatgtatgta

SEQ ID NO: 1160089 - DNA, 21 bp, Homo sapiens
tataaattactatctgttgaa

SEQ ID NO: 1160090 - DNA, 22 bp, Homo sapiens
tataaattactatctgttgaaa

SEQ ID NO: 1160091 - DNA, 16 bp, Homo sapiens
tataaattattcagaa

SEQ ID NO: 1160092 - DNA, 22 bp, Homo sapiens
tataaattattcagaactattt

SEQ ID NO: 1160093 - DNA, 13 bp, Homo sapiens
tataaattcactt

SEQ ID NO: 1160094 - DNA, 20 bp, Homo sapiens
tataaattcctctttgcttt

SEQ ID NO: 1160095 - DNA, 21 bp, Homo sapiens
tataaattcctctttgctttg

SEQ ID NO: 1160096 - DNA, 19 bp, Homo sapiens
tataaattgtacattttgt

SEQ ID NO: 1160097 - DNA, 23 bp, Homo sapiens
tataaattgtctttaaaaactgt

SEQ ID NO: 1160098 - DNA, 16 bp, Homo sapiens
tataaatttaagaaaa

SEQ ID NO: 1160099 - DNA, 15 bp, Homo sapiens
tataaatttaagcaa

SEQ ID NO: 1160100 - DNA, 16 bp, Homo sapiens
tataaatttatttact

SEQ ID NO: 1160101 - DNA, 22 bp, Homo sapiens
tataaatttatttactgctagt

SEQ ID NO: 1160102 - DNA, 15 bp, Homo sapiens
tataaatttttacct

SEQ ID NO: 1160103 - DNA, 17 bp, Homo sapiens
tataaattttttttgtt

SEQ ID NO: 1160104 - DNA, 14 bp, Homo sapiens
tataacagatcctt

SEQ ID NO: 1160105 - DNA, 22 bp, Homo sapiens
tataacagtgtctttctagcca

SEQ ID NO: 1160106 - DNA, 16 bp, Homo sapiens
tataacagtgtttaaa

SEQ ID NO: 1160107 - DNA, 17 bp, Homo sapiens
tataacagttatatttt

SEQ ID NO: 1160108 - DNA, 16 bp, Homo sapiens
ttgcagttttgtaagc

SEQ ID NO: 1160109 - DNA, 13 bp, Homo sapiens
ttgcataagagct

SEQ ID NO: 1160110 - DNA, 23 bp, Homo sapiens
ttgcatattgaaaagcacagagg

SEQ ID NO: 1160111 - DNA, 21 bp, Homo sapiens
ttgcatccattgttgtgtctg

SEQ ID NO: 1160112 - DNA, 15 bp, Homo sapiens
ttgcatcctgctggg

SEQ ID NO: 1160113 - DNA, 20 bp, Homo sapiens
ttgcatctaatgaaaaacaa

SEQ ID NO: 1160114 - DNA, 17 bp, Homo sapiens
ttgcatctcaaaattat

SEQ ID NO: 1160115 - DNA, 19 bp, Homo sapiens
ttgcatctgggtagctgta

SEQ ID NO: 1160116 - DNA, 20 bp, Homo sapiens
ttgcatctgggtagctgtaa

SEQ ID NO: 1160117 - DNA, 23 bp, Homo sapiens
ttgcatctgtataagtaagaaaa

SEQ ID NO: 1160118 - DNA, 18 bp, Homo sapiens
ttgcatgaccacatagaa

SEQ ID NO: 1160119 - DNA, 18 bp, Homo sapiens
ttgcatgctgataatcat

SEQ ID NO: 1160120 - DNA, 23 bp, Homo sapiens
ttgcatggaaatcagccaagttt

SEQ ID NO: 1160121 - DNA, 16 bp, Homo sapiens
ttgcatggcagggcct

SEQ ID NO: 1160122 - DNA, 16 bp, Homo sapiens
ttgcatgttatgttta

SEQ ID NO: 1160123 - DNA, 17 bp, Homo sapiens
ttgcatgttatgtttaa

SEQ ID NO: 1160124 - DNA, 20 bp, Homo sapiens
ttgcattaaattcacaaact

SEQ ID NO: 1160125 - DNA, 11 bp, Homo sapiens
ttgcattcaaa

SEQ ID NO: 1160126 - DNA, 12 bp, Homo sapiens
ttgcattcaaat

SEQ ID NO: 1160127 - DNA, 20 bp, Homo sapiens
ttgcattccttacttgcact

SEQ ID NO: 1160128 - DNA, 21 bp, Homo sapiens
ttgcattccttacttgcactg

SEQ ID NO: 1160129 - DNA, 23 bp, Homo sapiens
ttgcattgaacacaaactgtaaa

SEQ ID NO: 1160130 - DNA, 14 bp, Homo sapiens
ttgcattgaatata

SEQ ID NO: 1160131 - DNA, 21 bp, Homo sapiens
ttgcattgaccgcgactaatt

SEQ ID NO: 1160132 - DNA, 22 bp, Homo sapiens
ttgcatttaaaacagacactgg

SEQ ID NO: 1160133 - DNA, 19 bp, Homo sapiens
ttgcatttatgatgcagtt

SEQ ID NO: 1160134 - DNA, 15 bp, Homo sapiens
ttgcatttggtcaag

SEQ ID NO: 1160135 - DNA, 18 bp, Homo sapiens
ttgcatttttgttttgaa

SEQ ID NO: 1160136 - DNA, 21 bp, Homo sapiens
ttgcatttttgttttgaaagt

SEQ ID NO: 1160137 - DNA, 20 bp, Homo sapiens
ttgccaaaatgttggctgcg

SEQ ID NO: 1160138 - DNA, 16 bp, Homo sapiens
ttgccaaatatgtcct

SEQ ID NO: 1160139 - DNA, 21 bp, Homo sapiens
ttgccaagaaaatgaagggat

SEQ ID NO: 1160140 - DNA, 22 bp, Homo sapiens
ttgccaagaaaatgaagggatt

SEQ ID NO: 1160141 - DNA, 22 bp, Homo sapiens
ttgccaagctccaagccccatc

SEQ ID NO: 1160142 - DNA, 16 bp, Homo sapiens
ttgccaagttgctgtc

SEQ ID NO: 1160143 - DNA, 21 bp, Homo sapiens
ttgccaatgaggtctgaaatg

SEQ ID NO: 1160144 - DNA, 20 bp, Homo sapiens
ttgccacaagtccagctggg

SEQ ID NO: 1160145 - DNA, 20 bp, Homo sapiens
ttgccacaccaatcagagag

SEQ ID NO: 1160146 - DNA, 18 bp, Homo sapiens
ttgccacagcttttgcaa

SEQ ID NO: 1160147 - DNA, 20 bp, Homo sapiens
ttgccacagtagaactgtct

SEQ ID NO: 1160148 - DNA, 17 bp, Homo sapiens
ttgccaccacctctgtg

SEQ ID NO: 1160149 - DNA, 18 bp, Homo sapiens
ttgccaccacctctgtgg

SEQ ID NO: 1160150 - DNA, 18 bp, Homo sapiens
ttgccaccactagagctg

SEQ ID NO: 1160151 - DNA, 19 bp, Homo sapiens
ttgccacccccagttccta

SEQ ID NO: 1160152 - DNA, 19 bp, Homo sapiens
ttgccacctctggccaaat

SEQ ID NO: 1160153 - DNA, 15 bp, Homo sapiens
ttgccacctgttaaa

SEQ ID NO: 1160154 - DNA, 21 bp, Homo sapiens
ttgccactaattttagtattc

SEQ ID NO: 1160155 - DNA, 14 bp, Homo sapiens
ttgccactgcctct

SEQ ID NO: 1160156 - DNA, 17 bp, Homo sapiens
ttgccactttggcttct

SEQ ID NO: 1160157 - DNA, 22 bp, Homo sapiens
ttgccactttggcttctcctgt

SEQ ID NO: 1160158 - DNA, 15 bp, Homo sapiens
ttgccagagaaacta

SEQ ID NO: 1160159 - DNA, 19 bp, Homo sapiens
ttgccagagcaggagcccc

SEQ ID NO: 1160160 - DNA, 21 bp, Homo sapiens
ttgccagagcaggagcccctg

SEQ ID NO: 1160161 - DNA, 13 bp, Homo sapiens
ttgccagcaaata

SEQ ID NO: 1160162 - DNA, 17 bp, Homo sapiens
ttgccagcaaataaata

SEQ ID NO: 1160163 - DNA, 12 bp, Homo sapiens
ttgccagcacag

SEQ ID NO: 1160164 - DNA, 13 bp, Homo sapiens
ttgccagcacagg

SEQ ID NO: 1160165 - DNA, 14 bp, Homo sapiens
ttgccagcacaggg

SEQ ID NO: 1160166 - DNA, 17 bp, Homo sapiens
ttgccagcacaggggcc

SEQ ID NO: 1160167 - DNA, 16 bp, Homo sapiens
ttgccagcctccttgc

SEQ ID NO: 1160168 - DNA, 19 bp, Homo sapiens
ttgccagctgctgctggat

SEQ ID NO: 1160169 - DNA, 12 bp, Homo sapiens
ttgccagctttt

SEQ ID NO: 1160170 - DNA, 22 bp, Homo sapiens
ttgccaggaaaggagagtactt

SEQ ID NO: 1160171 - DNA, 21 bp, Homo sapiens
ttgccaggagatggccccaac

SEQ ID NO: 1160172 - DNA, 13 bp, Homo sapiens
ttgccagtcagca

SEQ ID NO: 1160173 - DNA, 15 bp, Homo sapiens
ttgccagtcagcaac

SEQ ID NO: 1160174 - DNA, 22 bp, Homo sapiens
ttgccatcactggtccaggtct

SEQ ID NO: 1160175 - DNA, 17 bp, Homo sapiens
ttgccatccattctgga

SEQ ID NO: 1160176 - DNA, 21 bp, Homo sapiens
ttgccatcctaaaagccaccc

SEQ ID NO: 1160177 - DNA, 14 bp, Homo sapiens
ttgccatcctgatg

SEQ ID NO: 1160178 - DNA, 21 bp, Homo sapiens
ttgccatgacatttcatctgg

SEQ ID NO: 1160179 - DNA, 23 bp, Homo sapiens
ttgccatgacatttcatctgggt

SEQ ID NO: 1160180 - DNA, 14 bp, Homo sapiens
ttgccatgcaggaa

SEQ ID NO: 1160181 - DNA, 20 bp, Homo sapiens
ttgccatggagatctgaagg

SEQ ID NO: 1160182 - DNA, 21 bp, Homo sapiens
ttgccatggagatctgaaggg

SEQ ID NO: 1160183 - DNA, 18 bp, Homo sapiens
ttgccatgggcctgctgc

SEQ ID NO: 1160184 - DNA, 16 bp, Homo sapiens
ttgccatgtagacccc

SEQ ID NO: 1160185 - DNA, 19 bp, Homo sapiens
ttgccatttttattagaaa

SEQ ID NO: 1160186 - DNA, 14 bp, Homo sapiens
ttgcccacccctca

SEQ ID NO: 1160187 - DNA, 15 bp, Homo sapiens
ttgcccacccctcac

SEQ ID NO: 1160188 - DNA, 16 bp, Homo sapiens
ttgcccagagatgcct

SEQ ID NO: 1160189 - DNA, 20 bp, Homo sapiens
ttgcccagtacatttaaatt

SEQ ID NO: 1160190 - DNA, 13 bp, Homo sapiens
ttgcccagtcctg

SEQ ID NO: 1160191 - DNA, 17 bp, Homo sapiens
ttgcccatcagccattt

SEQ ID NO: 1160192 - DNA, 17 bp, Homo sapiens
ttgcccatttatattca

SEQ ID NO: 1160193 - DNA, 14 bp, Homo sapiens
ttgccccaagtcct

SEQ ID NO: 1160194 - DNA, 11 bp, Homo sapiens
ttgccccactc

SEQ ID NO: 1160195 - DNA, 13 bp, Homo sapiens
ttgccccactcct

SEQ ID NO: 1160196 - DNA, 16 bp, Homo sapiens
ttgccccactcctctc

SEQ ID NO: 1160197 - DNA, 15 bp, Homo sapiens
ttgccccaggccagg

SEQ ID NO: 1160198 - DNA, 14 bp, Homo sapiens
ttgccccatcactg

SEQ ID NO: 1160199 - DNA, 15 bp, Homo sapiens
ttgcccccatccctc

SEQ ID NO: 1160200 - DNA, 13 bp, Homo sapiens
ttgcccccatggg

SEQ ID NO: 1160201 - DNA, 23 bp, Homo sapiens
ttgcccccatggggtccttggag

SEQ ID NO: 1160202 - DNA, 16 bp, Homo sapiens
ttgccccccaccccag

SEQ ID NO: 1160203 - DNA, 19 bp, Homo sapiens
ttgcccccgacggctgtga

SEQ ID NO: 1160204 - DNA, 23 bp, Homo sapiens
ttgccccggccccggccccagcc

SEQ ID NO: 1160205 - DNA, 20 bp, Homo sapiens
ttgcccgaaactaagccagg

SEQ ID NO: 1160206 - DNA, 15 bp, Homo sapiens
ttgcccgccagcctc

SEQ ID NO: 1160207 - DNA, 17 bp, Homo sapiens
ttgcccgcgctcaggag

SEQ ID NO: 1160208 - DNA, 21 bp, Homo sapiens
ttgcccgctcccacagcttcc

SEQ ID NO: 1160209 - DNA, 22 bp, Homo sapiens
ttgcccgctcccacagcttcct

SEQ ID NO: 1160210 - DNA, 17 bp, Homo sapiens
ttgcccgtcgtgtgctg

SEQ ID NO: 1160211 - DNA, 17 bp, Homo sapiens
ttgccctccgcctggga

SEQ ID NO: 1160212 - DNA, 18 bp, Homo sapiens
ttgccctgacctcccagc

SEQ ID NO: 1160213 - DNA, 16 bp, Homo sapiens
ttgcccttcacagtgt

SEQ ID NO: 1160214 - DNA, 11 bp, Homo sapiens
ttgcccttccc

SEQ ID NO: 1160215 - DNA, 13 bp, Homo sapiens
ttgcccttccctg

SEQ ID NO: 1160216 - DNA, 19 bp, Homo sapiens
ttgcccttccctgtccctc

SEQ ID NO: 1160217 - DNA, 17 bp, Homo sapiens
ttgcccttgccctgacc

SEQ ID NO: 1160218 - DNA, 18 bp, Homo sapiens
ttgcccttgccctgacct

SEQ ID NO: 1160219 - DNA, 22 bp, Homo sapiens
ttgccctttagggctgttgcta

SEQ ID NO: 1160220 - DNA, 14 bp, Homo sapiens
ttgccgagagaggc

SEQ ID NO: 1160221 - DNA, 21 bp, Homo sapiens
ttgccgtctcatcttctctca

SEQ ID NO: 1160222 - DNA, 22 bp, Homo sapiens
ttgcctaaatcccaagaaatgg

SEQ ID NO: 1160223 - DNA, 22 bp, Homo sapiens
ttgcctaaatttaatgctgcct

SEQ ID NO: 1160224 - DNA, 22 bp, Homo sapiens
ttgcctagaaatatctttctct

SEQ ID NO: 1160225 - DNA, 23 bp, Homo sapiens
ttgcctagaaatatctttctctt

SEQ ID NO: 1160226 - DNA, 19 bp, Homo sapiens
ttgcctataatacttgcaa

SEQ ID NO: 1160227 - DNA, 14 bp, Homo sapiens
ttgcctatctttaa

SEQ ID NO: 1160228 - DNA, 20 bp, Homo sapiens
ttgcctcagtagatactaaa

SEQ ID NO: 1160229 - DNA, 12 bp, Homo sapiens
ttgcctcccagg

SEQ ID NO: 1160230 - DNA, 19 bp, Homo sapiens
ttgcctcccaggcaagcag

SEQ ID NO: 1160231 - DNA, 20 bp, Homo sapiens
ttgcctccccatttcccatc

SEQ ID NO: 1160232 - DNA, 22 bp, Homo sapiens
tataacagttttgagtaattca

SEQ ID NO: 1160233 - DNA, 16 bp, Homo sapiens
tataaccagacacata

SEQ ID NO: 1160234 - DNA, 13 bp, Homo sapiens
tataaccattaca

SEQ ID NO: 1160235 - DNA, 16 bp, Homo sapiens
tataaccattacatgt

SEQ ID NO: 1160236 - DNA, 15 bp, Homo sapiens
tataaccccagcctg

SEQ ID NO: 1160237 - DNA, 16 bp, Homo sapiens
tataaccccagcctga

SEQ ID NO: 1160238 - DNA, 23 bp, Homo sapiens
tataacctgatgccataaataca

SEQ ID NO: 1160239 - DNA, 14 bp, Homo sapiens
tataacctggcaaa

SEQ ID NO: 1160240 - DNA, 20 bp, Homo sapiens
tataacctggcaaaatcttg

SEQ ID NO: 1160241 - DNA, 23 bp, Homo sapiens
tataaccttcatttttaagactg

SEQ ID NO: 1160242 - DNA, 20 bp, Homo sapiens
tataacggtttaattctgtc

SEQ ID NO: 1160243 - DNA, 14 bp, Homo sapiens
tataacgtgttcaa

SEQ ID NO: 1160244 - DNA, 19 bp, Homo sapiens
tataacgtgttcaatattt

SEQ ID NO: 1160245 - DNA, 21 bp, Homo sapiens
tataactagacatctgctgtt

SEQ ID NO: 1160246 - DNA, 17 bp, Homo sapiens
tataactcatcataaaa

SEQ ID NO: 1160247 - DNA, 18 bp, Homo sapiens
tataactcatcataaaat

SEQ ID NO: 1160248 - DNA, 23 bp, Homo sapiens
tataactctgcactactcctctg

SEQ ID NO: 1160249 - DNA, 13 bp, Homo sapiens
tataactgtttta

SEQ ID NO: 1160250 - DNA, 14 bp, Homo sapiens
tataactgttttag

SEQ ID NO: 1160251 - DNA, 20 bp, Homo sapiens
tataactgttttagaaattg

SEQ ID NO: 1160252 - DNA, 22 bp, Homo sapiens
tataactgttttagaaattggt

SEQ ID NO: 1160253 - DNA, 14 bp, Homo sapiens
tataacttaatgaa

SEQ ID NO: 1160254 - DNA, 16 bp, Homo sapiens
tataacttaatgaaaa

SEQ ID NO: 1160255 - DNA, 15 bp, Homo sapiens
tataacttcttaaaa

SEQ ID NO: 1160256 - DNA, 13 bp, Homo sapiens
tataacttgaaaa

SEQ ID NO: 1160257 - DNA, 16 bp, Homo sapiens
tataactttagaaata

SEQ ID NO: 1160258 - DNA, 15 bp, Homo sapiens
tataacttttgatga

SEQ ID NO: 1160259 - DNA, 15 bp, Homo sapiens
tataagaaaaacttt

SEQ ID NO: 1160260 - DNA, 13 bp, Homo sapiens
tataagaaaagta

SEQ ID NO: 1160261 - DNA, 22 bp, Homo sapiens
tataagaaaagtaatgaagaat

SEQ ID NO: 1160262 - DNA, 14 bp, Homo sapiens
tataagaagcaatc

SEQ ID NO: 1160263 - DNA, 20 bp, Homo sapiens
tataagaagcaatctttgaa

SEQ ID NO: 1160264 - DNA, 22 bp, Homo sapiens
tataagaagcaatctttgaaat

SEQ ID NO: 1160265 - DNA, 19 bp, Homo sapiens
tataagaataaaatgttga

SEQ ID NO: 1160266 - DNA, 12 bp, Homo sapiens
tataagaatttt

SEQ ID NO: 1160267 - DNA, 17 bp, Homo sapiens
tataagacactttgcca

SEQ ID NO: 1160268 - DNA, 17 bp, Homo sapiens
tataagaccactacagt

SEQ ID NO: 1160269 - DNA, 14 bp, Homo sapiens
tataagatttttga

SEQ ID NO: 1160270 - DNA, 22 bp, Homo sapiens
tataagcagattgctttaattt

SEQ ID NO: 1160271 - DNA, 15 bp, Homo sapiens
tataagccctgcata

SEQ ID NO: 1160272 - DNA, 13 bp, Homo sapiens
tataagcttaaat

SEQ ID NO: 1160273 - DNA, 22 bp, Homo sapiens
tataaggaaagcaataaatgaa

SEQ ID NO: 1160274 - DNA, 14 bp, Homo sapiens
tataaggaagattt

SEQ ID NO: 1160275 - DNA, 13 bp, Homo sapiens
tataagggagagc

SEQ ID NO: 1160276 - DNA, 14 bp, Homo sapiens
tataaggtaatgta

SEQ ID NO: 1160277 - DNA, 15 bp, Homo sapiens
tataaggtaatgtag

SEQ ID NO: 1160278 - DNA, 15 bp, Homo sapiens
tataaggtgcctcag

SEQ ID NO: 1160279 - DNA, 14 bp, Homo sapiens
tataagtaagaaaa

SEQ ID NO: 1160280 - DNA, 16 bp, Homo sapiens
tataagtagcaggcca

SEQ ID NO: 1160281 - DNA, 20 bp, Homo sapiens
tataagtagttggtttgtat

SEQ ID NO: 1160282 - DNA, 15 bp, Homo sapiens
tataagtcaagcaca

SEQ ID NO: 1160283 - DNA, 18 bp, Homo sapiens
tataagtcattgtatgtt

SEQ ID NO: 1160284 - DNA, 14 bp, Homo sapiens
tataagtgaagtga

SEQ ID NO: 1160285 - DNA, 18 bp, Homo sapiens
tataagtgtacatatgtg

SEQ ID NO: 1160286 - DNA, 15 bp, Homo sapiens
tataagttgtaccaa

SEQ ID NO: 1160287 - DNA, 21 bp, Homo sapiens
tataagttgtaccaaaacatc

SEQ ID NO: 1160288 - DNA, 16 bp, Homo sapiens
tataagtttgaaggaa

SEQ ID NO: 1160289 - DNA, 14 bp, Homo sapiens
tataataaaaatat

SEQ ID NO: 1160290 - DNA, 18 bp, Homo sapiens
tataataaaaatatattt

SEQ ID NO: 1160291 - DNA, 12 bp, Homo sapiens
tataataaaaga

SEQ ID NO: 1160292 - DNA, 22 bp, Homo sapiens
tataataaaaggaaaagcaaat

SEQ ID NO: 1160293 - DNA, 16 bp, Homo sapiens
tataataaatgtacat

SEQ ID NO: 1160294 - DNA, 12 bp, Homo sapiens
tataataacttt

SEQ ID NO: 1160295 - DNA, 22 bp, Homo sapiens
tataataactttattgcatata

SEQ ID NO: 1160296 - DNA, 15 bp, Homo sapiens
tataataagttttga

SEQ ID NO: 1160297 - DNA, 21 bp, Homo sapiens
tataataagttttgatataat

SEQ ID NO: 1160298 - DNA, 20 bp, Homo sapiens
tataatacagaatcttgttt

SEQ ID NO: 1160299 - DNA, 17 bp, Homo sapiens
tataatactctgttgta

SEQ ID NO: 1160300 - DNA, 15 bp, Homo sapiens
tataatactgtattt

SEQ ID NO: 1160301 - DNA, 17 bp, Homo sapiens
tataatacttgcaacta

SEQ ID NO: 1160302 - DNA, 19 bp, Homo sapiens
tataatactttgtatacaa

SEQ ID NO: 1160303 - DNA, 14 bp, Homo sapiens
tataatagattttt

SEQ ID NO: 1160304 - DNA, 22 bp, Homo sapiens
tataatatatttgtgtatttaa

SEQ ID NO: 1160305 - DNA, 14 bp, Homo sapiens
tataatatggaacc

SEQ ID NO: 1160306 - DNA, 13 bp, Homo sapiens
tataatattcagc

SEQ ID NO: 1160307 - DNA, 23 bp, Homo sapiens
tataatattcagccagcttaaac

SEQ ID NO: 1160308 - DNA, 16 bp, Homo sapiens
tataatattgaaaatt

SEQ ID NO: 1160309 - DNA, 15 bp, Homo sapiens
tataatattttatct

SEQ ID NO: 1160310 - DNA, 15 bp, Homo sapiens
tataatcatgctcat

SEQ ID NO: 1160311 - DNA, 23 bp, Homo sapiens
tataatcatgctcatgtatattt

SEQ ID NO: 1160312 - DNA, 18 bp, Homo sapiens
tataatcccagcactttg

SEQ ID NO: 1160313 - DNA, 22 bp, Homo sapiens
tataatccttaaatcttaatgt

SEQ ID NO: 1160314 - DNA, 22 bp, Homo sapiens
tataatccttgataatatattg

SEQ ID NO: 1160315 - DNA, 21 bp, Homo sapiens
tataatctcaaaggagaaaaa

SEQ ID NO: 1160316 - DNA, 18 bp, Homo sapiens
tataatctcctctgctca

SEQ ID NO: 1160317 - DNA, 20 bp, Homo sapiens
tataatctgtcaaaacactg

SEQ ID NO: 1160318 - DNA, 21 bp, Homo sapiens
tataatctgtcaaaacactgt

SEQ ID NO: 1160319 - DNA, 22 bp, Homo sapiens
tataatctgtcaaaacactgtg

SEQ ID NO: 1160320 - DNA, 16 bp, Homo sapiens
tataatcttatacaac

SEQ ID NO: 1160321 - DNA, 19 bp, Homo sapiens
tataatcttggcttcttaa

SEQ ID NO: 1160322 - DNA, 22 bp, Homo sapiens
tataatcttggcttcttaaaaa

SEQ ID NO: 1160323 - DNA, 13 bp, Homo sapiens
tataatctttcta

SEQ ID NO: 1160324 - DNA, 17 bp, Homo sapiens
tataatgaacaaaatta

SEQ ID NO: 1160325 - DNA, 15 bp, Homo sapiens
tataatgaataaatc

SEQ ID NO: 1160326 - DNA, 15 bp, Homo sapiens
tataatgattcataa

SEQ ID NO: 1160327 - DNA, 20 bp, Homo sapiens
tataatggaaacatttacaa

SEQ ID NO: 1160328 - DNA, 20 bp, Homo sapiens
tataatggacagattaatat

SEQ ID NO: 1160329 - DNA, 14 bp, Homo sapiens
tataatgtaagctc

SEQ ID NO: 1160330 - DNA, 21 bp, Homo sapiens
tataatgtatttgaaaattac

SEQ ID NO: 1160331 - DNA, 22 bp, Homo sapiens
tataatgtatttgaaaattaca

SEQ ID NO: 1160332 - DNA, 20 bp, Homo sapiens
tataatgtcattaaacatga

SEQ ID NO: 1160333 - DNA, 18 bp, Homo sapiens
tataatgttgttatttaa

SEQ ID NO: 1160334 - DNA, 16 bp, Homo sapiens
tataatgtttaaatca

SEQ ID NO: 1160335 - DNA, 17 bp, Homo sapiens
tataatgtttaaatcat

SEQ ID NO: 1160336 - DNA, 17 bp, Homo sapiens
tataatgtttattaaat

SEQ ID NO: 1160337 - DNA, 15 bp, Homo sapiens
tataatgtttgctat

SEQ ID NO: 1160338 - DNA, 17 bp, Homo sapiens
tataatgtttttaatat

SEQ ID NO: 1160339 - DNA, 21 bp, Homo sapiens
tataattaacttaactgaaga

SEQ ID NO: 1160340 - DNA, 22 bp, Homo sapiens
tataattcctatatcctgtgac

SEQ ID NO: 1160341 - DNA, 12 bp, Homo sapiens
tataattctgga

SEQ ID NO: 1160342 - DNA, 16 bp, Homo sapiens
tataattctgtaaatg

SEQ ID NO: 1160343 - DNA, 17 bp, Homo sapiens
tataattggatttccta

SEQ ID NO: 1160344 - DNA, 18 bp, Homo sapiens
tataattggatttcctaa

SEQ ID NO: 1160345 - DNA, 20 bp, Homo sapiens
tataattgggtcatagaaat

SEQ ID NO: 1160346 - DNA, 16 bp, Homo sapiens
tataattgttgatatt

SEQ ID NO: 1160347 - DNA, 15 bp, Homo sapiens
tataatttaacttca

SEQ ID NO: 1160348 - DNA, 18 bp, Homo sapiens
tataatttacctaagatt

SEQ ID NO: 1160349 - DNA, 20 bp, Homo sapiens
tataatttacctaagattac

SEQ ID NO: 1160350 - DNA, 18 bp, Homo sapiens
tataatttactttgtaga

SEQ ID NO: 1160351 - DNA, 20 bp, Homo sapiens
tataatttactttgtagact

SEQ ID NO: 1160352 - DNA, 19 bp, Homo sapiens
tataatttatttccactaa

SEQ ID NO: 1160353 - DNA, 14 bp, Homo sapiens
tataatttcaagga

SEQ ID NO: 1160354 - DNA, 22 bp, Homo sapiens
tataatttccatttacttaaga

SEQ ID NO: 1160355 - DNA, 15 bp, Homo sapiens
tataatttcctcact

SEQ ID NO: 1160356 - DNA, 14 bp, Homo sapiens
tataatttgaggtg

SEQ ID NO: 1160357 - DNA, 19 bp, Homo sapiens
ttgcctcctgttctgccca

SEQ ID NO: 1160358 - DNA, 13 bp, Homo sapiens
ttgcctctgccca

SEQ ID NO: 1160359 - DNA, 14 bp, Homo sapiens
ttgcctctgtcctc

SEQ ID NO: 1160360 - DNA, 16 bp, Homo sapiens
ttgcctctgtcctccc

SEQ ID NO: 1160361 - DNA, 17 bp, Homo sapiens
ttgcctctgtcctccca

SEQ ID NO: 1160362 - DNA, 14 bp, Homo sapiens
ttgcctctgtgctg

SEQ ID NO: 1160363 - DNA, 22 bp, Homo sapiens
ttgcctgaacatccttccttcc

SEQ ID NO: 1160364 - DNA, 19 bp, Homo sapiens
ttgcctgcagagagaagcc

SEQ ID NO: 1160365 - DNA, 20 bp, Homo sapiens
ttgcctgcagtttcttgtgt

SEQ ID NO: 1160366 - DNA, 18 bp, Homo sapiens
ttgcctgcctcctaggct

SEQ ID NO: 1160367 - DNA, 13 bp, Homo sapiens
ttgcctgctgtat

SEQ ID NO: 1160368 - DNA, 15 bp, Homo sapiens
ttgcctggctgtgga

SEQ ID NO: 1160369 - DNA, 22 bp, Homo sapiens
ttgcctggctgtggaggcctga

SEQ ID NO: 1160370 - DNA, 23 bp, Homo sapiens
ttgcctggtcaccctggggctgc

SEQ ID NO: 1160371 - DNA, 14 bp, Homo sapiens
ttgcctgtaacaag

SEQ ID NO: 1160372 - DNA, 15 bp, Homo sapiens
ttgcctgttaaatat

SEQ ID NO: 1160373 - DNA, 16 bp, Homo sapiens
ttgccttatttctcat

SEQ ID NO: 1160374 - DNA, 15 bp, Homo sapiens
ttgccttatttgtct

SEQ ID NO: 1160375 - DNA, 20 bp, Homo sapiens
ttgccttatttgtctgtaaa

SEQ ID NO: 1160376 - DNA, 23 bp, Homo sapiens
ttgccttcctttctccaggacca

SEQ ID NO: 1160377 - DNA, 19 bp, Homo sapiens
ttgccttctctgcccacag

SEQ ID NO: 1160378 - DNA, 21 bp, Homo sapiens
ttgccttctggagctgggaga

SEQ ID NO: 1160379 - DNA, 19 bp, Homo sapiens
ttgccttctggtttcttcc

SEQ ID NO: 1160380 - DNA, 15 bp, Homo sapiens
ttgccttgcagaact

SEQ ID NO: 1160381 - DNA, 18 bp, Homo sapiens
ttgcctttaggggtgtgt

SEQ ID NO: 1160382 - DNA, 14 bp, Homo sapiens
ttgcctttgaggtt

SEQ ID NO: 1160383 - DNA, 19 bp, Homo sapiens
ttgcgaatccaagctccct

SEQ ID NO: 1160384 - DNA, 17 bp, Homo sapiens
ttgcgaatggttccatt

SEQ ID NO: 1160385 - DNA, 18 bp, Homo sapiens
ttgcgacggagagaaaaa

SEQ ID NO: 1160386 - DNA, 19 bp, Homo sapiens
ttgcgacggagagaaaaaa

SEQ ID NO: 1160387 - DNA, 22 bp, Homo sapiens
ttgcgacggagagaaaaaagaa

SEQ ID NO: 1160388 - DNA, 19 bp, Homo sapiens
ttgcgcctcagccctcagt

SEQ ID NO: 1160389 - DNA, 23 bp, Homo sapiens
ttgcgcctttgtattataaaagc

SEQ ID NO: 1160390 - DNA, 20 bp, Homo sapiens
ttgcgctctcaagaccagag

SEQ ID NO: 1160391 - DNA, 13 bp, Homo sapiens
ttgcggaagccat

SEQ ID NO: 1160392 - DNA, 16 bp, Homo sapiens
ttgcggcaaaaggaaa

SEQ ID NO: 1160393 - DNA, 17 bp, Homo sapiens
ttgcggcaaaaggaaag

SEQ ID NO: 1160394 - DNA, 14 bp, Homo sapiens
ttgcggttcaggaa

SEQ ID NO: 1160395 - DNA, 18 bp, Homo sapiens
ttgcgtgcccggggcagc

SEQ ID NO: 1160396 - DNA, 15 bp, Homo sapiens
ttgctaaaaaataaa

SEQ ID NO: 1160397 - DNA, 16 bp, Homo sapiens
ttgctaaaagaagaga

SEQ ID NO: 1160398 - DNA, 18 bp, Homo sapiens
ttgctaaaatattttaga

SEQ ID NO: 1160399 - DNA, 23 bp, Homo sapiens
ttgctaaagcactttgcacttaa

SEQ ID NO: 1160400 - DNA, 18 bp, Homo sapiens
ttgctaatcaaagccagg

SEQ ID NO: 1160401 - DNA, 22 bp, Homo sapiens
ttgctaatcaaagccagggtct

SEQ ID NO: 1160402 - DNA, 20 bp, Homo sapiens
ttgctaattaactgaaacat

SEQ ID NO: 1160403 - DNA, 21 bp, Homo sapiens
ttgctacaaatttatgcattt

SEQ ID NO: 1160404 - DNA, 21 bp, Homo sapiens
ttgctacaccccttttccagt

SEQ ID NO: 1160405 - DNA, 13 bp, Homo sapiens
ttgctacataatt

SEQ ID NO: 1160406 - DNA, 15 bp, Homo sapiens
ttgctaccagtattt

SEQ ID NO: 1160407 - DNA, 16 bp, Homo sapiens
ttgctaccagtattta

SEQ ID NO: 1160408 - DNA, 13 bp, Homo sapiens
ttgctacgtgcct

SEQ ID NO: 1160409 - DNA, 15 bp, Homo sapiens
ttgctacgtgcctcc

SEQ ID NO: 1160410 - DNA, 18 bp, Homo sapiens
ttgctacgtgcctcccga

SEQ ID NO: 1160411 - DNA, 23 bp, Homo sapiens
ttgctagataaaagctgaagtta

SEQ ID NO: 1160412 - DNA, 20 bp, Homo sapiens
ttgctaggacgcaataaatt

SEQ ID NO: 1160413 - DNA, 22 bp, Homo sapiens
ttgctaggagctcccctgtttg

SEQ ID NO: 1160414 - DNA, 18 bp, Homo sapiens
ttgctatcaacaataaaa

SEQ ID NO: 1160415 - DNA, 22 bp, Homo sapiens
ttgctatcaacaataaaatttt

SEQ ID NO: 1160416 - DNA, 21 bp, Homo sapiens
ttgctatcgccctcctttccc

SEQ ID NO: 1160417 - DNA, 21 bp, Homo sapiens
ttgctatctaatggggaaatg

SEQ ID NO: 1160418 - DNA, 22 bp, Homo sapiens
ttgctatggcaggataagaaag

SEQ ID NO: 1160419 - DNA, 18 bp, Homo sapiens
ttgctatgttactatttt

SEQ ID NO: 1160420 - DNA, 19 bp, Homo sapiens
ttgctatgttactattttc

SEQ ID NO: 1160421 - DNA, 21 bp, Homo sapiens
ttgctatgttactattttcta

SEQ ID NO: 1160422 - DNA, 16 bp, Homo sapiens
ttgctatgttgcccaa

SEQ ID NO: 1160423 - DNA, 14 bp, Homo sapiens
ttgctattagagca

SEQ ID NO: 1160424 - DNA, 19 bp, Homo sapiens
ttgctattgtaaatatgtt

SEQ ID NO: 1160425 - DNA, 14 bp, Homo sapiens
ttgctattgtaagg

SEQ ID NO: 1160426 - DNA, 21 bp, Homo sapiens
ttgctattgtaaggtctttgt

SEQ ID NO: 1160427 - DNA, 12 bp, Homo sapiens
ttgctatttcaa

SEQ ID NO: 1160428 - DNA, 17 bp, Homo sapiens
ttgctatttcaataaca

SEQ ID NO: 1160429 - DNA, 19 bp, Homo sapiens
ttgctattttatttgtatt

SEQ ID NO: 1160430 - DNA, 20 bp, Homo sapiens
ttgctattttatttgtattc

SEQ ID NO: 1160431 - DNA, 17 bp, Homo sapiens
ttgctcaaaaaatgagc

SEQ ID NO: 1160432 - DNA, 19 bp, Homo sapiens
ttgctcaaatctattcaga

SEQ ID NO: 1160433 - DNA, 21 bp, Homo sapiens
ttgctcaagttcattgatgac

SEQ ID NO: 1160434 - DNA, 20 bp, Homo sapiens
ttgctcactcactcactcca

SEQ ID NO: 1160435 - DNA, 22 bp, Homo sapiens
ttgctcactcactcactccaag

SEQ ID NO: 1160436 - DNA, 17 bp, Homo sapiens
ttgctcagagaaggaaa

SEQ ID NO: 1160437 - DNA, 23 bp, Homo sapiens
ttgctcagagaaggaaaagactg

SEQ ID NO: 1160438 - DNA, 19 bp, Homo sapiens
ttgctcagatagatctgtg

SEQ ID NO: 1160439 - DNA, 13 bp, Homo sapiens
ttgctcagtctcc

SEQ ID NO: 1160440 - DNA, 17 bp, Homo sapiens
ttgctcagtgcctcctg

SEQ ID NO: 1160441 - DNA, 15 bp, Homo sapiens
ttgctcagtgtccag

SEQ ID NO: 1160442 - DNA, 16 bp, Homo sapiens
ttgctcagtgtccagc

SEQ ID NO: 1160443 - DNA, 20 bp, Homo sapiens
ttgctcagtgtccagcttcc

SEQ ID NO: 1160444 - DNA, 16 bp, Homo sapiens
ttgctcatgccctgcc

SEQ ID NO: 1160445 - DNA, 23 bp, Homo sapiens
ttgctcatgtaatgtggtcacca

SEQ ID NO: 1160446 - DNA, 20 bp, Homo sapiens
ttgctccagattctgatgca

SEQ ID NO: 1160447 - DNA, 11 bp, Homo sapiens
ttgctccaggg

SEQ ID NO: 1160448 - DNA, 14 bp, Homo sapiens
ttgctcccaaccca

SEQ ID NO: 1160449 - DNA, 21 bp, Homo sapiens
ttgctcccctgatagaagatt

SEQ ID NO: 1160450 - DNA, 21 bp, Homo sapiens
ttgctcccggggactcaagag

SEQ ID NO: 1160451 - DNA, 16 bp, Homo sapiens
ttgctccgcctggcct

SEQ ID NO: 1160452 - DNA, 14 bp, Homo sapiens
ttgctcctgccaac

SEQ ID NO: 1160453 - DNA, 20 bp, Homo sapiens
ttgctcgcccagacaccatg

SEQ ID NO: 1160454 - DNA, 21 bp, Homo sapiens
ttgctcgcccagacaccatgt

SEQ ID NO: 1160455 - DNA, 16 bp, Homo sapiens
ttgctctccctcttct

SEQ ID NO: 1160456 - DNA, 23 bp, Homo sapiens
ttgctctccctcttctcaagtgc

SEQ ID NO: 1160457 - DNA, 20 bp, Homo sapiens
ttgctctctctccctgcctt

SEQ ID NO: 1160458 - DNA, 12 bp, Homo sapiens
ttgctctgcacc

SEQ ID NO: 1160459 - DNA, 11 bp, Homo sapiens
ttgctctgccc

SEQ ID NO: 1160460 - DNA, 16 bp, Homo sapiens
ttgctctggagcagcc

SEQ ID NO: 1160461 - DNA, 19 bp, Homo sapiens
ttgctctggaggaagttct

SEQ ID NO: 1160462 - DNA, 16 bp, Homo sapiens
ttgctctgtcccccag

SEQ ID NO: 1160463 - DNA, 19 bp, Homo sapiens
ttgctcttgtcccacgtgt

SEQ ID NO: 1160464 - DNA, 20 bp, Homo sapiens
ttgctctttgacaactaaaa

SEQ ID NO: 1160465 - DNA, 18 bp, Homo sapiens
ttgctcttttaagcagtc

SEQ ID NO: 1160466 - DNA, 17 bp, Homo sapiens
ttgctgaaaatggtatt

SEQ ID NO: 1160467 - DNA, 14 bp, Homo sapiens
ttgctgaaactgtg

SEQ ID NO: 1160468 - DNA, 16 bp, Homo sapiens
ttgctgaaattttata

SEQ ID NO: 1160469 - DNA, 19 bp, Homo sapiens
ttgctgaaattttatatgc

SEQ ID NO: 1160470 - DNA, 12 bp, Homo sapiens
ttgctgaagatg

SEQ ID NO: 1160471 - DNA, 19 bp, Homo sapiens
ttgctgaagatgccttgag

SEQ ID NO: 1160472 - DNA, 23 bp, Homo sapiens
ttgctgaaggctaaattcacagc

SEQ ID NO: 1160473 - DNA, 17 bp, Homo sapiens
ttgctgaatcccatcag

SEQ ID NO: 1160474 - DNA, 19 bp, Homo sapiens
ttgctgaattcctttacaa

SEQ ID NO: 1160475 - DNA, 20 bp, Homo sapiens
ttgctgaccagctggagtga

SEQ ID NO: 1160476 - DNA, 22 bp, Homo sapiens
ttgctgactactactctgccaa

SEQ ID NO: 1160477 - DNA, 15 bp, Homo sapiens
ttgctgagaagcaaa

SEQ ID NO: 1160478 - DNA, 19 bp, Homo sapiens
ttgctgagtttcccttcct

SEQ ID NO: 1160479 - DNA, 14 bp, Homo sapiens
ttgctgatgctcct

SEQ ID NO: 1160480 - DNA, 21 bp, Homo sapiens
tataatttgaggtgaaattca

SEQ ID NO: 1160481 - DNA, 13 bp, Homo sapiens
tataattttatgg

SEQ ID NO: 1160482 - DNA, 13 bp, Homo sapiens
tataattttgcct

SEQ ID NO: 1160483 - DNA, 15 bp, Homo sapiens
tatacaaaactttat

SEQ ID NO: 1160484 - DNA, 13 bp, Homo sapiens
tatacaaattaga

SEQ ID NO: 1160485 - DNA, 17 bp, Homo sapiens
tatacaaattagaaaat

SEQ ID NO: 1160486 - DNA, 18 bp, Homo sapiens
tatacaaattagaaaatg

SEQ ID NO: 1160487 - DNA, 20 bp, Homo sapiens
tatacaaattttcagaaggt

SEQ ID NO: 1160488 - DNA, 23 bp, Homo sapiens
tatacaaattttcagaaggttat

SEQ ID NO: 1160489 - DNA, 21 bp, Homo sapiens
tatacaacagcaaaccctgat

SEQ ID NO: 1160490 - DNA, 21 bp, Homo sapiens
tatacaaccctggcattatgt

SEQ ID NO: 1160491 - DNA, 22 bp, Homo sapiens
tatacaaccctggcattatgtc

SEQ ID NO: 1160492 - DNA, 18 bp, Homo sapiens
tatacaaccttcatttaa

SEQ ID NO: 1160493 - DNA, 20 bp, Homo sapiens
tatacaactgtaaagcaaat

SEQ ID NO: 1160494 - DNA, 13 bp, Homo sapiens
tatacaaggcaag

SEQ ID NO: 1160495 - DNA, 19 bp, Homo sapiens
tatacaaggcaagcatttt

SEQ ID NO: 1160496 - DNA, 16 bp, Homo sapiens
tatacaagtactggta

SEQ ID NO: 1160497 - DNA, 23 bp, Homo sapiens
tatacaagtactggtaagattgt

SEQ ID NO: 1160498 - DNA, 15 bp, Homo sapiens
tatacaataacataa

SEQ ID NO: 1160499 - DNA, 16 bp, Homo sapiens
tatacaataacccagt

SEQ ID NO: 1160500 - DNA, 17 bp, Homo sapiens
tatacaataacccagtt

SEQ ID NO: 1160501 - DNA, 21 bp, Homo sapiens
tatacaataacccagttactt

SEQ ID NO: 1160502 - DNA, 22 bp, Homo sapiens
tatacaataacccagttacttt

SEQ ID NO: 1160503 - DNA, 16 bp, Homo sapiens
tatacacaactttgca

SEQ ID NO: 1160504 - DNA, 18 bp, Homo sapiens
tatacacaactttgcaaa

SEQ ID NO: 1160505 - DNA, 12 bp, Homo sapiens
tatacacacata

SEQ ID NO: 1160506 - DNA, 16 bp, Homo sapiens
tatacacacatataca

SEQ ID NO: 1160507 - DNA, 14 bp, Homo sapiens
tatacacatacata

SEQ ID NO: 1160508 - DNA, 19 bp, Homo sapiens
tatacacccagttctgaat

SEQ ID NO: 1160509 - DNA, 21 bp, Homo sapiens
tatacacgaatagacatcaaa

SEQ ID NO: 1160510 - DNA, 21 bp, Homo sapiens
tatacacttacactttatgca

SEQ ID NO: 1160511 - DNA, 22 bp, Homo sapiens
tatacacttacactttatgcac

SEQ ID NO: 1160512 - DNA, 17 bp, Homo sapiens
tatacagattttctaga

SEQ ID NO: 1160513 - DNA, 18 bp, Homo sapiens
tatacaggcataaaatag

SEQ ID NO: 1160514 - DNA, 19 bp, Homo sapiens
tatacagtaactttatgtg

SEQ ID NO: 1160515 - DNA, 17 bp, Homo sapiens
tatacagtgcagagcct

SEQ ID NO: 1160516 - DNA, 16 bp, Homo sapiens
tatacagttataaaat

SEQ ID NO: 1160517 - DNA, 19 bp, Homo sapiens
tatacagttataaaattaa

SEQ ID NO: 1160518 - DNA, 22 bp, Homo sapiens
tatacagttataaaattaaaag

SEQ ID NO: 1160519 - DNA, 16 bp, Homo sapiens
tatacagtttgacttt

SEQ ID NO: 1160520 - DNA, 13 bp, Homo sapiens
tatacataaacaa

SEQ ID NO: 1160521 - DNA, 14 bp, Homo sapiens
tatacatacatgta

SEQ ID NO: 1160522 - DNA, 18 bp, Homo sapiens
tatacatacatgtatctg

SEQ ID NO: 1160523 - DNA, 12 bp, Homo sapiens
tatacatatata

SEQ ID NO: 1160524 - DNA, 18 bp, Homo sapiens
tatacatatctttattaa

SEQ ID NO: 1160525 - DNA, 21 bp, Homo sapiens
tatacatatctttattaatca

SEQ ID NO: 1160526 - DNA, 21 bp, Homo sapiens
tatacatatgagaatatacct

SEQ ID NO: 1160527 - DNA, 23 bp, Homo sapiens
tatacatcagtatagtgttttat

SEQ ID NO: 1160528 - DNA, 22 bp, Homo sapiens
tatacatgaagaatagaaacaa

SEQ ID NO: 1160529 - DNA, 22 bp, Homo sapiens
tatacatggaatcgaagtgttt

SEQ ID NO: 1160530 - DNA, 11 bp, Homo sapiens
tatacatgttg

SEQ ID NO: 1160531 - DNA, 17 bp, Homo sapiens
tatacatgtttttctat

SEQ ID NO: 1160532 - DNA, 22 bp, Homo sapiens
tatacattagttttaatctctt

SEQ ID NO: 1160533 - DNA, 16 bp, Homo sapiens
tatacattctttatct

SEQ ID NO: 1160534 - DNA, 18 bp, Homo sapiens
tatacattgtgtgaaaaa

SEQ ID NO: 1160535 - DNA, 13 bp, Homo sapiens
tatacattttgtt

SEQ ID NO: 1160536 - DNA, 22 bp, Homo sapiens
tatacattttttaggacatctt

SEQ ID NO: 1160537 - DNA, 14 bp, Homo sapiens
tataccaatgtgtt

SEQ ID NO: 1160538 - DNA, 13 bp, Homo sapiens
tataccacctgta

SEQ ID NO: 1160539 - DNA, 14 bp, Homo sapiens
tataccacctgtac

SEQ ID NO: 1160540 - DNA, 20 bp, Homo sapiens
tataccagatgaacatttca

SEQ ID NO: 1160541 - DNA, 19 bp, Homo sapiens
tataccagtataattgagt

SEQ ID NO: 1160542 - DNA, 23 bp, Homo sapiens
tataccccaaattgtgtatatat

SEQ ID NO: 1160543 - DNA, 24 bp, Homo sapiens
tatacccccaggaaactagctttt

SEQ ID NO: 1160544 - DNA, 20 bp, Homo sapiens
tatacccgggaccaaactca

SEQ ID NO: 1160545 - DNA, 20 bp, Homo sapiens
tatacctgattttttttcct

SEQ ID NO: 1160546 - DNA, 13 bp, Homo sapiens
tatacctgccttt

SEQ ID NO: 1160547 - DNA, 19 bp, Homo sapiens
tatacctggcaattcacaa

SEQ ID NO: 1160548 - DNA, 20 bp, Homo sapiens
tatacctggcttttacttta

SEQ ID NO: 1160549 - DNA, 16 bp, Homo sapiens
tatacctggcttttta

SEQ ID NO: 1160550 - DNA, 13 bp, Homo sapiens
tatacctggttta

SEQ ID NO: 1160551 - DNA, 16 bp, Homo sapiens
tatacctggtttactt

SEQ ID NO: 1160552 - DNA, 17 bp, Homo sapiens
tatacctggtttacttc

SEQ ID NO: 1160553 - DNA, 19 bp, Homo sapiens
tatacgaaaagccagcttg

SEQ ID NO: 1160554 - DNA, 16 bp, Homo sapiens
tatacgaaataattgt

SEQ ID NO: 1160555 - DNA, 20 bp, Homo sapiens
tatacgtataaatatcagta

SEQ ID NO: 1160556 - DNA, 15 bp, Homo sapiens
tatactaagaaaaga

SEQ ID NO: 1160557 - DNA, 21 bp, Homo sapiens
tatactactttgttaggattt

SEQ ID NO: 1160558 - DNA, 18 bp, Homo sapiens
tatactctagatgaagtt

SEQ ID NO: 1160559 - DNA, 19 bp, Homo sapiens
tatactctttctgtatata

SEQ ID NO: 1160560 - DNA, 14 bp, Homo sapiens
tatactgaaagatc

SEQ ID NO: 1160561 - DNA, 23 bp, Homo sapiens
tatactgaaagatctctgtcaca

SEQ ID NO: 1160562 - DNA, 20 bp, Homo sapiens
tatactgaaggaaaaacaca

SEQ ID NO: 1160563 - DNA, 19 bp, Homo sapiens
tatactgcacagtggcaca

SEQ ID NO: 1160564 - DNA, 14 bp, Homo sapiens
tatactgcagcttt

SEQ ID NO: 1160565 - DNA, 17 bp, Homo sapiens
tatactgcatacttttt

SEQ ID NO: 1160566 - DNA, 14 bp, Homo sapiens
tatactgggtttca

SEQ ID NO: 1160567 - DNA, 15 bp, Homo sapiens
tatactgtaaaagtt

SEQ ID NO: 1160568 - DNA, 15 bp, Homo sapiens
tatactgtaatttag

SEQ ID NO: 1160569 - DNA, 22 bp, Homo sapiens
tatactgtaatttagttattga

SEQ ID NO: 1160570 - DNA, 22 bp, Homo sapiens
tatactgtacaataaaaacatt

SEQ ID NO: 1160571 - DNA, 16 bp, Homo sapiens
tatactgtacttaata

SEQ ID NO: 1160572 - DNA, 21 bp, Homo sapiens
tatactgtatttctaagaagt

SEQ ID NO: 1160573 - DNA, 18 bp, Homo sapiens
tatactgtgtgcttgttt

SEQ ID NO: 1160574 - DNA, 14 bp, Homo sapiens
tatactgtgtgtga

SEQ ID NO: 1160575 - DNA, 22 bp, Homo sapiens
tatacttaaaatgacaaagcca

SEQ ID NO: 1160576 - DNA, 23 bp, Homo sapiens
tatacttaaaatgacaaagccat

SEQ ID NO: 1160577 - DNA, 12 bp, Homo sapiens
tatacttaagaa

SEQ ID NO: 1160578 - DNA, 12 bp, Homo sapiens
tatacttcaaaa

SEQ ID NO: 1160579 - DNA, 19 bp, Homo sapiens
tatactttagtagacattt

SEQ ID NO: 1160580 - DNA, 18 bp, Homo sapiens
tatactttatataaggca

SEQ ID NO: 1160581 - DNA, 22 bp, Homo sapiens
tatacttttcccctgttaaaca

SEQ ID NO: 1160582 - DNA, 23 bp, Homo sapiens
tatacttttcccctgttaaacag

SEQ ID NO: 1160583 - DNA, 20 bp, Homo sapiens
tatactttttttgttataga

SEQ ID NO: 1160584 - DNA, 22 bp, Homo sapiens
tatactttttttgttatagatt

SEQ ID NO: 1160585 - DNA, 16 bp, Homo sapiens
tatagaaaaaaacatt

SEQ ID NO: 1160586 - DNA, 22 bp, Homo sapiens
tatagaaaaataaaaatctctt

SEQ ID NO: 1160587 - DNA, 11 bp, Homo sapiens
tatagaaaaca

SEQ ID NO: 1160588 - DNA, 12 bp, Homo sapiens
tatagaaaatct

SEQ ID NO: 1160589 - DNA, 17 bp, Homo sapiens
tatagaaaatcttagta

SEQ ID NO: 1160590 - DNA, 19 bp, Homo sapiens
tatagaaacaatactgttc

SEQ ID NO: 1160591 - DNA, 13 bp, Homo sapiens
tatagaaagctat

SEQ ID NO: 1160592 - DNA, 24 bp, Homo sapiens
tatagaaagctatataagacaaga

SEQ ID NO: 1160593 - DNA, 11 bp, Homo sapiens
tatagaaatgc

SEQ ID NO: 1160594 - DNA, 18 bp, Homo sapiens
tatagaaggaatttgtac

SEQ ID NO: 1160595 - DNA, 12 bp, Homo sapiens
tatagaataaac

SEQ ID NO: 1160596 - DNA, 17 bp, Homo sapiens
tatagaatagcctgagg

SEQ ID NO: 1160597 - DNA, 20 bp, Homo sapiens
tatagaataggcactttaaa

SEQ ID NO: 1160598 - DNA, 21 bp, Homo sapiens
tatagaatatttattacctct

SEQ ID NO: 1160599 - DNA, 13 bp, Homo sapiens
tatagacgctctt

SEQ ID NO: 1160600 - DNA, 20 bp, Homo sapiens
tatagacggtgctcactccc

SEQ ID NO: 1160601 - DNA, 22 bp, Homo sapiens
tatagagacaggacagaatgtg

SEQ ID NO: 1160602 - DNA, 18 bp, Homo sapiens
tatagagagggggctctc

SEQ ID NO: 1160603 - DNA, 23 bp, Homo sapiens
tatagagagggggctctccaaag

SEQ ID NO: 1160604 - DNA, 20 bp, Homo sapiens
ttgctgatggctgctagatt

SEQ ID NO: 1160605 - DNA, 15 bp, Homo sapiens
ttgctgatggcttga

SEQ ID NO: 1160606 - DNA, 20 bp, Homo sapiens
ttgctgatggcttgacatgt

SEQ ID NO: 1160607 - DNA, 16 bp, Homo sapiens
ttgctgatgtttataa

SEQ ID NO: 1160608 - DNA, 17 bp, Homo sapiens
ttgctgattatttatga

SEQ ID NO: 1160609 - DNA, 22 bp, Homo sapiens
ttgctgatttctagtgtatact

SEQ ID NO: 1160610 - DNA, 13 bp, Homo sapiens
ttgctgcaaagag

SEQ ID NO: 1160611 - DNA, 20 bp, Homo sapiens
ttgctgcaagcacagccctt

SEQ ID NO: 1160612 - DNA, 19 bp, Homo sapiens
ttgctgcactcttgcacat

SEQ ID NO: 1160613 - DNA, 21 bp, Homo sapiens
ttgctgcagagaaacttaagc

SEQ ID NO: 1160614 - DNA, 19 bp, Homo sapiens
ttgctgcaggccctccctc

SEQ ID NO: 1160615 - DNA, 20 bp, Homo sapiens
ttgctgcaggccctccctct

SEQ ID NO: 1160616 - DNA, 21 bp, Homo sapiens
ttgctgcaggccctccctcta

SEQ ID NO: 1160617 - DNA, 19 bp, Homo sapiens
ttgctgcagtcatctactt

SEQ ID NO: 1160618 - DNA, 23 bp, Homo sapiens
ttgctgcattgatccaggagata

SEQ ID NO: 1160619 - DNA, 15 bp, Homo sapiens
ttgctgccaaaacca

SEQ ID NO: 1160620 - DNA, 19 bp, Homo sapiens
ttgctgccccatcagtgct

SEQ ID NO: 1160621 - DNA, 20 bp, Homo sapiens
ttgctgccccatcagtgctc

SEQ ID NO: 1160622 - DNA, 21 bp, Homo sapiens
ttgctgcctgaagaacagtaa

SEQ ID NO: 1160623 - DNA, 16 bp, Homo sapiens
ttgctgcctttcaagc

SEQ ID NO: 1160624 - DNA, 21 bp, Homo sapiens
ttgctgctaccgccctgggct

SEQ ID NO: 1160625 - DNA, 14 bp, Homo sapiens
ttgctgctgctacc

SEQ ID NO: 1160626 - DNA, 16 bp, Homo sapiens
ttgctgctgctaccag

SEQ ID NO: 1160627 - DNA, 21 bp, Homo sapiens
ttgctgctgctctcaggcgct

SEQ ID NO: 1160628 - DNA, 19 bp, Homo sapiens
ttgctggaagaaactaaaa

SEQ ID NO: 1160629 - DNA, 21 bp, Homo sapiens
ttgctggacggggactgggga

SEQ ID NO: 1160630 - DNA, 21 bp, Homo sapiens
ttgctggaggggctgtcctcc

SEQ ID NO: 1160631 - DNA, 17 bp, Homo sapiens
ttgctggatcaggaagc

SEQ ID NO: 1160632 - DNA, 17 bp, Homo sapiens
ttgctggccccagccct

SEQ ID NO: 1160633 - DNA, 15 bp, Homo sapiens
ttgctggctctgaga

SEQ ID NO: 1160634 - DNA, 16 bp, Homo sapiens
ttgctggctctgagaa

SEQ ID NO: 1160635 - DNA, 19 bp, Homo sapiens
ttgctggctctgagaatca

SEQ ID NO: 1160636 - DNA, 13 bp, Homo sapiens
ttgctgggccagg

SEQ ID NO: 1160637 - DNA, 14 bp, Homo sapiens
ttgctgggccaggg

SEQ ID NO: 1160638 - DNA, 18 bp, Homo sapiens
ttgctggggtccagggct

SEQ ID NO: 1160639 - DNA, 23 bp, Homo sapiens
ttgctggtagagacccccaggcc

SEQ ID NO: 1160640 - DNA, 19 bp, Homo sapiens
ttgctggtgcaaagataga

SEQ ID NO: 1160641 - DNA, 22 bp, Homo sapiens
ttgctggttcagccttcgtgtg

SEQ ID NO: 1160642 - DNA, 22 bp, Homo sapiens
ttgctggttgtaaatactttgt

SEQ ID NO: 1160643 - DNA, 22 bp, Homo sapiens
ttgctggtttgaaagattatga

SEQ ID NO: 1160644 - DNA, 13 bp, Homo sapiens
ttgctgtaaaatt

SEQ ID NO: 1160645 - DNA, 15 bp, Homo sapiens
ttgctgtaaaatttg

SEQ ID NO: 1160646 - DNA, 16 bp, Homo sapiens
ttgctgtaaaatttgt

SEQ ID NO: 1160647 - DNA, 21 bp, Homo sapiens
ttgctgtaccacatctgctct

SEQ ID NO: 1160648 - DNA, 21 bp, Homo sapiens
ttgctgtcataagaatgaata

SEQ ID NO: 1160649 - DNA, 17 bp, Homo sapiens
ttgctgtccaggcagct

SEQ ID NO: 1160650 - DNA, 11 bp, Homo sapiens
ttgctgtccta

SEQ ID NO: 1160651 - DNA, 23 bp, Homo sapiens
ttgctgtctacagtagctgctac

SEQ ID NO: 1160652 - DNA, 16 bp, Homo sapiens
ttgctgtctctgctcg

SEQ ID NO: 1160653 - DNA, 16 bp, Homo sapiens
ttgctgtctggtgagg

SEQ ID NO: 1160654 - DNA, 15 bp, Homo sapiens
ttgctgtgaggctgt

SEQ ID NO: 1160655 - DNA, 19 bp, Homo sapiens
ttgctgtgaggctgtcctg

SEQ ID NO: 1160656 - DNA, 11 bp, Homo sapiens
ttgctgtggac

SEQ ID NO: 1160657 - DNA, 11 bp, Homo sapiens
ttgctgtgtga

SEQ ID NO: 1160658 - DNA, 20 bp, Homo sapiens
ttgctgttgatttctttcca

SEQ ID NO: 1160659 - DNA, 20 bp, Homo sapiens
ttgctgtttagcttcctcca

SEQ ID NO: 1160660 - DNA, 18 bp, Homo sapiens
ttgctgttttaaacatta

SEQ ID NO: 1160661 - DNA, 19 bp, Homo sapiens
ttgctgttttcctcccttc

SEQ ID NO: 1160662 - DNA, 22 bp, Homo sapiens
ttgctgttttcctcccttctgc

SEQ ID NO: 1160663 - DNA, 23 bp, Homo sapiens
ttgcttaaaatatgtgaagtttt

SEQ ID NO: 1160664 - DNA, 12 bp, Homo sapiens
ttgcttaaacaa

SEQ ID NO: 1160665 - DNA, 13 bp, Homo sapiens
ttgcttaacatta

SEQ ID NO: 1160666 - DNA, 20 bp, Homo sapiens
ttgcttaacattagatgtca

SEQ ID NO: 1160667 - DNA, 22 bp, Homo sapiens
ttgcttaatttccttctgttaa

SEQ ID NO: 1160668 - DNA, 14 bp, Homo sapiens
ttgcttacctctca

SEQ ID NO: 1160669 - DNA, 12 bp, Homo sapiens
ttgcttactaag

SEQ ID NO: 1160670 - DNA, 21 bp, Homo sapiens
ttgcttagagtgcccagcaga

SEQ ID NO: 1160671 - DNA, 21 bp, Homo sapiens
ttgcttagtatggttctcaga

SEQ ID NO: 1160672 - DNA, 19 bp, Homo sapiens
ttgcttataaactgggaag

SEQ ID NO: 1160673 - DNA, 22 bp, Homo sapiens
ttgcttattgttccaagacatt

SEQ ID NO: 1160674 - DNA, 23 bp, Homo sapiens
ttgcttattgttccaagacattg

SEQ ID NO: 1160675 - DNA, 24 bp, Homo sapiens
ttgcttcactttgccttctggtta

SEQ ID NO: 1160676 - DNA, 17 bp, Homo sapiens
ttgcttcataaatgaag

SEQ ID NO: 1160677 - DNA, 21 bp, Homo sapiens
ttgcttcctcttcttcttttc

SEQ ID NO: 1160678 - DNA, 21 bp, Homo sapiens
ttgcttctaggagtcaactgg

SEQ ID NO: 1160679 - DNA, 11 bp, Homo sapiens
ttgcttctccc

SEQ ID NO: 1160680 - DNA, 17 bp, Homo sapiens
ttgcttctcccatttcc

SEQ ID NO: 1160681 - DNA, 15 bp, Homo sapiens
ttgcttcttactgat

SEQ ID NO: 1160682 - DNA, 22 bp, Homo sapiens
ttgcttcttctcctatgtgtaa

SEQ ID NO: 1160683 - DNA, 12 bp, Homo sapiens
ttgcttctttct

SEQ ID NO: 1160684 - DNA, 20 bp, Homo sapiens
ttgcttgaaattactgtgta

SEQ ID NO: 1160685 - DNA, 21 bp, Homo sapiens
ttgcttgaaattactgtgtaa

SEQ ID NO: 1160686 - DNA, 13 bp, Homo sapiens
ttgcttgatccag

SEQ ID NO: 1160687 - DNA, 22 bp, Homo sapiens
ttgcttgccgagcctaatgaaa

SEQ ID NO: 1160688 - DNA, 18 bp, Homo sapiens
ttgcttgtattgtaaatg

SEQ ID NO: 1160689 - DNA, 23 bp, Homo sapiens
ttgctttaaagtacctgtagtga

SEQ ID NO: 1160690 - DNA, 16 bp, Homo sapiens
ttgctttaattaatta

SEQ ID NO: 1160691 - DNA, 19 bp, Homo sapiens
ttgctttagtatgctggct

SEQ ID NO: 1160692 - DNA, 16 bp, Homo sapiens
ttgctttcctgggcct

SEQ ID NO: 1160693 - DNA, 16 bp, Homo sapiens
ttgctttctattatca

SEQ ID NO: 1160694 - DNA, 13 bp, Homo sapiens
ttgctttctgaaa

SEQ ID NO: 1160695 - DNA, 14 bp, Homo sapiens
ttgctttctgaaat

SEQ ID NO: 1160696 - DNA, 18 bp, Homo sapiens
ttgctttctttagaattt

SEQ ID NO: 1160697 - DNA, 14 bp, Homo sapiens
ttgctttgaaaata

SEQ ID NO: 1160698 - DNA, 15 bp, Homo sapiens
ttgctttgaaaatat

SEQ ID NO: 1160699 - DNA, 22 bp, Homo sapiens
ttgctttgaagcagttgtgtca

SEQ ID NO: 1160700 - DNA, 11 bp, Homo sapiens
ttgctttgagc

SEQ ID NO: 1160701 - DNA, 14 bp, Homo sapiens
ttgctttgccagag

SEQ ID NO: 1160702 - DNA, 16 bp, Homo sapiens
ttgctttgccagagca

SEQ ID NO: 1160703 - DNA, 16 bp, Homo sapiens
ttgctttgcccaagat

SEQ ID NO: 1160704 - DNA, 14 bp, Homo sapiens
ttgctttgctgcac

SEQ ID NO: 1160705 - DNA, 23 bp, Homo sapiens
ttgctttgggctttgcaggctct

SEQ ID NO: 1160706 - DNA, 13 bp, Homo sapiens
ttgcttttagaaa

SEQ ID NO: 1160707 - DNA, 14 bp, Homo sapiens
ttgcttttagaaaa

SEQ ID NO: 1160708 - DNA, 15 bp, Homo sapiens
ttgcttttccctctt

SEQ ID NO: 1160709 - DNA, 19 bp, Homo sapiens
ttgcttttgcctctgccca

SEQ ID NO: 1160710 - DNA, 22 bp, Homo sapiens
ttgcttttgtttttttcctcat

SEQ ID NO: 1160711 - DNA, 19 bp, Homo sapiens
ttgctttttcacagtcact

SEQ ID NO: 1160712 - DNA, 15 bp, Homo sapiens
ttgctttttcaccag

SEQ ID NO: 1160713 - DNA, 22 bp, Homo sapiens
ttgctttttctaatgtggttat

SEQ ID NO: 1160714 - DNA, 15 bp, Homo sapiens
ttggaaaaaactctg

SEQ ID NO: 1160715 - DNA, 15 bp, Homo sapiens
ttggaaaaaatttgt

SEQ ID NO: 1160716 - DNA, 21 bp, Homo sapiens
ttggaaaaatccagaaagaaa

SEQ ID NO: 1160717 - DNA, 22 bp, Homo sapiens
ttggaaaagaatacagaaagat

SEQ ID NO: 1160718 - DNA, 17 bp, Homo sapiens
ttggaaaataaattatt

SEQ ID NO: 1160719 - DNA, 21 bp, Homo sapiens
ttggaaaatgtgtctctgctt

SEQ ID NO: 1160720 - DNA, 17 bp, Homo sapiens
ttggaaacctgccctgc

SEQ ID NO: 1160721 - DNA, 20 bp, Homo sapiens
ttggaaacctgccctgcctg

SEQ ID NO: 1160722 - DNA, 21 bp, Homo sapiens
ttggaaacctgccctgcctga

SEQ ID NO: 1160723 - DNA, 22 bp, Homo sapiens
ttggaaagcatcacctcaggcc

SEQ ID NO: 1160724 - DNA, 21 bp, Homo sapiens
ttggaaagccattgaccaccc

SEQ ID NO: 1160725 - DNA, 15 bp, Homo sapiens
ttggaaataaaaatg

SEQ ID NO: 1160726 - DNA, 16 bp, Homo sapiens
ttggaaataaaccatt

SEQ ID NO: 1160727 - DNA, 21 bp, Homo sapiens
tatagatataatgaacaaaat

SEQ ID NO: 1160728 - DNA, 14 bp, Homo sapiens
tatagatcctgagc

SEQ ID NO: 1160729 - DNA, 22 bp, Homo sapiens
tatagatgcaagatatttatat

SEQ ID NO: 1160730 - DNA, 14 bp, Homo sapiens
tatagattgtctta

SEQ ID NO: 1160731 - DNA, 17 bp, Homo sapiens
tatagcaactaatgttt

SEQ ID NO: 1160732 - DNA, 13 bp, Homo sapiens
tatagcaatccat

SEQ ID NO: 1160733 - DNA, 20 bp, Homo sapiens
tatagcagagtccttattct

SEQ ID NO: 1160734 - DNA, 17 bp, Homo sapiens
tatagcattgaacattt

SEQ ID NO: 1160735 - DNA, 18 bp, Homo sapiens
tatagccaaaaatagcta

SEQ ID NO: 1160736 - DNA, 22 bp, Homo sapiens
tatagccaaaaatagctaaata

SEQ ID NO: 1160737 - DNA, 14 bp, Homo sapiens
tatagctaagtaca

SEQ ID NO: 1160738 - DNA, 22 bp, Homo sapiens
tatagctacaggaagcacccca

SEQ ID NO: 1160739 - DNA, 19 bp, Homo sapiens
tatagctaggtgacatata

SEQ ID NO: 1160740 - DNA, 11 bp, Homo sapiens
tatagctatta

SEQ ID NO: 1160741 - DNA, 14 bp, Homo sapiens
tatagctattactg

SEQ ID NO: 1160742 - DNA, 22 bp, Homo sapiens
tatagctattactgtctggttt

SEQ ID NO: 1160743 - DNA, 21 bp, Homo sapiens
tatagctgagactacaagtgt

SEQ ID NO: 1160744 - DNA, 18 bp, Homo sapiens
tataggatagacactgga

SEQ ID NO: 1160745 - DNA, 21 bp, Homo sapiens
tataggatttatttaaaatag

SEQ ID NO: 1160746 - DNA, 22 bp, Homo sapiens
tataggcacattaccattcata

SEQ ID NO: 1160747 - DNA, 16 bp, Homo sapiens
tataggcatgagccac

SEQ ID NO: 1160748 - DNA, 14 bp, Homo sapiens
tataggccagggca

SEQ ID NO: 1160749 - DNA, 15 bp, Homo sapiens
tataggccagggcat

SEQ ID NO: 1160750 - DNA, 19 bp, Homo sapiens
tataggccagggcatgtgt

SEQ ID NO: 1160751 - DNA, 14 bp, Homo sapiens
tataggccatctgt

SEQ ID NO: 1160752 - DNA, 15 bp, Homo sapiens
tataggccatctgta

SEQ ID NO: 1160753 - DNA, 13 bp, Homo sapiens
tataggcgttttt

SEQ ID NO: 1160754 - DNA, 14 bp, Homo sapiens
tataggctggagaa

SEQ ID NO: 1160755 - DNA, 23 bp, Homo sapiens
tataggtaacgtgattgattcag

SEQ ID NO: 1160756 - DNA, 20 bp, Homo sapiens
tataggtgatgtttgctctt

SEQ ID NO: 1160757 - DNA, 14 bp, Homo sapiens
tatagtaaatgtgt

SEQ ID NO: 1160758 - DNA, 14 bp, Homo sapiens
tatagtacatgata

SEQ ID NO: 1160759 - DNA, 17 bp, Homo sapiens
tatagtatatttatact

SEQ ID NO: 1160760 - DNA, 21 bp, Homo sapiens
tatagtatgtgacttttctga

SEQ ID NO: 1160761 - DNA, 15 bp, Homo sapiens
tatagtctacagttg

SEQ ID NO: 1160762 - DNA, 13 bp, Homo sapiens
tatagtctattca

SEQ ID NO: 1160763 - DNA, 16 bp, Homo sapiens
tatagtctcttgtttg

SEQ ID NO: 1160764 - DNA, 21 bp, Homo sapiens
tatagtgcaatagtgcaacat

SEQ ID NO: 1160765 - DNA, 17 bp, Homo sapiens
tatagtgggtacatcaa

SEQ ID NO: 1160766 - DNA, 13 bp, Homo sapiens
tatagtgtaaaat

SEQ ID NO: 1160767 - DNA, 18 bp, Homo sapiens
tatagtgtaaaataagaa

SEQ ID NO: 1160768 - DNA, 13 bp, Homo sapiens
tatagtgtaataa

SEQ ID NO: 1160769 - DNA, 18 bp, Homo sapiens
tatagtgtaataatgtta

SEQ ID NO: 1160770 - DNA, 23 bp, Homo sapiens
tatagtgtataccacctgtacat

SEQ ID NO: 1160771 - DNA, 15 bp, Homo sapiens
tatagtgtccaggct

SEQ ID NO: 1160772 - DNA, 16 bp, Homo sapiens
tatagtgtgttgtgct

SEQ ID NO: 1160773 - DNA, 18 bp, Homo sapiens
tatagttaacacactacc

SEQ ID NO: 1160774 - DNA, 17 bp, Homo sapiens
tatagttactgtcctgt

SEQ ID NO: 1160775 - DNA, 20 bp, Homo sapiens
tatagttactgtgtaattag

SEQ ID NO: 1160776 - DNA, 17 bp, Homo sapiens
tatagttatgcatacat

SEQ ID NO: 1160777 - DNA, 14 bp, Homo sapiens
tatagttctgtgta

SEQ ID NO: 1160778 - DNA, 19 bp, Homo sapiens
tatagtttattgacaataa

SEQ ID NO: 1160779 - DNA, 22 bp, Homo sapiens
tatagttttacttttaaactgt

SEQ ID NO: 1160780 - DNA, 12 bp, Homo sapiens
tatataaaaaga

SEQ ID NO: 1160781 - DNA, 19 bp, Homo sapiens
tatataaaaagaaaagata

SEQ ID NO: 1160782 - DNA, 23 bp, Homo sapiens
tatataaaaagaaaagataaaga

SEQ ID NO: 1160783 - DNA, 15 bp, Homo sapiens
tatataaaaatggct

SEQ ID NO: 1160784 - DNA, 19 bp, Homo sapiens
tatataaaactaaggcttt

SEQ ID NO: 1160785 - DNA, 22 bp, Homo sapiens
tatataaaactaaggcttttat

SEQ ID NO: 1160786 - DNA, 16 bp, Homo sapiens
tatataaaataaatat

SEQ ID NO: 1160787 - DNA, 17 bp, Homo sapiens
tatataaaataaatata

SEQ ID NO: 1160788 - DNA, 14 bp, Homo sapiens
tatataaaatgtat

SEQ ID NO: 1160789 - DNA, 21 bp, Homo sapiens
tatataaacactccacagtgt

SEQ ID NO: 1160790 - DNA, 11 bp, Homo sapiens
tatataaacat

SEQ ID NO: 1160791 - DNA, 15 bp, Homo sapiens
tatataaacctaaaa

SEQ ID NO: 1160792 - DNA, 17 bp, Homo sapiens
tatataaacctaaaaaa

SEQ ID NO: 1160793 - DNA, 12 bp, Homo sapiens
tatataaatata

SEQ ID NO: 1160794 - DNA, 23 bp, Homo sapiens
tatataaattttttttgtttcat

SEQ ID NO: 1160795 - DNA, 18 bp, Homo sapiens
tatataacagatacattt

SEQ ID NO: 1160796 - DNA, 23 bp, Homo sapiens
tatataagtgtacatatgtgctg

SEQ ID NO: 1160797 - DNA, 18 bp, Homo sapiens
tatataagttgctgtgtg

SEQ ID NO: 1160798 - DNA, 14 bp, Homo sapiens
tatataataaagta

SEQ ID NO: 1160799 - DNA, 19 bp, Homo sapiens
tatataatatctaaagtta

SEQ ID NO: 1160800 - DNA, 14 bp, Homo sapiens
tatataatatgtca

SEQ ID NO: 1160801 - DNA, 16 bp, Homo sapiens
tatataatcatcaagt

SEQ ID NO: 1160802 - DNA, 16 bp, Homo sapiens
tatataatcatgctca

SEQ ID NO: 1160803 - DNA, 20 bp, Homo sapiens
tatataatggtgatgtcata

SEQ ID NO: 1160804 - DNA, 18 bp, Homo sapiens
tatataatttactttgta

SEQ ID NO: 1160805 - DNA, 22 bp, Homo sapiens
tatataatttttttatgttttg

SEQ ID NO: 1160806 - DNA, 18 bp, Homo sapiens
tatatacaaaaagaaaat

SEQ ID NO: 1160807 - DNA, 16 bp, Homo sapiens
tatatacaataacata

SEQ ID NO: 1160808 - DNA, 13 bp, Homo sapiens
tatatacacacaa

SEQ ID NO: 1160809 - DNA, 12 bp, Homo sapiens
tatatacacata

SEQ ID NO: 1160810 - DNA, 17 bp, Homo sapiens
tatatacagtaacttta

SEQ ID NO: 1160811 - DNA, 22 bp, Homo sapiens
tatatacagtaactttatgtgt

SEQ ID NO: 1160812 - DNA, 23 bp, Homo sapiens
tatatacagtaactttatgtgta

SEQ ID NO: 1160813 - DNA, 15 bp, Homo sapiens
tatatacattgctta

SEQ ID NO: 1160814 - DNA, 22 bp, Homo sapiens
tatatacctggcttttacttta

SEQ ID NO: 1160815 - DNA, 19 bp, Homo sapiens
tatatactgggttcttgtt

SEQ ID NO: 1160816 - DNA, 13 bp, Homo sapiens
tatatagagatgt

SEQ ID NO: 1160817 - DNA, 22 bp, Homo sapiens
tatatagagattgtacatttat

SEQ ID NO: 1160818 - DNA, 18 bp, Homo sapiens
tatatagcaaaatgattc

SEQ ID NO: 1160819 - DNA, 14 bp, Homo sapiens
tatataggctattt

SEQ ID NO: 1160820 - DNA, 21 bp, Homo sapiens
tatatagtatatttatactct

SEQ ID NO: 1160821 - DNA, 16 bp, Homo sapiens
tatatagtctacagtt

SEQ ID NO: 1160822 - DNA, 12 bp, Homo sapiens
tatatataaacc

SEQ ID NO: 1160823 - DNA, 14 bp, Homo sapiens
tatatataaagata

SEQ ID NO: 1160824 - DNA, 22 bp, Homo sapiens
tatatatacacatacatacaca

SEQ ID NO: 1160825 - DNA, 12 bp, Homo sapiens
tatatatagaat

SEQ ID NO: 1160826 - DNA, 13 bp, Homo sapiens
tatatatatatgt

SEQ ID NO: 1160827 - DNA, 20 bp, Homo sapiens
tatatatctatctatttgag

SEQ ID NO: 1160828 - DNA, 20 bp, Homo sapiens
tatatatctattattcaaaa

SEQ ID NO: 1160829 - DNA, 16 bp, Homo sapiens
tatatatcttataact

SEQ ID NO: 1160830 - DNA, 15 bp, Homo sapiens
tatatatgtatatgt

SEQ ID NO: 1160831 - DNA, 23 bp, Homo sapiens
tatatatgtgtatgcacagtaaa

SEQ ID NO: 1160832 - DNA, 18 bp, Homo sapiens
tatatatgtgtgtttaaa

SEQ ID NO: 1160833 - DNA, 22 bp, Homo sapiens
tatatatgtgtgtttaaataaa

SEQ ID NO: 1160834 - DNA, 14 bp, Homo sapiens
tatatattctatta

SEQ ID NO: 1160835 - DNA, 14 bp, Homo sapiens
tatatatttaaagg

SEQ ID NO: 1160836 - DNA, 17 bp, Homo sapiens
tatatatttacaaggag

SEQ ID NO: 1160837 - DNA, 13 bp, Homo sapiens
tatatatttgtaa

SEQ ID NO: 1160838 - DNA, 23 bp, Homo sapiens
tatatattttaagccttcatttg

SEQ ID NO: 1160839 - DNA, 15 bp, Homo sapiens
tatatattttatatg

SEQ ID NO: 1160840 - DNA, 15 bp, Homo sapiens
tatatatttttcaaa

SEQ ID NO: 1160841 - DNA, 17 bp, Homo sapiens
tatatatttttcaaata

SEQ ID NO: 1160842 - DNA, 20 bp, Homo sapiens
tatatatttttctgagattt

SEQ ID NO: 1160843 - DNA, 20 bp, Homo sapiens
tatatatttttggttgtcaa

SEQ ID NO: 1160844 - DNA, 22 bp, Homo sapiens
tatatcaacagatagttgtgtt

SEQ ID NO: 1160845 - DNA, 13 bp, Homo sapiens
tatatcagaaaag

SEQ ID NO: 1160846 - DNA, 14 bp, Homo sapiens
tatatcagaatctg

SEQ ID NO: 1160847 - DNA, 16 bp, Homo sapiens
tatatcagaatctgtg

SEQ ID NO: 1160848 - DNA, 19 bp, Homo sapiens
tatatcagaatctgtgtga

SEQ ID NO: 1160849 - DNA, 15 bp, Homo sapiens
tatatcagcctgagt

SEQ ID NO: 1160850 - DNA, 23 bp, Homo sapiens
tatatcagcctgagtctcctgtg

SEQ ID NO: 1160851 - DNA, 17 bp, Homo sapiens
tatatcagcttttctga

SEQ ID NO: 1160852 - DNA, 18 bp, Homo sapiens
ttggaaatagaaagaagc

SEQ ID NO: 1160853 - DNA, 22 bp, Homo sapiens
ttggaaatagaaagaagccata

SEQ ID NO: 1160854 - DNA, 13 bp, Homo sapiens
ttggaaatgtgtt

SEQ ID NO: 1160855 - DNA, 16 bp, Homo sapiens
ttggaaatgtgttttt

SEQ ID NO: 1160856 - DNA, 14 bp, Homo sapiens
ttggaacagaatgt

SEQ ID NO: 1160857 - DNA, 22 bp, Homo sapiens
ttggaacatttctttcttgctg

SEQ ID NO: 1160858 - DNA, 14 bp, Homo sapiens
ttggaaccagactc

SEQ ID NO: 1160859 - DNA, 21 bp, Homo sapiens
ttggaactgcgataactgaga

SEQ ID NO: 1160860 - DNA, 16 bp, Homo sapiens
ttggaagagaggcacc

SEQ ID NO: 1160861 - DNA, 13 bp, Homo sapiens
ttggaagagcccg

SEQ ID NO: 1160862 - DNA, 15 bp, Homo sapiens
ttggaagattcagct

SEQ ID NO: 1160863 - DNA, 18 bp, Homo sapiens
ttggaagctgtttggaaa

SEQ ID NO: 1160864 - DNA, 18 bp, Homo sapiens
ttggaaggatctgctgag

SEQ ID NO: 1160865 - DNA, 20 bp, Homo sapiens
ttggaaggatctgctgaggc

SEQ ID NO: 1160866 - DNA, 20 bp, Homo sapiens
ttggaagtgaaaactttgta

SEQ ID NO: 1160867 - DNA, 13 bp, Homo sapiens
ttggaagtttcat

SEQ ID NO: 1160868 - DNA, 15 bp, Homo sapiens
ttggaagttttaatc

SEQ ID NO: 1160869 - DNA, 22 bp, Homo sapiens
ttggaatattttatcctgtatt

SEQ ID NO: 1160870 - DNA, 14 bp, Homo sapiens
ttggaatcaaggta

SEQ ID NO: 1160871 - DNA, 21 bp, Homo sapiens
ttggaatcttcacctcagagt

SEQ ID NO: 1160872 - DNA, 13 bp, Homo sapiens
ttggaatttacca

SEQ ID NO: 1160873 - DNA, 17 bp, Homo sapiens
ttggaatttctggcctc

SEQ ID NO: 1160874 - DNA, 19 bp, Homo sapiens
ttggaatttgtaacctcag

SEQ ID NO: 1160875 - DNA, 21 bp, Homo sapiens
ttggaatttgtaacctcagct

SEQ ID NO: 1160876 - DNA, 20 bp, Homo sapiens
ttggacaaacctagaatttt

SEQ ID NO: 1160877 - DNA, 14 bp, Homo sapiens
ttggacaaatcaca

SEQ ID NO: 1160878 - DNA, 23 bp, Homo sapiens
ttggacaatcatgaaatatgcat

SEQ ID NO: 1160879 - DNA, 16 bp, Homo sapiens
ttggacagatttcagt

SEQ ID NO: 1160880 - DNA, 17 bp, Homo sapiens
ttggacagatttcagta

SEQ ID NO: 1160881 - DNA, 14 bp, Homo sapiens
ttggacagcaaaac

SEQ ID NO: 1160882 - DNA, 15 bp, Homo sapiens
ttggacagccccctt

SEQ ID NO: 1160883 - DNA, 18 bp, Homo sapiens
ttggacaggagatcagca

SEQ ID NO: 1160884 - DNA, 12 bp, Homo sapiens
ttggacagtggc

SEQ ID NO: 1160885 - DNA, 14 bp, Homo sapiens
ttggacagtggcct

SEQ ID NO: 1160886 - DNA, 14 bp, Homo sapiens
ttggacatcctcct

SEQ ID NO: 1160887 - DNA, 16 bp, Homo sapiens
ttggacatctctctgg

SEQ ID NO: 1160888 - DNA, 22 bp, Homo sapiens
ttggacatctctctggcttctg

SEQ ID NO: 1160889 - DNA, 16 bp, Homo sapiens
ttggacccagggcctg

SEQ ID NO: 1160890 - DNA, 19 bp, Homo sapiens
ttggacccagggcctgact

SEQ ID NO: 1160891 - DNA, 13 bp, Homo sapiens
ttggaccccagct

SEQ ID NO: 1160892 - DNA, 19 bp, Homo sapiens
ttggaccccagctgggagg

SEQ ID NO: 1160893 - DNA, 20 bp, Homo sapiens
ttggaccccagctgggaggc

SEQ ID NO: 1160894 - DNA, 16 bp, Homo sapiens
ttggacccgctctgga

SEQ ID NO: 1160895 - DNA, 22 bp, Homo sapiens
ttggaccctggtgacctcctgt

SEQ ID NO: 1160896 - DNA, 17 bp, Homo sapiens
ttggacccttggaaaac

SEQ ID NO: 1160897 - DNA, 23 bp, Homo sapiens
ttggacctaaatggcctcatgtg

SEQ ID NO: 1160898 - DNA, 15 bp, Homo sapiens
ttggacctccagggg

SEQ ID NO: 1160899 - DNA, 23 bp, Homo sapiens
ttggacctccaggggctcctggg

SEQ ID NO: 1160900 - DNA, 15 bp, Homo sapiens
ttggacctctgctct

SEQ ID NO: 1160901 - DNA, 17 bp, Homo sapiens
ttggacctctgctctga

SEQ ID NO: 1160902 - DNA, 21 bp, Homo sapiens
ttggacctctgctctgaggct

SEQ ID NO: 1160903 - DNA, 13 bp, Homo sapiens
ttggacggcctga

SEQ ID NO: 1160904 - DNA, 20 bp, Homo sapiens
ttggacggtttctagcctct

SEQ ID NO: 1160905 - DNA, 14 bp, Homo sapiens
ttggactccatctc

SEQ ID NO: 1160906 - DNA, 18 bp, Homo sapiens
ttggactgttagtgttaa

SEQ ID NO: 1160907 - DNA, 14 bp, Homo sapiens
ttggactgttttca

SEQ ID NO: 1160908 - DNA, 20 bp, Homo sapiens
ttggacttcctggggccccg

SEQ ID NO: 1160909 - DNA, 16 bp, Homo sapiens
ttggagaagatttatg

SEQ ID NO: 1160910 - DNA, 20 bp, Homo sapiens
ttggagaagcccgtgtgaga

SEQ ID NO: 1160911 - DNA, 21 bp, Homo sapiens
ttggagaatactttgcttcat

SEQ ID NO: 1160912 - DNA, 13 bp, Homo sapiens
ttggagaatttag

SEQ ID NO: 1160913 - DNA, 13 bp, Homo sapiens
ttggagactctgt

SEQ ID NO: 1160914 - DNA, 20 bp, Homo sapiens
ttggagactctgtggggcct

SEQ ID NO: 1160915 - DNA, 14 bp, Homo sapiens
ttggagagaatcat

SEQ ID NO: 1160916 - DNA, 12 bp, Homo sapiens
ttggagagcaaa

SEQ ID NO: 1160917 - DNA, 22 bp, Homo sapiens
ttggagagcagcaggtgctgtg

SEQ ID NO: 1160918 - DNA, 14 bp, Homo sapiens
ttggagagcagctg

SEQ ID NO: 1160919 - DNA, 13 bp, Homo sapiens
ttggagagccctg

SEQ ID NO: 1160920 - DNA, 15 bp, Homo sapiens
ttggagagccctgga

SEQ ID NO: 1160921 - DNA, 17 bp, Homo sapiens
ttggagagggggccgga

SEQ ID NO: 1160922 - DNA, 13 bp, Homo sapiens
ttggagagtaaaa

SEQ ID NO: 1160923 - DNA, 22 bp, Homo sapiens
ttggagatgctgagggtgtttc

SEQ ID NO: 1160924 - DNA, 15 bp, Homo sapiens
ttggagatttttcat

SEQ ID NO: 1160925 - DNA, 21 bp, Homo sapiens
ttggagcaaagaaggagctga

SEQ ID NO: 1160926 - DNA, 14 bp, Homo sapiens
ttggagcaagcttg

SEQ ID NO: 1160927 - DNA, 21 bp, Homo sapiens
ttggagcacaaaattcaaagc

SEQ ID NO: 1160928 - DNA, 23 bp, Homo sapiens
ttggagcacatgttactgcttca

SEQ ID NO: 1160929 - DNA, 23 bp, Homo sapiens
ttggagcaggcaaaaaagggaca

SEQ ID NO: 1160930 - DNA, 17 bp, Homo sapiens
ttggagcattaactaaa

SEQ ID NO: 1160931 - DNA, 24 bp, Homo sapiens
ttggagcattaactaaatgctcat

SEQ ID NO: 1160932 - DNA, 12 bp, Homo sapiens
ttggagccactc

SEQ ID NO: 1160933 - DNA, 14 bp, Homo sapiens
ttggagcctgcagg

SEQ ID NO: 1160934 - DNA, 17 bp, Homo sapiens
ttggagctttttcaaaa

SEQ ID NO: 1160935 - DNA, 21 bp, Homo sapiens
ttggagcttttttctttaaga

SEQ ID NO: 1160936 - DNA, 22 bp, Homo sapiens
ttggaggaagtatgagtgctga

SEQ ID NO: 1160937 - DNA, 14 bp, Homo sapiens
ttggaggaagttgg

SEQ ID NO: 1160938 - DNA, 11 bp, Homo sapiens
ttggaggctga

SEQ ID NO: 1160939 - DNA, 21 bp, Homo sapiens
ttggagggagaggtggcagga

SEQ ID NO: 1160940 - DNA, 12 bp, Homo sapiens
ttggagggatgg

SEQ ID NO: 1160941 - DNA, 18 bp, Homo sapiens
ttggaggtgcttaagcag

SEQ ID NO: 1160942 - DNA, 12 bp, Homo sapiens
ttggagtaattg

SEQ ID NO: 1160943 - DNA, 17 bp, Homo sapiens
ttggataaatcatttca

SEQ ID NO: 1160944 - DNA, 21 bp, Homo sapiens
ttggataagtttctattctgt

SEQ ID NO: 1160945 - DNA, 18 bp, Homo sapiens
ttggataccagctcaggg

SEQ ID NO: 1160946 - DNA, 19 bp, Homo sapiens
ttggatacttggatttagt

SEQ ID NO: 1160947 - DNA, 13 bp, Homo sapiens
ttggatccaagga

SEQ ID NO: 1160948 - DNA, 19 bp, Homo sapiens
ttggatcttcaatggcttt

SEQ ID NO: 1160949 - DNA, 17 bp, Homo sapiens
ttggatcttgaatgtgg

SEQ ID NO: 1160950 - DNA, 19 bp, Homo sapiens
ttggatgcgagcttggcct

SEQ ID NO: 1160951 - DNA, 21 bp, Homo sapiens
ttggatgggagtgagacagaa

SEQ ID NO: 1160952 - DNA, 14 bp, Homo sapiens
ttggatgggagtgg

SEQ ID NO: 1160953 - DNA, 18 bp, Homo sapiens
ttggatgggagtgggcac

SEQ ID NO: 1160954 - DNA, 21 bp, Homo sapiens
ttggatgggagtgggcacctc

SEQ ID NO: 1160955 - DNA, 23 bp, Homo sapiens
ttggatggggctggcatgttttc

SEQ ID NO: 1160956 - DNA, 16 bp, Homo sapiens
ttggatgttgtaaata

SEQ ID NO: 1160957 - DNA, 23 bp, Homo sapiens
ttggattaaatacatatggatgt

SEQ ID NO: 1160958 - DNA, 22 bp, Homo sapiens
ttggattcctaaatattttcaa

SEQ ID NO: 1160959 - DNA, 15 bp, Homo sapiens
ttggattcttatgta

SEQ ID NO: 1160960 - DNA, 20 bp, Homo sapiens
ttggattctttccatttgca

SEQ ID NO: 1160961 - DNA, 14 bp, Homo sapiens
ttggattggggtcc

SEQ ID NO: 1160962 - DNA, 21 bp, Homo sapiens
ttggatttaaaagcctgctca

SEQ ID NO: 1160963 - DNA, 19 bp, Homo sapiens
ttggatttgctcattgctg

SEQ ID NO: 1160964 - DNA, 13 bp, Homo sapiens
ttggatttgctgt

SEQ ID NO: 1160965 - DNA, 18 bp, Homo sapiens
ttggatttgctgtgacta

SEQ ID NO: 1160966 - DNA, 20 bp, Homo sapiens
ttggattttgcaaggtgcat

SEQ ID NO: 1160967 - DNA, 13 bp, Homo sapiens
ttggcaaaatggg

SEQ ID NO: 1160968 - DNA, 22 bp, Homo sapiens
ttggcaaaatggggtttgggcc

SEQ ID NO: 1160969 - DNA, 17 bp, Homo sapiens
ttggcaagatgtttctt

SEQ ID NO: 1160970 - DNA, 16 bp, Homo sapiens
ttggcaagtcacgttg

SEQ ID NO: 1160971 - DNA, 18 bp, Homo sapiens
ttggcaatacatttgatt

SEQ ID NO: 1160972 - DNA, 23 bp, Homo sapiens
ttggcacagaaacacaatatttt

SEQ ID NO: 1160973 - DNA, 14 bp, Homo sapiens
ttggcaccaccagg

SEQ ID NO: 1160974 - DNA, 20 bp, Homo sapiens
ttggcacccccatgctgcct

SEQ ID NO: 1160975 - DNA, 23 bp, Homo sapiens
ttggcactcacagacctggagcc

SEQ ID NO: 1160976 - DNA, 21 bp, Homo sapiens
tatatcagcttttctgatggt

SEQ ID NO: 1160977 - DNA, 17 bp, Homo sapiens
tatatcaggtgtataaa

SEQ ID NO: 1160978 - DNA, 23 bp, Homo sapiens
tatatcaggtgtataaatgtaca

SEQ ID NO: 1160979 - DNA, 14 bp, Homo sapiens
tatatcagtagtgt

SEQ ID NO: 1160980 - DNA, 18 bp, Homo sapiens
tatatcagtagtgtacat

SEQ ID NO: 1160981 - DNA, 14 bp, Homo sapiens
tatatcataactat

SEQ ID NO: 1160982 - DNA, 20 bp, Homo sapiens
tatatcatacagttttcatt

SEQ ID NO: 1160983 - DNA, 18 bp, Homo sapiens
tatatcattctacagaat

SEQ ID NO: 1160984 - DNA, 20 bp, Homo sapiens
tatatcattctacagaataa

SEQ ID NO: 1160985 - DNA, 21 bp, Homo sapiens
tatatcattctacagaataat

SEQ ID NO: 1160986 - DNA, 18 bp, Homo sapiens
tatatccagttcctgctc

SEQ ID NO: 1160987 - DNA, 14 bp, Homo sapiens
tatatcccagaaat

SEQ ID NO: 1160988 - DNA, 20 bp, Homo sapiens
tatatccttaatattttata

SEQ ID NO: 1160989 - DNA, 21 bp, Homo sapiens
tatatctaccccagactagat

SEQ ID NO: 1160990 - DNA, 15 bp, Homo sapiens
tatatctattatgta

SEQ ID NO: 1160991 - DNA, 23 bp, Homo sapiens
tatatctgaagagtatccttcct

SEQ ID NO: 1160992 - DNA, 14 bp, Homo sapiens
tatatcttaagcag

SEQ ID NO: 1160993 - DNA, 16 bp, Homo sapiens
tatatcttgtttacaa

SEQ ID NO: 1160994 - DNA, 14 bp, Homo sapiens
tatatcttttggtt

SEQ ID NO: 1160995 - DNA, 12 bp, Homo sapiens
tatatgaagttg

SEQ ID NO: 1160996 - DNA, 22 bp, Homo sapiens
tatatgaatttaaatataattc

SEQ ID NO: 1160997 - DNA, 15 bp, Homo sapiens
tatatgaccagaagc

SEQ ID NO: 1160998 - DNA, 20 bp, Homo sapiens
tatatgagagaatcacacaa

SEQ ID NO: 1160999 - DNA, 19 bp, Homo sapiens
tatatgaggacttgtgtct

SEQ ID NO: 1161000 - DNA, 14 bp, Homo sapiens
tatatgatcattga

SEQ ID NO: 1161001 - DNA, 17 bp, Homo sapiens
tatatgatctaatacaa

SEQ ID NO: 1161002 - DNA, 23 bp, Homo sapiens
tatatgatctaatacaaagatga

SEQ ID NO: 1161003 - DNA, 13 bp, Homo sapiens
tatatgatggggg

SEQ ID NO: 1161004 - DNA, 19 bp, Homo sapiens
tatatgatgtggacatatg

SEQ ID NO: 1161005 - DNA, 22 bp, Homo sapiens
tatatgatgtggacatatgtat

SEQ ID NO: 1161006 - DNA, 23 bp, Homo sapiens
tatatgatgtggacatatgtata

SEQ ID NO: 1161007 - DNA, 17 bp, Homo sapiens
tatatgcacaaaactac

SEQ ID NO: 1161008 - DNA, 21 bp, Homo sapiens
tatatgcacaaaactactttt

SEQ ID NO: 1161009 - DNA, 10 bp, Homo sapiens
tatatgcacc

SEQ ID NO: 1161010 - DNA, 18 bp, Homo sapiens
tatatgccaagctaattt

SEQ ID NO: 1161011 - DNA, 12 bp, Homo sapiens
tatatgctgtat

SEQ ID NO: 1161012 - DNA, 14 bp, Homo sapiens
tatatgctgtattt

SEQ ID NO: 1161013 - DNA, 16 bp, Homo sapiens
tatatgcttactgata

SEQ ID NO: 1161014 - DNA, 21 bp, Homo sapiens
tatatgcttactgatatattt

SEQ ID NO: 1161015 - DNA, 21 bp, Homo sapiens
tatatgcttcacatagcatgt

SEQ ID NO: 1161016 - DNA, 17 bp, Homo sapiens
tatatggaaattctgct

SEQ ID NO: 1161017 - DNA, 15 bp, Homo sapiens
tatatggacatggca

SEQ ID NO: 1161018 - DNA, 19 bp, Homo sapiens
tatatggcagagttgtaaa

SEQ ID NO: 1161019 - DNA, 23 bp, Homo sapiens
tatatggcagagttgtaaatata

SEQ ID NO: 1161020 - DNA, 20 bp, Homo sapiens
tatatggcatatttatattg

SEQ ID NO: 1161021 - DNA, 16 bp, Homo sapiens
tatatggcccagcctt

SEQ ID NO: 1161022 - DNA, 20 bp, Homo sapiens
tatatgggtatatattcatc

SEQ ID NO: 1161023 - DNA, 17 bp, Homo sapiens
tatatggttctccaaga

SEQ ID NO: 1161024 - DNA, 14 bp, Homo sapiens
tatatgtaaatgtg

SEQ ID NO: 1161025 - DNA, 13 bp, Homo sapiens
tatatgtacttgt

SEQ ID NO: 1161026 - DNA, 19 bp, Homo sapiens
tatatgtagtgcattttta

SEQ ID NO: 1161027 - DNA, 13 bp, Homo sapiens
tatatgtatatat

SEQ ID NO: 1161028 - DNA, 21 bp, Homo sapiens
tatatgtatatatatatagta

SEQ ID NO: 1161029 - DNA, 21 bp, Homo sapiens
tatatgtatatttttttaatt

SEQ ID NO: 1161030 - DNA, 22 bp, Homo sapiens
tatatgtatctacaatacatat

SEQ ID NO: 1161031 - DNA, 14 bp, Homo sapiens
tatatgtattccct

SEQ ID NO: 1161032 - DNA, 19 bp, Homo sapiens
tatatgtattcccttgtat

SEQ ID NO: 1161033 - DNA, 12 bp, Homo sapiens
tatatgtattta

SEQ ID NO: 1161034 - DNA, 23 bp, Homo sapiens
tatatgtatttaagatgtacatt

SEQ ID NO: 1161035 - DNA, 12 bp, Homo sapiens
tatatgtcaaag

SEQ ID NO: 1161036 - DNA, 12 bp, Homo sapiens
tatatgtctgat

SEQ ID NO: 1161037 - DNA, 19 bp, Homo sapiens
tatatgtctgataatgatt

SEQ ID NO: 1161038 - DNA, 23 bp, Homo sapiens
tatatgtgaaaaaaatgagactt

SEQ ID NO: 1161039 - DNA, 18 bp, Homo sapiens
tatatgtgaaaggatatg

SEQ ID NO: 1161040 - DNA, 22 bp, Homo sapiens
tatatgtgaatcctcttcttta

SEQ ID NO: 1161041 - DNA, 22 bp, Homo sapiens
tatatgtggactaaatatctgt

SEQ ID NO: 1161042 - DNA, 19 bp, Homo sapiens
tatatgtgtatacatacat

SEQ ID NO: 1161043 - DNA, 14 bp, Homo sapiens
tatatgttcactgt

SEQ ID NO: 1161044 - DNA, 14 bp, Homo sapiens
tatatgtttacaca

SEQ ID NO: 1161045 - DNA, 18 bp, Homo sapiens
tatatgtttacacaatta

SEQ ID NO: 1161046 - DNA, 19 bp, Homo sapiens
tatatgtttttgaaggcag

SEQ ID NO: 1161047 - DNA, 20 bp, Homo sapiens
tatattaaaaatataaaact

SEQ ID NO: 1161048 - DNA, 18 bp, Homo sapiens
tatattaaaatagcatac

SEQ ID NO: 1161049 - DNA, 23 bp, Homo sapiens
tatattaaaatagcatactgtgt

SEQ ID NO: 1161050 - DNA, 14 bp, Homo sapiens
tatattaacatcat

SEQ ID NO: 1161051 - DNA, 14 bp, Homo sapiens
tatattaagcagaa

SEQ ID NO: 1161052 - DNA, 15 bp, Homo sapiens
tatattaatagtaat

SEQ ID NO: 1161053 - DNA, 22 bp, Homo sapiens
tatattaatagtaatttgtaaa

SEQ ID NO: 1161054 - DNA, 23 bp, Homo sapiens
tatattaatagtaatttgtaaag

SEQ ID NO: 1161055 - DNA, 17 bp, Homo sapiens
tatattaatgtacttgt

SEQ ID NO: 1161056 - DNA, 11 bp, Homo sapiens
tatattacaag

SEQ ID NO: 1161057 - DNA, 18 bp, Homo sapiens
tatattacttttgtaaat

SEQ ID NO: 1161058 - DNA, 20 bp, Homo sapiens
tatattacttttgtaaatat

SEQ ID NO: 1161059 - DNA, 17 bp, Homo sapiens
tatattagctgaaacaa

SEQ ID NO: 1161060 - DNA, 18 bp, Homo sapiens
tatattataattggaagt

SEQ ID NO: 1161061 - DNA, 22 bp, Homo sapiens
tatattatcatgcaaatgctgt

SEQ ID NO: 1161062 - DNA, 12 bp, Homo sapiens
tatattattata

SEQ ID NO: 1161063 - DNA, 19 bp, Homo sapiens
tatattcaaattatgtata

SEQ ID NO: 1161064 - DNA, 14 bp, Homo sapiens
tatattcacagttt

SEQ ID NO: 1161065 - DNA, 22 bp, Homo sapiens
tatattcactggttttacacag

SEQ ID NO: 1161066 - DNA, 18 bp, Homo sapiens
tatattcatcagaatgtt

SEQ ID NO: 1161067 - DNA, 22 bp, Homo sapiens
tatattccaggtttaagtagat

SEQ ID NO: 1161068 - DNA, 15 bp, Homo sapiens
tatattccatgtata

SEQ ID NO: 1161069 - DNA, 13 bp, Homo sapiens
tatattctggaaa

SEQ ID NO: 1161070 - DNA, 22 bp, Homo sapiens
tatattctggaaaaaaaatata

SEQ ID NO: 1161071 - DNA, 18 bp, Homo sapiens
tatattgaaatttattta

SEQ ID NO: 1161072 - DNA, 22 bp, Homo sapiens
tatattgaataaaaaatagaca

SEQ ID NO: 1161073 - DNA, 15 bp, Homo sapiens
tatattgtaagaaat

SEQ ID NO: 1161074 - DNA, 19 bp, Homo sapiens
tatattgtaagaaatactg

SEQ ID NO: 1161075 - DNA, 13 bp, Homo sapiens
tatattgtacaaa

SEQ ID NO: 1161076 - DNA, 14 bp, Homo sapiens
tatattgtatattc

SEQ ID NO: 1161077 - DNA, 17 bp, Homo sapiens
tatattgtatattctgg

SEQ ID NO: 1161078 - DNA, 19 bp, Homo sapiens
tatattgtcagatattttt

SEQ ID NO: 1161079 - DNA, 19 bp, Homo sapiens
tatattgtggaataaatcc

SEQ ID NO: 1161080 - DNA, 19 bp, Homo sapiens
tatattgtgtttgtgtatt

SEQ ID NO: 1161081 - DNA, 13 bp, Homo sapiens
tatattgttttct

SEQ ID NO: 1161082 - DNA, 19 bp, Homo sapiens
tatatttaaaaaattaaaa

SEQ ID NO: 1161083 - DNA, 14 bp, Homo sapiens
tatatttaaaaata

SEQ ID NO: 1161084 - DNA, 15 bp, Homo sapiens
tatatttaaaaataa

SEQ ID NO: 1161085 - DNA, 20 bp, Homo sapiens
tatatttaagcaacatcttt

SEQ ID NO: 1161086 - DNA, 15 bp, Homo sapiens
tatatttaattttga

SEQ ID NO: 1161087 - DNA, 22 bp, Homo sapiens
tatatttagttacgtataatgc

SEQ ID NO: 1161088 - DNA, 18 bp, Homo sapiens
tatatttagttatagttt

SEQ ID NO: 1161089 - DNA, 12 bp, Homo sapiens
tatatttataac

SEQ ID NO: 1161090 - DNA, 21 bp, Homo sapiens
tatatttataactcatcataa

SEQ ID NO: 1161091 - DNA, 13 bp, Homo sapiens
tatatttatactc

SEQ ID NO: 1161092 - DNA, 14 bp, Homo sapiens
tatatttatactct

SEQ ID NO: 1161093 - DNA, 12 bp, Homo sapiens
tatatttattca

SEQ ID NO: 1161094 - DNA, 17 bp, Homo sapiens
tatatttattcataatg

SEQ ID NO: 1161095 - DNA, 22 bp, Homo sapiens
tatatttcacttttgttctgct

SEQ ID NO: 1161096 - DNA, 19 bp, Homo sapiens
tatatttcagatgtaatgt

SEQ ID NO: 1161097 - DNA, 12 bp, Homo sapiens
tatatttcagtg

SEQ ID NO: 1161098 - DNA, 11 bp, Homo sapiens
tatatttcctt

SEQ ID NO: 1161099 - DNA, 13 bp, Homo sapiens
tatatttccttta

SEQ ID NO: 1161100 - DNA, 22 bp, Homo sapiens
ttggcacttataggtaacgtga

SEQ ID NO: 1161101 - DNA, 20 bp, Homo sapiens
ttggcacttgccattccaaa

SEQ ID NO: 1161102 - DNA, 13 bp, Homo sapiens
ttggcacttgtat

SEQ ID NO: 1161103 - DNA, 17 bp, Homo sapiens
ttggcacttgtatttaa

SEQ ID NO: 1161104 - DNA, 19 bp, Homo sapiens
ttggcacttgtatttaatt

SEQ ID NO: 1161105 - DNA, 14 bp, Homo sapiens
ttggcagagaaggc

SEQ ID NO: 1161106 - DNA, 17 bp, Homo sapiens
ttggcagagaaggcctc

SEQ ID NO: 1161107 - DNA, 18 bp, Homo sapiens
ttggcagagaaggcctct

SEQ ID NO: 1161108 - DNA, 23 bp, Homo sapiens
ttggcagcttaacattgacttct

SEQ ID NO: 1161109 - DNA, 15 bp, Homo sapiens
ttggcagctttttct

SEQ ID NO: 1161110 - DNA, 19 bp, Homo sapiens
ttggcagctttttctgtgg

SEQ ID NO: 1161111 - DNA, 21 bp, Homo sapiens
ttggcaggcccactccccagc

SEQ ID NO: 1161112 - DNA, 13 bp, Homo sapiens
ttggcaggctggc

SEQ ID NO: 1161113 - DNA, 16 bp, Homo sapiens
ttggcataatttgtct

SEQ ID NO: 1161114 - DNA, 17 bp, Homo sapiens
ttggcataatttgtctt

SEQ ID NO: 1161115 - DNA, 17 bp, Homo sapiens
ttggcatctctgtccca

SEQ ID NO: 1161116 - DNA, 20 bp, Homo sapiens
ttggcatggaaatttaaagc

SEQ ID NO: 1161117 - DNA, 12 bp, Homo sapiens
ttggcatggtga

SEQ ID NO: 1161118 - DNA, 14 bp, Homo sapiens
ttggcatttctata

SEQ ID NO: 1161119 - DNA, 16 bp, Homo sapiens
ttggccaaacatcaga

SEQ ID NO: 1161120 - DNA, 15 bp, Homo sapiens
ttggccaaagtgtta

SEQ ID NO: 1161121 - DNA, 15 bp, Homo sapiens
ttggccaagcagaaa

SEQ ID NO: 1161122 - DNA, 22 bp, Homo sapiens
ttggccaatgcacctaaagaaa

SEQ ID NO: 1161123 - DNA, 23 bp, Homo sapiens
ttggccaatgcacctaaagaaaa

SEQ ID NO: 1161124 - DNA, 21 bp, Homo sapiens
ttggccactccgagaggtggg

SEQ ID NO: 1161125 - DNA, 22 bp, Homo sapiens
ttggccactccgagaggtgggc

SEQ ID NO: 1161126 - DNA, 22 bp, Homo sapiens
ttggccactgggtctcactcct

SEQ ID NO: 1161127 - DNA, 22 bp, Homo sapiens
ttggccaggaggttcccccgac

SEQ ID NO: 1161128 - DNA, 21 bp, Homo sapiens
ttggccagggaggcgcaggga

SEQ ID NO: 1161129 - DNA, 20 bp, Homo sapiens
ttggccatgatgtccttgga

SEQ ID NO: 1161130 - DNA, 13 bp, Homo sapiens
ttggcccaatgcc

SEQ ID NO: 1161131 - DNA, 15 bp, Homo sapiens
ttggcccaggagctc

SEQ ID NO: 1161132 - DNA, 16 bp, Homo sapiens
ttggcccaggagctct

SEQ ID NO: 1161133 - DNA, 14 bp, Homo sapiens
ttggccccagagga

SEQ ID NO: 1161134 - DNA, 13 bp, Homo sapiens
ttggcccctccct

SEQ ID NO: 1161135 - DNA, 21 bp, Homo sapiens
ttggccctcttgcgggcctgg

SEQ ID NO: 1161136 - DNA, 13 bp, Homo sapiens
ttggccctggagc

SEQ ID NO: 1161137 - DNA, 15 bp, Homo sapiens
ttggccctggagcca

SEQ ID NO: 1161138 - DNA, 16 bp, Homo sapiens
ttggccctggagccag

SEQ ID NO: 1161139 - DNA, 22 bp, Homo sapiens
ttggccctggagccagggcaga

SEQ ID NO: 1161140 - DNA, 15 bp, Homo sapiens
ttggcccttccagtg
